United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 170

SEQ ID NO: 7106654 - DNA, 22 bp, Homo sapiens
ctgcaggggcagtccacttcct

SEQ ID NO: 7106655 - DNA, 22 bp, Homo sapiens
ctgcaggggcctcgagcacagg

SEQ ID NO: 7106656 - DNA, 22 bp, Homo sapiens
ctgcaggggcctcgagcacagg

SEQ ID NO: 7106657 - DNA, 22 bp, Homo sapiens
ctgcaggggaccaaagtctgac

SEQ ID NO: 7106658 - DNA, 22 bp, Homo sapiens
ctgcagggcccgcctgagccct

SEQ ID NO: 7106659 - DNA, 22 bp, Homo sapiens
ctgcagggcttaccttgctctg

SEQ ID NO: 7106660 - DNA, 22 bp, Homo sapiens
ctgcagggcttaccttgctctg

SEQ ID NO: 7106661 - DNA, 22 bp, Homo sapiens
ctgcagggcttaccttgctctg

SEQ ID NO: 7106662 - DNA, 22 bp, Homo sapiens
ctgcagggcttaccttgctctg

SEQ ID NO: 7106663 - DNA, 22 bp, Homo sapiens
ctgcaggggaccaaagtctgac

SEQ ID NO: 7106664 - DNA, 22 bp, Homo sapiens
ctgcagggccatgggttctata

SEQ ID NO: 7106665 - DNA, 22 bp, Homo sapiens
ctgcagggccatgggttctata

SEQ ID NO: 7106666 - DNA, 22 bp, Homo sapiens
ctgcagggcattgtaactcttt

SEQ ID NO: 7106667 - DNA, 22 bp, Homo sapiens
ctgcagggcccaaggtcaacgg

SEQ ID NO: 7106668 - DNA, 22 bp, Homo sapiens
ctgcagggcccaaggtcaacgg

SEQ ID NO: 7106669 - DNA, 22 bp, Homo sapiens
ctgcagggcccgcctgagccct

SEQ ID NO: 7106670 - DNA, 22 bp, Homo sapiens
ctgcagggcccgcctgagccct

SEQ ID NO: 7106671 - DNA, 22 bp, Homo sapiens
ctgcagggcccgcctgagccct

SEQ ID NO: 7106672 - DNA, 22 bp, Homo sapiens
ctgcagggcccgcctgagccct

SEQ ID NO: 7106673 - DNA, 22 bp, Homo sapiens
ctgcagggcccgcctgagccct

SEQ ID NO: 7106674 - DNA, 22 bp, Homo sapiens
ctgcacatagtaagtactcaat

SEQ ID NO: 7106675 - DNA, 22 bp, Homo sapiens
ctgcaccacagcctgaggcagc

SEQ ID NO: 7106676 - DNA, 22 bp, Homo sapiens
ctgcacccaggcctggtcccag

SEQ ID NO: 7106677 - DNA, 22 bp, Homo sapiens
ctgcaccatccttcatgctctg

SEQ ID NO: 7106678 - DNA, 22 bp, Homo sapiens
ctgcaccatctggagcacctcc

SEQ ID NO: 7106679 - DNA, 22 bp, Homo sapiens
ctgcaccgtgtctcgggctgcc

SEQ ID NO: 7106680 - DNA, 22 bp, Homo sapiens
ctgcaccgtgtctcgggctgcc

SEQ ID NO: 7106681 - DNA, 22 bp, Homo sapiens
ctgcacctacagccacatttac

SEQ ID NO: 7106682 - DNA, 22 bp, Homo sapiens
ctgcacgtataatcagtctgtt

SEQ ID NO: 7106683 - DNA, 19 bp, Homo sapiens
ctgcactaggcctgtgctc

SEQ ID NO: 7106684 - DNA, 18 bp, Homo sapiens
ctgcactcccgcctgggc

SEQ ID NO: 7106685 - DNA, 22 bp, Homo sapiens
ctgcactgaagaaaggagctct

SEQ ID NO: 7106686 - DNA, 22 bp, Homo sapiens
ctgcactgaagaaaggagctct

SEQ ID NO: 7106687 - DNA, 22 bp, Homo sapiens
ctgcactgacttccccggctgc

SEQ ID NO: 7106688 - DNA, 22 bp, Homo sapiens
ctgcactgagaccctctttgct

SEQ ID NO: 7106689 - DNA, 22 bp, Homo sapiens
ctgcactgagcatctaacctta

SEQ ID NO: 7106690 - DNA, 22 bp, Homo sapiens
ctgcactgagcatctaacctta

SEQ ID NO: 7106691 - DNA, 22 bp, Homo sapiens
ctgcactgtgtattccttggct

SEQ ID NO: 7106692 - DNA, 22 bp, Homo sapiens
ctgcactgtgtattccttggct

SEQ ID NO: 7106693 - DNA, 22 bp, Homo sapiens
ctgcacttgacatgctctcaga

SEQ ID NO: 7106694 - DNA, 22 bp, Homo sapiens
ctgcaggcccccttcctggagt

SEQ ID NO: 7106695 - DNA, 22 bp, Homo sapiens
ctgcaggcccccttcctggagt

SEQ ID NO: 7106696 - DNA, 22 bp, Homo sapiens
ctgcaggctcgaagacacggat

SEQ ID NO: 7106697 - DNA, 22 bp, Homo sapiens
ctgcagggagaggggacagcct

SEQ ID NO: 7106698 - DNA, 22 bp, Homo sapiens
ctgcagggagcagatggcgtgt

SEQ ID NO: 7106699 - DNA, 22 bp, Homo sapiens
ctgcagggagcagatggcgtgt

SEQ ID NO: 7106700 - DNA, 22 bp, Homo sapiens
ctgcagggagaggggacagcct

SEQ ID NO: 7106701 - DNA, 22 bp, Homo sapiens
ctgcagggagcagatggcgtgt

SEQ ID NO: 7106702 - DNA, 22 bp, Homo sapiens
ctgcagggagcagatggcgtgt

SEQ ID NO: 7106703 - DNA, 22 bp, Homo sapiens
ctgcagggaggttccttgttct

SEQ ID NO: 7106704 - DNA, 22 bp, Homo sapiens
ctgcagggaggttccttgttct

SEQ ID NO: 7106705 - DNA, 22 bp, Homo sapiens
ctgcagggatgtgaggcccgtt

SEQ ID NO: 7106706 - DNA, 22 bp, Homo sapiens
ctgaggcatgttacaggacata

SEQ ID NO: 7106707 - DNA, 22 bp, Homo sapiens
ctgaggcatgttacaggacata

SEQ ID NO: 7106708 - DNA, 18 bp, Homo sapiens
ctgaggccaactacactg

SEQ ID NO: 7106709 - DNA, 22 bp, Homo sapiens
ctgaggcatgttacaggacata

SEQ ID NO: 7106710 - DNA, 22 bp, Homo sapiens
ctgaggcatgttacaggacata

SEQ ID NO: 7106711 - DNA, 18 bp, Homo sapiens
ctgaggccaactacactg

SEQ ID NO: 7106712 - DNA, 22 bp, Homo sapiens
ctgaggccagaacccgaccctg

SEQ ID NO: 7106713 - DNA, 22 bp, Homo sapiens
ctgaggccagaacccgaccctg

SEQ ID NO: 7106714 - DNA, 22 bp, Homo sapiens
ctgaggccagagtgggcctctt

SEQ ID NO: 7106715 - DNA, 22 bp, Homo sapiens
ctgaggccagagtgggcctctt

SEQ ID NO: 7106716 - DNA, 22 bp, Homo sapiens
ctgaggccagctgcagagctct

SEQ ID NO: 7106717 - DNA, 22 bp, Homo sapiens
ctgaggccagctgcagagctct

SEQ ID NO: 7106718 - DNA, 22 bp, Homo sapiens
ctgaggccagctgcagagctct

SEQ ID NO: 7106719 - DNA, 22 bp, Homo sapiens
ctgaggccagctgcagagctct

SEQ ID NO: 7106720 - DNA, 22 bp, Homo sapiens
ctgaggccggagcactgaagag

SEQ ID NO: 7106721 - DNA, 22 bp, Homo sapiens
ctgaggcccctcttgtgagcat

SEQ ID NO: 7106722 - DNA, 22 bp, Homo sapiens
ctgaggcccctcttgtgagcat

SEQ ID NO: 7106723 - DNA, 22 bp, Homo sapiens
ctgaggcccctcttgtgagcat

SEQ ID NO: 7106724 - DNA, 22 bp, Homo sapiens
ctgaggcccctctcttgagctt

SEQ ID NO: 7106725 - DNA, 19 bp, Homo sapiens
ctgaggcccatgtaccatg

SEQ ID NO: 7106726 - DNA, 22 bp, Homo sapiens
ctgaggcccctctcttgagctt

SEQ ID NO: 7106727 - DNA, 18 bp, Homo sapiens
ctgaggcccagagagggc

SEQ ID NO: 7106728 - DNA, 22 bp, Homo sapiens
ctgaggccagctgcagagctct

SEQ ID NO: 7106729 - DNA, 18 bp, Homo sapiens
ctgaggcccagagagggc

SEQ ID NO: 7106730 - DNA, 22 bp, Homo sapiens
ctgaggccagctgcagagctct

SEQ ID NO: 7106731 - DNA, 18 bp, Homo sapiens
ctgaggcccagagagggc

SEQ ID NO: 7106732 - DNA, 18 bp, Homo sapiens
ctgaggcccagagagggc

SEQ ID NO: 7106733 - DNA, 17 bp, Homo sapiens
ctgaggcccagggccca

SEQ ID NO: 7106734 - DNA, 17 bp, Homo sapiens
ctgaggcccagggccca

SEQ ID NO: 7106735 - DNA, 22 bp, Homo sapiens
ctgcacagtggacagtgaagat

SEQ ID NO: 7106736 - DNA, 22 bp, Homo sapiens
ctgcacagtggacagtgaagat

SEQ ID NO: 7106737 - DNA, 22 bp, Homo sapiens
ctgcacagtgggtggggcgtca

SEQ ID NO: 7106738 - DNA, 22 bp, Homo sapiens
ctgcacagtgggtggggcgtca

SEQ ID NO: 7106739 - DNA, 22 bp, Homo sapiens
ctgcacagtgttggaagctgcc

SEQ ID NO: 7106740 - DNA, 22 bp, Homo sapiens
ctgcacagggatatggggagct

SEQ ID NO: 7106741 - DNA, 22 bp, Homo sapiens
ctgcacaggggatgagggcagt

SEQ ID NO: 7106742 - DNA, 22 bp, Homo sapiens
ctgcacagtaagcttcagagat

SEQ ID NO: 7106743 - DNA, 22 bp, Homo sapiens
ctgcacagcctgtctgggggcc

SEQ ID NO: 7106744 - DNA, 22 bp, Homo sapiens
ctgcacagctggccagggagag

SEQ ID NO: 7106745 - DNA, 22 bp, Homo sapiens
ctgcacagcatgctctgattta

SEQ ID NO: 7106746 - DNA, 22 bp, Homo sapiens
ctgcacagccctcaagagcctg

SEQ ID NO: 7106747 - DNA, 22 bp, Homo sapiens
ctgcacagctggccagggagag

SEQ ID NO: 7106748 - DNA, 21 bp, Homo sapiens
ctgcaaatacctagttatctg

SEQ ID NO: 7106749 - DNA, 22 bp, Homo sapiens
ctgcaaataggaaaagggcata

SEQ ID NO: 7106750 - DNA, 22 bp, Homo sapiens
ctgcaaaggtgggggaggagct

SEQ ID NO: 7106751 - DNA, 21 bp, Homo sapiens
ctgcaaatacctagttatctg

SEQ ID NO: 7106752 - DNA, 22 bp, Homo sapiens
ctgcaaaattgttctttgctcc

SEQ ID NO: 7106753 - DNA, 22 bp, Homo sapiens
ctgcaaaattgttctttgctcc

SEQ ID NO: 7106754 - DNA, 22 bp, Homo sapiens
ctgcaaagctgttcacaaattt

SEQ ID NO: 7106755 - DNA, 22 bp, Homo sapiens
ctgaggccggagcactgaagag

SEQ ID NO: 7106756 - DNA, 22 bp, Homo sapiens
ctgaggccggagcactgaagag

SEQ ID NO: 7106757 - DNA, 22 bp, Homo sapiens
ctgaggccgtctgggtctgcag

SEQ ID NO: 7106758 - DNA, 22 bp, Homo sapiens
ctgcaaaagtcattgtggtttt

SEQ ID NO: 7106759 - DNA, 20 bp, Homo sapiens
ctgcaaaatgacattaggaa

SEQ ID NO: 7106760 - DNA, 22 bp, Homo sapiens
ctgcacagagcagggcagacac

SEQ ID NO: 7106761 - DNA, 22 bp, Homo sapiens
ctgcacagagcagggcagacac

SEQ ID NO: 7106762 - DNA, 22 bp, Homo sapiens
ctgcacagagcagggcagacac

SEQ ID NO: 7106763 - DNA, 22 bp, Homo sapiens
ctgcacagagcggcagttctta

SEQ ID NO: 7106764 - DNA, 22 bp, Homo sapiens
ctgcacagaggtcggtctgcca

SEQ ID NO: 7106765 - DNA, 22 bp, Homo sapiens
ctgcacagccctcaagagcctg

SEQ ID NO: 7106766 - DNA, 22 bp, Homo sapiens
ctgcaaataggaaaagggcata

SEQ ID NO: 7106767 - DNA, 22 bp, Homo sapiens
ctgcaaataggggtgtgaataa

SEQ ID NO: 7106768 - DNA, 22 bp, Homo sapiens
ctgcacacatcgcactgcccgt

SEQ ID NO: 7106769 - DNA, 22 bp, Homo sapiens
ctgcacagagcagggcagacac

SEQ ID NO: 7106770 - DNA, 22 bp, Homo sapiens
ctgcacagagcagggcagacac

SEQ ID NO: 7106771 - DNA, 22 bp, Homo sapiens
tttagtatgtatttaatggact

SEQ ID NO: 7106772 - DNA, 22 bp, Homo sapiens
tttagtattctctatttccatc

SEQ ID NO: 7106773 - DNA, 22 bp, Homo sapiens
tttagtatcctatctcatttaa

SEQ ID NO: 7106774 - DNA, 19 bp, Homo sapiens
tttagtatgagctccaggg

SEQ ID NO: 7106775 - DNA, 22 bp, Homo sapiens
tttagtgagtgtgaatcaaatg

SEQ ID NO: 7106776 - DNA, 22 bp, Homo sapiens
tttagtgagtgtgaatcaaatg

SEQ ID NO: 7106777 - DNA, 22 bp, Homo sapiens
tttagtctaataaaagtggagt

SEQ ID NO: 7106778 - DNA, 22 bp, Homo sapiens
tttagtctagtctcctcagaaa

SEQ ID NO: 7106779 - DNA, 22 bp, Homo sapiens
tttagtctgactattacctcca

SEQ ID NO: 7106780 - DNA, 22 bp, Homo sapiens
tttagtgataagaattatgaaa

SEQ ID NO: 7106781 - DNA, 22 bp, Homo sapiens
tttagtgattcatttagaaaaa

SEQ ID NO: 7106782 - DNA, 22 bp, Homo sapiens
ctcctccacagagtccttgcca

SEQ ID NO: 7106783 - DNA, 22 bp, Homo sapiens
ctcctccacagacctactgaat

SEQ ID NO: 7106784 - DNA, 22 bp, Homo sapiens
ctcctccacagagtccttgcca

SEQ ID NO: 7106785 - DNA, 22 bp, Homo sapiens
ctcctccacagagtccttgcca

SEQ ID NO: 7106786 - DNA, 22 bp, Homo sapiens
tttaggttcttggaatcagtct

SEQ ID NO: 7106787 - DNA, 22 bp, Homo sapiens
tttaggttttttcacgtggcta

SEQ ID NO: 7106788 - DNA, 22 bp, Homo sapiens
tttagggtgatgtatgtgcagc

SEQ ID NO: 7106789 - DNA, 20 bp, Homo sapiens
tttaggtcctgtgcctgggt

SEQ ID NO: 7106790 - DNA, 22 bp, Homo sapiens
tttaggtcttcttaagagtcaa

SEQ ID NO: 7106791 - DNA, 22 bp, Homo sapiens
tttaggttaatcaacaaacatt

SEQ ID NO: 7106792 - DNA, 22 bp, Homo sapiens
tttaggcatacttttgggagaa

SEQ ID NO: 7106793 - DNA, 22 bp, Homo sapiens
tttaggcatgcagttctattta

SEQ ID NO: 7106794 - DNA, 22 bp, Homo sapiens
tttaggcattgaattagaatag

SEQ ID NO: 7106795 - DNA, 20 bp, Homo sapiens
tttaggcattactcttttgt

SEQ ID NO: 7106796 - DNA, 22 bp, Homo sapiens
tttaggcattgggtgctcaagt

SEQ ID NO: 7106797 - DNA, 22 bp, Homo sapiens
tttaggctcaaaagagttggtg

SEQ ID NO: 7106798 - DNA, 22 bp, Homo sapiens
tttagggaaattgagggttaag

SEQ ID NO: 7106799 - DNA, 22 bp, Homo sapiens
tttagtaagttcactgcaaagc

SEQ ID NO: 7106800 - DNA, 22 bp, Homo sapiens
tttagtactgtttaaaaatgga

SEQ ID NO: 7106801 - DNA, 22 bp, Homo sapiens
tttagtagaaatatttgggcct

SEQ ID NO: 7106802 - DNA, 22 bp, Homo sapiens
tttagtagaatagtatatcaaa

SEQ ID NO: 7106803 - DNA, 22 bp, Homo sapiens
tttagtaggaaattgtcttata

SEQ ID NO: 7106804 - DNA, 22 bp, Homo sapiens
tttagtaggcactaggagggga

SEQ ID NO: 7106805 - DNA, 22 bp, Homo sapiens
tttagtagtgacagattctggg

SEQ ID NO: 7106806 - DNA, 22 bp, Homo sapiens
tttagtatataaaaagagaagt

SEQ ID NO: 7106807 - DNA, 22 bp, Homo sapiens
ctccccttcttgccagatcctt

SEQ ID NO: 7106808 - DNA, 22 bp, Homo sapiens
ctccccttccgccagctcttga

SEQ ID NO: 7106809 - DNA, 18 bp, Homo sapiens
ctcccctgttttccctgc

SEQ ID NO: 7106810 - DNA, 22 bp, Homo sapiens
ctcccctccttaggtcttctag

SEQ ID NO: 7106811 - DNA, 20 bp, Homo sapiens
ctcccctctacagagggctg

SEQ ID NO: 7106812 - DNA, 22 bp, Homo sapiens
tttagacatttgtggtttgcaa

SEQ ID NO: 7106813 - DNA, 22 bp, Homo sapiens
tttagagaagttaggaaataaa

SEQ ID NO: 7106814 - DNA, 22 bp, Homo sapiens
tttaggcagtcattgaacaagt

SEQ ID NO: 7106815 - DNA, 22 bp, Homo sapiens
tttagacatggcttgctcactt

SEQ ID NO: 7106816 - DNA, 19 bp, Homo sapiens
tttagacattgtctggtat

SEQ ID NO: 7106817 - DNA, 19 bp, Homo sapiens
tttagacattgtctggtat

SEQ ID NO: 7106818 - DNA, 22 bp, Homo sapiens
ctccctcacaaagcattctctt

SEQ ID NO: 7106819 - DNA, 22 bp, Homo sapiens
tttagacatggcttgctcactt

SEQ ID NO: 7106820 - DNA, 22 bp, Homo sapiens
ctcccgtgccactggctcctgc

SEQ ID NO: 7106821 - DNA, 23 bp, Homo sapiens
ctccccagtgtcctcatgcatct

SEQ ID NO: 7106822 - DNA, 23 bp, Homo sapiens
ctccccagtgtcctcatgcatct

SEQ ID NO: 7106823 - DNA, 23 bp, Homo sapiens
ctccccagtgtcctcatgcatct

SEQ ID NO: 7106824 - DNA, 23 bp, Homo sapiens
ctccccagtgtcctcatgcatct

SEQ ID NO: 7106825 - DNA, 22 bp, Homo sapiens
tttaatcataagaaggaaaata

SEQ ID NO: 7106826 - DNA, 22 bp, Homo sapiens
tttaatctattccctaaacacc

SEQ ID NO: 7106827 - DNA, 22 bp, Homo sapiens
ctcccccttagctcttgtcttt

SEQ ID NO: 7106828 - DNA, 22 bp, Homo sapiens
ctcccctccttaggtcttctag

SEQ ID NO: 7106829 - DNA, 18 bp, Homo sapiens
ctcctccacagcccctgc

SEQ ID NO: 7106830 - DNA, 18 bp, Homo sapiens
ctcctccacagcccctgc

SEQ ID NO: 7106831 - DNA, 18 bp, Homo sapiens
ctcctccacagcccctgc

SEQ ID NO: 7106832 - DNA, 22 bp, Homo sapiens
ctcctccagctctccctggggg

SEQ ID NO: 7106833 - DNA, 22 bp, Homo sapiens
ctcctccagctctccctggggg

SEQ ID NO: 7106834 - DNA, 22 bp, Homo sapiens
ctcctccagctctccctggggg

SEQ ID NO: 7106835 - DNA, 22 bp, Homo sapiens
ctcctccagctctccctggggg

SEQ ID NO: 7106836 - DNA, 22 bp, Homo sapiens
ctcctccagcttccagtggctc

SEQ ID NO: 7106837 - DNA, 22 bp, Homo sapiens
ctcctccagtgggtccctcagg

SEQ ID NO: 7106838 - DNA, 22 bp, Homo sapiens
ctcctccagtgggtccctcagg

SEQ ID NO: 7106839 - DNA, 22 bp, Homo sapiens
tttattccagtgtttctcaaat

SEQ ID NO: 7106840 - DNA, 22 bp, Homo sapiens
ctcctccagtgggtccctcagg

SEQ ID NO: 7106841 - DNA, 22 bp, Homo sapiens
tttattgttgttagtcataagt

SEQ ID NO: 7106842 - DNA, 22 bp, Homo sapiens
tttattgttgttagtcataagt

SEQ ID NO: 7106843 - DNA, 22 bp, Homo sapiens
tttattgttgggtcttaagctg

SEQ ID NO: 7106844 - DNA, 22 bp, Homo sapiens
tttattgttgggtcttaagctg

SEQ ID NO: 7106845 - DNA, 22 bp, Homo sapiens
tttattgttgttagtcataagt

SEQ ID NO: 7106846 - DNA, 22 bp, Homo sapiens
tttattgtttagaagggggctg

SEQ ID NO: 7106847 - DNA, 22 bp, Homo sapiens
tttattgtttagaagggggctg

SEQ ID NO: 7106848 - DNA, 22 bp, Homo sapiens
tttatttaaagtcgtgtgttaa

SEQ ID NO: 7106849 - DNA, 22 bp, Homo sapiens
tttatttaaagtcgtgtgttaa

SEQ ID NO: 7106850 - DNA, 22 bp, Homo sapiens
tttatttaaagtcgtgtgttaa

SEQ ID NO: 7106851 - DNA, 22 bp, Homo sapiens
tttattccatgtgtctatgacc

SEQ ID NO: 7106852 - DNA, 18 bp, Homo sapiens
tttattcctgcccccagc

SEQ ID NO: 7106853 - DNA, 22 bp, Homo sapiens
tttattgtgttgaaactgaatt

SEQ ID NO: 7106854 - DNA, 22 bp, Homo sapiens
tttattgttatcatgggtgagt

SEQ ID NO: 7106855 - DNA, 22 bp, Homo sapiens
tttattgttatcatgggtgagt

SEQ ID NO: 7106856 - DNA, 22 bp, Homo sapiens
tttattgttatcatgggtgagt

SEQ ID NO: 7106857 - DNA, 22 bp, Homo sapiens
tttattgttgggtcttaagctg

SEQ ID NO: 7106858 - DNA, 22 bp, Homo sapiens
tttatttaccttatgtcctcca

SEQ ID NO: 7106859 - DNA, 22 bp, Homo sapiens
tttatttaccttatgtcctcca

SEQ ID NO: 7106860 - DNA, 22 bp, Homo sapiens
tttatttaccttatgtcctcca

SEQ ID NO: 7106861 - DNA, 22 bp, Homo sapiens
tttatttaccttatgtcctcca

SEQ ID NO: 7106862 - DNA, 22 bp, Homo sapiens
tttatttaaagtcgtgtgttaa

SEQ ID NO: 7106863 - DNA, 22 bp, Homo sapiens
tttatttaccttatgtcctcca

SEQ ID NO: 7106864 - DNA, 22 bp, Homo sapiens
tttatttaaagtcgtgtgttaa

SEQ ID NO: 7106865 - DNA, 22 bp, Homo sapiens
tttatttaaagtcgtgtgttaa

SEQ ID NO: 7106866 - DNA, 22 bp, Homo sapiens
tttatttaaagtcgtgtgttaa

SEQ ID NO: 7106867 - DNA, 22 bp, Homo sapiens
tttatttaccttatgtcctcca

SEQ ID NO: 7106868 - DNA, 16 bp, Homo sapiens
tttatttactagtgtt

SEQ ID NO: 7106869 - DNA, 16 bp, Homo sapiens
tttatttactagtgtt

SEQ ID NO: 7106870 - DNA, 16 bp, Homo sapiens
tttatttactagtgtt

SEQ ID NO: 7106871 - DNA, 16 bp, Homo sapiens
tttatttactagtgtt

SEQ ID NO: 7106872 - DNA, 22 bp, Homo sapiens
ctcctggatgcaggctgtctgc

SEQ ID NO: 7106873 - DNA, 22 bp, Homo sapiens
ctcctggatgcaggctgtctgc

SEQ ID NO: 7106874 - DNA, 22 bp, Homo sapiens
ctcctggcactcagtgtggaag

SEQ ID NO: 7106875 - DNA, 22 bp, Homo sapiens
ctcctggcactcagtgtggaag

SEQ ID NO: 7106876 - DNA, 22 bp, Homo sapiens
ctcctggcactgtcttgaccca

SEQ ID NO: 7106877 - DNA, 22 bp, Homo sapiens
ctcctggccctgagctcccagg

SEQ ID NO: 7106878 - DNA, 22 bp, Homo sapiens
ctcctggccacgttcttgctgg

SEQ ID NO: 7106879 - DNA, 22 bp, Homo sapiens
ctcctggccacgttcttgctgg

SEQ ID NO: 7106880 - DNA, 17 bp, Homo sapiens
ctcctggcagcctcagg

SEQ ID NO: 7106881 - DNA, 17 bp, Homo sapiens
ctcctggcagcctcagg

SEQ ID NO: 7106882 - DNA, 22 bp, Homo sapiens
ctcctggcaggctgagtgaaat

SEQ ID NO: 7106883 - DNA, 22 bp, Homo sapiens
ctcctggcagttccccttgtca

SEQ ID NO: 7106884 - DNA, 22 bp, Homo sapiens
ctctcctggtgtggaggacagg

SEQ ID NO: 7106885 - DNA, 22 bp, Homo sapiens
ctctcctggggagcacacacac

SEQ ID NO: 7106886 - DNA, 22 bp, Homo sapiens
ctctcctggggagcacacacac

SEQ ID NO: 7106887 - DNA, 22 bp, Homo sapiens
ctctcctggtgtggaggacagg

SEQ ID NO: 7106888 - DNA, 22 bp, Homo sapiens
ctctccagtcatattctcagtc

SEQ ID NO: 7106889 - DNA, 21 bp, Homo sapiens
ctctccagtggttcctgattc

SEQ ID NO: 7106890 - DNA, 22 bp, Homo sapiens
ctctccagtcatattctcagtc

SEQ ID NO: 7106891 - DNA, 22 bp, Homo sapiens
ctctccagtcatattctcagtc

SEQ ID NO: 7106892 - DNA, 22 bp, Homo sapiens
ctctccagtcaggaactctgac

SEQ ID NO: 7106893 - DNA, 22 bp, Homo sapiens
ctctccagtcatattctcagtc

SEQ ID NO: 7106894 - DNA, 22 bp, Homo sapiens
ctctccagtcatattctcagtc

SEQ ID NO: 7106895 - DNA, 22 bp, Homo sapiens
ctctccagtcatattctcagtc

SEQ ID NO: 7106896 - DNA, 22 bp, Homo sapiens
ctctccaggttagagcacttat

SEQ ID NO: 7106897 - DNA, 22 bp, Homo sapiens
ctctccagtcaggaactctgac

SEQ ID NO: 7106898 - DNA, 22 bp, Homo sapiens
ctctccaggggtagatgccttc

SEQ ID NO: 7106899 - DNA, 22 bp, Homo sapiens
ctctccaggggtagatgccttc

SEQ ID NO: 7106900 - DNA, 21 bp, Homo sapiens
ctctccaggtaggataaatgt

SEQ ID NO: 7106901 - DNA, 22 bp, Homo sapiens
ctctccaggggtagatgccttc

SEQ ID NO: 7106902 - DNA, 22 bp, Homo sapiens
ctctccaggggtagatgccttc

SEQ ID NO: 7106903 - DNA, 22 bp, Homo sapiens
ctctccagggaagcagtgtact

SEQ ID NO: 7106904 - DNA, 22 bp, Homo sapiens
ctctccagggcatgagttccac

SEQ ID NO: 7106905 - DNA, 22 bp, Homo sapiens
ctctccagggcatgagttccac

SEQ ID NO: 7106906 - DNA, 22 bp, Homo sapiens
ctctccaggggaacattgttcc

SEQ ID NO: 7106907 - DNA, 22 bp, Homo sapiens
ctctccaggggtagatgccttc

SEQ ID NO: 7106908 - DNA, 22 bp, Homo sapiens
ctctccaggggtagatgccttc

SEQ ID NO: 7106909 - DNA, 22 bp, Homo sapiens
tttcctcactcatgtcatcagt

SEQ ID NO: 7106910 - DNA, 22 bp, Homo sapiens
ctctccaggagctcagagtcta

SEQ ID NO: 7106911 - DNA, 22 bp, Homo sapiens
ctctccaggagctcagagtcta

SEQ ID NO: 7106912 - DNA, 22 bp, Homo sapiens
tttcctcacacagaagatcttg

SEQ ID NO: 7106913 - DNA, 22 bp, Homo sapiens
tttcctcaactgtcaaatgggg

SEQ ID NO: 7106914 - DNA, 22 bp, Homo sapiens
ctctccaggagctcagagtcta

SEQ ID NO: 7106915 - DNA, 22 bp, Homo sapiens
ctctccaggagctcagagtcta

SEQ ID NO: 7106916 - DNA, 22 bp, Homo sapiens
ctctccaggagctcagagtcta

SEQ ID NO: 7106917 - DNA, 22 bp, Homo sapiens
ctctccaggagctcagagtcta

SEQ ID NO: 7106918 - DNA, 22 bp, Homo sapiens
ctctccaggcgaggtcctactg

SEQ ID NO: 7106919 - DNA, 22 bp, Homo sapiens
ctctccaggcgaggtcctactg

SEQ ID NO: 7106920 - DNA, 22 bp, Homo sapiens
ctctccaggctgggacaggacc

SEQ ID NO: 7106921 - DNA, 22 bp, Homo sapiens
ctctccaggctgggacaggacc

SEQ ID NO: 7106922 - DNA, 22 bp, Homo sapiens
ctctccaggctgggacaggacc

SEQ ID NO: 7106923 - DNA, 22 bp, Homo sapiens
ctctccaggctgggacaggacc

SEQ ID NO: 7106924 - DNA, 22 bp, Homo sapiens
ctctccaggctgggacaggacc

SEQ ID NO: 7106925 - DNA, 22 bp, Homo sapiens
ctctccagggaagcagtgtact

SEQ ID NO: 7106926 - DNA, 22 bp, Homo sapiens
ctctccagggaagcagtgtact

SEQ ID NO: 7106927 - DNA, 20 bp, Homo sapiens
ctctctctccattcccaggg

SEQ ID NO: 7106928 - DNA, 20 bp, Homo sapiens
ctctctctccattcccaggg

SEQ ID NO: 7106929 - DNA, 20 bp, Homo sapiens
ctctctctccattcccaggg

SEQ ID NO: 7106930 - DNA, 20 bp, Homo sapiens
ctctctctccattcccaggg

SEQ ID NO: 7106931 - DNA, 20 bp, Homo sapiens
ctctctctccattcccaggg

SEQ ID NO: 7106932 - DNA, 22 bp, Homo sapiens
ctctctctatgcgttgttccta

SEQ ID NO: 7106933 - DNA, 17 bp, Homo sapiens
ctctccttcctctgagg

SEQ ID NO: 7106934 - DNA, 17 bp, Homo sapiens
ctctccttcctctgagg

SEQ ID NO: 7106935 - DNA, 22 bp, Homo sapiens
ctctctctatgcgttgttccta

SEQ ID NO: 7106936 - DNA, 22 bp, Homo sapiens
ctctctctatgcgttgttccta

SEQ ID NO: 7106937 - DNA, 22 bp, Homo sapiens
ctctctcttgtgttgctgcaga

SEQ ID NO: 7106938 - DNA, 22 bp, Homo sapiens
ctctctcttgtgttgctgcaga

SEQ ID NO: 7106939 - DNA, 22 bp, Homo sapiens
ctctctcttgtgttgctgcaga

SEQ ID NO: 7106940 - DNA, 22 bp, Homo sapiens
ctctctcttgtgttgctgcaga

SEQ ID NO: 7106941 - DNA, 22 bp, Homo sapiens
ctctctctttagaagcgtctgg

SEQ ID NO: 7106942 - DNA, 22 bp, Homo sapiens
ctctctctttagaagcgtctgg

SEQ ID NO: 7106943 - DNA, 22 bp, Homo sapiens
ctctctgaaactggagagtctc

SEQ ID NO: 7106944 - DNA, 22 bp, Homo sapiens
ctctctgaggaaggagcatctg

SEQ ID NO: 7106945 - DNA, 22 bp, Homo sapiens
ctctctgaggaaggagcatctg

SEQ ID NO: 7106946 - DNA, 22 bp, Homo sapiens
ctctctgaggcaggcctgtggg

SEQ ID NO: 7106947 - DNA, 21 bp, Homo sapiens
ctctctgcttatgaatagtga

SEQ ID NO: 7106948 - DNA, 22 bp, Homo sapiens
ctctctgctgtatccttaggct

SEQ ID NO: 7106949 - DNA, 22 bp, Homo sapiens
ctctctggaagggggagctgat

SEQ ID NO: 7106950 - DNA, 22 bp, Homo sapiens
ctctctggaagggggagctgat

SEQ ID NO: 7106951 - DNA, 22 bp, Homo sapiens
ctctctggaagggggagctgat

SEQ ID NO: 7106952 - DNA, 22 bp, Homo sapiens
ctctctgagtggctgtactttc

SEQ ID NO: 7106953 - DNA, 22 bp, Homo sapiens
ctctctgagtggctgtactttc

SEQ ID NO: 7106954 - DNA, 22 bp, Homo sapiens
ctctctgatgtcaggtcgctga

SEQ ID NO: 7106955 - DNA, 22 bp, Homo sapiens
ctctctgatgtcaggtcgctga

SEQ ID NO: 7106956 - DNA, 22 bp, Homo sapiens
tttccttgcctcctgtccttct

SEQ ID NO: 7106957 - DNA, 22 bp, Homo sapiens
ctctctggaagggggagctgat

SEQ ID NO: 7106958 - DNA, 18 bp, Homo sapiens
tttccttgtatgaacata

SEQ ID NO: 7106959 - DNA, 22 bp, Homo sapiens
tttcacaaactgaggagacaat

SEQ ID NO: 7106960 - DNA, 22 bp, Homo sapiens
tttcacaaactgaggagacaat

SEQ ID NO: 7106961 - DNA, 22 bp, Homo sapiens
tttcacaaactcagggtgtgtg

SEQ ID NO: 7106962 - DNA, 21 bp, Homo sapiens
tttcacaaaagtatgtgacaa

SEQ ID NO: 7106963 - DNA, 21 bp, Homo sapiens
tttcacaaaagtatgtgacaa

SEQ ID NO: 7106964 - DNA, 22 bp, Homo sapiens
tttcacaaagcatagcacttta

SEQ ID NO: 7106965 - DNA, 22 bp, Homo sapiens
tttcacaaagcatagcacttta

SEQ ID NO: 7106966 - DNA, 22 bp, Homo sapiens
tttcacaaatgtctttaacttg

SEQ ID NO: 7106967 - DNA, 22 bp, Homo sapiens
tttcacaaatgtctttaacttg

SEQ ID NO: 7106968 - DNA, 22 bp, Homo sapiens
tttcacaacacaatctcgttaa

SEQ ID NO: 7106969 - DNA, 22 bp, Homo sapiens
tttcacaggtaagcaatacagg

SEQ ID NO: 7106970 - DNA, 22 bp, Homo sapiens
tttcacaggtaagcaatacagg

SEQ ID NO: 7106971 - DNA, 22 bp, Homo sapiens
tttcacagtagaaatcattatg

SEQ ID NO: 7106972 - DNA, 22 bp, Homo sapiens
tttcaattgactttggaagaaa

SEQ ID NO: 7106973 - DNA, 22 bp, Homo sapiens
tttcaattccaccaaagcgccc

SEQ ID NO: 7106974 - DNA, 22 bp, Homo sapiens
tttcaatttccaggctagaatt

SEQ ID NO: 7106975 - DNA, 21 bp, Homo sapiens
tttcaatttgccttgagtcat

SEQ ID NO: 7106976 - DNA, 21 bp, Homo sapiens
tttcacaaaagtatgtgacaa

SEQ ID NO: 7106977 - DNA, 22 bp, Homo sapiens
tttcaatgtatgtctttctgag

SEQ ID NO: 7106978 - DNA, 23 bp, Homo sapiens
tttcaaattactctgcagatgac

SEQ ID NO: 7106979 - DNA, 23 bp, Homo sapiens
tttcaaattactctgcagatgac

SEQ ID NO: 7106980 - DNA, 22 bp, Homo sapiens
tttcaatgtaacatttccaggc

SEQ ID NO: 7106981 - DNA, 22 bp, Homo sapiens
ctcctggccctgagctcccagg

SEQ ID NO: 7106982 - DNA, 22 bp, Homo sapiens
tttcaaatggatccctcagcct

SEQ ID NO: 7106983 - DNA, 22 bp, Homo sapiens
tttcacatagaaagtgatttac

SEQ ID NO: 7106984 - DNA, 22 bp, Homo sapiens
tttcacataaatattatgccta

SEQ ID NO: 7106985 - DNA, 22 bp, Homo sapiens
tttcacataaatggagtaaaga

SEQ ID NO: 7106986 - DNA, 22 bp, Homo sapiens
tttcacataaatggagtaaaga

SEQ ID NO: 7106987 - DNA, 22 bp, Homo sapiens
tttcacatacagtgtatagtag

SEQ ID NO: 7106988 - DNA, 22 bp, Homo sapiens
tttcacagttagcatgaggact

SEQ ID NO: 7106989 - DNA, 22 bp, Homo sapiens
tttcacagttagcatgaggact

SEQ ID NO: 7106990 - DNA, 22 bp, Homo sapiens
tttcacagtgctctgtaagtat

SEQ ID NO: 7106991 - DNA, 22 bp, Homo sapiens
tttcacagttagcatgaggact

SEQ ID NO: 7106992 - DNA, 22 bp, Homo sapiens
tttcacagtagaaatcattatg

SEQ ID NO: 7106993 - DNA, 22 bp, Homo sapiens
tttcacagtcaatttggagtca

SEQ ID NO: 7106994 - DNA, 22 bp, Homo sapiens
tttcctaagatagatacttcag

SEQ ID NO: 7106995 - DNA, 22 bp, Homo sapiens
tttcctaagatagatacttcag

SEQ ID NO: 7106996 - DNA, 22 bp, Homo sapiens
tttcctaactcatcggatgtac

SEQ ID NO: 7106997 - DNA, 22 bp, Homo sapiens
tttcctaacacaatgcatgaga

SEQ ID NO: 7106998 - DNA, 22 bp, Homo sapiens
tttcctaaggctcattttaaaa

SEQ ID NO: 7106999 - DNA, 20 bp, Homo sapiens
tttccactgtaatgtatgat

SEQ ID NO: 7107000 - DNA, 22 bp, Homo sapiens
tttccactgtagagatgttgaa

SEQ ID NO: 7107001 - DNA, 22 bp, Homo sapiens
tttcctaaggtagtgataattt

SEQ ID NO: 7107002 - DNA, 22 bp, Homo sapiens
tttcctaagggatgcggctcaa

SEQ ID NO: 7107003 - DNA, 22 bp, Homo sapiens
tttcctaatcccaatgacattt

SEQ ID NO: 7107004 - DNA, 20 bp, Homo sapiens
tttcctaagtggtttgctga

SEQ ID NO: 7107005 - DNA, 22 bp, Homo sapiens
tttcctacccttccaggcagag

SEQ ID NO: 7107006 - DNA, 22 bp, Homo sapiens
tttcctacccttccaggcagag

SEQ ID NO: 7107007 - DNA, 22 bp, Homo sapiens
tttcctactgccctatacacac

SEQ ID NO: 7107008 - DNA, 22 bp, Homo sapiens
tttcctaatcccaatgacattt

SEQ ID NO: 7107009 - DNA, 22 bp, Homo sapiens
tttcctactgccctatacacac

SEQ ID NO: 7107010 - DNA, 22 bp, Homo sapiens
tttcctaggctctagagttcta

SEQ ID NO: 7107011 - DNA, 22 bp, Homo sapiens
ctcccagagaccaagctgagaa

SEQ ID NO: 7107012 - DNA, 22 bp, Homo sapiens
ctcccagacatgtgcctccttg

SEQ ID NO: 7107013 - DNA, 22 bp, Homo sapiens
ctcccagacatgtgcctccttg

SEQ ID NO: 7107014 - DNA, 22 bp, Homo sapiens
ctcccagagaccaagctgagaa

SEQ ID NO: 7107015 - DNA, 22 bp, Homo sapiens
ctcccagagaccaagctgagaa

SEQ ID NO: 7107016 - DNA, 22 bp, Homo sapiens
ctcccagagaccaagctgagaa

SEQ ID NO: 7107017 - DNA, 22 bp, Homo sapiens
ctcccagattcctgctgtggga

SEQ ID NO: 7107018 - DNA, 22 bp, Homo sapiens
ctcccagattcctgctgtggga

SEQ ID NO: 7107019 - DNA, 22 bp, Homo sapiens
ctcccagagagcaggtgggccg

SEQ ID NO: 7107020 - DNA, 22 bp, Homo sapiens
ctcccagagagcaggtgggccg

SEQ ID NO: 7107021 - DNA, 22 bp, Homo sapiens
ctcccagaggtgtcattcgagc

SEQ ID NO: 7107022 - DNA, 22 bp, Homo sapiens
ctcccagccttcgccagtctga

SEQ ID NO: 7107023 - DNA, 22 bp, Homo sapiens
ctcccagccttcgccagtctga

SEQ ID NO: 7107024 - DNA, 22 bp, Homo sapiens
ctcccagccttcgccagtctga

SEQ ID NO: 7107025 - DNA, 22 bp, Homo sapiens
ctcccagccttcgccagtctga

SEQ ID NO: 7107026 - DNA, 22 bp, Homo sapiens
ctcccagccttcgccagtctga

SEQ ID NO: 7107027 - DNA, 22 bp, Homo sapiens
ctcccagccttcgccagtctga

SEQ ID NO: 7107028 - DNA, 22 bp, Homo sapiens
ctcccaggactcagaggagaag

SEQ ID NO: 7107029 - DNA, 22 bp, Homo sapiens
ctcccaggactcagaggagaag

SEQ ID NO: 7107030 - DNA, 22 bp, Homo sapiens
ctcccagccttcgccagtctga

SEQ ID NO: 7107031 - DNA, 22 bp, Homo sapiens
ctcccaggactcagaggagaag

SEQ ID NO: 7107032 - DNA, 22 bp, Homo sapiens
ctcccaggactcagaggagaag

SEQ ID NO: 7107033 - DNA, 22 bp, Homo sapiens
ctcccaggactcagaggagaag

SEQ ID NO: 7107034 - DNA, 22 bp, Homo sapiens
ctcccaggactcagaggagaag

SEQ ID NO: 7107035 - DNA, 22 bp, Homo sapiens
ctcccaggactggctctaactg

SEQ ID NO: 7107036 - DNA, 22 bp, Homo sapiens
ctcccaggactggctctaactg

SEQ ID NO: 7107037 - DNA, 22 bp, Homo sapiens
ctcccaagataaataaggcagt

SEQ ID NO: 7107038 - DNA, 22 bp, Homo sapiens
ctccatggggaaatgaaggtgg

SEQ ID NO: 7107039 - DNA, 22 bp, Homo sapiens
ctccatgggggctggcctgtgt

SEQ ID NO: 7107040 - DNA, 22 bp, Homo sapiens
ctcccaaggggtaagggagctg

SEQ ID NO: 7107041 - DNA, 22 bp, Homo sapiens
ctcccaaggggtaagggagctg

SEQ ID NO: 7107042 - DNA, 22 bp, Homo sapiens
ctcccaaggggtaagggagctg

SEQ ID NO: 7107043 - DNA, 22 bp, Homo sapiens
ctcccacatggaatagcaggga

SEQ ID NO: 7107044 - DNA, 22 bp, Homo sapiens
ctcccacatggaatagcaggga

SEQ ID NO: 7107045 - DNA, 22 bp, Homo sapiens
ctcccactcctggctcaccaca

SEQ ID NO: 7107046 - DNA, 22 bp, Homo sapiens
ctcccactcctggctcaccaca

SEQ ID NO: 7107047 - DNA, 22 bp, Homo sapiens
ctcccactcctggctcaccaca

SEQ ID NO: 7107048 - DNA, 22 bp, Homo sapiens
ctcccactcctggctcaccaca

SEQ ID NO: 7107049 - DNA, 22 bp, Homo sapiens
ctcccactcctggctcaccaca

SEQ ID NO: 7107050 - DNA, 22 bp, Homo sapiens
ctcccactcctggctcaccaca

SEQ ID NO: 7107051 - DNA, 22 bp, Homo sapiens
ctcccagaaaattctcagacaa

SEQ ID NO: 7107052 - DNA, 22 bp, Homo sapiens
ctcccagaaaattctcagacaa

SEQ ID NO: 7107053 - DNA, 22 bp, Homo sapiens
ctcccagaaaattctcagacaa

SEQ ID NO: 7107054 - DNA, 22 bp, Homo sapiens
ctcccagaaaattctcagacaa

SEQ ID NO: 7107055 - DNA, 22 bp, Homo sapiens
ctcccagaaaattctcagacaa

SEQ ID NO: 7107056 - DNA, 22 bp, Homo sapiens
ctcccagacatgtgcctccttg

SEQ ID NO: 7107057 - DNA, 22 bp, Homo sapiens
ctcccagacatgtgcctccttg

SEQ ID NO: 7107058 - DNA, 22 bp, Homo sapiens
ctcccagacatgtgcctccttg

SEQ ID NO: 7107059 - DNA, 22 bp, Homo sapiens
tttaatatttctttcctgaagc

SEQ ID NO: 7107060 - DNA, 22 bp, Homo sapiens
tttaatatttctttcctgaagc

SEQ ID NO: 7107061 - DNA, 22 bp, Homo sapiens
tttaatcaggcaaagcataata

SEQ ID NO: 7107062 - DNA, 22 bp, Homo sapiens
tttaatatctcacacttccatg

SEQ ID NO: 7107063 - DNA, 22 bp, Homo sapiens
tttaatatctcacacttccatg

SEQ ID NO: 7107064 - DNA, 15 bp, Homo sapiens
tttaatatggagtta

SEQ ID NO: 7107065 - DNA, 22 bp, Homo sapiens
tttaatattctgcattctcctt

SEQ ID NO: 7107066 - DNA, 22 bp, Homo sapiens
tttaatattctgcattctcctt

SEQ ID NO: 7107067 - DNA, 22 bp, Homo sapiens
tttaatattctgcattctcctt

SEQ ID NO: 7107068 - DNA, 22 bp, Homo sapiens
tttaatattctgcattctcctt

SEQ ID NO: 7107069 - DNA, 22 bp, Homo sapiens
tttaatatttctttcctgaagc

SEQ ID NO: 7107070 - DNA, 22 bp, Homo sapiens
tttaatatctcacacttccatg

SEQ ID NO: 7107071 - DNA, 22 bp, Homo sapiens
tttaatatctcacacttccatg

SEQ ID NO: 7107072 - DNA, 22 bp, Homo sapiens
tttaatatctcacacttccatg

SEQ ID NO: 7107073 - DNA, 22 bp, Homo sapiens
tttaatatccagtggatacaaa

SEQ ID NO: 7107074 - DNA, 22 bp, Homo sapiens
tttaatatccagtggatacaaa

SEQ ID NO: 7107075 - DNA, 22 bp, Homo sapiens
tttaatatccagtggatacaaa

SEQ ID NO: 7107076 - DNA, 22 bp, Homo sapiens
tttaatatccagtggatacaaa

SEQ ID NO: 7107077 - DNA, 22 bp, Homo sapiens
tttaatagggcccaatgagact

SEQ ID NO: 7107078 - DNA, 22 bp, Homo sapiens
tttaatagggcccaatgagact

SEQ ID NO: 7107079 - DNA, 22 bp, Homo sapiens
tttaatatccagtggatacaaa

SEQ ID NO: 7107080 - DNA, 22 bp, Homo sapiens
tttaatatccagtggatacaaa

SEQ ID NO: 7107081 - DNA, 22 bp, Homo sapiens
tttaatatccagtggatacaaa

SEQ ID NO: 7107082 - DNA, 22 bp, Homo sapiens
tttaatatccagtggatacaaa

SEQ ID NO: 7107083 - DNA, 22 bp, Homo sapiens
ctcccaggcacagggaggagcc

SEQ ID NO: 7107084 - DNA, 22 bp, Homo sapiens
ctcccaggcacagggaggagcc

SEQ ID NO: 7107085 - DNA, 22 bp, Homo sapiens
ctcccaggcacagggaggagcc

SEQ ID NO: 7107086 - DNA, 22 bp, Homo sapiens
ctcccaggcacagggaggagcc

SEQ ID NO: 7107087 - DNA, 22 bp, Homo sapiens
ctcccaggcagggctgcccact

SEQ ID NO: 7107088 - DNA, 22 bp, Homo sapiens
ctcccaggcagggctgcccact

SEQ ID NO: 7107089 - DNA, 22 bp, Homo sapiens
ctcccaggcagggctgcccact

SEQ ID NO: 7107090 - DNA, 22 bp, Homo sapiens
ctcccaggccatgctctagcca

SEQ ID NO: 7107091 - DNA, 22 bp, Homo sapiens
ctcccaggccatgctctagcca

SEQ ID NO: 7107092 - DNA, 22 bp, Homo sapiens
ctcccaggccatgctctagcca

SEQ ID NO: 7107093 - DNA, 22 bp, Homo sapiens
ctcccaggccatgctctagcca

SEQ ID NO: 7107094 - DNA, 22 bp, Homo sapiens
tttaacagatgctatgtctacc

SEQ ID NO: 7107095 - DNA, 22 bp, Homo sapiens
ctcccagggccatcgagtcact

SEQ ID NO: 7107096 - DNA, 22 bp, Homo sapiens
ctcccagggccatcgagtcact

SEQ ID NO: 7107097 - DNA, 22 bp, Homo sapiens
ctcccagggccatcgagtcact

SEQ ID NO: 7107098 - DNA, 22 bp, Homo sapiens
ctcccaggccatgctctagcca

SEQ ID NO: 7107099 - DNA, 22 bp, Homo sapiens
tttaagttccttttcaacaact

SEQ ID NO: 7107100 - DNA, 22 bp, Homo sapiens
tttaacagatgtgaaattttca

SEQ ID NO: 7107101 - DNA, 22 bp, Homo sapiens
tttaagttccttttcaacaact

SEQ ID NO: 7107102 - DNA, 22 bp, Homo sapiens
tttaatacagaacttgtcaggg

SEQ ID NO: 7107103 - DNA, 22 bp, Homo sapiens
ttgtctttggaaatttaatgtt

SEQ ID NO: 7107104 - DNA, 22 bp, Homo sapiens
ttgtctttggaaatttaatgtt

SEQ ID NO: 7107105 - DNA, 22 bp, Homo sapiens
ttgtcttttgtgggaaatatgg

SEQ ID NO: 7107106 - DNA, 22 bp, Homo sapiens
ttgtcttttgtgggaaatatgg

SEQ ID NO: 7107107 - DNA, 22 bp, Homo sapiens
ttgtcttttgtgggaaatatgg

SEQ ID NO: 7107108 - DNA, 22 bp, Homo sapiens
ttgtcttattttatcataagca

SEQ ID NO: 7107109 - DNA, 22 bp, Homo sapiens
ttgtctttcccagcttctagag

SEQ ID NO: 7107110 - DNA, 22 bp, Homo sapiens
ttgtctttcccagcttctagag

SEQ ID NO: 7107111 - DNA, 22 bp, Homo sapiens
ttgtctttcccagcttctagag

SEQ ID NO: 7107112 - DNA, 22 bp, Homo sapiens
ttgtctttcccagcttctagag

SEQ ID NO: 7107113 - DNA, 22 bp, Homo sapiens
ttgtctttcccagcttctagag

SEQ ID NO: 7107114 - DNA, 22 bp, Homo sapiens
ttgtctttggaaatttaatgtt

SEQ ID NO: 7107115 - DNA, 22 bp, Homo sapiens
ttgtctttggaaatttaatgtt

SEQ ID NO: 7107116 - DNA, 22 bp, Homo sapiens
ttgtcttaaatggatggacaat

SEQ ID NO: 7107117 - DNA, 19 bp, Homo sapiens
ttgtcttagctgcataaga

SEQ ID NO: 7107118 - DNA, 19 bp, Homo sapiens
ttgtcttagctgcataaga

SEQ ID NO: 7107119 - DNA, 22 bp, Homo sapiens
ttgtctttcccagcttctagag

SEQ ID NO: 7107120 - DNA, 22 bp, Homo sapiens
ttgtctgtcccagcttgtgcat

SEQ ID NO: 7107121 - DNA, 22 bp, Homo sapiens
ttgtctgtgaaatggaaatagt

SEQ ID NO: 7107122 - DNA, 22 bp, Homo sapiens
ttgtctgtgaaatggaaatagt

SEQ ID NO: 7107123 - DNA, 23 bp, Homo sapiens
ttgtctgtgcttttccagttgct

SEQ ID NO: 7107124 - DNA, 23 bp, Homo sapiens
ttgtctgtgcttttccagttgct

SEQ ID NO: 7107125 - DNA, 22 bp, Homo sapiens
ctccagcaggtgcgtctcagag

SEQ ID NO: 7107126 - DNA, 22 bp, Homo sapiens
ctccagccagagtgcctctgtt

SEQ ID NO: 7107127 - DNA, 22 bp, Homo sapiens
ctccagcaggtgcgtctcagag

SEQ ID NO: 7107128 - DNA, 22 bp, Homo sapiens
ctccagccagagtgcctctgtt

SEQ ID NO: 7107129 - DNA, 22 bp, Homo sapiens
ctccagccagagtgcctctgtt

SEQ ID NO: 7107130 - DNA, 20 bp, Homo sapiens
ctccagcccctgccctggtc

SEQ ID NO: 7107131 - DNA, 20 bp, Homo sapiens
ctccagcccctgccctggtc

SEQ ID NO: 7107132 - DNA, 20 bp, Homo sapiens
ctccagcccctgccctggtc

SEQ ID NO: 7107133 - DNA, 20 bp, Homo sapiens
ctccagcccctgccctggtc

SEQ ID NO: 7107134 - DNA, 22 bp, Homo sapiens
ctccagcctcagatgacggtac

SEQ ID NO: 7107135 - DNA, 22 bp, Homo sapiens
ctccagcctcagatgacggtac

SEQ ID NO: 7107136 - DNA, 22 bp, Homo sapiens
ctccagcctcatctcctggctg

SEQ ID NO: 7107137 - DNA, 22 bp, Homo sapiens
ctccagcctcatctcctggctg

SEQ ID NO: 7107138 - DNA, 22 bp, Homo sapiens
ttgtattttgttatgctactgc

SEQ ID NO: 7107139 - DNA, 22 bp, Homo sapiens
ttgtattttgttatgctactgc

SEQ ID NO: 7107140 - DNA, 23 bp, Homo sapiens
ttgtatttttagtagagacaggg

SEQ ID NO: 7107141 - DNA, 23 bp, Homo sapiens
ttgtatttttagtagagacaggg

SEQ ID NO: 7107142 - DNA, 22 bp, Homo sapiens
ttgtctgtccaggcaccccaag

SEQ ID NO: 7107143 - DNA, 23 bp, Homo sapiens
ttgtatttttagtagagacaggg

SEQ ID NO: 7107144 - DNA, 22 bp, Homo sapiens
ttgtctgtcccagcttgtgcat

SEQ ID NO: 7107145 - DNA, 22 bp, Homo sapiens
ttgtgaaatcgtgtttggaagc

SEQ ID NO: 7107146 - DNA, 22 bp, Homo sapiens
ttgtgaaaagccgcaagtatag

SEQ ID NO: 7107147 - DNA, 22 bp, Homo sapiens
ttgtgaaaagccgcaagtatag

SEQ ID NO: 7107148 - DNA, 22 bp, Homo sapiens
ttgtgaaaagccgcaagtatag

SEQ ID NO: 7107149 - DNA, 22 bp, Homo sapiens
ttgtgaaaagccgcaagtatag

SEQ ID NO: 7107150 - DNA, 22 bp, Homo sapiens
ttgtgaaacattcatggatttg

SEQ ID NO: 7107151 - DNA, 22 bp, Homo sapiens
ttgtgaaacattcatggatttg

SEQ ID NO: 7107152 - DNA, 21 bp, Homo sapiens
ttgtgaaagtccaggaacaac

SEQ ID NO: 7107153 - DNA, 22 bp, Homo sapiens
ttgtgggccattcagctgctct

SEQ ID NO: 7107154 - DNA, 22 bp, Homo sapiens
ttgtgggcttgcctggctcttg

SEQ ID NO: 7107155 - DNA, 22 bp, Homo sapiens
ttgtgggcttgcctggctcttg

SEQ ID NO: 7107156 - DNA, 22 bp, Homo sapiens
ttgtggggaaacactgtttctt

SEQ ID NO: 7107157 - DNA, 22 bp, Homo sapiens
ttgtggggaacccctgtcccac

SEQ ID NO: 7107158 - DNA, 22 bp, Homo sapiens
ttgtggggaacccctgtcccac

SEQ ID NO: 7107159 - DNA, 22 bp, Homo sapiens
ttgtggggaacccctgtcccac

SEQ ID NO: 7107160 - DNA, 22 bp, Homo sapiens
ttgtggggaggatttgatgaga

SEQ ID NO: 7107161 - DNA, 22 bp, Homo sapiens
ttgtggggaggatttgatgaga

SEQ ID NO: 7107162 - DNA, 22 bp, Homo sapiens
ttgtggggcaacagcaggtgaa

SEQ ID NO: 7107163 - DNA, 22 bp, Homo sapiens
ttgtggggcaacagcaggtgaa

SEQ ID NO: 7107164 - DNA, 22 bp, Homo sapiens
ttgtggggcaacagcaggtgaa

SEQ ID NO: 7107165 - DNA, 22 bp, Homo sapiens
ttgtggggcaacagcaggtgaa

SEQ ID NO: 7107166 - DNA, 22 bp, Homo sapiens
ttgtggggcaacagcaggtgaa

SEQ ID NO: 7107167 - DNA, 22 bp, Homo sapiens
ttgtggggccccaatgttgctg

SEQ ID NO: 7107168 - DNA, 20 bp, Homo sapiens
ttgtgggggcaatggtatgc

SEQ ID NO: 7107169 - DNA, 20 bp, Homo sapiens
ttgtgggggcaatggtatgc

SEQ ID NO: 7107170 - DNA, 22 bp, Homo sapiens
ctccatggctttcgcatctgca

SEQ ID NO: 7107171 - DNA, 22 bp, Homo sapiens
ttgtgtaacttgagcaaacaca

SEQ ID NO: 7107172 - DNA, 22 bp, Homo sapiens
ttgtgtaattagcaaacaaatc

SEQ ID NO: 7107173 - DNA, 22 bp, Homo sapiens
ctccagtgcgtcttagtaaacc

SEQ ID NO: 7107174 - DNA, 22 bp, Homo sapiens
ttgtgtaacttgagcaaacaca

SEQ ID NO: 7107175 - DNA, 22 bp, Homo sapiens
ttgtgtaaaacctgtgatcttt

SEQ ID NO: 7107176 - DNA, 22 bp, Homo sapiens
ttgtggttaaccgcacattttt

SEQ ID NO: 7107177 - DNA, 22 bp, Homo sapiens
ttgtggggttggcagttcttta

SEQ ID NO: 7107178 - DNA, 22 bp, Homo sapiens
ttgtgggggctgccctgtacgg

SEQ ID NO: 7107179 - DNA, 22 bp, Homo sapiens
ttgtgggggctgccctgtacgg

SEQ ID NO: 7107180 - DNA, 22 bp, Homo sapiens
ttgtggggtgatttgccacggg

SEQ ID NO: 7107181 - DNA, 22 bp, Homo sapiens
ttgtggggtgatttgccacggg

SEQ ID NO: 7107182 - DNA, 22 bp, Homo sapiens
ttgtggggtgatttgccacggg

SEQ ID NO: 7107183 - DNA, 20 bp, Homo sapiens
ctccacacctgttcgcaggc

SEQ ID NO: 7107184 - DNA, 22 bp, Homo sapiens
ctccacagcccctccagtggca

SEQ ID NO: 7107185 - DNA, 22 bp, Homo sapiens
ctccacagcccctccagtggca

SEQ ID NO: 7107186 - DNA, 22 bp, Homo sapiens
ctccacagcccctccagtggca

SEQ ID NO: 7107187 - DNA, 22 bp, Homo sapiens
ctccacagcccctccagtggca

SEQ ID NO: 7107188 - DNA, 22 bp, Homo sapiens
ctccaaggttttccctgtcctt

SEQ ID NO: 7107189 - DNA, 22 bp, Homo sapiens
ctccacagcccctccagtggca

SEQ ID NO: 7107190 - DNA, 22 bp, Homo sapiens
ctccacagctcaggctcagagt

SEQ ID NO: 7107191 - DNA, 19 bp, Homo sapiens
ctccacagggattgtgatt

SEQ ID NO: 7107192 - DNA, 22 bp, Homo sapiens
ctccacaggtggtgtttgcttc

SEQ ID NO: 7107193 - DNA, 22 bp, Homo sapiens
ctccacaggtgtactgtacctt

SEQ ID NO: 7107194 - DNA, 20 bp, Homo sapiens
ctccaaattcctgaggataa

SEQ ID NO: 7107195 - DNA, 22 bp, Homo sapiens
ctccaacgaggctggggtacaa

SEQ ID NO: 7107196 - DNA, 22 bp, Homo sapiens
ctccaaggaagccccaagggat

SEQ ID NO: 7107197 - DNA, 20 bp, Homo sapiens
ctccaaggcttgcaggaggc

SEQ ID NO: 7107198 - DNA, 22 bp, Homo sapiens
ctccaagggtcttccaccagga

SEQ ID NO: 7107199 - DNA, 22 bp, Homo sapiens
ttgtacaaataggaacctctga

SEQ ID NO: 7107200 - DNA, 22 bp, Homo sapiens
ttgtaatttgcaaatgtattgt

SEQ ID NO: 7107201 - DNA, 22 bp, Homo sapiens
ttgtaatttgttcccaagcaga

SEQ ID NO: 7107202 - DNA, 22 bp, Homo sapiens
ttgtaatttttcatggtatcac

SEQ ID NO: 7107203 - DNA, 22 bp, Homo sapiens
ttgtaatttttcatggtatcac

SEQ ID NO: 7107204 - DNA, 22 bp, Homo sapiens
ttgtacaaagatttcacagctc

SEQ ID NO: 7107205 - DNA, 22 bp, Homo sapiens
ttgtaattgaacccttaggctt

SEQ ID NO: 7107206 - DNA, 22 bp, Homo sapiens
ttgtaattggacagccatcagg

SEQ ID NO: 7107207 - DNA, 22 bp, Homo sapiens
ttgtaattgggtggtttgggac

SEQ ID NO: 7107208 - DNA, 22 bp, Homo sapiens
ttgtaatttgcaaatgtattgt

SEQ ID NO: 7107209 - DNA, 22 bp, Homo sapiens
ttgtaatttgcaaatgtattgt

SEQ ID NO: 7107210 - DNA, 22 bp, Homo sapiens
ttgtaattaatggcagcaatta

SEQ ID NO: 7107211 - DNA, 22 bp, Homo sapiens
ttgtaatggagcaaacaggttg

SEQ ID NO: 7107212 - DNA, 22 bp, Homo sapiens
ttggtcagcactgatgtttcag

SEQ ID NO: 7107213 - DNA, 22 bp, Homo sapiens
ttgtaattaatggcagcaatta

SEQ ID NO: 7107214 - DNA, 22 bp, Homo sapiens
ttgtaattaatggcagcaatta

SEQ ID NO: 7107215 - DNA, 22 bp, Homo sapiens
ttgtaattactccaggggtaaa

SEQ ID NO: 7107216 - DNA, 22 bp, Homo sapiens
ttgtaattagtttttgatctgg

SEQ ID NO: 7107217 - DNA, 22 bp, Homo sapiens
ctccacagttgctgcttttaat

SEQ ID NO: 7107218 - DNA, 22 bp, Homo sapiens
ctccaccccgtgccggtgctgg

SEQ ID NO: 7107219 - DNA, 22 bp, Homo sapiens
ctccacggcccattgggcagga

SEQ ID NO: 7107220 - DNA, 22 bp, Homo sapiens
ctccacggcccattgggcagga

SEQ ID NO: 7107221 - DNA, 22 bp, Homo sapiens
ctccagatccagctgagctgca

SEQ ID NO: 7107222 - DNA, 22 bp, Homo sapiens
ttgtacaagtattatgtgaaca

SEQ ID NO: 7107223 - DNA, 22 bp, Homo sapiens
ctccagattcctgctggcagaa

SEQ ID NO: 7107224 - DNA, 22 bp, Homo sapiens
ctccagattctggatgactggg

SEQ ID NO: 7107225 - DNA, 22 bp, Homo sapiens
ctccagcagaaagggcgagtgg

SEQ ID NO: 7107226 - DNA, 22 bp, Homo sapiens
ttgtacaacacatattctacag

SEQ ID NO: 7107227 - DNA, 22 bp, Homo sapiens
ttgtacaaatgcatattcctgg

SEQ ID NO: 7107228 - DNA, 22 bp, Homo sapiens
ttgtacaacgttttaaatttga

SEQ ID NO: 7107229 - DNA, 22 bp, Homo sapiens
ttgtacaacgttttaaatttga

SEQ ID NO: 7107230 - DNA, 22 bp, Homo sapiens
ttgtacaacgttttaaatttga

SEQ ID NO: 7107231 - DNA, 22 bp, Homo sapiens
ctcatttactactcatgtgacc

SEQ ID NO: 7107232 - DNA, 22 bp, Homo sapiens
ctcatttactcatctgcaaaac

SEQ ID NO: 7107233 - DNA, 22 bp, Homo sapiens
ctcatttactgtagaacagtta

SEQ ID NO: 7107234 - DNA, 22 bp, Homo sapiens
ctcatttagggggcatggtaca

SEQ ID NO: 7107235 - DNA, 22 bp, Homo sapiens
ctcatttagggggcatggtaca

SEQ ID NO: 7107236 - DNA, 22 bp, Homo sapiens
ctcatttatccaaaagccagtt

SEQ ID NO: 7107237 - DNA, 22 bp, Homo sapiens
ctcatttacactatgggaacta

SEQ ID NO: 7107238 - DNA, 22 bp, Homo sapiens
ctcatttacctttgcaatcaag

SEQ ID NO: 7107239 - DNA, 22 bp, Homo sapiens
ctcatttatgtaatgattaagg

SEQ ID NO: 7107240 - DNA, 22 bp, Homo sapiens
ctcatttatttctcccaaaaca

SEQ ID NO: 7107241 - DNA, 21 bp, Homo sapiens
ctcatttatttttgtgtccaa

SEQ ID NO: 7107242 - DNA, 22 bp, Homo sapiens
ctcatttgtaattagttctcag

SEQ ID NO: 7107243 - DNA, 22 bp, Homo sapiens
ctcatttgttacaattcatact

SEQ ID NO: 7107244 - DNA, 22 bp, Homo sapiens
ctcatttgttggcctagagtgg

SEQ ID NO: 7107245 - DNA, 22 bp, Homo sapiens
ctccaaaggataaaagcagagt

SEQ ID NO: 7107246 - DNA, 22 bp, Homo sapiens
ctccaaatacaatattgttgtt

SEQ ID NO: 7107247 - DNA, 22 bp, Homo sapiens
ctccaaatacagtcatcttggg

SEQ ID NO: 7107248 - DNA, 23 bp, Homo sapiens
ctccaaatactcccaattgtttt

SEQ ID NO: 7107249 - DNA, 19 bp, Homo sapiens
ctccaaatacttttccctt

SEQ ID NO: 7107250 - DNA, 22 bp, Homo sapiens
ctccaaatataatcacattgga

SEQ ID NO: 7107251 - DNA, 22 bp, Homo sapiens
ctccaaattcagtcacagtctg

SEQ ID NO: 7107252 - DNA, 22 bp, Homo sapiens
ctcatctgtctgggctggtttt

SEQ ID NO: 7107253 - DNA, 22 bp, Homo sapiens
ctcatttaacagattaaaaagt

SEQ ID NO: 7107254 - DNA, 22 bp, Homo sapiens
ctcatctgtatatagtgaatga

SEQ ID NO: 7107255 - DNA, 22 bp, Homo sapiens
ctcatctggcttcagtaacagt

SEQ ID NO: 7107256 - DNA, 22 bp, Homo sapiens
ttgaaatactgcattgttcagt

SEQ ID NO: 7107257 - DNA, 22 bp, Homo sapiens
ttgaaatactgcattgttcagt

SEQ ID NO: 7107258 - DNA, 22 bp, Homo sapiens
ttgaaatactgcattgttcagt

SEQ ID NO: 7107259 - DNA, 22 bp, Homo sapiens
ttgaaagtagcagctgcatatg

SEQ ID NO: 7107260 - DNA, 22 bp, Homo sapiens
ttgaaagtagcagctgcatatg

SEQ ID NO: 7107261 - DNA, 22 bp, Homo sapiens
ttgaaagtctaggcttacagta

SEQ ID NO: 7107262 - DNA, 22 bp, Homo sapiens
ttgaaagtctaggcttacagta

SEQ ID NO: 7107263 - DNA, 22 bp, Homo sapiens
ttgaaagtctctgcatgtagga

SEQ ID NO: 7107264 - DNA, 22 bp, Homo sapiens
ttgaaagtctctgcatgtagga

SEQ ID NO: 7107265 - DNA, 22 bp, Homo sapiens
ttgaaatactgcattgttcagt

SEQ ID NO: 7107266 - DNA, 22 bp, Homo sapiens
ttgaaatactgcattgttcagt

SEQ ID NO: 7107267 - DNA, 22 bp, Homo sapiens
ctcacaggttagttgtgtggat

SEQ ID NO: 7107268 - DNA, 22 bp, Homo sapiens
ctcacaggttagttgtgtggat

SEQ ID NO: 7107269 - DNA, 22 bp, Homo sapiens
ttctttcttagcaatctatggt

SEQ ID NO: 7107270 - DNA, 22 bp, Homo sapiens
ttctttcttagcaatctatggt

SEQ ID NO: 7107271 - DNA, 22 bp, Homo sapiens
ttctttcttagcaatctatggt

SEQ ID NO: 7107272 - DNA, 22 bp, Homo sapiens
ttcttttaatttctgtctgcag

SEQ ID NO: 7107273 - DNA, 22 bp, Homo sapiens
ttcttttacattaagatttcag

SEQ ID NO: 7107274 - DNA, 22 bp, Homo sapiens
ttcttttacattaagatttcag

SEQ ID NO: 7107275 - DNA, 22 bp, Homo sapiens
ttcttttaatttctgtctgcag

SEQ ID NO: 7107276 - DNA, 22 bp, Homo sapiens
ttcttttaatttctgtctgcag

SEQ ID NO: 7107277 - DNA, 22 bp, Homo sapiens
ttcttttaatttctgtctgcag

SEQ ID NO: 7107278 - DNA, 22 bp, Homo sapiens
ttcttttacattaagatttcag

SEQ ID NO: 7107279 - DNA, 22 bp, Homo sapiens
ttcttttagaatttcctaaggt

SEQ ID NO: 7107280 - DNA, 22 bp, Homo sapiens
ttcttttcaagaggggcaagga

SEQ ID NO: 7107281 - DNA, 22 bp, Homo sapiens
ttgaaaggtgctgtgtgctgat

SEQ ID NO: 7107282 - DNA, 21 bp, Homo sapiens
ttgaaagtaaattcagcagct

SEQ ID NO: 7107283 - DNA, 22 bp, Homo sapiens
ttgaaaggtgacattgttagag

SEQ ID NO: 7107284 - DNA, 22 bp, Homo sapiens
ttgaaaggtgaacatgatgcac

SEQ ID NO: 7107285 - DNA, 23 bp, Homo sapiens
ttgaaaggtagctggcagctaga

SEQ ID NO: 7107286 - DNA, 23 bp, Homo sapiens
ttgaaaggtagctggcagctaga

SEQ ID NO: 7107287 - DNA, 22 bp, Homo sapiens
ttcttttcggcctgtgagaagg

SEQ ID NO: 7107288 - DNA, 22 bp, Homo sapiens
ttcttttcggcctgtgagaagg

SEQ ID NO: 7107289 - DNA, 22 bp, Homo sapiens
ttcttttcctgtggctcatcca

SEQ ID NO: 7107290 - DNA, 22 bp, Homo sapiens
ttcttttcccaatattttgctg

SEQ ID NO: 7107291 - DNA, 22 bp, Homo sapiens
ttcttttcctacacagcgattt

SEQ ID NO: 7107292 - DNA, 22 bp, Homo sapiens
ttcttttcctacacagcgattt

SEQ ID NO: 7107293 - DNA, 18 bp, Homo sapiens
ttcttttcatgtgatctc

SEQ ID NO: 7107294 - DNA, 18 bp, Homo sapiens
ttcttttcatgtgatctc

SEQ ID NO: 7107295 - DNA, 22 bp, Homo sapiens
ttcttttcccaatattttgctg

SEQ ID NO: 7107296 - DNA, 22 bp, Homo sapiens
ttcttttcccaatattttgctg

SEQ ID NO: 7107297 - DNA, 19 bp, Homo sapiens
ctattagcttgggcatcat

SEQ ID NO: 7107298 - DNA, 19 bp, Homo sapiens
ctattagcttgggcatcat

SEQ ID NO: 7107299 - DNA, 22 bp, Homo sapiens
ctattaggcttccatttcatgc

SEQ ID NO: 7107300 - DNA, 22 bp, Homo sapiens
ctattaggtatgcagcctattt

SEQ ID NO: 7107301 - DNA, 22 bp, Homo sapiens
ctattaggtatgtggttgctat

SEQ ID NO: 7107302 - DNA, 22 bp, Homo sapiens
ctattaggttggtgcaaaagta

SEQ ID NO: 7107303 - DNA, 22 bp, Homo sapiens
ctattagttaggaagacaagca

SEQ ID NO: 7107304 - DNA, 22 bp, Homo sapiens
ctattattaatgtggggctttg

SEQ ID NO: 7107305 - DNA, 22 bp, Homo sapiens
ctattagacacaattagtgatt

SEQ ID NO: 7107306 - DNA, 17 bp, Homo sapiens
ctattactcccaagtaa

SEQ ID NO: 7107307 - DNA, 22 bp, Homo sapiens
ctattactgacttctgtattta

SEQ ID NO: 7107308 - DNA, 22 bp, Homo sapiens
ctattagctgaataatgcattg

SEQ ID NO: 7107309 - DNA, 22 bp, Homo sapiens
ctattagctgaataatgcattg

SEQ ID NO: 7107310 - DNA, 22 bp, Homo sapiens
ctattagaaagcatcttctata

SEQ ID NO: 7107311 - DNA, 22 bp, Homo sapiens
ctattactgacttctgtattta

SEQ ID NO: 7107312 - DNA, 22 bp, Homo sapiens
ctattatttcctcatctataaa

SEQ ID NO: 7107313 - DNA, 22 bp, Homo sapiens
ctatttttctgtaccctaattt

SEQ ID NO: 7107314 - DNA, 22 bp, Homo sapiens
ctcaaaagacttaaacataaga

SEQ ID NO: 7107315 - DNA, 22 bp, Homo sapiens
ctcaaaagacttaaacataaga

SEQ ID NO: 7107316 - DNA, 22 bp, Homo sapiens
ctcaaaatccataaaatcaggt

SEQ ID NO: 7107317 - DNA, 22 bp, Homo sapiens
ctcaaaatccataaaatcaggt

SEQ ID NO: 7107318 - DNA, 22 bp, Homo sapiens
ctcaaaatccataaaatcaggt

SEQ ID NO: 7107319 - DNA, 22 bp, Homo sapiens
ctattattatcctaatttctgt

SEQ ID NO: 7107320 - DNA, 22 bp, Homo sapiens
ctattattatcctaatttctgt

SEQ ID NO: 7107321 - DNA, 22 bp, Homo sapiens
ctattattatcctaatttctgt

SEQ ID NO: 7107322 - DNA, 22 bp, Homo sapiens
ctattattatgttaactggact

SEQ ID NO: 7107323 - DNA, 22 bp, Homo sapiens
ctattattatgttaactggact

SEQ ID NO: 7107324 - DNA, 22 bp, Homo sapiens
ctattatttcctcatctataaa

SEQ ID NO: 7107325 - DNA, 22 bp, Homo sapiens
ctattatttcctcatctataaa

SEQ ID NO: 7107326 - DNA, 22 bp, Homo sapiens
ctcaagtctgatgggttaggtt

SEQ ID NO: 7107327 - DNA, 22 bp, Homo sapiens
ctcaagtctattgataagtgca

SEQ ID NO: 7107328 - DNA, 22 bp, Homo sapiens
ctcaagtctgagtactggctct

SEQ ID NO: 7107329 - DNA, 22 bp, Homo sapiens
ctcaagttggcatgaacaaatt

SEQ ID NO: 7107330 - DNA, 22 bp, Homo sapiens
ctcaagtttcatatttgtctag

SEQ ID NO: 7107331 - DNA, 22 bp, Homo sapiens
ctcaagtcagaaataaaagcat

SEQ ID NO: 7107332 - DNA, 22 bp, Homo sapiens
ctcaagtccatagaatcaggaa

SEQ ID NO: 7107333 - DNA, 22 bp, Homo sapiens
ctcaagtaagaaacagaattgg

SEQ ID NO: 7107334 - DNA, 22 bp, Homo sapiens
ctcaagtaagaaacagaattgg

SEQ ID NO: 7107335 - DNA, 22 bp, Homo sapiens
ctcaagtaattagcaacaaata

SEQ ID NO: 7107336 - DNA, 22 bp, Homo sapiens
ctcaaaatggttaattttaata

SEQ ID NO: 7107337 - DNA, 22 bp, Homo sapiens
ctcaagaggatatgtccagaaa

SEQ ID NO: 7107338 - DNA, 22 bp, Homo sapiens
ctcaagaggatatgtccagaaa

SEQ ID NO: 7107339 - DNA, 22 bp, Homo sapiens
ctcaagataatgacaaaaagag

SEQ ID NO: 7107340 - DNA, 22 bp, Homo sapiens
ctcaagatattccagctctcaa

SEQ ID NO: 7107341 - DNA, 22 bp, Homo sapiens
ctcaagatattccagctctcaa

SEQ ID NO: 7107342 - DNA, 22 bp, Homo sapiens
ctcaagatcacacagctgagaa

SEQ ID NO: 7107343 - DNA, 22 bp, Homo sapiens
ctcaagatcatcaatataccaa

SEQ ID NO: 7107344 - DNA, 22 bp, Homo sapiens
ctcaagatgtcagggcacctgc

SEQ ID NO: 7107345 - DNA, 22 bp, Homo sapiens
ctcaagcctgctgagttttgga

SEQ ID NO: 7107346 - DNA, 22 bp, Homo sapiens
ctcaaggaaagtctggagaaga

SEQ ID NO: 7107347 - DNA, 22 bp, Homo sapiens
ctcaaggacttattcatgcctg

SEQ ID NO: 7107348 - DNA, 22 bp, Homo sapiens
ctcaaggccagttcttctgact

SEQ ID NO: 7107349 - DNA, 22 bp, Homo sapiens
ctcacaggagaaagtcatggtc

SEQ ID NO: 7107350 - DNA, 22 bp, Homo sapiens
ctcacagcaaggaggtaaggta

SEQ ID NO: 7107351 - DNA, 22 bp, Homo sapiens
ctcacagcagccagtctgcctt

SEQ ID NO: 7107352 - DNA, 22 bp, Homo sapiens
ctcacagcagctctgcgagata

SEQ ID NO: 7107353 - DNA, 22 bp, Homo sapiens
ctcacagcagctctgcgagata

SEQ ID NO: 7107354 - DNA, 21 bp, Homo sapiens
ctcacaggatgcagtgttact

SEQ ID NO: 7107355 - DNA, 22 bp, Homo sapiens
ctcacaggcatctcatcaggct

SEQ ID NO: 7107356 - DNA, 22 bp, Homo sapiens
ctcacaggcatctcatcaggct

SEQ ID NO: 7107357 - DNA, 22 bp, Homo sapiens
ctcacaggcggtaattcaggga

SEQ ID NO: 7107358 - DNA, 22 bp, Homo sapiens
ctcacagggttctatcgaagag

SEQ ID NO: 7107359 - DNA, 22 bp, Homo sapiens
ctcacaggtaccagcaccctcc

SEQ ID NO: 7107360 - DNA, 22 bp, Homo sapiens
ctcacaggtaccagcaccctcc

SEQ ID NO: 7107361 - DNA, 22 bp, Homo sapiens
ctcacaggtcatgtggtggctt

SEQ ID NO: 7107362 - DNA, 22 bp, Homo sapiens
ctcacacacgaagcccttggcc

SEQ ID NO: 7107363 - DNA, 22 bp, Homo sapiens
ctcacaccagcttacaagactt

SEQ ID NO: 7107364 - DNA, 22 bp, Homo sapiens
ctcaatatgccagaggggaaag

SEQ ID NO: 7107365 - DNA, 22 bp, Homo sapiens
ctcacacacgaagcccttggcc

SEQ ID NO: 7107366 - DNA, 22 bp, Homo sapiens
ctcacactgtgccaaatccttt

SEQ ID NO: 7107367 - DNA, 22 bp, Homo sapiens
ctcacacttcccaccctcctgg

SEQ ID NO: 7107368 - DNA, 22 bp, Homo sapiens
ctcacagagctcatactgggag

SEQ ID NO: 7107369 - DNA, 22 bp, Homo sapiens
ctcacagagcctctgtgtcttc

SEQ ID NO: 7107370 - DNA, 22 bp, Homo sapiens
ctcacagagctcatactgggag

SEQ ID NO: 7107371 - DNA, 22 bp, Homo sapiens
ctcacagatacggctattcctg

SEQ ID NO: 7107372 - DNA, 22 bp, Homo sapiens
ctcacagatatttgcttcaggt

SEQ ID NO: 7107373 - DNA, 22 bp, Homo sapiens
ctcacagatatttgcttcaggt

SEQ ID NO: 7107374 - DNA, 22 bp, Homo sapiens
ctcacagatctgtgcctgaacc

SEQ ID NO: 7107375 - DNA, 22 bp, Homo sapiens
ctcacagatgatgtctatgtgg

SEQ ID NO: 7107376 - DNA, 22 bp, Homo sapiens
ctcacagatgtcctggcacttc

SEQ ID NO: 7107377 - DNA, 22 bp, Homo sapiens
ctcacagatgtcctggcacttc

SEQ ID NO: 7107378 - DNA, 22 bp, Homo sapiens
ctcacagatgtcctggcacttc

SEQ ID NO: 7107379 - DNA, 22 bp, Homo sapiens
ctcacagatgttctcctttagg

SEQ ID NO: 7107380 - DNA, 22 bp, Homo sapiens
ttctctggcctgaggcgaggcc

SEQ ID NO: 7107381 - DNA, 22 bp, Homo sapiens
ttctctggccatagctggctag

SEQ ID NO: 7107382 - DNA, 22 bp, Homo sapiens
ttctctggcgcgctgtgctatg

SEQ ID NO: 7107383 - DNA, 22 bp, Homo sapiens
ttctctggcgcgctgtgctatg

SEQ ID NO: 7107384 - DNA, 22 bp, Homo sapiens
ttctctggcgcgctgtgctatg

SEQ ID NO: 7107385 - DNA, 22 bp, Homo sapiens
ttctctggcggtgtgttttcct

SEQ ID NO: 7107386 - DNA, 22 bp, Homo sapiens
ttctctggccatagctggctag

SEQ ID NO: 7107387 - DNA, 22 bp, Homo sapiens
ttctctggatgtttctcagtca

SEQ ID NO: 7107388 - DNA, 22 bp, Homo sapiens
ttctctggccatagctggctag

SEQ ID NO: 7107389 - DNA, 22 bp, Homo sapiens
ttctctggatgtttctcagtca

SEQ ID NO: 7107390 - DNA, 22 bp, Homo sapiens
ctagcacagtatggtatcagat

SEQ ID NO: 7107391 - DNA, 22 bp, Homo sapiens
ctagcacagcccattcagtcta

SEQ ID NO: 7107392 - DNA, 22 bp, Homo sapiens
ctagcacagtatggtatcagat

SEQ ID NO: 7107393 - DNA, 22 bp, Homo sapiens
ctagatttctagttcattatcc

SEQ ID NO: 7107394 - DNA, 22 bp, Homo sapiens
ctagatttctagttcattatcc

SEQ ID NO: 7107395 - DNA, 22 bp, Homo sapiens
ctagatttgcatgcctacacca

SEQ ID NO: 7107396 - DNA, 22 bp, Homo sapiens
ttctctggcggtgtgttttcct

SEQ ID NO: 7107397 - DNA, 21 bp, Homo sapiens
ttctctggcttctgtagctgg

SEQ ID NO: 7107398 - DNA, 21 bp, Homo sapiens
ttctctggcttctgtagctgg

SEQ ID NO: 7107399 - DNA, 21 bp, Homo sapiens
ttctctggcttctgtagctgg

SEQ ID NO: 7107400 - DNA, 21 bp, Homo sapiens
ttctctggcttctgtagctgg

SEQ ID NO: 7107401 - DNA, 22 bp, Homo sapiens
ttctctgggaacataaatgaag

SEQ ID NO: 7107402 - DNA, 22 bp, Homo sapiens
ctagatgccaatttttatggat

SEQ ID NO: 7107403 - DNA, 22 bp, Homo sapiens
ctagcagaagctccttgagggt

SEQ ID NO: 7107404 - DNA, 22 bp, Homo sapiens
ctagcaggctaatgtaagcttg

SEQ ID NO: 7107405 - DNA, 22 bp, Homo sapiens
ctagcagggattgggcactggg

SEQ ID NO: 7107406 - DNA, 22 bp, Homo sapiens
ctagcagggattgggcactggg

SEQ ID NO: 7107407 - DNA, 22 bp, Homo sapiens
ctagcagggtcgacgtctggcg

SEQ ID NO: 7107408 - DNA, 22 bp, Homo sapiens
ctagcagggattgggcactggg

SEQ ID NO: 7107409 - DNA, 22 bp, Homo sapiens
ctagcaggtcaaaccagctgat

SEQ ID NO: 7107410 - DNA, 22 bp, Homo sapiens
ctagcaggtcaaaccagctgat

SEQ ID NO: 7107411 - DNA, 22 bp, Homo sapiens
ctagcaggtcaaaccagctgat

SEQ ID NO: 7107412 - DNA, 22 bp, Homo sapiens
ctagcaggtcaaaccagctgat

SEQ ID NO: 7107413 - DNA, 22 bp, Homo sapiens
ctagccagactcaagggccacc

SEQ ID NO: 7107414 - DNA, 22 bp, Homo sapiens
ctagccagactcaagggccacc

SEQ ID NO: 7107415 - DNA, 22 bp, Homo sapiens
ctagccagatgattcccaaata

SEQ ID NO: 7107416 - DNA, 22 bp, Homo sapiens
ctagccagatgattcccaaata

SEQ ID NO: 7107417 - DNA, 22 bp, Homo sapiens
ctagccagatttaaagagagac

SEQ ID NO: 7107418 - DNA, 22 bp, Homo sapiens
ctagccagatttaaagagagac

SEQ ID NO: 7107419 - DNA, 22 bp, Homo sapiens
ctagccataccaggattaacaa

SEQ ID NO: 7107420 - DNA, 22 bp, Homo sapiens
ctatatatatcatcttccagtt

SEQ ID NO: 7107421 - DNA, 23 bp, Homo sapiens
ctatggttttaaaggtggatatc

SEQ ID NO: 7107422 - DNA, 22 bp, Homo sapiens
ctatggctcaattctagtggtt

SEQ ID NO: 7107423 - DNA, 22 bp, Homo sapiens
ctatggctccttctctactggg

SEQ ID NO: 7107424 - DNA, 23 bp, Homo sapiens
ctatggaataccaatgattctca

SEQ ID NO: 7107425 - DNA, 23 bp, Homo sapiens
ctatggaataccaatgattctca

SEQ ID NO: 7107426 - DNA, 22 bp, Homo sapiens
ctatggaaacctaatcaggaga

SEQ ID NO: 7107427 - DNA, 22 bp, Homo sapiens
ctatggaaactcaacatttgtt

SEQ ID NO: 7107428 - DNA, 22 bp, Homo sapiens
ctatggaaacctaatcaggaga

SEQ ID NO: 7107429 - DNA, 22 bp, Homo sapiens
ctatggaaactcaacatttgtt

SEQ ID NO: 7107430 - DNA, 22 bp, Homo sapiens
ctatggaagggatgcaaagaaa

SEQ ID NO: 7107431 - DNA, 22 bp, Homo sapiens
ctatgcagaatttagtgactta

SEQ ID NO: 7107432 - DNA, 22 bp, Homo sapiens
ctatgcttcagagttccaggtg

SEQ ID NO: 7107433 - DNA, 22 bp, Homo sapiens
ctattaaatactcttcaaattg

SEQ ID NO: 7107434 - DNA, 22 bp, Homo sapiens
ctattacaatctgctactatga

SEQ ID NO: 7107435 - DNA, 22 bp, Homo sapiens
ctattacaatctgctactatga

SEQ ID NO: 7107436 - DNA, 22 bp, Homo sapiens
ctattaaatactcttcaaattg

SEQ ID NO: 7107437 - DNA, 22 bp, Homo sapiens
ctattaaatactcttcaaattg

SEQ ID NO: 7107438 - DNA, 22 bp, Homo sapiens
ctattacagggaagccttggga

SEQ ID NO: 7107439 - DNA, 22 bp, Homo sapiens
ctacttgttcactgtaggtcgc

SEQ ID NO: 7107440 - DNA, 22 bp, Homo sapiens
ctacttctgtgatgaaactaca

SEQ ID NO: 7107441 - DNA, 22 bp, Homo sapiens
ctactttacctccatcagactg

SEQ ID NO: 7107442 - DNA, 22 bp, Homo sapiens
ctagaaaaatactttattgtga

SEQ ID NO: 7107443 - DNA, 22 bp, Homo sapiens
ctagaaaaatactttattgtga

SEQ ID NO: 7107444 - DNA, 22 bp, Homo sapiens
ctacttctgtggctctaagaga

SEQ ID NO: 7107445 - DNA, 22 bp, Homo sapiens
ctacttgttcactgtaggtcgc

SEQ ID NO: 7107446 - DNA, 22 bp, Homo sapiens
ctacttctaagtacatggtgat

SEQ ID NO: 7107447 - DNA, 21 bp, Homo sapiens
ctacttaagtaggggattagg

SEQ ID NO: 7107448 - DNA, 22 bp, Homo sapiens
ctacttagagacatgctaacat

SEQ ID NO: 7107449 - DNA, 21 bp, Homo sapiens
ctacttaagtaggggattagg

SEQ ID NO: 7107450 - DNA, 22 bp, Homo sapiens
ttctctggatgtttctcagtca

SEQ ID NO: 7107451 - DNA, 22 bp, Homo sapiens
ttctctggatgtttctcagtca

SEQ ID NO: 7107452 - DNA, 21 bp, Homo sapiens
ttctctggataggccagtcct

SEQ ID NO: 7107453 - DNA, 21 bp, Homo sapiens
ttctctggataggccagtcct

SEQ ID NO: 7107454 - DNA, 21 bp, Homo sapiens
ttctctggataggccagtcct

SEQ ID NO: 7107455 - DNA, 20 bp, Homo sapiens
ttctctggatagccagatgt

SEQ ID NO: 7107456 - DNA, 22 bp, Homo sapiens
ttctctggagggctgcccggcc

SEQ ID NO: 7107457 - DNA, 20 bp, Homo sapiens
ttctctggatagccagatgt

SEQ ID NO: 7107458 - DNA, 22 bp, Homo sapiens
ttctctggactatttgcactcc

SEQ ID NO: 7107459 - DNA, 22 bp, Homo sapiens
ttctctggagagtatcttctta

SEQ ID NO: 7107460 - DNA, 22 bp, Homo sapiens
ttctctggagagtatcttctta

SEQ ID NO: 7107461 - DNA, 22 bp, Homo sapiens
ttctctggagagtatcttctta

SEQ ID NO: 7107462 - DNA, 22 bp, Homo sapiens
ttctctggagggctgcccggcc

SEQ ID NO: 7107463 - DNA, 22 bp, Homo sapiens
ttctctaaaattaagtgaggta

SEQ ID NO: 7107464 - DNA, 22 bp, Homo sapiens
ttctctaaacatattggatctg

SEQ ID NO: 7107465 - DNA, 22 bp, Homo sapiens
ttctctaaacatattggatctg

SEQ ID NO: 7107466 - DNA, 22 bp, Homo sapiens
ttctctaaagagttaggccaag

SEQ ID NO: 7107467 - DNA, 22 bp, Homo sapiens
ttctctaaatgtgaaccggctt

SEQ ID NO: 7107468 - DNA, 22 bp, Homo sapiens
ttctctaagagatgcagaagtt

SEQ ID NO: 7107469 - DNA, 22 bp, Homo sapiens
ttctctggactatttgcactcc

SEQ ID NO: 7107470 - DNA, 22 bp, Homo sapiens
ttctctggactatttgcactcc

SEQ ID NO: 7107471 - DNA, 22 bp, Homo sapiens
ctagaaacattacatgtgttaa

SEQ ID NO: 7107472 - DNA, 22 bp, Homo sapiens
ctagaaacgcctttagcacaac

SEQ ID NO: 7107473 - DNA, 21 bp, Homo sapiens
ctagaaagaatgttgtcgtct

SEQ ID NO: 7107474 - DNA, 22 bp, Homo sapiens
ttctccttttccagttcccagt

SEQ ID NO: 7107475 - DNA, 22 bp, Homo sapiens
ttctccttttccagttcccagt

SEQ ID NO: 7107476 - DNA, 22 bp, Homo sapiens
ctagaaactccatctcactaca

SEQ ID NO: 7107477 - DNA, 22 bp, Homo sapiens
ctactgccattgtctctgccat

SEQ ID NO: 7107478 - DNA, 22 bp, Homo sapiens
ctactgtaatagatgaatttga

SEQ ID NO: 7107479 - DNA, 22 bp, Homo sapiens
ctactgtatgtgttctctagtc

SEQ ID NO: 7107480 - DNA, 22 bp, Homo sapiens
ctactgtctcatcagtgttatt

SEQ ID NO: 7107481 - DNA, 21 bp, Homo sapiens
ctactgtgagacacaaagtgc

SEQ ID NO: 7107482 - DNA, 22 bp, Homo sapiens
ctactagatcagtatgcctcaa

SEQ ID NO: 7107483 - DNA, 22 bp, Homo sapiens
ctacctttctgactcttgggat

SEQ ID NO: 7107484 - DNA, 22 bp, Homo sapiens
ctactatttgtcctttataagc

SEQ ID NO: 7107485 - DNA, 22 bp, Homo sapiens
ctactataaaatacacatctgt

SEQ ID NO: 7107486 - DNA, 22 bp, Homo sapiens
ctactctcccatgattctctgt

SEQ ID NO: 7107487 - DNA, 22 bp, Homo sapiens
ctactctcccatgattctctgt

SEQ ID NO: 7107488 - DNA, 22 bp, Homo sapiens
ctactctgaattgaagtgatat

SEQ ID NO: 7107489 - DNA, 22 bp, Homo sapiens
ctactctgtggtgtatttgcat

SEQ ID NO: 7107490 - DNA, 22 bp, Homo sapiens
ctactcttttgagtcttcagat

SEQ ID NO: 7107491 - DNA, 22 bp, Homo sapiens
ctactgaaactcagaaattcaa

SEQ ID NO: 7107492 - DNA, 22 bp, Homo sapiens
ctactgaagataactggctctt

SEQ ID NO: 7107493 - DNA, 22 bp, Homo sapiens
ctactgaattagactgcatttt

SEQ ID NO: 7107494 - DNA, 21 bp, Homo sapiens
ttcctggggaaggagctgcct

SEQ ID NO: 7107495 - DNA, 22 bp, Homo sapiens
ttcctgggctgcagagagcacc

SEQ ID NO: 7107496 - DNA, 22 bp, Homo sapiens
ttcctgggctctggctggccta

SEQ ID NO: 7107497 - DNA, 22 bp, Homo sapiens
ctacatttcatccagggagagc

SEQ ID NO: 7107498 - DNA, 22 bp, Homo sapiens
ctaccctgtatttagagatgca

SEQ ID NO: 7107499 - DNA, 22 bp, Homo sapiens
ctacccaggcttagagggctgg

SEQ ID NO: 7107500 - DNA, 22 bp, Homo sapiens
ctacccaggcttagagggctgg

SEQ ID NO: 7107501 - DNA, 22 bp, Homo sapiens
ctacccttaagtttctgtgggg

SEQ ID NO: 7107502 - DNA, 22 bp, Homo sapiens
ctacccttaagtttctgtgggg

SEQ ID NO: 7107503 - DNA, 22 bp, Homo sapiens
ctacccttaagtttctgtgggg

SEQ ID NO: 7107504 - DNA, 22 bp, Homo sapiens
ctacctgaaaaggttgtggtga

SEQ ID NO: 7107505 - DNA, 22 bp, Homo sapiens
ctaaatgacttccagtggttat

SEQ ID NO: 7107506 - DNA, 22 bp, Homo sapiens
ctaaatgacttccagtggttat

SEQ ID NO: 7107507 - DNA, 22 bp, Homo sapiens
ctaaatgacaggtaccatagtg

SEQ ID NO: 7107508 - DNA, 22 bp, Homo sapiens
ctaaatgatattttggtttcct

SEQ ID NO: 7107509 - DNA, 22 bp, Homo sapiens
ttccaggactcgttctggctca

SEQ ID NO: 7107510 - DNA, 22 bp, Homo sapiens
ctacagagtatctaaagaggta

SEQ ID NO: 7107511 - DNA, 22 bp, Homo sapiens
ctacagaggacacaaagatctt

SEQ ID NO: 7107512 - DNA, 22 bp, Homo sapiens
ctacagaggacacaaagatctt

SEQ ID NO: 7107513 - DNA, 22 bp, Homo sapiens
ctacaacaccaggcacggagtg

SEQ ID NO: 7107514 - DNA, 22 bp, Homo sapiens
ctacaacatagtcttctacaga

SEQ ID NO: 7107515 - DNA, 22 bp, Homo sapiens
ctacaacatagtcttctacaga

SEQ ID NO: 7107516 - DNA, 22 bp, Homo sapiens
ctacaggaaggatcttgctcaa

SEQ ID NO: 7107517 - DNA, 22 bp, Homo sapiens
ctacagctgtgtgtttatgtgc

SEQ ID NO: 7107518 - DNA, 22 bp, Homo sapiens
ctacagctggccttggaaaact

SEQ ID NO: 7107519 - DNA, 22 bp, Homo sapiens
ctacagagtgaatgcagaaaat

SEQ ID NO: 7107520 - DNA, 22 bp, Homo sapiens
ctacagagtatctaaagaggta

SEQ ID NO: 7107521 - DNA, 22 bp, Homo sapiens
ctacagagtatctaaagaggta

SEQ ID NO: 7107522 - DNA, 22 bp, Homo sapiens
ctacagcagagaccagccacat

SEQ ID NO: 7107523 - DNA, 22 bp, Homo sapiens
ctacagcagagctacactaact

SEQ ID NO: 7107524 - DNA, 22 bp, Homo sapiens
ctacaggctcagggagccctct

SEQ ID NO: 7107525 - DNA, 22 bp, Homo sapiens
ctacaggctcagggagccctct

SEQ ID NO: 7107526 - DNA, 22 bp, Homo sapiens
ctacaggagggtgtgttgggcg

SEQ ID NO: 7107527 - DNA, 22 bp, Homo sapiens
ctacaggtatgtgcatgacatc

SEQ ID NO: 7107528 - DNA, 22 bp, Homo sapiens
ctacaggtatgtgcatgacatc

SEQ ID NO: 7107529 - DNA, 22 bp, Homo sapiens
ctacaggtcaagcagtagctct

SEQ ID NO: 7107530 - DNA, 22 bp, Homo sapiens
ctacaggtcagtaagacctaga

SEQ ID NO: 7107531 - DNA, 23 bp, Homo sapiens
ctacaggttaattttcagtggaa

SEQ ID NO: 7107532 - DNA, 23 bp, Homo sapiens
ctacaggttaattttcagtggaa

SEQ ID NO: 7107533 - DNA, 22 bp, Homo sapiens
ctacagtagagaggatgtagaa

SEQ ID NO: 7107534 - DNA, 22 bp, Homo sapiens
ctacagtagaggttgtcaggga

SEQ ID NO: 7107535 - DNA, 22 bp, Homo sapiens
ctacagtatgaaacctttactc

SEQ ID NO: 7107536 - DNA, 22 bp, Homo sapiens
ttcctgggctctggctggccta

SEQ ID NO: 7107537 - DNA, 22 bp, Homo sapiens
ttcctgggctgcagagagcacc

SEQ ID NO: 7107538 - DNA, 22 bp, Homo sapiens
ctacagtctggcaggaatgtta

SEQ ID NO: 7107539 - DNA, 22 bp, Homo sapiens
ttcctgggactggagcagccca

SEQ ID NO: 7107540 - DNA, 22 bp, Homo sapiens
ttcctgggagctagccacatct

SEQ ID NO: 7107541 - DNA, 22 bp, Homo sapiens
cggtcaggtgcagcgttggcac

SEQ ID NO: 7107542 - DNA, 22 bp, Homo sapiens
cggtcaggtgcagcgttggcac

SEQ ID NO: 7107543 - DNA, 22 bp, Homo sapiens
cggggctgtagcacagctgagc

SEQ ID NO: 7107544 - DNA, 22 bp, Homo sapiens
ttcagggccctgagagggcagt

SEQ ID NO: 7107545 - DNA, 22 bp, Homo sapiens
cggggctgtagcacagctgagc

SEQ ID NO: 7107546 - DNA, 22 bp, Homo sapiens
cggggctgtagcacagctgagc

SEQ ID NO: 7107547 - DNA, 22 bp, Homo sapiens
ttcagggagagcgggacgggtg

SEQ ID NO: 7107548 - DNA, 22 bp, Homo sapiens
ttcaggctatagaccaatttgg

SEQ ID NO: 7107549 - DNA, 22 bp, Homo sapiens
ttcagcaaacacgatgcttgtt

SEQ ID NO: 7107550 - DNA, 22 bp, Homo sapiens
ttcaggagtgtcaggagtgcct

SEQ ID NO: 7107551 - DNA, 22 bp, Homo sapiens
ttcaggagtgtcaggagtgcct

SEQ ID NO: 7107552 - DNA, 22 bp, Homo sapiens
ttcagatatcattaatttagta

SEQ ID NO: 7107553 - DNA, 22 bp, Homo sapiens
ttcagatgattagaatagtatt

SEQ ID NO: 7107554 - DNA, 22 bp, Homo sapiens
ttcagatgtggctttgtcaggc

SEQ ID NO: 7107555 - DNA, 22 bp, Homo sapiens
ttcagattttttaataggtaat

SEQ ID NO: 7107556 - DNA, 22 bp, Homo sapiens
ttcagcaaaatatctcagatag

SEQ ID NO: 7107557 - DNA, 22 bp, Homo sapiens
ttcagcaaaatatctcagatag

SEQ ID NO: 7107558 - DNA, 22 bp, Homo sapiens
ttcaggcaagatattaacttct

SEQ ID NO: 7107559 - DNA, 22 bp, Homo sapiens
ttcaggcagctgaggagaaagt

SEQ ID NO: 7107560 - DNA, 22 bp, Homo sapiens
ttcaggcatggaaactggatta

SEQ ID NO: 7107561 - DNA, 22 bp, Homo sapiens
ttcagagggacattcaagggaa

SEQ ID NO: 7107562 - DNA, 22 bp, Homo sapiens
ttcagaggctctgccaatgtgt

SEQ ID NO: 7107563 - DNA, 22 bp, Homo sapiens
ttcagaaataaaatatcccaac

SEQ ID NO: 7107564 - DNA, 21 bp, Homo sapiens
ttcagaggatgccaaggtcca

SEQ ID NO: 7107565 - DNA, 22 bp, Homo sapiens
ttcacagacattgcagactgaa

SEQ ID NO: 7107566 - DNA, 22 bp, Homo sapiens
ttcagaaagtgaatcttgttat

SEQ ID NO: 7107567 - DNA, 22 bp, Homo sapiens
ttcacagaattgtcttgactgg

SEQ ID NO: 7107568 - DNA, 22 bp, Homo sapiens
ttcacagaattgtcttgactgg

SEQ ID NO: 7107569 - DNA, 22 bp, Homo sapiens
ttcacagaatggcaagttatgg

SEQ ID NO: 7107570 - DNA, 22 bp, Homo sapiens
ttcacagaagaggtcacatttc

SEQ ID NO: 7107571 - DNA, 22 bp, Homo sapiens
ttcacactttggaattccacct

SEQ ID NO: 7107572 - DNA, 22 bp, Homo sapiens
ttcacagaagaggtcacatttc

SEQ ID NO: 7107573 - DNA, 22 bp, Homo sapiens
ttcacaccaggtatttatattt

SEQ ID NO: 7107574 - DNA, 22 bp, Homo sapiens
ttcacactgtttttcatagtgg

SEQ ID NO: 7107575 - DNA, 20 bp, Homo sapiens
ttcagaggtgaagttgtggt

SEQ ID NO: 7107576 - DNA, 22 bp, Homo sapiens
ttcagaggtaagggtctcagaa

SEQ ID NO: 7107577 - DNA, 22 bp, Homo sapiens
ttcagagggttttagggtcaga

SEQ ID NO: 7107578 - DNA, 22 bp, Homo sapiens
ttcagaggtgggctgagaggat

SEQ ID NO: 7107579 - DNA, 22 bp, Homo sapiens
ttcagaggttagagcagtggga

SEQ ID NO: 7107580 - DNA, 22 bp, Homo sapiens
ttcagaggtttccgggccatgc

SEQ ID NO: 7107581 - DNA, 22 bp, Homo sapiens
ttcagagtaggatactagctta

SEQ ID NO: 7107582 - DNA, 22 bp, Homo sapiens
ttcagagtcagggatctcagag

SEQ ID NO: 7107583 - DNA, 22 bp, Homo sapiens
ttcagagttagacgaaaagcaa

SEQ ID NO: 7107584 - DNA, 22 bp, Homo sapiens
ttcagataaactacaaataatt

SEQ ID NO: 7107585 - DNA, 22 bp, Homo sapiens
ttcagataaattgttttgtgat

SEQ ID NO: 7107586 - DNA, 22 bp, Homo sapiens
ttcatgaatgttccatgtgagt

SEQ ID NO: 7107587 - DNA, 22 bp, Homo sapiens
ctaaaattatcaagataattcc

SEQ ID NO: 7107588 - DNA, 22 bp, Homo sapiens
ctaaaattatcaagataattcc

SEQ ID NO: 7107589 - DNA, 22 bp, Homo sapiens
ctaaacttttataacattgaga

SEQ ID NO: 7107590 - DNA, 22 bp, Homo sapiens
ctaaagaagctagcaatctata

SEQ ID NO: 7107591 - DNA, 22 bp, Homo sapiens
ctaaagaagctagcaatctata

SEQ ID NO: 7107592 - DNA, 22 bp, Homo sapiens
ttcatgaagggtgaatatagtc

SEQ ID NO: 7107593 - DNA, 22 bp, Homo sapiens
ttcatgaagggtgaatatagtc

SEQ ID NO: 7107594 - DNA, 22 bp, Homo sapiens
ctaaataatccctctggtctta

SEQ ID NO: 7107595 - DNA, 22 bp, Homo sapiens
ctaaagtgccaggaatacaggt

SEQ ID NO: 7107596 - DNA, 22 bp, Homo sapiens
ctaaataatccctctggtctta

SEQ ID NO: 7107597 - DNA, 22 bp, Homo sapiens
ctaaataatccctctggtctta

SEQ ID NO: 7107598 - DNA, 22 bp, Homo sapiens
ctaaatcaggccttacagcttc

SEQ ID NO: 7107599 - DNA, 22 bp, Homo sapiens
ctaaagaagctagcaatctata

SEQ ID NO: 7107600 - DNA, 22 bp, Homo sapiens
ctaaagataaggaaagtatcct

SEQ ID NO: 7107601 - DNA, 22 bp, Homo sapiens
ctaaagcaactgagacacatag

SEQ ID NO: 7107602 - DNA, 22 bp, Homo sapiens
ctaaagcaactgagacacatag

SEQ ID NO: 7107603 - DNA, 22 bp, Homo sapiens
ctaaagcattctcagattttgc

SEQ ID NO: 7107604 - DNA, 22 bp, Homo sapiens
ctaaagcattctcagattttgc

SEQ ID NO: 7107605 - DNA, 22 bp, Homo sapiens
ctaaaggctcagcattcttttc

SEQ ID NO: 7107606 - DNA, 22 bp, Homo sapiens
ctaaagtcatacaaggtgggag

SEQ ID NO: 7107607 - DNA, 22 bp, Homo sapiens
ctaaagtccttatcaagtgtaa

SEQ ID NO: 7107608 - DNA, 22 bp, Homo sapiens
ctaaagtccttatcaagtgtaa

SEQ ID NO: 7107609 - DNA, 22 bp, Homo sapiens
ctaaagtgccaggaatacaggt

SEQ ID NO: 7107610 - DNA, 20 bp, Homo sapiens
cgtaaggcaagtgctgcatc

SEQ ID NO: 7107611 - DNA, 22 bp, Homo sapiens
cgtaggatactcagtgctcatt

SEQ ID NO: 7107612 - DNA, 22 bp, Homo sapiens
cgtaggtggctcagcacctggg

SEQ ID NO: 7107613 - DNA, 22 bp, Homo sapiens
cgtaggtggctcagcacctggg

SEQ ID NO: 7107614 - DNA, 22 bp, Homo sapiens
cgtaggtggctcagcacctggg

SEQ ID NO: 7107615 - DNA, 22 bp, Homo sapiens
cggtgggattcccagcgacttc

SEQ ID NO: 7107616 - DNA, 22 bp, Homo sapiens
cggtggagtgctcagctgaacc

SEQ ID NO: 7107617 - DNA, 22 bp, Homo sapiens
cggtggccaacaagaggccggg

SEQ ID NO: 7107618 - DNA, 22 bp, Homo sapiens
cggtctcccgtgtgtgtgcgct

SEQ ID NO: 7107619 - DNA, 22 bp, Homo sapiens
cggtctcccgtgtgtgtgcgct

SEQ ID NO: 7107620 - DNA, 22 bp, Homo sapiens
cggtctcccgtgtgtgtgcgct

SEQ ID NO: 7107621 - DNA, 22 bp, Homo sapiens
cggtcaggtgcagcgttggcac

SEQ ID NO: 7107622 - DNA, 22 bp, Homo sapiens
ttcatccatatgcagagagctt

SEQ ID NO: 7107623 - DNA, 22 bp, Homo sapiens
ttcatccatatgcagagagctt

SEQ ID NO: 7107624 - DNA, 22 bp, Homo sapiens
ttcatccatatgcagagagctt

SEQ ID NO: 7107625 - DNA, 22 bp, Homo sapiens
ttcatccatgtggttgtgtata

SEQ ID NO: 7107626 - DNA, 22 bp, Homo sapiens
cgtcacttcttagtctattttc

SEQ ID NO: 7107627 - DNA, 22 bp, Homo sapiens
cgtcactggcgtgaagtgagga

SEQ ID NO: 7107628 - DNA, 22 bp, Homo sapiens
cgtcacttcttagtctattttc

SEQ ID NO: 7107629 - DNA, 22 bp, Homo sapiens
cgtcacttcttagtctattttc

SEQ ID NO: 7107630 - DNA, 22 bp, Homo sapiens
cgtcacttcttagtctattttc

SEQ ID NO: 7107631 - DNA, 22 bp, Homo sapiens
cgtatcaaagcaaaacatattt

SEQ ID NO: 7107632 - DNA, 22 bp, Homo sapiens
cgtatttagaaggctgctgaaa

SEQ ID NO: 7107633 - DNA, 22 bp, Homo sapiens
cgtattcactcaggacacatag

SEQ ID NO: 7107634 - DNA, 22 bp, Homo sapiens
ttcatgaaacttaactgttggg

SEQ ID NO: 7107635 - DNA, 22 bp, Homo sapiens
ttcatgaaacttaactgttggg

SEQ ID NO: 7107636 - DNA, 22 bp, Homo sapiens
ttcatctgcttcttcctattcc

SEQ ID NO: 7107637 - DNA, 22 bp, Homo sapiens
ttcatctgcttcttgattttgc

SEQ ID NO: 7107638 - DNA, 22 bp, Homo sapiens
ttcatctggaagttcccaaggc

SEQ ID NO: 7107639 - DNA, 22 bp, Homo sapiens
ttcatctggaatttatgttata

SEQ ID NO: 7107640 - DNA, 22 bp, Homo sapiens
ttcatctggaatttatgttata

SEQ ID NO: 7107641 - DNA, 21 bp, Homo sapiens
ttcatctggccgtattccagg

SEQ ID NO: 7107642 - DNA, 22 bp, Homo sapiens
ttcatctgtacgccaagtactc

SEQ ID NO: 7107643 - DNA, 22 bp, Homo sapiens
ttcatctgtacgccaagtactc

SEQ ID NO: 7107644 - DNA, 22 bp, Homo sapiens
ttcatctgtagcatcttccaat

SEQ ID NO: 7107645 - DNA, 17 bp, Homo sapiens
cctttctctttcatctc

SEQ ID NO: 7107646 - DNA, 22 bp, Homo sapiens
cctttctgacagtgatgggggg

SEQ ID NO: 7107647 - DNA, 22 bp, Homo sapiens
cctttctctttgctgatcatgt

SEQ ID NO: 7107648 - DNA, 22 bp, Homo sapiens
ttaggaaggacttggattctgg

SEQ ID NO: 7107649 - DNA, 22 bp, Homo sapiens
ttaggaaggccttgaatgccag

SEQ ID NO: 7107650 - DNA, 20 bp, Homo sapiens
ttaggaagtcacaatttcag

SEQ ID NO: 7107651 - DNA, 22 bp, Homo sapiens
ttaggaggtctatggacatcct

SEQ ID NO: 7107652 - DNA, 22 bp, Homo sapiens
ttaggacatggacagctttggt

SEQ ID NO: 7107653 - DNA, 22 bp, Homo sapiens
ttaggacatggacagctttggt

SEQ ID NO: 7107654 - DNA, 18 bp, Homo sapiens
ttaggaagtttctccgtc

SEQ ID NO: 7107655 - DNA, 22 bp, Homo sapiens
ttaggaagtgtgtccagaagcg

SEQ ID NO: 7107656 - DNA, 22 bp, Homo sapiens
ttaggaagttatagtggaaatg

SEQ ID NO: 7107657 - DNA, 22 bp, Homo sapiens
ttaggaagtttcagaaaatgca

SEQ ID NO: 7107658 - DNA, 18 bp, Homo sapiens
cctttcctcccctcagct

SEQ ID NO: 7107659 - DNA, 18 bp, Homo sapiens
cctttcctcccctcagct

SEQ ID NO: 7107660 - DNA, 22 bp, Homo sapiens
cctttcaaaacagaacactagc

SEQ ID NO: 7107661 - DNA, 22 bp, Homo sapiens
cctttcaaagttttgccatgct

SEQ ID NO: 7107662 - DNA, 22 bp, Homo sapiens
cctttcaaagttttgccatgct

SEQ ID NO: 7107663 - DNA, 22 bp, Homo sapiens
cctttcaaattacatgactgct

SEQ ID NO: 7107664 - DNA, 19 bp, Homo sapiens
cctttcagaacagaagcca

SEQ ID NO: 7107665 - DNA, 22 bp, Homo sapiens
cctttctacagatgcctcttgc

SEQ ID NO: 7107666 - DNA, 16 bp, Homo sapiens
cctttctctgccttcc

SEQ ID NO: 7107667 - DNA, 22 bp, Homo sapiens
cctttctaagatactgcaactt

SEQ ID NO: 7107668 - DNA, 22 bp, Homo sapiens
cctttctaagatactgcaactt

SEQ ID NO: 7107669 - DNA, 22 bp, Homo sapiens
ttaggatagtctgttagaaaag

SEQ ID NO: 7107670 - DNA, 22 bp, Homo sapiens
ttaggatatgaaacagtataag

SEQ ID NO: 7107671 - DNA, 22 bp, Homo sapiens
ttaggattaaaagttaatgcaa

SEQ ID NO: 7107672 - DNA, 22 bp, Homo sapiens
ttaggatttgaaaaggggcaga

SEQ ID NO: 7107673 - DNA, 22 bp, Homo sapiens
ttaggatttgaaaaggggcaga

SEQ ID NO: 7107674 - DNA, 22 bp, Homo sapiens
ttaggcaaagatattacgtagt

SEQ ID NO: 7107675 - DNA, 22 bp, Homo sapiens
ttaggcacactttaccccctga

SEQ ID NO: 7107676 - DNA, 22 bp, Homo sapiens
ttaggcacagatgctgggtgct

SEQ ID NO: 7107677 - DNA, 22 bp, Homo sapiens
ttaggcaccatttgccaagtga

SEQ ID NO: 7107678 - DNA, 22 bp, Homo sapiens
ttaggcaatatcattggagttg

SEQ ID NO: 7107679 - DNA, 22 bp, Homo sapiens
ttaggcaatgaattattccaag

SEQ ID NO: 7107680 - DNA, 20 bp, Homo sapiens
ttaggcacctatcctcccat

SEQ ID NO: 7107681 - DNA, 22 bp, Homo sapiens
ttaggcaccttcattcaatcca

SEQ ID NO: 7107682 - DNA, 21 bp, Homo sapiens
ttaggcactgcaattttatgc

SEQ ID NO: 7107683 - DNA, 22 bp, Homo sapiens
ttaggcactggcatgcccggag

SEQ ID NO: 7107684 - DNA, 23 bp, Homo sapiens
ttaggcacttagtagggccagag

SEQ ID NO: 7107685 - DNA, 22 bp, Homo sapiens
ttaggcacttgctttgtgttca

SEQ ID NO: 7107686 - DNA, 22 bp, Homo sapiens
ttaggcacttgctttgtgttca

SEQ ID NO: 7107687 - DNA, 22 bp, Homo sapiens
ttaggcaattttgtcattgtgt

SEQ ID NO: 7107688 - DNA, 22 bp, Homo sapiens
ttaggcataaaggttgtatgca

SEQ ID NO: 7107689 - DNA, 22 bp, Homo sapiens
ttaggcatataggtaggaattg

SEQ ID NO: 7107690 - DNA, 22 bp, Homo sapiens
ttaggcatatgaaatagaatgt

SEQ ID NO: 7107691 - DNA, 22 bp, Homo sapiens
ttaggcatattgtacaatctag

SEQ ID NO: 7107692 - DNA, 22 bp, Homo sapiens
ttaggcatcacgggggatgcag

SEQ ID NO: 7107693 - DNA, 22 bp, Homo sapiens
ttaggcatcctgtccctggatt

SEQ ID NO: 7107694 - DNA, 22 bp, Homo sapiens
ttaggcatgaacaggattcatt

SEQ ID NO: 7107695 - DNA, 22 bp, Homo sapiens
ttaggctgttcttgtgttgtta

SEQ ID NO: 7107696 - DNA, 22 bp, Homo sapiens
ttaggctgttcttgtgttgtta

SEQ ID NO: 7107697 - DNA, 22 bp, Homo sapiens
ttaggctgttcttgtgttgtta

SEQ ID NO: 7107698 - DNA, 22 bp, Homo sapiens
ttaggcatgcaagattaagctc

SEQ ID NO: 7107699 - DNA, 22 bp, Homo sapiens
ttaggcatatggcacatgatag

SEQ ID NO: 7107700 - DNA, 20 bp, Homo sapiens
ttaggcatttggattggctt

SEQ ID NO: 7107701 - DNA, 22 bp, Homo sapiens
ttaggccacagggaaaatcaaa

SEQ ID NO: 7107702 - DNA, 22 bp, Homo sapiens
cgccaggcttggtagctcatgc

SEQ ID NO: 7107703 - DNA, 22 bp, Homo sapiens
cgcatgcagtggggctgcagtt

SEQ ID NO: 7107704 - DNA, 22 bp, Homo sapiens
cgcattatccgtccagcagact

SEQ ID NO: 7107705 - DNA, 22 bp, Homo sapiens
cgcatccagggcgcaggatctg

SEQ ID NO: 7107706 - DNA, 22 bp, Homo sapiens
cgcatccagggcgcaggatctg

SEQ ID NO: 7107707 - DNA, 22 bp, Homo sapiens
cgcccagctgaaatctccaggc

SEQ ID NO: 7107708 - DNA, 23 bp, Homo sapiens
cgcccagcctcagtgacctgggc

SEQ ID NO: 7107709 - DNA, 23 bp, Homo sapiens
cgcccagcctcagtgacctgggc

SEQ ID NO: 7107710 - DNA, 22 bp, Homo sapiens
cgccagtggcagctggaacagg

SEQ ID NO: 7107711 - DNA, 22 bp, Homo sapiens
cgccaggcttggtagctcatgc

SEQ ID NO: 7107712 - DNA, 22 bp, Homo sapiens
cgccagaactgtaagagaataa

SEQ ID NO: 7107713 - DNA, 22 bp, Homo sapiens
cgcagctggatatcatgtgcct

SEQ ID NO: 7107714 - DNA, 22 bp, Homo sapiens
cgcagctggatatcatgtgcct

SEQ ID NO: 7107715 - DNA, 22 bp, Homo sapiens
cgcaggtgccggcagatggggt

SEQ ID NO: 7107716 - DNA, 19 bp, Homo sapiens
cgcaggtggaaggagccgc

SEQ ID NO: 7107717 - DNA, 22 bp, Homo sapiens
cgcaggtgggcccttcattgat

SEQ ID NO: 7107718 - DNA, 22 bp, Homo sapiens
cgcaggtgtgttttcaggacta

SEQ ID NO: 7107719 - DNA, 22 bp, Homo sapiens
cgcaggtgttcagtaaatgtat

SEQ ID NO: 7107720 - DNA, 22 bp, Homo sapiens
ttcaagttaactctccttgtac

SEQ ID NO: 7107721 - DNA, 22 bp, Homo sapiens
ttcaagtctgcccagagtcagc

SEQ ID NO: 7107722 - DNA, 22 bp, Homo sapiens
cgccctccacacagcccctggc

SEQ ID NO: 7107723 - DNA, 22 bp, Homo sapiens
cgccctccacacagcccctggc

SEQ ID NO: 7107724 - DNA, 22 bp, Homo sapiens
cgccctccacacagcccctggc

SEQ ID NO: 7107725 - DNA, 18 bp, Homo sapiens
cgccctgctataaatgac

SEQ ID NO: 7107726 - DNA, 22 bp, Homo sapiens
cgccccagtctgtaggtgcccc

SEQ ID NO: 7107727 - DNA, 22 bp, Homo sapiens
cgccccggacgtctgaccaaac

SEQ ID NO: 7107728 - DNA, 22 bp, Homo sapiens
cgcccagggcaggaggccgctc

SEQ ID NO: 7107729 - DNA, 22 bp, Homo sapiens
cgcccagggcaggaggccgctc

SEQ ID NO: 7107730 - DNA, 22 bp, Homo sapiens
cgcccaggctggagtgcagtgg

SEQ ID NO: 7107731 - DNA, 22 bp, Homo sapiens
cgcccaggctggagtgcagtgg

SEQ ID NO: 7107732 - DNA, 22 bp, Homo sapiens
cgccccagatgcaagacaaaga

SEQ ID NO: 7107733 - DNA, 22 bp, Homo sapiens
cgccccagatgcaagacaaaga

SEQ ID NO: 7107734 - DNA, 22 bp, Homo sapiens
cgccccagccagttgagcggcg

SEQ ID NO: 7107735 - DNA, 22 bp, Homo sapiens
cgccccagtctgtaggtgcccc

SEQ ID NO: 7107736 - DNA, 22 bp, Homo sapiens
cgcccaggctggagtgcagtga

SEQ ID NO: 7107737 - DNA, 22 bp, Homo sapiens
cgcccaggctggagtgcagtga

SEQ ID NO: 7107738 - DNA, 22 bp, Homo sapiens
cgcccaggctggagagcagtgg

SEQ ID NO: 7107739 - DNA, 22 bp, Homo sapiens
cgcccaggctggagagcagtgg

SEQ ID NO: 7107740 - DNA, 22 bp, Homo sapiens
cgcccagctgaaatctccaggc

SEQ ID NO: 7107741 - DNA, 22 bp, Homo sapiens
cgcccagctgaaatctccaggc

SEQ ID NO: 7107742 - DNA, 20 bp, Homo sapiens
cgcccaggagggcccatgtg

SEQ ID NO: 7107743 - DNA, 22 bp, Homo sapiens
cgcccaggctggagagcagtgg

SEQ ID NO: 7107744 - DNA, 22 bp, Homo sapiens
ttcacacacagcttcctattgt

SEQ ID NO: 7107745 - DNA, 22 bp, Homo sapiens
ttcacaatttcccttcatcagg

SEQ ID NO: 7107746 - DNA, 22 bp, Homo sapiens
ttcacaatttcccttcatcagg

SEQ ID NO: 7107747 - DNA, 22 bp, Homo sapiens
ttcacacagaatctgaggagct

SEQ ID NO: 7107748 - DNA, 22 bp, Homo sapiens
ttcacacagaatctgaggagct

SEQ ID NO: 7107749 - DNA, 22 bp, Homo sapiens
ttcacacagcaactgtatgaat

SEQ ID NO: 7107750 - DNA, 22 bp, Homo sapiens
ttcaagtttttaaaggcagtta

SEQ ID NO: 7107751 - DNA, 22 bp, Homo sapiens
ttcaatacaaagaaaggaattt

SEQ ID NO: 7107752 - DNA, 22 bp, Homo sapiens
ttcaatacaccataggaatagt

SEQ ID NO: 7107753 - DNA, 20 bp, Homo sapiens
ttcaatacattactttgatt

SEQ ID NO: 7107754 - DNA, 22 bp, Homo sapiens
ttcaatagaaatgacattcttt

SEQ ID NO: 7107755 - DNA, 19 bp, Homo sapiens
ttcacaattatgaaattag

SEQ ID NO: 7107756 - DNA, 22 bp, Homo sapiens
ttcaagtttgtatttctgtatt

SEQ ID NO: 7107757 - DNA, 22 bp, Homo sapiens
ttcaagtttgcatgcccaagca

SEQ ID NO: 7107758 - DNA, 22 bp, Homo sapiens
ttcaagtttgtatttctgtatt

SEQ ID NO: 7107759 - DNA, 22 bp, Homo sapiens
ttcaagtttgtatttctgtatt

SEQ ID NO: 7107760 - DNA, 22 bp, Homo sapiens
ttcaagttttatatccatggct

SEQ ID NO: 7107761 - DNA, 22 bp, Homo sapiens
ttcaagtttactttgaagttta

SEQ ID NO: 7107762 - DNA, 22 bp, Homo sapiens
ttcaagtttcgcaaggacatat

SEQ ID NO: 7107763 - DNA, 22 bp, Homo sapiens
ttcaagttttatatccatggct

SEQ ID NO: 7107764 - DNA, 22 bp, Homo sapiens
ttcaagttttatattgaagcaa

SEQ ID NO: 7107765 - DNA, 22 bp, Homo sapiens
ttcaagttttcagaatagccac

SEQ ID NO: 7107766 - DNA, 22 bp, Homo sapiens
ttcaagttttcagaatagccac

SEQ ID NO: 7107767 - DNA, 22 bp, Homo sapiens
ttcaagttttcagaatagccac

SEQ ID NO: 7107768 - DNA, 22 bp, Homo sapiens
ttcaagttttgacttagtcctt

SEQ ID NO: 7107769 - DNA, 22 bp, Homo sapiens
ttcaagttttcagaatagccac

SEQ ID NO: 7107770 - DNA, 22 bp, Homo sapiens
ttcaagttttgcctccccatcc

SEQ ID NO: 7107771 - DNA, 22 bp, Homo sapiens
ttcaagttctagtgttcacttc

SEQ ID NO: 7107772 - DNA, 22 bp, Homo sapiens
ttcaagttcatgtgtagtcagt

SEQ ID NO: 7107773 - DNA, 22 bp, Homo sapiens
ttcaagttagagatatatttag

SEQ ID NO: 7107774 - DNA, 22 bp, Homo sapiens
ttcaagttaatgattctggttt

SEQ ID NO: 7107775 - DNA, 22 bp, Homo sapiens
ttcaagttaatgattctggttt

SEQ ID NO: 7107776 - DNA, 22 bp, Homo sapiens
ttcaagttacctttaaacagct

SEQ ID NO: 7107777 - DNA, 22 bp, Homo sapiens
ttcaagttctagtgttcacttc

SEQ ID NO: 7107778 - DNA, 22 bp, Homo sapiens
ttcaagttctagtgttcacttc

SEQ ID NO: 7107779 - DNA, 20 bp, Homo sapiens
ttcaagttgggtctctggct

SEQ ID NO: 7107780 - DNA, 22 bp, Homo sapiens
ttcaagttctgtggagagctgt

SEQ ID NO: 7107781 - DNA, 20 bp, Homo sapiens
ttcaagttgggtctctggct

SEQ ID NO: 7107782 - DNA, 22 bp, Homo sapiens
tggggaggaagtcagatttcag

SEQ ID NO: 7107783 - DNA, 22 bp, Homo sapiens
tggggcagcagacctttcttgg

SEQ ID NO: 7107784 - DNA, 22 bp, Homo sapiens
tggggcagcagacctttcttgg

SEQ ID NO: 7107785 - DNA, 22 bp, Homo sapiens
tggggcagccacatagacaaca

SEQ ID NO: 7107786 - DNA, 22 bp, Homo sapiens
tggggcagccacatagacaaca

SEQ ID NO: 7107787 - DNA, 22 bp, Homo sapiens
tggggcagccacatagacaaca

SEQ ID NO: 7107788 - DNA, 22 bp, Homo sapiens
tggggcagctccatctattcca

SEQ ID NO: 7107789 - DNA, 22 bp, Homo sapiens
tggggcagctccatctattcca

SEQ ID NO: 7107790 - DNA, 22 bp, Homo sapiens
tggggcagctccatctattcca

SEQ ID NO: 7107791 - DNA, 22 bp, Homo sapiens
tggggcagccacatagacaaca

SEQ ID NO: 7107792 - DNA, 22 bp, Homo sapiens
tggggcagccacatagacaaca

SEQ ID NO: 7107793 - DNA, 22 bp, Homo sapiens
tggggcagctccatctattcca

SEQ ID NO: 7107794 - DNA, 22 bp, Homo sapiens
tggggcagctccatctattcca

SEQ ID NO: 7107795 - DNA, 22 bp, Homo sapiens
tggggcagggatgggaaactat

SEQ ID NO: 7107796 - DNA, 22 bp, Homo sapiens
tggggcagggatgggaaactat

SEQ ID NO: 7107797 - DNA, 22 bp, Homo sapiens
tggggcagggatgggaaactat

SEQ ID NO: 7107798 - DNA, 22 bp, Homo sapiens
tggggcagggatgggaaactat

SEQ ID NO: 7107799 - DNA, 22 bp, Homo sapiens
tggggcagggatgggaaactat

SEQ ID NO: 7107800 - DNA, 22 bp, Homo sapiens
tggggcagggatgggaaactat

SEQ ID NO: 7107801 - DNA, 22 bp, Homo sapiens
tggggcagtggcttttcaccct

SEQ ID NO: 7107802 - DNA, 22 bp, Homo sapiens
tggggcagtggcttttcaccct

SEQ ID NO: 7107803 - DNA, 22 bp, Homo sapiens
tggggcagtggcttttcaccct

SEQ ID NO: 7107804 - DNA, 22 bp, Homo sapiens
tggggcagttaataaacattct

SEQ ID NO: 7107805 - DNA, 22 bp, Homo sapiens
tggggccacacatctctttcta

SEQ ID NO: 7107806 - DNA, 22 bp, Homo sapiens
tggggccacacatctctttcta

SEQ ID NO: 7107807 - DNA, 22 bp, Homo sapiens
tggggccacactgatctcccag

SEQ ID NO: 7107808 - DNA, 23 bp, Homo sapiens
tggggccaagtgaggaagggtct

SEQ ID NO: 7107809 - DNA, 23 bp, Homo sapiens
tggggccaagtgaggaagggtct

SEQ ID NO: 7107810 - DNA, 22 bp, Homo sapiens
tggggctgtgagactacaggat

SEQ ID NO: 7107811 - DNA, 22 bp, Homo sapiens
tggggctgtgagactacaggat

SEQ ID NO: 7107812 - DNA, 22 bp, Homo sapiens
tggggctgtgagactacaggat

SEQ ID NO: 7107813 - DNA, 22 bp, Homo sapiens
tggggcagttaataaacattct

SEQ ID NO: 7107814 - DNA, 22 bp, Homo sapiens
tggggcatggatgataagctgg

SEQ ID NO: 7107815 - DNA, 22 bp, Homo sapiens
tggggcatgtgaacctggatgt

SEQ ID NO: 7107816 - DNA, 22 bp, Homo sapiens
tggggccaagaaggtctcatgt

SEQ ID NO: 7107817 - DNA, 22 bp, Homo sapiens
tggggccaagaaggtctcatgt

SEQ ID NO: 7107818 - DNA, 22 bp, Homo sapiens
tggggccaagaaggtctcatgt

SEQ ID NO: 7107819 - DNA, 22 bp, Homo sapiens
tggggccaagaaggtctcatgt

SEQ ID NO: 7107820 - DNA, 22 bp, Homo sapiens
tggggccaagaaggtctcatgt

SEQ ID NO: 7107821 - DNA, 23 bp, Homo sapiens
tggggccaagtgaggaagggtct

SEQ ID NO: 7107822 - DNA, 23 bp, Homo sapiens
tggggccaagtgaggaagggtct

SEQ ID NO: 7107823 - DNA, 23 bp, Homo sapiens
tggggccaagtgaggaagggtct

SEQ ID NO: 7107824 - DNA, 23 bp, Homo sapiens
tggggccaagtgaggaagggtct

SEQ ID NO: 7107825 - DNA, 19 bp, Homo sapiens
tggggctgtgttttgaccc

SEQ ID NO: 7107826 - DNA, 22 bp, Homo sapiens
tggggctgtggattctcacgaa

SEQ ID NO: 7107827 - DNA, 22 bp, Homo sapiens
tggggctgtggattctcacgaa

SEQ ID NO: 7107828 - DNA, 22 bp, Homo sapiens
tggggctgtggattctcacgaa

SEQ ID NO: 7107829 - DNA, 22 bp, Homo sapiens
tggggctgtgagactacaggat

SEQ ID NO: 7107830 - DNA, 22 bp, Homo sapiens
tgggggactgcactggcgtcag

SEQ ID NO: 7107831 - DNA, 22 bp, Homo sapiens
tgggggactgcactggcgtcag

SEQ ID NO: 7107832 - DNA, 21 bp, Homo sapiens
tgggggagaattggttgcttt

SEQ ID NO: 7107833 - DNA, 22 bp, Homo sapiens
tgggggaaattcagccagatat

SEQ ID NO: 7107834 - DNA, 22 bp, Homo sapiens
tgggggaaattcagccagatat

SEQ ID NO: 7107835 - DNA, 22 bp, Homo sapiens
tgggggaactgttgcgcgcggg

SEQ ID NO: 7107836 - DNA, 22 bp, Homo sapiens
tgggggaagagcttgttaaagt

SEQ ID NO: 7107837 - DNA, 22 bp, Homo sapiens
tgggggacaccagtctctctct

SEQ ID NO: 7107838 - DNA, 21 bp, Homo sapiens
tgggggagaattggttgcttt

SEQ ID NO: 7107839 - DNA, 21 bp, Homo sapiens
tgggggagaattggttgcttt

SEQ ID NO: 7107840 - DNA, 21 bp, Homo sapiens
tgggggagaattggttgcttt

SEQ ID NO: 7107841 - DNA, 21 bp, Homo sapiens
tgggggagaattggttgcttt

SEQ ID NO: 7107842 - DNA, 22 bp, Homo sapiens
cctgggaggtggatgttgcggt

SEQ ID NO: 7107843 - DNA, 22 bp, Homo sapiens
cctgggaggtggatgttgcggt

SEQ ID NO: 7107844 - DNA, 19 bp, Homo sapiens
cctgggagtcagctgaagg

SEQ ID NO: 7107845 - DNA, 22 bp, Homo sapiens
cctgggagtgtgccatctctgt

SEQ ID NO: 7107846 - DNA, 22 bp, Homo sapiens
cctgggagtgtgccatctctgt

SEQ ID NO: 7107847 - DNA, 22 bp, Homo sapiens
cctgggagtgtgccatctctgt

SEQ ID NO: 7107848 - DNA, 22 bp, Homo sapiens
cctgggagtgtcagacttgctt

SEQ ID NO: 7107849 - DNA, 22 bp, Homo sapiens
cctgggagtggcactcacagca

SEQ ID NO: 7107850 - DNA, 22 bp, Homo sapiens
cctgggagtggcactcacagca

SEQ ID NO: 7107851 - DNA, 22 bp, Homo sapiens
cctgggagtggcactcacagca

SEQ ID NO: 7107852 - DNA, 19 bp, Homo sapiens
cctgggagtcagctgaagg

SEQ ID NO: 7107853 - DNA, 22 bp, Homo sapiens
cctgggagtggcactcacagca

SEQ ID NO: 7107854 - DNA, 22 bp, Homo sapiens
cctgggagtggcactcacagca

SEQ ID NO: 7107855 - DNA, 22 bp, Homo sapiens
cctgggcaaatgccagagacaa

SEQ ID NO: 7107856 - DNA, 22 bp, Homo sapiens
cctgggcaaatgccagagacaa

SEQ ID NO: 7107857 - DNA, 22 bp, Homo sapiens
cctgggcaacatagggagaccc

SEQ ID NO: 7107858 - DNA, 22 bp, Homo sapiens
cctgggcaacatagggagaccc

SEQ ID NO: 7107859 - DNA, 22 bp, Homo sapiens
cctgggcaacatagtgagaccc

SEQ ID NO: 7107860 - DNA, 22 bp, Homo sapiens
cctgggcaacatagtgagaccc

SEQ ID NO: 7107861 - DNA, 22 bp, Homo sapiens
cctgggcaacatagtgagacct

SEQ ID NO: 7107862 - DNA, 22 bp, Homo sapiens
cctgggcaacatagtgagacct

SEQ ID NO: 7107863 - DNA, 22 bp, Homo sapiens
cctgggcaatatagtgaggccc

SEQ ID NO: 7107864 - DNA, 22 bp, Homo sapiens
tgtgggtcttccaaagaagggc

SEQ ID NO: 7107865 - DNA, 22 bp, Homo sapiens
tgtgggtgatgaatttgttctt

SEQ ID NO: 7107866 - DNA, 22 bp, Homo sapiens
tgtgggtgatgaatttgttctt

SEQ ID NO: 7107867 - DNA, 22 bp, Homo sapiens
tgtgtataaacaagagtctgtg

SEQ ID NO: 7107868 - DNA, 22 bp, Homo sapiens
tgtgtataactcttaattcatt

SEQ ID NO: 7107869 - DNA, 22 bp, Homo sapiens
tgtgtataagtgagaatgctgt

SEQ ID NO: 7107870 - DNA, 22 bp, Homo sapiens
tgtgtatacgagtatgaatatg

SEQ ID NO: 7107871 - DNA, 22 bp, Homo sapiens
tgtgtataggttgtgctaatag

SEQ ID NO: 7107872 - DNA, 22 bp, Homo sapiens
tgtgtctgcccttagtacatct

SEQ ID NO: 7107873 - DNA, 22 bp, Homo sapiens
tgtgtctgcactgagtcctcac

SEQ ID NO: 7107874 - DNA, 22 bp, Homo sapiens
tgtgtctgcactgagtcctcac

SEQ ID NO: 7107875 - DNA, 22 bp, Homo sapiens
tgtgtctgaacatgctttgtaa

SEQ ID NO: 7107876 - DNA, 23 bp, Homo sapiens
tgtgtctgaggatatatgtgcat

SEQ ID NO: 7107877 - DNA, 23 bp, Homo sapiens
tgtgtctgaggatatatgtgcat

SEQ ID NO: 7107878 - DNA, 23 bp, Homo sapiens
tgtgtctgaggatatatgtgcat

SEQ ID NO: 7107879 - DNA, 23 bp, Homo sapiens
tgtgtctgaggatatatgtgcat

SEQ ID NO: 7107880 - DNA, 23 bp, Homo sapiens
tgtgtctgaggatatatgtgcat

SEQ ID NO: 7107881 - DNA, 22 bp, Homo sapiens
tgtgtctgaactagttgctctc

SEQ ID NO: 7107882 - DNA, 22 bp, Homo sapiens
tgtgtctgaacatgctttgtaa

SEQ ID NO: 7107883 - DNA, 22 bp, Homo sapiens
tgtgtctctttgtcctagagct

SEQ ID NO: 7107884 - DNA, 22 bp, Homo sapiens
tgtgtctctttgtcctagagct

SEQ ID NO: 7107885 - DNA, 22 bp, Homo sapiens
tgtgtctgaacatgctttgtaa

SEQ ID NO: 7107886 - DNA, 22 bp, Homo sapiens
tgtgtctgaacatgctttgtaa

SEQ ID NO: 7107887 - DNA, 22 bp, Homo sapiens
tgtgtctgaacatgctttgtaa

SEQ ID NO: 7107888 - DNA, 22 bp, Homo sapiens
tgtgtctcatttcctcctgctg

SEQ ID NO: 7107889 - DNA, 22 bp, Homo sapiens
tgtgtctccatagccagctagc

SEQ ID NO: 7107890 - DNA, 22 bp, Homo sapiens
tgtgtctccatagccagctagc

SEQ ID NO: 7107891 - DNA, 22 bp, Homo sapiens
tgtgtctcctttccctgtctaa

SEQ ID NO: 7107892 - DNA, 22 bp, Homo sapiens
tgtgtctctcctggaagcacgt

SEQ ID NO: 7107893 - DNA, 22 bp, Homo sapiens
tgtgtctctcctggaagcacgt

SEQ ID NO: 7107894 - DNA, 22 bp, Homo sapiens
tgtgtattaatgtttgtatatg

SEQ ID NO: 7107895 - DNA, 22 bp, Homo sapiens
tgtgtattaatgtttgtatatg

SEQ ID NO: 7107896 - DNA, 22 bp, Homo sapiens
tgtgtctcaagtcagagcatca

SEQ ID NO: 7107897 - DNA, 22 bp, Homo sapiens
tgtgtatgtctgtatgcacaca

SEQ ID NO: 7107898 - DNA, 22 bp, Homo sapiens
tgtgtatgtctgtatgcacaca

SEQ ID NO: 7107899 - DNA, 20 bp, Homo sapiens
tgtgtatgtgcacatgcgaa

SEQ ID NO: 7107900 - DNA, 20 bp, Homo sapiens
tgtgtatgtgcacatgcgaa

SEQ ID NO: 7107901 - DNA, 22 bp, Homo sapiens
tgtgtatatatgtttaagtcat

SEQ ID NO: 7107902 - DNA, 22 bp, Homo sapiens
tgtgtatatgtaaatatagttg

SEQ ID NO: 7107903 - DNA, 20 bp, Homo sapiens
tgtgtatctcagatcccatt

SEQ ID NO: 7107904 - DNA, 23 bp, Homo sapiens
tgtgtatgtatctatgcataggt

SEQ ID NO: 7107905 - DNA, 23 bp, Homo sapiens
tgtgtatgtatctatgcataggt

SEQ ID NO: 7107906 - DNA, 23 bp, Homo sapiens
tgtgtatgtatctatgcataggt

SEQ ID NO: 7107907 - DNA, 23 bp, Homo sapiens
tgtgtatgtatctatgcataggt

SEQ ID NO: 7107908 - DNA, 20 bp, Homo sapiens
tgttccatgactatttggat

SEQ ID NO: 7107909 - DNA, 22 bp, Homo sapiens
cctgggtgtcatgggcagctgg

SEQ ID NO: 7107910 - DNA, 22 bp, Homo sapiens
cctggtggacagcagccagcag

SEQ ID NO: 7107911 - DNA, 22 bp, Homo sapiens
cctggtggacagcagccagcag

SEQ ID NO: 7107912 - DNA, 22 bp, Homo sapiens
cctggtggagaggggcggagcg

SEQ ID NO: 7107913 - DNA, 22 bp, Homo sapiens
cctggtggccttcagcccacaa

SEQ ID NO: 7107914 - DNA, 22 bp, Homo sapiens
cctggtggccttcagcccacaa

SEQ ID NO: 7107915 - DNA, 22 bp, Homo sapiens
cctggtggagaggggcggagcg

SEQ ID NO: 7107916 - DNA, 22 bp, Homo sapiens
cctggtggcttctgggtggacg

SEQ ID NO: 7107917 - DNA, 22 bp, Homo sapiens
cctggtggcttctgggtggacg

SEQ ID NO: 7107918 - DNA, 22 bp, Homo sapiens
cctggtgggcaggagtgagacc

SEQ ID NO: 7107919 - DNA, 20 bp, Homo sapiens
cctggtgtatttcctggggt

SEQ ID NO: 7107920 - DNA, 22 bp, Homo sapiens
cctggtgtcatggatgtcacat

SEQ ID NO: 7107921 - DNA, 22 bp, Homo sapiens
tgtttacttcatcgagtacttc

SEQ ID NO: 7107922 - DNA, 22 bp, Homo sapiens
tgtttacttgaggtggaaacaa

SEQ ID NO: 7107923 - DNA, 22 bp, Homo sapiens
tgtttacttaaatgttttcata

SEQ ID NO: 7107924 - DNA, 22 bp, Homo sapiens
cctggtgtctgtttacagcagc

SEQ ID NO: 7107925 - DNA, 22 bp, Homo sapiens
cctggtgtggccctgtgacatg

SEQ ID NO: 7107926 - DNA, 22 bp, Homo sapiens
cctggtgtggctgtcacagagg

SEQ ID NO: 7107927 - DNA, 22 bp, Homo sapiens
cctggtgtggctgtcacagagg

SEQ ID NO: 7107928 - DNA, 22 bp, Homo sapiens
cctggtgttgccaatctgtgcc

SEQ ID NO: 7107929 - DNA, 22 bp, Homo sapiens
cctggtgttatcataggtcatg

SEQ ID NO: 7107930 - DNA, 22 bp, Homo sapiens
cctggtgttgtgaagtagccgt

SEQ ID NO: 7107931 - DNA, 22 bp, Homo sapiens
cctggttgagggaggtgtggac

SEQ ID NO: 7107932 - DNA, 21 bp, Homo sapiens
cctggttggcgtagctcagtc

SEQ ID NO: 7107933 - DNA, 21 bp, Homo sapiens
cctggttggcgtagctcagtc

SEQ ID NO: 7107934 - DNA, 22 bp, Homo sapiens
tgttcattttgaagtacttcaa

SEQ ID NO: 7107935 - DNA, 23 bp, Homo sapiens
tgttccagatacgccttttcctc

SEQ ID NO: 7107936 - DNA, 23 bp, Homo sapiens
tgttccagatacgccttttcctc

SEQ ID NO: 7107937 - DNA, 22 bp, Homo sapiens
tgttccagattcggcgtgggac

SEQ ID NO: 7107938 - DNA, 22 bp, Homo sapiens
tgttccagggcgcgaaggtggt

SEQ ID NO: 7107939 - DNA, 22 bp, Homo sapiens
tgttccataagtggtgctttgt

SEQ ID NO: 7107940 - DNA, 22 bp, Homo sapiens
tgttccatcagtttttggttga

SEQ ID NO: 7107941 - DNA, 22 bp, Homo sapiens
tgttcattagtggaagtaagtt

SEQ ID NO: 7107942 - DNA, 22 bp, Homo sapiens
tgttcatctggcaggcatagcc

SEQ ID NO: 7107943 - DNA, 22 bp, Homo sapiens
tgttcagagacagaaattctaa

SEQ ID NO: 7107944 - DNA, 22 bp, Homo sapiens
tgttcagagacagaaattctaa

SEQ ID NO: 7107945 - DNA, 19 bp, Homo sapiens
tgttcagatatgtcagctt

SEQ ID NO: 7107946 - DNA, 19 bp, Homo sapiens
tgttcagatatgtcagctt

SEQ ID NO: 7107947 - DNA, 22 bp, Homo sapiens
tgttcagcatcaggaaagcttt

SEQ ID NO: 7107948 - DNA, 22 bp, Homo sapiens
tgttcagccctctattaatcag

SEQ ID NO: 7107949 - DNA, 22 bp, Homo sapiens
tgttcagtccaatgttggaaaa

SEQ ID NO: 7107950 - DNA, 22 bp, Homo sapiens
tgttcagtttgctatcataatc

SEQ ID NO: 7107951 - DNA, 22 bp, Homo sapiens
tgttacaatattatcaactgag

SEQ ID NO: 7107952 - DNA, 22 bp, Homo sapiens
tgttacaatattatcaactgag

SEQ ID NO: 7107953 - DNA, 22 bp, Homo sapiens
tgttacacccacaaaaaattcc

SEQ ID NO: 7107954 - DNA, 22 bp, Homo sapiens
tgttacagaaagtttatgaatg

SEQ ID NO: 7107955 - DNA, 22 bp, Homo sapiens
tgttacagaaatattgcttctt

SEQ ID NO: 7107956 - DNA, 22 bp, Homo sapiens
tgttacaggaaatagaattacc

SEQ ID NO: 7107957 - DNA, 22 bp, Homo sapiens
cctgggctgtacctgtgcgcgg

SEQ ID NO: 7107958 - DNA, 22 bp, Homo sapiens
cctgggctgggcgtctcatggg

SEQ ID NO: 7107959 - DNA, 22 bp, Homo sapiens
cctgggctgggcgtctcatggg

SEQ ID NO: 7107960 - DNA, 22 bp, Homo sapiens
cctgggctgggcgtctcatggg

SEQ ID NO: 7107961 - DNA, 21 bp, Homo sapiens
cctgggctgtggtttggagac

SEQ ID NO: 7107962 - DNA, 21 bp, Homo sapiens
cctgggctgtggtttggagac

SEQ ID NO: 7107963 - DNA, 22 bp, Homo sapiens
cctgggctgtacctgtgcgcgg

SEQ ID NO: 7107964 - DNA, 22 bp, Homo sapiens
cctgggcttccacgagcagagg

SEQ ID NO: 7107965 - DNA, 22 bp, Homo sapiens
cctgggcttccacgagcagagg

SEQ ID NO: 7107966 - DNA, 22 bp, Homo sapiens
cctgggcttacgacctctgact

SEQ ID NO: 7107967 - DNA, 22 bp, Homo sapiens
cctgggctgttgcatcatcctt

SEQ ID NO: 7107968 - DNA, 22 bp, Homo sapiens
cctgggcttacgacctctgact

SEQ ID NO: 7107969 - DNA, 18 bp, Homo sapiens
tgttaaggatccagtagt

SEQ ID NO: 7107970 - DNA, 22 bp, Homo sapiens
tgttaaggctcttgtttatgtc

SEQ ID NO: 7107971 - DNA, 22 bp, Homo sapiens
tgttaaggggatatagcagggc

SEQ ID NO: 7107972 - DNA, 22 bp, Homo sapiens
tgttaagggtaaacagcagtaa

SEQ ID NO: 7107973 - DNA, 22 bp, Homo sapiens
tgttaaggtcctgacttctgca

SEQ ID NO: 7107974 - DNA, 22 bp, Homo sapiens
tgttaaggttatttgttatgtc

SEQ ID NO: 7107975 - DNA, 22 bp, Homo sapiens
tgttaagttgccagtgtatgac

SEQ ID NO: 7107976 - DNA, 23 bp, Homo sapiens
tgttaatacatctgccactcatt

SEQ ID NO: 7107977 - DNA, 22 bp, Homo sapiens
tgttaatatactaaaatccact

SEQ ID NO: 7107978 - DNA, 22 bp, Homo sapiens
tgttaatatactaaaatccact

SEQ ID NO: 7107979 - DNA, 22 bp, Homo sapiens
tgttaatatactaaaatccact

SEQ ID NO: 7107980 - DNA, 22 bp, Homo sapiens
tgttaatggctgaagacatcct

SEQ ID NO: 7107981 - DNA, 17 bp, Homo sapiens
tgttaattccaatgata

SEQ ID NO: 7107982 - DNA, 22 bp, Homo sapiens
tgttaatttctttagaagtgga

SEQ ID NO: 7107983 - DNA, 22 bp, Homo sapiens
tgttacaaactgttgtttctat

SEQ ID NO: 7107984 - DNA, 22 bp, Homo sapiens
tgttacaaactgttgtttctat

SEQ ID NO: 7107985 - DNA, 22 bp, Homo sapiens
tgttacaaatgcggagtttgtg

SEQ ID NO: 7107986 - DNA, 22 bp, Homo sapiens
tgttacaactatagatcccaag

SEQ ID NO: 7107987 - DNA, 22 bp, Homo sapiens
tgttacaacagtaccgtgctgt

SEQ ID NO: 7107988 - DNA, 23 bp, Homo sapiens
tgttacaagcaccacaggtggct

SEQ ID NO: 7107989 - DNA, 23 bp, Homo sapiens
tgttacaagcaccacaggtggct

SEQ ID NO: 7107990 - DNA, 22 bp, Homo sapiens
tgttacaaggaagaatgtaggt

SEQ ID NO: 7107991 - DNA, 22 bp, Homo sapiens
tgttacaaggaagaatgtaggt

SEQ ID NO: 7107992 - DNA, 22 bp, Homo sapiens
tgttacaaggaagaatgtaggt

SEQ ID NO: 7107993 - DNA, 22 bp, Homo sapiens
tgttacaagtcttgaggtactt

SEQ ID NO: 7107994 - DNA, 22 bp, Homo sapiens
tgttacaaggaagaatgtaggt

SEQ ID NO: 7107995 - DNA, 22 bp, Homo sapiens
tgtgtctggataggtaatggat

SEQ ID NO: 7107996 - DNA, 22 bp, Homo sapiens
tgtgtctgcccttagtacatct

SEQ ID NO: 7107997 - DNA, 22 bp, Homo sapiens
tgtgtctggaccggggaggagc

SEQ ID NO: 7107998 - DNA, 22 bp, Homo sapiens
tgtgtctggaccggggaggagc

SEQ ID NO: 7107999 - DNA, 22 bp, Homo sapiens
cctgggctcaagtgatcctcct

SEQ ID NO: 7108000 - DNA, 22 bp, Homo sapiens
cctgggctctgaggagggagtc

SEQ ID NO: 7108001 - DNA, 22 bp, Homo sapiens
cctgggctctgaggagggagtc

SEQ ID NO: 7108002 - DNA, 22 bp, Homo sapiens
cctgggctctgtcagaattggg

SEQ ID NO: 7108003 - DNA, 22 bp, Homo sapiens
cctgggctctgtcagaattggg

SEQ ID NO: 7108004 - DNA, 22 bp, Homo sapiens
cctgggctctgaggagggagtc

SEQ ID NO: 7108005 - DNA, 22 bp, Homo sapiens
cctgggctctgaggagggagtc

SEQ ID NO: 7108006 - DNA, 22 bp, Homo sapiens
cctgggctctgaggagggagtc

SEQ ID NO: 7108007 - DNA, 22 bp, Homo sapiens
cctgggctctatcctgacccag

SEQ ID NO: 7108008 - DNA, 22 bp, Homo sapiens
cctgggctgcatgatggcattt

SEQ ID NO: 7108009 - DNA, 22 bp, Homo sapiens
cctgggctgcatgatggcattt

SEQ ID NO: 7108010 - DNA, 22 bp, Homo sapiens
cctgggctggagtacagcagtg

SEQ ID NO: 7108011 - DNA, 22 bp, Homo sapiens
cctgggctggagtacagcagtg

SEQ ID NO: 7108012 - DNA, 22 bp, Homo sapiens
cctgggctgctcatggggatga

SEQ ID NO: 7108013 - DNA, 22 bp, Homo sapiens
cctgggctgcatgatggcattt

SEQ ID NO: 7108014 - DNA, 22 bp, Homo sapiens
cctgggctggagtacagcagtg

SEQ ID NO: 7108015 - DNA, 22 bp, Homo sapiens
cctgggctggagtacagcagtg

SEQ ID NO: 7108016 - DNA, 22 bp, Homo sapiens
ccttctcagccccagctcccgc

SEQ ID NO: 7108017 - DNA, 21 bp, Homo sapiens
ccttctccacagggtctccgg

SEQ ID NO: 7108018 - DNA, 21 bp, Homo sapiens
ccttctccacagggtctccgg

SEQ ID NO: 7108019 - DNA, 22 bp, Homo sapiens
ccttcctttgcatcatttctag

SEQ ID NO: 7108020 - DNA, 22 bp, Homo sapiens
ccttccttttactgtctccgga

SEQ ID NO: 7108021 - DNA, 22 bp, Homo sapiens
ccttctagcaaatcaacataaa

SEQ ID NO: 7108022 - DNA, 22 bp, Homo sapiens
ccttcctttcagggctatgcct

SEQ ID NO: 7108023 - DNA, 22 bp, Homo sapiens
ccttccttcaagcacacatcta

SEQ ID NO: 7108024 - DNA, 23 bp, Homo sapiens
ttacttttgcaccaacctaatat

SEQ ID NO: 7108025 - DNA, 21 bp, Homo sapiens
ttacttttgcagcaacctaat

SEQ ID NO: 7108026 - DNA, 22 bp, Homo sapiens
ttagaaaaaacgtcttctagtg

SEQ ID NO: 7108027 - DNA, 22 bp, Homo sapiens
ttagaaaaaacgtcttctagtg

SEQ ID NO: 7108028 - DNA, 22 bp, Homo sapiens
ttagaaaaaacgtcttctagtg

SEQ ID NO: 7108029 - DNA, 22 bp, Homo sapiens
ttagaaaaaggctgtggtctta

SEQ ID NO: 7108030 - DNA, 21 bp, Homo sapiens
ttacttttgcaccaacctaat

SEQ ID NO: 7108031 - DNA, 23 bp, Homo sapiens
ttactacacaagtaacgattccc

SEQ ID NO: 7108032 - DNA, 22 bp, Homo sapiens
ttacttttgcaccaaactaata

SEQ ID NO: 7108033 - DNA, 22 bp, Homo sapiens
ttagacaatctgttggtaaggt

SEQ ID NO: 7108034 - DNA, 23 bp, Homo sapiens
ttagacaatcctcaaaaggtaat

SEQ ID NO: 7108035 - DNA, 23 bp, Homo sapiens
ttagacaatcctcaaaaggtaat

SEQ ID NO: 7108036 - DNA, 22 bp, Homo sapiens
cctttacagtatggttgtatca

SEQ ID NO: 7108037 - DNA, 20 bp, Homo sapiens
cctttagaaactcatatgta

SEQ ID NO: 7108038 - DNA, 22 bp, Homo sapiens
ttagaatctttagagtctcact

SEQ ID NO: 7108039 - DNA, 22 bp, Homo sapiens
ttagaatgatagagaatttgtt

SEQ ID NO: 7108040 - DNA, 22 bp, Homo sapiens
ttagaattattgtttccttcta

SEQ ID NO: 7108041 - DNA, 22 bp, Homo sapiens
ttagaattattgtttccttcta

SEQ ID NO: 7108042 - DNA, 22 bp, Homo sapiens
ttagaatttctgctcactttga

SEQ ID NO: 7108043 - DNA, 22 bp, Homo sapiens
ttagacaagggctccttaaaag

SEQ ID NO: 7108044 - DNA, 22 bp, Homo sapiens
ttagaatctaacattcttatct

SEQ ID NO: 7108045 - DNA, 22 bp, Homo sapiens
ttagaatccatggttgcagtgg

SEQ ID NO: 7108046 - DNA, 22 bp, Homo sapiens
ttagaatcttgtatcagaagtt

SEQ ID NO: 7108047 - DNA, 22 bp, Homo sapiens
ttagaatctttagagtctcact

SEQ ID NO: 7108048 - DNA, 22 bp, Homo sapiens
ttagaatcagaagagaggtatt

SEQ ID NO: 7108049 - DNA, 22 bp, Homo sapiens
ttagaatcaggtgttataatca

SEQ ID NO: 7108050 - DNA, 22 bp, Homo sapiens
ttagaaaaatgttcagtagttt

SEQ ID NO: 7108051 - DNA, 22 bp, Homo sapiens
ttagaaaaatgttcagtagttt

SEQ ID NO: 7108052 - DNA, 22 bp, Homo sapiens
ttagaaaacataagtggtaaag

SEQ ID NO: 7108053 - DNA, 22 bp, Homo sapiens
ttagaaaacataagtggtaaag

SEQ ID NO: 7108054 - DNA, 22 bp, Homo sapiens
ttagaaaatggaggtgggaggg

SEQ ID NO: 7108055 - DNA, 22 bp, Homo sapiens
ttagaaaatggaggtgggaggg

SEQ ID NO: 7108056 - DNA, 19 bp, Homo sapiens
ccttccccttcagcctctg

SEQ ID NO: 7108057 - DNA, 19 bp, Homo sapiens
ccttccccttcagcctctg

SEQ ID NO: 7108058 - DNA, 19 bp, Homo sapiens
ccttccccttcagcctctg

SEQ ID NO: 7108059 - DNA, 22 bp, Homo sapiens
ccttccccaggtgctcactgtc

SEQ ID NO: 7108060 - DNA, 22 bp, Homo sapiens
ccttccccaggtgctcactgtc

SEQ ID NO: 7108061 - DNA, 22 bp, Homo sapiens
ccttcccatgcagcctgtctga

SEQ ID NO: 7108062 - DNA, 22 bp, Homo sapiens
ccttcccatgcagcctgtctga

SEQ ID NO: 7108063 - DNA, 22 bp, Homo sapiens
ccttccagttcttggttgtaat

SEQ ID NO: 7108064 - DNA, 22 bp, Homo sapiens
ccttcccacattccttacatgc

SEQ ID NO: 7108065 - DNA, 22 bp, Homo sapiens
ccttcccacattccttacatgc

SEQ ID NO: 7108066 - DNA, 22 bp, Homo sapiens
ccttcccaggctagaccaacat

SEQ ID NO: 7108067 - DNA, 22 bp, Homo sapiens
ccttcctggctgtccgcctgat

SEQ ID NO: 7108068 - DNA, 22 bp, Homo sapiens
ccttcctggctgtccgcctgat

SEQ ID NO: 7108069 - DNA, 22 bp, Homo sapiens
ccttcctggagcccatgcagat

SEQ ID NO: 7108070 - DNA, 22 bp, Homo sapiens
ccttcctggctgtccgcctgat

SEQ ID NO: 7108071 - DNA, 22 bp, Homo sapiens
ccttcctggctgtccgcctgat

SEQ ID NO: 7108072 - DNA, 22 bp, Homo sapiens
ccttccttcaagcacacatcta

SEQ ID NO: 7108073 - DNA, 22 bp, Homo sapiens
ccttcctggctgtccgcctgat

SEQ ID NO: 7108074 - DNA, 19 bp, Homo sapiens
ccttcctccccagggccat

SEQ ID NO: 7108075 - DNA, 19 bp, Homo sapiens
ccttcctccccagggccat

SEQ ID NO: 7108076 - DNA, 19 bp, Homo sapiens
ccttcctccccagggccat

SEQ ID NO: 7108077 - DNA, 22 bp, Homo sapiens
ccttcctggagcccatgcagat

SEQ ID NO: 7108078 - DNA, 22 bp, Homo sapiens
ccttcctggagcccatgcagat

SEQ ID NO: 7108079 - DNA, 19 bp, Homo sapiens
ccttcctccccagggccat

SEQ ID NO: 7108080 - DNA, 22 bp, Homo sapiens
ccttcctggagcccatgcagat

SEQ ID NO: 7108081 - DNA, 22 bp, Homo sapiens
ccttcctggagcccatgcagat

SEQ ID NO: 7108082 - DNA, 17 bp, Homo sapiens
ccttcctcatctccttc

SEQ ID NO: 7108083 - DNA, 17 bp, Homo sapiens
ccttcctcatctccttc

SEQ ID NO: 7108084 - DNA, 17 bp, Homo sapiens
ccttcctcatctccttc

SEQ ID NO: 7108085 - DNA, 22 bp, Homo sapiens
ccttcctcatccatttctcttg

SEQ ID NO: 7108086 - DNA, 22 bp, Homo sapiens
ccttccctaaagcgtcgcttag

SEQ ID NO: 7108087 - DNA, 22 bp, Homo sapiens
ccttcctcatccatttctcttg

SEQ ID NO: 7108088 - DNA, 19 bp, Homo sapiens
ccttccccttcagcctctg

SEQ ID NO: 7108089 - DNA, 23 bp, Homo sapiens
cctgtgtctgttgctgaataatg

SEQ ID NO: 7108090 - DNA, 22 bp, Homo sapiens
cctgtgtcttccccactggtgt

SEQ ID NO: 7108091 - DNA, 22 bp, Homo sapiens
cctgtgtctttgcctcagggtc

SEQ ID NO: 7108092 - DNA, 16 bp, Homo sapiens
cctgtgtctatcaggt

SEQ ID NO: 7108093 - DNA, 22 bp, Homo sapiens
cctgtgtctgaccatgcacatg

SEQ ID NO: 7108094 - DNA, 22 bp, Homo sapiens
cctgtgtctgaccatgcacatg

SEQ ID NO: 7108095 - DNA, 22 bp, Homo sapiens
cctgtgtcctcccactcagtcc

SEQ ID NO: 7108096 - DNA, 22 bp, Homo sapiens
cctgtgtccttggcagatatcc

SEQ ID NO: 7108097 - DNA, 22 bp, Homo sapiens
cctgtgtgaaggttaggcaggt

SEQ ID NO: 7108098 - DNA, 22 bp, Homo sapiens
cctgtgtgaaggttaggcaggt

SEQ ID NO: 7108099 - DNA, 22 bp, Homo sapiens
cctgtgtgcacacgaggccatg

SEQ ID NO: 7108100 - DNA, 22 bp, Homo sapiens
cctgtgtgcacacgaggccatg

SEQ ID NO: 7108101 - DNA, 22 bp, Homo sapiens
cctgtgtgctgatgacgacaga

SEQ ID NO: 7108102 - DNA, 22 bp, Homo sapiens
cctgtgtgtaggccaggggagt

SEQ ID NO: 7108103 - DNA, 20 bp, Homo sapiens
cctgtgtggtttgcactaca

SEQ ID NO: 7108104 - DNA, 22 bp, Homo sapiens
cctgtgtggtagccagcggtgc

SEQ ID NO: 7108105 - DNA, 22 bp, Homo sapiens
cctgtgtggtagccagcggtgc

SEQ ID NO: 7108106 - DNA, 19 bp, Homo sapiens
cctgtgtggggtagagatc

SEQ ID NO: 7108107 - DNA, 22 bp, Homo sapiens
cctgtgtgtaggccaggggagt

SEQ ID NO: 7108108 - DNA, 22 bp, Homo sapiens
cctgtgtgtaggccaggggagt

SEQ ID NO: 7108109 - DNA, 21 bp, Homo sapiens
cctgtgtgtctgactgggcta

SEQ ID NO: 7108110 - DNA, 22 bp, Homo sapiens
cctgtgtgtctgtcactgcaca

SEQ ID NO: 7108111 - DNA, 22 bp, Homo sapiens
cctgtgtggaaggcaggaggcc

SEQ ID NO: 7108112 - DNA, 20 bp, Homo sapiens
cctgtgtggccagctgaggc

SEQ ID NO: 7108113 - DNA, 20 bp, Homo sapiens
cctgtgtggccagctgaggc

SEQ ID NO: 7108114 - DNA, 22 bp, Homo sapiens
cctgtgtggccaggctggagtc

SEQ ID NO: 7108115 - DNA, 22 bp, Homo sapiens
cctgtgtggccaggctggagtc

SEQ ID NO: 7108116 - DNA, 20 bp, Homo sapiens
cctgtgtggccagctgaggc

SEQ ID NO: 7108117 - DNA, 22 bp, Homo sapiens
cctgtgtggccaggctggagtc

SEQ ID NO: 7108118 - DNA, 22 bp, Homo sapiens
cctgtgtggccaggctggagtc

SEQ ID NO: 7108119 - DNA, 19 bp, Homo sapiens
cctgtgtggggtagagatc

SEQ ID NO: 7108120 - DNA, 19 bp, Homo sapiens
cctgtgtggggtagagatc

SEQ ID NO: 7108121 - DNA, 22 bp, Homo sapiens
cctgtctgtttcattccttgtt

SEQ ID NO: 7108122 - DNA, 23 bp, Homo sapiens
cctgtctgtgctgggtggacaca

SEQ ID NO: 7108123 - DNA, 22 bp, Homo sapiens
cctgtctgtcctttgcattctt

SEQ ID NO: 7108124 - DNA, 22 bp, Homo sapiens
cctgtctgtcctttgcattctt

SEQ ID NO: 7108125 - DNA, 19 bp, Homo sapiens
cctgtctgtcttcagctag

SEQ ID NO: 7108126 - DNA, 23 bp, Homo sapiens
cctgtctgtgctgggtggacaca

SEQ ID NO: 7108127 - DNA, 22 bp, Homo sapiens
cctgtctgtttgcccattcttg

SEQ ID NO: 7108128 - DNA, 21 bp, Homo sapiens
cctgtcttggactgaggcacc

SEQ ID NO: 7108129 - DNA, 21 bp, Homo sapiens
cctgtcttggactgaggcacc

SEQ ID NO: 7108130 - DNA, 17 bp, Homo sapiens
cctgtcttgtttctgcc

SEQ ID NO: 7108131 - DNA, 22 bp, Homo sapiens
cctgtgacaaacccgcctattc

SEQ ID NO: 7108132 - DNA, 23 bp, Homo sapiens
cctgtgacactgtttgtggtaag

SEQ ID NO: 7108133 - DNA, 18 bp, Homo sapiens
cctgtgacagaggcatca

SEQ ID NO: 7108134 - DNA, 18 bp, Homo sapiens
cctgtgacagaggcatca

SEQ ID NO: 7108135 - DNA, 22 bp, Homo sapiens
cctgtctgtcctctcatgagcc

SEQ ID NO: 7108136 - DNA, 22 bp, Homo sapiens
cctgtctgtattggtttgctat

SEQ ID NO: 7108137 - DNA, 18 bp, Homo sapiens
cctgtctggggtccccac

SEQ ID NO: 7108138 - DNA, 18 bp, Homo sapiens
cctgtctggggtccccac

SEQ ID NO: 7108139 - DNA, 22 bp, Homo sapiens
cctgtctggggactccctgggt

SEQ ID NO: 7108140 - DNA, 22 bp, Homo sapiens
cctgtctggtgagggggttgca

SEQ ID NO: 7108141 - DNA, 22 bp, Homo sapiens
cctgtctgtatcggttcagagt

SEQ ID NO: 7108142 - DNA, 22 bp, Homo sapiens
cctgtctgtattattcaccact

SEQ ID NO: 7108143 - DNA, 22 bp, Homo sapiens
cctgtctggccttccacggggg

SEQ ID NO: 7108144 - DNA, 22 bp, Homo sapiens
cctgtctggccaccagggcgat

SEQ ID NO: 7108145 - DNA, 22 bp, Homo sapiens
cctgtctggccttccacggggg

SEQ ID NO: 7108146 - DNA, 22 bp, Homo sapiens
cctgtctggccttccacggggg

SEQ ID NO: 7108147 - DNA, 22 bp, Homo sapiens
cctgtctgggcttgagtattta

SEQ ID NO: 7108148 - DNA, 22 bp, Homo sapiens
cctgtctggaacatggcctgtt

SEQ ID NO: 7108149 - DNA, 20 bp, Homo sapiens
cctgtctggagacaaagaga

SEQ ID NO: 7108150 - DNA, 22 bp, Homo sapiens
cctgtctggccaccagggcgat

SEQ ID NO: 7108151 - DNA, 22 bp, Homo sapiens
cctgtctgcatgatccctgcca

SEQ ID NO: 7108152 - DNA, 22 bp, Homo sapiens
cctgtctgcatgatccctgcca

SEQ ID NO: 7108153 - DNA, 22 bp, Homo sapiens
cctgtctgcagatatctcaggt

SEQ ID NO: 7108154 - DNA, 22 bp, Homo sapiens
cctgtctgcaggaaattaccag

SEQ ID NO: 7108155 - DNA, 20 bp, Homo sapiens
cctgtctgcaatggaggtca

SEQ ID NO: 7108156 - DNA, 22 bp, Homo sapiens
cctgtctgaatcatgatttcct

SEQ ID NO: 7108157 - DNA, 22 bp, Homo sapiens
cctgtcagctgatggctatgta

SEQ ID NO: 7108158 - DNA, 22 bp, Homo sapiens
tgtttagtaggagtttaatact

SEQ ID NO: 7108159 - DNA, 22 bp, Homo sapiens
tgtttataaattttcttgccat

SEQ ID NO: 7108160 - DNA, 22 bp, Homo sapiens
tgtttactttccttctcacagg

SEQ ID NO: 7108161 - DNA, 22 bp, Homo sapiens
tgtttagaatcattcaaaagtt

SEQ ID NO: 7108162 - DNA, 22 bp, Homo sapiens
tgtttagacaaggatcaggtta

SEQ ID NO: 7108163 - DNA, 22 bp, Homo sapiens
tgtttagactcaaaattgaaag

SEQ ID NO: 7108164 - DNA, 22 bp, Homo sapiens
tgtttagaggaacaacagactt

SEQ ID NO: 7108165 - DNA, 22 bp, Homo sapiens
tgtttagagtctctgtcaacat

SEQ ID NO: 7108166 - DNA, 22 bp, Homo sapiens
tgtttagatgcaaagtctcaca

SEQ ID NO: 7108167 - DNA, 19 bp, Homo sapiens
cctgtgctaggagctgacc

SEQ ID NO: 7108168 - DNA, 19 bp, Homo sapiens
cctgtgctaggagctgacc

SEQ ID NO: 7108169 - DNA, 19 bp, Homo sapiens
cctgtgctaggagctgacc

SEQ ID NO: 7108170 - DNA, 19 bp, Homo sapiens
cctgtgctaggagctgacc

SEQ ID NO: 7108171 - DNA, 19 bp, Homo sapiens
cctgtgctaggagctgacc

SEQ ID NO: 7108172 - DNA, 21 bp, Homo sapiens
cctgtgctccacacagggtcc

SEQ ID NO: 7108173 - DNA, 18 bp, Homo sapiens
cctgtgctccagcatctg

SEQ ID NO: 7108174 - DNA, 22 bp, Homo sapiens
cctgtgctcccatagcttctgt

SEQ ID NO: 7108175 - DNA, 22 bp, Homo sapiens
cctgtgctcccatagcttctgt

SEQ ID NO: 7108176 - DNA, 22 bp, Homo sapiens
cctgtgctccctatgtatctgg

SEQ ID NO: 7108177 - DNA, 22 bp, Homo sapiens
cctgtgctccctatgtatctgg

SEQ ID NO: 7108178 - DNA, 22 bp, Homo sapiens
cctgtgccctacacctttccag

SEQ ID NO: 7108179 - DNA, 22 bp, Homo sapiens
cctgtgccctcagcctggctct

SEQ ID NO: 7108180 - DNA, 22 bp, Homo sapiens
cctgtgccctcagcctggctct

SEQ ID NO: 7108181 - DNA, 22 bp, Homo sapiens
cctgtgccctgccaggctggtg

SEQ ID NO: 7108182 - DNA, 22 bp, Homo sapiens
cctgtgcctgcctgtgagttct

SEQ ID NO: 7108183 - DNA, 22 bp, Homo sapiens
cctgtgccttaaccctttaggc

SEQ ID NO: 7108184 - DNA, 22 bp, Homo sapiens
cctgtgccttaaccctttaggc

SEQ ID NO: 7108185 - DNA, 22 bp, Homo sapiens
ttaaagctggcgttacagtttg

SEQ ID NO: 7108186 - DNA, 22 bp, Homo sapiens
ttaaagctgagccctcagaagc

SEQ ID NO: 7108187 - DNA, 22 bp, Homo sapiens
ttaaagctgctgaatcctattt

SEQ ID NO: 7108188 - DNA, 22 bp, Homo sapiens
ttaaaggatctttgtcattaat

SEQ ID NO: 7108189 - DNA, 22 bp, Homo sapiens
ttaaaggatctttgtcattaat

SEQ ID NO: 7108190 - DNA, 23 bp, Homo sapiens
ttaaaggcagatgttgagtatta

SEQ ID NO: 7108191 - DNA, 22 bp, Homo sapiens
ttaaaggcatggttagacatgg

SEQ ID NO: 7108192 - DNA, 22 bp, Homo sapiens
ttaaaggcatggttagacatgg

SEQ ID NO: 7108193 - DNA, 21 bp, Homo sapiens
ttaaagctatggtagtgggct

SEQ ID NO: 7108194 - DNA, 22 bp, Homo sapiens
cctgtgcttcagctggaggagg

SEQ ID NO: 7108195 - DNA, 22 bp, Homo sapiens
cctgtgctgggtgtgagggaca

SEQ ID NO: 7108196 - DNA, 20 bp, Homo sapiens
cctgtgcttatcacttgctg

SEQ ID NO: 7108197 - DNA, 22 bp, Homo sapiens
cctgtgcttcactcaacaagcc

SEQ ID NO: 7108198 - DNA, 22 bp, Homo sapiens
cctgtgcttcactcaacaagcc

SEQ ID NO: 7108199 - DNA, 22 bp, Homo sapiens
cctgtgcttcagctggaggagg

SEQ ID NO: 7108200 - DNA, 22 bp, Homo sapiens
cctgtgctggacagggctgggc

SEQ ID NO: 7108201 - DNA, 22 bp, Homo sapiens
cctgtgctggacagggctgggc

SEQ ID NO: 7108202 - DNA, 22 bp, Homo sapiens
cctgtgctccctatgtatctgg

SEQ ID NO: 7108203 - DNA, 20 bp, Homo sapiens
cctgtgctgccctcggggcc

SEQ ID NO: 7108204 - DNA, 20 bp, Homo sapiens
cctgtgctgccctcggggcc

SEQ ID NO: 7108205 - DNA, 22 bp, Homo sapiens
cctgtgctggacagggctgggc

SEQ ID NO: 7108206 - DNA, 22 bp, Homo sapiens
cctgtgctggctttattctcag

SEQ ID NO: 7108207 - DNA, 22 bp, Homo sapiens
cctgtgctgggaaaacacggag

SEQ ID NO: 7108208 - DNA, 22 bp, Homo sapiens
cctgtgctgggtgtgagggaca

SEQ ID NO: 7108209 - DNA, 22 bp, Homo sapiens
cctgtgtcctaatccatcaggc

SEQ ID NO: 7108210 - DNA, 19 bp, Homo sapiens
cctgtgtcccacgtagatg

SEQ ID NO: 7108211 - DNA, 22 bp, Homo sapiens
cctgtgtccagttccaggttgt

SEQ ID NO: 7108212 - DNA, 22 bp, Homo sapiens
cctgtgtcaccggaacggagga

SEQ ID NO: 7108213 - DNA, 22 bp, Homo sapiens
cctgtgtcaccggaacggagga

SEQ ID NO: 7108214 - DNA, 22 bp, Homo sapiens
cctgtgtcagcccctgcctcca

SEQ ID NO: 7108215 - DNA, 22 bp, Homo sapiens
cctgtgtcatcagctgtggcta

SEQ ID NO: 7108216 - DNA, 22 bp, Homo sapiens
cctgtgggagcccaggcagata

SEQ ID NO: 7108217 - DNA, 22 bp, Homo sapiens
cctgtgggtcacatgggtgact

SEQ ID NO: 7108218 - DNA, 22 bp, Homo sapiens
cctgtgggagcccaggcagata

SEQ ID NO: 7108219 - DNA, 22 bp, Homo sapiens
cctgtgggttttcaagatgcta

SEQ ID NO: 7108220 - DNA, 22 bp, Homo sapiens
cctgtgggttttctgtagaaat

SEQ ID NO: 7108221 - DNA, 21 bp, Homo sapiens
cctgtggtctggagggagcac

SEQ ID NO: 7108222 - DNA, 21 bp, Homo sapiens
cctgtggtctggagggagcac

SEQ ID NO: 7108223 - DNA, 21 bp, Homo sapiens
cctgtggtctggagggagcac

SEQ ID NO: 7108224 - DNA, 22 bp, Homo sapiens
cctgtggtttacatgacagtta

SEQ ID NO: 7108225 - DNA, 22 bp, Homo sapiens
cctgtggtttacgtacagctcc

SEQ ID NO: 7108226 - DNA, 22 bp, Homo sapiens
cctgtggtttactctgtggcta

SEQ ID NO: 7108227 - DNA, 19 bp, Homo sapiens
ttaaagtgcgagaagtctt

SEQ ID NO: 7108228 - DNA, 22 bp, Homo sapiens
ttaaagtctatgtactacactt

SEQ ID NO: 7108229 - DNA, 22 bp, Homo sapiens
ttaaagtatggtttaagggctt

SEQ ID NO: 7108230 - DNA, 22 bp, Homo sapiens
ttaaagtccctgccttaattcc

SEQ ID NO: 7108231 - DNA, 22 bp, Homo sapiens
ttaaagtctatgtactacactt

SEQ ID NO: 7108232 - DNA, 22 bp, Homo sapiens
ttaaagtatagaggacaaaaac

SEQ ID NO: 7108233 - DNA, 22 bp, Homo sapiens
ttaaagtaatctgtgtgaattt

SEQ ID NO: 7108234 - DNA, 22 bp, Homo sapiens
ttaaagtaatctgtgtgaattt

SEQ ID NO: 7108235 - DNA, 22 bp, Homo sapiens
ttaaatagctcttgtagaagaa

SEQ ID NO: 7108236 - DNA, 22 bp, Homo sapiens
ttaaagttcattaaatgagcca

SEQ ID NO: 7108237 - DNA, 22 bp, Homo sapiens
ttaaatagctcttgtagaagaa

SEQ ID NO: 7108238 - DNA, 22 bp, Homo sapiens
ttaaatagctcttgtagaagaa

SEQ ID NO: 7108239 - DNA, 22 bp, Homo sapiens
ttaaatagctcttgtagaagaa

SEQ ID NO: 7108240 - DNA, 22 bp, Homo sapiens
ttaaatagctcttgtagaagaa

SEQ ID NO: 7108241 - DNA, 22 bp, Homo sapiens
cctgtgggaaaggtctgctctc

SEQ ID NO: 7108242 - DNA, 22 bp, Homo sapiens
ccatggcctgaaggagtgcatc

SEQ ID NO: 7108243 - DNA, 22 bp, Homo sapiens
ccatggctaagtatctgtagaa

SEQ ID NO: 7108244 - DNA, 22 bp, Homo sapiens
ccatgtgggattttggtgtctg

SEQ ID NO: 7108245 - DNA, 22 bp, Homo sapiens
ccatgtggtgggaaggagaatg

SEQ ID NO: 7108246 - DNA, 22 bp, Homo sapiens
ccatgtgtaaattagataactc

SEQ ID NO: 7108247 - DNA, 22 bp, Homo sapiens
ccatgtgtcgggcctgcagtgg

SEQ ID NO: 7108248 - DNA, 22 bp, Homo sapiens
ccatgtgtctcccctggaagta

SEQ ID NO: 7108249 - DNA, 22 bp, Homo sapiens
ccatgtgttcaataagggagtt

SEQ ID NO: 7108250 - DNA, 18 bp, Homo sapiens
ccatgtgttccttttggg

SEQ ID NO: 7108251 - DNA, 22 bp, Homo sapiens
tgaggtatggtaaggtaaaatc

SEQ ID NO: 7108252 - DNA, 22 bp, Homo sapiens
tgaggtcaagcccagagcagca

SEQ ID NO: 7108253 - DNA, 22 bp, Homo sapiens
tgaggtcaagcccagagcagca

SEQ ID NO: 7108254 - DNA, 22 bp, Homo sapiens
tgaggtcacagctggggatgga

SEQ ID NO: 7108255 - DNA, 22 bp, Homo sapiens
tgaggtcacctggaggcagcct

SEQ ID NO: 7108256 - DNA, 22 bp, Homo sapiens
ccatggcctgaaggagtgcatc

SEQ ID NO: 7108257 - DNA, 22 bp, Homo sapiens
tgaggtaggataagacaatgag

SEQ ID NO: 7108258 - DNA, 22 bp, Homo sapiens
tgaggtaggcttgagatgggag

SEQ ID NO: 7108259 - DNA, 22 bp, Homo sapiens
tgaggtaggcttgagatgggag

SEQ ID NO: 7108260 - DNA, 22 bp, Homo sapiens
tgaggtagggaaggctggtatt

SEQ ID NO: 7108261 - DNA, 22 bp, Homo sapiens
tgaggtagggagtttgttgttg

SEQ ID NO: 7108262 - DNA, 22 bp, Homo sapiens
tgaggtagggacttaaaactgt

SEQ ID NO: 7108263 - DNA, 22 bp, Homo sapiens
tgaggtaggtaccattatcact

SEQ ID NO: 7108264 - DNA, 22 bp, Homo sapiens
tgaggtaggtggtaagagatac

SEQ ID NO: 7108265 - DNA, 22 bp, Homo sapiens
tgaggtaggtggtaagagatac

SEQ ID NO: 7108266 - DNA, 22 bp, Homo sapiens
tgaggtaggtggtgaaaaatga

SEQ ID NO: 7108267 - DNA, 22 bp, Homo sapiens
tgaggtaggtggtgaaaaatga

SEQ ID NO: 7108268 - DNA, 22 bp, Homo sapiens
tgaggtaggtggtggcagccat

SEQ ID NO: 7108269 - DNA, 22 bp, Homo sapiens
tgaggtaggtgtcgagagaggt

SEQ ID NO: 7108270 - DNA, 22 bp, Homo sapiens
tgaggtaggtgtcgagagaggt

SEQ ID NO: 7108271 - DNA, 22 bp, Homo sapiens
tgaggtaggttgaaagatagat

SEQ ID NO: 7108272 - DNA, 22 bp, Homo sapiens
tgaggtaggttgaaagatagat

SEQ ID NO: 7108273 - DNA, 22 bp, Homo sapiens
tgaggtagtaaaggtgttagtt

SEQ ID NO: 7108274 - DNA, 22 bp, Homo sapiens
tgaggtagtgattgtagaagtg

SEQ ID NO: 7108275 - DNA, 22 bp, Homo sapiens
tgaggtagtagatttttgtcca

SEQ ID NO: 7108276 - DNA, 22 bp, Homo sapiens
tgaggtagtgattgtagaagtg

SEQ ID NO: 7108277 - DNA, 22 bp, Homo sapiens
tgaggtagtgcttgtcatgttt

SEQ ID NO: 7108278 - DNA, 21 bp, Homo sapiens
tgaggtagtgtttgtcaagtt

SEQ ID NO: 7108279 - DNA, 22 bp, Homo sapiens
tgaggtagtgtttagtccagtc

SEQ ID NO: 7108280 - DNA, 22 bp, Homo sapiens
tgaggtagttctaatattaaag

SEQ ID NO: 7108281 - DNA, 22 bp, Homo sapiens
tgaggtagtttgttgtacagta

SEQ ID NO: 7108282 - DNA, 22 bp, Homo sapiens
tgaggtatacgttggttcagtc

SEQ ID NO: 7108283 - DNA, 22 bp, Homo sapiens
tgaggtagtttttcaagtattt

SEQ ID NO: 7108284 - DNA, 22 bp, Homo sapiens
ccatgcatgcctgaaattgctg

SEQ ID NO: 7108285 - DNA, 22 bp, Homo sapiens
ccatgcatataatagtgcctgg

SEQ ID NO: 7108286 - DNA, 22 bp, Homo sapiens
ccatgcatatgcacgtaaatta

SEQ ID NO: 7108287 - DNA, 22 bp, Homo sapiens
ccatgcatctaccagccccaga

SEQ ID NO: 7108288 - DNA, 22 bp, Homo sapiens
ccatgcatgcctgaaattgctg

SEQ ID NO: 7108289 - DNA, 22 bp, Homo sapiens
ccatgcatggcactggactggg

SEQ ID NO: 7108290 - DNA, 22 bp, Homo sapiens
ccatgcatggcactggactggg

SEQ ID NO: 7108291 - DNA, 22 bp, Homo sapiens
ccatgcattcctgctctgcgca

SEQ ID NO: 7108292 - DNA, 22 bp, Homo sapiens
ccatgccagctgctaggtcaca

SEQ ID NO: 7108293 - DNA, 22 bp, Homo sapiens
ccatgccatactggccacccgg

SEQ ID NO: 7108294 - DNA, 22 bp, Homo sapiens
ccatgcccacgttgtggctcag

SEQ ID NO: 7108295 - DNA, 22 bp, Homo sapiens
ccatgcccacgttgtggctcag

SEQ ID NO: 7108296 - DNA, 22 bp, Homo sapiens
ccatgccccaccaggacgctgc

SEQ ID NO: 7108297 - DNA, 22 bp, Homo sapiens
ccatgccccaccaggacgctgc

SEQ ID NO: 7108298 - DNA, 22 bp, Homo sapiens
ccatcctggcctcgctgtccac

SEQ ID NO: 7108299 - DNA, 22 bp, Homo sapiens
ccatcctggcctcgctgtccac

SEQ ID NO: 7108300 - DNA, 22 bp, Homo sapiens
ccatcctggccttgctgtccac

SEQ ID NO: 7108301 - DNA, 22 bp, Homo sapiens
ccatcctggcctcgctgtccac

SEQ ID NO: 7108302 - DNA, 22 bp, Homo sapiens
ccatcctggccttgctgtccac

SEQ ID NO: 7108303 - DNA, 22 bp, Homo sapiens
ccatcctggccttgctgtccac

SEQ ID NO: 7108304 - DNA, 22 bp, Homo sapiens
ccatgcagtgctggagctgatt

SEQ ID NO: 7108305 - DNA, 22 bp, Homo sapiens
ccatcctgcattgctattcaga

SEQ ID NO: 7108306 - DNA, 22 bp, Homo sapiens
ccagtgtttccgtcagtacacg

SEQ ID NO: 7108307 - DNA, 22 bp, Homo sapiens
ccatgccctaaaggactggcag

SEQ ID NO: 7108308 - DNA, 22 bp, Homo sapiens
ccatgcccttgtcatctccagg

SEQ ID NO: 7108309 - DNA, 22 bp, Homo sapiens
ccatgcctcgggaagagtctgt

SEQ ID NO: 7108310 - DNA, 22 bp, Homo sapiens
ccatgcctggactccactctca

SEQ ID NO: 7108311 - DNA, 22 bp, Homo sapiens
ccatgcctggactccactctca

SEQ ID NO: 7108312 - DNA, 22 bp, Homo sapiens
ccatgccttcctttccctggaa

SEQ ID NO: 7108313 - DNA, 22 bp, Homo sapiens
ccatgctccttaccactcactt

SEQ ID NO: 7108314 - DNA, 22 bp, Homo sapiens
ccatgctccttaccactcactt

SEQ ID NO: 7108315 - DNA, 22 bp, Homo sapiens
ccatgctctggggaggtcaagc

SEQ ID NO: 7108316 - DNA, 22 bp, Homo sapiens
ccatgctgaccctgtgcaggca

SEQ ID NO: 7108317 - DNA, 22 bp, Homo sapiens
ccatgctgaccctgtgcaggca

SEQ ID NO: 7108318 - DNA, 22 bp, Homo sapiens
ccatgctggagtccctagctgt

SEQ ID NO: 7108319 - DNA, 22 bp, Homo sapiens
ccatgctgggatgctccaagtg

SEQ ID NO: 7108320 - DNA, 22 bp, Homo sapiens
ccatgctgtgacacagtagtta

SEQ ID NO: 7108321 - DNA, 22 bp, Homo sapiens
ccatgctgtgacacagtagtta

SEQ ID NO: 7108322 - DNA, 20 bp, Homo sapiens
ccagtccctgagcaccaggg

SEQ ID NO: 7108323 - DNA, 22 bp, Homo sapiens
ccagtcccgcatggtccagaat

SEQ ID NO: 7108324 - DNA, 22 bp, Homo sapiens
ccagtcccgcatggtccagaat

SEQ ID NO: 7108325 - DNA, 22 bp, Homo sapiens
ccagtcccgcatggtccagaat

SEQ ID NO: 7108326 - DNA, 22 bp, Homo sapiens
ccagtcccgcatggtccagaat

SEQ ID NO: 7108327 - DNA, 22 bp, Homo sapiens
ccagtcccgcatggtccagaat

SEQ ID NO: 7108328 - DNA, 22 bp, Homo sapiens
tgaggcagcctgcattaaagag

SEQ ID NO: 7108329 - DNA, 22 bp, Homo sapiens
ccagtcccatctctgtcgctta

SEQ ID NO: 7108330 - DNA, 20 bp, Homo sapiens
ccagtccctgagcaccaggg

SEQ ID NO: 7108331 - DNA, 20 bp, Homo sapiens
ccagtccctgagcaccaggg

SEQ ID NO: 7108332 - DNA, 20 bp, Homo sapiens
ccagtccctgagcaccaggg

SEQ ID NO: 7108333 - DNA, 20 bp, Homo sapiens
ccagtccctgagcaccaggg

SEQ ID NO: 7108334 - DNA, 20 bp, Homo sapiens
ccagtccctgagcaccaggg

SEQ ID NO: 7108335 - DNA, 22 bp, Homo sapiens
ccagtcctagaagaggagtcga

SEQ ID NO: 7108336 - DNA, 20 bp, Homo sapiens
ccagtccctgagcaccaggg

SEQ ID NO: 7108337 - DNA, 22 bp, Homo sapiens
ccagtcctagttctaccttaca

SEQ ID NO: 7108338 - DNA, 22 bp, Homo sapiens
ccagtcctcagatggtctgtgc

SEQ ID NO: 7108339 - DNA, 22 bp, Homo sapiens
tgaggcagcccactttccttag

SEQ ID NO: 7108340 - DNA, 22 bp, Homo sapiens
tgaggcagcccactttccttag

SEQ ID NO: 7108341 - DNA, 22 bp, Homo sapiens
tgaggcagcccactttccttag

SEQ ID NO: 7108342 - DNA, 22 bp, Homo sapiens
tgaggcagcccactttccttag

SEQ ID NO: 7108343 - DNA, 22 bp, Homo sapiens
tgaggcagcctgcattaaagag

SEQ ID NO: 7108344 - DNA, 22 bp, Homo sapiens
tgaggcagcctgcattaaagag

SEQ ID NO: 7108345 - DNA, 22 bp, Homo sapiens
tgaggcagcattcttcaagaca

SEQ ID NO: 7108346 - DNA, 22 bp, Homo sapiens
tgaggcagcattcttcaagaca

SEQ ID NO: 7108347 - DNA, 22 bp, Homo sapiens
tgaggcagcattcttcaagaca

SEQ ID NO: 7108348 - DNA, 22 bp, Homo sapiens
tgaggcagcattcttcaagaca

SEQ ID NO: 7108349 - DNA, 22 bp, Homo sapiens
tgaggcagcattcttcaagaca

SEQ ID NO: 7108350 - DNA, 22 bp, Homo sapiens
tgaggcagcaattgtattgtat

SEQ ID NO: 7108351 - DNA, 22 bp, Homo sapiens
ccagtctcttccctcctgccag

SEQ ID NO: 7108352 - DNA, 22 bp, Homo sapiens
ccagtctcttccctcctgccag

SEQ ID NO: 7108353 - DNA, 23 bp, Homo sapiens
ccagtctctttccaaaatcacat

SEQ ID NO: 7108354 - DNA, 22 bp, Homo sapiens
ccagtctcttccctcctgccag

SEQ ID NO: 7108355 - DNA, 22 bp, Homo sapiens
ccagtctcctaagagcccctga

SEQ ID NO: 7108356 - DNA, 19 bp, Homo sapiens
ccagtctccttgcagcatc

SEQ ID NO: 7108357 - DNA, 22 bp, Homo sapiens
ccagtctcgttgaggcgcttgt

SEQ ID NO: 7108358 - DNA, 22 bp, Homo sapiens
ccagtctcagttcacgttggta

SEQ ID NO: 7108359 - DNA, 22 bp, Homo sapiens
ccagtcctagttctaccttaca

SEQ ID NO: 7108360 - DNA, 22 bp, Homo sapiens
ccagtcctgccaccctgtctat

SEQ ID NO: 7108361 - DNA, 22 bp, Homo sapiens
ccagtcctgccaccctgtctat

SEQ ID NO: 7108362 - DNA, 22 bp, Homo sapiens
ccagtcctgctccctgaccacc

SEQ ID NO: 7108363 - DNA, 22 bp, Homo sapiens
ccagtcctgctccctgaccacc

SEQ ID NO: 7108364 - DNA, 22 bp, Homo sapiens
ccagtcctggccagtaacatga

SEQ ID NO: 7108365 - DNA, 22 bp, Homo sapiens
ccagtcctggccagtaacatga

SEQ ID NO: 7108366 - DNA, 22 bp, Homo sapiens
ccagtcctgggagcttgcactg

SEQ ID NO: 7108367 - DNA, 22 bp, Homo sapiens
ccagtcctgggagcttgcactg

SEQ ID NO: 7108368 - DNA, 22 bp, Homo sapiens
ccagtcctgggagcttgcactg

SEQ ID NO: 7108369 - DNA, 22 bp, Homo sapiens
ccagtcctgtgtgaccctgcac

SEQ ID NO: 7108370 - DNA, 22 bp, Homo sapiens
ccagtcctgtgtgaccctgcac

SEQ ID NO: 7108371 - DNA, 22 bp, Homo sapiens
ccagtcctttgagccagttctg

SEQ ID NO: 7108372 - DNA, 22 bp, Homo sapiens
tgaggggaactgatgcccattg

SEQ ID NO: 7108373 - DNA, 22 bp, Homo sapiens
tgagggctgcttccagagctag

SEQ ID NO: 7108374 - DNA, 22 bp, Homo sapiens
tgagggctgcttccagagctag

SEQ ID NO: 7108375 - DNA, 22 bp, Homo sapiens
tgagggctgcttccagagctag

SEQ ID NO: 7108376 - DNA, 22 bp, Homo sapiens
tgagggctgtctgaagcttggg

SEQ ID NO: 7108377 - DNA, 22 bp, Homo sapiens
tgagggctgtggaaggctaacc

SEQ ID NO: 7108378 - DNA, 22 bp, Homo sapiens
tgagggctgcttccagagctag

SEQ ID NO: 7108379 - DNA, 22 bp, Homo sapiens
tgagggctgcttccagagctag

SEQ ID NO: 7108380 - DNA, 22 bp, Homo sapiens
tgagggctgcttccagagctag

SEQ ID NO: 7108381 - DNA, 22 bp, Homo sapiens
tgagggctgacaggaggacagc

SEQ ID NO: 7108382 - DNA, 22 bp, Homo sapiens
tgagggctgacaggaggacagc

SEQ ID NO: 7108383 - DNA, 20 bp, Homo sapiens
tgagggctaaccagactctg

SEQ ID NO: 7108384 - DNA, 20 bp, Homo sapiens
tgagggctaaccagactctg

SEQ ID NO: 7108385 - DNA, 22 bp, Homo sapiens
tgagggctccccgctgctgtgt

SEQ ID NO: 7108386 - DNA, 22 bp, Homo sapiens
tgagggcagagcactggggagc

SEQ ID NO: 7108387 - DNA, 22 bp, Homo sapiens
tgagggcaaagtggtgctgagg

SEQ ID NO: 7108388 - DNA, 22 bp, Homo sapiens
tgagggatggtgagagtctgat

SEQ ID NO: 7108389 - DNA, 23 bp, Homo sapiens
tgaggctgattgatttttgctca

SEQ ID NO: 7108390 - DNA, 23 bp, Homo sapiens
tgaggctgattgatttttgctca

SEQ ID NO: 7108391 - DNA, 22 bp, Homo sapiens
ccagtctgaggcctggtgaggg

SEQ ID NO: 7108392 - DNA, 23 bp, Homo sapiens
tgaggctgattgatttttgctca

SEQ ID NO: 7108393 - DNA, 22 bp, Homo sapiens
tgagggccgaggagctgtgggt

SEQ ID NO: 7108394 - DNA, 22 bp, Homo sapiens
tgagggcagagcactggggagc

SEQ ID NO: 7108395 - DNA, 22 bp, Homo sapiens
tgagggctaaattgtggcaggt

SEQ ID NO: 7108396 - DNA, 22 bp, Homo sapiens
tgagggctaaattgtggcaggt

SEQ ID NO: 7108397 - DNA, 22 bp, Homo sapiens
tgagggctaaattgtggcaggt

SEQ ID NO: 7108398 - DNA, 22 bp, Homo sapiens
tgcacagaatcattttcagctg

SEQ ID NO: 7108399 - DNA, 22 bp, Homo sapiens
tgcacagacaactctttctaga

SEQ ID NO: 7108400 - DNA, 22 bp, Homo sapiens
tgcacacattctatggggctga

SEQ ID NO: 7108401 - DNA, 22 bp, Homo sapiens
tgcacagaataatatatgttct

SEQ ID NO: 7108402 - DNA, 22 bp, Homo sapiens
tgcacacattaaggatacacag

SEQ ID NO: 7108403 - DNA, 23 bp, Homo sapiens
cccagaccttgtgctgcccttgg

SEQ ID NO: 7108404 - DNA, 22 bp, Homo sapiens
cccagactcatccctgggagct

SEQ ID NO: 7108405 - DNA, 22 bp, Homo sapiens
tgcacacatatgagcatgtgtg

SEQ ID NO: 7108406 - DNA, 22 bp, Homo sapiens
cccagaaggctaagcgtggatt

SEQ ID NO: 7108407 - DNA, 22 bp, Homo sapiens
cccagaaggctaagcgtggatt

SEQ ID NO: 7108408 - DNA, 22 bp, Homo sapiens
cccagaaggcttgccaggaagc

SEQ ID NO: 7108409 - DNA, 22 bp, Homo sapiens
cccagaaggcttgccaggaagc

SEQ ID NO: 7108410 - DNA, 22 bp, Homo sapiens
cccagaaggcttgccaggaagc

SEQ ID NO: 7108411 - DNA, 22 bp, Homo sapiens
cccagaaggtcgaggctgcagt

SEQ ID NO: 7108412 - DNA, 22 bp, Homo sapiens
cccagaaggtcgaggctgcagt

SEQ ID NO: 7108413 - DNA, 22 bp, Homo sapiens
cccagaaggtcgaggctgcagt

SEQ ID NO: 7108414 - DNA, 22 bp, Homo sapiens
cccagaaggtcgaggctgcagt

SEQ ID NO: 7108415 - DNA, 22 bp, Homo sapiens
cccagaaggtcgaggctgcagt

SEQ ID NO: 7108416 - DNA, 20 bp, Homo sapiens
cccagaagtcacctccactc

SEQ ID NO: 7108417 - DNA, 21 bp, Homo sapiens
cccagaagttccatggggggc

SEQ ID NO: 7108418 - DNA, 21 bp, Homo sapiens
cccagaagttccatggggggc

SEQ ID NO: 7108419 - DNA, 21 bp, Homo sapiens
cccagaagttccatggggggc

SEQ ID NO: 7108420 - DNA, 22 bp, Homo sapiens
cccagaataggtaagcccaggg

SEQ ID NO: 7108421 - DNA, 22 bp, Homo sapiens
cccagaatgattcagcgacagt

SEQ ID NO: 7108422 - DNA, 22 bp, Homo sapiens
cccagaatgttatagtgcccct

SEQ ID NO: 7108423 - DNA, 22 bp, Homo sapiens
cccagaattattctcttctcct

SEQ ID NO: 7108424 - DNA, 22 bp, Homo sapiens
cccagacagtcaagaggcctgc

SEQ ID NO: 7108425 - DNA, 22 bp, Homo sapiens
cccagacagtcaagaggcctgc

SEQ ID NO: 7108426 - DNA, 22 bp, Homo sapiens
cccagacagtcaagaggcctgc

SEQ ID NO: 7108427 - DNA, 22 bp, Homo sapiens
cccagacagtcaagaggcctgc

SEQ ID NO: 7108428 - DNA, 22 bp, Homo sapiens
cccagacagtgatttacttaat

SEQ ID NO: 7108429 - DNA, 22 bp, Homo sapiens
cccagacataacagcagagagg

SEQ ID NO: 7108430 - DNA, 22 bp, Homo sapiens
cccagacataacagcagagagg

SEQ ID NO: 7108431 - DNA, 22 bp, Homo sapiens
cccagacataacagcagagagg

SEQ ID NO: 7108432 - DNA, 22 bp, Homo sapiens
cccagacattgcagggactggt

SEQ ID NO: 7108433 - DNA, 22 bp, Homo sapiens
cccagacattgcagggactggt

SEQ ID NO: 7108434 - DNA, 22 bp, Homo sapiens
cccagacccagagggaggcagg

SEQ ID NO: 7108435 - DNA, 22 bp, Homo sapiens
cccactttggttgcactctgcc

SEQ ID NO: 7108436 - DNA, 20 bp, Homo sapiens
cccagaagcttaacagagca

SEQ ID NO: 7108437 - DNA, 20 bp, Homo sapiens
cccagaagcttaacagagca

SEQ ID NO: 7108438 - DNA, 22 bp, Homo sapiens
cccacttcatgggcaggaagga

SEQ ID NO: 7108439 - DNA, 22 bp, Homo sapiens
cccacttcatgggcaggaagga

SEQ ID NO: 7108440 - DNA, 22 bp, Homo sapiens
cccactgtgttgcagtctagtg

SEQ ID NO: 7108441 - DNA, 22 bp, Homo sapiens
tgcaaataggggacaactcttt

SEQ ID NO: 7108442 - DNA, 22 bp, Homo sapiens
tgcaaataggggacaactcttt

SEQ ID NO: 7108443 - DNA, 23 bp, Homo sapiens
tgcaaataacaaggagtttaagg

SEQ ID NO: 7108444 - DNA, 22 bp, Homo sapiens
tgcaaataaatttctgttcatt

SEQ ID NO: 7108445 - DNA, 23 bp, Homo sapiens
tgcaaataacaaggagtttaagg

SEQ ID NO: 7108446 - DNA, 22 bp, Homo sapiens
tgcaaatacaaaatggtacagc

SEQ ID NO: 7108447 - DNA, 22 bp, Homo sapiens
tgcaaagggctttgcatacaga

SEQ ID NO: 7108448 - DNA, 22 bp, Homo sapiens
tgcaaagcaatgtaggtcagct

SEQ ID NO: 7108449 - DNA, 23 bp, Homo sapiens
tgcaaagcacttaagaggccctg

SEQ ID NO: 7108450 - DNA, 22 bp, Homo sapiens
tgcaaagccacaatgaaatcag

SEQ ID NO: 7108451 - DNA, 21 bp, Homo sapiens
tgcaaagctgctgaagtggta

SEQ ID NO: 7108452 - DNA, 18 bp, Homo sapiens
tgcaaaggacactgagat

SEQ ID NO: 7108453 - DNA, 21 bp, Homo sapiens
tgcaaaggacctgaggtagga

SEQ ID NO: 7108454 - DNA, 22 bp, Homo sapiens
tgatttctcttggcaatatgtt

SEQ ID NO: 7108455 - DNA, 20 bp, Homo sapiens
tgatttctcttctattcctt

SEQ ID NO: 7108456 - DNA, 22 bp, Homo sapiens
tgatttcttctaatttccatca

SEQ ID NO: 7108457 - DNA, 22 bp, Homo sapiens
tgatttctcatattgttcaaaa

SEQ ID NO: 7108458 - DNA, 21 bp, Homo sapiens
tgatttctagatattggccca

SEQ ID NO: 7108459 - DNA, 22 bp, Homo sapiens
ccattgtaaattctgtggaagt

SEQ ID NO: 7108460 - DNA, 22 bp, Homo sapiens
ccattgtaaattctgtggaagt

SEQ ID NO: 7108461 - DNA, 23 bp, Homo sapiens
tgattttaaaaagtaagttatca

SEQ ID NO: 7108462 - DNA, 23 bp, Homo sapiens
tgattttaaaaagtaagttatca

SEQ ID NO: 7108463 - DNA, 23 bp, Homo sapiens
tgattttaaaaagtaagttatca

SEQ ID NO: 7108464 - DNA, 23 bp, Homo sapiens
tgattttaaaaagtaagttatca

SEQ ID NO: 7108465 - DNA, 22 bp, Homo sapiens
tgatttgaattttaaaacactg

SEQ ID NO: 7108466 - DNA, 22 bp, Homo sapiens
tgatttgaactctgggacttgt

SEQ ID NO: 7108467 - DNA, 22 bp, Homo sapiens
tgatttgaggtacataaatcca

SEQ ID NO: 7108468 - DNA, 23 bp, Homo sapiens
tgattttaaaaagtaagttatca

SEQ ID NO: 7108469 - DNA, 23 bp, Homo sapiens
tgattttaaaaagtaagttatca

SEQ ID NO: 7108470 - DNA, 23 bp, Homo sapiens
tgattttaaaaagtaagttatca

SEQ ID NO: 7108471 - DNA, 22 bp, Homo sapiens
tgattttacttagcatgatgtt

SEQ ID NO: 7108472 - DNA, 22 bp, Homo sapiens
tgattttacttagcatgatgtt

SEQ ID NO: 7108473 - DNA, 22 bp, Homo sapiens
tgattttattggtgaggaaatt

SEQ ID NO: 7108474 - DNA, 22 bp, Homo sapiens
tgattttattggtgaggaaatt

SEQ ID NO: 7108475 - DNA, 22 bp, Homo sapiens
tgattttacttagcatgatgtt

SEQ ID NO: 7108476 - DNA, 22 bp, Homo sapiens
tgattttattgaaacttcactt

SEQ ID NO: 7108477 - DNA, 22 bp, Homo sapiens
tgattttattgaaacttcactt

SEQ ID NO: 7108478 - DNA, 22 bp, Homo sapiens
ccattctgtccagaggaggaag

SEQ ID NO: 7108479 - DNA, 22 bp, Homo sapiens
ccattgaacccctctaggccac

SEQ ID NO: 7108480 - DNA, 22 bp, Homo sapiens
ccattgaaggcacttgagcaga

SEQ ID NO: 7108481 - DNA, 22 bp, Homo sapiens
ccattgaatcctcagctgctag

SEQ ID NO: 7108482 - DNA, 22 bp, Homo sapiens
ccattgaattagaaggggaagg

SEQ ID NO: 7108483 - DNA, 21 bp, Homo sapiens
ccattgagaccatggaggagt

SEQ ID NO: 7108484 - DNA, 20 bp, Homo sapiens
ccattctgggtgcagtctgg

SEQ ID NO: 7108485 - DNA, 20 bp, Homo sapiens
ccattctgggtgcagtctgg

SEQ ID NO: 7108486 - DNA, 22 bp, Homo sapiens
ccattccttcatcaaaaggcct

SEQ ID NO: 7108487 - DNA, 19 bp, Homo sapiens
ccattcctctagaatttgg

SEQ ID NO: 7108488 - DNA, 22 bp, Homo sapiens
ccattagataatgcacaccctc

SEQ ID NO: 7108489 - DNA, 22 bp, Homo sapiens
ccatgtgttgagattccagcct

SEQ ID NO: 7108490 - DNA, 22 bp, Homo sapiens
ccatgtgttgattctctgcaga

SEQ ID NO: 7108491 - DNA, 22 bp, Homo sapiens
ccatgttggaacttcacattct

SEQ ID NO: 7108492 - DNA, 22 bp, Homo sapiens
ccatgttgtatctcttatcggc

SEQ ID NO: 7108493 - DNA, 22 bp, Homo sapiens
ccatgttgtcaaacttagagta

SEQ ID NO: 7108494 - DNA, 22 bp, Homo sapiens
ccattaaaatggaatgtagtga

SEQ ID NO: 7108495 - DNA, 22 bp, Homo sapiens
tgagaaggtgaaagtgtggaga

SEQ ID NO: 7108496 - DNA, 22 bp, Homo sapiens
tgagaaggtgaaagtgtggaga

SEQ ID NO: 7108497 - DNA, 22 bp, Homo sapiens
tgagaaggtgaaagtgtggaga

SEQ ID NO: 7108498 - DNA, 19 bp, Homo sapiens
tgagaaggtttccgtgggt

SEQ ID NO: 7108499 - DNA, 17 bp, Homo sapiens
tgagaagtaggcatcat

SEQ ID NO: 7108500 - DNA, 22 bp, Homo sapiens
tgagaagtactacaagagaggg

SEQ ID NO: 7108501 - DNA, 22 bp, Homo sapiens
tgagaagtactacaagagaggg

SEQ ID NO: 7108502 - DNA, 17 bp, Homo sapiens
tgagaagtaggcatcat

SEQ ID NO: 7108503 - DNA, 22 bp, Homo sapiens
tgagaagtgacattattgaatg

SEQ ID NO: 7108504 - DNA, 19 bp, Homo sapiens
tgagaaggcagtggggagc

SEQ ID NO: 7108505 - DNA, 19 bp, Homo sapiens
tgagaaggcagtggggagc

SEQ ID NO: 7108506 - DNA, 19 bp, Homo sapiens
tgagaaggcagtggggagc

SEQ ID NO: 7108507 - DNA, 22 bp, Homo sapiens
tgagaaggcctgtgtgacaggg

SEQ ID NO: 7108508 - DNA, 22 bp, Homo sapiens
tgagaaggcctgtgtgacaggg

SEQ ID NO: 7108509 - DNA, 22 bp, Homo sapiens
tgagaaggcctgtgtgacaggg

SEQ ID NO: 7108510 - DNA, 22 bp, Homo sapiens
tgagaaggcctgtgtgacaggg

SEQ ID NO: 7108511 - DNA, 22 bp, Homo sapiens
tgagaaggcctgtgtgacaggg

SEQ ID NO: 7108512 - DNA, 22 bp, Homo sapiens
tgagaaggctcaggcttagaga

SEQ ID NO: 7108513 - DNA, 22 bp, Homo sapiens
tgagaaggctcaggcttagaga

SEQ ID NO: 7108514 - DNA, 22 bp, Homo sapiens
tgagaaggctcaggcttagaga

SEQ ID NO: 7108515 - DNA, 20 bp, Homo sapiens
tgagaaggggtcagctgtac

SEQ ID NO: 7108516 - DNA, 20 bp, Homo sapiens
tgagaaggggtcagctgtac

SEQ ID NO: 7108517 - DNA, 22 bp, Homo sapiens
tgagaagggttggagaaataat

SEQ ID NO: 7108518 - DNA, 22 bp, Homo sapiens
tgagaagggttggagaaataat

SEQ ID NO: 7108519 - DNA, 22 bp, Homo sapiens
tgagaatgaatcttttgctttc

SEQ ID NO: 7108520 - DNA, 22 bp, Homo sapiens
tgagaatatttgaagatgttag

SEQ ID NO: 7108521 - DNA, 22 bp, Homo sapiens
tgagaatactgcattgttagga

SEQ ID NO: 7108522 - DNA, 22 bp, Homo sapiens
tgagaataggcatagaacctgg

SEQ ID NO: 7108523 - DNA, 22 bp, Homo sapiens
tgagaatagtaataatttctgg

SEQ ID NO: 7108524 - DNA, 22 bp, Homo sapiens
tgagaatattgttttagtgagg

SEQ ID NO: 7108525 - DNA, 22 bp, Homo sapiens
tgagaatattgttttagtgagg

SEQ ID NO: 7108526 - DNA, 18 bp, Homo sapiens
tgagaatatttatcccac

SEQ ID NO: 7108527 - DNA, 22 bp, Homo sapiens
tgagaatgccataagagctatt

SEQ ID NO: 7108528 - DNA, 22 bp, Homo sapiens
ccaggggctctcagggtgtgtg

SEQ ID NO: 7108529 - DNA, 22 bp, Homo sapiens
ccaggggctgcagatccatggt

SEQ ID NO: 7108530 - DNA, 22 bp, Homo sapiens
ccaggggctctcagggtgtgtg

SEQ ID NO: 7108531 - DNA, 22 bp, Homo sapiens
ccaggggctggtgctgagctgg

SEQ ID NO: 7108532 - DNA, 22 bp, Homo sapiens
ccaggggctggtgctgagctgg

SEQ ID NO: 7108533 - DNA, 22 bp, Homo sapiens
ccaggggctgcagatccatggt

SEQ ID NO: 7108534 - DNA, 22 bp, Homo sapiens
ccaggggctgcagatccatggt

SEQ ID NO: 7108535 - DNA, 22 bp, Homo sapiens
ccaggggctgcagatccatggt

SEQ ID NO: 7108536 - DNA, 22 bp, Homo sapiens
ccaggggctggtgctgagctgg

SEQ ID NO: 7108537 - DNA, 22 bp, Homo sapiens
ccaggtggacggcgagtacagg

SEQ ID NO: 7108538 - DNA, 22 bp, Homo sapiens
ccaggtggacaaggctttcaca

SEQ ID NO: 7108539 - DNA, 22 bp, Homo sapiens
ccaggtggacaaggctttcaca

SEQ ID NO: 7108540 - DNA, 22 bp, Homo sapiens
ccaggtggaaggtctgtgctct

SEQ ID NO: 7108541 - DNA, 22 bp, Homo sapiens
ccaggtggaaggtctgtgctct

SEQ ID NO: 7108542 - DNA, 22 bp, Homo sapiens
ccaggtggaaggtctgtgctct

SEQ ID NO: 7108543 - DNA, 22 bp, Homo sapiens
ccaggtggaaggtctgtgctct

SEQ ID NO: 7108544 - DNA, 17 bp, Homo sapiens
ccaggtggaatcgtgga

SEQ ID NO: 7108545 - DNA, 19 bp, Homo sapiens
ccaggtggaactgaggtag

SEQ ID NO: 7108546 - DNA, 22 bp, Homo sapiens
ccaggtggaaggtctgtgctct

SEQ ID NO: 7108547 - DNA, 22 bp, Homo sapiens
ccaggtggaaggtctgtgctct

SEQ ID NO: 7108548 - DNA, 22 bp, Homo sapiens
ccaggtggaaggtctgtgctct

SEQ ID NO: 7108549 - DNA, 19 bp, Homo sapiens
ccaggtggaactgaggtag

SEQ ID NO: 7108550 - DNA, 19 bp, Homo sapiens
ccaggtggaactgaggtag

SEQ ID NO: 7108551 - DNA, 19 bp, Homo sapiens
ccaggtggaactgaggtag

SEQ ID NO: 7108552 - DNA, 19 bp, Homo sapiens
ccaggtggaactgaggtag

SEQ ID NO: 7108553 - DNA, 19 bp, Homo sapiens
ccaggtggaactgaggtag

SEQ ID NO: 7108554 - DNA, 22 bp, Homo sapiens
ccaggtgctgaccggtcagatt

SEQ ID NO: 7108555 - DNA, 22 bp, Homo sapiens
ccaggtgctgaccggtcagatt

SEQ ID NO: 7108556 - DNA, 22 bp, Homo sapiens
ccaggtgctcttgccagggctg

SEQ ID NO: 7108557 - DNA, 22 bp, Homo sapiens
ccaggtgctcttgccagggctg

SEQ ID NO: 7108558 - DNA, 22 bp, Homo sapiens
ccaggtctcgggtctgctcgtg

SEQ ID NO: 7108559 - DNA, 21 bp, Homo sapiens
ccagggtccagctgccatggt

SEQ ID NO: 7108560 - DNA, 22 bp, Homo sapiens
ccagggtagctgagctaagcct

SEQ ID NO: 7108561 - DNA, 22 bp, Homo sapiens
ccagggtcacaaataactgcag

SEQ ID NO: 7108562 - DNA, 22 bp, Homo sapiens
ccagggtcacaaataactgcag

SEQ ID NO: 7108563 - DNA, 21 bp, Homo sapiens
ccagggtccagctgccatggt

SEQ ID NO: 7108564 - DNA, 21 bp, Homo sapiens
ccagggtccagctgccatggt

SEQ ID NO: 7108565 - DNA, 22 bp, Homo sapiens
ccaggggggcgtagatgctggg

SEQ ID NO: 7108566 - DNA, 22 bp, Homo sapiens
ccaggggttggaggttgcagtg

SEQ ID NO: 7108567 - DNA, 22 bp, Homo sapiens
ccaggggttggaggttgcagtg

SEQ ID NO: 7108568 - DNA, 22 bp, Homo sapiens
ccaggggggcgtagatgctggg

SEQ ID NO: 7108569 - DNA, 22 bp, Homo sapiens
ccaggggggcgtagatgctggg

SEQ ID NO: 7108570 - DNA, 22 bp, Homo sapiens
ccaggggctggtgctgagctgg

SEQ ID NO: 7108571 - DNA, 22 bp, Homo sapiens
ccaggggctggtgctgagctgg

SEQ ID NO: 7108572 - DNA, 22 bp, Homo sapiens
ccaggggctggtgctgagctgg

SEQ ID NO: 7108573 - DNA, 22 bp, Homo sapiens
ccagggggcttggtgaggccat

SEQ ID NO: 7108574 - DNA, 22 bp, Homo sapiens
tgaggcagcaattgattattca

SEQ ID NO: 7108575 - DNA, 22 bp, Homo sapiens
tgaggcagcaattgattattca

SEQ ID NO: 7108576 - DNA, 22 bp, Homo sapiens
tgaggcagcaattgattattca

SEQ ID NO: 7108577 - DNA, 22 bp, Homo sapiens
tgaggcagcaattgattattca

SEQ ID NO: 7108578 - DNA, 22 bp, Homo sapiens
tgaggcagcaattgtattgtat

SEQ ID NO: 7108579 - DNA, 22 bp, Homo sapiens
tgaggcagcaattgtattgtat

SEQ ID NO: 7108580 - DNA, 22 bp, Homo sapiens
tgaggcagagtaagatacatga

SEQ ID NO: 7108581 - DNA, 22 bp, Homo sapiens
tgaggcagatatttattgggtt

SEQ ID NO: 7108582 - DNA, 22 bp, Homo sapiens
tgaggcagatatttattgggtt

SEQ ID NO: 7108583 - DNA, 22 bp, Homo sapiens
tgaggcagaaaatagcagttca

SEQ ID NO: 7108584 - DNA, 22 bp, Homo sapiens
tgaggcagaaaatagcagttca

SEQ ID NO: 7108585 - DNA, 22 bp, Homo sapiens
tgaggcagaaaatagcagttca

SEQ ID NO: 7108586 - DNA, 22 bp, Homo sapiens
tgaggactttccatgttaatgt

SEQ ID NO: 7108587 - DNA, 22 bp, Homo sapiens
tgaggactacctggggtgggag

SEQ ID NO: 7108588 - DNA, 22 bp, Homo sapiens
tgaggcagaaattcctgttttc

SEQ ID NO: 7108589 - DNA, 22 bp, Homo sapiens
tgaggcagaaattcctgttttc

SEQ ID NO: 7108590 - DNA, 22 bp, Homo sapiens
tgaggcagaaattcctgttttc

SEQ ID NO: 7108591 - DNA, 22 bp, Homo sapiens
tgaggcagaaattcctgttttc

SEQ ID NO: 7108592 - DNA, 22 bp, Homo sapiens
tgaggcagagtaagatacatga

SEQ ID NO: 7108593 - DNA, 22 bp, Homo sapiens
tgaggcagagtaagatacatga

SEQ ID NO: 7108594 - DNA, 22 bp, Homo sapiens
tgaggactacctggggtgggag

SEQ ID NO: 7108595 - DNA, 22 bp, Homo sapiens
ccaggtgtggtggcatacacct

SEQ ID NO: 7108596 - DNA, 22 bp, Homo sapiens
ccaggtgtgtacagaacagcac

SEQ ID NO: 7108597 - DNA, 22 bp, Homo sapiens
ccaggtgtgtcaccattgccca

SEQ ID NO: 7108598 - DNA, 22 bp, Homo sapiens
ccaggtgtggtggcatacacct

SEQ ID NO: 7108599 - DNA, 22 bp, Homo sapiens
ccaggtgtggtggcatacacct

SEQ ID NO: 7108600 - DNA, 22 bp, Homo sapiens
ccaggtgtgtacagaacagcac

SEQ ID NO: 7108601 - DNA, 22 bp, Homo sapiens
ccaggtgtgtacagaacagcac

SEQ ID NO: 7108602 - DNA, 22 bp, Homo sapiens
ccaggtgtggggaggactcaca

SEQ ID NO: 7108603 - DNA, 22 bp, Homo sapiens
ccaggtgtggccacatggctgg

SEQ ID NO: 7108604 - DNA, 22 bp, Homo sapiens
ccaggtgtggccacatggctgg

SEQ ID NO: 7108605 - DNA, 22 bp, Homo sapiens
ccaggtgtggggaggactcaca

SEQ ID NO: 7108606 - DNA, 22 bp, Homo sapiens
ccaggtgtggggaggactcaca

SEQ ID NO: 7108607 - DNA, 22 bp, Homo sapiens
ccaggtgtgctctgcagtggat

SEQ ID NO: 7108608 - DNA, 22 bp, Homo sapiens
ccaggtgtggccacatggctgg

SEQ ID NO: 7108609 - DNA, 22 bp, Homo sapiens
ccaggtgtggccacatggctgg

SEQ ID NO: 7108610 - DNA, 22 bp, Homo sapiens
ccaggtgtgctctgcagtggat

SEQ ID NO: 7108611 - DNA, 22 bp, Homo sapiens
ccaggtgtgctctgcagtggat

SEQ ID NO: 7108612 - DNA, 22 bp, Homo sapiens
ccaggtgtgctctgcagtggat

SEQ ID NO: 7108613 - DNA, 22 bp, Homo sapiens
ccaggtgtgccagcagggactg

SEQ ID NO: 7108614 - DNA, 22 bp, Homo sapiens
ccaggtgtgccagcagggactg

SEQ ID NO: 7108615 - DNA, 22 bp, Homo sapiens
ccaggtgtgccagcagggactg

SEQ ID NO: 7108616 - DNA, 22 bp, Homo sapiens
ccaggtgtgccagcagggactg

SEQ ID NO: 7108617 - DNA, 22 bp, Homo sapiens
ccaggtgtgccagcagggactg

SEQ ID NO: 7108618 - DNA, 22 bp, Homo sapiens
ccaggtgtgatttggcagtgtc

SEQ ID NO: 7108619 - DNA, 22 bp, Homo sapiens
ccaggtgtgatttcatctgagg

SEQ ID NO: 7108620 - DNA, 22 bp, Homo sapiens
ccaggtgtctgtggccagccct

SEQ ID NO: 7108621 - DNA, 22 bp, Homo sapiens
ccaggtgtgagcattctgtctt

SEQ ID NO: 7108622 - DNA, 22 bp, Homo sapiens
ccaggtgtgatttcatctgagg

SEQ ID NO: 7108623 - DNA, 22 bp, Homo sapiens
ccaggtgtgatttggcagtgtc

SEQ ID NO: 7108624 - DNA, 22 bp, Homo sapiens
ccaggtgtgatttcatctgagg

SEQ ID NO: 7108625 - DNA, 22 bp, Homo sapiens
ccaggtgtgatttggcagtgtc

SEQ ID NO: 7108626 - DNA, 22 bp, Homo sapiens
ccaggtgtctgtggccagccct

SEQ ID NO: 7108627 - DNA, 22 bp, Homo sapiens
ccaggtgtctgtggccagccct

SEQ ID NO: 7108628 - DNA, 22 bp, Homo sapiens
ccaggtgtctgtctctttttca

SEQ ID NO: 7108629 - DNA, 22 bp, Homo sapiens
ccaggtgtctgtctctttttca

SEQ ID NO: 7108630 - DNA, 22 bp, Homo sapiens
ccaggtgtgagcattctgtctt

SEQ ID NO: 7108631 - DNA, 22 bp, Homo sapiens
ccaggtgtccccgtcactgcag

SEQ ID NO: 7108632 - DNA, 22 bp, Homo sapiens
ccaggtgtccccgtcactgcag

SEQ ID NO: 7108633 - DNA, 22 bp, Homo sapiens
ccaggtgtccccgtcactgcag

SEQ ID NO: 7108634 - DNA, 22 bp, Homo sapiens
ccaggtgtccccgtcactgcag

SEQ ID NO: 7108635 - DNA, 22 bp, Homo sapiens
ccaggtgtctgtctctttttca

SEQ ID NO: 7108636 - DNA, 22 bp, Homo sapiens
ccaggtgtccccgtcactgcag

SEQ ID NO: 7108637 - DNA, 22 bp, Homo sapiens
ccaggtgtcatgcgtgtgaccc

SEQ ID NO: 7108638 - DNA, 22 bp, Homo sapiens
ccaggtgtaggacaccaaggga

SEQ ID NO: 7108639 - DNA, 22 bp, Homo sapiens
ccaggtgtaggacaccaaggga

SEQ ID NO: 7108640 - DNA, 22 bp, Homo sapiens
ccaggtgtaggacaccaaggga

SEQ ID NO: 7108641 - DNA, 22 bp, Homo sapiens
ccaggtgtcatgcgtgtgaccc

SEQ ID NO: 7108642 - DNA, 22 bp, Homo sapiens
ccaggtgtcatgcgtgtgaccc

SEQ ID NO: 7108643 - DNA, 22 bp, Homo sapiens
ccaggtgtcatggataatgggt

SEQ ID NO: 7108644 - DNA, 22 bp, Homo sapiens
ccaggtgtcatggataatgggt

SEQ ID NO: 7108645 - DNA, 22 bp, Homo sapiens
ccaggtgtcatggataatgggt

SEQ ID NO: 7108646 - DNA, 22 bp, Homo sapiens
ccaggtgtagcactgctcacag

SEQ ID NO: 7108647 - DNA, 22 bp, Homo sapiens
ccaggtgtagcactgctcacag

SEQ ID NO: 7108648 - DNA, 22 bp, Homo sapiens
ccaggtgtaagacatggtccta

SEQ ID NO: 7108649 - DNA, 22 bp, Homo sapiens
ccaggtgtagcactgctcacag

SEQ ID NO: 7108650 - DNA, 22 bp, Homo sapiens
ccaggtgtagcactgctcacag

SEQ ID NO: 7108651 - DNA, 22 bp, Homo sapiens
ccaggtgtaagacatggtccta

SEQ ID NO: 7108652 - DNA, 22 bp, Homo sapiens
ccaggtgtaagacatggtccta

SEQ ID NO: 7108653 - DNA, 22 bp, Homo sapiens
ccaggtgggcgtgtcttcacct

SEQ ID NO: 7108654 - DNA, 22 bp, Homo sapiens
tgagacgaagtcttgctctgtt

SEQ ID NO: 7108655 - DNA, 22 bp, Homo sapiens
tgagacgaagtcttgctctgtt

SEQ ID NO: 7108656 - DNA, 22 bp, Homo sapiens
tgagacgaagtcttgctctgtt

SEQ ID NO: 7108657 - DNA, 22 bp, Homo sapiens
tgagacagttctgcagctgggt

SEQ ID NO: 7108658 - DNA, 22 bp, Homo sapiens
tgagacagttctgcagctgggt

SEQ ID NO: 7108659 - DNA, 22 bp, Homo sapiens
tgagaccatttgacatacagtg

SEQ ID NO: 7108660 - DNA, 22 bp, Homo sapiens
tgagacatcacaaaatcctcaa

SEQ ID NO: 7108661 - DNA, 22 bp, Homo sapiens
tgagacatcatggctgaaagta

SEQ ID NO: 7108662 - DNA, 22 bp, Homo sapiens
tgagacatgctgtccaagaagt

SEQ ID NO: 7108663 - DNA, 23 bp, Homo sapiens
tgagaccctaatttagcaagtgt

SEQ ID NO: 7108664 - DNA, 22 bp, Homo sapiens
tgagacctgcccaacgcagacc

SEQ ID NO: 7108665 - DNA, 22 bp, Homo sapiens
tgagacctgtagcttcacagag

SEQ ID NO: 7108666 - DNA, 22 bp, Homo sapiens
tgagacctgtaatgagaaattg

SEQ ID NO: 7108667 - DNA, 22 bp, Homo sapiens
tgagacgaagtcttgctctgtt

SEQ ID NO: 7108668 - DNA, 22 bp, Homo sapiens
ccaggggaaacagggagcactc

SEQ ID NO: 7108669 - DNA, 22 bp, Homo sapiens
ccaggggaaacagggagcactc

SEQ ID NO: 7108670 - DNA, 22 bp, Homo sapiens
ccaggggaaacagggagcactc

SEQ ID NO: 7108671 - DNA, 22 bp, Homo sapiens
ccaggggaaacagggagcactc

SEQ ID NO: 7108672 - DNA, 22 bp, Homo sapiens
ccaggggaaacagggagcactc

SEQ ID NO: 7108673 - DNA, 22 bp, Homo sapiens
ccagggctttatctgcctttga

SEQ ID NO: 7108674 - DNA, 22 bp, Homo sapiens
ccagggctttatctgcctttga

SEQ ID NO: 7108675 - DNA, 22 bp, Homo sapiens
ccagggctttgccaaagtccag

SEQ ID NO: 7108676 - DNA, 22 bp, Homo sapiens
ccagggcttcagttagtggtga

SEQ ID NO: 7108677 - DNA, 22 bp, Homo sapiens
ccagggcttcccacgtgccctg

SEQ ID NO: 7108678 - DNA, 22 bp, Homo sapiens
ccagggcttcccacgtgccctg

SEQ ID NO: 7108679 - DNA, 22 bp, Homo sapiens
ccagggcttggtggcttgtatc

SEQ ID NO: 7108680 - DNA, 22 bp, Homo sapiens
ccagggcttggtggcttgtatc

SEQ ID NO: 7108681 - DNA, 19 bp, Homo sapiens
ccagggctttaagttgagg

SEQ ID NO: 7108682 - DNA, 22 bp, Homo sapiens
tgacaatggggcacatggaaag

SEQ ID NO: 7108683 - DNA, 22 bp, Homo sapiens
ccagggctgctgtgggactcca

SEQ ID NO: 7108684 - DNA, 22 bp, Homo sapiens
tgacaatagcgatttatcttgc

SEQ ID NO: 7108685 - DNA, 22 bp, Homo sapiens
tgacaatagcgatttatcttgc

SEQ ID NO: 7108686 - DNA, 22 bp, Homo sapiens
tgacaatgacatggacagtgat

SEQ ID NO: 7108687 - DNA, 22 bp, Homo sapiens
tgacaatggatattagttgtgg

SEQ ID NO: 7108688 - DNA, 22 bp, Homo sapiens
tgacaagaggcagaatcagctg

SEQ ID NO: 7108689 - DNA, 19 bp, Homo sapiens
tgacaagataatagccttg

SEQ ID NO: 7108690 - DNA, 19 bp, Homo sapiens
tgacaagataatagccttg

SEQ ID NO: 7108691 - DNA, 22 bp, Homo sapiens
tgacaagatagattgagtttta

SEQ ID NO: 7108692 - DNA, 22 bp, Homo sapiens
tgacaagatcacagtcaagtgt

SEQ ID NO: 7108693 - DNA, 22 bp, Homo sapiens
tgacaagatcacagtcaagtgt

SEQ ID NO: 7108694 - DNA, 22 bp, Homo sapiens
tgacaagcatttttgagtatct

SEQ ID NO: 7108695 - DNA, 22 bp, Homo sapiens
tgacaatacagagagagcaaaa

SEQ ID NO: 7108696 - DNA, 22 bp, Homo sapiens
tgacataatgctttgaagttgc

SEQ ID NO: 7108697 - DNA, 22 bp, Homo sapiens
tgacataatgctttgaagttgc

SEQ ID NO: 7108698 - DNA, 22 bp, Homo sapiens
tgacataataatccaaacatac

SEQ ID NO: 7108699 - DNA, 22 bp, Homo sapiens
tgacatacttttagatagatgg

SEQ ID NO: 7108700 - DNA, 22 bp, Homo sapiens
tgacatacttttagatagatgg

SEQ ID NO: 7108701 - DNA, 22 bp, Homo sapiens
tgacatagggcaaaagagtagg

SEQ ID NO: 7108702 - DNA, 22 bp, Homo sapiens
tgacatcacaagccatctgcag

SEQ ID NO: 7108703 - DNA, 22 bp, Homo sapiens
tgacatcacgtcctttcagaga

SEQ ID NO: 7108704 - DNA, 22 bp, Homo sapiens
tgacatcagaatggcatagaaa

SEQ ID NO: 7108705 - DNA, 22 bp, Homo sapiens
tgacatcagggcaggggttgag

SEQ ID NO: 7108706 - DNA, 22 bp, Homo sapiens
tgacatcattagtaacatagct

SEQ ID NO: 7108707 - DNA, 22 bp, Homo sapiens
tgacatcattggccattgggga

SEQ ID NO: 7108708 - DNA, 22 bp, Homo sapiens
tgacatccggccactagactcc

SEQ ID NO: 7108709 - DNA, 22 bp, Homo sapiens
tgacatctagtaggtagagacc

SEQ ID NO: 7108710 - DNA, 22 bp, Homo sapiens
tgacatctagtaggtagagacc

SEQ ID NO: 7108711 - DNA, 22 bp, Homo sapiens
tgagaaaaggttgagatgataa

SEQ ID NO: 7108712 - DNA, 22 bp, Homo sapiens
tgagaaaagtacatggagaagc

SEQ ID NO: 7108713 - DNA, 22 bp, Homo sapiens
tgagaaaagtacatggagaagc

SEQ ID NO: 7108714 - DNA, 22 bp, Homo sapiens
tgagaaaagtacatggagaagc

SEQ ID NO: 7108715 - DNA, 22 bp, Homo sapiens
tgagaaaagtacatggagaagc

SEQ ID NO: 7108716 - DNA, 22 bp, Homo sapiens
tgagaaaagtacatggagaagc

SEQ ID NO: 7108717 - DNA, 20 bp, Homo sapiens
tgacagtttcatatggttca

SEQ ID NO: 7108718 - DNA, 22 bp, Homo sapiens
tgacataaaccagtgagcaaaa

SEQ ID NO: 7108719 - DNA, 22 bp, Homo sapiens
tgacataaatctaaaggaaagg

SEQ ID NO: 7108720 - DNA, 22 bp, Homo sapiens
tgacagttaaggtatacattca

SEQ ID NO: 7108721 - DNA, 22 bp, Homo sapiens
tgacagttaaggtatacattca

SEQ ID NO: 7108722 - DNA, 22 bp, Homo sapiens
tgacagttcaggtcagatttat

SEQ ID NO: 7108723 - DNA, 22 bp, Homo sapiens
tgacagttgagcatgtaagaga

SEQ ID NO: 7108724 - DNA, 22 bp, Homo sapiens
tgacagttgagcatgtaagaga

SEQ ID NO: 7108725 - DNA, 21 bp, Homo sapiens
ccaggggcaaattgtcgtttc

SEQ ID NO: 7108726 - DNA, 21 bp, Homo sapiens
ccaggggcaaattgtcgtttc

SEQ ID NO: 7108727 - DNA, 22 bp, Homo sapiens
ccaggggcctgtgaaggtgccc

SEQ ID NO: 7108728 - DNA, 22 bp, Homo sapiens
ccaggggcctgtgaaggtgccc

SEQ ID NO: 7108729 - DNA, 22 bp, Homo sapiens
ccaggggcctgtgaaggtgccc

SEQ ID NO: 7108730 - DNA, 23 bp, Homo sapiens
tgacagtgtatttgactatatgg

SEQ ID NO: 7108731 - DNA, 23 bp, Homo sapiens
tgacagtgtatttgactatatgg

SEQ ID NO: 7108732 - DNA, 22 bp, Homo sapiens
tgacagtgtcagtttcctaata

SEQ ID NO: 7108733 - DNA, 22 bp, Homo sapiens
tgacagtgtcagtttcctaata

SEQ ID NO: 7108734 - DNA, 22 bp, Homo sapiens
tgacagttaaggtatacattca

SEQ ID NO: 7108735 - DNA, 21 bp, Homo sapiens
ccaggctggccatggtattga

SEQ ID NO: 7108736 - DNA, 20 bp, Homo sapiens
ccaggctggcaaatgggggc

SEQ ID NO: 7108737 - DNA, 20 bp, Homo sapiens
ccaggctggcaaatgggggc

SEQ ID NO: 7108738 - DNA, 21 bp, Homo sapiens
ccaggctggccatggtattga

SEQ ID NO: 7108739 - DNA, 22 bp, Homo sapiens
ccaggctggattttgcagttca

SEQ ID NO: 7108740 - DNA, 22 bp, Homo sapiens
ccaggctggattttgcagttca

SEQ ID NO: 7108741 - DNA, 20 bp, Homo sapiens
ccaggctggcaaatgggggc

SEQ ID NO: 7108742 - DNA, 20 bp, Homo sapiens
ccaggctggcaaatgggggc

SEQ ID NO: 7108743 - DNA, 20 bp, Homo sapiens
ccaggctggcaaatgggggc

SEQ ID NO: 7108744 - DNA, 22 bp, Homo sapiens
ccaggctggagtgtagtcgcat

SEQ ID NO: 7108745 - DNA, 22 bp, Homo sapiens
ccaggctggattttgcagttca

SEQ ID NO: 7108746 - DNA, 22 bp, Homo sapiens
ccaggctggattttgcagttca

SEQ ID NO: 7108747 - DNA, 22 bp, Homo sapiens
ccaggctggagtgtagtcgcat

SEQ ID NO: 7108748 - DNA, 22 bp, Homo sapiens
ccaggctggattttgcagttca

SEQ ID NO: 7108749 - DNA, 22 bp, Homo sapiens
ccaggctggagtgcagtggcac

SEQ ID NO: 7108750 - DNA, 22 bp, Homo sapiens
ccaggctggagtgcagtggcac

SEQ ID NO: 7108751 - DNA, 22 bp, Homo sapiens
ccaggctggagtgcagtggcac

SEQ ID NO: 7108752 - DNA, 22 bp, Homo sapiens
ccaggctggagtgcagtggcac

SEQ ID NO: 7108753 - DNA, 22 bp, Homo sapiens
ccaggctggagtgcagtggcac

SEQ ID NO: 7108754 - DNA, 22 bp, Homo sapiens
ccaggctggagtgcagtggcac

SEQ ID NO: 7108755 - DNA, 22 bp, Homo sapiens
ccaggctggagtgcagtggcac

SEQ ID NO: 7108756 - DNA, 22 bp, Homo sapiens
ccaggctggagtgcagtagtgt

SEQ ID NO: 7108757 - DNA, 22 bp, Homo sapiens
ccaggctggagtgcagtagtgt

SEQ ID NO: 7108758 - DNA, 22 bp, Homo sapiens
ccaggctggagtgcagtagtgt

SEQ ID NO: 7108759 - DNA, 22 bp, Homo sapiens
ccaggctggagtgcaatggtgc

SEQ ID NO: 7108760 - DNA, 22 bp, Homo sapiens
ccaggctggagtgcagtagtgt

SEQ ID NO: 7108761 - DNA, 22 bp, Homo sapiens
tgacaagaatttgggactgtta

SEQ ID NO: 7108762 - DNA, 22 bp, Homo sapiens
tgacaagaatttgggactgtta

SEQ ID NO: 7108763 - DNA, 22 bp, Homo sapiens
tgacaagagacccctccgcagg

SEQ ID NO: 7108764 - DNA, 22 bp, Homo sapiens
tgacaagagacccctccgcagg

SEQ ID NO: 7108765 - DNA, 22 bp, Homo sapiens
tgacaagagcattcccacacct

SEQ ID NO: 7108766 - DNA, 22 bp, Homo sapiens
tgacaactctagttaatgaatt

SEQ ID NO: 7108767 - DNA, 20 bp, Homo sapiens
tgacaactctgagaacgttc

SEQ ID NO: 7108768 - DNA, 20 bp, Homo sapiens
tgacaactctgagaacgttc

SEQ ID NO: 7108769 - DNA, 22 bp, Homo sapiens
tgacaagaaagcgtcttctttt

SEQ ID NO: 7108770 - DNA, 22 bp, Homo sapiens
tgacaagaagacctggtaatga

SEQ ID NO: 7108771 - DNA, 23 bp, Homo sapiens
tgacaacagctctcagccatgtc

SEQ ID NO: 7108772 - DNA, 22 bp, Homo sapiens
tgaatgcagagactgtgggaaa

SEQ ID NO: 7108773 - DNA, 22 bp, Homo sapiens
tgaatgcatggcttagatctac

SEQ ID NO: 7108774 - DNA, 22 bp, Homo sapiens
tgaatgatgtataatattgaga

SEQ ID NO: 7108775 - DNA, 22 bp, Homo sapiens
tgaatgatttgggtgcattcag

SEQ ID NO: 7108776 - DNA, 22 bp, Homo sapiens
tgaatgcaaatcatgattgtaa

SEQ ID NO: 7108777 - DNA, 22 bp, Homo sapiens
tgaatgcaaatcatgattgtaa

SEQ ID NO: 7108778 - DNA, 22 bp, Homo sapiens
tgaatgcaagtcacacatttct

SEQ ID NO: 7108779 - DNA, 22 bp, Homo sapiens
tgaatgcacattagtaagtgca

SEQ ID NO: 7108780 - DNA, 22 bp, Homo sapiens
tgaatgagtggattctgagtag

SEQ ID NO: 7108781 - DNA, 22 bp, Homo sapiens
tgaagttgttaaggttgccatt

SEQ ID NO: 7108782 - DNA, 22 bp, Homo sapiens
tgaagttgttaaggttgccatt

SEQ ID NO: 7108783 - DNA, 22 bp, Homo sapiens
tgaatgatatgtgaaaaggaac

SEQ ID NO: 7108784 - DNA, 22 bp, Homo sapiens
tgaatgatctagttttgtagac

SEQ ID NO: 7108785 - DNA, 22 bp, Homo sapiens
tgaatgatctagttttgtagac

SEQ ID NO: 7108786 - DNA, 22 bp, Homo sapiens
tgaatgatctccgattagtcct

SEQ ID NO: 7108787 - DNA, 22 bp, Homo sapiens
tgaatgatacagaattatgtag

SEQ ID NO: 7108788 - DNA, 22 bp, Homo sapiens
tgaatgatatattgggaataat

SEQ ID NO: 7108789 - DNA, 21 bp, Homo sapiens
tgaatgatctggttgcctttt

SEQ ID NO: 7108790 - DNA, 22 bp, Homo sapiens
tgaatgatgaggggagaataat

SEQ ID NO: 7108791 - DNA, 22 bp, Homo sapiens
tgaatgatgcagtataatgata

SEQ ID NO: 7108792 - DNA, 22 bp, Homo sapiens
tgaatgatgcagtataatgata

SEQ ID NO: 7108793 - DNA, 22 bp, Homo sapiens
tgaatgatgcatttgtttccca

SEQ ID NO: 7108794 - DNA, 21 bp, Homo sapiens
tgaatgatgccccagagttgt

SEQ ID NO: 7108795 - DNA, 23 bp, Homo sapiens
tgaatgatggtgctcctcatctt

SEQ ID NO: 7108796 - DNA, 22 bp, Homo sapiens
tgaatgatggtgtgttcttgcc

SEQ ID NO: 7108797 - DNA, 22 bp, Homo sapiens
tgaatgatggtgtgttcttgcc

SEQ ID NO: 7108798 - DNA, 22 bp, Homo sapiens
tgaatgatgtataatattgaga

SEQ ID NO: 7108799 - DNA, 22 bp, Homo sapiens
tgaatgattaaaacccggacta

SEQ ID NO: 7108800 - DNA, 23 bp, Homo sapiens
tgaatgattgtactgagctttta

SEQ ID NO: 7108801 - DNA, 22 bp, Homo sapiens
tgaatgatttcttaggcaattg

SEQ ID NO: 7108802 - DNA, 22 bp, Homo sapiens
ccaggagggaccgcggcatccc

SEQ ID NO: 7108803 - DNA, 17 bp, Homo sapiens
ccaggagagatgcttgt

SEQ ID NO: 7108804 - DNA, 17 bp, Homo sapiens
ccaggagagatgcttgt

SEQ ID NO: 7108805 - DNA, 22 bp, Homo sapiens
ccaggagggaccgcggcatccc

SEQ ID NO: 7108806 - DNA, 22 bp, Homo sapiens
ccaggagggaccgcggcatccc

SEQ ID NO: 7108807 - DNA, 22 bp, Homo sapiens
ccaggaggttgaggctgcagtg

SEQ ID NO: 7108808 - DNA, 22 bp, Homo sapiens
ccaggagggaggagttcctgag

SEQ ID NO: 7108809 - DNA, 22 bp, Homo sapiens
ccaggagggaggagttcctgag

SEQ ID NO: 7108810 - DNA, 22 bp, Homo sapiens
ccaggaggttgaggctgcagtg

SEQ ID NO: 7108811 - DNA, 22 bp, Homo sapiens
ccaggaggttgaggctgcagtg

SEQ ID NO: 7108812 - DNA, 22 bp, Homo sapiens
ccaggaggttgaggctgcagtg

SEQ ID NO: 7108813 - DNA, 22 bp, Homo sapiens
ccaggaggttgaggctgcagtg

SEQ ID NO: 7108814 - DNA, 22 bp, Homo sapiens
ccaggaggttgaggctgcagtg

SEQ ID NO: 7108815 - DNA, 22 bp, Homo sapiens
ccaggagacaaagatgactgct

SEQ ID NO: 7108816 - DNA, 22 bp, Homo sapiens
ccaggagacccagggaaggagc

SEQ ID NO: 7108817 - DNA, 22 bp, Homo sapiens
ccaggagacaaagatgactgct

SEQ ID NO: 7108818 - DNA, 22 bp, Homo sapiens
ccaggagacccagggaaggagc

SEQ ID NO: 7108819 - DNA, 22 bp, Homo sapiens
ccaggagaatgggattacccta

SEQ ID NO: 7108820 - DNA, 22 bp, Homo sapiens
ccaggagactgtactgatattt

SEQ ID NO: 7108821 - DNA, 22 bp, Homo sapiens
ccaggagactgtactgatattt

SEQ ID NO: 7108822 - DNA, 22 bp, Homo sapiens
ccaggagacccagggaaggagc

SEQ ID NO: 7108823 - DNA, 22 bp, Homo sapiens
ccaggagacccagggaaggagc

SEQ ID NO: 7108824 - DNA, 22 bp, Homo sapiens
ccaggaggttgaggctgcagtg

SEQ ID NO: 7108825 - DNA, 22 bp, Homo sapiens
ccaggaggttgaggctgcagtg

SEQ ID NO: 7108826 - DNA, 22 bp, Homo sapiens
ccaggaggttgaggctgcagtg

SEQ ID NO: 7108827 - DNA, 22 bp, Homo sapiens
ccaggaggttgaggctgcagtg

SEQ ID NO: 7108828 - DNA, 22 bp, Homo sapiens
ccaggagtggctggtgaccttc

SEQ ID NO: 7108829 - DNA, 22 bp, Homo sapiens
ccaggagtggctggtgaccttc

SEQ ID NO: 7108830 - DNA, 22 bp, Homo sapiens
ccaggagttggaagctgccatg

SEQ ID NO: 7108831 - DNA, 22 bp, Homo sapiens
ccaggagttggaagctgccatg

SEQ ID NO: 7108832 - DNA, 19 bp, Homo sapiens
ccaggagtggtggggtgag

SEQ ID NO: 7108833 - DNA, 22 bp, Homo sapiens
ccaggagtctggatgaggtgtc

SEQ ID NO: 7108834 - DNA, 22 bp, Homo sapiens
ccaggagtctggatgaggtgtc

SEQ ID NO: 7108835 - DNA, 22 bp, Homo sapiens
ccaggagtgcagggatggtatc

SEQ ID NO: 7108836 - DNA, 22 bp, Homo sapiens
ccaggagtcaataaaggaagct

SEQ ID NO: 7108837 - DNA, 22 bp, Homo sapiens
tcttcaccatcaacagaatgaa

SEQ ID NO: 7108838 - DNA, 22 bp, Homo sapiens
tcttcaccatcaacagaatgaa

SEQ ID NO: 7108839 - DNA, 22 bp, Homo sapiens
tcttcacgccaagtgcccctca

SEQ ID NO: 7108840 - DNA, 22 bp, Homo sapiens
tcttcactgatgtctctcaaat

SEQ ID NO: 7108841 - DNA, 22 bp, Homo sapiens
tcttcacattttagtggtttgt

SEQ ID NO: 7108842 - DNA, 22 bp, Homo sapiens
tcttcacattcacgtaacatag

SEQ ID NO: 7108843 - DNA, 22 bp, Homo sapiens
tcttcacattcacgtaacatag

SEQ ID NO: 7108844 - DNA, 22 bp, Homo sapiens
tcttagaatgtcaactgatgtt

SEQ ID NO: 7108845 - DNA, 22 bp, Homo sapiens
ccaggagttggaagctgccatg

SEQ ID NO: 7108846 - DNA, 22 bp, Homo sapiens
ccaggagttggaagctgccatg

SEQ ID NO: 7108847 - DNA, 22 bp, Homo sapiens
ccaggagttggaggctgcagtg

SEQ ID NO: 7108848 - DNA, 22 bp, Homo sapiens
ccaggagttggaggctgcagtg

SEQ ID NO: 7108849 - DNA, 22 bp, Homo sapiens
ccaggagttggaggctgcagtg

SEQ ID NO: 7108850 - DNA, 22 bp, Homo sapiens
ccaggagttggaggttgcagtg

SEQ ID NO: 7108851 - DNA, 22 bp, Homo sapiens
ccaggagttggaggttgcagtg

SEQ ID NO: 7108852 - DNA, 22 bp, Homo sapiens
ccaggagtttgaggctgcagtg

SEQ ID NO: 7108853 - DNA, 22 bp, Homo sapiens
ccaggagtttgaggctgcagtg

SEQ ID NO: 7108854 - DNA, 22 bp, Homo sapiens
ccaggagtttgaggctgcagtg

SEQ ID NO: 7108855 - DNA, 22 bp, Homo sapiens
ccaggatactgctctctgctgc

SEQ ID NO: 7108856 - DNA, 22 bp, Homo sapiens
ccaggatagtatgagtagggat

SEQ ID NO: 7108857 - DNA, 22 bp, Homo sapiens
ccaggatagtatgagtagggat

SEQ ID NO: 7108858 - DNA, 22 bp, Homo sapiens
ccaggatggggagcagatagaa

SEQ ID NO: 7108859 - DNA, 20 bp, Homo sapiens
tcttccaggtacagtctgca

SEQ ID NO: 7108860 - DNA, 22 bp, Homo sapiens
tcttccaggtatgtttctagtt

SEQ ID NO: 7108861 - DNA, 22 bp, Homo sapiens
tcttccagtctgtaggactagg

SEQ ID NO: 7108862 - DNA, 22 bp, Homo sapiens
tcttcagagtgagcagtgtcat

SEQ ID NO: 7108863 - DNA, 22 bp, Homo sapiens
tcttcagagtgagcagtgtcat

SEQ ID NO: 7108864 - DNA, 20 bp, Homo sapiens
tcttcagatgcttttggagt

SEQ ID NO: 7108865 - DNA, 22 bp, Homo sapiens
tcttccagtgtagacatctgcc

SEQ ID NO: 7108866 - DNA, 22 bp, Homo sapiens
tcttccagtgtagacatctgcc

SEQ ID NO: 7108867 - DNA, 22 bp, Homo sapiens
tcttcccaatgcaaagtaggac

SEQ ID NO: 7108868 - DNA, 22 bp, Homo sapiens
tcttcccaatgcaaagtaggac

SEQ ID NO: 7108869 - DNA, 22 bp, Homo sapiens
tcttcccactgcccatgggcag

SEQ ID NO: 7108870 - DNA, 22 bp, Homo sapiens
tcttcccactgcccatgggcag

SEQ ID NO: 7108871 - DNA, 22 bp, Homo sapiens
tcttcccagaccttacatgtga

SEQ ID NO: 7108872 - DNA, 22 bp, Homo sapiens
tcttcccagaccttacatgtga

SEQ ID NO: 7108873 - DNA, 22 bp, Homo sapiens
tcttcccagaccttacatgtga

SEQ ID NO: 7108874 - DNA, 22 bp, Homo sapiens
tcttcccagaggaggtgccagc

SEQ ID NO: 7108875 - DNA, 22 bp, Homo sapiens
tcttcccagaggaggtgccagc

SEQ ID NO: 7108876 - DNA, 22 bp, Homo sapiens
tcttcccagctgctgcgatgcc

SEQ ID NO: 7108877 - DNA, 22 bp, Homo sapiens
tcttcccagctgctgcgatgcc

SEQ ID NO: 7108878 - DNA, 22 bp, Homo sapiens
tcttcccagctgctgcgatgcc

SEQ ID NO: 7108879 - DNA, 22 bp, Homo sapiens
tcttcagacccttagctgtgat

SEQ ID NO: 7108880 - DNA, 22 bp, Homo sapiens
tcttcagacccttagctgtgat

SEQ ID NO: 7108881 - DNA, 22 bp, Homo sapiens
tcttcagaagatcacatcagtg

SEQ ID NO: 7108882 - DNA, 22 bp, Homo sapiens
tcttcagaaaattatcacttgt

SEQ ID NO: 7108883 - DNA, 22 bp, Homo sapiens
tcttcactgtgaatttgttctt

SEQ ID NO: 7108884 - DNA, 22 bp, Homo sapiens
tcttcactgtgaatttgttctt

SEQ ID NO: 7108885 - DNA, 22 bp, Homo sapiens
tcttcagaaaattatcacttgt

SEQ ID NO: 7108886 - DNA, 22 bp, Homo sapiens
tcttcagaaaattatcacttgt

SEQ ID NO: 7108887 - DNA, 22 bp, Homo sapiens
tcttcagacttccggaaacgtg

SEQ ID NO: 7108888 - DNA, 22 bp, Homo sapiens
tcttcagagatgtaacatatgg

SEQ ID NO: 7108889 - DNA, 22 bp, Homo sapiens
tcttcagagatgtaacatatgg

SEQ ID NO: 7108890 - DNA, 22 bp, Homo sapiens
tcttcagagcatttctgaggta

SEQ ID NO: 7108891 - DNA, 22 bp, Homo sapiens
tcttcagaggaagtcagtcttt

SEQ ID NO: 7108892 - DNA, 22 bp, Homo sapiens
tcttcagaggagctgaatatat

SEQ ID NO: 7108893 - DNA, 22 bp, Homo sapiens
tcttcagagtgaaagtctgtga

SEQ ID NO: 7108894 - DNA, 22 bp, Homo sapiens
tcttcctatggggctgcaggaa

SEQ ID NO: 7108895 - DNA, 22 bp, Homo sapiens
ccaggcaggctagaatgtaaat

SEQ ID NO: 7108896 - DNA, 22 bp, Homo sapiens
ccaggcaggctagaatgtaaat

SEQ ID NO: 7108897 - DNA, 22 bp, Homo sapiens
tcttcctatgccaacattctgt

SEQ ID NO: 7108898 - DNA, 19 bp, Homo sapiens
tcttccctggctgtcagtc

SEQ ID NO: 7108899 - DNA, 19 bp, Homo sapiens
tcttccctggctgtcagtc

SEQ ID NO: 7108900 - DNA, 22 bp, Homo sapiens
ccaggcagggagctgtttggcc

SEQ ID NO: 7108901 - DNA, 22 bp, Homo sapiens
ccaggcagggagctgtttggcc

SEQ ID NO: 7108902 - DNA, 22 bp, Homo sapiens
ccaggcagggagctgtttggcc

SEQ ID NO: 7108903 - DNA, 22 bp, Homo sapiens
ccaggccagagtgcagtggcac

SEQ ID NO: 7108904 - DNA, 22 bp, Homo sapiens
ccaggccagagtgcagtggcac

SEQ ID NO: 7108905 - DNA, 21 bp, Homo sapiens
tcttccctcaggatgtcctgc

SEQ ID NO: 7108906 - DNA, 22 bp, Homo sapiens
tcttccctaatcaccatcttca

SEQ ID NO: 7108907 - DNA, 22 bp, Homo sapiens
tcttcccattagtaatgaagtg

SEQ ID NO: 7108908 - DNA, 21 bp, Homo sapiens
tcttcccattatgttccaatt

SEQ ID NO: 7108909 - DNA, 22 bp, Homo sapiens
tcttcccccgtgctccagtgca

SEQ ID NO: 7108910 - DNA, 22 bp, Homo sapiens
ccaggccagcaggcacacctgc

SEQ ID NO: 7108911 - DNA, 22 bp, Homo sapiens
ccaggccagcaggcacacctgc

SEQ ID NO: 7108912 - DNA, 22 bp, Homo sapiens
ccaggccagcaggcacacctgc

SEQ ID NO: 7108913 - DNA, 22 bp, Homo sapiens
ccaggccagcaggcacacctgc

SEQ ID NO: 7108914 - DNA, 22 bp, Homo sapiens
ccaggccagcctggagcatggc

SEQ ID NO: 7108915 - DNA, 22 bp, Homo sapiens
ccaggccagagtgcagtggcac

SEQ ID NO: 7108916 - DNA, 22 bp, Homo sapiens
ccaggccagagtgcagtggcac

SEQ ID NO: 7108917 - DNA, 22 bp, Homo sapiens
ccaggccagagtgcagtggcac

SEQ ID NO: 7108918 - DNA, 22 bp, Homo sapiens
ccaggccagcctggagcatggc

SEQ ID NO: 7108919 - DNA, 22 bp, Homo sapiens
ccaggccagcgctggctggagg

SEQ ID NO: 7108920 - DNA, 22 bp, Homo sapiens
ccaggccagcgctggctggagg

SEQ ID NO: 7108921 - DNA, 22 bp, Homo sapiens
ccaggccagcgctggctggagg

SEQ ID NO: 7108922 - DNA, 22 bp, Homo sapiens
ccaggccagcgctggctggagg

SEQ ID NO: 7108923 - DNA, 22 bp, Homo sapiens
ccaggccagcgctggctggagg

SEQ ID NO: 7108924 - DNA, 22 bp, Homo sapiens
ccaggccaggagagcgaggttt

SEQ ID NO: 7108925 - DNA, 22 bp, Homo sapiens
tctttggctgcctgaagcccaa

SEQ ID NO: 7108926 - DNA, 19 bp, Homo sapiens
tctttggcttctggatcag

SEQ ID NO: 7108927 - DNA, 22 bp, Homo sapiens
tctttggccttaggagcccttg

SEQ ID NO: 7108928 - DNA, 22 bp, Homo sapiens
ccaggctgaatatgttccaggg

SEQ ID NO: 7108929 - DNA, 22 bp, Homo sapiens
ccaggctgagcatgattggagc

SEQ ID NO: 7108930 - DNA, 22 bp, Homo sapiens
ccaggctgagcatgattggagc

SEQ ID NO: 7108931 - DNA, 22 bp, Homo sapiens
tctttggggcatctgggagatt

SEQ ID NO: 7108932 - DNA, 23 bp, Homo sapiens
tctttggtaaataaagtggggat

SEQ ID NO: 7108933 - DNA, 23 bp, Homo sapiens
tctttggtaaataaagtggggat

SEQ ID NO: 7108934 - DNA, 22 bp, Homo sapiens
tctttggtattcacttgtgaag

SEQ ID NO: 7108935 - DNA, 22 bp, Homo sapiens
tctttggtattcacttgtgaag

SEQ ID NO: 7108936 - DNA, 22 bp, Homo sapiens
tctttggtcagaaagattacac

SEQ ID NO: 7108937 - DNA, 22 bp, Homo sapiens
tctttggtcagaaagattacac

SEQ ID NO: 7108938 - DNA, 22 bp, Homo sapiens
tctttggtcatcatgggaagca

SEQ ID NO: 7108939 - DNA, 22 bp, Homo sapiens
ccaggctggagtgcaatggtgc

SEQ ID NO: 7108940 - DNA, 22 bp, Homo sapiens
ccaggctggagtgcaatggtgc

SEQ ID NO: 7108941 - DNA, 22 bp, Homo sapiens
ccaggctggagtgcaatggtgc

SEQ ID NO: 7108942 - DNA, 22 bp, Homo sapiens
ccaggctggagtgcaatggcgt

SEQ ID NO: 7108943 - DNA, 22 bp, Homo sapiens
ccaggctggagtgcaatggcgt

SEQ ID NO: 7108944 - DNA, 22 bp, Homo sapiens
ccaggctggagtgcaatggcat

SEQ ID NO: 7108945 - DNA, 22 bp, Homo sapiens
ccaggctggagtgcaatggcgt

SEQ ID NO: 7108946 - DNA, 22 bp, Homo sapiens
ccaggctggagtgcaatggcgt

SEQ ID NO: 7108947 - DNA, 22 bp, Homo sapiens
ccaggctggagtgcaatggcat

SEQ ID NO: 7108948 - DNA, 22 bp, Homo sapiens
tctttggttgcactgcaggtgt

SEQ ID NO: 7108949 - DNA, 22 bp, Homo sapiens
tctttggttgcactgcaggtgt

SEQ ID NO: 7108950 - DNA, 22 bp, Homo sapiens
tctttggttgcactgcaggtgt

SEQ ID NO: 7108951 - DNA, 22 bp, Homo sapiens
tctttggtgaatggtcatccag

SEQ ID NO: 7108952 - DNA, 22 bp, Homo sapiens
tctttggtgaatggtcatccag

SEQ ID NO: 7108953 - DNA, 22 bp, Homo sapiens
tctttggtgatatctctttggt

SEQ ID NO: 7108954 - DNA, 22 bp, Homo sapiens
ccaggctgaatatgttccaggg

SEQ ID NO: 7108955 - DNA, 23 bp, Homo sapiens
ccaggctctttcacctgctattc

SEQ ID NO: 7108956 - DNA, 23 bp, Homo sapiens
ccaggctctttcacctgctattc

SEQ ID NO: 7108957 - DNA, 23 bp, Homo sapiens
ccaggctctttcacctgctattc

SEQ ID NO: 7108958 - DNA, 23 bp, Homo sapiens
ccaggctctttcacctgctattc

SEQ ID NO: 7108959 - DNA, 23 bp, Homo sapiens
ccaggctctttcacctgctattc

SEQ ID NO: 7108960 - DNA, 23 bp, Homo sapiens
ccaggctctttcacctgctattc

SEQ ID NO: 7108961 - DNA, 22 bp, Homo sapiens
ccaggctgaatatgttccaggg

SEQ ID NO: 7108962 - DNA, 22 bp, Homo sapiens
ccaggctgaatatgttccaggg

SEQ ID NO: 7108963 - DNA, 22 bp, Homo sapiens
ccaggctctgttccccgaggag

SEQ ID NO: 7108964 - DNA, 22 bp, Homo sapiens
ccaggctctgttccccgaggag

SEQ ID NO: 7108965 - DNA, 22 bp, Homo sapiens
ccaggctctgtgtgggctagag

SEQ ID NO: 7108966 - DNA, 22 bp, Homo sapiens
ccaggctctgttccccgaggag

SEQ ID NO: 7108967 - DNA, 22 bp, Homo sapiens
ccaggctctgttccccgaggag

SEQ ID NO: 7108968 - DNA, 22 bp, Homo sapiens
ccaggctctgttccccgaggag

SEQ ID NO: 7108969 - DNA, 22 bp, Homo sapiens
ccaggctctgtgtgggctagag

SEQ ID NO: 7108970 - DNA, 22 bp, Homo sapiens
ccaggctctgtgtgggctagag

SEQ ID NO: 7108971 - DNA, 22 bp, Homo sapiens
ccaggctctgtgtgggctagag

SEQ ID NO: 7108972 - DNA, 22 bp, Homo sapiens
ccaggctctgtgtgggctagag

SEQ ID NO: 7108973 - DNA, 22 bp, Homo sapiens
ccaggctctgtgtgggctagag

SEQ ID NO: 7108974 - DNA, 22 bp, Homo sapiens
ccaggctctgtgtgggctagag

SEQ ID NO: 7108975 - DNA, 22 bp, Homo sapiens
ccaggctctgtctggtcagaag

SEQ ID NO: 7108976 - DNA, 22 bp, Homo sapiens
ccaggctctgtctggtcagaag

SEQ ID NO: 7108977 - DNA, 22 bp, Homo sapiens
ccaggctctgtctggtcagaag

SEQ ID NO: 7108978 - DNA, 22 bp, Homo sapiens
ccaggctctgtgtgggctagag

SEQ ID NO: 7108979 - DNA, 22 bp, Homo sapiens
ccaggctctgtgtgggctagag

SEQ ID NO: 7108980 - DNA, 21 bp, Homo sapiens
ccaggctcctgaggctggtca

SEQ ID NO: 7108981 - DNA, 22 bp, Homo sapiens
ccaggctctgtctggtcagaag

SEQ ID NO: 7108982 - DNA, 22 bp, Homo sapiens
ccaggctctgtctggtcagaag

SEQ ID NO: 7108983 - DNA, 22 bp, Homo sapiens
ccaggctctgtctggtcagaag

SEQ ID NO: 7108984 - DNA, 21 bp, Homo sapiens
ccaggctcctgaggctggtca

SEQ ID NO: 7108985 - DNA, 21 bp, Homo sapiens
ccaggctcctgaggctggtca

SEQ ID NO: 7108986 - DNA, 22 bp, Homo sapiens
ccaggcctggacgggtggcctg

SEQ ID NO: 7108987 - DNA, 22 bp, Homo sapiens
ccaggcctggacgggtggcctg

SEQ ID NO: 7108988 - DNA, 22 bp, Homo sapiens
ccaggcctggccaggggatgcc

SEQ ID NO: 7108989 - DNA, 22 bp, Homo sapiens
ccaggcctggccaggggatgcc

SEQ ID NO: 7108990 - DNA, 22 bp, Homo sapiens
ccaggcctggaccatgccaggg

SEQ ID NO: 7108991 - DNA, 22 bp, Homo sapiens
ccaggcctggacgggtggcctg

SEQ ID NO: 7108992 - DNA, 22 bp, Homo sapiens
ccaggcctggacgggtggcctg

SEQ ID NO: 7108993 - DNA, 22 bp, Homo sapiens
ccaggcctggaccatgccaggg

SEQ ID NO: 7108994 - DNA, 22 bp, Homo sapiens
ccaggcctggacgggtggcctg

SEQ ID NO: 7108995 - DNA, 22 bp, Homo sapiens
ccaggccccagggctggctttc

SEQ ID NO: 7108996 - DNA, 22 bp, Homo sapiens
ccaggccccagggctggctttc

SEQ ID NO: 7108997 - DNA, 22 bp, Homo sapiens
ccaggcccccgagcagaagaca

SEQ ID NO: 7108998 - DNA, 22 bp, Homo sapiens
ccaggcccccgagcagaagaca

SEQ ID NO: 7108999 - DNA, 22 bp, Homo sapiens
tctttcaaatgcttgaattgga

SEQ ID NO: 7109000 - DNA, 22 bp, Homo sapiens
ccaggcccccgagcagaagaca

SEQ ID NO: 7109001 - DNA, 22 bp, Homo sapiens
tctttcaagggccctagtttgg

SEQ ID NO: 7109002 - DNA, 22 bp, Homo sapiens
tctttcaatccattcatatgtc

SEQ ID NO: 7109003 - DNA, 22 bp, Homo sapiens
tctttcaatccattcatatgtc

SEQ ID NO: 7109004 - DNA, 22 bp, Homo sapiens
tctttcttattagccattgttc

SEQ ID NO: 7109005 - DNA, 22 bp, Homo sapiens
ccaggcccagggtactgaccaa

SEQ ID NO: 7109006 - DNA, 22 bp, Homo sapiens
ccaggccccagggctggctttc

SEQ ID NO: 7109007 - DNA, 22 bp, Homo sapiens
ccaggccccagggctggctttc

SEQ ID NO: 7109008 - DNA, 22 bp, Homo sapiens
ccaggccccagggctggctttc

SEQ ID NO: 7109009 - DNA, 22 bp, Homo sapiens
ccaggcccagggtactgaccaa

SEQ ID NO: 7109010 - DNA, 22 bp, Homo sapiens
ccaggcccagggtactgaccaa

SEQ ID NO: 7109011 - DNA, 22 bp, Homo sapiens
ccaggcccagggtactgaccaa

SEQ ID NO: 7109012 - DNA, 22 bp, Homo sapiens
ccaggcccagggtactgaccaa

SEQ ID NO: 7109013 - DNA, 22 bp, Homo sapiens
ccaggcccaccttggccactta

SEQ ID NO: 7109014 - DNA, 22 bp, Homo sapiens
ccaggcccaccttggccactta

SEQ ID NO: 7109015 - DNA, 22 bp, Homo sapiens
ccaggcccaccttggccactta

SEQ ID NO: 7109016 - DNA, 22 bp, Homo sapiens
ccaggcccaccttggccactta

SEQ ID NO: 7109017 - DNA, 22 bp, Homo sapiens
ccaggccagtgtttggtccagg

SEQ ID NO: 7109018 - DNA, 22 bp, Homo sapiens
ccaggccagtgtttggtccagg

SEQ ID NO: 7109019 - DNA, 22 bp, Homo sapiens
ccaggccagtgtttggtccagg

SEQ ID NO: 7109020 - DNA, 22 bp, Homo sapiens
ccaggccagggctgcagcgagc

SEQ ID NO: 7109021 - DNA, 21 bp, Homo sapiens
ccaggccaggcctacggggat

SEQ ID NO: 7109022 - DNA, 22 bp, Homo sapiens
ccaggccagggctgcagcgagc

SEQ ID NO: 7109023 - DNA, 22 bp, Homo sapiens
ccaggccagggctgcagcgagc

SEQ ID NO: 7109024 - DNA, 22 bp, Homo sapiens
ccaggccagtgtttggtccagg

SEQ ID NO: 7109025 - DNA, 19 bp, Homo sapiens
ccaggccatcccagttccc

SEQ ID NO: 7109026 - DNA, 19 bp, Homo sapiens
ccaggccatcccagttccc

SEQ ID NO: 7109027 - DNA, 18 bp, Homo sapiens
ccaggccatgaacctctg

SEQ ID NO: 7109028 - DNA, 18 bp, Homo sapiens
ccaggccatgaacctctg

SEQ ID NO: 7109029 - DNA, 22 bp, Homo sapiens
ccaggccattcccagagttgct

SEQ ID NO: 7109030 - DNA, 22 bp, Homo sapiens
ccaggccattcccagagttgct

SEQ ID NO: 7109031 - DNA, 22 bp, Homo sapiens
ccaggccattcccagagttgct

SEQ ID NO: 7109032 - DNA, 22 bp, Homo sapiens
ccaggccattcccagagttgct

SEQ ID NO: 7109033 - DNA, 22 bp, Homo sapiens
ccaggcctgcattccctctcag

SEQ ID NO: 7109034 - DNA, 19 bp, Homo sapiens
ccaggcctgcgggcgttgg

SEQ ID NO: 7109035 - DNA, 22 bp, Homo sapiens
ccaggcctgcattccctctcag

SEQ ID NO: 7109036 - DNA, 22 bp, Homo sapiens
ccaggcctgcatctgctgcgca

SEQ ID NO: 7109037 - DNA, 22 bp, Homo sapiens
ccaggcctgcattccctctcag

SEQ ID NO: 7109038 - DNA, 22 bp, Homo sapiens
ccaggcctgcattccctctcag

SEQ ID NO: 7109039 - DNA, 22 bp, Homo sapiens
ccaggcctggaccatgccaggg

SEQ ID NO: 7109040 - DNA, 22 bp, Homo sapiens
ccaggcctggaccatgccaggg

SEQ ID NO: 7109041 - DNA, 22 bp, Homo sapiens
ccaggcctggaccatgccaggg

SEQ ID NO: 7109042 - DNA, 22 bp, Homo sapiens
tctttgaaagctgttctagagt

SEQ ID NO: 7109043 - DNA, 22 bp, Homo sapiens
tctttgaaagctgttctagagt

SEQ ID NO: 7109044 - DNA, 22 bp, Homo sapiens
tctttgaaagctgttctagagt

SEQ ID NO: 7109045 - DNA, 22 bp, Homo sapiens
tctttgaaaagatattcctcct

SEQ ID NO: 7109046 - DNA, 22 bp, Homo sapiens
tctttgaaaagatattcctcct

SEQ ID NO: 7109047 - DNA, 22 bp, Homo sapiens
tctttgaaacaccctaaccttt

SEQ ID NO: 7109048 - DNA, 22 bp, Homo sapiens
tctttcttggtataaagcaggg

SEQ ID NO: 7109049 - DNA, 22 bp, Homo sapiens
tctttcttgtgggtgccctttt

SEQ ID NO: 7109050 - DNA, 22 bp, Homo sapiens
tctttctttatcacctgatatg

SEQ ID NO: 7109051 - DNA, 22 bp, Homo sapiens
tctttcttcctggagcccaaca

SEQ ID NO: 7109052 - DNA, 22 bp, Homo sapiens
tctttcttctttcatagtgtga

SEQ ID NO: 7109053 - DNA, 22 bp, Homo sapiens
tctttcttgcaaggatgcagga

SEQ ID NO: 7109054 - DNA, 22 bp, Homo sapiens
tctttcttcagccctgtaagat

SEQ ID NO: 7109055 - DNA, 22 bp, Homo sapiens
tctttcttcagccctgtaagat

SEQ ID NO: 7109056 - DNA, 22 bp, Homo sapiens
tctttcttattatgctcaatgt

SEQ ID NO: 7109057 - DNA, 22 bp, Homo sapiens
tctttcttattatgctcaatgt

SEQ ID NO: 7109058 - DNA, 22 bp, Homo sapiens
tctttcttattatgctcaatgt

SEQ ID NO: 7109059 - DNA, 22 bp, Homo sapiens
tctttcttcagccctgtaagat

SEQ ID NO: 7109060 - DNA, 22 bp, Homo sapiens
ccaggacagtgaacatgtaaga

SEQ ID NO: 7109061 - DNA, 22 bp, Homo sapiens
ccaggacagtgaacatgtaaga

SEQ ID NO: 7109062 - DNA, 22 bp, Homo sapiens
ccaggaccctgcaaaccctgtt

SEQ ID NO: 7109063 - DNA, 22 bp, Homo sapiens
ccaggacctggagctctatgaa

SEQ ID NO: 7109064 - DNA, 19 bp, Homo sapiens
ccaggacctttccagggtc

SEQ ID NO: 7109065 - DNA, 19 bp, Homo sapiens
ccaggacctttccagggtc

SEQ ID NO: 7109066 - DNA, 19 bp, Homo sapiens
ccaggacctttccagggtc

SEQ ID NO: 7109067 - DNA, 19 bp, Homo sapiens
ccaggacctttccagggtc

SEQ ID NO: 7109068 - DNA, 22 bp, Homo sapiens
ccaggactcaatgaccacaggg

SEQ ID NO: 7109069 - DNA, 22 bp, Homo sapiens
ccaggactcaatgaccacaggg

SEQ ID NO: 7109070 - DNA, 18 bp, Homo sapiens
ccaggacaggcaaaaggt

SEQ ID NO: 7109071 - DNA, 22 bp, Homo sapiens
ccaggacagggagacgggagcc

SEQ ID NO: 7109072 - DNA, 22 bp, Homo sapiens
ccaggacagggagacgggagcc

SEQ ID NO: 7109073 - DNA, 22 bp, Homo sapiens
ccaggacactgcttcacagcag

SEQ ID NO: 7109074 - DNA, 22 bp, Homo sapiens
ccaggacactgcttcacagcag

SEQ ID NO: 7109075 - DNA, 22 bp, Homo sapiens
ccaggacactgcttcacagcag

SEQ ID NO: 7109076 - DNA, 22 bp, Homo sapiens
tctggctcagggctctgaggga

SEQ ID NO: 7109077 - DNA, 22 bp, Homo sapiens
tctggctcaggtcagacaggga

SEQ ID NO: 7109078 - DNA, 22 bp, Homo sapiens
tctggctcatacaagcctgcaa

SEQ ID NO: 7109079 - DNA, 17 bp, Homo sapiens
tctggccttcctgaact

SEQ ID NO: 7109080 - DNA, 22 bp, Homo sapiens
tctggctcaaaatacgtactct

SEQ ID NO: 7109081 - DNA, 22 bp, Homo sapiens
tctggctcacttcaggcttcac

SEQ ID NO: 7109082 - DNA, 22 bp, Homo sapiens
tctggctcacttcaggcttcac

SEQ ID NO: 7109083 - DNA, 22 bp, Homo sapiens
tctggctcacttcaggcttcac

SEQ ID NO: 7109084 - DNA, 22 bp, Homo sapiens
tctggctcacttcaggcttcac

SEQ ID NO: 7109085 - DNA, 22 bp, Homo sapiens
tctggctcaggagctgtgttca

SEQ ID NO: 7109086 - DNA, 21 bp, Homo sapiens
tctggcaggcacgggcccagc

SEQ ID NO: 7109087 - DNA, 21 bp, Homo sapiens
tctggcaggcacgggcccagc

SEQ ID NO: 7109088 - DNA, 22 bp, Homo sapiens
tctggcaggcaatcggctctgg

SEQ ID NO: 7109089 - DNA, 22 bp, Homo sapiens
tctggcaggcaatcggctctgg

SEQ ID NO: 7109090 - DNA, 22 bp, Homo sapiens
tctggcaggccttgtcaatctg

SEQ ID NO: 7109091 - DNA, 22 bp, Homo sapiens
tctggcaggccttgtcaatctg

SEQ ID NO: 7109092 - DNA, 22 bp, Homo sapiens
tctggcaggaccatgaagcgta

SEQ ID NO: 7109093 - DNA, 21 bp, Homo sapiens
tctggcaggaagacggatggg

SEQ ID NO: 7109094 - DNA, 22 bp, Homo sapiens
tctggcaggatatcgaagtgaa

SEQ ID NO: 7109095 - DNA, 22 bp, Homo sapiens
tctggcaggatatcgaagtgaa

SEQ ID NO: 7109096 - DNA, 22 bp, Homo sapiens
tctggcagctatcctctggcca

SEQ ID NO: 7109097 - DNA, 22 bp, Homo sapiens
tctggcagctatcctctggcca

SEQ ID NO: 7109098 - DNA, 21 bp, Homo sapiens
tctggcagcagtttgttgagt

SEQ ID NO: 7109099 - DNA, 22 bp, Homo sapiens
tctggcagcgaagcgtgtactt

SEQ ID NO: 7109100 - DNA, 22 bp, Homo sapiens
tctggcaggacatgctgaccat

SEQ ID NO: 7109101 - DNA, 21 bp, Homo sapiens
tctggcaggaagacggatggg

SEQ ID NO: 7109102 - DNA, 22 bp, Homo sapiens
tctggcagctctcctcggcgga

SEQ ID NO: 7109103 - DNA, 22 bp, Homo sapiens
tctggcagctctcctcggcgga

SEQ ID NO: 7109104 - DNA, 22 bp, Homo sapiens
tctggcagctcagttcaggtct

SEQ ID NO: 7109105 - DNA, 22 bp, Homo sapiens
tctggcaggggttctgcacttg

SEQ ID NO: 7109106 - DNA, 22 bp, Homo sapiens
tctggcagggtcagggcccagg

SEQ ID NO: 7109107 - DNA, 22 bp, Homo sapiens
tctggcagggtcagggcccagg

SEQ ID NO: 7109108 - DNA, 22 bp, Homo sapiens
tctggcaggggttctgcacttg

SEQ ID NO: 7109109 - DNA, 22 bp, Homo sapiens
tctggcaggggttctgcacttg

SEQ ID NO: 7109110 - DNA, 22 bp, Homo sapiens
tctggcctatttctgtcagatc

SEQ ID NO: 7109111 - DNA, 22 bp, Homo sapiens
tctggcctcctccaccagggaa

SEQ ID NO: 7109112 - DNA, 22 bp, Homo sapiens
tctggtggtatacatctaggag

SEQ ID NO: 7109113 - DNA, 22 bp, Homo sapiens
tctggtctccaggagtggtggt

SEQ ID NO: 7109114 - DNA, 22 bp, Homo sapiens
tctggtgtcagtattctttgaa

SEQ ID NO: 7109115 - DNA, 22 bp, Homo sapiens
tctggtggtgggccacaagcat

SEQ ID NO: 7109116 - DNA, 22 bp, Homo sapiens
tctggtgtcagtattctttgaa

SEQ ID NO: 7109117 - DNA, 22 bp, Homo sapiens
tctggtcactgtccaattctat

SEQ ID NO: 7109118 - DNA, 22 bp, Homo sapiens
tctggtcagtctccattctacc

SEQ ID NO: 7109119 - DNA, 22 bp, Homo sapiens
tctggtcagtctccattctacc

SEQ ID NO: 7109120 - DNA, 22 bp, Homo sapiens
tctggtcagtaataagaagtgg

SEQ ID NO: 7109121 - DNA, 22 bp, Homo sapiens
tctggtcatcggaaagatcaaa

SEQ ID NO: 7109122 - DNA, 22 bp, Homo sapiens
tctggtccccattccaggtggg

SEQ ID NO: 7109123 - DNA, 22 bp, Homo sapiens
tctggtccccattccaggtggg

SEQ ID NO: 7109124 - DNA, 22 bp, Homo sapiens
tctggtcccttttcctgcagtc

SEQ ID NO: 7109125 - DNA, 22 bp, Homo sapiens
ccaggagaataatggcagatta

SEQ ID NO: 7109126 - DNA, 22 bp, Homo sapiens
ccaggagaataatggcagatta

SEQ ID NO: 7109127 - DNA, 22 bp, Homo sapiens
ccaggagaagcatctgagtgta

SEQ ID NO: 7109128 - DNA, 22 bp, Homo sapiens
ccaggagaagcatctgagtgta

SEQ ID NO: 7109129 - DNA, 22 bp, Homo sapiens
ccaggagaagcatctgagtgta

SEQ ID NO: 7109130 - DNA, 22 bp, Homo sapiens
tctggttgtcgaccaccaatgc

SEQ ID NO: 7109131 - DNA, 22 bp, Homo sapiens
tctggtttcccagttcctccgt

SEQ ID NO: 7109132 - DNA, 22 bp, Homo sapiens
tctggtttcaatgggtacgatt

SEQ ID NO: 7109133 - DNA, 20 bp, Homo sapiens
ccaggactgctggggactct

SEQ ID NO: 7109134 - DNA, 22 bp, Homo sapiens
ccaggacttattacagtataac

SEQ ID NO: 7109135 - DNA, 22 bp, Homo sapiens
ccaggacttcgaggctacagtg

SEQ ID NO: 7109136 - DNA, 22 bp, Homo sapiens
ccaggacttcgaggctacagtg

SEQ ID NO: 7109137 - DNA, 22 bp, Homo sapiens
ccaggactttaagtccagcact

SEQ ID NO: 7109138 - DNA, 22 bp, Homo sapiens
ccaggactttaagtccagcact

SEQ ID NO: 7109139 - DNA, 22 bp, Homo sapiens
ccaggactttaagtccagcact

SEQ ID NO: 7109140 - DNA, 22 bp, Homo sapiens
tctgggagatccaagcagaact

SEQ ID NO: 7109141 - DNA, 19 bp, Homo sapiens
tctgggagagtgaatctga

SEQ ID NO: 7109142 - DNA, 19 bp, Homo sapiens
tctgggagagtgaatctga

SEQ ID NO: 7109143 - DNA, 22 bp, Homo sapiens
ccaggactgcagggggcgagga

SEQ ID NO: 7109144 - DNA, 22 bp, Homo sapiens
tctgggagagtcacaggcattg

SEQ ID NO: 7109145 - DNA, 22 bp, Homo sapiens
ccaggactcaatgaccacaggg

SEQ ID NO: 7109146 - DNA, 22 bp, Homo sapiens
ccaggactcaattaacctcact

SEQ ID NO: 7109147 - DNA, 22 bp, Homo sapiens
ccaggactcagtggggaaaggg

SEQ ID NO: 7109148 - DNA, 21 bp, Homo sapiens
ccaggactccatggggtctct

SEQ ID NO: 7109149 - DNA, 22 bp, Homo sapiens
tctgggagatccaagcagaact

SEQ ID NO: 7109150 - DNA, 19 bp, Homo sapiens
tctgggagagtgaatctga

SEQ ID NO: 7109151 - DNA, 22 bp, Homo sapiens
tctgggagcagatgatggtata

SEQ ID NO: 7109152 - DNA, 22 bp, Homo sapiens
tctgggagcagatgatggtata

SEQ ID NO: 7109153 - DNA, 22 bp, Homo sapiens
tctgggagctggctttgcctca

SEQ ID NO: 7109154 - DNA, 22 bp, Homo sapiens
tctgggagccatgccttggagt

SEQ ID NO: 7109155 - DNA, 22 bp, Homo sapiens
tctggtcaagacatcctaacat

SEQ ID NO: 7109156 - DNA, 22 bp, Homo sapiens
tctggtcaagacatcctaacat

SEQ ID NO: 7109157 - DNA, 22 bp, Homo sapiens
tctggtcaaggagcagtgactg

SEQ ID NO: 7109158 - DNA, 22 bp, Homo sapiens
tctgggtttgaagtagagccca

SEQ ID NO: 7109159 - DNA, 22 bp, Homo sapiens
tctgggaggctgggtcccgtcc

SEQ ID NO: 7109160 - DNA, 22 bp, Homo sapiens
tctggggatgaggtccagtgat

SEQ ID NO: 7109161 - DNA, 20 bp, Homo sapiens
tctggggatgaggtctagga

SEQ ID NO: 7109162 - DNA, 22 bp, Homo sapiens
tctggggatgaggtccagtgat

SEQ ID NO: 7109163 - DNA, 20 bp, Homo sapiens
tctggggatgaggtctagga

SEQ ID NO: 7109164 - DNA, 22 bp, Homo sapiens
ccagctgctgtgaggaccacag

SEQ ID NO: 7109165 - DNA, 22 bp, Homo sapiens
ccagctgctgtgaggaccacag

SEQ ID NO: 7109166 - DNA, 22 bp, Homo sapiens
ccagctgctgtgaggaccacag

SEQ ID NO: 7109167 - DNA, 22 bp, Homo sapiens
ccagctgctgtgcagggaggct

SEQ ID NO: 7109168 - DNA, 22 bp, Homo sapiens
ccagctgctgcaccgtgcatgg

SEQ ID NO: 7109169 - DNA, 22 bp, Homo sapiens
ccagctgctgtgaggaccacag

SEQ ID NO: 7109170 - DNA, 22 bp, Homo sapiens
ccagctgctgtgaggaccacag

SEQ ID NO: 7109171 - DNA, 22 bp, Homo sapiens
ccagctgctgacatgggcaggt

SEQ ID NO: 7109172 - DNA, 22 bp, Homo sapiens
ccagctgctgacatgggcaggt

SEQ ID NO: 7109173 - DNA, 22 bp, Homo sapiens
ccagctgctgacatgggcaggt

SEQ ID NO: 7109174 - DNA, 22 bp, Homo sapiens
ccagctgctgcaccgtgcatgg

SEQ ID NO: 7109175 - DNA, 22 bp, Homo sapiens
ccagctgctctcttctccgcca

SEQ ID NO: 7109176 - DNA, 22 bp, Homo sapiens
ccagctgctctcttctccgcca

SEQ ID NO: 7109177 - DNA, 22 bp, Homo sapiens
ccagctgctctcttctccgcca

SEQ ID NO: 7109178 - DNA, 22 bp, Homo sapiens
ccagctgctgacatgggcaggt

SEQ ID NO: 7109179 - DNA, 22 bp, Homo sapiens
ccagctgctgacatgggcaggt

SEQ ID NO: 7109180 - DNA, 22 bp, Homo sapiens
ccagctgctgtgcagggaggct

SEQ ID NO: 7109181 - DNA, 22 bp, Homo sapiens
ccagctgctgtgcagggaggct

SEQ ID NO: 7109182 - DNA, 22 bp, Homo sapiens
ccagctgctgtgcagggaggct

SEQ ID NO: 7109183 - DNA, 22 bp, Homo sapiens
ccagctgctgtgcagggaggct

SEQ ID NO: 7109184 - DNA, 22 bp, Homo sapiens
ccagctgcttgggaaaatgtct

SEQ ID NO: 7109185 - DNA, 22 bp, Homo sapiens
tctggaggcaggctgccaggat

SEQ ID NO: 7109186 - DNA, 22 bp, Homo sapiens
tctggaggccatagggaaggat

SEQ ID NO: 7109187 - DNA, 22 bp, Homo sapiens
tctggaggccatagggaaggat

SEQ ID NO: 7109188 - DNA, 22 bp, Homo sapiens
tctggaggccatagggaaggat

SEQ ID NO: 7109189 - DNA, 22 bp, Homo sapiens
tctggaggccatagggaaggat

SEQ ID NO: 7109190 - DNA, 22 bp, Homo sapiens
tctggaggccatagggaaggat

SEQ ID NO: 7109191 - DNA, 22 bp, Homo sapiens
tctggcagcagcatcagtggct

SEQ ID NO: 7109192 - DNA, 22 bp, Homo sapiens
tctggcagcagcatcagtggct

SEQ ID NO: 7109193 - DNA, 22 bp, Homo sapiens
tctggcagcagcatcagtggct

SEQ ID NO: 7109194 - DNA, 22 bp, Homo sapiens
ccagctgcccaagaggcatcct

SEQ ID NO: 7109195 - DNA, 22 bp, Homo sapiens
ccagctgcccaagaggcatcct

SEQ ID NO: 7109196 - DNA, 22 bp, Homo sapiens
ccagctgcccaagaggcatcct

SEQ ID NO: 7109197 - DNA, 22 bp, Homo sapiens
ccagctgcccaagaggcatcct

SEQ ID NO: 7109198 - DNA, 22 bp, Homo sapiens
ccagctgcccaagaggcatcct

SEQ ID NO: 7109199 - DNA, 22 bp, Homo sapiens
ccagctgcccaagaggcatcct

SEQ ID NO: 7109200 - DNA, 22 bp, Homo sapiens
ccagctgcccactatgtgttct

SEQ ID NO: 7109201 - DNA, 22 bp, Homo sapiens
ccagctgcccactatgtgttct

SEQ ID NO: 7109202 - DNA, 22 bp, Homo sapiens
ccagctgcccactatgtgttct

SEQ ID NO: 7109203 - DNA, 22 bp, Homo sapiens
ccagctgcctaagcaatccata

SEQ ID NO: 7109204 - DNA, 22 bp, Homo sapiens
ccagctgcctaagcaatccata

SEQ ID NO: 7109205 - DNA, 21 bp, Homo sapiens
ccagctgcctgcactttggac

SEQ ID NO: 7109206 - DNA, 21 bp, Homo sapiens
ccagctgcctgcactttggac

SEQ ID NO: 7109207 - DNA, 21 bp, Homo sapiens
ccagctgcctgcactttggac

SEQ ID NO: 7109208 - DNA, 21 bp, Homo sapiens
ccagctgcctgcactttggac

SEQ ID NO: 7109209 - DNA, 18 bp, Homo sapiens
ccagctgcgctgaaccga

SEQ ID NO: 7109210 - DNA, 18 bp, Homo sapiens
ccagctgcgctgaaccga

SEQ ID NO: 7109211 - DNA, 18 bp, Homo sapiens
ccagctgcgctgaaccga

SEQ ID NO: 7109212 - DNA, 22 bp, Homo sapiens
ccagctgcgggcatcgagagtt

SEQ ID NO: 7109213 - DNA, 22 bp, Homo sapiens
ccagctgcgggcatcgagagtt

SEQ ID NO: 7109214 - DNA, 22 bp, Homo sapiens
ccagctgcgggcatcgagagtt

SEQ ID NO: 7109215 - DNA, 22 bp, Homo sapiens
ccagctgcgggcatcgagagtt

SEQ ID NO: 7109216 - DNA, 22 bp, Homo sapiens
ccagctgcgggcatcgagagtt

SEQ ID NO: 7109217 - DNA, 22 bp, Homo sapiens
ccagctgcggtctcccaaagtt

SEQ ID NO: 7109218 - DNA, 22 bp, Homo sapiens
ccagctgcggtctcccaaagtt

SEQ ID NO: 7109219 - DNA, 22 bp, Homo sapiens
ccagctgctaacacaaaggagt

SEQ ID NO: 7109220 - DNA, 22 bp, Homo sapiens
ccagctgctaacacaaaggagt

SEQ ID NO: 7109221 - DNA, 22 bp, Homo sapiens
ccagctgctatcatgccatttc

SEQ ID NO: 7109222 - DNA, 22 bp, Homo sapiens
ccagctgctatcatgccatttc

SEQ ID NO: 7109223 - DNA, 22 bp, Homo sapiens
ccagctgctatcatgccatttc

SEQ ID NO: 7109224 - DNA, 17 bp, Homo sapiens
ccagctgctccctcaga

SEQ ID NO: 7109225 - DNA, 17 bp, Homo sapiens
ccagctgctccctcaga

SEQ ID NO: 7109226 - DNA, 17 bp, Homo sapiens
ccagctgctccctcaga

SEQ ID NO: 7109227 - DNA, 21 bp, Homo sapiens
ccagctgctccttgaggttcc

SEQ ID NO: 7109228 - DNA, 21 bp, Homo sapiens
ccagctgctccttgaggttcc

SEQ ID NO: 7109229 - DNA, 21 bp, Homo sapiens
ccagctgctccttgaggttcc

SEQ ID NO: 7109230 - DNA, 22 bp, Homo sapiens
ccagctgcccaagaggcatcct

SEQ ID NO: 7109231 - DNA, 22 bp, Homo sapiens
ccagctgcatgacattaggtga

SEQ ID NO: 7109232 - DNA, 22 bp, Homo sapiens
ccagctgcatcctattcactgc

SEQ ID NO: 7109233 - DNA, 22 bp, Homo sapiens
ccagctgcatgacattaggtga

SEQ ID NO: 7109234 - DNA, 20 bp, Homo sapiens
ccagctgcagttcttaatga

SEQ ID NO: 7109235 - DNA, 22 bp, Homo sapiens
ccagctgcatcctattcactgc

SEQ ID NO: 7109236 - DNA, 22 bp, Homo sapiens
ccagctgcatcctattcactgc

SEQ ID NO: 7109237 - DNA, 22 bp, Homo sapiens
ccagctgcatcctattcactgc

SEQ ID NO: 7109238 - DNA, 22 bp, Homo sapiens
ccagctgcaggtgttccagatg

SEQ ID NO: 7109239 - DNA, 22 bp, Homo sapiens
ccagctgcaggggagcagtgga

SEQ ID NO: 7109240 - DNA, 22 bp, Homo sapiens
ccagctgcaggggagcagtgga

SEQ ID NO: 7109241 - DNA, 22 bp, Homo sapiens
ccagctgcaggtgttccagatg

SEQ ID NO: 7109242 - DNA, 22 bp, Homo sapiens
ccagctgcaggtgttccagatg

SEQ ID NO: 7109243 - DNA, 20 bp, Homo sapiens
ccagctgcagttcttaatga

SEQ ID NO: 7109244 - DNA, 22 bp, Homo sapiens
ccagctgcagaatgttggggaa

SEQ ID NO: 7109245 - DNA, 22 bp, Homo sapiens
ccagctgattcggtggtggttg

SEQ ID NO: 7109246 - DNA, 22 bp, Homo sapiens
ccagctgaggttgaagaaagag

SEQ ID NO: 7109247 - DNA, 22 bp, Homo sapiens
ccagctgattcggtggtggttg

SEQ ID NO: 7109248 - DNA, 22 bp, Homo sapiens
ccagctgattcggtggtggttg

SEQ ID NO: 7109249 - DNA, 22 bp, Homo sapiens
ccagctgcagaatgttggggaa

SEQ ID NO: 7109250 - DNA, 22 bp, Homo sapiens
ccagctgcaggggagcagtgga

SEQ ID NO: 7109251 - DNA, 22 bp, Homo sapiens
ccagctgcaggggagcagtgga

SEQ ID NO: 7109252 - DNA, 22 bp, Homo sapiens
ccagctgcaggggagcagtgga

SEQ ID NO: 7109253 - DNA, 22 bp, Homo sapiens
ccagctgaggcagccacacagg

SEQ ID NO: 7109254 - DNA, 22 bp, Homo sapiens
ccagctgaggcagccacacagg

SEQ ID NO: 7109255 - DNA, 22 bp, Homo sapiens
ccagctgaggcagccacacagg

SEQ ID NO: 7109256 - DNA, 22 bp, Homo sapiens
ccagctgaggttgaagaaagag

SEQ ID NO: 7109257 - DNA, 22 bp, Homo sapiens
ccagctctgccaagcgtcagct

SEQ ID NO: 7109258 - DNA, 22 bp, Homo sapiens
ccagctctgccaagcgtcagct

SEQ ID NO: 7109259 - DNA, 22 bp, Homo sapiens
ccagctctctgtcctccccaca

SEQ ID NO: 7109260 - DNA, 22 bp, Homo sapiens
ccagctctctgcagaaaggact

SEQ ID NO: 7109261 - DNA, 22 bp, Homo sapiens
ccagctctctgtcctccccaca

SEQ ID NO: 7109262 - DNA, 22 bp, Homo sapiens
ccagctctctgcagaaaggact

SEQ ID NO: 7109263 - DNA, 22 bp, Homo sapiens
ccagctctctgtcctccccaca

SEQ ID NO: 7109264 - DNA, 22 bp, Homo sapiens
ccagctctcttcaagcccactc

SEQ ID NO: 7109265 - DNA, 22 bp, Homo sapiens
ccagctctcttcaagcccactc

SEQ ID NO: 7109266 - DNA, 22 bp, Homo sapiens
ccagctctcttcaagcccactc

SEQ ID NO: 7109267 - DNA, 22 bp, Homo sapiens
ccagctctctttgaagcataaa

SEQ ID NO: 7109268 - DNA, 22 bp, Homo sapiens
ccagctctctttgaagcataaa

SEQ ID NO: 7109269 - DNA, 22 bp, Homo sapiens
ccagctctgattttgacctcca

SEQ ID NO: 7109270 - DNA, 22 bp, Homo sapiens
ccagctctgattttgacctcca

SEQ ID NO: 7109271 - DNA, 22 bp, Homo sapiens
ccagctctgcagggcctggggt

SEQ ID NO: 7109272 - DNA, 22 bp, Homo sapiens
ccagctctgcagggcctggggt

SEQ ID NO: 7109273 - DNA, 22 bp, Homo sapiens
ccagctctgcagggcctggggt

SEQ ID NO: 7109274 - DNA, 22 bp, Homo sapiens
ccagctctgattttgacctcca

SEQ ID NO: 7109275 - DNA, 22 bp, Homo sapiens
ccagctctgattttgacctcca

SEQ ID NO: 7109276 - DNA, 22 bp, Homo sapiens
ccagctctgattttgacctcca

SEQ ID NO: 7109277 - DNA, 22 bp, Homo sapiens
ccagctctgcatgtttcccttg

SEQ ID NO: 7109278 - DNA, 22 bp, Homo sapiens
ccagctctgccaagcgtcagct

SEQ ID NO: 7109279 - DNA, 22 bp, Homo sapiens
ccagctctgccaagcgtcagct

SEQ ID NO: 7109280 - DNA, 22 bp, Homo sapiens
ccagctctgcatgtttcccttg

SEQ ID NO: 7109281 - DNA, 22 bp, Homo sapiens
ccagctctgccaagcgtcagct

SEQ ID NO: 7109282 - DNA, 22 bp, Homo sapiens
tctggaaaagcgataaaccatt

SEQ ID NO: 7109283 - DNA, 22 bp, Homo sapiens
tctgctttttcattgactgaaa

SEQ ID NO: 7109284 - DNA, 22 bp, Homo sapiens
tctgctttttcattgactgaaa

SEQ ID NO: 7109285 - DNA, 22 bp, Homo sapiens
tctgctttgctgcctcctgatc

SEQ ID NO: 7109286 - DNA, 22 bp, Homo sapiens
tctgctttgctgcctcctgatc

SEQ ID NO: 7109287 - DNA, 22 bp, Homo sapiens
tctgctttgctgcctcctgatc

SEQ ID NO: 7109288 - DNA, 22 bp, Homo sapiens
tctgctttcttgcgcagatgtg

SEQ ID NO: 7109289 - DNA, 22 bp, Homo sapiens
tctgctttgaccttcttgatgc

SEQ ID NO: 7109290 - DNA, 22 bp, Homo sapiens
tctgctttgaccttcttgatgc

SEQ ID NO: 7109291 - DNA, 22 bp, Homo sapiens
tctgctttgaccttcttgatgc

SEQ ID NO: 7109292 - DNA, 22 bp, Homo sapiens
tctggaacagttacttgctgat

SEQ ID NO: 7109293 - DNA, 22 bp, Homo sapiens
ccagctctcagcgggagactca

SEQ ID NO: 7109294 - DNA, 22 bp, Homo sapiens
tctggaaatttcagttttagag

SEQ ID NO: 7109295 - DNA, 18 bp, Homo sapiens
tctggaacaacttcatgt

SEQ ID NO: 7109296 - DNA, 18 bp, Homo sapiens
tctggaacaacttcatgt

SEQ ID NO: 7109297 - DNA, 22 bp, Homo sapiens
tctgctcacatggctccatgca

SEQ ID NO: 7109298 - DNA, 22 bp, Homo sapiens
tctgctgtttactgtgtgatat

SEQ ID NO: 7109299 - DNA, 22 bp, Homo sapiens
tctgcttaacaacagcacagag

SEQ ID NO: 7109300 - DNA, 22 bp, Homo sapiens
tctgctttagaatccagtagct

SEQ ID NO: 7109301 - DNA, 22 bp, Homo sapiens
tctgctttagacataaaaggta

SEQ ID NO: 7109302 - DNA, 22 bp, Homo sapiens
tctgctttagtgcaaagtctta

SEQ ID NO: 7109303 - DNA, 22 bp, Homo sapiens
tctgctttagtgcaaagtctta

SEQ ID NO: 7109304 - DNA, 22 bp, Homo sapiens
tctgctttatggctcagagact

SEQ ID NO: 7109305 - DNA, 22 bp, Homo sapiens
tctgctttattacactagccaa

SEQ ID NO: 7109306 - DNA, 22 bp, Homo sapiens
tctgctttcaaattcacttagt

SEQ ID NO: 7109307 - DNA, 22 bp, Homo sapiens
tctgctttcaaattcacttagt

SEQ ID NO: 7109308 - DNA, 22 bp, Homo sapiens
tctgctttcaaattcacttagt

SEQ ID NO: 7109309 - DNA, 22 bp, Homo sapiens
tctgctttcttactaaaaatga

SEQ ID NO: 7109310 - DNA, 22 bp, Homo sapiens
tctgctttcttactaaaaatga

SEQ ID NO: 7109311 - DNA, 22 bp, Homo sapiens
tctgctttcttactaaaaatga

SEQ ID NO: 7109312 - DNA, 22 bp, Homo sapiens
tctgctttcttgcgcagatgtg

SEQ ID NO: 7109313 - DNA, 22 bp, Homo sapiens
tctcagagaacagttggtgctt

SEQ ID NO: 7109314 - DNA, 22 bp, Homo sapiens
tctcagagaagtgatgagcaat

SEQ ID NO: 7109315 - DNA, 18 bp, Homo sapiens
tctgctattagaattgcc

SEQ ID NO: 7109316 - DNA, 22 bp, Homo sapiens
tctcagaattgtgtccactggg

SEQ ID NO: 7109317 - DNA, 23 bp, Homo sapiens
tctcagacccgaagccagaggaa

SEQ ID NO: 7109318 - DNA, 22 bp, Homo sapiens
tctcagagaaatgtgtcaccat

SEQ ID NO: 7109319 - DNA, 22 bp, Homo sapiens
tctcagaattgtgtccactggg

SEQ ID NO: 7109320 - DNA, 22 bp, Homo sapiens
tctcagaattgtgtccactggg

SEQ ID NO: 7109321 - DNA, 19 bp, Homo sapiens
tctcagaattaagagtgct

SEQ ID NO: 7109322 - DNA, 22 bp, Homo sapiens
tctcagaatccttgcccaggtg

SEQ ID NO: 7109323 - DNA, 22 bp, Homo sapiens
tctcagaatcaggacctacttc

SEQ ID NO: 7109324 - DNA, 22 bp, Homo sapiens
tctcagaatccttgcccaggtg

SEQ ID NO: 7109325 - DNA, 22 bp, Homo sapiens
ccagagagaaaatggagggcca

SEQ ID NO: 7109326 - DNA, 22 bp, Homo sapiens
ccagagagaaaatggagggcca

SEQ ID NO: 7109327 - DNA, 22 bp, Homo sapiens
ccagagagaaaatggagggcca

SEQ ID NO: 7109328 - DNA, 22 bp, Homo sapiens
ccagagagaaaatggagggcca

SEQ ID NO: 7109329 - DNA, 22 bp, Homo sapiens
ccagagagaaaatggagggcca

SEQ ID NO: 7109330 - DNA, 22 bp, Homo sapiens
ccagagagaaaatggagggcca

SEQ ID NO: 7109331 - DNA, 22 bp, Homo sapiens
ccagagagaaaatggagggcca

SEQ ID NO: 7109332 - DNA, 22 bp, Homo sapiens
ccagagagaaaatggagggcca

SEQ ID NO: 7109333 - DNA, 22 bp, Homo sapiens
tctcagaagtgatcaggatgtt

SEQ ID NO: 7109334 - DNA, 22 bp, Homo sapiens
tctcagaagggtggtgctggag

SEQ ID NO: 7109335 - DNA, 22 bp, Homo sapiens
tctcagaagtgatcaggatgtt

SEQ ID NO: 7109336 - DNA, 22 bp, Homo sapiens
ccagagagagaggtcaatggca

SEQ ID NO: 7109337 - DNA, 22 bp, Homo sapiens
ccagagagaaatggatttgagt

SEQ ID NO: 7109338 - DNA, 22 bp, Homo sapiens
ccagagagaaatggatttgagt

SEQ ID NO: 7109339 - DNA, 22 bp, Homo sapiens
ccagagagagaggtcaatggca

SEQ ID NO: 7109340 - DNA, 22 bp, Homo sapiens
ccagagagagaggtcaatggca

SEQ ID NO: 7109341 - DNA, 18 bp, Homo sapiens
tggagcaggtaggcatga

SEQ ID NO: 7109342 - DNA, 18 bp, Homo sapiens
tggagcaggtaggcatga

SEQ ID NO: 7109343 - DNA, 22 bp, Homo sapiens
ccctgcagccttgcatgccttc

SEQ ID NO: 7109344 - DNA, 18 bp, Homo sapiens
tggagcaggtaggcatga

SEQ ID NO: 7109345 - DNA, 22 bp, Homo sapiens
ccctgcagccttgcatgccttc

SEQ ID NO: 7109346 - DNA, 22 bp, Homo sapiens
tggagcaggccggaagtggctt

SEQ ID NO: 7109347 - DNA, 22 bp, Homo sapiens
tggagcaggccggaagtggctt

SEQ ID NO: 7109348 - DNA, 22 bp, Homo sapiens
tggagcaggcatctttctctct

SEQ ID NO: 7109349 - DNA, 22 bp, Homo sapiens
tggagcaggccggaagtggctt

SEQ ID NO: 7109350 - DNA, 22 bp, Homo sapiens
tggagcagggcatcactgtgcg

SEQ ID NO: 7109351 - DNA, 22 bp, Homo sapiens
tggagcagggcatcactgtgcg

SEQ ID NO: 7109352 - DNA, 22 bp, Homo sapiens
ccctgcaggggacctgcagcct

SEQ ID NO: 7109353 - DNA, 23 bp, Homo sapiens
ccctgcagtcagggtgagatggt

SEQ ID NO: 7109354 - DNA, 23 bp, Homo sapiens
ccctgcagtcagggtgagatggt

SEQ ID NO: 7109355 - DNA, 23 bp, Homo sapiens
ccctgcagtcagggtgagatggt

SEQ ID NO: 7109356 - DNA, 22 bp, Homo sapiens
ccctgcaggggacctgcagcct

SEQ ID NO: 7109357 - DNA, 22 bp, Homo sapiens
ccctgcaggctcagactggagt

SEQ ID NO: 7109358 - DNA, 22 bp, Homo sapiens
ccctgcaggggacctgcagcct

SEQ ID NO: 7109359 - DNA, 22 bp, Homo sapiens
ccctgcaggggacctgcagcct

SEQ ID NO: 7109360 - DNA, 22 bp, Homo sapiens
ccctgcagccttgcatgccttc

SEQ ID NO: 7109361 - DNA, 22 bp, Homo sapiens
ccctgcagccttgcatgccttc

SEQ ID NO: 7109362 - DNA, 22 bp, Homo sapiens
ccctgcagccttgcatgccttc

SEQ ID NO: 7109363 - DNA, 22 bp, Homo sapiens
ccctgcagcttttgcatagtca

SEQ ID NO: 7109364 - DNA, 22 bp, Homo sapiens
ccctgcagcttttgcatagtca

SEQ ID NO: 7109365 - DNA, 21 bp, Homo sapiens
ccctgcaggccagggctgagc

SEQ ID NO: 7109366 - DNA, 21 bp, Homo sapiens
ccctgcaggccagggctgagc

SEQ ID NO: 7109367 - DNA, 21 bp, Homo sapiens
ccctgcaggccagggctgagc

SEQ ID NO: 7109368 - DNA, 21 bp, Homo sapiens
ccctgcaggccagggctgagc

SEQ ID NO: 7109369 - DNA, 22 bp, Homo sapiens
ccctgcaggctcagactggagt

SEQ ID NO: 7109370 - DNA, 22 bp, Homo sapiens
ccctgcaggctcagactggagt

SEQ ID NO: 7109371 - DNA, 22 bp, Homo sapiens
ccctgcaggctcagactggagt

SEQ ID NO: 7109372 - DNA, 22 bp, Homo sapiens
cccttctctttcactcactatt

SEQ ID NO: 7109373 - DNA, 22 bp, Homo sapiens
cccttctctttcactcactatt

SEQ ID NO: 7109374 - DNA, 22 bp, Homo sapiens
cccttccttgtgactggtgggg

SEQ ID NO: 7109375 - DNA, 22 bp, Homo sapiens
cccttctctttcactcactatt

SEQ ID NO: 7109376 - DNA, 21 bp, Homo sapiens
cccttctgctccagctttgcc

SEQ ID NO: 7109377 - DNA, 22 bp, Homo sapiens
cccttctgtaaatgctgactgg

SEQ ID NO: 7109378 - DNA, 22 bp, Homo sapiens
cccttctgtaaatgctgactgg

SEQ ID NO: 7109379 - DNA, 22 bp, Homo sapiens
tggcagaggagaattaagatta

SEQ ID NO: 7109380 - DNA, 19 bp, Homo sapiens
tggcagaggacaaggactt

SEQ ID NO: 7109381 - DNA, 19 bp, Homo sapiens
tggcagaggacaaggactt

SEQ ID NO: 7109382 - DNA, 19 bp, Homo sapiens
tggcagaggacaaggactt

SEQ ID NO: 7109383 - DNA, 19 bp, Homo sapiens
tggcagaggacaaggactt

SEQ ID NO: 7109384 - DNA, 22 bp, Homo sapiens
tggcagaggaaaaagtcactgg

SEQ ID NO: 7109385 - DNA, 19 bp, Homo sapiens
tggcagaggacaaggactt

SEQ ID NO: 7109386 - DNA, 19 bp, Homo sapiens
tggcagaggacaaggactt

SEQ ID NO: 7109387 - DNA, 22 bp, Homo sapiens
tggcagaggaaaaagtcactgg

SEQ ID NO: 7109388 - DNA, 22 bp, Homo sapiens
cccttctttgtaataaagatta

SEQ ID NO: 7109389 - DNA, 22 bp, Homo sapiens
cccttcctcccaggcttctgtg

SEQ ID NO: 7109390 - DNA, 22 bp, Homo sapiens
cccttcctcctcgcctgtcaga

SEQ ID NO: 7109391 - DNA, 22 bp, Homo sapiens
cccttcctcctcgcctgtcaga

SEQ ID NO: 7109392 - DNA, 22 bp, Homo sapiens
ccctgtggggtccgcctgtccg

SEQ ID NO: 7109393 - DNA, 22 bp, Homo sapiens
cccttcctggagtaccctctgt

SEQ ID NO: 7109394 - DNA, 22 bp, Homo sapiens
cccttcctggagtaccctctgt

SEQ ID NO: 7109395 - DNA, 22 bp, Homo sapiens
cccttcctgggtgtcccggagt

SEQ ID NO: 7109396 - DNA, 22 bp, Homo sapiens
cccttcctggagtaccctctgt

SEQ ID NO: 7109397 - DNA, 22 bp, Homo sapiens
cccttcctggagtaccctctgt

SEQ ID NO: 7109398 - DNA, 22 bp, Homo sapiens
cccttcctcctcgcctgtcaga

SEQ ID NO: 7109399 - DNA, 22 bp, Homo sapiens
cccttcctcctcgcctgtcaga

SEQ ID NO: 7109400 - DNA, 22 bp, Homo sapiens
cctcagaaggacaagagacaaa

SEQ ID NO: 7109401 - DNA, 18 bp, Homo sapiens
cctcagaggcaaattgtt

SEQ ID NO: 7109402 - DNA, 22 bp, Homo sapiens
cctcagaggcagatggtaagaa

SEQ ID NO: 7109403 - DNA, 22 bp, Homo sapiens
cctcagaggcagatggtaagaa

SEQ ID NO: 7109404 - DNA, 23 bp, Homo sapiens
cctcagaggcctcatagtctggc

SEQ ID NO: 7109405 - DNA, 22 bp, Homo sapiens
cctcagaggtgaacatcagtgc

SEQ ID NO: 7109406 - DNA, 22 bp, Homo sapiens
cctcagaggtgtggcatctctg

SEQ ID NO: 7109407 - DNA, 22 bp, Homo sapiens
cctcagaggtgtggcatctctg

SEQ ID NO: 7109408 - DNA, 22 bp, Homo sapiens
cctcagaggtgtggcatctctg

SEQ ID NO: 7109409 - DNA, 22 bp, Homo sapiens
cctcagaggtgtggcatctctg

SEQ ID NO: 7109410 - DNA, 22 bp, Homo sapiens
tggcaggtagtcagaggcgaca

SEQ ID NO: 7109411 - DNA, 22 bp, Homo sapiens
tggcaggtagagttctgagatg

SEQ ID NO: 7109412 - DNA, 18 bp, Homo sapiens
tggcaggtagactcaggt

SEQ ID NO: 7109413 - DNA, 22 bp, Homo sapiens
tggcaggtacccattggctgta

SEQ ID NO: 7109414 - DNA, 22 bp, Homo sapiens
tggcaggtacccattggctgta

SEQ ID NO: 7109415 - DNA, 22 bp, Homo sapiens
tggcagggtgggcttcagcccc

SEQ ID NO: 7109416 - DNA, 22 bp, Homo sapiens
tggcagggtgggcttcagcccc

SEQ ID NO: 7109417 - DNA, 22 bp, Homo sapiens
tggcagggtgggcttcagcccc

SEQ ID NO: 7109418 - DNA, 22 bp, Homo sapiens
tggcagggtgggcttcagcccc

SEQ ID NO: 7109419 - DNA, 22 bp, Homo sapiens
tggcagggtgggcttcagcccc

SEQ ID NO: 7109420 - DNA, 22 bp, Homo sapiens
tggcagggtgggcttcagcccc

SEQ ID NO: 7109421 - DNA, 22 bp, Homo sapiens
tggcagggtgggcttcagcccc

SEQ ID NO: 7109422 - DNA, 22 bp, Homo sapiens
tggcagggtgggcttcagcccc

SEQ ID NO: 7109423 - DNA, 22 bp, Homo sapiens
tggcagggttggccaccttacc

SEQ ID NO: 7109424 - DNA, 22 bp, Homo sapiens
tggcagggttggccaccttacc

SEQ ID NO: 7109425 - DNA, 22 bp, Homo sapiens
tggcagggttggccaccttacc

SEQ ID NO: 7109426 - DNA, 22 bp, Homo sapiens
tggcagggttggccaccttacc

SEQ ID NO: 7109427 - DNA, 22 bp, Homo sapiens
tggcagggttggccaccttacc

SEQ ID NO: 7109428 - DNA, 22 bp, Homo sapiens
tggcagggttggccaccttacc

SEQ ID NO: 7109429 - DNA, 22 bp, Homo sapiens
tggcagggtgggcttcagcccc

SEQ ID NO: 7109430 - DNA, 22 bp, Homo sapiens
tggcagggttggccaccttacc

SEQ ID NO: 7109431 - DNA, 22 bp, Homo sapiens
cctaggaacccccaggcttctg

SEQ ID NO: 7109432 - DNA, 22 bp, Homo sapiens
cctaggaagctgagattgcagt

SEQ ID NO: 7109433 - DNA, 22 bp, Homo sapiens
cctaggagttcgaagctgcagt

SEQ ID NO: 7109434 - DNA, 22 bp, Homo sapiens
cctaggagttgaggtggccaga

SEQ ID NO: 7109435 - DNA, 22 bp, Homo sapiens
cctaggagttgaggtggccaga

SEQ ID NO: 7109436 - DNA, 22 bp, Homo sapiens
cctaggcaagagttggtgtgga

SEQ ID NO: 7109437 - DNA, 22 bp, Homo sapiens
cctaggcccattaattcccctt

SEQ ID NO: 7109438 - DNA, 22 bp, Homo sapiens
cctagccccagatatctcacac

SEQ ID NO: 7109439 - DNA, 18 bp, Homo sapiens
cctaggaaagggaggcaa

SEQ ID NO: 7109440 - DNA, 18 bp, Homo sapiens
cctaggaaagggaggcaa

SEQ ID NO: 7109441 - DNA, 22 bp, Homo sapiens
cctagcagggaagcagtgagga

SEQ ID NO: 7109442 - DNA, 22 bp, Homo sapiens
cctagcagggaagcagtgagga

SEQ ID NO: 7109443 - DNA, 22 bp, Homo sapiens
cctagcagggagaggatacctg

SEQ ID NO: 7109444 - DNA, 22 bp, Homo sapiens
cctagcagaagctgcaatgcct

SEQ ID NO: 7109445 - DNA, 22 bp, Homo sapiens
cctagcagggaagcagtgagga

SEQ ID NO: 7109446 - DNA, 19 bp, Homo sapiens
cctagagggaaggcaggac

SEQ ID NO: 7109447 - DNA, 22 bp, Homo sapiens
cctagatggattatgtaagatt

SEQ ID NO: 7109448 - DNA, 22 bp, Homo sapiens
cctaagattggtgtgcactgtg

SEQ ID NO: 7109449 - DNA, 22 bp, Homo sapiens
cctagagctctgctttatctaa

SEQ ID NO: 7109450 - DNA, 22 bp, Homo sapiens
cctagagctctgctttatctaa

SEQ ID NO: 7109451 - DNA, 22 bp, Homo sapiens
cctagagctctgctttatctaa

SEQ ID NO: 7109452 - DNA, 22 bp, Homo sapiens
cctagagctctgctttatctaa

SEQ ID NO: 7109453 - DNA, 22 bp, Homo sapiens
cctagaggctgcaaggagaggc

SEQ ID NO: 7109454 - DNA, 22 bp, Homo sapiens
cctagaggctgcaaggagaggc

SEQ ID NO: 7109455 - DNA, 22 bp, Homo sapiens
cctagaggctgcaaggagaggc

SEQ ID NO: 7109456 - DNA, 19 bp, Homo sapiens
cctagagggaaggcaggac

SEQ ID NO: 7109457 - DNA, 22 bp, Homo sapiens
tggcagaggaggctcagattga

SEQ ID NO: 7109458 - DNA, 22 bp, Homo sapiens
tggcagaggaggctcagattga

SEQ ID NO: 7109459 - DNA, 22 bp, Homo sapiens
tggcagaggagaattaagatta

SEQ ID NO: 7109460 - DNA, 22 bp, Homo sapiens
tggcagaggagaattaagatta

SEQ ID NO: 7109461 - DNA, 19 bp, Homo sapiens
tggcagaggcagtttgtac

SEQ ID NO: 7109462 - DNA, 19 bp, Homo sapiens
tggcagaggcagtttgtac

SEQ ID NO: 7109463 - DNA, 19 bp, Homo sapiens
tggcagaggcagtttgtac

SEQ ID NO: 7109464 - DNA, 19 bp, Homo sapiens
tggcagaggcagtttgtac

SEQ ID NO: 7109465 - DNA, 22 bp, Homo sapiens
tggcagaggaggctcagattga

SEQ ID NO: 7109466 - DNA, 22 bp, Homo sapiens
cctaagatctggtatgtgacag

SEQ ID NO: 7109467 - DNA, 22 bp, Homo sapiens
cctaagattgcaaactctctcc

SEQ ID NO: 7109468 - DNA, 22 bp, Homo sapiens
tggcagaggtaattcaaatccc

SEQ ID NO: 7109469 - DNA, 22 bp, Homo sapiens
tggcagaggtaattcaaatccc

SEQ ID NO: 7109470 - DNA, 22 bp, Homo sapiens
tggcagaggctctgtgatgttg

SEQ ID NO: 7109471 - DNA, 22 bp, Homo sapiens
tggcagaggctctgtgatgttg

SEQ ID NO: 7109472 - DNA, 22 bp, Homo sapiens
tggcagaggctctgtgatgttg

SEQ ID NO: 7109473 - DNA, 22 bp, Homo sapiens
cctcaggcttgtgagccttcag

SEQ ID NO: 7109474 - DNA, 22 bp, Homo sapiens
cctcaggcttctagttcagtga

SEQ ID NO: 7109475 - DNA, 22 bp, Homo sapiens
cctcaggcttctagttcagtga

SEQ ID NO: 7109476 - DNA, 22 bp, Homo sapiens
cctcaggcttgtgagccttcag

SEQ ID NO: 7109477 - DNA, 22 bp, Homo sapiens
cctcagggaatgggaggctggg

SEQ ID NO: 7109478 - DNA, 22 bp, Homo sapiens
cctcagggaatgggaggctggg

SEQ ID NO: 7109479 - DNA, 22 bp, Homo sapiens
cctcagggaatgggaggctggg

SEQ ID NO: 7109480 - DNA, 22 bp, Homo sapiens
cctcagggacgggatcacttgg

SEQ ID NO: 7109481 - DNA, 22 bp, Homo sapiens
cctcagggacgggatcacttgg

SEQ ID NO: 7109482 - DNA, 22 bp, Homo sapiens
cctcaggctgtcttccttctgg

SEQ ID NO: 7109483 - DNA, 22 bp, Homo sapiens
cctcaggcttaacttgtcttga

SEQ ID NO: 7109484 - DNA, 22 bp, Homo sapiens
cctcaggcttaacttgtcttga

SEQ ID NO: 7109485 - DNA, 22 bp, Homo sapiens
cctcaggcttacgggcaatgga

SEQ ID NO: 7109486 - DNA, 22 bp, Homo sapiens
cctcaggcttacgggcaatgga

SEQ ID NO: 7109487 - DNA, 22 bp, Homo sapiens
cctcaggcttcgtcttccaccc

SEQ ID NO: 7109488 - DNA, 22 bp, Homo sapiens
cctcaggcttcgtcttccaccc

SEQ ID NO: 7109489 - DNA, 22 bp, Homo sapiens
cctcaggcttcgtcttccaccc

SEQ ID NO: 7109490 - DNA, 22 bp, Homo sapiens
cctcaggcttcgtcttccaccc

SEQ ID NO: 7109491 - DNA, 22 bp, Homo sapiens
cctcaggctgggctgcccctgg

SEQ ID NO: 7109492 - DNA, 22 bp, Homo sapiens
cctcaggctgggctgcccctgg

SEQ ID NO: 7109493 - DNA, 22 bp, Homo sapiens
cctcaggctgtcttccttctgg

SEQ ID NO: 7109494 - DNA, 22 bp, Homo sapiens
cctcaggctgggctgcccctgg

SEQ ID NO: 7109495 - DNA, 22 bp, Homo sapiens
cctcaggctgggctgcccctgg

SEQ ID NO: 7109496 - DNA, 22 bp, Homo sapiens
cctcaggctgggctgcccctgg

SEQ ID NO: 7109497 - DNA, 22 bp, Homo sapiens
cctcaggctctgggtgcctacc

SEQ ID NO: 7109498 - DNA, 22 bp, Homo sapiens
cctcaggctctgggtgcctacc

SEQ ID NO: 7109499 - DNA, 22 bp, Homo sapiens
cctcaggctgctcacacttgtc

SEQ ID NO: 7109500 - DNA, 22 bp, Homo sapiens
cctcaggctgctcacacttgtc

SEQ ID NO: 7109501 - DNA, 22 bp, Homo sapiens
cctcaggctgctcacacttgtc

SEQ ID NO: 7109502 - DNA, 22 bp, Homo sapiens
cctcagcttgatttctgcagag

SEQ ID NO: 7109503 - DNA, 22 bp, Homo sapiens
cctcaggcctctgcctcattgg

SEQ ID NO: 7109504 - DNA, 22 bp, Homo sapiens
cctcaggcctgccagagcccca

SEQ ID NO: 7109505 - DNA, 22 bp, Homo sapiens
cctcaggctagctactgtccct

SEQ ID NO: 7109506 - DNA, 22 bp, Homo sapiens
cctcaggctagctactgtccct

SEQ ID NO: 7109507 - DNA, 22 bp, Homo sapiens
cctcaggctagctactgtccct

SEQ ID NO: 7109508 - DNA, 22 bp, Homo sapiens
cctcaggctagctactgtccct

SEQ ID NO: 7109509 - DNA, 22 bp, Homo sapiens
cctcaggctagctactgtccct

SEQ ID NO: 7109510 - DNA, 22 bp, Homo sapiens
cctcaggctctgggtgcctacc

SEQ ID NO: 7109511 - DNA, 22 bp, Homo sapiens
cctcaggctctgggtgcctacc

SEQ ID NO: 7109512 - DNA, 22 bp, Homo sapiens
cctcaggctctgggtgcctacc

SEQ ID NO: 7109513 - DNA, 22 bp, Homo sapiens
cctcagagttggaatcacattt

SEQ ID NO: 7109514 - DNA, 22 bp, Homo sapiens
cctcagagttggaatcacattt

SEQ ID NO: 7109515 - DNA, 22 bp, Homo sapiens
cctcagagttatttgaagtgaa

SEQ ID NO: 7109516 - DNA, 22 bp, Homo sapiens
cctcagaggttttcattctgta

SEQ ID NO: 7109517 - DNA, 22 bp, Homo sapiens
cctcagaggttttcattctgta

SEQ ID NO: 7109518 - DNA, 22 bp, Homo sapiens
cctcagagtaggtctcagctgt

SEQ ID NO: 7109519 - DNA, 22 bp, Homo sapiens
cctcagagtaggtctcagctgt

SEQ ID NO: 7109520 - DNA, 22 bp, Homo sapiens
cctcagagtaggtctcagctgt

SEQ ID NO: 7109521 - DNA, 22 bp, Homo sapiens
cctcagagtaggtctcagctgt

SEQ ID NO: 7109522 - DNA, 22 bp, Homo sapiens
cctcagagttggccacgagagc

SEQ ID NO: 7109523 - DNA, 22 bp, Homo sapiens
cctcagagtttaagatgtcaga

SEQ ID NO: 7109524 - DNA, 22 bp, Homo sapiens
cctcagagtttaagatgtcaga

SEQ ID NO: 7109525 - DNA, 22 bp, Homo sapiens
cctcagcagacacgcttctcac

SEQ ID NO: 7109526 - DNA, 22 bp, Homo sapiens
cctcagcatcctcatgctcagt

SEQ ID NO: 7109527 - DNA, 22 bp, Homo sapiens
cctcagcatcctcctgctcagt

SEQ ID NO: 7109528 - DNA, 22 bp, Homo sapiens
cctcagcatcctcctgctcagt

SEQ ID NO: 7109529 - DNA, 22 bp, Homo sapiens
tggcccagagcactgctgggca

SEQ ID NO: 7109530 - DNA, 19 bp, Homo sapiens
tggcccagatggtcctggg

SEQ ID NO: 7109531 - DNA, 19 bp, Homo sapiens
tggcccagatggtcctggg

SEQ ID NO: 7109532 - DNA, 19 bp, Homo sapiens
tggcccagatggtcctggg

SEQ ID NO: 7109533 - DNA, 19 bp, Homo sapiens
tggcccagatggtcctggg

SEQ ID NO: 7109534 - DNA, 19 bp, Homo sapiens
tggcccagatggtcctggg

SEQ ID NO: 7109535 - DNA, 22 bp, Homo sapiens
tggcccagatctctgaccttga

SEQ ID NO: 7109536 - DNA, 22 bp, Homo sapiens
tggcccagagcactgctgggca

SEQ ID NO: 7109537 - DNA, 22 bp, Homo sapiens
tggcccagatctctgaccttga

SEQ ID NO: 7109538 - DNA, 20 bp, Homo sapiens
tggcccagcacgacgaggac

SEQ ID NO: 7109539 - DNA, 20 bp, Homo sapiens
tggcccagcacgacgaggac

SEQ ID NO: 7109540 - DNA, 20 bp, Homo sapiens
tggcccagcacgacgaggac

SEQ ID NO: 7109541 - DNA, 22 bp, Homo sapiens
tggcccagcactccaagtaggg

SEQ ID NO: 7109542 - DNA, 22 bp, Homo sapiens
tggcccagcactccaagtaggg

SEQ ID NO: 7109543 - DNA, 22 bp, Homo sapiens
tggcccagcactccaagtaggg

SEQ ID NO: 7109544 - DNA, 22 bp, Homo sapiens
tggcccagcagttctgccccag

SEQ ID NO: 7109545 - DNA, 17 bp, Homo sapiens
cctcagcttctttcctc

SEQ ID NO: 7109546 - DNA, 22 bp, Homo sapiens
tggcctggctgccctgtctgga

SEQ ID NO: 7109547 - DNA, 22 bp, Homo sapiens
tggcctggctgccctgtctgga

SEQ ID NO: 7109548 - DNA, 22 bp, Homo sapiens
tggcctggctgccctgtctgga

SEQ ID NO: 7109549 - DNA, 22 bp, Homo sapiens
cctccaaggtgagagaggatgg

SEQ ID NO: 7109550 - DNA, 22 bp, Homo sapiens
cctcatgaggcaggcagggtag

SEQ ID NO: 7109551 - DNA, 22 bp, Homo sapiens
cctcatgctgcatctctgaggt

SEQ ID NO: 7109552 - DNA, 22 bp, Homo sapiens
cctcatggccttgagctgaggg

SEQ ID NO: 7109553 - DNA, 22 bp, Homo sapiens
cctcattaacacaatgtcattt

SEQ ID NO: 7109554 - DNA, 22 bp, Homo sapiens
cctcattagctgttatttattg

SEQ ID NO: 7109555 - DNA, 22 bp, Homo sapiens
cctcatttatagccaaagtaaa

SEQ ID NO: 7109556 - DNA, 22 bp, Homo sapiens
cctccaaccataggtccagggg

SEQ ID NO: 7109557 - DNA, 22 bp, Homo sapiens
cctccaaccataggtccagggg

SEQ ID NO: 7109558 - DNA, 22 bp, Homo sapiens
cctcagggactccatgctgcag

SEQ ID NO: 7109559 - DNA, 22 bp, Homo sapiens
cctcagggactccatgctgcag

SEQ ID NO: 7109560 - DNA, 22 bp, Homo sapiens
cctcagggactccatgctgcag

SEQ ID NO: 7109561 - DNA, 22 bp, Homo sapiens
cctcagggactccatgctgcag

SEQ ID NO: 7109562 - DNA, 18 bp, Homo sapiens
cctcagggagagagacgc

SEQ ID NO: 7109563 - DNA, 18 bp, Homo sapiens
cctcagggagagagacgc

SEQ ID NO: 7109564 - DNA, 18 bp, Homo sapiens
cctcagggagatccagtg

SEQ ID NO: 7109565 - DNA, 18 bp, Homo sapiens
cctcagggagatccagtg

SEQ ID NO: 7109566 - DNA, 22 bp, Homo sapiens
cctcagtgagtgtttccttctt

SEQ ID NO: 7109567 - DNA, 22 bp, Homo sapiens
cctcagtgcgtactgaacagtg

SEQ ID NO: 7109568 - DNA, 22 bp, Homo sapiens
cctcagtgtgtggatgttagag

SEQ ID NO: 7109569 - DNA, 22 bp, Homo sapiens
cctcagtttatcctctgtaaca

SEQ ID NO: 7109570 - DNA, 22 bp, Homo sapiens
cctcagttttctcatctgtaaa

SEQ ID NO: 7109571 - DNA, 22 bp, Homo sapiens
cctcagttttctcatctgtaaa

SEQ ID NO: 7109572 - DNA, 20 bp, Homo sapiens
cctcatctcaagggcagtcc

SEQ ID NO: 7109573 - DNA, 22 bp, Homo sapiens
cctcatctgtcatcctagggaa

SEQ ID NO: 7109574 - DNA, 22 bp, Homo sapiens
tggcctgggcctgccggtgcaa

SEQ ID NO: 7109575 - DNA, 22 bp, Homo sapiens
tggcctgggcctgccggtgcaa

SEQ ID NO: 7109576 - DNA, 22 bp, Homo sapiens
tggcctgggcctgccggtgcaa

SEQ ID NO: 7109577 - DNA, 22 bp, Homo sapiens
tggcctgggccggcagatatac

SEQ ID NO: 7109578 - DNA, 22 bp, Homo sapiens
tggcctgggccggcagatatac

SEQ ID NO: 7109579 - DNA, 22 bp, Homo sapiens
tggcctggctgccctgtctgga

SEQ ID NO: 7109580 - DNA, 22 bp, Homo sapiens
tggcctggctgccctgtctgga

SEQ ID NO: 7109581 - DNA, 22 bp, Homo sapiens
tggcctggctgccctgtctgga

SEQ ID NO: 7109582 - DNA, 22 bp, Homo sapiens
tggcctgggcatgaagcatcgt

SEQ ID NO: 7109583 - DNA, 22 bp, Homo sapiens
tggcctggggaagaccatgggc

SEQ ID NO: 7109584 - DNA, 22 bp, Homo sapiens
tggcctggggaagaccatgggc

SEQ ID NO: 7109585 - DNA, 22 bp, Homo sapiens
tggcctggggaagaccatgggc

SEQ ID NO: 7109586 - DNA, 22 bp, Homo sapiens
tggcctggggaagaccatgggc

SEQ ID NO: 7109587 - DNA, 22 bp, Homo sapiens
tggcctggggaagaccatgggc

SEQ ID NO: 7109588 - DNA, 22 bp, Homo sapiens
tggcctggggaagaccatgggc

SEQ ID NO: 7109589 - DNA, 22 bp, Homo sapiens
tggcctgggcctgccggtgcaa

SEQ ID NO: 7109590 - DNA, 22 bp, Homo sapiens
tggcctggggacctgtgagacc

SEQ ID NO: 7109591 - DNA, 22 bp, Homo sapiens
tggcctggggacctgtgagacc

SEQ ID NO: 7109592 - DNA, 22 bp, Homo sapiens
tggcctggggacctgtgagacc

SEQ ID NO: 7109593 - DNA, 22 bp, Homo sapiens
tggcctggggaagaccatgggc

SEQ ID NO: 7109594 - DNA, 22 bp, Homo sapiens
tggctctgaccaggtagaggag

SEQ ID NO: 7109595 - DNA, 22 bp, Homo sapiens
tggctctgaccaggtagaggag

SEQ ID NO: 7109596 - DNA, 22 bp, Homo sapiens
tggctctgagacacaggctctc

SEQ ID NO: 7109597 - DNA, 22 bp, Homo sapiens
tggctctgagacacaggctctc

SEQ ID NO: 7109598 - DNA, 22 bp, Homo sapiens
tggctctgagacacaggctctc

SEQ ID NO: 7109599 - DNA, 21 bp, Homo sapiens
tggctctgggtaggagagtgc

SEQ ID NO: 7109600 - DNA, 22 bp, Homo sapiens
tggctctggggacagtaagtcc

SEQ ID NO: 7109601 - DNA, 21 bp, Homo sapiens
tggctctgggtaggagagtgc

SEQ ID NO: 7109602 - DNA, 21 bp, Homo sapiens
tggctctgggtaggagagtgc

SEQ ID NO: 7109603 - DNA, 22 bp, Homo sapiens
tggctctggtaacattgggtag

SEQ ID NO: 7109604 - DNA, 22 bp, Homo sapiens
tggctctggtaacattgggtag

SEQ ID NO: 7109605 - DNA, 22 bp, Homo sapiens
tggctctggtgcgggctcctgc

SEQ ID NO: 7109606 - DNA, 22 bp, Homo sapiens
tggctctggtgcgggctcctgc

SEQ ID NO: 7109607 - DNA, 22 bp, Homo sapiens
tggctctggtgcgggctcctgc

SEQ ID NO: 7109608 - DNA, 22 bp, Homo sapiens
tggctctggtgcgggctcctgc

SEQ ID NO: 7109609 - DNA, 22 bp, Homo sapiens
tggctctgtcaaactgcacaca

SEQ ID NO: 7109610 - DNA, 22 bp, Homo sapiens
tggctctgtcaaactgcacaca

SEQ ID NO: 7109611 - DNA, 22 bp, Homo sapiens
tggctctgtcaaactgcacaca

SEQ ID NO: 7109612 - DNA, 22 bp, Homo sapiens
tggctctgtcactgtgagctat

SEQ ID NO: 7109613 - DNA, 22 bp, Homo sapiens
tggctctgtcactgtgagctat

SEQ ID NO: 7109614 - DNA, 22 bp, Homo sapiens
tggctctgtcaaactgcacaca

SEQ ID NO: 7109615 - DNA, 22 bp, Homo sapiens
tggctctgtcactgtgagctat

SEQ ID NO: 7109616 - DNA, 22 bp, Homo sapiens
tgggcccaagtgcaatgcagtg

SEQ ID NO: 7109617 - DNA, 22 bp, Homo sapiens
tgggcccaagtgcaatgcagtg

SEQ ID NO: 7109618 - DNA, 22 bp, Homo sapiens
tgggcccaagagagtctccaac

SEQ ID NO: 7109619 - DNA, 22 bp, Homo sapiens
tgggcccacatgcctttctgcc

SEQ ID NO: 7109620 - DNA, 21 bp, Homo sapiens
tgggcccagctctgtctgttt

SEQ ID NO: 7109621 - DNA, 21 bp, Homo sapiens
tgggcccagctctgtctgttt

SEQ ID NO: 7109622 - DNA, 22 bp, Homo sapiens
tgggcccaggtcctgggagaag

SEQ ID NO: 7109623 - DNA, 22 bp, Homo sapiens
tgggcccatcattgctgtgggc

SEQ ID NO: 7109624 - DNA, 22 bp, Homo sapiens
tgggcccatcattgctgtgggc

SEQ ID NO: 7109625 - DNA, 21 bp, Homo sapiens
tgggcccagttcccgctgggc

SEQ ID NO: 7109626 - DNA, 22 bp, Homo sapiens
tgggcccaggtcctgggagaag

SEQ ID NO: 7109627 - DNA, 21 bp, Homo sapiens
tgggcccagttcccgctgggc

SEQ ID NO: 7109628 - DNA, 22 bp, Homo sapiens
tgggcccaggtcctgggagaag

SEQ ID NO: 7109629 - DNA, 22 bp, Homo sapiens
tgggcccaggtcctgggagaag

SEQ ID NO: 7109630 - DNA, 22 bp, Homo sapiens
tgggcccaggtcctgggagaag

SEQ ID NO: 7109631 - DNA, 22 bp, Homo sapiens
tgggcccaggtcctgggagaag

SEQ ID NO: 7109632 - DNA, 22 bp, Homo sapiens
tgggccctgcccttgtctgtcc

SEQ ID NO: 7109633 - DNA, 23 bp, Homo sapiens
tgggccctggagtcgccagtctg

SEQ ID NO: 7109634 - DNA, 23 bp, Homo sapiens
tgggccctggagtcgccagtctg

SEQ ID NO: 7109635 - DNA, 22 bp, Homo sapiens
tgggccctgacttcaagcatcc

SEQ ID NO: 7109636 - DNA, 23 bp, Homo sapiens
tgggccctggagtcgccagtctg

SEQ ID NO: 7109637 - DNA, 23 bp, Homo sapiens
tgggccctggagtcgccagtctg

SEQ ID NO: 7109638 - DNA, 22 bp, Homo sapiens
tgggccctggtggccatgcctc

SEQ ID NO: 7109639 - DNA, 22 bp, Homo sapiens
tgggccctggtggccatgcctc

SEQ ID NO: 7109640 - DNA, 22 bp, Homo sapiens
tgggcccgcagctgctgctcca

SEQ ID NO: 7109641 - DNA, 22 bp, Homo sapiens
tgggccctgacttcaagcatcc

SEQ ID NO: 7109642 - DNA, 22 bp, Homo sapiens
tgggcccatcattgctgtgggc

SEQ ID NO: 7109643 - DNA, 22 bp, Homo sapiens
tgggccccagcacgtctgggga

SEQ ID NO: 7109644 - DNA, 22 bp, Homo sapiens
tgggccctggtggccatgcctc

SEQ ID NO: 7109645 - DNA, 22 bp, Homo sapiens
tgggccctggtggccatgcctc

SEQ ID NO: 7109646 - DNA, 22 bp, Homo sapiens
tgggcccttatgaagctcaaga

SEQ ID NO: 7109647 - DNA, 23 bp, Homo sapiens
tgggcccttggaatctctatttt

SEQ ID NO: 7109648 - DNA, 22 bp, Homo sapiens
tgggctccttgggagcaagtga

SEQ ID NO: 7109649 - DNA, 18 bp, Homo sapiens
tgggctgcctggcctctg

SEQ ID NO: 7109650 - DNA, 18 bp, Homo sapiens
tgggctgcctggcctctg

SEQ ID NO: 7109651 - DNA, 22 bp, Homo sapiens
tgggctgcggataggcctcgga

SEQ ID NO: 7109652 - DNA, 22 bp, Homo sapiens
tgggctgcggataggcctcgga

SEQ ID NO: 7109653 - DNA, 22 bp, Homo sapiens
tgggctgctgttacaggggctg

SEQ ID NO: 7109654 - DNA, 22 bp, Homo sapiens
tgggctgctgttacaggggctg

SEQ ID NO: 7109655 - DNA, 22 bp, Homo sapiens
tgggctgctgtctgcacatgct

SEQ ID NO: 7109656 - DNA, 22 bp, Homo sapiens
tgggctgctgtctgcacatgct

SEQ ID NO: 7109657 - DNA, 22 bp, Homo sapiens
tgggctgctgagaatgagagag

SEQ ID NO: 7109658 - DNA, 22 bp, Homo sapiens
tgggctgctgagaatgagagag

SEQ ID NO: 7109659 - DNA, 22 bp, Homo sapiens
tgggctgctgcggtgctcttgg

SEQ ID NO: 7109660 - DNA, 22 bp, Homo sapiens
tgggctgctgcggtgctcttgg

SEQ ID NO: 7109661 - DNA, 22 bp, Homo sapiens
tgggctgctgtctgcacatgct

SEQ ID NO: 7109662 - DNA, 22 bp, Homo sapiens
tgggctgctgtctgcacatgct

SEQ ID NO: 7109663 - DNA, 22 bp, Homo sapiens
tgggctgctgtctgcacatgct

SEQ ID NO: 7109664 - DNA, 22 bp, Homo sapiens
cctgagctgaactaagcagttt

SEQ ID NO: 7109665 - DNA, 22 bp, Homo sapiens
cctgagctcaaagggtgcctgg

SEQ ID NO: 7109666 - DNA, 22 bp, Homo sapiens
cctgagctgcggggcagtgctc

SEQ ID NO: 7109667 - DNA, 22 bp, Homo sapiens
cctgagctgcggggcagtgctc

SEQ ID NO: 7109668 - DNA, 22 bp, Homo sapiens
cctgagctgcggggcagtgctc

SEQ ID NO: 7109669 - DNA, 22 bp, Homo sapiens
cctgagctgactctcctttcag

SEQ ID NO: 7109670 - DNA, 22 bp, Homo sapiens
tggggaggaagtcagatttcag

SEQ ID NO: 7109671 - DNA, 22 bp, Homo sapiens
tggggagcccactcacctcccc

SEQ ID NO: 7109672 - DNA, 22 bp, Homo sapiens
tggggagcccactcacctcccc

SEQ ID NO: 7109673 - DNA, 22 bp, Homo sapiens
cctgagctggaagagcttgtgc

SEQ ID NO: 7109674 - DNA, 22 bp, Homo sapiens
cctgagctggcagtgacctgga

SEQ ID NO: 7109675 - DNA, 22 bp, Homo sapiens
tgggctggagcttgttgcttcc

SEQ ID NO: 7109676 - DNA, 22 bp, Homo sapiens
tgggctggagcttgttgcttcc

SEQ ID NO: 7109677 - DNA, 22 bp, Homo sapiens
tgggctgcttctcaaatgtctc

SEQ ID NO: 7109678 - DNA, 22 bp, Homo sapiens
tgggctggagcttgttgcttcc

SEQ ID NO: 7109679 - DNA, 22 bp, Homo sapiens
tgggctggagcttgttgcttcc

SEQ ID NO: 7109680 - DNA, 22 bp, Homo sapiens
tgggctggagcttgttgcttcc

SEQ ID NO: 7109681 - DNA, 22 bp, Homo sapiens
tgggctggagcttgttgcttcc

SEQ ID NO: 7109682 - DNA, 22 bp, Homo sapiens
tgggctgctgttacaggggctg

SEQ ID NO: 7109683 - DNA, 22 bp, Homo sapiens
tgggctgcttcctcagctgaga

SEQ ID NO: 7109684 - DNA, 22 bp, Homo sapiens
tgggctgcttcctcagctgaga

SEQ ID NO: 7109685 - DNA, 22 bp, Homo sapiens
tgggctgcttcctcagctgaga

SEQ ID NO: 7109686 - DNA, 22 bp, Homo sapiens
tgggctgcttctattggtggtc

SEQ ID NO: 7109687 - DNA, 22 bp, Homo sapiens
tgggctgcttctattggtggtc

SEQ ID NO: 7109688 - DNA, 22 bp, Homo sapiens
cctgagcctggctcatgcactc

SEQ ID NO: 7109689 - DNA, 22 bp, Homo sapiens
cctgagcctggctcatgcactc

SEQ ID NO: 7109690 - DNA, 21 bp, Homo sapiens
cctgagcctgtttatccagaa

SEQ ID NO: 7109691 - DNA, 22 bp, Homo sapiens
tgggctggcccaccacacctcg

SEQ ID NO: 7109692 - DNA, 22 bp, Homo sapiens
tgggctggcccaccacacctcg

SEQ ID NO: 7109693 - DNA, 22 bp, Homo sapiens
tgggctggcccaccacacctcg

SEQ ID NO: 7109694 - DNA, 22 bp, Homo sapiens
tgggctggcccaccacacctcg

SEQ ID NO: 7109695 - DNA, 22 bp, Homo sapiens
tgggctggcccaccacacctcg

SEQ ID NO: 7109696 - DNA, 22 bp, Homo sapiens
tgggctggcccaccacacctcg

SEQ ID NO: 7109697 - DNA, 22 bp, Homo sapiens
cctgagcaaaggcccagaggga

SEQ ID NO: 7109698 - DNA, 22 bp, Homo sapiens
cctgagcaaaggaaggatgact

SEQ ID NO: 7109699 - DNA, 22 bp, Homo sapiens
cctgagatggccagtgctggga

SEQ ID NO: 7109700 - DNA, 22 bp, Homo sapiens
cctgagaccaagttgcagccat

SEQ ID NO: 7109701 - DNA, 22 bp, Homo sapiens
cctgagagagaagcgacctggt

SEQ ID NO: 7109702 - DNA, 22 bp, Homo sapiens
tgggagttgggtgggagacttc

SEQ ID NO: 7109703 - DNA, 22 bp, Homo sapiens
tgggagtttgttagaaatgcag

SEQ ID NO: 7109704 - DNA, 22 bp, Homo sapiens
cctgagagagaagcgacctggt

SEQ ID NO: 7109705 - DNA, 22 bp, Homo sapiens
cctgagatcagtgcatttggtg

SEQ ID NO: 7109706 - DNA, 22 bp, Homo sapiens
tgggagtgttcttggcttgctt

SEQ ID NO: 7109707 - DNA, 23 bp, Homo sapiens
tgggagtgttgggatctctgctc

SEQ ID NO: 7109708 - DNA, 23 bp, Homo sapiens
tgggagtgttgggatctctgctc

SEQ ID NO: 7109709 - DNA, 22 bp, Homo sapiens
tgggagttcacgtgatattcac

SEQ ID NO: 7109710 - DNA, 23 bp, Homo sapiens
tgggagttgagtgaggttgcttt

SEQ ID NO: 7109711 - DNA, 22 bp, Homo sapiens
tgggagttgggcagaacaagtg

SEQ ID NO: 7109712 - DNA, 22 bp, Homo sapiens
tgggagttgggtgggagacttc

SEQ ID NO: 7109713 - DNA, 22 bp, Homo sapiens
cctgagcatcagcgcctcctta

SEQ ID NO: 7109714 - DNA, 22 bp, Homo sapiens
cctgagcagggctctgcagggc

SEQ ID NO: 7109715 - DNA, 22 bp, Homo sapiens
cctgagcatcagcgcctcctta

SEQ ID NO: 7109716 - DNA, 22 bp, Homo sapiens
cctgagcagctctgaggggcga

SEQ ID NO: 7109717 - DNA, 22 bp, Homo sapiens
cctgagcagggctctgcagggc

SEQ ID NO: 7109718 - DNA, 22 bp, Homo sapiens
cctgagcagggctctgcagggc

SEQ ID NO: 7109719 - DNA, 18 bp, Homo sapiens
cctgagccctgcttactt

SEQ ID NO: 7109720 - DNA, 22 bp, Homo sapiens
cctgagccgagcgctctttctc

SEQ ID NO: 7109721 - DNA, 22 bp, Homo sapiens
cctgagcctgagtggtgcaggg

SEQ ID NO: 7109722 - DNA, 22 bp, Homo sapiens
cctgagcctgcagccgagcaga

SEQ ID NO: 7109723 - DNA, 22 bp, Homo sapiens
cctgagcctcttgcacgctcag

SEQ ID NO: 7109724 - DNA, 22 bp, Homo sapiens
tgggccatttttggaagactgg

SEQ ID NO: 7109725 - DNA, 22 bp, Homo sapiens
tgggccagtttctcattgaaat

SEQ ID NO: 7109726 - DNA, 22 bp, Homo sapiens
tgggcccaagagagtctccaac

SEQ ID NO: 7109727 - DNA, 22 bp, Homo sapiens
tgggccatttttggaagactgg

SEQ ID NO: 7109728 - DNA, 22 bp, Homo sapiens
cctgagcctgcagccgagcaga

SEQ ID NO: 7109729 - DNA, 22 bp, Homo sapiens
cctgagcctgcagccgagcaga

SEQ ID NO: 7109730 - DNA, 22 bp, Homo sapiens
cctgagcctggctcatgcactc

SEQ ID NO: 7109731 - DNA, 19 bp, Homo sapiens
tgggagtggggaaggtcct

SEQ ID NO: 7109732 - DNA, 19 bp, Homo sapiens
tgggagtggggaaggtcct

SEQ ID NO: 7109733 - DNA, 18 bp, Homo sapiens
tgggagtgggagtggata

SEQ ID NO: 7109734 - DNA, 18 bp, Homo sapiens
tgggagtgggagtggata

SEQ ID NO: 7109735 - DNA, 18 bp, Homo sapiens
tgggagtgggagtggata

SEQ ID NO: 7109736 - DNA, 22 bp, Homo sapiens
cctcttctcaactccagccaga

SEQ ID NO: 7109737 - DNA, 22 bp, Homo sapiens
cctcttctcaactccagccaga

SEQ ID NO: 7109738 - DNA, 19 bp, Homo sapiens
tgggagtggggaaggtcct

SEQ ID NO: 7109739 - DNA, 19 bp, Homo sapiens
tgggagtggggaaggtcct

SEQ ID NO: 7109740 - DNA, 22 bp, Homo sapiens
tgggagtggggcatagaaggta

SEQ ID NO: 7109741 - DNA, 19 bp, Homo sapiens
tgggagtggggaaggtcct

SEQ ID NO: 7109742 - DNA, 22 bp, Homo sapiens
tgggagtgttcttggcttgctt

SEQ ID NO: 7109743 - DNA, 22 bp, Homo sapiens
tgggagtgttcttggcttgctt

SEQ ID NO: 7109744 - DNA, 22 bp, Homo sapiens
tgggagtgtaaattagttcaac

SEQ ID NO: 7109745 - DNA, 22 bp, Homo sapiens
tgggagtggggcatagaaggta

SEQ ID NO: 7109746 - DNA, 22 bp, Homo sapiens
cctcttcctgcactgacatttt

SEQ ID NO: 7109747 - DNA, 22 bp, Homo sapiens
cctcttcctgcactgacatttt

SEQ ID NO: 7109748 - DNA, 19 bp, Homo sapiens
cctcttcctctgacactat

SEQ ID NO: 7109749 - DNA, 22 bp, Homo sapiens
cctcttccttctcactgtggaa

SEQ ID NO: 7109750 - DNA, 22 bp, Homo sapiens
cctcttccttctcactgtggaa

SEQ ID NO: 7109751 - DNA, 19 bp, Homo sapiens
cctcttcctctgacactat

SEQ ID NO: 7109752 - DNA, 17 bp, Homo sapiens
cctcttcctctcagctg

SEQ ID NO: 7109753 - DNA, 22 bp, Homo sapiens
cctcttcctcaccatctacaac

SEQ ID NO: 7109754 - DNA, 17 bp, Homo sapiens
cctcttcctctcagctg

SEQ ID NO: 7109755 - DNA, 17 bp, Homo sapiens
cctcttcctctcagctg

SEQ ID NO: 7109756 - DNA, 17 bp, Homo sapiens
cctcttcctctcagctg

SEQ ID NO: 7109757 - DNA, 22 bp, Homo sapiens
cctcttctaggacgtccttgtg

SEQ ID NO: 7109758 - DNA, 22 bp, Homo sapiens
cctcttctaggacgtccttgtg

SEQ ID NO: 7109759 - DNA, 22 bp, Homo sapiens
cctcttctaggacgtccttgtg

SEQ ID NO: 7109760 - DNA, 22 bp, Homo sapiens
cctcttctaggtttcagcctgc

SEQ ID NO: 7109761 - DNA, 22 bp, Homo sapiens
cctcttctaggacgtccttgtg

SEQ ID NO: 7109762 - DNA, 22 bp, Homo sapiens
cctcttctaggtttcagcctgc

SEQ ID NO: 7109763 - DNA, 19 bp, Homo sapiens
tggctctgtcgaaggcaca

SEQ ID NO: 7109764 - DNA, 19 bp, Homo sapiens
tggctctgtcgaaggcaca

SEQ ID NO: 7109765 - DNA, 17 bp, Homo sapiens
tggctctgtcctcagct

SEQ ID NO: 7109766 - DNA, 17 bp, Homo sapiens
tggctctgtcctcagct

SEQ ID NO: 7109767 - DNA, 17 bp, Homo sapiens
tggctctgtcctcagct

SEQ ID NO: 7109768 - DNA, 17 bp, Homo sapiens
tggctctgtcctcagct

SEQ ID NO: 7109769 - DNA, 22 bp, Homo sapiens
tggctctgtcactgtgagctat

SEQ ID NO: 7109770 - DNA, 17 bp, Homo sapiens
tggctctgtcctcagct

SEQ ID NO: 7109771 - DNA, 17 bp, Homo sapiens
tggctctgtcctcagct

SEQ ID NO: 7109772 - DNA, 22 bp, Homo sapiens
tggctctgtcactgtgagctat

SEQ ID NO: 7109773 - DNA, 17 bp, Homo sapiens
tggctctgtcctcagct

SEQ ID NO: 7109774 - DNA, 22 bp, Homo sapiens
tggctgagaatgggatgatgcc

SEQ ID NO: 7109775 - DNA, 22 bp, Homo sapiens
tggctgagaatgggatgatgcc

SEQ ID NO: 7109776 - DNA, 19 bp, Homo sapiens
tggctctgtcgaaggcaca

SEQ ID NO: 7109777 - DNA, 19 bp, Homo sapiens
tggctctgtcgaaggcaca

SEQ ID NO: 7109778 - DNA, 22 bp, Homo sapiens
tggctgagaccatcagggtgta

SEQ ID NO: 7109779 - DNA, 22 bp, Homo sapiens
tggctgagaccatcagggtgta

SEQ ID NO: 7109780 - DNA, 22 bp, Homo sapiens
tggctgctagccagagcttcag

SEQ ID NO: 7109781 - DNA, 22 bp, Homo sapiens
tggctgctcaagggaggaggct

SEQ ID NO: 7109782 - DNA, 22 bp, Homo sapiens
tggctgctcaagggaggaggct

SEQ ID NO: 7109783 - DNA, 18 bp, Homo sapiens
tggctggctctgtcatct

SEQ ID NO: 7109784 - DNA, 18 bp, Homo sapiens
tggctggctctgtcatct

SEQ ID NO: 7109785 - DNA, 22 bp, Homo sapiens
tggctgagaccttcccaaattc

SEQ ID NO: 7109786 - DNA, 22 bp, Homo sapiens
tggctgagagaagacggggaag

SEQ ID NO: 7109787 - DNA, 22 bp, Homo sapiens
tggctgctactgagggggtctg

SEQ ID NO: 7109788 - DNA, 22 bp, Homo sapiens
tggctgctagccagagcttcag

SEQ ID NO: 7109789 - DNA, 22 bp, Homo sapiens
tggctgctagccagagcttcag

SEQ ID NO: 7109790 - DNA, 16 bp, Homo sapiens
tggctgagagagggtt

SEQ ID NO: 7109791 - DNA, 22 bp, Homo sapiens
tggcttcatctgcagcactgcc

SEQ ID NO: 7109792 - DNA, 22 bp, Homo sapiens
tggcttcatggctgtgcaatct

SEQ ID NO: 7109793 - DNA, 22 bp, Homo sapiens
tggcttcatgtagtttgagttg

SEQ ID NO: 7109794 - DNA, 22 bp, Homo sapiens
tggcttcattcagcatgacagt

SEQ ID NO: 7109795 - DNA, 22 bp, Homo sapiens
tggcttcattctcctgtgaata

SEQ ID NO: 7109796 - DNA, 22 bp, Homo sapiens
tggcttcattctgtagttaaaa

SEQ ID NO: 7109797 - DNA, 21 bp, Homo sapiens
tggcttcatttgcaacccact

SEQ ID NO: 7109798 - DNA, 22 bp, Homo sapiens
tggcttcatctgcagcactgcc

SEQ ID NO: 7109799 - DNA, 22 bp, Homo sapiens
tggcttcatggcaagtcttagt

SEQ ID NO: 7109800 - DNA, 22 bp, Homo sapiens
tggctggctttcttgtatttac

SEQ ID NO: 7109801 - DNA, 22 bp, Homo sapiens
tggctgggagctggaactgggc

SEQ ID NO: 7109802 - DNA, 22 bp, Homo sapiens
tggctgggagctggaactgggc

SEQ ID NO: 7109803 - DNA, 22 bp, Homo sapiens
tggctgggagctggaactgggc

SEQ ID NO: 7109804 - DNA, 22 bp, Homo sapiens
tggctgggagctggaactgggc

SEQ ID NO: 7109805 - DNA, 22 bp, Homo sapiens
tggctgggagctggaactgggc

SEQ ID NO: 7109806 - DNA, 22 bp, Homo sapiens
tggctgggagctggaactgggc

SEQ ID NO: 7109807 - DNA, 22 bp, Homo sapiens
tggctgggagctggaactgggc

SEQ ID NO: 7109808 - DNA, 22 bp, Homo sapiens
tggctgggagctggaactgggc

SEQ ID NO: 7109809 - DNA, 20 bp, Homo sapiens
tggctggcttgtatttcctt

SEQ ID NO: 7109810 - DNA, 22 bp, Homo sapiens
tggctggcttgttcactgactg

SEQ ID NO: 7109811 - DNA, 22 bp, Homo sapiens
tggctggctgtcagtaggctgt

SEQ ID NO: 7109812 - DNA, 22 bp, Homo sapiens
tggctggctgtcaaggaaagcc

SEQ ID NO: 7109813 - DNA, 22 bp, Homo sapiens
tggctggctgtcaaggaaagcc

SEQ ID NO: 7109814 - DNA, 22 bp, Homo sapiens
tggctggctgtccagctgggca

SEQ ID NO: 7109815 - DNA, 22 bp, Homo sapiens
cctctgctgctgttgagcaccg

SEQ ID NO: 7109816 - DNA, 22 bp, Homo sapiens
cctctgctctggtccatgtgct

SEQ ID NO: 7109817 - DNA, 22 bp, Homo sapiens
cctctgctctggtccatgtgct

SEQ ID NO: 7109818 - DNA, 22 bp, Homo sapiens
cctctgctctggtccatgtgct

SEQ ID NO: 7109819 - DNA, 22 bp, Homo sapiens
cctctgctctggtccatgtgct

SEQ ID NO: 7109820 - DNA, 19 bp, Homo sapiens
cctctgcgctgtcctgctc

SEQ ID NO: 7109821 - DNA, 19 bp, Homo sapiens
cctctgctccagtttcctt

SEQ ID NO: 7109822 - DNA, 21 bp, Homo sapiens
cctctgctcgggcatgcgttt

SEQ ID NO: 7109823 - DNA, 21 bp, Homo sapiens
cctctgctcgggcatgcgttt

SEQ ID NO: 7109824 - DNA, 20 bp, Homo sapiens
cctctgcctttctagtctga

SEQ ID NO: 7109825 - DNA, 22 bp, Homo sapiens
cctctgcctgcacatcatcctg

SEQ ID NO: 7109826 - DNA, 22 bp, Homo sapiens
cctctgcctgcacatcatcctg

SEQ ID NO: 7109827 - DNA, 22 bp, Homo sapiens
cctctgcctttagtgaaagttg

SEQ ID NO: 7109828 - DNA, 20 bp, Homo sapiens
cctctgcctttctagtctga

SEQ ID NO: 7109829 - DNA, 20 bp, Homo sapiens
cctctgcctttctagtctga

SEQ ID NO: 7109830 - DNA, 20 bp, Homo sapiens
cctctgcctttctagtctga

SEQ ID NO: 7109831 - DNA, 20 bp, Homo sapiens
cctctgcctttctagtctga

SEQ ID NO: 7109832 - DNA, 18 bp, Homo sapiens
cctctgcctttgtagagc

SEQ ID NO: 7109833 - DNA, 22 bp, Homo sapiens
cctctgcgcccttgatcagcca

SEQ ID NO: 7109834 - DNA, 19 bp, Homo sapiens
cctctgcgctgtcctgctc

SEQ ID NO: 7109835 - DNA, 22 bp, Homo sapiens
cctctgcccttttcctgtatca

SEQ ID NO: 7109836 - DNA, 22 bp, Homo sapiens
cctctgcctgcacatcatcctg

SEQ ID NO: 7109837 - DNA, 20 bp, Homo sapiens
cctctgccccggggctgcta

SEQ ID NO: 7109838 - DNA, 22 bp, Homo sapiens
cctctgcccttttcctgtatca

SEQ ID NO: 7109839 - DNA, 22 bp, Homo sapiens
cctctgcccttttcctgtatca

SEQ ID NO: 7109840 - DNA, 22 bp, Homo sapiens
cctctgcccttttcctgtatca

SEQ ID NO: 7109841 - DNA, 22 bp, Homo sapiens
cctctgagtcctccctggttgc

SEQ ID NO: 7109842 - DNA, 18 bp, Homo sapiens
cctctgccatagccagca

SEQ ID NO: 7109843 - DNA, 18 bp, Homo sapiens
cctctgccatagccagca

SEQ ID NO: 7109844 - DNA, 19 bp, Homo sapiens
tggcttccatctctctcat

SEQ ID NO: 7109845 - DNA, 22 bp, Homo sapiens
cctctgagtagactggacatga

SEQ ID NO: 7109846 - DNA, 22 bp, Homo sapiens
cctctgagtagactggacatga

SEQ ID NO: 7109847 - DNA, 22 bp, Homo sapiens
cctctgagtcatgcgcatagga

SEQ ID NO: 7109848 - DNA, 22 bp, Homo sapiens
cctctgagtcatgcgcatagga

SEQ ID NO: 7109849 - DNA, 22 bp, Homo sapiens
tggcttccagagctgctccacc

SEQ ID NO: 7109850 - DNA, 22 bp, Homo sapiens
tggcttccagagctgctccacc

SEQ ID NO: 7109851 - DNA, 22 bp, Homo sapiens
cctcttcctcaccatctacaac

SEQ ID NO: 7109852 - DNA, 22 bp, Homo sapiens
cctcttcctcaccatctacaac

SEQ ID NO: 7109853 - DNA, 22 bp, Homo sapiens
cctcttccagctgttgcttcca

SEQ ID NO: 7109854 - DNA, 19 bp, Homo sapiens
cctctgtgggagtcagtga

SEQ ID NO: 7109855 - DNA, 22 bp, Homo sapiens
cctcttccagctgttgcttcca

SEQ ID NO: 7109856 - DNA, 22 bp, Homo sapiens
tgggaaggcagtcactgtccta

SEQ ID NO: 7109857 - DNA, 22 bp, Homo sapiens
tgggaaggcagtcactgtccta

SEQ ID NO: 7109858 - DNA, 22 bp, Homo sapiens
tgggaaggcagtcactgtccta

SEQ ID NO: 7109859 - DNA, 19 bp, Homo sapiens
cctctgtgggagtcagtga

SEQ ID NO: 7109860 - DNA, 22 bp, Homo sapiens
tgggaaggatacgttacaagat

SEQ ID NO: 7109861 - DNA, 22 bp, Homo sapiens
tgggaaggataccttggaacat

SEQ ID NO: 7109862 - DNA, 22 bp, Homo sapiens
tgggaaggatacgttacaagat

SEQ ID NO: 7109863 - DNA, 22 bp, Homo sapiens
tgggaaggatacgttacaagat

SEQ ID NO: 7109864 - DNA, 22 bp, Homo sapiens
tgggaaggacgtgtcagtggca

SEQ ID NO: 7109865 - DNA, 22 bp, Homo sapiens
tgggaaggacgtgtcagtggca

SEQ ID NO: 7109866 - DNA, 22 bp, Homo sapiens
tgggaaggacgtgtcagtggca

SEQ ID NO: 7109867 - DNA, 22 bp, Homo sapiens
tgggaaggacgtgtcagtggca

SEQ ID NO: 7109868 - DNA, 22 bp, Homo sapiens
tgggaaggacgtgtcagtggca

SEQ ID NO: 7109869 - DNA, 22 bp, Homo sapiens
tgggaaggacgtgtcagtggca

SEQ ID NO: 7109870 - DNA, 22 bp, Homo sapiens
tgggaaggataccttggaacat

SEQ ID NO: 7109871 - DNA, 22 bp, Homo sapiens
tgggaagctttaaatgggtgtc

SEQ ID NO: 7109872 - DNA, 22 bp, Homo sapiens
tgggaagctactcatgcaggca

SEQ ID NO: 7109873 - DNA, 22 bp, Homo sapiens
tgggaagctgcattttaacaag

SEQ ID NO: 7109874 - DNA, 22 bp, Homo sapiens
cctctggagtcagaccagcttg

SEQ ID NO: 7109875 - DNA, 22 bp, Homo sapiens
cctctgctgctgttgagcaccg

SEQ ID NO: 7109876 - DNA, 22 bp, Homo sapiens
cctctgctgctgttgagcaccg

SEQ ID NO: 7109877 - DNA, 22 bp, Homo sapiens
cctctggacttgggacagtgag

SEQ ID NO: 7109878 - DNA, 22 bp, Homo sapiens
tgggaaggacgtgtcagtggca

SEQ ID NO: 7109879 - DNA, 22 bp, Homo sapiens
tgggaaggacgtgtcagtggca

SEQ ID NO: 7109880 - DNA, 22 bp, Homo sapiens
tgggaaggacagaacataattg

SEQ ID NO: 7109881 - DNA, 22 bp, Homo sapiens
tgggaaggacagaacataattg

SEQ ID NO: 7109882 - DNA, 22 bp, Homo sapiens
tgggaaggacagaacataattg

SEQ ID NO: 7109883 - DNA, 22 bp, Homo sapiens
tgggaaggaatggtgattaata

SEQ ID NO: 7109884 - DNA, 22 bp, Homo sapiens
tgggaaggacagaacataattg

SEQ ID NO: 7109885 - DNA, 22 bp, Homo sapiens
tgggaaggaactgcctttagct

SEQ ID NO: 7109886 - DNA, 22 bp, Homo sapiens
tgggaagctttaaatgggtgtc

SEQ ID NO: 7109887 - DNA, 22 bp, Homo sapiens
tgggaaggaactgcctttagct

SEQ ID NO: 7109888 - DNA, 22 bp, Homo sapiens
tgggaaggaactgcctttagct

SEQ ID NO: 7109889 - DNA, 22 bp, Homo sapiens
tgggaaggaatggtgattaata

SEQ ID NO: 7109890 - DNA, 22 bp, Homo sapiens
tgcacagagctggactccgcgg

SEQ ID NO: 7109891 - DNA, 22 bp, Homo sapiens
tgcacagatagtgatagatagc

SEQ ID NO: 7109892 - DNA, 22 bp, Homo sapiens
tgcacagacatacacatatatg

SEQ ID NO: 7109893 - DNA, 22 bp, Homo sapiens
tgcacagatagtgatagatagc

SEQ ID NO: 7109894 - DNA, 22 bp, Homo sapiens
tgcacagagcaggcaccagcgg

SEQ ID NO: 7109895 - DNA, 22 bp, Homo sapiens
tgcacagagggaggcataaaat

SEQ ID NO: 7109896 - DNA, 22 bp, Homo sapiens
tgcacagagggaggcataaaat

SEQ ID NO: 7109897 - DNA, 20 bp, Homo sapiens
tgcacagacaatgagcccag

SEQ ID NO: 7109898 - DNA, 22 bp, Homo sapiens
tgcacagacatacacatatatg

SEQ ID NO: 7109899 - DNA, 22 bp, Homo sapiens
tgcacagacatacacatatatg

SEQ ID NO: 7109900 - DNA, 22 bp, Homo sapiens
tgcacagagagatgagacacgt

SEQ ID NO: 7109901 - DNA, 22 bp, Homo sapiens
tgcacagagagatgagacacgt

SEQ ID NO: 7109902 - DNA, 22 bp, Homo sapiens
tgcacagagagatgagacacgt

SEQ ID NO: 7109903 - DNA, 22 bp, Homo sapiens
tgcacagatctggtggcaagga

SEQ ID NO: 7109904 - DNA, 22 bp, Homo sapiens
tgcacagatagtgatagatagc

SEQ ID NO: 7109905 - DNA, 22 bp, Homo sapiens
tgccacagaggtgaagcccact

SEQ ID NO: 7109906 - DNA, 22 bp, Homo sapiens
tgccacagaggtgaagcccact

SEQ ID NO: 7109907 - DNA, 19 bp, Homo sapiens
tgccacagataaaaactga

SEQ ID NO: 7109908 - DNA, 19 bp, Homo sapiens
tgccacagataaaaactga

SEQ ID NO: 7109909 - DNA, 22 bp, Homo sapiens
tgccacaggcaatccctgcacg

SEQ ID NO: 7109910 - DNA, 22 bp, Homo sapiens
tgccagctccgaggagctgcag

SEQ ID NO: 7109911 - DNA, 22 bp, Homo sapiens
tgcacagatctggtggcaagga

SEQ ID NO: 7109912 - DNA, 22 bp, Homo sapiens
tgccagctcctgcagctcctgt

SEQ ID NO: 7109913 - DNA, 22 bp, Homo sapiens
tgccagctcctgcagctcctgt

SEQ ID NO: 7109914 - DNA, 22 bp, Homo sapiens
tgccagctgttcccacccaaaa

SEQ ID NO: 7109915 - DNA, 22 bp, Homo sapiens
tgccagcttctaaggacccagg

SEQ ID NO: 7109916 - DNA, 22 bp, Homo sapiens
tgccagctgacagcagagacaa

SEQ ID NO: 7109917 - DNA, 22 bp, Homo sapiens
tgccagcttttgactatcttag

SEQ ID NO: 7109918 - DNA, 22 bp, Homo sapiens
tgccaggaaactgtatatcttg

SEQ ID NO: 7109919 - DNA, 19 bp, Homo sapiens
tgccaggaatactccagaa

SEQ ID NO: 7109920 - DNA, 19 bp, Homo sapiens
tgccaggaatactccagaa

SEQ ID NO: 7109921 - DNA, 22 bp, Homo sapiens
tgccaggagagtgcatgcaggg

SEQ ID NO: 7109922 - DNA, 22 bp, Homo sapiens
tgccaggaggaggtgggacaga

SEQ ID NO: 7109923 - DNA, 22 bp, Homo sapiens
tgccaggaggaggtgggacaga

SEQ ID NO: 7109924 - DNA, 22 bp, Homo sapiens
cccaggagacatatagaaggac

SEQ ID NO: 7109925 - DNA, 22 bp, Homo sapiens
cccaggagacatatagaaggac

SEQ ID NO: 7109926 - DNA, 22 bp, Homo sapiens
cccaggagacctagatctgttt

SEQ ID NO: 7109927 - DNA, 22 bp, Homo sapiens
cccaggagacctagatctgttt

SEQ ID NO: 7109928 - DNA, 22 bp, Homo sapiens
cccaggagacctagatctgttt

SEQ ID NO: 7109929 - DNA, 22 bp, Homo sapiens
tgccaggaggcggcttgggaaa

SEQ ID NO: 7109930 - DNA, 22 bp, Homo sapiens
tgccaggagtcaggccaggcag

SEQ ID NO: 7109931 - DNA, 22 bp, Homo sapiens
cccaggagacctagatctgttt

SEQ ID NO: 7109932 - DNA, 22 bp, Homo sapiens
cccaggagacctagatctgttt

SEQ ID NO: 7109933 - DNA, 22 bp, Homo sapiens
cccaggagacctagatctgttt

SEQ ID NO: 7109934 - DNA, 22 bp, Homo sapiens
cccaggagacctagatctgttt

SEQ ID NO: 7109935 - DNA, 22 bp, Homo sapiens
cccaggagacctgtgaaaggac

SEQ ID NO: 7109936 - DNA, 22 bp, Homo sapiens
cccaggagacctgtgaaaggac

SEQ ID NO: 7109937 - DNA, 22 bp, Homo sapiens
cccaggagagagacttgaatct

SEQ ID NO: 7109938 - DNA, 22 bp, Homo sapiens
cccaggagagagacttgaatct

SEQ ID NO: 7109939 - DNA, 22 bp, Homo sapiens
cccaggagacctgtgaaaggac

SEQ ID NO: 7109940 - DNA, 22 bp, Homo sapiens
cccaggagactgagctgtaacc

SEQ ID NO: 7109941 - DNA, 22 bp, Homo sapiens
cccaggagactgagctgtaacc

SEQ ID NO: 7109942 - DNA, 22 bp, Homo sapiens
cccaggagagaggccagttggc

SEQ ID NO: 7109943 - DNA, 22 bp, Homo sapiens
cccaggagagaggccagttggc

SEQ ID NO: 7109944 - DNA, 22 bp, Homo sapiens
cccaggagagagacttgaatct

SEQ ID NO: 7109945 - DNA, 22 bp, Homo sapiens
cccaggagagaggccagttggc

SEQ ID NO: 7109946 - DNA, 22 bp, Homo sapiens
cccaggagagaggccagttggc

SEQ ID NO: 7109947 - DNA, 22 bp, Homo sapiens
cccaggagagaggccagttggc

SEQ ID NO: 7109948 - DNA, 22 bp, Homo sapiens
cccaggagagaggggataaagc

SEQ ID NO: 7109949 - DNA, 22 bp, Homo sapiens
cccaggagagggaaccaaatgt

SEQ ID NO: 7109950 - DNA, 22 bp, Homo sapiens
cccaggagagggaaccaaatgt

SEQ ID NO: 7109951 - DNA, 22 bp, Homo sapiens
cccaggagagaggggataaagc

SEQ ID NO: 7109952 - DNA, 22 bp, Homo sapiens
tgccagtgcttgtgtctgagca

SEQ ID NO: 7109953 - DNA, 22 bp, Homo sapiens
tgccagtgcctgctgcccaata

SEQ ID NO: 7109954 - DNA, 22 bp, Homo sapiens
tgccagtgaaacatggaagaat

SEQ ID NO: 7109955 - DNA, 22 bp, Homo sapiens
tgccagtgaaacgtggtctcat

SEQ ID NO: 7109956 - DNA, 22 bp, Homo sapiens
tgccagtgaaacgtggtctcat

SEQ ID NO: 7109957 - DNA, 22 bp, Homo sapiens
tgccagtgagccctgggatgtg

SEQ ID NO: 7109958 - DNA, 22 bp, Homo sapiens
tgccaggctaagtggaggactt

SEQ ID NO: 7109959 - DNA, 22 bp, Homo sapiens
tgccagtgtggaactaggaaga

SEQ ID NO: 7109960 - DNA, 22 bp, Homo sapiens
tgccagtgggtgtgcagagact

SEQ ID NO: 7109961 - DNA, 22 bp, Homo sapiens
tgccagtgtggaactaggaaga

SEQ ID NO: 7109962 - DNA, 22 bp, Homo sapiens
tgccagttgggaaaacagacat

SEQ ID NO: 7109963 - DNA, 22 bp, Homo sapiens
tgccatagcaatggtaagctga

SEQ ID NO: 7109964 - DNA, 22 bp, Homo sapiens
tgccatattattgagcatatta

SEQ ID NO: 7109965 - DNA, 22 bp, Homo sapiens
tgccatagcaatggtaagctga

SEQ ID NO: 7109966 - DNA, 22 bp, Homo sapiens
tgccatagcaatggtaagctga

SEQ ID NO: 7109967 - DNA, 22 bp, Homo sapiens
tgccatatgcaaatactttctt

SEQ ID NO: 7109968 - DNA, 22 bp, Homo sapiens
tgccatattgatgtgctgtacc

SEQ ID NO: 7109969 - DNA, 22 bp, Homo sapiens
tgccatcacctttctgaacgtt

SEQ ID NO: 7109970 - DNA, 22 bp, Homo sapiens
tgccatattgcaaagtgtctgc

SEQ ID NO: 7109971 - DNA, 22 bp, Homo sapiens
tgccatcacacggaacccgatt

SEQ ID NO: 7109972 - DNA, 22 bp, Homo sapiens
tgcccagccaatttgttatgtt

SEQ ID NO: 7109973 - DNA, 22 bp, Homo sapiens
tgcccagccaatttgttatgtt

SEQ ID NO: 7109974 - DNA, 22 bp, Homo sapiens
tgccatcacacggaacccgatt

SEQ ID NO: 7109975 - DNA, 22 bp, Homo sapiens
tgcccagccagtttatggtaat

SEQ ID NO: 7109976 - DNA, 22 bp, Homo sapiens
tgcccagccagtttatggtaat

SEQ ID NO: 7109977 - DNA, 22 bp, Homo sapiens
tgcccagcccctatccctggga

SEQ ID NO: 7109978 - DNA, 22 bp, Homo sapiens
tgcccagcccctatccctggga

SEQ ID NO: 7109979 - DNA, 22 bp, Homo sapiens
tgcccagcccctatccctggga

SEQ ID NO: 7109980 - DNA, 22 bp, Homo sapiens
tgcccagctgtcaaagtagata

SEQ ID NO: 7109981 - DNA, 22 bp, Homo sapiens
tgcccagctgtcaaagtagata

SEQ ID NO: 7109982 - DNA, 22 bp, Homo sapiens
tgcccagcttcttacttttaaa

SEQ ID NO: 7109983 - DNA, 19 bp, Homo sapiens
cccaggctacatggagagg

SEQ ID NO: 7109984 - DNA, 23 bp, Homo sapiens
cccaggctacaaattatgctctg

SEQ ID NO: 7109985 - DNA, 19 bp, Homo sapiens
cccaggctacatggagagg

SEQ ID NO: 7109986 - DNA, 22 bp, Homo sapiens
tgcccagcccctatccctggga

SEQ ID NO: 7109987 - DNA, 22 bp, Homo sapiens
tgcccagcctaaacttggcaag

SEQ ID NO: 7109988 - DNA, 22 bp, Homo sapiens
tgcccagcctaaacttggcaag

SEQ ID NO: 7109989 - DNA, 22 bp, Homo sapiens
tgcccagcctaaacttggcaag

SEQ ID NO: 7109990 - DNA, 22 bp, Homo sapiens
tgcccagcctaaacttggcaag

SEQ ID NO: 7109991 - DNA, 22 bp, Homo sapiens
tgcccagcctaaacttggcaag

SEQ ID NO: 7109992 - DNA, 22 bp, Homo sapiens
tgcccagcgcccacattctgtc

SEQ ID NO: 7109993 - DNA, 22 bp, Homo sapiens
tgcccagcgcccacattctgtc

SEQ ID NO: 7109994 - DNA, 22 bp, Homo sapiens
tgcccagctattcctttcttag

SEQ ID NO: 7109995 - DNA, 22 bp, Homo sapiens
cccaggctcagactggcttgtt

SEQ ID NO: 7109996 - DNA, 22 bp, Homo sapiens
cccaggctcagactggcttgtt

SEQ ID NO: 7109997 - DNA, 22 bp, Homo sapiens
cccaggctcccaggtgggacaa

SEQ ID NO: 7109998 - DNA, 22 bp, Homo sapiens
cccaggctcccaggtgggacaa

SEQ ID NO: 7109999 - DNA, 22 bp, Homo sapiens
cccaggctcccaggtgggacaa

SEQ ID NO: 7110000 - DNA, 22 bp, Homo sapiens
cccaggctcactgtccgcttcc

SEQ ID NO: 7110001 - DNA, 22 bp, Homo sapiens
cccaggctcagactggcttgtt

SEQ ID NO: 7110002 - DNA, 22 bp, Homo sapiens
cccaggctcagactggcttgtt

SEQ ID NO: 7110003 - DNA, 19 bp, Homo sapiens
cccaggctacatggagagg

SEQ ID NO: 7110004 - DNA, 22 bp, Homo sapiens
cccaggctagaaaggccaacaa

SEQ ID NO: 7110005 - DNA, 22 bp, Homo sapiens
cccaggctagaaaggccaacaa

SEQ ID NO: 7110006 - DNA, 22 bp, Homo sapiens
cccaggctagtatgatatcagt

SEQ ID NO: 7110007 - DNA, 22 bp, Homo sapiens
cccaggctagtatgatatcagt

SEQ ID NO: 7110008 - DNA, 22 bp, Homo sapiens
cccaggctagtatgatatcagt

SEQ ID NO: 7110009 - DNA, 22 bp, Homo sapiens
cccaggctagtatgatatcagt

SEQ ID NO: 7110010 - DNA, 22 bp, Homo sapiens
cccaggctcccaggtgggacaa

SEQ ID NO: 7110011 - DNA, 22 bp, Homo sapiens
cccaggctcccaggtgggacaa

SEQ ID NO: 7110012 - DNA, 22 bp, Homo sapiens
cccaggctcccaggtgggacaa

SEQ ID NO: 7110013 - DNA, 22 bp, Homo sapiens
cccaggctcccaggtgggacaa

SEQ ID NO: 7110014 - DNA, 22 bp, Homo sapiens
tgccctgggagttggagctgct

SEQ ID NO: 7110015 - DNA, 22 bp, Homo sapiens
tgccctggggagcccagccagg

SEQ ID NO: 7110016 - DNA, 21 bp, Homo sapiens
tgccctggggctcttccctca

SEQ ID NO: 7110017 - DNA, 21 bp, Homo sapiens
tgccctggggctcttccctca

SEQ ID NO: 7110018 - DNA, 22 bp, Homo sapiens
tgccctggggtctggagcagca

SEQ ID NO: 7110019 - DNA, 22 bp, Homo sapiens
tgccctggggtctggagcagca

SEQ ID NO: 7110020 - DNA, 19 bp, Homo sapiens
cccagggtttcctctctcc

SEQ ID NO: 7110021 - DNA, 23 bp, Homo sapiens
cccaggtagccctctagagcctg

SEQ ID NO: 7110022 - DNA, 22 bp, Homo sapiens
cccaggtagttggaagagacaa

SEQ ID NO: 7110023 - DNA, 22 bp, Homo sapiens
cccagggttgcctgcctctgct

SEQ ID NO: 7110024 - DNA, 22 bp, Homo sapiens
cccagggttgcctgcctctgct

SEQ ID NO: 7110025 - DNA, 22 bp, Homo sapiens
cccagggtggatgcaagcagca

SEQ ID NO: 7110026 - DNA, 22 bp, Homo sapiens
cccagggtgcggccctggctgg

SEQ ID NO: 7110027 - DNA, 22 bp, Homo sapiens
cccagggtccctgctctctgtg

SEQ ID NO: 7110028 - DNA, 22 bp, Homo sapiens
cccagggtggatgcaagcagca

SEQ ID NO: 7110029 - DNA, 22 bp, Homo sapiens
cccagggtccctgctctctgtg

SEQ ID NO: 7110030 - DNA, 22 bp, Homo sapiens
cccagggtccctgctctctgtg

SEQ ID NO: 7110031 - DNA, 22 bp, Homo sapiens
cccagggtccctgctctctgtg

SEQ ID NO: 7110032 - DNA, 22 bp, Homo sapiens
cccaggggttcaaggctgcagt

SEQ ID NO: 7110033 - DNA, 22 bp, Homo sapiens
cccagggccctggacagctaca

SEQ ID NO: 7110034 - DNA, 22 bp, Homo sapiens
cccaggggttcaaggctgcagt

SEQ ID NO: 7110035 - DNA, 22 bp, Homo sapiens
cccaggggttctagaccagctt

SEQ ID NO: 7110036 - DNA, 22 bp, Homo sapiens
cccaggggttctgagcagcagc

SEQ ID NO: 7110037 - DNA, 22 bp, Homo sapiens
cccaggggttctgagcagcagc

SEQ ID NO: 7110038 - DNA, 20 bp, Homo sapiens
cccaggggttgtggtgagga

SEQ ID NO: 7110039 - DNA, 20 bp, Homo sapiens
cccaggggttgtggtgagga

SEQ ID NO: 7110040 - DNA, 20 bp, Homo sapiens
cccaggggttgtggtgagga

SEQ ID NO: 7110041 - DNA, 22 bp, Homo sapiens
cccagggtaatcatgtgaagcc

SEQ ID NO: 7110042 - DNA, 22 bp, Homo sapiens
cccagggtaatcatgtgaagcc

SEQ ID NO: 7110043 - DNA, 22 bp, Homo sapiens
cccagggtagctgagctggcag

SEQ ID NO: 7110044 - DNA, 22 bp, Homo sapiens
cccagggtagctgagctggcag

SEQ ID NO: 7110045 - DNA, 22 bp, Homo sapiens
tgccttcctggagctgaaggct

SEQ ID NO: 7110046 - DNA, 22 bp, Homo sapiens
tgccttcctggagctgaaggct

SEQ ID NO: 7110047 - DNA, 22 bp, Homo sapiens
tgccttcctggagctgaaggct

SEQ ID NO: 7110048 - DNA, 22 bp, Homo sapiens
tgccttcctggagctgaaggct

SEQ ID NO: 7110049 - DNA, 22 bp, Homo sapiens
tgccttcaccaggccttcagcc

SEQ ID NO: 7110050 - DNA, 22 bp, Homo sapiens
tgccttcactgagcttatggga

SEQ ID NO: 7110051 - DNA, 22 bp, Homo sapiens
tgccttcatccatgttatagtg

SEQ ID NO: 7110052 - DNA, 22 bp, Homo sapiens
tgccttcctaatggtggggttt

SEQ ID NO: 7110053 - DNA, 22 bp, Homo sapiens
tgccttcctaatggtggggttt

SEQ ID NO: 7110054 - DNA, 22 bp, Homo sapiens
tgcctgttaagggtgtagatat

SEQ ID NO: 7110055 - DNA, 22 bp, Homo sapiens
tgcctgttgcccacctgataaa

SEQ ID NO: 7110056 - DNA, 22 bp, Homo sapiens
tgcctgttgcccacctgataaa

SEQ ID NO: 7110057 - DNA, 22 bp, Homo sapiens
tgccttcaagacccatcctcca

SEQ ID NO: 7110058 - DNA, 22 bp, Homo sapiens
tgccttcaagacccatcctcca

SEQ ID NO: 7110059 - DNA, 22 bp, Homo sapiens
tgccttcaccaggccttcagcc

SEQ ID NO: 7110060 - DNA, 22 bp, Homo sapiens
tgcctgtgttgattactttgtc

SEQ ID NO: 7110061 - DNA, 22 bp, Homo sapiens
tgcctgtgttgattactttgtc

SEQ ID NO: 7110062 - DNA, 22 bp, Homo sapiens
tgcctgtgtggtctgcgcatta

SEQ ID NO: 7110063 - DNA, 22 bp, Homo sapiens
tgcctgtgtgaccacgggcaag

SEQ ID NO: 7110064 - DNA, 22 bp, Homo sapiens
tgcctgtgtggggtctgccgcc

SEQ ID NO: 7110065 - DNA, 22 bp, Homo sapiens
tgcctgtgtggggtctgccgcc

SEQ ID NO: 7110066 - DNA, 17 bp, Homo sapiens
cccagggaccactgctt

SEQ ID NO: 7110067 - DNA, 17 bp, Homo sapiens
cccagggaccactgctt

SEQ ID NO: 7110068 - DNA, 17 bp, Homo sapiens
cccagggaccactgctt

SEQ ID NO: 7110069 - DNA, 17 bp, Homo sapiens
cccagggaccactgctt

SEQ ID NO: 7110070 - DNA, 22 bp, Homo sapiens
cccagggacagctaggtggggc

SEQ ID NO: 7110071 - DNA, 22 bp, Homo sapiens
cccagggacagatgggcagcta

SEQ ID NO: 7110072 - DNA, 22 bp, Homo sapiens
cccagggacagatgggcagcta

SEQ ID NO: 7110073 - DNA, 22 bp, Homo sapiens
cccagggacagatgggcagcta

SEQ ID NO: 7110074 - DNA, 22 bp, Homo sapiens
cccagggacagatgggcagcta

SEQ ID NO: 7110075 - DNA, 22 bp, Homo sapiens
cccagggacagatgggcagcta

SEQ ID NO: 7110076 - DNA, 22 bp, Homo sapiens
cccagggacagatgggcagcta

SEQ ID NO: 7110077 - DNA, 22 bp, Homo sapiens
cccagggaatgactctggcctt

SEQ ID NO: 7110078 - DNA, 23 bp, Homo sapiens
cccagggacacgatgacacctcc

SEQ ID NO: 7110079 - DNA, 23 bp, Homo sapiens
cccagggacacgatgacacctcc

SEQ ID NO: 7110080 - DNA, 23 bp, Homo sapiens
cccagggacacgatgacacctcc

SEQ ID NO: 7110081 - DNA, 22 bp, Homo sapiens
cccagggaatgactctggcctt

SEQ ID NO: 7110082 - DNA, 22 bp, Homo sapiens
cccagggaatgactctggcctt

SEQ ID NO: 7110083 - DNA, 22 bp, Homo sapiens
cccagggaagggctacctgagg

SEQ ID NO: 7110084 - DNA, 22 bp, Homo sapiens
cccagggaaggcagatggagga

SEQ ID NO: 7110085 - DNA, 22 bp, Homo sapiens
cccagggaaggcagatggagga

SEQ ID NO: 7110086 - DNA, 22 bp, Homo sapiens
cccagggaaggcagatggagga

SEQ ID NO: 7110087 - DNA, 22 bp, Homo sapiens
cccaggctggtcctgaactcct

SEQ ID NO: 7110088 - DNA, 22 bp, Homo sapiens
cccaggctggtcctgaactcct

SEQ ID NO: 7110089 - DNA, 22 bp, Homo sapiens
cccaggctggtcctgaactcct

SEQ ID NO: 7110090 - DNA, 22 bp, Homo sapiens
cccaggctggcctccgcagtgc

SEQ ID NO: 7110091 - DNA, 22 bp, Homo sapiens
cccaggctggcctccgcagtgc

SEQ ID NO: 7110092 - DNA, 22 bp, Homo sapiens
cccaggctggcactgctgaagt

SEQ ID NO: 7110093 - DNA, 22 bp, Homo sapiens
cccaggctggcactgctgaagt

SEQ ID NO: 7110094 - DNA, 22 bp, Homo sapiens
cccaggctggggctcctccagc

SEQ ID NO: 7110095 - DNA, 22 bp, Homo sapiens
cccaggctggggctcctccagc

SEQ ID NO: 7110096 - DNA, 22 bp, Homo sapiens
cccaggctgggaacgattctag

SEQ ID NO: 7110097 - DNA, 22 bp, Homo sapiens
cccaggctggggctcctccagc

SEQ ID NO: 7110098 - DNA, 22 bp, Homo sapiens
cccaggctggatttcggtggca

SEQ ID NO: 7110099 - DNA, 22 bp, Homo sapiens
cccaggctggatttcggtggca

SEQ ID NO: 7110100 - DNA, 22 bp, Homo sapiens
cccaggctggcactgctgaagt

SEQ ID NO: 7110101 - DNA, 22 bp, Homo sapiens
cccaggctggcactgctgaagt

SEQ ID NO: 7110102 - DNA, 22 bp, Homo sapiens
cccaggctggagtgcagtggcg

SEQ ID NO: 7110103 - DNA, 22 bp, Homo sapiens
cccaggctggagtgtaatggtg

SEQ ID NO: 7110104 - DNA, 22 bp, Homo sapiens
cccaggctggatttcggtggca

SEQ ID NO: 7110105 - DNA, 22 bp, Homo sapiens
cccaggctggagggcagtgtca

SEQ ID NO: 7110106 - DNA, 22 bp, Homo sapiens
cccaggctggagggcagtgtca

SEQ ID NO: 7110107 - DNA, 22 bp, Homo sapiens
cccaggctggaattccaggcct

SEQ ID NO: 7110108 - DNA, 22 bp, Homo sapiens
cccaggctggagggcagtgtca

SEQ ID NO: 7110109 - DNA, 22 bp, Homo sapiens
cccaggctggaattccaggcct

SEQ ID NO: 7110110 - DNA, 22 bp, Homo sapiens
cccaggctgagttagaggtgtc

SEQ ID NO: 7110111 - DNA, 22 bp, Homo sapiens
cccaggctgagttagaggtgtc

SEQ ID NO: 7110112 - DNA, 22 bp, Homo sapiens
cccaggctggaattccaggcct

SEQ ID NO: 7110113 - DNA, 22 bp, Homo sapiens
tgccctggttacactggagtcc

SEQ ID NO: 7110114 - DNA, 22 bp, Homo sapiens
tgccctggttacactggagtcc

SEQ ID NO: 7110115 - DNA, 22 bp, Homo sapiens
tgccctggttacactggagtcc

SEQ ID NO: 7110116 - DNA, 22 bp, Homo sapiens
tgccctggttacactggagtcc

SEQ ID NO: 7110117 - DNA, 22 bp, Homo sapiens
tgccctggtatcatgtggaatt

SEQ ID NO: 7110118 - DNA, 22 bp, Homo sapiens
tgccctggtatcatgtggaatt

SEQ ID NO: 7110119 - DNA, 22 bp, Homo sapiens
tgccctggtatcatgtggaatt

SEQ ID NO: 7110120 - DNA, 22 bp, Homo sapiens
tgccctggtgaagtgctctcct

SEQ ID NO: 7110121 - DNA, 22 bp, Homo sapiens
tgccctggtgaagtgctctcct

SEQ ID NO: 7110122 - DNA, 22 bp, Homo sapiens
tgccctggtagacacagactgt

SEQ ID NO: 7110123 - DNA, 22 bp, Homo sapiens
cccaggctggagtgcaatggca

SEQ ID NO: 7110124 - DNA, 22 bp, Homo sapiens
cccaggctggagtgcaatggca

SEQ ID NO: 7110125 - DNA, 22 bp, Homo sapiens
cccaggctggagtgcaatggca

SEQ ID NO: 7110126 - DNA, 22 bp, Homo sapiens
cccaggctggagtgcaatggtg

SEQ ID NO: 7110127 - DNA, 22 bp, Homo sapiens
cccaggctggagtgcaatggtg

SEQ ID NO: 7110128 - DNA, 22 bp, Homo sapiens
cccaggctggagggcagtgtca

SEQ ID NO: 7110129 - DNA, 22 bp, Homo sapiens
cccaggctggagtgcaatggca

SEQ ID NO: 7110130 - DNA, 22 bp, Homo sapiens
cccaggctggagtgcaatggca

SEQ ID NO: 7110131 - DNA, 22 bp, Homo sapiens
cccaggctggagtgcagtggcg

SEQ ID NO: 7110132 - DNA, 22 bp, Homo sapiens
cccaggctggagtgcagtggcg

SEQ ID NO: 7110133 - DNA, 22 bp, Homo sapiens
cccaggctggagtgcagtggcg

SEQ ID NO: 7110134 - DNA, 22 bp, Homo sapiens
cccaggctggagtgcaatggtg

SEQ ID NO: 7110135 - DNA, 22 bp, Homo sapiens
cccaggctggagtgcaatggtg

SEQ ID NO: 7110136 - DNA, 22 bp, Homo sapiens
cccaggctggagtgcagtggcg

SEQ ID NO: 7110137 - DNA, 22 bp, Homo sapiens
cccaggctggagtgcagtggcg

SEQ ID NO: 7110138 - DNA, 22 bp, Homo sapiens
cccaggctggagtgcaatggtg

SEQ ID NO: 7110139 - DNA, 22 bp, Homo sapiens
ccccttccgtctcttgagtgtc

SEQ ID NO: 7110140 - DNA, 22 bp, Homo sapiens
ccccttccttcctcagacagcc

SEQ ID NO: 7110141 - DNA, 23 bp, Homo sapiens
cccctctggtggctcagctcctg

SEQ ID NO: 7110142 - DNA, 22 bp, Homo sapiens
tgctgggcacacagtaggtgct

SEQ ID NO: 7110143 - DNA, 22 bp, Homo sapiens
cccctcttgtactagacagttt

SEQ ID NO: 7110144 - DNA, 22 bp, Homo sapiens
cccctcttgtactagacagttt

SEQ ID NO: 7110145 - DNA, 22 bp, Homo sapiens
tgctgggatatagcttctaggg

SEQ ID NO: 7110146 - DNA, 22 bp, Homo sapiens
tgctgggatatagcttctaggg

SEQ ID NO: 7110147 - DNA, 22 bp, Homo sapiens
tgctgggatatagcttctaggg

SEQ ID NO: 7110148 - DNA, 22 bp, Homo sapiens
tgctgggatatagcttctaggg

SEQ ID NO: 7110149 - DNA, 22 bp, Homo sapiens
tgctgggcacacagtaggtgct

SEQ ID NO: 7110150 - DNA, 22 bp, Homo sapiens
tgctggctttttggtccttgct

SEQ ID NO: 7110151 - DNA, 22 bp, Homo sapiens
cccctttctcccgcgactggcc

SEQ ID NO: 7110152 - DNA, 22 bp, Homo sapiens
ccccttctgtgtcctgtcagcc

SEQ ID NO: 7110153 - DNA, 22 bp, Homo sapiens
ccccttctggtcttcaatggtg

SEQ ID NO: 7110154 - DNA, 22 bp, Homo sapiens
ccccttctgtgtcctgtcagcc

SEQ ID NO: 7110155 - DNA, 22 bp, Homo sapiens
ccccttctgtgtcctgtcagcc

SEQ ID NO: 7110156 - DNA, 22 bp, Homo sapiens
ccccttctctgcaagcctgctc

SEQ ID NO: 7110157 - DNA, 22 bp, Homo sapiens
cccgagcgggccctggggtgac

SEQ ID NO: 7110158 - DNA, 22 bp, Homo sapiens
cccgaggaaccagaggtagctc

SEQ ID NO: 7110159 - DNA, 22 bp, Homo sapiens
cccgagggccgaaagctgcttt

SEQ ID NO: 7110160 - DNA, 21 bp, Homo sapiens
cccgcacagcggtaggccgcc

SEQ ID NO: 7110161 - DNA, 21 bp, Homo sapiens
cccgcacagcggtaggccgcc

SEQ ID NO: 7110162 - DNA, 22 bp, Homo sapiens
cccggacagaggggcagagtgt

SEQ ID NO: 7110163 - DNA, 22 bp, Homo sapiens
cccggacagaggggcagagtgt

SEQ ID NO: 7110164 - DNA, 22 bp, Homo sapiens
cccggacagaggggcagagtgt

SEQ ID NO: 7110165 - DNA, 22 bp, Homo sapiens
cccggccccgtggcaggtaacg

SEQ ID NO: 7110166 - DNA, 22 bp, Homo sapiens
cccggcctctgcctggtggcct

SEQ ID NO: 7110167 - DNA, 22 bp, Homo sapiens
tgctggctttgcgagatgcatt

SEQ ID NO: 7110168 - DNA, 22 bp, Homo sapiens
tgctggctttctgtccctggca

SEQ ID NO: 7110169 - DNA, 22 bp, Homo sapiens
tgctggctttctgtccctggca

SEQ ID NO: 7110170 - DNA, 23 bp, Homo sapiens
tgctggcttttatctggtcccta

SEQ ID NO: 7110171 - DNA, 22 bp, Homo sapiens
tgctggctacattattgctgtc

SEQ ID NO: 7110172 - DNA, 22 bp, Homo sapiens
tgctggcccagtatggactgca

SEQ ID NO: 7110173 - DNA, 22 bp, Homo sapiens
tgctggcccagtatggactgca

SEQ ID NO: 7110174 - DNA, 22 bp, Homo sapiens
tgctggcccatgaagacgcagt

SEQ ID NO: 7110175 - DNA, 22 bp, Homo sapiens
tgctggcccatgaagacgcagt

SEQ ID NO: 7110176 - DNA, 22 bp, Homo sapiens
tgctggccggccaggtgctgag

SEQ ID NO: 7110177 - DNA, 22 bp, Homo sapiens
tgctggccgtgagctctcggga

SEQ ID NO: 7110178 - DNA, 22 bp, Homo sapiens
tgctggccgtgagctctcggga

SEQ ID NO: 7110179 - DNA, 21 bp, Homo sapiens
tgctggcctcaagggtgactt

SEQ ID NO: 7110180 - DNA, 22 bp, Homo sapiens
tgctggcctcggcgctgggcct

SEQ ID NO: 7110181 - DNA, 22 bp, Homo sapiens
tgctggcctgggctgcaccttg

SEQ ID NO: 7110182 - DNA, 22 bp, Homo sapiens
tgctggagcccaggcggccttt

SEQ ID NO: 7110183 - DNA, 22 bp, Homo sapiens
tgctggagcccaggcggccttt

SEQ ID NO: 7110184 - DNA, 22 bp, Homo sapiens
tgctggagcccaggcggccttt

SEQ ID NO: 7110185 - DNA, 22 bp, Homo sapiens
ccccaccctcgctccatttcgg

SEQ ID NO: 7110186 - DNA, 22 bp, Homo sapiens
tgctggagcccaggcggccttt

SEQ ID NO: 7110187 - DNA, 22 bp, Homo sapiens
tgctggccaatggcagaggcgg

SEQ ID NO: 7110188 - DNA, 22 bp, Homo sapiens
tgctggccaatggcagaggcgg

SEQ ID NO: 7110189 - DNA, 22 bp, Homo sapiens
tgctggccaatggcagaggcgg

SEQ ID NO: 7110190 - DNA, 21 bp, Homo sapiens
tgctggccatgtgctgggcat

SEQ ID NO: 7110191 - DNA, 22 bp, Homo sapiens
ccccacccacctaagagaaact

SEQ ID NO: 7110192 - DNA, 22 bp, Homo sapiens
ccccacccacctaagagaaact

SEQ ID NO: 7110193 - DNA, 22 bp, Homo sapiens
ccccaccagcaccctctctatc

SEQ ID NO: 7110194 - DNA, 22 bp, Homo sapiens
ccccaccatgtagaaactgaga

SEQ ID NO: 7110195 - DNA, 22 bp, Homo sapiens
ccccaccaccaaggctcagttt

SEQ ID NO: 7110196 - DNA, 22 bp, Homo sapiens
ccccaccagcaccctctctatc

SEQ ID NO: 7110197 - DNA, 22 bp, Homo sapiens
ccccacccacctaagagaaact

SEQ ID NO: 7110198 - DNA, 22 bp, Homo sapiens
ccccacccacctaagagaaact

SEQ ID NO: 7110199 - DNA, 22 bp, Homo sapiens
ccccaccctcgctccatttcgg

SEQ ID NO: 7110200 - DNA, 22 bp, Homo sapiens
ccccaccctcgctccatttcgg

SEQ ID NO: 7110201 - DNA, 22 bp, Homo sapiens
ccccaccctcgctccatttcgg

SEQ ID NO: 7110202 - DNA, 22 bp, Homo sapiens
ccccaccctcgctccatttcgg

SEQ ID NO: 7110203 - DNA, 22 bp, Homo sapiens
ccccacaactcatgttgaaact

SEQ ID NO: 7110204 - DNA, 22 bp, Homo sapiens
ccccacaactcatgttgaaact

SEQ ID NO: 7110205 - DNA, 22 bp, Homo sapiens
ccccaaggtgctcactgtctgg

SEQ ID NO: 7110206 - DNA, 22 bp, Homo sapiens
ccccacactctttacattcata

SEQ ID NO: 7110207 - DNA, 22 bp, Homo sapiens
ccccacagccgccagcagggag

SEQ ID NO: 7110208 - DNA, 22 bp, Homo sapiens
ccccacagccgccagcagggag

SEQ ID NO: 7110209 - DNA, 22 bp, Homo sapiens
ccccacagcttgtggagagaat

SEQ ID NO: 7110210 - DNA, 22 bp, Homo sapiens
ccccacagcttgtggagagaat

SEQ ID NO: 7110211 - DNA, 22 bp, Homo sapiens
ccccacagcttgtggagagaat

SEQ ID NO: 7110212 - DNA, 22 bp, Homo sapiens
ccccacaggtgtctgaggcagg

SEQ ID NO: 7110213 - DNA, 22 bp, Homo sapiens
ccccacagtccgtgaggagcca

SEQ ID NO: 7110214 - DNA, 22 bp, Homo sapiens
ccccaccaccaaggctcagttt

SEQ ID NO: 7110215 - DNA, 23 bp, Homo sapiens
cccaggtcaaaattcacaggcct

SEQ ID NO: 7110216 - DNA, 22 bp, Homo sapiens
cccaggtccccacctgtctgct

SEQ ID NO: 7110217 - DNA, 21 bp, Homo sapiens
cccaggtcgtggtcttcccag

SEQ ID NO: 7110218 - DNA, 22 bp, Homo sapiens
cccattcatcctcgcttccttc

SEQ ID NO: 7110219 - DNA, 22 bp, Homo sapiens
cccaggtctatgccagctctga

SEQ ID NO: 7110220 - DNA, 22 bp, Homo sapiens
cccaggtctatgccagctctga

SEQ ID NO: 7110221 - DNA, 22 bp, Homo sapiens
cccatttttgtgtgagtaatga

SEQ ID NO: 7110222 - DNA, 22 bp, Homo sapiens
ccccaaagcctcagcctgcctg

SEQ ID NO: 7110223 - DNA, 22 bp, Homo sapiens
ccccaaagcctcagcctgcctg

SEQ ID NO: 7110224 - DNA, 22 bp, Homo sapiens
ccccaaagctgagttcccgcct

SEQ ID NO: 7110225 - DNA, 22 bp, Homo sapiens
ccccaaagctgagttcccgcct

SEQ ID NO: 7110226 - DNA, 22 bp, Homo sapiens
ccccaaagtgttggataattga

SEQ ID NO: 7110227 - DNA, 19 bp, Homo sapiens
ccccaaagtttagatgttg

SEQ ID NO: 7110228 - DNA, 22 bp, Homo sapiens
ccccaaccctggttccgtggcg

SEQ ID NO: 7110229 - DNA, 23 bp, Homo sapiens
cccattttcatgttaactcctgg

SEQ ID NO: 7110230 - DNA, 22 bp, Homo sapiens
cccatttgtccaaagtataaaa

SEQ ID NO: 7110231 - DNA, 22 bp, Homo sapiens
cccatttatcccaaggttactc

SEQ ID NO: 7110232 - DNA, 22 bp, Homo sapiens
cccatttatgactacacaggtg

SEQ ID NO: 7110233 - DNA, 22 bp, Homo sapiens
cccatttatttaagtaggtctt

SEQ ID NO: 7110234 - DNA, 22 bp, Homo sapiens
cccatttcttgagttcagctct

SEQ ID NO: 7110235 - DNA, 23 bp, Homo sapiens
cccatttgctcacaggacagcag

SEQ ID NO: 7110236 - DNA, 22 bp, Homo sapiens
cccatttgtatagagccttata

SEQ ID NO: 7110237 - DNA, 22 bp, Homo sapiens
cccattccctttactgttgcat

SEQ ID NO: 7110238 - DNA, 22 bp, Homo sapiens
cccattgcccaaatagtaaaca

SEQ ID NO: 7110239 - DNA, 22 bp, Homo sapiens
cccattgtggttgttgaggata

SEQ ID NO: 7110240 - DNA, 22 bp, Homo sapiens
cccatttaaacacaagctttca

SEQ ID NO: 7110241 - DNA, 22 bp, Homo sapiens
cccatttaagtaatgataaact

SEQ ID NO: 7110242 - DNA, 22 bp, Homo sapiens
cccatttagacctattctgccc

SEQ ID NO: 7110243 - DNA, 22 bp, Homo sapiens
cccatttagagtataagagaga

SEQ ID NO: 7110244 - DNA, 22 bp, Homo sapiens
cccatttagataacagttcaaa

SEQ ID NO: 7110245 - DNA, 23 bp, Homo sapiens
cccatttagcggatgagggaagt

SEQ ID NO: 7110246 - DNA, 22 bp, Homo sapiens
tggaagggagctggaatttgga

SEQ ID NO: 7110247 - DNA, 22 bp, Homo sapiens
tggaagggagctggaatttgga

SEQ ID NO: 7110248 - DNA, 22 bp, Homo sapiens
tggaagggagctggaatttgga

SEQ ID NO: 7110249 - DNA, 22 bp, Homo sapiens
tggaatggaaacaaactgagga

SEQ ID NO: 7110250 - DNA, 22 bp, Homo sapiens
tggaatggaaacaaactgagga

SEQ ID NO: 7110251 - DNA, 22 bp, Homo sapiens
tgctgtgttcctcagtttcatg

SEQ ID NO: 7110252 - DNA, 22 bp, Homo sapiens
tgctgtgttctcctgactcacc

SEQ ID NO: 7110253 - DNA, 22 bp, Homo sapiens
tgctgtgttctcctgactcacc

SEQ ID NO: 7110254 - DNA, 22 bp, Homo sapiens
tgctgtgttctcctgactcacc

SEQ ID NO: 7110255 - DNA, 22 bp, Homo sapiens
tgctgtgttaaatacaagcatg

SEQ ID NO: 7110256 - DNA, 22 bp, Homo sapiens
tgctgtgttaaatacaagcatg

SEQ ID NO: 7110257 - DNA, 22 bp, Homo sapiens
tgctgtgttcaccaatatgtgt

SEQ ID NO: 7110258 - DNA, 22 bp, Homo sapiens
tgctgtgttcaccaatatgtgt

SEQ ID NO: 7110259 - DNA, 20 bp, Homo sapiens
tgctgtgtggcccagcatga

SEQ ID NO: 7110260 - DNA, 20 bp, Homo sapiens
tgctgtgtggcccagcatga

SEQ ID NO: 7110261 - DNA, 22 bp, Homo sapiens
tgctgtgttaaatacaagcatg

SEQ ID NO: 7110262 - DNA, 22 bp, Homo sapiens
tgctgtgttaaatacaagcatg

SEQ ID NO: 7110263 - DNA, 22 bp, Homo sapiens
tgctgtgtggatgtgaagaatc

SEQ ID NO: 7110264 - DNA, 22 bp, Homo sapiens
tgctgtgtggatgtgaagaatc

SEQ ID NO: 7110265 - DNA, 18 bp, Homo sapiens
cccggctaatttttggta

SEQ ID NO: 7110266 - DNA, 18 bp, Homo sapiens
cccggctaatttttggta

SEQ ID NO: 7110267 - DNA, 18 bp, Homo sapiens
cccggctaatttttggta

SEQ ID NO: 7110268 - DNA, 22 bp, Homo sapiens
tgctgtgctctttaaggtgctg

SEQ ID NO: 7110269 - DNA, 22 bp, Homo sapiens
tgctgtgctccattgtcttcac

SEQ ID NO: 7110270 - DNA, 23 bp, Homo sapiens
tgctgtggatggcaggtccttgc

SEQ ID NO: 7110271 - DNA, 22 bp, Homo sapiens
tgctgtgctggcggcagaggcc

SEQ ID NO: 7110272 - DNA, 22 bp, Homo sapiens
tgctgtgctggcggcagaggcc

SEQ ID NO: 7110273 - DNA, 22 bp, Homo sapiens
tgctgtgctggcggcagaggcc

SEQ ID NO: 7110274 - DNA, 22 bp, Homo sapiens
tgctgtggttcccagagtggat

SEQ ID NO: 7110275 - DNA, 22 bp, Homo sapiens
tgctgtgggcagtacataagct

SEQ ID NO: 7110276 - DNA, 22 bp, Homo sapiens
tgctgtgggcagtacataagct

SEQ ID NO: 7110277 - DNA, 22 bp, Homo sapiens
tgctgtgggatatatgttcaaa

SEQ ID NO: 7110278 - DNA, 22 bp, Homo sapiens
tgctgtggttcccagagtggat

SEQ ID NO: 7110279 - DNA, 22 bp, Homo sapiens
tgctgtgtaaaaggtgattgaa

SEQ ID NO: 7110280 - DNA, 22 bp, Homo sapiens
tgctgtgtaaaaggtgattgaa

SEQ ID NO: 7110281 - DNA, 22 bp, Homo sapiens
tgctgtgtaaaaggtgattgaa

SEQ ID NO: 7110282 - DNA, 22 bp, Homo sapiens
tgctgtgtaaaaggtgattgaa

SEQ ID NO: 7110283 - DNA, 22 bp, Homo sapiens
tgctgtgtaaaaggtgattgaa

SEQ ID NO: 7110284 - DNA, 22 bp, Homo sapiens
tgctgtgtctttctgtgaaaag

SEQ ID NO: 7110285 - DNA, 22 bp, Homo sapiens
tggaatgtgctagggctgtggc

SEQ ID NO: 7110286 - DNA, 22 bp, Homo sapiens
tggaatgtgctagggctgtggc

SEQ ID NO: 7110287 - DNA, 22 bp, Homo sapiens
tggaatgtggataagggtgtct

SEQ ID NO: 7110288 - DNA, 22 bp, Homo sapiens
tggaatgtggataagggtgtct

SEQ ID NO: 7110289 - DNA, 22 bp, Homo sapiens
tggaatgtggtatcagtagaaa

SEQ ID NO: 7110290 - DNA, 22 bp, Homo sapiens
tggaatgtggtatcagtagaaa

SEQ ID NO: 7110291 - DNA, 22 bp, Homo sapiens
tggaatgtcttgatatagaggt

SEQ ID NO: 7110292 - DNA, 22 bp, Homo sapiens
tggaatgtcttgatatagaggt

SEQ ID NO: 7110293 - DNA, 22 bp, Homo sapiens
tggaatgtgaacatacaaggta

SEQ ID NO: 7110294 - DNA, 22 bp, Homo sapiens
tggaatgtgaacatacaaggta

SEQ ID NO: 7110295 - DNA, 22 bp, Homo sapiens
tggaatgtgaacatacaaggta

SEQ ID NO: 7110296 - DNA, 22 bp, Homo sapiens
tggaatgtgagaataccgtttt

SEQ ID NO: 7110297 - DNA, 22 bp, Homo sapiens
tggaatgtgagaataccgtttt

SEQ ID NO: 7110298 - DNA, 22 bp, Homo sapiens
tggaatgtgctactgttgattt

SEQ ID NO: 7110299 - DNA, 22 bp, Homo sapiens
tggaatgtgctactgttgattt

SEQ ID NO: 7110300 - DNA, 22 bp, Homo sapiens
tggaatgtatagatgttatgta

SEQ ID NO: 7110301 - DNA, 22 bp, Homo sapiens
tggaatgtatagatgttatgta

SEQ ID NO: 7110302 - DNA, 22 bp, Homo sapiens
tggaatgtagtgtccatggaat

SEQ ID NO: 7110303 - DNA, 22 bp, Homo sapiens
tggaatgtattaagtattgagt

SEQ ID NO: 7110304 - DNA, 22 bp, Homo sapiens
tggaatgtattaagtattgagt

SEQ ID NO: 7110305 - DNA, 22 bp, Homo sapiens
tggaatgtcaaaagtctgctat

SEQ ID NO: 7110306 - DNA, 22 bp, Homo sapiens
tggaatgtcaaaagtctgctat

SEQ ID NO: 7110307 - DNA, 22 bp, Homo sapiens
tggaatgtcaagaagcagtaag

SEQ ID NO: 7110308 - DNA, 22 bp, Homo sapiens
tggaatgtcaagaagcagtaag

SEQ ID NO: 7110309 - DNA, 22 bp, Homo sapiens
tggaatgtcagctacaagaggg

SEQ ID NO: 7110310 - DNA, 22 bp, Homo sapiens
tggaatgtcagctacaagaggg

SEQ ID NO: 7110311 - DNA, 22 bp, Homo sapiens
tggaatgtcagctacaagaggg

SEQ ID NO: 7110312 - DNA, 22 bp, Homo sapiens
tggaatgtcataccataaaaga

SEQ ID NO: 7110313 - DNA, 22 bp, Homo sapiens
tggaatgtcataccataaaaga

SEQ ID NO: 7110314 - DNA, 23 bp, Homo sapiens
tggaatgtctgattctgctctag

SEQ ID NO: 7110315 - DNA, 23 bp, Homo sapiens
tggaatgtctgattctgctctag

SEQ ID NO: 7110316 - DNA, 20 bp, Homo sapiens
tggaatgggtccttgaaaaa

SEQ ID NO: 7110317 - DNA, 22 bp, Homo sapiens
tggaatggggactttgggacat

SEQ ID NO: 7110318 - DNA, 22 bp, Homo sapiens
tggaatgtaaacctcaggtggg

SEQ ID NO: 7110319 - DNA, 22 bp, Homo sapiens
tggaatgtaaacctcaggtggg

SEQ ID NO: 7110320 - DNA, 22 bp, Homo sapiens
tggaatgtaaactctgtgaggg

SEQ ID NO: 7110321 - DNA, 22 bp, Homo sapiens
tggaatgtaaactctgtgaggg

SEQ ID NO: 7110322 - DNA, 22 bp, Homo sapiens
tggaatgtaaactctgtgaggg

SEQ ID NO: 7110323 - DNA, 22 bp, Homo sapiens
tggaatggaaacaaactgagga

SEQ ID NO: 7110324 - DNA, 22 bp, Homo sapiens
tggaatgtaaagcgtgtgataa

SEQ ID NO: 7110325 - DNA, 22 bp, Homo sapiens
tggaatgtaaagcgtgtgataa

SEQ ID NO: 7110326 - DNA, 22 bp, Homo sapiens
tggaatgtaaagggtatgggat

SEQ ID NO: 7110327 - DNA, 22 bp, Homo sapiens
tggaatgtaaagggtatgggat

SEQ ID NO: 7110328 - DNA, 22 bp, Homo sapiens
tggaatgtaatcagaatatgaa

SEQ ID NO: 7110329 - DNA, 22 bp, Homo sapiens
tggaatgtaatcagaatatgaa

SEQ ID NO: 7110330 - DNA, 22 bp, Homo sapiens
tggaatgtaatcatgtggtggt

SEQ ID NO: 7110331 - DNA, 22 bp, Homo sapiens
tggaatgtaatcatgtggtggt

SEQ ID NO: 7110332 - DNA, 21 bp, Homo sapiens
tggaatgtacctccctctctt

SEQ ID NO: 7110333 - DNA, 21 bp, Homo sapiens
tggaatgtacctccctctctt

SEQ ID NO: 7110334 - DNA, 22 bp, Homo sapiens
tggaatgtagcaagtgttgtca

SEQ ID NO: 7110335 - DNA, 22 bp, Homo sapiens
tggaatgtagcaagtgttgtca

SEQ ID NO: 7110336 - DNA, 20 bp, Homo sapiens
tggaatgtagtcggtgagag

SEQ ID NO: 7110337 - DNA, 20 bp, Homo sapiens
tggaatgtagtcggtgagag

SEQ ID NO: 7110338 - DNA, 22 bp, Homo sapiens
tggaatgtagtgtccatggaat

SEQ ID NO: 7110339 - DNA, 22 bp, Homo sapiens
tggaatgtgttctattttacag

SEQ ID NO: 7110340 - DNA, 22 bp, Homo sapiens
tggaatgtgttctattttacag

SEQ ID NO: 7110341 - DNA, 22 bp, Homo sapiens
tggaatgtgttctattttacag

SEQ ID NO: 7110342 - DNA, 22 bp, Homo sapiens
tggaatgttaaacctcaatgat

SEQ ID NO: 7110343 - DNA, 22 bp, Homo sapiens
tggaatgttaaacctcaatgat

SEQ ID NO: 7110344 - DNA, 22 bp, Homo sapiens
tggaatgtgttctattttacag

SEQ ID NO: 7110345 - DNA, 22 bp, Homo sapiens
tggaatgttatgatgatggtaa

SEQ ID NO: 7110346 - DNA, 22 bp, Homo sapiens
tggaatgttatgatgatggtaa

SEQ ID NO: 7110347 - DNA, 22 bp, Homo sapiens
ccctcctctccctaagagtcac

SEQ ID NO: 7110348 - DNA, 22 bp, Homo sapiens
ccctcctggaggcggatgccca

SEQ ID NO: 7110349 - DNA, 22 bp, Homo sapiens
ccctcctggaggcggatgccca

SEQ ID NO: 7110350 - DNA, 22 bp, Homo sapiens
ccctcctggaggcggatgccca

SEQ ID NO: 7110351 - DNA, 22 bp, Homo sapiens
ccctcctggaggcggatgccca

SEQ ID NO: 7110352 - DNA, 22 bp, Homo sapiens
ccctcctgtgcctgaggccagc

SEQ ID NO: 7110353 - DNA, 22 bp, Homo sapiens
ccctcctttctaggcttccagc

SEQ ID NO: 7110354 - DNA, 22 bp, Homo sapiens
ccctcgaggttttctgaggtac

SEQ ID NO: 7110355 - DNA, 22 bp, Homo sapiens
ccctcctgtgcctgaggccagc

SEQ ID NO: 7110356 - DNA, 22 bp, Homo sapiens
ccctcctgtgcctgaggccagc

SEQ ID NO: 7110357 - DNA, 22 bp, Homo sapiens
ccctccttaccaccacagctcc

SEQ ID NO: 7110358 - DNA, 20 bp, Homo sapiens
ccctgagacgactgagctcc

SEQ ID NO: 7110359 - DNA, 20 bp, Homo sapiens
ccctgagacgactgagctcc

SEQ ID NO: 7110360 - DNA, 22 bp, Homo sapiens
ccctgagaggttgagtgtctgc

SEQ ID NO: 7110361 - DNA, 22 bp, Homo sapiens
ccctgagagcagggtctttctc

SEQ ID NO: 7110362 - DNA, 22 bp, Homo sapiens
ccctgagaggttgagtgtctgc

SEQ ID NO: 7110363 - DNA, 20 bp, Homo sapiens
ccctgagaccagagagcagc

SEQ ID NO: 7110364 - DNA, 20 bp, Homo sapiens
ccctgagaccagagagcagc

SEQ ID NO: 7110365 - DNA, 20 bp, Homo sapiens
ccctgagacaaaggaggggc

SEQ ID NO: 7110366 - DNA, 22 bp, Homo sapiens
ccctgaccatcccgcactgact

SEQ ID NO: 7110367 - DNA, 22 bp, Homo sapiens
ccctgacccaaaactgtcagaa

SEQ ID NO: 7110368 - DNA, 22 bp, Homo sapiens
ccctgacccaaaactgtcagaa

SEQ ID NO: 7110369 - DNA, 20 bp, Homo sapiens
ccctgagacaaaggaggggc

SEQ ID NO: 7110370 - DNA, 20 bp, Homo sapiens
ccctgagacaaaggaggggc

SEQ ID NO: 7110371 - DNA, 22 bp, Homo sapiens
ccctctcctggctgcatggagc

SEQ ID NO: 7110372 - DNA, 22 bp, Homo sapiens
ccctctcctggctgcatggagc

SEQ ID NO: 7110373 - DNA, 18 bp, Homo sapiens
ccctctcctgctagtggg

SEQ ID NO: 7110374 - DNA, 18 bp, Homo sapiens
ccctctcctgctagtggg

SEQ ID NO: 7110375 - DNA, 18 bp, Homo sapiens
ccctctcctgctagtggg

SEQ ID NO: 7110376 - DNA, 22 bp, Homo sapiens
ccctctcctggctgcatggagc

SEQ ID NO: 7110377 - DNA, 22 bp, Homo sapiens
ccctctacagggaagcgctttc

SEQ ID NO: 7110378 - DNA, 22 bp, Homo sapiens
ccctctccctgcagaatgtggc

SEQ ID NO: 7110379 - DNA, 22 bp, Homo sapiens
ccctctccctgcagaatgtggc

SEQ ID NO: 7110380 - DNA, 22 bp, Homo sapiens
ccctctccctgcagaatgtggc

SEQ ID NO: 7110381 - DNA, 22 bp, Homo sapiens
ccctctccctgcagaatgtggc

SEQ ID NO: 7110382 - DNA, 18 bp, Homo sapiens
ccctctcctgctagtggg

SEQ ID NO: 7110383 - DNA, 18 bp, Homo sapiens
ccctctcctgctagtggg

SEQ ID NO: 7110384 - DNA, 19 bp, Homo sapiens
ccctcttgcacaaagcaaa

SEQ ID NO: 7110385 - DNA, 22 bp, Homo sapiens
ccctctctcaggctgacagcct

SEQ ID NO: 7110386 - DNA, 22 bp, Homo sapiens
ccctctctcaggctgacagcct

SEQ ID NO: 7110387 - DNA, 22 bp, Homo sapiens
ccctctcctggctgcatggagc

SEQ ID NO: 7110388 - DNA, 22 bp, Homo sapiens
ccctctcgcggggcagcggagg

SEQ ID NO: 7110389 - DNA, 22 bp, Homo sapiens
ccctctctcaggctgacagcct

SEQ ID NO: 7110390 - DNA, 22 bp, Homo sapiens
ccctctctcaggctgacagcct

SEQ ID NO: 7110391 - DNA, 22 bp, Homo sapiens
ccctcttgctgactcttaaagg

SEQ ID NO: 7110392 - DNA, 19 bp, Homo sapiens
ccctcttgcacaaagcaaa

SEQ ID NO: 7110393 - DNA, 22 bp, Homo sapiens
ccctgaaatcctgtgctctgtg

SEQ ID NO: 7110394 - DNA, 22 bp, Homo sapiens
ccctgaacaaagcccaggctct

SEQ ID NO: 7110395 - DNA, 22 bp, Homo sapiens
tggagcaaattcaagctcatct

SEQ ID NO: 7110396 - DNA, 19 bp, Homo sapiens
tggagcacctaggaataga

SEQ ID NO: 7110397 - DNA, 22 bp, Homo sapiens
tggagcagaaatggcctcttgt

SEQ ID NO: 7110398 - DNA, 22 bp, Homo sapiens
ccctgaggaccaggaaggaggg

SEQ ID NO: 7110399 - DNA, 22 bp, Homo sapiens
ccctgaggaaagggtggagggc

SEQ ID NO: 7110400 - DNA, 22 bp, Homo sapiens
ccctgaggaaagggtggagggc

SEQ ID NO: 7110401 - DNA, 23 bp, Homo sapiens
ccctgagctggtccaggctcaac

SEQ ID NO: 7110402 - DNA, 23 bp, Homo sapiens
ccctgagctggtccaggctcaac

SEQ ID NO: 7110403 - DNA, 22 bp, Homo sapiens
ccctgagctcaggcccttgggg

SEQ ID NO: 7110404 - DNA, 23 bp, Homo sapiens
ccctgagctggtccaggctcaac

SEQ ID NO: 7110405 - DNA, 22 bp, Homo sapiens
tggagcaggacggggagtggta

SEQ ID NO: 7110406 - DNA, 22 bp, Homo sapiens
tggagcaggacggggagtggta

SEQ ID NO: 7110407 - DNA, 22 bp, Homo sapiens
tggagcaggacggggagtggta

SEQ ID NO: 7110408 - DNA, 22 bp, Homo sapiens
tggagcaggactgctgccctca

SEQ ID NO: 7110409 - DNA, 22 bp, Homo sapiens
tggagcaggactgctgccctca

SEQ ID NO: 7110410 - DNA, 22 bp, Homo sapiens
tggagcaggactgctgccctca

SEQ ID NO: 7110411 - DNA, 16 bp, Homo sapiens
tggagcaggcaggatg

SEQ ID NO: 7110412 - DNA, 22 bp, Homo sapiens
tggagcaggcatctttctctct

SEQ ID NO: 7110413 - DNA, 22 bp, Homo sapiens
ccctgagccgctgctccaacct

SEQ ID NO: 7110414 - DNA, 22 bp, Homo sapiens
ccctgagccgctgctccaacct

SEQ ID NO: 7110415 - DNA, 22 bp, Homo sapiens
ccctgagcgtgaggaggaagta

SEQ ID NO: 7110416 - DNA, 22 bp, Homo sapiens
ccctgagccgcctgccgtgtcc

SEQ ID NO: 7110417 - DNA, 22 bp, Homo sapiens
ccctgagcccatagttgacatt

SEQ ID NO: 7110418 - DNA, 22 bp, Homo sapiens
ccctgagccacacagagcaggt

SEQ ID NO: 7110419 - DNA, 22 bp, Homo sapiens
ccctgagcattcatgtgagctt

SEQ ID NO: 7110420 - DNA, 22 bp, Homo sapiens
ccctgagccacacagagcaggt

SEQ ID NO: 7110421 - DNA, 22 bp, Homo sapiens
ccctgagcattcatgtgagctt

SEQ ID NO: 7110422 - DNA, 22 bp, Homo sapiens
ccctgagcagtctgcagagagc

SEQ ID NO: 7110423 - DNA, 22 bp, Homo sapiens
ccctgagcacacctggcagaca

SEQ ID NO: 7110424 - DNA, 22 bp, Homo sapiens
ccctgagcacacctggcagaca

SEQ ID NO: 7110425 - DNA, 22 bp, Homo sapiens
ccctgagatgcctcaccctagt

SEQ ID NO: 7110426 - DNA, 22 bp, Homo sapiens
catgacattttaaaaagaacat

SEQ ID NO: 7110427 - DNA, 22 bp, Homo sapiens
catgacatctgcttagtatgaa

SEQ ID NO: 7110428 - DNA, 22 bp, Homo sapiens
catgacattttaaaaagaacat

SEQ ID NO: 7110429 - DNA, 22 bp, Homo sapiens
catgagaaccaggtctgtgttt

SEQ ID NO: 7110430 - DNA, 22 bp, Homo sapiens
catgagaaccaggtctgtgttt

SEQ ID NO: 7110431 - DNA, 20 bp, Homo sapiens
catgacactgttcctctgcc

SEQ ID NO: 7110432 - DNA, 22 bp, Homo sapiens
catgacagatgcaaaggattgg

SEQ ID NO: 7110433 - DNA, 22 bp, Homo sapiens
catgacagtcctgaagagaacg

SEQ ID NO: 7110434 - DNA, 22 bp, Homo sapiens
catgacagtcctgaagagaacg

SEQ ID NO: 7110435 - DNA, 22 bp, Homo sapiens
catgacatcctgaagctgcaca

SEQ ID NO: 7110436 - DNA, 22 bp, Homo sapiens
catgcacacacagttctaatta

SEQ ID NO: 7110437 - DNA, 22 bp, Homo sapiens
catgcacacacgtgcatgtacg

SEQ ID NO: 7110438 - DNA, 22 bp, Homo sapiens
catgcacacacgtgcatgtacg

SEQ ID NO: 7110439 - DNA, 22 bp, Homo sapiens
catgcacacacgtgcatgtacg

SEQ ID NO: 7110440 - DNA, 22 bp, Homo sapiens
catgcacactgcaacaaggact

SEQ ID NO: 7110441 - DNA, 22 bp, Homo sapiens
catgcaggcctatggagcagtg

SEQ ID NO: 7110442 - DNA, 22 bp, Homo sapiens
catgaatatttagtatttactt

SEQ ID NO: 7110443 - DNA, 22 bp, Homo sapiens
catgaatatacatcctgatggc

SEQ ID NO: 7110444 - DNA, 22 bp, Homo sapiens
catgaatgctgggttcatgtaa

SEQ ID NO: 7110445 - DNA, 23 bp, Homo sapiens
catgacaaaggatctcatgggcc

SEQ ID NO: 7110446 - DNA, 22 bp, Homo sapiens
catgacaaataaacctttgcca

SEQ ID NO: 7110447 - DNA, 22 bp, Homo sapiens
catgacaaatcagaggggcttg

SEQ ID NO: 7110448 - DNA, 22 bp, Homo sapiens
catgacaaatcagaggggcttg

SEQ ID NO: 7110449 - DNA, 22 bp, Homo sapiens
catgacaataagccagcagaaa

SEQ ID NO: 7110450 - DNA, 22 bp, Homo sapiens
catgacaatatgttctttcatt

SEQ ID NO: 7110451 - DNA, 22 bp, Homo sapiens
catgcatatgtcaaaaaagcta

SEQ ID NO: 7110452 - DNA, 22 bp, Homo sapiens
catgcatatgtcaaaaaagcta

SEQ ID NO: 7110453 - DNA, 22 bp, Homo sapiens
catgcatattactagcacagca

SEQ ID NO: 7110454 - DNA, 22 bp, Homo sapiens
catgcatatatgctacatgcaa

SEQ ID NO: 7110455 - DNA, 22 bp, Homo sapiens
catgcatatgtcaaaaaagcta

SEQ ID NO: 7110456 - DNA, 22 bp, Homo sapiens
catgcatagccagcattgtatg

SEQ ID NO: 7110457 - DNA, 22 bp, Homo sapiens
catgcatagctttggagctagg

SEQ ID NO: 7110458 - DNA, 22 bp, Homo sapiens
catgcatagctttggagctagg

SEQ ID NO: 7110459 - DNA, 22 bp, Homo sapiens
catgcataggaaatgttttttg

SEQ ID NO: 7110460 - DNA, 22 bp, Homo sapiens
catgcataggaaatgttttttg

SEQ ID NO: 7110461 - DNA, 22 bp, Homo sapiens
catgcatagtttttctagaagg

SEQ ID NO: 7110462 - DNA, 22 bp, Homo sapiens
catgcatagtttttctagaagg

SEQ ID NO: 7110463 - DNA, 22 bp, Homo sapiens
catgcatagtttttctagaagg

SEQ ID NO: 7110464 - DNA, 22 bp, Homo sapiens
catgcatatatgctacatgcaa

SEQ ID NO: 7110465 - DNA, 22 bp, Homo sapiens
catgcatattactagcacagca

SEQ ID NO: 7110466 - DNA, 22 bp, Homo sapiens
catgcatgccgggctgacagag

SEQ ID NO: 7110467 - DNA, 22 bp, Homo sapiens
catgcagtgcctctggattctt

SEQ ID NO: 7110468 - DNA, 22 bp, Homo sapiens
catgcagtgcctctggattctt

SEQ ID NO: 7110469 - DNA, 22 bp, Homo sapiens
catgcagtgcctctggattctt

SEQ ID NO: 7110470 - DNA, 22 bp, Homo sapiens
catgcagtgctttgcgccgggc

SEQ ID NO: 7110471 - DNA, 22 bp, Homo sapiens
catgcagtggtaaaaagtcagg

SEQ ID NO: 7110472 - DNA, 22 bp, Homo sapiens
catgcagtgtgtatctacttaa

SEQ ID NO: 7110473 - DNA, 22 bp, Homo sapiens
catgcagttgaagcacagagag

SEQ ID NO: 7110474 - DNA, 22 bp, Homo sapiens
catgcagttgaagcacagagag

SEQ ID NO: 7110475 - DNA, 22 bp, Homo sapiens
catgcagttgaagcacagagag

SEQ ID NO: 7110476 - DNA, 22 bp, Homo sapiens
catgcagtttctctatgcgtag

SEQ ID NO: 7110477 - DNA, 22 bp, Homo sapiens
catgcagtttctctatgcgtag

SEQ ID NO: 7110478 - DNA, 22 bp, Homo sapiens
catgcagtttctctatgcgtag

SEQ ID NO: 7110479 - DNA, 16 bp, Homo sapiens
catgcataaacgatgg

SEQ ID NO: 7110480 - DNA, 22 bp, Homo sapiens
catgcatacacaggtcaggcag

SEQ ID NO: 7110481 - DNA, 22 bp, Homo sapiens
catgcatacacaggtcaggcag

SEQ ID NO: 7110482 - DNA, 16 bp, Homo sapiens
catgcataaacgatgg

SEQ ID NO: 7110483 - DNA, 21 bp, Homo sapiens
catgcatacatatacaagctt

SEQ ID NO: 7110484 - DNA, 21 bp, Homo sapiens
catgcatacatatacaagctt

SEQ ID NO: 7110485 - DNA, 22 bp, Homo sapiens
catgcatagaatgaagaggctg

SEQ ID NO: 7110486 - DNA, 22 bp, Homo sapiens
catgcatagaatgaagaggctg

SEQ ID NO: 7110487 - DNA, 21 bp, Homo sapiens
catgcatacatatacaagctt

SEQ ID NO: 7110488 - DNA, 22 bp, Homo sapiens
catgcatagagcagaacttggc

SEQ ID NO: 7110489 - DNA, 22 bp, Homo sapiens
catgcatagagcagaacttggc

SEQ ID NO: 7110490 - DNA, 22 bp, Homo sapiens
catgcatagccagcattgtatg

SEQ ID NO: 7110491 - DNA, 22 bp, Homo sapiens
catgcagggactagagaacagg

SEQ ID NO: 7110492 - DNA, 22 bp, Homo sapiens
catgcagggactagagaacagg

SEQ ID NO: 7110493 - DNA, 22 bp, Homo sapiens
catgcagggactagagaacagg

SEQ ID NO: 7110494 - DNA, 22 bp, Homo sapiens
catgcagggagcagaggagaca

SEQ ID NO: 7110495 - DNA, 22 bp, Homo sapiens
catgcagggacttgtgctccat

SEQ ID NO: 7110496 - DNA, 22 bp, Homo sapiens
catgcagggacttgtgctccat

SEQ ID NO: 7110497 - DNA, 22 bp, Homo sapiens
catgcagggagcagaggagaca

SEQ ID NO: 7110498 - DNA, 22 bp, Homo sapiens
catgcagggagcagaggagaca

SEQ ID NO: 7110499 - DNA, 22 bp, Homo sapiens
catgcaggtctggagcttgggg

SEQ ID NO: 7110500 - DNA, 22 bp, Homo sapiens
catgcaggtctggagcttgggg

SEQ ID NO: 7110501 - DNA, 22 bp, Homo sapiens
catgcaggtctggagcttgggg

SEQ ID NO: 7110502 - DNA, 22 bp, Homo sapiens
catgcaggtgaccaggtgtggg

SEQ ID NO: 7110503 - DNA, 22 bp, Homo sapiens
catgcagtgactcagacacagg

SEQ ID NO: 7110504 - DNA, 22 bp, Homo sapiens
catgcagtgatgcactgcatca

SEQ ID NO: 7110505 - DNA, 22 bp, Homo sapiens
catgcagtgatgcactgcatca

SEQ ID NO: 7110506 - DNA, 22 bp, Homo sapiens
catgcagtgactcagacacagg

SEQ ID NO: 7110507 - DNA, 22 bp, Homo sapiens
catgcagtgactcagacacagg

SEQ ID NO: 7110508 - DNA, 22 bp, Homo sapiens
catgcagtgaaattgatatcca

SEQ ID NO: 7110509 - DNA, 22 bp, Homo sapiens
catgcagtgaaattgatatcca

SEQ ID NO: 7110510 - DNA, 22 bp, Homo sapiens
catgcagtctggagccttctgt

SEQ ID NO: 7110511 - DNA, 22 bp, Homo sapiens
catgcagtctggagccttctgt

SEQ ID NO: 7110512 - DNA, 22 bp, Homo sapiens
catgcagtgaaattgatatcca

SEQ ID NO: 7110513 - DNA, 22 bp, Homo sapiens
catgcaggttatatgtgcttct

SEQ ID NO: 7110514 - DNA, 22 bp, Homo sapiens
catgcaggttatatgtgcttct

SEQ ID NO: 7110515 - DNA, 22 bp, Homo sapiens
catgcagtattcaggacagttc

SEQ ID NO: 7110516 - DNA, 22 bp, Homo sapiens
catgcagtcaataaacatgtgt

SEQ ID NO: 7110517 - DNA, 22 bp, Homo sapiens
catgcagtcaataaacatgtgt

SEQ ID NO: 7110518 - DNA, 22 bp, Homo sapiens
catggccagcccccagttcctc

SEQ ID NO: 7110519 - DNA, 22 bp, Homo sapiens
catggccacatctagctgcaag

SEQ ID NO: 7110520 - DNA, 22 bp, Homo sapiens
catggccacatctagctgcaag

SEQ ID NO: 7110521 - DNA, 22 bp, Homo sapiens
catggccacatctagctgcaag

SEQ ID NO: 7110522 - DNA, 22 bp, Homo sapiens
catggccaaggatgctcaacca

SEQ ID NO: 7110523 - DNA, 22 bp, Homo sapiens
catggccacatctagctgcaag

SEQ ID NO: 7110524 - DNA, 22 bp, Homo sapiens
catggcattttttcatggagac

SEQ ID NO: 7110525 - DNA, 22 bp, Homo sapiens
catggcattttttcatggagac

SEQ ID NO: 7110526 - DNA, 22 bp, Homo sapiens
catggccaaagaattatatttt

SEQ ID NO: 7110527 - DNA, 20 bp, Homo sapiens
tccagctgggaacagctgat

SEQ ID NO: 7110528 - DNA, 22 bp, Homo sapiens
tccaggagaaggccatccagcg

SEQ ID NO: 7110529 - DNA, 23 bp, Homo sapiens
tccaggagaattccagggcccgg

SEQ ID NO: 7110530 - DNA, 22 bp, Homo sapiens
catggcagggctgtgggcaggt

SEQ ID NO: 7110531 - DNA, 22 bp, Homo sapiens
catggcagggctgtgggcaggt

SEQ ID NO: 7110532 - DNA, 22 bp, Homo sapiens
catggcagggctgtgggcaggt

SEQ ID NO: 7110533 - DNA, 22 bp, Homo sapiens
catggcaggtgcagattctgtg

SEQ ID NO: 7110534 - DNA, 22 bp, Homo sapiens
catggcaggtgcagattctgtg

SEQ ID NO: 7110535 - DNA, 22 bp, Homo sapiens
catggcaggtgcagattctgtg

SEQ ID NO: 7110536 - DNA, 22 bp, Homo sapiens
catggcagtgattcagcctttg

SEQ ID NO: 7110537 - DNA, 22 bp, Homo sapiens
catggcagtgattcagcctttg

SEQ ID NO: 7110538 - DNA, 22 bp, Homo sapiens
catggcagtgattcagcctttg

SEQ ID NO: 7110539 - DNA, 22 bp, Homo sapiens
catggcagtgattcagcctttg

SEQ ID NO: 7110540 - DNA, 22 bp, Homo sapiens
catggcagtgattcagcctttg

SEQ ID NO: 7110541 - DNA, 22 bp, Homo sapiens
catggcagtgattcagcctttg

SEQ ID NO: 7110542 - DNA, 22 bp, Homo sapiens
catggcattgcataacggggct

SEQ ID NO: 7110543 - DNA, 22 bp, Homo sapiens
catggcattgcataacggggct

SEQ ID NO: 7110544 - DNA, 22 bp, Homo sapiens
catggcattgcataacggggct

SEQ ID NO: 7110545 - DNA, 22 bp, Homo sapiens
catggcattgcataacggggct

SEQ ID NO: 7110546 - DNA, 22 bp, Homo sapiens
catggcattgcataacggggct

SEQ ID NO: 7110547 - DNA, 22 bp, Homo sapiens
catggcaggaggctgctggcag

SEQ ID NO: 7110548 - DNA, 22 bp, Homo sapiens
catggcaggaggctgctggcag

SEQ ID NO: 7110549 - DNA, 22 bp, Homo sapiens
catggcaggaaggacatgcact

SEQ ID NO: 7110550 - DNA, 22 bp, Homo sapiens
catggcaggaaggacatgcact

SEQ ID NO: 7110551 - DNA, 22 bp, Homo sapiens
catggcagggctgtgggcaggt

SEQ ID NO: 7110552 - DNA, 22 bp, Homo sapiens
catggcagggctgtgggcaggt

SEQ ID NO: 7110553 - DNA, 22 bp, Homo sapiens
catggcagggctgtgggcaggt

SEQ ID NO: 7110554 - DNA, 22 bp, Homo sapiens
catggcaggcttcttcagcctt

SEQ ID NO: 7110555 - DNA, 22 bp, Homo sapiens
catggcagggctgtgggcaggt

SEQ ID NO: 7110556 - DNA, 22 bp, Homo sapiens
catggcagggctgtgggcaggt

SEQ ID NO: 7110557 - DNA, 22 bp, Homo sapiens
catggcaggatctgggcccaca

SEQ ID NO: 7110558 - DNA, 22 bp, Homo sapiens
catggcaggatctgggcccaca

SEQ ID NO: 7110559 - DNA, 22 bp, Homo sapiens
catggcaggaaggacatgcact

SEQ ID NO: 7110560 - DNA, 22 bp, Homo sapiens
catggcaggaaggacatgcact

SEQ ID NO: 7110561 - DNA, 22 bp, Homo sapiens
catggcaggaaggacatgcact

SEQ ID NO: 7110562 - DNA, 22 bp, Homo sapiens
catggcaggaaaatgaacaggc

SEQ ID NO: 7110563 - DNA, 22 bp, Homo sapiens
catggcaggaaaatgaacaggc

SEQ ID NO: 7110564 - DNA, 22 bp, Homo sapiens
catggcaggaaggacatgcact

SEQ ID NO: 7110565 - DNA, 22 bp, Homo sapiens
catggcaggaaaatgaacaggc

SEQ ID NO: 7110566 - DNA, 22 bp, Homo sapiens
catggcaggaaaatgaacaggc

SEQ ID NO: 7110567 - DNA, 22 bp, Homo sapiens
catggcaggaaaatgaacaggc

SEQ ID NO: 7110568 - DNA, 22 bp, Homo sapiens
catggcagctttgggaggagga

SEQ ID NO: 7110569 - DNA, 22 bp, Homo sapiens
catggcagctttgggaggagga

SEQ ID NO: 7110570 - DNA, 22 bp, Homo sapiens
catggcagctttgggaggagga

SEQ ID NO: 7110571 - DNA, 22 bp, Homo sapiens
catggcagctttgggaggagga

SEQ ID NO: 7110572 - DNA, 22 bp, Homo sapiens
catggcagctttgggaggagga

SEQ ID NO: 7110573 - DNA, 22 bp, Homo sapiens
catggcagagcctgcaggtggg

SEQ ID NO: 7110574 - DNA, 23 bp, Homo sapiens
catggcagcaagagctcatggcc

SEQ ID NO: 7110575 - DNA, 23 bp, Homo sapiens
catggcagcaagagctcatggcc

SEQ ID NO: 7110576 - DNA, 23 bp, Homo sapiens
catggcagcaagagctcatggcc

SEQ ID NO: 7110577 - DNA, 23 bp, Homo sapiens
catggcagcaagagctcatggcc

SEQ ID NO: 7110578 - DNA, 23 bp, Homo sapiens
catggcagcaagagctcatggcc

SEQ ID NO: 7110579 - DNA, 22 bp, Homo sapiens
catggcagcctgccctgcttgc

SEQ ID NO: 7110580 - DNA, 22 bp, Homo sapiens
catggcagcctgccctgcttgc

SEQ ID NO: 7110581 - DNA, 22 bp, Homo sapiens
catggcagcctgccctgcttgc

SEQ ID NO: 7110582 - DNA, 22 bp, Homo sapiens
catggcagctcctccagtgtga

SEQ ID NO: 7110583 - DNA, 22 bp, Homo sapiens
catggcagctcctccagtgtga

SEQ ID NO: 7110584 - DNA, 22 bp, Homo sapiens
catggcagagcctgcaggtggg

SEQ ID NO: 7110585 - DNA, 22 bp, Homo sapiens
catggcagagcctgcaggtggg

SEQ ID NO: 7110586 - DNA, 22 bp, Homo sapiens
catggcagagcctgcaggtggg

SEQ ID NO: 7110587 - DNA, 22 bp, Homo sapiens
catggcagagcctgcaggtggg

SEQ ID NO: 7110588 - DNA, 22 bp, Homo sapiens
catggaaggcaaaagacacaga

SEQ ID NO: 7110589 - DNA, 22 bp, Homo sapiens
catggcagagaaggggaactgg

SEQ ID NO: 7110590 - DNA, 22 bp, Homo sapiens
catgcatttctaccaaggaata

SEQ ID NO: 7110591 - DNA, 22 bp, Homo sapiens
catgcatttctaccaaggaata

SEQ ID NO: 7110592 - DNA, 22 bp, Homo sapiens
catgcatttggagttttcaagt

SEQ ID NO: 7110593 - DNA, 22 bp, Homo sapiens
catgcatttggagttttcaagt

SEQ ID NO: 7110594 - DNA, 22 bp, Homo sapiens
catgcattttctattcactcag

SEQ ID NO: 7110595 - DNA, 22 bp, Homo sapiens
catgcattttctattcactcag

SEQ ID NO: 7110596 - DNA, 22 bp, Homo sapiens
catgcattttctattcactcag

SEQ ID NO: 7110597 - DNA, 22 bp, Homo sapiens
catggaaggcaaaagacacaga

SEQ ID NO: 7110598 - DNA, 22 bp, Homo sapiens
catggaaggcaaaagacacaga

SEQ ID NO: 7110599 - DNA, 22 bp, Homo sapiens
catgcatgcctggctcacagag

SEQ ID NO: 7110600 - DNA, 22 bp, Homo sapiens
catgcatggagctcaccctccc

SEQ ID NO: 7110601 - DNA, 22 bp, Homo sapiens
catgcatggtcatgctgggact

SEQ ID NO: 7110602 - DNA, 22 bp, Homo sapiens
catgcatggtcatgctgggact

SEQ ID NO: 7110603 - DNA, 22 bp, Homo sapiens
catgcatgtcagggatcctgga

SEQ ID NO: 7110604 - DNA, 22 bp, Homo sapiens
catgcatgtttactacagtgac

SEQ ID NO: 7110605 - DNA, 22 bp, Homo sapiens
catgcattacaattgcatagta

SEQ ID NO: 7110606 - DNA, 22 bp, Homo sapiens
catgcattacaattgcatagta

SEQ ID NO: 7110607 - DNA, 22 bp, Homo sapiens
catgcattcagaatctctcaca

SEQ ID NO: 7110608 - DNA, 22 bp, Homo sapiens
catgcattcagaatctctcaca

SEQ ID NO: 7110609 - DNA, 22 bp, Homo sapiens
catgcattcagaatctctcaca

SEQ ID NO: 7110610 - DNA, 22 bp, Homo sapiens
catgcattcctcctctgcctta

SEQ ID NO: 7110611 - DNA, 22 bp, Homo sapiens
catgcattcctcctctgcctta

SEQ ID NO: 7110612 - DNA, 22 bp, Homo sapiens
catgcattgtaatttttagtct

SEQ ID NO: 7110613 - DNA, 22 bp, Homo sapiens
catgcattgtaatttttagtct

SEQ ID NO: 7110614 - DNA, 22 bp, Homo sapiens
catgaagcatgttttgtcatga

SEQ ID NO: 7110615 - DNA, 22 bp, Homo sapiens
catgaacatttgtttacatctg

SEQ ID NO: 7110616 - DNA, 22 bp, Homo sapiens
catgaacattgcagggatgtga

SEQ ID NO: 7110617 - DNA, 22 bp, Homo sapiens
catgaacattgcagggatgtga

SEQ ID NO: 7110618 - DNA, 22 bp, Homo sapiens
catgaacatttgtttacatctg

SEQ ID NO: 7110619 - DNA, 22 bp, Homo sapiens
catgaactccaagcttccttcc

SEQ ID NO: 7110620 - DNA, 22 bp, Homo sapiens
catgaagatcctgtatgttttt

SEQ ID NO: 7110621 - DNA, 22 bp, Homo sapiens
catgaacaaattctgtttgagg

SEQ ID NO: 7110622 - DNA, 22 bp, Homo sapiens
catgaacaatttgctcactgat

SEQ ID NO: 7110623 - DNA, 22 bp, Homo sapiens
catgaacaatttgctcactgat

SEQ ID NO: 7110624 - DNA, 22 bp, Homo sapiens
catgaacaaattctgtttgagg

SEQ ID NO: 7110625 - DNA, 22 bp, Homo sapiens
catgaacaatttgctcactgat

SEQ ID NO: 7110626 - DNA, 22 bp, Homo sapiens
catgaacaccaggcatgaacaa

SEQ ID NO: 7110627 - DNA, 22 bp, Homo sapiens
catgaacaccaggcatgaacaa

SEQ ID NO: 7110628 - DNA, 22 bp, Homo sapiens
catgaacagattcttcatttct

SEQ ID NO: 7110629 - DNA, 22 bp, Homo sapiens
catgaacagattcttcatttct

SEQ ID NO: 7110630 - DNA, 22 bp, Homo sapiens
catgaacagctaacattttggg

SEQ ID NO: 7110631 - DNA, 22 bp, Homo sapiens
catgaacagctaacattttggg

SEQ ID NO: 7110632 - DNA, 22 bp, Homo sapiens
catgaacagctaacattttggg

SEQ ID NO: 7110633 - DNA, 21 bp, Homo sapiens
catgaacatgcttatcctcag

SEQ ID NO: 7110634 - DNA, 22 bp, Homo sapiens
catgaacattcagaaatacagc

SEQ ID NO: 7110635 - DNA, 22 bp, Homo sapiens
catgaacattcagaaatacagc

SEQ ID NO: 7110636 - DNA, 22 bp, Homo sapiens
catgaaattgctcctttggtgc

SEQ ID NO: 7110637 - DNA, 22 bp, Homo sapiens
catgaaattgtattggcctcaa

SEQ ID NO: 7110638 - DNA, 22 bp, Homo sapiens
catgaaattgtattggcctcaa

SEQ ID NO: 7110639 - DNA, 22 bp, Homo sapiens
catgaaatttgaagtacagcaa

SEQ ID NO: 7110640 - DNA, 22 bp, Homo sapiens
catgaaatttgaagtacagcaa

SEQ ID NO: 7110641 - DNA, 22 bp, Homo sapiens
catgaaatttgaagtacagcaa

SEQ ID NO: 7110642 - DNA, 22 bp, Homo sapiens
catgaacaaatcctgcgagtat

SEQ ID NO: 7110643 - DNA, 22 bp, Homo sapiens
catgaaaataacattgttgtga

SEQ ID NO: 7110644 - DNA, 22 bp, Homo sapiens
catgaaattgctcctttggtgc

SEQ ID NO: 7110645 - DNA, 22 bp, Homo sapiens
catgaaattgctcctttggtgc

SEQ ID NO: 7110646 - DNA, 22 bp, Homo sapiens
catcttaaattaaagcttaagg

SEQ ID NO: 7110647 - DNA, 22 bp, Homo sapiens
catcttaaattaaagcttaagg

SEQ ID NO: 7110648 - DNA, 22 bp, Homo sapiens
catctgtttcctaatctgtagc

SEQ ID NO: 7110649 - DNA, 22 bp, Homo sapiens
catcttaaaatgtgtcataact

SEQ ID NO: 7110650 - DNA, 22 bp, Homo sapiens
catcttaaaatgtgtcataact

SEQ ID NO: 7110651 - DNA, 22 bp, Homo sapiens
catctgtcatcaaccctggcta

SEQ ID NO: 7110652 - DNA, 22 bp, Homo sapiens
catctgttaaagtctaatgaaa

SEQ ID NO: 7110653 - DNA, 19 bp, Homo sapiens
catctggatgattctcctg

SEQ ID NO: 7110654 - DNA, 19 bp, Homo sapiens
catctggatgattctcctg

SEQ ID NO: 7110655 - DNA, 19 bp, Homo sapiens
catctggatgattctcctg

SEQ ID NO: 7110656 - DNA, 19 bp, Homo sapiens
catctggatgattctcctg

SEQ ID NO: 7110657 - DNA, 22 bp, Homo sapiens
catctgctgttccttggactca

SEQ ID NO: 7110658 - DNA, 23 bp, Homo sapiens
catctggggacatcattaggctg

SEQ ID NO: 7110659 - DNA, 22 bp, Homo sapiens
catctgggactgtcaggttagc

SEQ ID NO: 7110660 - DNA, 22 bp, Homo sapiens
catctgggttctcagatggata

SEQ ID NO: 7110661 - DNA, 22 bp, Homo sapiens
catctggttagttgatgaaact

SEQ ID NO: 7110662 - DNA, 22 bp, Homo sapiens
catctggtttaaaagaagaaag

SEQ ID NO: 7110663 - DNA, 22 bp, Homo sapiens
catctgtaaagtaggaatattg

SEQ ID NO: 7110664 - DNA, 22 bp, Homo sapiens
catctgtaaggaagaggatcaa

SEQ ID NO: 7110665 - DNA, 22 bp, Homo sapiens
catctgtagctccatgacaatt

SEQ ID NO: 7110666 - DNA, 22 bp, Homo sapiens
catctgtaggtgacacatgagt

SEQ ID NO: 7110667 - DNA, 22 bp, Homo sapiens
catctgctctgtctgccatgtt

SEQ ID NO: 7110668 - DNA, 22 bp, Homo sapiens
catctgctgacttgacaagtac

SEQ ID NO: 7110669 - DNA, 22 bp, Homo sapiens
catctgctgctgaagccagcat

SEQ ID NO: 7110670 - DNA, 22 bp, Homo sapiens
catctgctgtaattaacaagcc

SEQ ID NO: 7110671 - DNA, 22 bp, Homo sapiens
catctgctgttccttggactca

SEQ ID NO: 7110672 - DNA, 22 bp, Homo sapiens
catctgcctaagtggccctgtt

SEQ ID NO: 7110673 - DNA, 17 bp, Homo sapiens
catctgctctgcccctt

SEQ ID NO: 7110674 - DNA, 22 bp, Homo sapiens
catctgaatatcccaggcatat

SEQ ID NO: 7110675 - DNA, 22 bp, Homo sapiens
catctgaatatcccaggcatat

SEQ ID NO: 7110676 - DNA, 22 bp, Homo sapiens
catctgaataaagacttgcaga

SEQ ID NO: 7110677 - DNA, 22 bp, Homo sapiens
catctgatgggaatataagagc

SEQ ID NO: 7110678 - DNA, 22 bp, Homo sapiens
tcagggattaaggtcaaaggtg

SEQ ID NO: 7110679 - DNA, 22 bp, Homo sapiens
tcaggtgtatcatggagttgaa

SEQ ID NO: 7110680 - DNA, 22 bp, Homo sapiens
tcaggtgtatcatggagttgaa

SEQ ID NO: 7110681 - DNA, 22 bp, Homo sapiens
tcaggtgtattgatgtctgtga

SEQ ID NO: 7110682 - DNA, 22 bp, Homo sapiens
tcagtcaaggaaaaatacctcc

SEQ ID NO: 7110683 - DNA, 22 bp, Homo sapiens
tcagtcaatgccttcctgggca

SEQ ID NO: 7110684 - DNA, 22 bp, Homo sapiens
tcagtcacactcactgaggtag

SEQ ID NO: 7110685 - DNA, 22 bp, Homo sapiens
tcagtcacactcactgaggtag

SEQ ID NO: 7110686 - DNA, 22 bp, Homo sapiens
tcagtcaccaatgggaggagga

SEQ ID NO: 7110687 - DNA, 22 bp, Homo sapiens
tcagtcaccttgactatagctg

SEQ ID NO: 7110688 - DNA, 22 bp, Homo sapiens
tcagtcaccttgactatagctg

SEQ ID NO: 7110689 - DNA, 22 bp, Homo sapiens
tcagtcacttttgcctgctaca

SEQ ID NO: 7110690 - DNA, 22 bp, Homo sapiens
tcagtcacttttgcctgctaca

SEQ ID NO: 7110691 - DNA, 22 bp, Homo sapiens
tcagtcagggctgtgaactgcc

SEQ ID NO: 7110692 - DNA, 19 bp, Homo sapiens
tcagtcatatatctgcacc

SEQ ID NO: 7110693 - DNA, 22 bp, Homo sapiens
tcagtccactaagacccttgtt

SEQ ID NO: 7110694 - DNA, 22 bp, Homo sapiens
tcagtccagccatcatttattc

SEQ ID NO: 7110695 - DNA, 22 bp, Homo sapiens
tcagtccagctcctcatttccc

SEQ ID NO: 7110696 - DNA, 22 bp, Homo sapiens
tcagggagatttggggactcaa

SEQ ID NO: 7110697 - DNA, 22 bp, Homo sapiens
tcagggagcctggacttcaagg

SEQ ID NO: 7110698 - DNA, 22 bp, Homo sapiens
tcagggagatttggggactcaa

SEQ ID NO: 7110699 - DNA, 22 bp, Homo sapiens
tcagggagggacctgaggctgg

SEQ ID NO: 7110700 - DNA, 22 bp, Homo sapiens
tcagggagggacctgaggctgg

SEQ ID NO: 7110701 - DNA, 22 bp, Homo sapiens
tcagggagggacctgaggctgg

SEQ ID NO: 7110702 - DNA, 22 bp, Homo sapiens
tcagggagggacctgaggctgg

SEQ ID NO: 7110703 - DNA, 22 bp, Homo sapiens
tcagggaggtgtctgccagaga

SEQ ID NO: 7110704 - DNA, 22 bp, Homo sapiens
tcagggaggtgtctgccagaga

SEQ ID NO: 7110705 - DNA, 22 bp, Homo sapiens
tcagggagtagtttgtgctatg

SEQ ID NO: 7110706 - DNA, 22 bp, Homo sapiens
tcagggagtgttggcaggatca

SEQ ID NO: 7110707 - DNA, 22 bp, Homo sapiens
tcagggagtgttggcaggatca

SEQ ID NO: 7110708 - DNA, 19 bp, Homo sapiens
tcagggagtttacagcatg

SEQ ID NO: 7110709 - DNA, 19 bp, Homo sapiens
tcagggagtttacagcatg

SEQ ID NO: 7110710 - DNA, 22 bp, Homo sapiens
tcagtgctcaggggagccgagg

SEQ ID NO: 7110711 - DNA, 22 bp, Homo sapiens
tcagtgcctactttgatcaatt

SEQ ID NO: 7110712 - DNA, 22 bp, Homo sapiens
tcagtgcctactttgatcaatt

SEQ ID NO: 7110713 - DNA, 20 bp, Homo sapiens
tcagtgctcaggcaccaggt

SEQ ID NO: 7110714 - DNA, 20 bp, Homo sapiens
tcagtgctcaggcaccaggt

SEQ ID NO: 7110715 - DNA, 22 bp, Homo sapiens
tcagtgctgagtagcgtgcacc

SEQ ID NO: 7110716 - DNA, 22 bp, Homo sapiens
tcagtgctgagtagcgtgcacc

SEQ ID NO: 7110717 - DNA, 22 bp, Homo sapiens
tcagtgctgctttatgacagtt

SEQ ID NO: 7110718 - DNA, 22 bp, Homo sapiens
catctcacagcaaactgctgaa

SEQ ID NO: 7110719 - DNA, 22 bp, Homo sapiens
catctcactgaggggtttacaa

SEQ ID NO: 7110720 - DNA, 22 bp, Homo sapiens
catctcacttccctgcagcatc

SEQ ID NO: 7110721 - DNA, 22 bp, Homo sapiens
catctcaggtctgtggttcact

SEQ ID NO: 7110722 - DNA, 21 bp, Homo sapiens
catctcagtgggttggtggat

SEQ ID NO: 7110723 - DNA, 22 bp, Homo sapiens
catctcttgccaaagtttgacc

SEQ ID NO: 7110724 - DNA, 22 bp, Homo sapiens
tcagtcccttaaaggtggcagc

SEQ ID NO: 7110725 - DNA, 22 bp, Homo sapiens
tcagtcccttctccaggtcagc

SEQ ID NO: 7110726 - DNA, 22 bp, Homo sapiens
tcagtccctcgcaccctgccat

SEQ ID NO: 7110727 - DNA, 22 bp, Homo sapiens
tcagtccctcgcaccctgccat

SEQ ID NO: 7110728 - DNA, 21 bp, Homo sapiens
tcagtccctgggtgtgtccca

SEQ ID NO: 7110729 - DNA, 21 bp, Homo sapiens
tcagtccctgggtgtgtccca

SEQ ID NO: 7110730 - DNA, 21 bp, Homo sapiens
tcagtccctgggtgtgtccca

SEQ ID NO: 7110731 - DNA, 22 bp, Homo sapiens
tcagtgcattctaccaaaaggc

SEQ ID NO: 7110732 - DNA, 22 bp, Homo sapiens
tcagtgcattgttcattgtagg

SEQ ID NO: 7110733 - DNA, 22 bp, Homo sapiens
tcagtgccaattctgccatggg

SEQ ID NO: 7110734 - DNA, 22 bp, Homo sapiens
tcagtgccatgggcagacaggc

SEQ ID NO: 7110735 - DNA, 22 bp, Homo sapiens
tcagtcccaaggtcctgaggtg

SEQ ID NO: 7110736 - DNA, 22 bp, Homo sapiens
tcagtcccaaggtcctgaggtg

SEQ ID NO: 7110737 - DNA, 22 bp, Homo sapiens
tcagtccccagatgtgtgctgt

SEQ ID NO: 7110738 - DNA, 22 bp, Homo sapiens
tcagtccccagatgtgtgctgt

SEQ ID NO: 7110739 - DNA, 22 bp, Homo sapiens
tcagtccctaaggatatgggct

SEQ ID NO: 7110740 - DNA, 23 bp, Homo sapiens
tcagtcccaacagcttctcctgg

SEQ ID NO: 7110741 - DNA, 23 bp, Homo sapiens
tcagtcccaacagcttctcctgg

SEQ ID NO: 7110742 - DNA, 22 bp, Homo sapiens
tcagtcccaaggtcctgaggtg

SEQ ID NO: 7110743 - DNA, 19 bp, Homo sapiens
tcagtccagctgtgaagac

SEQ ID NO: 7110744 - DNA, 22 bp, Homo sapiens
tcagtccaggggctgtgatgtc

SEQ ID NO: 7110745 - DNA, 22 bp, Homo sapiens
tcaatcataatgaagtgaagaa

SEQ ID NO: 7110746 - DNA, 22 bp, Homo sapiens
tcaatctgtgtatgctgggagt

SEQ ID NO: 7110747 - DNA, 22 bp, Homo sapiens
tcaatgaaagagcatgcatttt

SEQ ID NO: 7110748 - DNA, 22 bp, Homo sapiens
tcaatgaaagagcatgcatttt

SEQ ID NO: 7110749 - DNA, 22 bp, Homo sapiens
tcaatcaatgtgtcagttccca

SEQ ID NO: 7110750 - DNA, 22 bp, Homo sapiens
tcaatcacgtgttccatgttct

SEQ ID NO: 7110751 - DNA, 22 bp, Homo sapiens
tcaatcacgtgttccatgttct

SEQ ID NO: 7110752 - DNA, 22 bp, Homo sapiens
tcaatcacgtgttccatgttct

SEQ ID NO: 7110753 - DNA, 22 bp, Homo sapiens
tcaatattcttctttagtagga

SEQ ID NO: 7110754 - DNA, 22 bp, Homo sapiens
tcaatatattccatgttttctc

SEQ ID NO: 7110755 - DNA, 22 bp, Homo sapiens
tcaatatattccatgttttctc

SEQ ID NO: 7110756 - DNA, 22 bp, Homo sapiens
tcaatatattccatgttttctc

SEQ ID NO: 7110757 - DNA, 22 bp, Homo sapiens
tcaatagattaggtattagatt

SEQ ID NO: 7110758 - DNA, 22 bp, Homo sapiens
tcaatagattaggtattagatt

SEQ ID NO: 7110759 - DNA, 22 bp, Homo sapiens
tcaatagattaggtattagatt

SEQ ID NO: 7110760 - DNA, 22 bp, Homo sapiens
tcaatagcaatcaagccttcca

SEQ ID NO: 7110761 - DNA, 22 bp, Homo sapiens
cagttgaaaagattttattctg

SEQ ID NO: 7110762 - DNA, 20 bp, Homo sapiens
cagttgaaataatttgtttg

SEQ ID NO: 7110763 - DNA, 22 bp, Homo sapiens
cagttgataataccagagagag

SEQ ID NO: 7110764 - DNA, 22 bp, Homo sapiens
cagttgataataccagagagag

SEQ ID NO: 7110765 - DNA, 21 bp, Homo sapiens
cagttgatagagatcttgagc

SEQ ID NO: 7110766 - DNA, 21 bp, Homo sapiens
cagttgatagagatcttgagc

SEQ ID NO: 7110767 - DNA, 22 bp, Homo sapiens
cagttgatatagaaaaaagtga

SEQ ID NO: 7110768 - DNA, 22 bp, Homo sapiens
cagttgatattgcagacaagca

SEQ ID NO: 7110769 - DNA, 22 bp, Homo sapiens
cagttgatcactataggcttca

SEQ ID NO: 7110770 - DNA, 22 bp, Homo sapiens
cagttgatgggactcatgtggg

SEQ ID NO: 7110771 - DNA, 22 bp, Homo sapiens
cagttgatgggactcatgtggg

SEQ ID NO: 7110772 - DNA, 22 bp, Homo sapiens
cagttgatattgcagacaagca

SEQ ID NO: 7110773 - DNA, 23 bp, Homo sapiens
cagttgatgttaccttccttaga

SEQ ID NO: 7110774 - DNA, 22 bp, Homo sapiens
cagttgatgtttagactctgca

SEQ ID NO: 7110775 - DNA, 22 bp, Homo sapiens
cagttgattgacttaagtacct

SEQ ID NO: 7110776 - DNA, 22 bp, Homo sapiens
cagttataagactaagctattc

SEQ ID NO: 7110777 - DNA, 22 bp, Homo sapiens
cagttataagactaagctattc

SEQ ID NO: 7110778 - DNA, 22 bp, Homo sapiens
cagttagcactcagtttccaga

SEQ ID NO: 7110779 - DNA, 22 bp, Homo sapiens
cagttagaggaggtaaagatgc

SEQ ID NO: 7110780 - DNA, 22 bp, Homo sapiens
cagttataagactaagctattc

SEQ ID NO: 7110781 - DNA, 22 bp, Homo sapiens
cagttctggaggctccacatct

SEQ ID NO: 7110782 - DNA, 22 bp, Homo sapiens
cagttcttatttggccagtgtc

SEQ ID NO: 7110783 - DNA, 22 bp, Homo sapiens
tcagagagttacacaaattgtt

SEQ ID NO: 7110784 - DNA, 22 bp, Homo sapiens
tcagagagtgcaaaatatagct

SEQ ID NO: 7110785 - DNA, 22 bp, Homo sapiens
tcagagagtgcaaaatatagct

SEQ ID NO: 7110786 - DNA, 22 bp, Homo sapiens
tcagagagttagtgtcttagct

SEQ ID NO: 7110787 - DNA, 22 bp, Homo sapiens
tcagagagttagtgtcttagct

SEQ ID NO: 7110788 - DNA, 22 bp, Homo sapiens
tcagagagttggaaagaattaa

SEQ ID NO: 7110789 - DNA, 22 bp, Homo sapiens
tcagagagttggaaagaattaa

SEQ ID NO: 7110790 - DNA, 22 bp, Homo sapiens
tcagagagttggaaagaattaa

SEQ ID NO: 7110791 - DNA, 22 bp, Homo sapiens
tcagagagttttcactagggtg

SEQ ID NO: 7110792 - DNA, 22 bp, Homo sapiens
tcagagagttttcactagggtg

SEQ ID NO: 7110793 - DNA, 22 bp, Homo sapiens
tcagagagttttcactagggtg

SEQ ID NO: 7110794 - DNA, 22 bp, Homo sapiens
tcagagatctggagtacaactg

SEQ ID NO: 7110795 - DNA, 22 bp, Homo sapiens
tcagagatcttcaggatgggac

SEQ ID NO: 7110796 - DNA, 22 bp, Homo sapiens
tcagagatctggagtacaactg

SEQ ID NO: 7110797 - DNA, 22 bp, Homo sapiens
tcagagatcttcaggatgggac

SEQ ID NO: 7110798 - DNA, 22 bp, Homo sapiens
tcagagatgcagtgccacctac

SEQ ID NO: 7110799 - DNA, 23 bp, Homo sapiens
tcagagatggaaagcagaccacg

SEQ ID NO: 7110800 - DNA, 23 bp, Homo sapiens
tcagagatggaaagcagaccacg

SEQ ID NO: 7110801 - DNA, 22 bp, Homo sapiens
tcagagatggagttagcagtga

SEQ ID NO: 7110802 - DNA, 22 bp, Homo sapiens
tcagagattcacgtcagtccca

SEQ ID NO: 7110803 - DNA, 22 bp, Homo sapiens
tcagagattcacgtcagtccca

SEQ ID NO: 7110804 - DNA, 22 bp, Homo sapiens
tcagagattcacgtcagtccca

SEQ ID NO: 7110805 - DNA, 22 bp, Homo sapiens
tcagagattgaaaacatatcca

SEQ ID NO: 7110806 - DNA, 18 bp, Homo sapiens
tcagagcaaacagaagcc

SEQ ID NO: 7110807 - DNA, 18 bp, Homo sapiens
tcagagcaaacagaagcc

SEQ ID NO: 7110808 - DNA, 22 bp, Homo sapiens
tcagagcaaattcctgtgagcc

SEQ ID NO: 7110809 - DNA, 22 bp, Homo sapiens
tcagagcaacttttcctgcttt

SEQ ID NO: 7110810 - DNA, 22 bp, Homo sapiens
tcagagcaacttttcctgcttt

SEQ ID NO: 7110811 - DNA, 17 bp, Homo sapiens
cagttggagacaagtcc

SEQ ID NO: 7110812 - DNA, 22 bp, Homo sapiens
cagttggaggaatgaggctgta

SEQ ID NO: 7110813 - DNA, 23 bp, Homo sapiens
cagttggaggtacagagacactg

SEQ ID NO: 7110814 - DNA, 22 bp, Homo sapiens
cagttggtcttcccttggagca

SEQ ID NO: 7110815 - DNA, 22 bp, Homo sapiens
cagttgatttttatggtgtgaa

SEQ ID NO: 7110816 - DNA, 22 bp, Homo sapiens
cagttgattgacttaagtacct

SEQ ID NO: 7110817 - DNA, 22 bp, Homo sapiens
cagttgcactagccacatttca

SEQ ID NO: 7110818 - DNA, 22 bp, Homo sapiens
cagttgcagaggcagagtgcta

SEQ ID NO: 7110819 - DNA, 22 bp, Homo sapiens
cagttgcagctgtgacattgcg

SEQ ID NO: 7110820 - DNA, 22 bp, Homo sapiens
cagttgcctactacatggcagg

SEQ ID NO: 7110821 - DNA, 22 bp, Homo sapiens
cagttgcctactacatggcagg

SEQ ID NO: 7110822 - DNA, 22 bp, Homo sapiens
cagttgctacagttcaagtgtg

SEQ ID NO: 7110823 - DNA, 22 bp, Homo sapiens
tcagagagtgcaaaatatagct

SEQ ID NO: 7110824 - DNA, 22 bp, Homo sapiens
tcagagagtgcaaaatatagct

SEQ ID NO: 7110825 - DNA, 21 bp, Homo sapiens
tcagagagtcacagtgaactg

SEQ ID NO: 7110826 - DNA, 22 bp, Homo sapiens
tcagagagtcctggtcatttgc

SEQ ID NO: 7110827 - DNA, 22 bp, Homo sapiens
tcagagagtcctggtcatttgc

SEQ ID NO: 7110828 - DNA, 21 bp, Homo sapiens
tcagagagtcacagtgaactg

SEQ ID NO: 7110829 - DNA, 21 bp, Homo sapiens
tcagagagtcacagtgaactg

SEQ ID NO: 7110830 - DNA, 22 bp, Homo sapiens
tcagagaggttggtgataagaa

SEQ ID NO: 7110831 - DNA, 22 bp, Homo sapiens
cagttgttcccagcaatgaaag

SEQ ID NO: 7110832 - DNA, 22 bp, Homo sapiens
tcagaggatcatgtccctactc

SEQ ID NO: 7110833 - DNA, 22 bp, Homo sapiens
tcagaggatcatgtccctactc

SEQ ID NO: 7110834 - DNA, 23 bp, Homo sapiens
tcagaggatcatcaaacgttttc

SEQ ID NO: 7110835 - DNA, 22 bp, Homo sapiens
tcagaggatagaaatacttatt

SEQ ID NO: 7110836 - DNA, 22 bp, Homo sapiens
tcagaggagggactcagaccca

SEQ ID NO: 7110837 - DNA, 22 bp, Homo sapiens
tcagaggagggactcagaccca

SEQ ID NO: 7110838 - DNA, 22 bp, Homo sapiens
tcagaggaggcatttaaacaga

SEQ ID NO: 7110839 - DNA, 22 bp, Homo sapiens
tcagaggaggcatttaaacaga

SEQ ID NO: 7110840 - DNA, 22 bp, Homo sapiens
tcagaggagccaaagttctgag

SEQ ID NO: 7110841 - DNA, 22 bp, Homo sapiens
tcagaggagcaaaagaggggat

SEQ ID NO: 7110842 - DNA, 22 bp, Homo sapiens
tcagaggagcaaaagaggggat

SEQ ID NO: 7110843 - DNA, 22 bp, Homo sapiens
tcagaggagatggttaccaggg

SEQ ID NO: 7110844 - DNA, 22 bp, Homo sapiens
tcagaggagcaaaagaggggat

SEQ ID NO: 7110845 - DNA, 22 bp, Homo sapiens
tcagagcaccacacagttccct

SEQ ID NO: 7110846 - DNA, 22 bp, Homo sapiens
tcagagcaccacacagttccct

SEQ ID NO: 7110847 - DNA, 23 bp, Homo sapiens
tcagagcaagatgatgtatgagc

SEQ ID NO: 7110848 - DNA, 22 bp, Homo sapiens
tcagaggatgctgttctttaat

SEQ ID NO: 7110849 - DNA, 22 bp, Homo sapiens
tcagaggattgcctcagcgagc

SEQ ID NO: 7110850 - DNA, 22 bp, Homo sapiens
tcagagtttcaggatacaaata

SEQ ID NO: 7110851 - DNA, 22 bp, Homo sapiens
tcagagtttgaaataattttta

SEQ ID NO: 7110852 - DNA, 22 bp, Homo sapiens
tcagagtttgtactgacaggag

SEQ ID NO: 7110853 - DNA, 22 bp, Homo sapiens
tcagataaaggagagcttagca

SEQ ID NO: 7110854 - DNA, 22 bp, Homo sapiens
tcagatactgtggcttatgggc

SEQ ID NO: 7110855 - DNA, 22 bp, Homo sapiens
tcagataattaatcatgaaatt

SEQ ID NO: 7110856 - DNA, 22 bp, Homo sapiens
tcagataccattgaatttgttg

SEQ ID NO: 7110857 - DNA, 22 bp, Homo sapiens
tcagatatgaattcatatctct

SEQ ID NO: 7110858 - DNA, 22 bp, Homo sapiens
tcagatattcaattaagttaaa

SEQ ID NO: 7110859 - DNA, 22 bp, Homo sapiens
cagttttaaattgttagataat

SEQ ID NO: 7110860 - DNA, 22 bp, Homo sapiens
cagttttcttgttatatttggg

SEQ ID NO: 7110861 - DNA, 22 bp, Homo sapiens
tcagatattctctaagaacaat

SEQ ID NO: 7110862 - DNA, 22 bp, Homo sapiens
tcagatcatggatctattactt

SEQ ID NO: 7110863 - DNA, 22 bp, Homo sapiens
tcagatccgagtgtgccaagga

SEQ ID NO: 7110864 - DNA, 22 bp, Homo sapiens
tcagatccgagtgtgccaagga

SEQ ID NO: 7110865 - DNA, 23 bp, Homo sapiens
cataaaatattagtatggtagca

SEQ ID NO: 7110866 - DNA, 22 bp, Homo sapiens
cataaaatggcttgttctttaa

SEQ ID NO: 7110867 - DNA, 22 bp, Homo sapiens
cataaaaggtagcagtttgaaa

SEQ ID NO: 7110868 - DNA, 23 bp, Homo sapiens
cataaaatattagtatggtagca

SEQ ID NO: 7110869 - DNA, 23 bp, Homo sapiens
cataaaatattagtatggtagca

SEQ ID NO: 7110870 - DNA, 22 bp, Homo sapiens
cagtttttcaaaattacatgat

SEQ ID NO: 7110871 - DNA, 22 bp, Homo sapiens
cagtttttcaaaattacatgat

SEQ ID NO: 7110872 - DNA, 22 bp, Homo sapiens
cagtttttcaaaattacatgat

SEQ ID NO: 7110873 - DNA, 17 bp, Homo sapiens
cataaaacagttctatt

SEQ ID NO: 7110874 - DNA, 17 bp, Homo sapiens
cataaaacagttctatt

SEQ ID NO: 7110875 - DNA, 17 bp, Homo sapiens
cataaaacagttctatt

SEQ ID NO: 7110876 - DNA, 17 bp, Homo sapiens
cataaaacagttctatt

SEQ ID NO: 7110877 - DNA, 22 bp, Homo sapiens
cataaaagccacctatttaaag

SEQ ID NO: 7110878 - DNA, 22 bp, Homo sapiens
cataatatctccgattacttgc

SEQ ID NO: 7110879 - DNA, 22 bp, Homo sapiens
cataatatctccgattacttgc

SEQ ID NO: 7110880 - DNA, 22 bp, Homo sapiens
tcagcagtcctccaggatcaag

SEQ ID NO: 7110881 - DNA, 22 bp, Homo sapiens
cataacatccttgctactttga

SEQ ID NO: 7110882 - DNA, 22 bp, Homo sapiens
cataacatccttgctactttga

SEQ ID NO: 7110883 - DNA, 22 bp, Homo sapiens
cataatcagatgtgtacataag

SEQ ID NO: 7110884 - DNA, 22 bp, Homo sapiens
cataatccatttgcactgcaga

SEQ ID NO: 7110885 - DNA, 22 bp, Homo sapiens
cataatcccaggcttgcattca

SEQ ID NO: 7110886 - DNA, 22 bp, Homo sapiens
cataatcccccatttgtgacat

SEQ ID NO: 7110887 - DNA, 22 bp, Homo sapiens
cataatcctggtgtagccctct

SEQ ID NO: 7110888 - DNA, 22 bp, Homo sapiens
cataatcctgtcctggattctt

SEQ ID NO: 7110889 - DNA, 22 bp, Homo sapiens
cataatccttgattcaaataat

SEQ ID NO: 7110890 - DNA, 22 bp, Homo sapiens
cataatgtatgcattttccagc

SEQ ID NO: 7110891 - DNA, 22 bp, Homo sapiens
cataatgtctgacacagtaaga

SEQ ID NO: 7110892 - DNA, 22 bp, Homo sapiens
tcagcaggtgctttgtttactc

SEQ ID NO: 7110893 - DNA, 22 bp, Homo sapiens
tcagcaggtgcctcagattctt

SEQ ID NO: 7110894 - DNA, 22 bp, Homo sapiens
tcagcaggtggtgggcaggtga

SEQ ID NO: 7110895 - DNA, 22 bp, Homo sapiens
tcagcaggtggtgggcaggtga

SEQ ID NO: 7110896 - DNA, 17 bp, Homo sapiens
tcagcagtaatggtggg

SEQ ID NO: 7110897 - DNA, 17 bp, Homo sapiens
tcagcagtaatggtggg

SEQ ID NO: 7110898 - DNA, 22 bp, Homo sapiens
cataaaatggcttgttctttaa

SEQ ID NO: 7110899 - DNA, 22 bp, Homo sapiens
tcagcagggtttgacttctaat

SEQ ID NO: 7110900 - DNA, 22 bp, Homo sapiens
tcagcaggtctgaggcggggcc

SEQ ID NO: 7110901 - DNA, 22 bp, Homo sapiens
tcagcaggtgaacatcatgcca

SEQ ID NO: 7110902 - DNA, 22 bp, Homo sapiens
tcagcaggtgcctcagattctt

SEQ ID NO: 7110903 - DNA, 22 bp, Homo sapiens
cataatttcccaagagattgaa

SEQ ID NO: 7110904 - DNA, 22 bp, Homo sapiens
cataatttcccaagagattgaa

SEQ ID NO: 7110905 - DNA, 22 bp, Homo sapiens
cataatttcccaagagattgaa

SEQ ID NO: 7110906 - DNA, 22 bp, Homo sapiens
cataatttcccaagagattgaa

SEQ ID NO: 7110907 - DNA, 22 bp, Homo sapiens
cataatttctaccagggccata

SEQ ID NO: 7110908 - DNA, 22 bp, Homo sapiens
cataatttctaccagggccata

SEQ ID NO: 7110909 - DNA, 22 bp, Homo sapiens
cataatttcactgtcgtatggc

SEQ ID NO: 7110910 - DNA, 22 bp, Homo sapiens
cataatttcactgtcgtatggc

SEQ ID NO: 7110911 - DNA, 22 bp, Homo sapiens
cataatttcactgtcgtatggc

SEQ ID NO: 7110912 - DNA, 22 bp, Homo sapiens
cataatttcccaagagattgaa

SEQ ID NO: 7110913 - DNA, 22 bp, Homo sapiens
cataatttcccaagagattgaa

SEQ ID NO: 7110914 - DNA, 22 bp, Homo sapiens
cataatttcccaagagattgaa

SEQ ID NO: 7110915 - DNA, 22 bp, Homo sapiens
cataattataaacgcaagttca

SEQ ID NO: 7110916 - DNA, 22 bp, Homo sapiens
cataattagtcatgttatgcat

SEQ ID NO: 7110917 - DNA, 22 bp, Homo sapiens
cataattataaacgcaagttca

SEQ ID NO: 7110918 - DNA, 22 bp, Homo sapiens
cataattaggcagttgatcatt

SEQ ID NO: 7110919 - DNA, 22 bp, Homo sapiens
cataattaggcagttgatcatt

SEQ ID NO: 7110920 - DNA, 22 bp, Homo sapiens
cataattagtcatgttatgcat

SEQ ID NO: 7110921 - DNA, 22 bp, Homo sapiens
cataattagagaattcatgtta

SEQ ID NO: 7110922 - DNA, 22 bp, Homo sapiens
cataattaggcagttgatcatt

SEQ ID NO: 7110923 - DNA, 22 bp, Homo sapiens
cataattactgatatgctgatt

SEQ ID NO: 7110924 - DNA, 22 bp, Homo sapiens
cataattactgatatgctgatt

SEQ ID NO: 7110925 - DNA, 22 bp, Homo sapiens
cataattaaattctgggcaaga

SEQ ID NO: 7110926 - DNA, 22 bp, Homo sapiens
cataattaaattctgggcaaga

SEQ ID NO: 7110927 - DNA, 22 bp, Homo sapiens
cataatgttaatcttgactcca

SEQ ID NO: 7110928 - DNA, 22 bp, Homo sapiens
cataattttccatggtttgcta

SEQ ID NO: 7110929 - DNA, 22 bp, Homo sapiens
cataattttccatggtttgcta

SEQ ID NO: 7110930 - DNA, 22 bp, Homo sapiens
cataattttccatggtttgcta

SEQ ID NO: 7110931 - DNA, 22 bp, Homo sapiens
cataattttccatggtttgcta

SEQ ID NO: 7110932 - DNA, 22 bp, Homo sapiens
cataatttgtggtagtggggga

SEQ ID NO: 7110933 - DNA, 22 bp, Homo sapiens
cataatttgtggtagtggggga

SEQ ID NO: 7110934 - DNA, 22 bp, Homo sapiens
cataatttgtggtagtggggga

SEQ ID NO: 7110935 - DNA, 22 bp, Homo sapiens
cataatttgtggtagtggggga

SEQ ID NO: 7110936 - DNA, 22 bp, Homo sapiens
cataatttgatatgcttgatgg

SEQ ID NO: 7110937 - DNA, 22 bp, Homo sapiens
cataatttgatatgcttgatgg

SEQ ID NO: 7110938 - DNA, 22 bp, Homo sapiens
cataatttgatatgcttgatgg

SEQ ID NO: 7110939 - DNA, 22 bp, Homo sapiens
cataatttgatatgcttgatgg

SEQ ID NO: 7110940 - DNA, 22 bp, Homo sapiens
cataatttgatatgcttgatgg

SEQ ID NO: 7110941 - DNA, 22 bp, Homo sapiens
cataatttctaccagggccata

SEQ ID NO: 7110942 - DNA, 22 bp, Homo sapiens
cataatttctaccagggccata

SEQ ID NO: 7110943 - DNA, 22 bp, Homo sapiens
cataatttctgtatcagcacca

SEQ ID NO: 7110944 - DNA, 22 bp, Homo sapiens
cataatttctgtatcagcacca

SEQ ID NO: 7110945 - DNA, 22 bp, Homo sapiens
cataatttctgtatcagcacca

SEQ ID NO: 7110946 - DNA, 22 bp, Homo sapiens
cataatttctgtatcagcacca

SEQ ID NO: 7110947 - DNA, 18 bp, Homo sapiens
cataattttctttcttta

SEQ ID NO: 7110948 - DNA, 18 bp, Homo sapiens
cataattttctttcttta

SEQ ID NO: 7110949 - DNA, 18 bp, Homo sapiens
cataattttctttcttta

SEQ ID NO: 7110950 - DNA, 18 bp, Homo sapiens
cataattttctttcttta

SEQ ID NO: 7110951 - DNA, 22 bp, Homo sapiens
tcaggcagagtggaagctgcaa

SEQ ID NO: 7110952 - DNA, 22 bp, Homo sapiens
tcaggcagagttaatttgctcc

SEQ ID NO: 7110953 - DNA, 22 bp, Homo sapiens
tcaggcagagttaatttgctcc

SEQ ID NO: 7110954 - DNA, 22 bp, Homo sapiens
tcaggccaggagatcagattga

SEQ ID NO: 7110955 - DNA, 22 bp, Homo sapiens
tcaggcccagagtcacggatcc

SEQ ID NO: 7110956 - DNA, 22 bp, Homo sapiens
tcaggcccagagtcacggatcc

SEQ ID NO: 7110957 - DNA, 22 bp, Homo sapiens
catagaaactgagacaaggatt

SEQ ID NO: 7110958 - DNA, 22 bp, Homo sapiens
catagaaactgagacaaggatt

SEQ ID NO: 7110959 - DNA, 22 bp, Homo sapiens
catagaaacttgcagcaagcac

SEQ ID NO: 7110960 - DNA, 22 bp, Homo sapiens
catagaaactgagacaaggatt

SEQ ID NO: 7110961 - DNA, 22 bp, Homo sapiens
catagaaactgagacaaggatt

SEQ ID NO: 7110962 - DNA, 22 bp, Homo sapiens
catagaaactgagacaaggatt

SEQ ID NO: 7110963 - DNA, 22 bp, Homo sapiens
catagaaactgagacaaggatt

SEQ ID NO: 7110964 - DNA, 22 bp, Homo sapiens
catagaaacttgcagcaagcac

SEQ ID NO: 7110965 - DNA, 22 bp, Homo sapiens
catagaaacttgcagcaagcac

SEQ ID NO: 7110966 - DNA, 22 bp, Homo sapiens
catagaaagtattatggaattt

SEQ ID NO: 7110967 - DNA, 22 bp, Homo sapiens
catagaaagtattatggaattt

SEQ ID NO: 7110968 - DNA, 22 bp, Homo sapiens
catagaaatcaggtgagaatct

SEQ ID NO: 7110969 - DNA, 22 bp, Homo sapiens
catagaaatcaggtgagaatct

SEQ ID NO: 7110970 - DNA, 22 bp, Homo sapiens
catagaaatcaggtgagaatct

SEQ ID NO: 7110971 - DNA, 22 bp, Homo sapiens
catagaaatcaggtgagaatct

SEQ ID NO: 7110972 - DNA, 22 bp, Homo sapiens
tcaggcccttctcccaggactc

SEQ ID NO: 7110973 - DNA, 22 bp, Homo sapiens
tcaggcccttctcccaggactc

SEQ ID NO: 7110974 - DNA, 22 bp, Homo sapiens
tcaggcccttctcccaggactc

SEQ ID NO: 7110975 - DNA, 22 bp, Homo sapiens
tcaggcccttctcccaggactc

SEQ ID NO: 7110976 - DNA, 22 bp, Homo sapiens
tcaggccctttgctgctgcccc

SEQ ID NO: 7110977 - DNA, 22 bp, Homo sapiens
tcaggccctttgctgctgcccc

SEQ ID NO: 7110978 - DNA, 22 bp, Homo sapiens
tcaggccccttgtcagctctgt

SEQ ID NO: 7110979 - DNA, 22 bp, Homo sapiens
tcaggccccttgtcagctctgt

SEQ ID NO: 7110980 - DNA, 22 bp, Homo sapiens
tcaggcccagagtcacggatcc

SEQ ID NO: 7110981 - DNA, 22 bp, Homo sapiens
tcaggccccatcccagacttat

SEQ ID NO: 7110982 - DNA, 22 bp, Homo sapiens
tcaggccccatcccagacttat

SEQ ID NO: 7110983 - DNA, 22 bp, Homo sapiens
tcaggccctttgctgctgcccc

SEQ ID NO: 7110984 - DNA, 22 bp, Homo sapiens
tcaggcctagaacacagcagat

SEQ ID NO: 7110985 - DNA, 22 bp, Homo sapiens
tcaggcctagaacacagcagat

SEQ ID NO: 7110986 - DNA, 22 bp, Homo sapiens
tcaggcctagggagaaaattca

SEQ ID NO: 7110987 - DNA, 22 bp, Homo sapiens
tcaggcctagggagccacacca

SEQ ID NO: 7110988 - DNA, 22 bp, Homo sapiens
tcaggcctagggagccacacca

SEQ ID NO: 7110989 - DNA, 22 bp, Homo sapiens
tcaggcctcaagctgctttaag

SEQ ID NO: 7110990 - DNA, 22 bp, Homo sapiens
tcaggcctcagaaattgcactg

SEQ ID NO: 7110991 - DNA, 22 bp, Homo sapiens
tcaggcctcagcagcccacagg

SEQ ID NO: 7110992 - DNA, 22 bp, Homo sapiens
tcaggcctcagcagcccacagg

SEQ ID NO: 7110993 - DNA, 22 bp, Homo sapiens
tcaggcctcagcagcccacagg

SEQ ID NO: 7110994 - DNA, 17 bp, Homo sapiens
tcaggctgtgcctggta

SEQ ID NO: 7110995 - DNA, 17 bp, Homo sapiens
tcaggctgtgcctggta

SEQ ID NO: 7110996 - DNA, 17 bp, Homo sapiens
tcaggctgtgcctggta

SEQ ID NO: 7110997 - DNA, 21 bp, Homo sapiens
tcaggctgtctgctggttcca

SEQ ID NO: 7110998 - DNA, 21 bp, Homo sapiens
tcaggctgtctgctggttcca

SEQ ID NO: 7110999 - DNA, 17 bp, Homo sapiens
tcaggctgtgcctggta

SEQ ID NO: 7111000 - DNA, 22 bp, Homo sapiens
tcaggctgtatatcttgcactc

SEQ ID NO: 7111001 - DNA, 21 bp, Homo sapiens
tcaggctgtctgctggttcca

SEQ ID NO: 7111002 - DNA, 22 bp, Homo sapiens
tcaggctgtatatcttgcactc

SEQ ID NO: 7111003 - DNA, 22 bp, Homo sapiens
tcaggctgcctatcagactgtg

SEQ ID NO: 7111004 - DNA, 22 bp, Homo sapiens
tcaggctgcctatcagactgtg

SEQ ID NO: 7111005 - DNA, 22 bp, Homo sapiens
catagaatgcagcaggaaagtt

SEQ ID NO: 7111006 - DNA, 22 bp, Homo sapiens
catagaatgcagcaggaaagtt

SEQ ID NO: 7111007 - DNA, 22 bp, Homo sapiens
catagaatggattgacaagatt

SEQ ID NO: 7111008 - DNA, 22 bp, Homo sapiens
catagaatggattgacaagatt

SEQ ID NO: 7111009 - DNA, 22 bp, Homo sapiens
tcaggctgcctatcagactgtg

SEQ ID NO: 7111010 - DNA, 22 bp, Homo sapiens
catagaatatgtgtgattgtta

SEQ ID NO: 7111011 - DNA, 22 bp, Homo sapiens
catagaatcatagcacatttga

SEQ ID NO: 7111012 - DNA, 22 bp, Homo sapiens
catagaatatgtgtgattgtta

SEQ ID NO: 7111013 - DNA, 22 bp, Homo sapiens
catagaacagctcctagcacat

SEQ ID NO: 7111014 - DNA, 22 bp, Homo sapiens
tcaggctgtgggcactggccat

SEQ ID NO: 7111015 - DNA, 22 bp, Homo sapiens
tcaggctgtgggcactggccat

SEQ ID NO: 7111016 - DNA, 22 bp, Homo sapiens
tcaggctgtggcttcagttctt

SEQ ID NO: 7111017 - DNA, 22 bp, Homo sapiens
tcaggctgtggctttgaccgca

SEQ ID NO: 7111018 - DNA, 17 bp, Homo sapiens
tcaggctgtgcctggta

SEQ ID NO: 7111019 - DNA, 22 bp, Homo sapiens
tcaggctgtggcttcagttctt

SEQ ID NO: 7111020 - DNA, 22 bp, Homo sapiens
tcaggctgttagccacctcctc

SEQ ID NO: 7111021 - DNA, 22 bp, Homo sapiens
tcaggctgtgggcactggccat

SEQ ID NO: 7111022 - DNA, 22 bp, Homo sapiens
tcaggctgtgtctttaaacaat

SEQ ID NO: 7111023 - DNA, 22 bp, Homo sapiens
tcaggctgtgggcactggccat

SEQ ID NO: 7111024 - DNA, 22 bp, Homo sapiens
tcaggctgtgggcactggccat

SEQ ID NO: 7111025 - DNA, 22 bp, Homo sapiens
tcagggagaggtgagagcctgt

SEQ ID NO: 7111026 - DNA, 22 bp, Homo sapiens
tcagggagagtgacccatccac

SEQ ID NO: 7111027 - DNA, 22 bp, Homo sapiens
tcagggagagtgacccatccac

SEQ ID NO: 7111028 - DNA, 22 bp, Homo sapiens
tcaggctgttagccacctcctc

SEQ ID NO: 7111029 - DNA, 22 bp, Homo sapiens
tcagggagaggtgagagcctgt

SEQ ID NO: 7111030 - DNA, 22 bp, Homo sapiens
tcctggaggacagaggcatctc

SEQ ID NO: 7111031 - DNA, 22 bp, Homo sapiens
ccaaggcttcctgacctacatg

SEQ ID NO: 7111032 - DNA, 22 bp, Homo sapiens
ccaagggaaaccgagaggctgg

SEQ ID NO: 7111033 - DNA, 22 bp, Homo sapiens
ccaaggcttcccagagatgctc

SEQ ID NO: 7111034 - DNA, 22 bp, Homo sapiens
tcctggaggagatccaatctga

SEQ ID NO: 7111035 - DNA, 22 bp, Homo sapiens
tcctggaggagatccaatctga

SEQ ID NO: 7111036 - DNA, 22 bp, Homo sapiens
tcctggcactttgggggctcgc

SEQ ID NO: 7111037 - DNA, 22 bp, Homo sapiens
tcctggcactttgggggctcgc

SEQ ID NO: 7111038 - DNA, 22 bp, Homo sapiens
tcctggcagaaatggggctgtg

SEQ ID NO: 7111039 - DNA, 22 bp, Homo sapiens
tcctggcagagagcatgaggcc

SEQ ID NO: 7111040 - DNA, 22 bp, Homo sapiens
tcctggcagagggcggcctcga

SEQ ID NO: 7111041 - DNA, 22 bp, Homo sapiens
tcctggcagcccgcaggtgctg

SEQ ID NO: 7111042 - DNA, 22 bp, Homo sapiens
tcctggcagcccgcaggtgctg

SEQ ID NO: 7111043 - DNA, 22 bp, Homo sapiens
tcctggcagcccgcaggtgctg

SEQ ID NO: 7111044 - DNA, 22 bp, Homo sapiens
ccaaggctgtcattcagtagct

SEQ ID NO: 7111045 - DNA, 22 bp, Homo sapiens
ccaaggctggagtgcagtggcg

SEQ ID NO: 7111046 - DNA, 22 bp, Homo sapiens
ccaaggctgtggggctgtgcag

SEQ ID NO: 7111047 - DNA, 22 bp, Homo sapiens
ccaaggctgtggggctgtgcag

SEQ ID NO: 7111048 - DNA, 22 bp, Homo sapiens
ccaaggctggagtgcagtggcg

SEQ ID NO: 7111049 - DNA, 22 bp, Homo sapiens
ccaaggctggagtgcagtggcg

SEQ ID NO: 7111050 - DNA, 22 bp, Homo sapiens
ccaaggctggagtgcagtggcg

SEQ ID NO: 7111051 - DNA, 22 bp, Homo sapiens
ccaaggctggagtgcagtggcg

SEQ ID NO: 7111052 - DNA, 22 bp, Homo sapiens
ccaaggctggagggcttatgta

SEQ ID NO: 7111053 - DNA, 22 bp, Homo sapiens
ccaaggctgaggtttccagttg

SEQ ID NO: 7111054 - DNA, 22 bp, Homo sapiens
ccaaggcccctgtggtctagcc

SEQ ID NO: 7111055 - DNA, 17 bp, Homo sapiens
ccaaggctatttgtagt

SEQ ID NO: 7111056 - DNA, 22 bp, Homo sapiens
ccaaggctcctcagctggtctt

SEQ ID NO: 7111057 - DNA, 22 bp, Homo sapiens
ccaaggctcctcagctggtctt

SEQ ID NO: 7111058 - DNA, 18 bp, Homo sapiens
ccaaggcccctgctgggg

SEQ ID NO: 7111059 - DNA, 22 bp, Homo sapiens
ccaaggcccctgtggtctagcc

SEQ ID NO: 7111060 - DNA, 22 bp, Homo sapiens
ccaaggccacaaacagcctggc

SEQ ID NO: 7111061 - DNA, 18 bp, Homo sapiens
ccaaggcccctgctgggg

SEQ ID NO: 7111062 - DNA, 18 bp, Homo sapiens
ccaaggcccctgctgggg

SEQ ID NO: 7111063 - DNA, 22 bp, Homo sapiens
ccaaggagtagagcaggaagct

SEQ ID NO: 7111064 - DNA, 22 bp, Homo sapiens
ccaaggagtagagcaggaagct

SEQ ID NO: 7111065 - DNA, 22 bp, Homo sapiens
ccaaggaggccccaggtcagct

SEQ ID NO: 7111066 - DNA, 22 bp, Homo sapiens
ccaaggcaacgttggtgtcagg

SEQ ID NO: 7111067 - DNA, 22 bp, Homo sapiens
ccaaggcaacgttggtgtcagg

SEQ ID NO: 7111068 - DNA, 22 bp, Homo sapiens
ccaaggcaatgtgcagctggtg

SEQ ID NO: 7111069 - DNA, 22 bp, Homo sapiens
ccaaggcaatgtgcagctggtg

SEQ ID NO: 7111070 - DNA, 22 bp, Homo sapiens
ccaaggcacactctgcaaggtt

SEQ ID NO: 7111071 - DNA, 22 bp, Homo sapiens
ccaaggcacactctgcaaggtt

SEQ ID NO: 7111072 - DNA, 22 bp, Homo sapiens
ccaaggcacactctgcaaggtt

SEQ ID NO: 7111073 - DNA, 22 bp, Homo sapiens
ccaaggcacactctgcaaggtt

SEQ ID NO: 7111074 - DNA, 22 bp, Homo sapiens
ccaaggcagaagatggctcttg

SEQ ID NO: 7111075 - DNA, 22 bp, Homo sapiens
ccaaggcagaagatggctcttg

SEQ ID NO: 7111076 - DNA, 22 bp, Homo sapiens
ccaaggcaggggatcaaagttt

SEQ ID NO: 7111077 - DNA, 22 bp, Homo sapiens
ccaaggcaggggatcaaagttt

SEQ ID NO: 7111078 - DNA, 22 bp, Homo sapiens
ccaaggcatatggctgaaacca

SEQ ID NO: 7111079 - DNA, 22 bp, Homo sapiens
ccaaggcatatggctgaaacca

SEQ ID NO: 7111080 - DNA, 22 bp, Homo sapiens
ccaaggccacaaacagcctggc

SEQ ID NO: 7111081 - DNA, 22 bp, Homo sapiens
ccaaggccacaaacagcctggc

SEQ ID NO: 7111082 - DNA, 22 bp, Homo sapiens
ccaaggccacaaacagcctggc

SEQ ID NO: 7111083 - DNA, 22 bp, Homo sapiens
ccaaggccacaaacagcctggc

SEQ ID NO: 7111084 - DNA, 22 bp, Homo sapiens
ccaaggccatcaggtaggtcct

SEQ ID NO: 7111085 - DNA, 22 bp, Homo sapiens
ccaaggccatcaggtaggtcct

SEQ ID NO: 7111086 - DNA, 22 bp, Homo sapiens
ccaagaggttgtgaggcaggca

SEQ ID NO: 7111087 - DNA, 22 bp, Homo sapiens
ccaaggagaatgacaccatgga

SEQ ID NO: 7111088 - DNA, 22 bp, Homo sapiens
tcctagaactccaggacagtcc

SEQ ID NO: 7111089 - DNA, 22 bp, Homo sapiens
ccaagaggttgaggctgcagtg

SEQ ID NO: 7111090 - DNA, 22 bp, Homo sapiens
ccaagaggttgtgaggcaggca

SEQ ID NO: 7111091 - DNA, 22 bp, Homo sapiens
ccaaggagcaaggctcaacaag

SEQ ID NO: 7111092 - DNA, 22 bp, Homo sapiens
tcctagaactccaggacagtcc

SEQ ID NO: 7111093 - DNA, 22 bp, Homo sapiens
tcctagaacagcccacctggaa

SEQ ID NO: 7111094 - DNA, 22 bp, Homo sapiens
tcctacagatactaaggagatc

SEQ ID NO: 7111095 - DNA, 22 bp, Homo sapiens
tcctacagatactaaggagatc

SEQ ID NO: 7111096 - DNA, 22 bp, Homo sapiens
tcctacagatactaaggagatc

SEQ ID NO: 7111097 - DNA, 22 bp, Homo sapiens
tcctacagcacagatgtttact

SEQ ID NO: 7111098 - DNA, 22 bp, Homo sapiens
tcctacatcagctctcagtagc

SEQ ID NO: 7111099 - DNA, 20 bp, Homo sapiens
tcctactcttttaatatgtg

SEQ ID NO: 7111100 - DNA, 20 bp, Homo sapiens
tcctactcttttaatatgtg

SEQ ID NO: 7111101 - DNA, 20 bp, Homo sapiens
tcctaataacctgaagaaat

SEQ ID NO: 7111102 - DNA, 22 bp, Homo sapiens
tcctacagaaccaggctaggtg

SEQ ID NO: 7111103 - DNA, 22 bp, Homo sapiens
tcctacagaaccaggctaggtg

SEQ ID NO: 7111104 - DNA, 22 bp, Homo sapiens
tcctggcaggtcagcaggagca

SEQ ID NO: 7111105 - DNA, 22 bp, Homo sapiens
tcctggcaggtcagcaggagca

SEQ ID NO: 7111106 - DNA, 22 bp, Homo sapiens
tcctggcaggtctgagaggtct

SEQ ID NO: 7111107 - DNA, 22 bp, Homo sapiens
tcctggcaggtctgagaggtct

SEQ ID NO: 7111108 - DNA, 22 bp, Homo sapiens
tcctggcaggtcagcaggagca

SEQ ID NO: 7111109 - DNA, 22 bp, Homo sapiens
tcctggcaggtcagcaggagca

SEQ ID NO: 7111110 - DNA, 22 bp, Homo sapiens
tcctggcaggtctgagaggtct

SEQ ID NO: 7111111 - DNA, 22 bp, Homo sapiens
tcctggcaggtctgagaggtct

SEQ ID NO: 7111112 - DNA, 22 bp, Homo sapiens
tcctggcaggtgtattggctgt

SEQ ID NO: 7111113 - DNA, 22 bp, Homo sapiens
tcctggcagtaatttgatgttg

SEQ ID NO: 7111114 - DNA, 22 bp, Homo sapiens
tcctggcagtcaaataaccttg

SEQ ID NO: 7111115 - DNA, 18 bp, Homo sapiens
tcctggcagtcagagagg

SEQ ID NO: 7111116 - DNA, 18 bp, Homo sapiens
tcctggcagtcagagagg

SEQ ID NO: 7111117 - DNA, 22 bp, Homo sapiens
tcctggcagggtggcagcgggt

SEQ ID NO: 7111118 - DNA, 22 bp, Homo sapiens
tcctggcagggtggcagcgggt

SEQ ID NO: 7111119 - DNA, 22 bp, Homo sapiens
tcctggcagggtggcagcgggt

SEQ ID NO: 7111120 - DNA, 22 bp, Homo sapiens
tcctggcagggaacttgtcagc

SEQ ID NO: 7111121 - DNA, 22 bp, Homo sapiens
tcctggcagggaacttgtcagc

SEQ ID NO: 7111122 - DNA, 22 bp, Homo sapiens
tcctggcagggtctaggtctag

SEQ ID NO: 7111123 - DNA, 22 bp, Homo sapiens
tcctggcagggtctaggtctag

SEQ ID NO: 7111124 - DNA, 22 bp, Homo sapiens
tcctggcagggtctaggtctag

SEQ ID NO: 7111125 - DNA, 21 bp, Homo sapiens
tcctggcaggcccaggaccct

SEQ ID NO: 7111126 - DNA, 21 bp, Homo sapiens
tcctggcaggcccaggaccct

SEQ ID NO: 7111127 - DNA, 21 bp, Homo sapiens
tcctggcaggcccaggaccct

SEQ ID NO: 7111128 - DNA, 21 bp, Homo sapiens
tcctggcaggcccaggaccct

SEQ ID NO: 7111129 - DNA, 18 bp, Homo sapiens
tcctggcagtcagagagg

SEQ ID NO: 7111130 - DNA, 18 bp, Homo sapiens
tcctggcagtcagagagg

SEQ ID NO: 7111131 - DNA, 19 bp, Homo sapiens
ccacacagtgtgcaattta

SEQ ID NO: 7111132 - DNA, 22 bp, Homo sapiens
ccacaccatcgtttttacctta

SEQ ID NO: 7111133 - DNA, 17 bp, Homo sapiens
ccacaccctttccttcc

SEQ ID NO: 7111134 - DNA, 22 bp, Homo sapiens
ccacactccccgcaggcgtagg

SEQ ID NO: 7111135 - DNA, 22 bp, Homo sapiens
ccacactgaacctcagtgtctt

SEQ ID NO: 7111136 - DNA, 22 bp, Homo sapiens
ccacactgaacctcagtgtctt

SEQ ID NO: 7111137 - DNA, 22 bp, Homo sapiens
ccacactgaccagctgtgagac

SEQ ID NO: 7111138 - DNA, 22 bp, Homo sapiens
ccacactgcctgttatctccca

SEQ ID NO: 7111139 - DNA, 22 bp, Homo sapiens
ccacactttgagatgactagga

SEQ ID NO: 7111140 - DNA, 22 bp, Homo sapiens
ccacactttgagatgactagga

SEQ ID NO: 7111141 - DNA, 22 bp, Homo sapiens
tcctgggactctttatcagaga

SEQ ID NO: 7111142 - DNA, 22 bp, Homo sapiens
tcctgggactctttatcagaga

SEQ ID NO: 7111143 - DNA, 22 bp, Homo sapiens
tcctggctcctgatctgtcact

SEQ ID NO: 7111144 - DNA, 22 bp, Homo sapiens
ccacagaaagttgtctagagta

SEQ ID NO: 7111145 - DNA, 22 bp, Homo sapiens
ccacagaagatggggagagtgg

SEQ ID NO: 7111146 - DNA, 22 bp, Homo sapiens
ccacagaagatggggagagtgg

SEQ ID NO: 7111147 - DNA, 22 bp, Homo sapiens
tcctggctccagcagctcttcc

SEQ ID NO: 7111148 - DNA, 22 bp, Homo sapiens
tcctggctccagcagctcttcc

SEQ ID NO: 7111149 - DNA, 22 bp, Homo sapiens
tcctgggactttcaaggctagg

SEQ ID NO: 7111150 - DNA, 22 bp, Homo sapiens
tcctgggactttcaaggctagg

SEQ ID NO: 7111151 - DNA, 22 bp, Homo sapiens
tcctgggagacccagctgtgga

SEQ ID NO: 7111152 - DNA, 22 bp, Homo sapiens
tcctgggagacccagctgtgga

SEQ ID NO: 7111153 - DNA, 22 bp, Homo sapiens
tcctgggagagtttgattcatt

SEQ ID NO: 7111154 - DNA, 22 bp, Homo sapiens
tcctgggagagtgggactgtat

SEQ ID NO: 7111155 - DNA, 22 bp, Homo sapiens
tcctgggagagtgggactgtat

SEQ ID NO: 7111156 - DNA, 22 bp, Homo sapiens
tcctgggagcccttgctccacc

SEQ ID NO: 7111157 - DNA, 22 bp, Homo sapiens
tcctgggagcatggtgccgtga

SEQ ID NO: 7111158 - DNA, 22 bp, Homo sapiens
tcctgggagcacatggtcctgc

SEQ ID NO: 7111159 - DNA, 22 bp, Homo sapiens
tcctgggagcacatggtcctgc

SEQ ID NO: 7111160 - DNA, 22 bp, Homo sapiens
tcctgggagcatgaagagggat

SEQ ID NO: 7111161 - DNA, 22 bp, Homo sapiens
tcctgggcttaagtgatcctcc

SEQ ID NO: 7111162 - DNA, 22 bp, Homo sapiens
tcctgggcttaagtgatcctcc

SEQ ID NO: 7111163 - DNA, 22 bp, Homo sapiens
tcctgggcttagtggctaggtc

SEQ ID NO: 7111164 - DNA, 22 bp, Homo sapiens
tcctgggagcccttgctccacc

SEQ ID NO: 7111165 - DNA, 22 bp, Homo sapiens
tcctgggaggaacatttaccta

SEQ ID NO: 7111166 - DNA, 19 bp, Homo sapiens
ccagagacattggcatctt

SEQ ID NO: 7111167 - DNA, 22 bp, Homo sapiens
ccagagaatccggagagtccat

SEQ ID NO: 7111168 - DNA, 22 bp, Homo sapiens
ccagagaaccatctgcttgagg

SEQ ID NO: 7111169 - DNA, 22 bp, Homo sapiens
ccagacagttccttgaggttca

SEQ ID NO: 7111170 - DNA, 22 bp, Homo sapiens
ccagacagttccttgaggttca

SEQ ID NO: 7111171 - DNA, 22 bp, Homo sapiens
ccagagaaataaggggaaaatg

SEQ ID NO: 7111172 - DNA, 22 bp, Homo sapiens
ccagagaaccttgagctgtgag

SEQ ID NO: 7111173 - DNA, 22 bp, Homo sapiens
ccagagaaccttgagctgtgag

SEQ ID NO: 7111174 - DNA, 22 bp, Homo sapiens
ccagagaagaaaagcacctttt

SEQ ID NO: 7111175 - DNA, 22 bp, Homo sapiens
ccagagaagaaaagcacctttt

SEQ ID NO: 7111176 - DNA, 22 bp, Homo sapiens
ccagagaaggtggagcttgtgt

SEQ ID NO: 7111177 - DNA, 22 bp, Homo sapiens
ccagagaaggtggagcttgtgt

SEQ ID NO: 7111178 - DNA, 22 bp, Homo sapiens
tctaatctacaaaaggaaattc

SEQ ID NO: 7111179 - DNA, 22 bp, Homo sapiens
ccagacaggggctgttcctgct

SEQ ID NO: 7111180 - DNA, 22 bp, Homo sapiens
ccagacaggggctgttcctgct

SEQ ID NO: 7111181 - DNA, 22 bp, Homo sapiens
tctaatcctatggtggggaggg

SEQ ID NO: 7111182 - DNA, 22 bp, Homo sapiens
tctaatccttgctacctgggtg

SEQ ID NO: 7111183 - DNA, 22 bp, Homo sapiens
tctaatccttgctacctgggtg

SEQ ID NO: 7111184 - DNA, 22 bp, Homo sapiens
tctaataaataaatgctctagg

SEQ ID NO: 7111185 - DNA, 22 bp, Homo sapiens
tctaatcctatggtggggaggg

SEQ ID NO: 7111186 - DNA, 22 bp, Homo sapiens
tctaaggccttcatgtcagtat

SEQ ID NO: 7111187 - DNA, 22 bp, Homo sapiens
tctaaggacattggctttggag

SEQ ID NO: 7111188 - DNA, 22 bp, Homo sapiens
tctaagggaaggtgatatgtta

SEQ ID NO: 7111189 - DNA, 22 bp, Homo sapiens
tctaaggtcaggggaaagtttg

SEQ ID NO: 7111190 - DNA, 22 bp, Homo sapiens
tctaaggtcaggggaaagtttg

SEQ ID NO: 7111191 - DNA, 22 bp, Homo sapiens
tctaagtttggtgattaccaat

SEQ ID NO: 7111192 - DNA, 22 bp, Homo sapiens
tctaagcctcagaccacgctgc

SEQ ID NO: 7111193 - DNA, 21 bp, Homo sapiens
tctaagccttgcagatgggtt

SEQ ID NO: 7111194 - DNA, 22 bp, Homo sapiens
tctaagctagtggctcatgtga

SEQ ID NO: 7111195 - DNA, 22 bp, Homo sapiens
tctaaggaaggacaccctggct

SEQ ID NO: 7111196 - DNA, 22 bp, Homo sapiens
tctaaggacaaggtcttggaga

SEQ ID NO: 7111197 - DNA, 22 bp, Homo sapiens
ccactgtcttttccaggctgaa

SEQ ID NO: 7111198 - DNA, 22 bp, Homo sapiens
ccactgtctgtgacatcagaaa

SEQ ID NO: 7111199 - DNA, 22 bp, Homo sapiens
ccactgtcttttccaggctgaa

SEQ ID NO: 7111200 - DNA, 22 bp, Homo sapiens
ccactgtgagcatgaacaggac

SEQ ID NO: 7111201 - DNA, 22 bp, Homo sapiens
ccactgtatcttccttgaattt

SEQ ID NO: 7111202 - DNA, 22 bp, Homo sapiens
ccactgtatcttccttgaattt

SEQ ID NO: 7111203 - DNA, 22 bp, Homo sapiens
ccactgtattttggaagcagat

SEQ ID NO: 7111204 - DNA, 22 bp, Homo sapiens
ccactgtattttggaagcagat

SEQ ID NO: 7111205 - DNA, 22 bp, Homo sapiens
ccactgtctgcaggcctcagca

SEQ ID NO: 7111206 - DNA, 22 bp, Homo sapiens
ccactgtcagaggggctgtgcc

SEQ ID NO: 7111207 - DNA, 22 bp, Homo sapiens
ccactgtctgcaggcctcagca

SEQ ID NO: 7111208 - DNA, 22 bp, Homo sapiens
ccactgggggctgctcccaggt

SEQ ID NO: 7111209 - DNA, 22 bp, Homo sapiens
ccactgggggctgctcccaggt

SEQ ID NO: 7111210 - DNA, 22 bp, Homo sapiens
ccactgctagagatgcatcccc

SEQ ID NO: 7111211 - DNA, 22 bp, Homo sapiens
ccactgtaaccattatcaccat

SEQ ID NO: 7111212 - DNA, 22 bp, Homo sapiens
ccactgtaagtttgaaaataac

SEQ ID NO: 7111213 - DNA, 21 bp, Homo sapiens
ccactgtagactcattctgag

SEQ ID NO: 7111214 - DNA, 21 bp, Homo sapiens
ccactgtagactcattctgag

SEQ ID NO: 7111215 - DNA, 22 bp, Homo sapiens
ccactgtagagatttgaatgcc

SEQ ID NO: 7111216 - DNA, 22 bp, Homo sapiens
ccactgtagttatgatgaagtt

SEQ ID NO: 7111217 - DNA, 22 bp, Homo sapiens
ccactgtagttatgatgaagtt

SEQ ID NO: 7111218 - DNA, 22 bp, Homo sapiens
ccactgtataagcaaaatgaaa

SEQ ID NO: 7111219 - DNA, 22 bp, Homo sapiens
ccactgtatagccactgccggt

SEQ ID NO: 7111220 - DNA, 22 bp, Homo sapiens
tctaagaaatcagatgatgagg

SEQ ID NO: 7111221 - DNA, 21 bp, Homo sapiens
tctaagaacatgattctccct

SEQ ID NO: 7111222 - DNA, 22 bp, Homo sapiens
tctaagaattgaagtggctctt

SEQ ID NO: 7111223 - DNA, 22 bp, Homo sapiens
tctaagaggcatcaagacaagc

SEQ ID NO: 7111224 - DNA, 22 bp, Homo sapiens
tctaagatctactatacatgtg

SEQ ID NO: 7111225 - DNA, 22 bp, Homo sapiens
tctaagccaggactgagagacg

SEQ ID NO: 7111226 - DNA, 22 bp, Homo sapiens
tctaagccgcaagcctatctgt

SEQ ID NO: 7111227 - DNA, 22 bp, Homo sapiens
ccacttcatcagtgctccattt

SEQ ID NO: 7111228 - DNA, 22 bp, Homo sapiens
ccacttcatcagtgctccattt

SEQ ID NO: 7111229 - DNA, 22 bp, Homo sapiens
ccacttcatcccagctcagata

SEQ ID NO: 7111230 - DNA, 22 bp, Homo sapiens
ccactgttggcccgaaggggtc

SEQ ID NO: 7111231 - DNA, 22 bp, Homo sapiens
ccactgtttcctttctgctggc

SEQ ID NO: 7111232 - DNA, 22 bp, Homo sapiens
ccactgtggaaagcagttcaga

SEQ ID NO: 7111233 - DNA, 22 bp, Homo sapiens
ccactgtgtccaccaggaatgc

SEQ ID NO: 7111234 - DNA, 22 bp, Homo sapiens
tcctgggcttagtggctaggtc

SEQ ID NO: 7111235 - DNA, 22 bp, Homo sapiens
tcctgggcttagtggctaggtc

SEQ ID NO: 7111236 - DNA, 22 bp, Homo sapiens
tcctgggcttcacagactctgt

SEQ ID NO: 7111237 - DNA, 22 bp, Homo sapiens
tcctgggcttgctcctccagct

SEQ ID NO: 7111238 - DNA, 22 bp, Homo sapiens
tcctgggcttgctcctccagct

SEQ ID NO: 7111239 - DNA, 22 bp, Homo sapiens
tcctgggctttgtttctctcct

SEQ ID NO: 7111240 - DNA, 22 bp, Homo sapiens
tccttaaacaacacactttgta

SEQ ID NO: 7111241 - DNA, 19 bp, Homo sapiens
tccttaaaaaagcagttct

SEQ ID NO: 7111242 - DNA, 19 bp, Homo sapiens
tcctggggaggggcatggc

SEQ ID NO: 7111243 - DNA, 19 bp, Homo sapiens
tcctggggaggggcatggc

SEQ ID NO: 7111244 - DNA, 22 bp, Homo sapiens
tccttaaagttggggtgctgca

SEQ ID NO: 7111245 - DNA, 22 bp, Homo sapiens
tccttaaagttggggtgctgca

SEQ ID NO: 7111246 - DNA, 22 bp, Homo sapiens
tccttaaaggactagaagtcaa

SEQ ID NO: 7111247 - DNA, 22 bp, Homo sapiens
tccttcccaggtgtcgccgcct

SEQ ID NO: 7111248 - DNA, 22 bp, Homo sapiens
tccttggggtaactccagcctg

SEQ ID NO: 7111249 - DNA, 22 bp, Homo sapiens
tccttggggacgctgacatcgt

SEQ ID NO: 7111250 - DNA, 22 bp, Homo sapiens
tccttcctgcaggccaagtcct

SEQ ID NO: 7111251 - DNA, 22 bp, Homo sapiens
tccttcctgcaggccaagtcct

SEQ ID NO: 7111252 - DNA, 22 bp, Homo sapiens
tccttcctgctctaacattcag

SEQ ID NO: 7111253 - DNA, 19 bp, Homo sapiens
tccttccccccagcacaga

SEQ ID NO: 7111254 - DNA, 22 bp, Homo sapiens
tccttccccctcaagagaactt

SEQ ID NO: 7111255 - DNA, 21 bp, Homo sapiens
tccttcccccttggcctggga

SEQ ID NO: 7111256 - DNA, 20 bp, Homo sapiens
tccttccctctctttttgca

SEQ ID NO: 7111257 - DNA, 22 bp, Homo sapiens
tccttcctccatggtcttggtt

SEQ ID NO: 7111258 - DNA, 22 bp, Homo sapiens
tccttcctcggggacccagatc

SEQ ID NO: 7111259 - DNA, 22 bp, Homo sapiens
tccttcctgcaggccaagtcct

SEQ ID NO: 7111260 - DNA, 22 bp, Homo sapiens
ccactgctaacttgctgcagct

SEQ ID NO: 7111261 - DNA, 22 bp, Homo sapiens
tcctttcaccaaaaagtgttgt

SEQ ID NO: 7111262 - DNA, 22 bp, Homo sapiens
ccactgctaacttgctgcagct

SEQ ID NO: 7111263 - DNA, 22 bp, Homo sapiens
tcctttatgtgagttgtttccc

SEQ ID NO: 7111264 - DNA, 22 bp, Homo sapiens
tcctttcaccaaaaagtgttgt

SEQ ID NO: 7111265 - DNA, 22 bp, Homo sapiens
tcctttcaccaaaaagtgttgt

SEQ ID NO: 7111266 - DNA, 23 bp, Homo sapiens
tcctttaagatatcttattcctt

SEQ ID NO: 7111267 - DNA, 22 bp, Homo sapiens
tcctttaacttgattattttca

SEQ ID NO: 7111268 - DNA, 22 bp, Homo sapiens
tcctttaacttgattattttca

SEQ ID NO: 7111269 - DNA, 23 bp, Homo sapiens
tcctttaagatatcttattcctt

SEQ ID NO: 7111270 - DNA, 22 bp, Homo sapiens
tcctttagctttcttggacaaa

SEQ ID NO: 7111271 - DNA, 22 bp, Homo sapiens
tcctttatctgctcagaaagta

SEQ ID NO: 7111272 - DNA, 22 bp, Homo sapiens
tccttgtaacgttgggctgggg

SEQ ID NO: 7111273 - DNA, 22 bp, Homo sapiens
tccttgtgctgagggtgttgct

SEQ ID NO: 7111274 - DNA, 22 bp, Homo sapiens
tcctttaaactcctttcaagtc

SEQ ID NO: 7111275 - DNA, 22 bp, Homo sapiens
tcctttaaactcctttcaagtc

SEQ ID NO: 7111276 - DNA, 22 bp, Homo sapiens
tcctttaaagaactgtgctttt

SEQ ID NO: 7111277 - DNA, 22 bp, Homo sapiens
tcctttaacttgattattttca

SEQ ID NO: 7111278 - DNA, 22 bp, Homo sapiens
catgggcccgtgagaggcaggg

SEQ ID NO: 7111279 - DNA, 22 bp, Homo sapiens
catgggcccgtgagaggcaggg

SEQ ID NO: 7111280 - DNA, 22 bp, Homo sapiens
catgggcccgtgagaggcaggg

SEQ ID NO: 7111281 - DNA, 22 bp, Homo sapiens
catgggccatggtgaagccagg

SEQ ID NO: 7111282 - DNA, 22 bp, Homo sapiens
catgggccatggtgaagccagg

SEQ ID NO: 7111283 - DNA, 22 bp, Homo sapiens
catgggcccgtgagaggcaggg

SEQ ID NO: 7111284 - DNA, 22 bp, Homo sapiens
catgggctacagaagcatgctg

SEQ ID NO: 7111285 - DNA, 22 bp, Homo sapiens
catgggcagttggcagggctca

SEQ ID NO: 7111286 - DNA, 22 bp, Homo sapiens
catgggcagttggcagggctca

SEQ ID NO: 7111287 - DNA, 22 bp, Homo sapiens
catgggcagttggcagggctca

SEQ ID NO: 7111288 - DNA, 22 bp, Homo sapiens
catgggcagttggcagggctca

SEQ ID NO: 7111289 - DNA, 22 bp, Homo sapiens
catgggccatggtgaagccagg

SEQ ID NO: 7111290 - DNA, 22 bp, Homo sapiens
catgggccagagctcctctggg

SEQ ID NO: 7111291 - DNA, 22 bp, Homo sapiens
catgggccagagctcctctggg

SEQ ID NO: 7111292 - DNA, 22 bp, Homo sapiens
catgggccatggtgaagccagg

SEQ ID NO: 7111293 - DNA, 22 bp, Homo sapiens
catgggcagttggcagggctca

SEQ ID NO: 7111294 - DNA, 22 bp, Homo sapiens
tccattttagaagaaaatccac

SEQ ID NO: 7111295 - DNA, 22 bp, Homo sapiens
tccattttagaagaaaatccac

SEQ ID NO: 7111296 - DNA, 22 bp, Homo sapiens
tccatttgaaatgaaagtgata

SEQ ID NO: 7111297 - DNA, 22 bp, Homo sapiens
tccatcaccatttctgcgagct

SEQ ID NO: 7111298 - DNA, 22 bp, Homo sapiens
tccatttaggttccactagtta

SEQ ID NO: 7111299 - DNA, 22 bp, Homo sapiens
tccatcaccacagaggacagag

SEQ ID NO: 7111300 - DNA, 22 bp, Homo sapiens
tccatcaccacagaggacagag

SEQ ID NO: 7111301 - DNA, 22 bp, Homo sapiens
catgggctctctgagctccagg

SEQ ID NO: 7111302 - DNA, 22 bp, Homo sapiens
tccatattaactaaaactagaa

SEQ ID NO: 7111303 - DNA, 22 bp, Homo sapiens
tccatattgcagcatgtgtcag

SEQ ID NO: 7111304 - DNA, 22 bp, Homo sapiens
tccatattgcagcatgtgtcag

SEQ ID NO: 7111305 - DNA, 22 bp, Homo sapiens
tccatttttcatgactcctcaa

SEQ ID NO: 7111306 - DNA, 22 bp, Homo sapiens
tcccaaaaaaggtatgttgaag

SEQ ID NO: 7111307 - DNA, 22 bp, Homo sapiens
tcccaaaatacttttctctcct

SEQ ID NO: 7111308 - DNA, 20 bp, Homo sapiens
tcccaaaattctactttatc

SEQ ID NO: 7111309 - DNA, 22 bp, Homo sapiens
tccattttgtaggtatgctaca

SEQ ID NO: 7111310 - DNA, 22 bp, Homo sapiens
tccattttctaagtatcactta

SEQ ID NO: 7111311 - DNA, 22 bp, Homo sapiens
tccattttgtaggtatgctaca

SEQ ID NO: 7111312 - DNA, 22 bp, Homo sapiens
tccattttgtaggtatgctaca

SEQ ID NO: 7111313 - DNA, 22 bp, Homo sapiens
tccattttctaagtatcactta

SEQ ID NO: 7111314 - DNA, 22 bp, Homo sapiens
tccattttcatctcatgtataa

SEQ ID NO: 7111315 - DNA, 22 bp, Homo sapiens
tccattttcatctcatgtataa

SEQ ID NO: 7111316 - DNA, 22 bp, Homo sapiens
tccattttcatctcatgtataa

SEQ ID NO: 7111317 - DNA, 22 bp, Homo sapiens
tccattttagagatgaagaaac

SEQ ID NO: 7111318 - DNA, 22 bp, Homo sapiens
tccattttagagatgaagaaac

SEQ ID NO: 7111319 - DNA, 22 bp, Homo sapiens
tccattttcatctcatgtataa

SEQ ID NO: 7111320 - DNA, 22 bp, Homo sapiens
tccattttcatctcatgtataa

SEQ ID NO: 7111321 - DNA, 22 bp, Homo sapiens
tccattttagagatgaagaaac

SEQ ID NO: 7111322 - DNA, 22 bp, Homo sapiens
tccattttagagatgaagaaac

SEQ ID NO: 7111323 - DNA, 22 bp, Homo sapiens
catgggaggtctgcaaggtgct

SEQ ID NO: 7111324 - DNA, 22 bp, Homo sapiens
catgggaggtctgcaaggtgct

SEQ ID NO: 7111325 - DNA, 22 bp, Homo sapiens
catgggaggtctgcaaggtgct

SEQ ID NO: 7111326 - DNA, 22 bp, Homo sapiens
catgggaggttggcttggcatg

SEQ ID NO: 7111327 - DNA, 22 bp, Homo sapiens
catgggaggttggcttggcatg

SEQ ID NO: 7111328 - DNA, 22 bp, Homo sapiens
catgggcaccttaaaatgaggc

SEQ ID NO: 7111329 - DNA, 23 bp, Homo sapiens
catgggagtgagaatgccagctc

SEQ ID NO: 7111330 - DNA, 22 bp, Homo sapiens
catgggcagaagtggcatcatt

SEQ ID NO: 7111331 - DNA, 22 bp, Homo sapiens
catgggcagaagtggcatcatt

SEQ ID NO: 7111332 - DNA, 22 bp, Homo sapiens
catgggaggcctgctgctggtg

SEQ ID NO: 7111333 - DNA, 22 bp, Homo sapiens
tccaggagcatccaggtgaagc

SEQ ID NO: 7111334 - DNA, 22 bp, Homo sapiens
catgggaggcctgctgctggtg

SEQ ID NO: 7111335 - DNA, 22 bp, Homo sapiens
catgggaggcctgctgctggtg

SEQ ID NO: 7111336 - DNA, 22 bp, Homo sapiens
tccaggagcatccaggtgaagc

SEQ ID NO: 7111337 - DNA, 19 bp, Homo sapiens
tccaggagcaaagccagtt

SEQ ID NO: 7111338 - DNA, 21 bp, Homo sapiens
tccaggagcacgggactagga

SEQ ID NO: 7111339 - DNA, 21 bp, Homo sapiens
tccaggagcacgggactagga

SEQ ID NO: 7111340 - DNA, 22 bp, Homo sapiens
tccaggagaccagatgtaggcc

SEQ ID NO: 7111341 - DNA, 22 bp, Homo sapiens
tccaggagaccagatgtaggcc

SEQ ID NO: 7111342 - DNA, 22 bp, Homo sapiens
tccaggagaggcctgaccaggt

SEQ ID NO: 7111343 - DNA, 22 bp, Homo sapiens
tccaggagacacccttgtgtgt

SEQ ID NO: 7111344 - DNA, 22 bp, Homo sapiens
tccaggagacacccttgtgtgt

SEQ ID NO: 7111345 - DNA, 23 bp, Homo sapiens
tccaggagaattccagggcccgg

SEQ ID NO: 7111346 - DNA, 22 bp, Homo sapiens
tccaggagacacaaggtacata

SEQ ID NO: 7111347 - DNA, 22 bp, Homo sapiens
tccaggagatacactgcaccag

SEQ ID NO: 7111348 - DNA, 22 bp, Homo sapiens
tccaggagaggtgtggggactg

SEQ ID NO: 7111349 - DNA, 22 bp, Homo sapiens
tccaggagaggcctgaccaggt

SEQ ID NO: 7111350 - DNA, 22 bp, Homo sapiens
tccaggagaggcctgaccaggt

SEQ ID NO: 7111351 - DNA, 22 bp, Homo sapiens
cattcatttatgaaatatctat

SEQ ID NO: 7111352 - DNA, 22 bp, Homo sapiens
cattcatttgcccagtaagtca

SEQ ID NO: 7111353 - DNA, 22 bp, Homo sapiens
cattcatttgcccagtaagtca

SEQ ID NO: 7111354 - DNA, 22 bp, Homo sapiens
cattctatgaaaactaggcaat

SEQ ID NO: 7111355 - DNA, 22 bp, Homo sapiens
cattctccctattgaaaaagta

SEQ ID NO: 7111356 - DNA, 22 bp, Homo sapiens
cattctctacactcctgccctg

SEQ ID NO: 7111357 - DNA, 22 bp, Homo sapiens
cattaggcccttgtcagctagt

SEQ ID NO: 7111358 - DNA, 22 bp, Homo sapiens
cattaggtatttaagcacacag

SEQ ID NO: 7111359 - DNA, 22 bp, Homo sapiens
cattagcattcagtgacttgta

SEQ ID NO: 7111360 - DNA, 22 bp, Homo sapiens
cattagcattcagtgacttgta

SEQ ID NO: 7111361 - DNA, 22 bp, Homo sapiens
cattagcattcagtgacttgta

SEQ ID NO: 7111362 - DNA, 22 bp, Homo sapiens
cattagcaatcataaaccttta

SEQ ID NO: 7111363 - DNA, 22 bp, Homo sapiens
cattagcaatcataaaccttta

SEQ ID NO: 7111364 - DNA, 22 bp, Homo sapiens
cattagcaatcataaaccttta

SEQ ID NO: 7111365 - DNA, 22 bp, Homo sapiens
cattagcacagtttcagtccac

SEQ ID NO: 7111366 - DNA, 22 bp, Homo sapiens
cattagcacagtttcagtccac

SEQ ID NO: 7111367 - DNA, 22 bp, Homo sapiens
cattagcacatgacggaaagca

SEQ ID NO: 7111368 - DNA, 22 bp, Homo sapiens
cattagcacatgacggaaagca

SEQ ID NO: 7111369 - DNA, 18 bp, Homo sapiens
cattagcaccacgtagag

SEQ ID NO: 7111370 - DNA, 18 bp, Homo sapiens
cattagcaccacgtagag

SEQ ID NO: 7111371 - DNA, 22 bp, Homo sapiens
cattagcactctaaggaagaga

SEQ ID NO: 7111372 - DNA, 22 bp, Homo sapiens
cattagcactctaaggaagaga

SEQ ID NO: 7111373 - DNA, 22 bp, Homo sapiens
cattagcaggcactaagaaggt

SEQ ID NO: 7111374 - DNA, 22 bp, Homo sapiens
cattagcaggcactaagaaggt

SEQ ID NO: 7111375 - DNA, 22 bp, Homo sapiens
cattagcaggcactaagaaggt

SEQ ID NO: 7111376 - DNA, 22 bp, Homo sapiens
cattagcaggcactaagaaggt

SEQ ID NO: 7111377 - DNA, 22 bp, Homo sapiens
cattagcagtcattactgtgct

SEQ ID NO: 7111378 - DNA, 22 bp, Homo sapiens
cattagcagtcattactgtgct

SEQ ID NO: 7111379 - DNA, 22 bp, Homo sapiens
cattagcagtcattactgtgct

SEQ ID NO: 7111380 - DNA, 22 bp, Homo sapiens
cattagcatggtagccaggtca

SEQ ID NO: 7111381 - DNA, 22 bp, Homo sapiens
cattagcatggtagccaggtca

SEQ ID NO: 7111382 - DNA, 22 bp, Homo sapiens
cattagcattacttcaaagagt

SEQ ID NO: 7111383 - DNA, 22 bp, Homo sapiens
cattagcattacttcaaagagt

SEQ ID NO: 7111384 - DNA, 22 bp, Homo sapiens
cattagattggtgcaaaaataa

SEQ ID NO: 7111385 - DNA, 22 bp, Homo sapiens
cattagcaagtcactattttat

SEQ ID NO: 7111386 - DNA, 22 bp, Homo sapiens
cattagcaagtcactattttat

SEQ ID NO: 7111387 - DNA, 22 bp, Homo sapiens
cattagaacctataaaaagcat

SEQ ID NO: 7111388 - DNA, 22 bp, Homo sapiens
cattagaactaagatgtccagg

SEQ ID NO: 7111389 - DNA, 20 bp, Homo sapiens
tcccaaaattctactttatc

SEQ ID NO: 7111390 - DNA, 20 bp, Homo sapiens
tcccaaaattctactttatc

SEQ ID NO: 7111391 - DNA, 22 bp, Homo sapiens
tcccaaacatttttggccttga

SEQ ID NO: 7111392 - DNA, 22 bp, Homo sapiens
tcccaaagaactgaatagtaat

SEQ ID NO: 7111393 - DNA, 22 bp, Homo sapiens
cattacagaatatgtaatgatc

SEQ ID NO: 7111394 - DNA, 22 bp, Homo sapiens
cattacagtgtcagaggaactg

SEQ ID NO: 7111395 - DNA, 22 bp, Homo sapiens
cattacagtgtcagaggaactg

SEQ ID NO: 7111396 - DNA, 22 bp, Homo sapiens
cattacagtgtcagaggaactg

SEQ ID NO: 7111397 - DNA, 22 bp, Homo sapiens
cattacatggtccaggatatat

SEQ ID NO: 7111398 - DNA, 21 bp, Homo sapiens
cattacatggttttagtgaac

SEQ ID NO: 7111399 - DNA, 22 bp, Homo sapiens
cattacatttcaaaatgtttcc

SEQ ID NO: 7111400 - DNA, 22 bp, Homo sapiens
cattacatttcaaaatgtttcc

SEQ ID NO: 7111401 - DNA, 22 bp, Homo sapiens
cattacatttcaaaatgtttcc

SEQ ID NO: 7111402 - DNA, 22 bp, Homo sapiens
cattacatttcaaaatgtttcc

SEQ ID NO: 7111403 - DNA, 22 bp, Homo sapiens
cattacgagctctaaaatacta

SEQ ID NO: 7111404 - DNA, 22 bp, Homo sapiens
cattacttctcatgcttcatgc

SEQ ID NO: 7111405 - DNA, 22 bp, Homo sapiens
tcccacccatcctgcatctctt

SEQ ID NO: 7111406 - DNA, 22 bp, Homo sapiens
tcccacccatcctgcatctctt

SEQ ID NO: 7111407 - DNA, 22 bp, Homo sapiens
tcccaccccctccaaggaggaa

SEQ ID NO: 7111408 - DNA, 22 bp, Homo sapiens
tcccaccaggtgaccatttcat

SEQ ID NO: 7111409 - DNA, 22 bp, Homo sapiens
tcccacccatcctgcatctctt

SEQ ID NO: 7111410 - DNA, 22 bp, Homo sapiens
tcccacccatcctgcatctctt

SEQ ID NO: 7111411 - DNA, 22 bp, Homo sapiens
tcccacccatcctgcatctctt

SEQ ID NO: 7111412 - DNA, 22 bp, Homo sapiens
tcccaccaggtgaccatttcat

SEQ ID NO: 7111413 - DNA, 22 bp, Homo sapiens
tcccaccccctccaaggaggaa

SEQ ID NO: 7111414 - DNA, 22 bp, Homo sapiens
tcccaccccctccaaggaggaa

SEQ ID NO: 7111415 - DNA, 22 bp, Homo sapiens
tcccaccccctccaaggaggaa

SEQ ID NO: 7111416 - DNA, 22 bp, Homo sapiens
tcccaccccggtcaagggctga

SEQ ID NO: 7111417 - DNA, 22 bp, Homo sapiens
tcccaccccggtcaagggctga

SEQ ID NO: 7111418 - DNA, 22 bp, Homo sapiens
tcccaccccggtcaagggctga

SEQ ID NO: 7111419 - DNA, 22 bp, Homo sapiens
tcccaccccggtcaagggctga

SEQ ID NO: 7111420 - DNA, 22 bp, Homo sapiens
tcccaccccggtcaagggctga

SEQ ID NO: 7111421 - DNA, 22 bp, Homo sapiens
tcccaccccttgactctttaag

SEQ ID NO: 7111422 - DNA, 22 bp, Homo sapiens
tcccaccccttgactctttaag

SEQ ID NO: 7111423 - DNA, 22 bp, Homo sapiens
tcccaccccttgactctttaag

SEQ ID NO: 7111424 - DNA, 22 bp, Homo sapiens
tcccaccccttgactctttaag

SEQ ID NO: 7111425 - DNA, 22 bp, Homo sapiens
tcccaccccttgactctttaag

SEQ ID NO: 7111426 - DNA, 22 bp, Homo sapiens
cattctgagctaatatgcttat

SEQ ID NO: 7111427 - DNA, 22 bp, Homo sapiens
cattctgagtcactctttagca

SEQ ID NO: 7111428 - DNA, 22 bp, Homo sapiens
cattctgcgatcctcaagcaca

SEQ ID NO: 7111429 - DNA, 22 bp, Homo sapiens
cattctgggtctggctcaggga

SEQ ID NO: 7111430 - DNA, 22 bp, Homo sapiens
cattctgggtctggctcaggga

SEQ ID NO: 7111431 - DNA, 22 bp, Homo sapiens
cattctctgatcttcacatacc

SEQ ID NO: 7111432 - DNA, 22 bp, Homo sapiens
cattctctgatcttcacatacc

SEQ ID NO: 7111433 - DNA, 22 bp, Homo sapiens
cattctctgatcttcacatacc

SEQ ID NO: 7111434 - DNA, 22 bp, Homo sapiens
cattctgggtctggctcaggga

SEQ ID NO: 7111435 - DNA, 22 bp, Homo sapiens
cattcttacacaatattttaat

SEQ ID NO: 7111436 - DNA, 22 bp, Homo sapiens
cattcttctcccttaccttcca

SEQ ID NO: 7111437 - DNA, 22 bp, Homo sapiens
cattcttctggatagttagttg

SEQ ID NO: 7111438 - DNA, 22 bp, Homo sapiens
cattcttctggatagttagttg

SEQ ID NO: 7111439 - DNA, 22 bp, Homo sapiens
cattcttctggatagttagttg

SEQ ID NO: 7111440 - DNA, 22 bp, Homo sapiens
catttattgagtggccacagtg

SEQ ID NO: 7111441 - DNA, 22 bp, Homo sapiens
tccctgctttcttgtgagggga

SEQ ID NO: 7111442 - DNA, 18 bp, Homo sapiens
tccctggggctgccaccc

SEQ ID NO: 7111443 - DNA, 18 bp, Homo sapiens
tccctggggctgccaccc

SEQ ID NO: 7111444 - DNA, 20 bp, Homo sapiens
tccctggggccctacttcct

SEQ ID NO: 7111445 - DNA, 20 bp, Homo sapiens
tccctggggccctacttcct

SEQ ID NO: 7111446 - DNA, 22 bp, Homo sapiens
tccctggggtaacattagaggg

SEQ ID NO: 7111447 - DNA, 22 bp, Homo sapiens
tccctggggtatcgctgaggca

SEQ ID NO: 7111448 - DNA, 22 bp, Homo sapiens
tccctggggtatcgctgaggca

SEQ ID NO: 7111449 - DNA, 22 bp, Homo sapiens
tccctggggttcctccagccac

SEQ ID NO: 7111450 - DNA, 18 bp, Homo sapiens
tcctaacttagatactcc

SEQ ID NO: 7111451 - DNA, 16 bp, Homo sapiens
tcctaactggcagttc

SEQ ID NO: 7111452 - DNA, 22 bp, Homo sapiens
tcctaactgccctgggcaaggt

SEQ ID NO: 7111453 - DNA, 23 bp, Homo sapiens
tcctaactgattctgcagtctct

SEQ ID NO: 7111454 - DNA, 23 bp, Homo sapiens
tcctaactgattctgcagtctct

SEQ ID NO: 7111455 - DNA, 22 bp, Homo sapiens
tcctaactccactagccttggg

SEQ ID NO: 7111456 - DNA, 23 bp, Homo sapiens
tcctaactcaattcaggggtgtc

SEQ ID NO: 7111457 - DNA, 16 bp, Homo sapiens
tcctaacgtgcagcca

SEQ ID NO: 7111458 - DNA, 22 bp, Homo sapiens
tcctaactaatttgtagcaaaa

SEQ ID NO: 7111459 - DNA, 20 bp, Homo sapiens
tcctaactataaagtggctc

SEQ ID NO: 7111460 - DNA, 22 bp, Homo sapiens
tcctaactaatttgtagcaaaa

SEQ ID NO: 7111461 - DNA, 22 bp, Homo sapiens
tccctgggttcccgtggaagtg

SEQ ID NO: 7111462 - DNA, 22 bp, Homo sapiens
tccctgggttacctttcaaggt

SEQ ID NO: 7111463 - DNA, 22 bp, Homo sapiens
tccctgggttcccgtggaagtg

SEQ ID NO: 7111464 - DNA, 22 bp, Homo sapiens
tccctggggttcctccagccac

SEQ ID NO: 7111465 - DNA, 22 bp, Homo sapiens
tccctgggtcattctctggcac

SEQ ID NO: 7111466 - DNA, 22 bp, Homo sapiens
tccctgggtcctgcttgctctc

SEQ ID NO: 7111467 - DNA, 22 bp, Homo sapiens
tccctgggtcctgcttgctctc

SEQ ID NO: 7111468 - DNA, 22 bp, Homo sapiens
tccctgggtcctgcttgctctc

SEQ ID NO: 7111469 - DNA, 22 bp, Homo sapiens
tccctgggtcctgcttgctctc

SEQ ID NO: 7111470 - DNA, 22 bp, Homo sapiens
tccctgggttacctttcaaggt

SEQ ID NO: 7111471 - DNA, 22 bp, Homo sapiens
tccctgggtcctgcttgctctc

SEQ ID NO: 7111472 - DNA, 22 bp, Homo sapiens
catttattctcagatccttgtc

SEQ ID NO: 7111473 - DNA, 22 bp, Homo sapiens
catttattctcagatccttgtc

SEQ ID NO: 7111474 - DNA, 22 bp, Homo sapiens
catttattctcagatccttgtc

SEQ ID NO: 7111475 - DNA, 22 bp, Homo sapiens
catttattgagtggccacagtg

SEQ ID NO: 7111476 - DNA, 22 bp, Homo sapiens
catttattgagtggccacagtg

SEQ ID NO: 7111477 - DNA, 22 bp, Homo sapiens
catttattcatttgctagggct

SEQ ID NO: 7111478 - DNA, 22 bp, Homo sapiens
catttattcatttgctagggct

SEQ ID NO: 7111479 - DNA, 22 bp, Homo sapiens
catttattcatttgctagggct

SEQ ID NO: 7111480 - DNA, 22 bp, Homo sapiens
catttattcatgatctgtagct

SEQ ID NO: 7111481 - DNA, 22 bp, Homo sapiens
catttattcatgatctgtagct

SEQ ID NO: 7111482 - DNA, 22 bp, Homo sapiens
catttattcagctcagtcggtt

SEQ ID NO: 7111483 - DNA, 22 bp, Homo sapiens
catttattcatgatctgtagct

SEQ ID NO: 7111484 - DNA, 22 bp, Homo sapiens
catttattcatgatctgtagct

SEQ ID NO: 7111485 - DNA, 22 bp, Homo sapiens
tccctctcttgggcgtggctca

SEQ ID NO: 7111486 - DNA, 22 bp, Homo sapiens
catttattagttagttcgatgt

SEQ ID NO: 7111487 - DNA, 22 bp, Homo sapiens
tccctctctggctggggtgcgg

SEQ ID NO: 7111488 - DNA, 22 bp, Homo sapiens
tccctctctggctggggtgcgg

SEQ ID NO: 7111489 - DNA, 22 bp, Homo sapiens
tccctctcttgggcgtggctca

SEQ ID NO: 7111490 - DNA, 22 bp, Homo sapiens
tccctctctagcctgttcagta

SEQ ID NO: 7111491 - DNA, 22 bp, Homo sapiens
tccctctctagcctgttcagta

SEQ ID NO: 7111492 - DNA, 22 bp, Homo sapiens
tccctctctggctggggtgcgg

SEQ ID NO: 7111493 - DNA, 22 bp, Homo sapiens
tccctctctggctggggtgcgg

SEQ ID NO: 7111494 - DNA, 22 bp, Homo sapiens
tccctctccctattgcctggag

SEQ ID NO: 7111495 - DNA, 22 bp, Homo sapiens
tccctctctagcctgttcagta

SEQ ID NO: 7111496 - DNA, 22 bp, Homo sapiens
tccctctccctattgcctggag

SEQ ID NO: 7111497 - DNA, 22 bp, Homo sapiens
tccctctccctattgcctggag

SEQ ID NO: 7111498 - DNA, 22 bp, Homo sapiens
tccctctccctattgcctggag

SEQ ID NO: 7111499 - DNA, 22 bp, Homo sapiens
tccctctccctattgcctggag

SEQ ID NO: 7111500 - DNA, 22 bp, Homo sapiens
tccctctccctattgcctggag

SEQ ID NO: 7111501 - DNA, 22 bp, Homo sapiens
tccctctccctattgcctggag

SEQ ID NO: 7111502 - DNA, 22 bp, Homo sapiens
tcccactcccaggcaggcctct

SEQ ID NO: 7111503 - DNA, 22 bp, Homo sapiens
tcccactcccaggcaggcctct

SEQ ID NO: 7111504 - DNA, 22 bp, Homo sapiens
tcccactattatcctatgtggg

SEQ ID NO: 7111505 - DNA, 22 bp, Homo sapiens
tcccactcactgtctctgacac

SEQ ID NO: 7111506 - DNA, 22 bp, Homo sapiens
tcccactcactgtctctgacac

SEQ ID NO: 7111507 - DNA, 22 bp, Homo sapiens
tcccactcactgtctctgacac

SEQ ID NO: 7111508 - DNA, 22 bp, Homo sapiens
tcccactcccaggcaggcctct

SEQ ID NO: 7111509 - DNA, 22 bp, Homo sapiens
cattgtcacccaaagctcatag

SEQ ID NO: 7111510 - DNA, 22 bp, Homo sapiens
cattgtcacccaaagctcatag

SEQ ID NO: 7111511 - DNA, 22 bp, Homo sapiens
cattgtcacccaaagctcatag

SEQ ID NO: 7111512 - DNA, 22 bp, Homo sapiens
cattgtcacccaaagctcatag

SEQ ID NO: 7111513 - DNA, 22 bp, Homo sapiens
cattgtcattctatgctattca

SEQ ID NO: 7111514 - DNA, 22 bp, Homo sapiens
cattgtctggtaggaagtgggc

SEQ ID NO: 7111515 - DNA, 22 bp, Homo sapiens
cattgtctcttgtcatttagta

SEQ ID NO: 7111516 - DNA, 22 bp, Homo sapiens
catttaaaggttgtgggtaaaa

SEQ ID NO: 7111517 - DNA, 22 bp, Homo sapiens
catttaaaggttgtgggtaaaa

SEQ ID NO: 7111518 - DNA, 22 bp, Homo sapiens
cattgttttgagaacaacctga

SEQ ID NO: 7111519 - DNA, 22 bp, Homo sapiens
cattgttttgagaacaacctga

SEQ ID NO: 7111520 - DNA, 22 bp, Homo sapiens
catttaaaggttgtgggtaaaa

SEQ ID NO: 7111521 - DNA, 22 bp, Homo sapiens
cattgttggtcattgtcggttg

SEQ ID NO: 7111522 - DNA, 22 bp, Homo sapiens
cattgttgtgagatcaagcagt

SEQ ID NO: 7111523 - DNA, 22 bp, Homo sapiens
cattgttgttaaacatagtaat

SEQ ID NO: 7111524 - DNA, 22 bp, Homo sapiens
cattgtttgtaaaattccagta

SEQ ID NO: 7111525 - DNA, 22 bp, Homo sapiens
cattgttctggagaaggttcca

SEQ ID NO: 7111526 - DNA, 22 bp, Homo sapiens
cattgttatagcattacacacc

SEQ ID NO: 7111527 - DNA, 22 bp, Homo sapiens
cattgttgaacacctgctggat

SEQ ID NO: 7111528 - DNA, 22 bp, Homo sapiens
cattgttgctgcttcaagatat

SEQ ID NO: 7111529 - DNA, 22 bp, Homo sapiens
cattgttggcagagggacagag

SEQ ID NO: 7111530 - DNA, 22 bp, Homo sapiens
cattgttggtaatgctcagagg

SEQ ID NO: 7111531 - DNA, 22 bp, Homo sapiens
cattgtgcagggataatgcagc

SEQ ID NO: 7111532 - DNA, 22 bp, Homo sapiens
cattgtgtatttctgtagtact

SEQ ID NO: 7111533 - DNA, 22 bp, Homo sapiens
cattgtgctttcattcaatata

SEQ ID NO: 7111534 - DNA, 22 bp, Homo sapiens
cattgttaattggtatcttaca

SEQ ID NO: 7111535 - DNA, 22 bp, Homo sapiens
cattgttaattggtatcttaca

SEQ ID NO: 7111536 - DNA, 22 bp, Homo sapiens
cattgttaattggtatcttaca

SEQ ID NO: 7111537 - DNA, 22 bp, Homo sapiens
cattgttaccatcttttaccta

SEQ ID NO: 7111538 - DNA, 18 bp, Homo sapiens
tccctcctgcctgcttcc

SEQ ID NO: 7111539 - DNA, 18 bp, Homo sapiens
tccctcctgcctgcttcc

SEQ ID NO: 7111540 - DNA, 22 bp, Homo sapiens
tccctcctggccgtcaccgctg

SEQ ID NO: 7111541 - DNA, 22 bp, Homo sapiens
tccctcctggtgatgatgcaaa

SEQ ID NO: 7111542 - DNA, 22 bp, Homo sapiens
tccctccttaataagaggtctg

SEQ ID NO: 7111543 - DNA, 22 bp, Homo sapiens
tccctcctgcatgaggctcggc

SEQ ID NO: 7111544 - DNA, 22 bp, Homo sapiens
tccctcctgcatgaggctcggc

SEQ ID NO: 7111545 - DNA, 21 bp, Homo sapiens
tccctcagaagctcttggtca

SEQ ID NO: 7111546 - DNA, 21 bp, Homo sapiens
tccctcagaagctcttggtca

SEQ ID NO: 7111547 - DNA, 20 bp, Homo sapiens
tccctcctgcagatagagaa

SEQ ID NO: 7111548 - DNA, 20 bp, Homo sapiens
tccctcctgcagatagagaa

SEQ ID NO: 7111549 - DNA, 22 bp, Homo sapiens
catttacacttctaaccacaag

SEQ ID NO: 7111550 - DNA, 22 bp, Homo sapiens
tccctcagaaattctctctgaa

SEQ ID NO: 7111551 - DNA, 22 bp, Homo sapiens
catttacacttctaaccacaag

SEQ ID NO: 7111552 - DNA, 22 bp, Homo sapiens
catttacacttctaaccacaag

SEQ ID NO: 7111553 - DNA, 22 bp, Homo sapiens
catttacacacagaggtgtgct

SEQ ID NO: 7111554 - DNA, 22 bp, Homo sapiens
catttacacacagaggtgtgct

SEQ ID NO: 7111555 - DNA, 22 bp, Homo sapiens
catttacacttctaaccacaag

SEQ ID NO: 7111556 - DNA, 22 bp, Homo sapiens
catttacacacagaggtgtgct

SEQ ID NO: 7111557 - DNA, 22 bp, Homo sapiens
catttacacacagaggtgtgct

SEQ ID NO: 7111558 - DNA, 22 bp, Homo sapiens
catttacaatgtacaggttgtg

SEQ ID NO: 7111559 - DNA, 22 bp, Homo sapiens
catttacaatgtacaggttgtg

SEQ ID NO: 7111560 - DNA, 22 bp, Homo sapiens
catttaatgcctttgccatcca

SEQ ID NO: 7111561 - DNA, 22 bp, Homo sapiens
catttacaatgtacaggttgtg

SEQ ID NO: 7111562 - DNA, 22 bp, Homo sapiens
catttacaatgtacaggttgtg

SEQ ID NO: 7111563 - DNA, 22 bp, Homo sapiens
catttaatagatgctgtttcag

SEQ ID NO: 7111564 - DNA, 22 bp, Homo sapiens
catttaatagatgctgtttcag

SEQ ID NO: 7111565 - DNA, 22 bp, Homo sapiens
catttaatagatgctgtttcag

SEQ ID NO: 7111566 - DNA, 22 bp, Homo sapiens
catttaatccatagaggaatgt

SEQ ID NO: 7111567 - DNA, 22 bp, Homo sapiens
catttaatccatagaggaatgt

SEQ ID NO: 7111568 - DNA, 22 bp, Homo sapiens
catttaatcctcacaagcctat

SEQ ID NO: 7111569 - DNA, 22 bp, Homo sapiens
catttaatctggctcatgagca

SEQ ID NO: 7111570 - DNA, 22 bp, Homo sapiens
catttaatctggctcatgagca

SEQ ID NO: 7111571 - DNA, 22 bp, Homo sapiens
catttaatgcacggatgtagcc

SEQ ID NO: 7111572 - DNA, 22 bp, Homo sapiens
catttaatgcacggatgtagcc

SEQ ID NO: 7111573 - DNA, 22 bp, Homo sapiens
cagggaaactaggaaataagct

SEQ ID NO: 7111574 - DNA, 22 bp, Homo sapiens
cagggaaagttcttgtccactc

SEQ ID NO: 7111575 - DNA, 22 bp, Homo sapiens
cagggaaagttcttgtccactc

SEQ ID NO: 7111576 - DNA, 22 bp, Homo sapiens
cagggaaagttcttgtccactc

SEQ ID NO: 7111577 - DNA, 22 bp, Homo sapiens
cagggaagaatagttagcaaag

SEQ ID NO: 7111578 - DNA, 22 bp, Homo sapiens
cagggaagaatagttagcaaag

SEQ ID NO: 7111579 - DNA, 22 bp, Homo sapiens
cagggaagagccgatgctgcag

SEQ ID NO: 7111580 - DNA, 22 bp, Homo sapiens
cagggaagagccgatgctgcag

SEQ ID NO: 7111581 - DNA, 22 bp, Homo sapiens
cagggaagagccgatgctgcag

SEQ ID NO: 7111582 - DNA, 22 bp, Homo sapiens
cagggaagagccgatgctgcag

SEQ ID NO: 7111583 - DNA, 22 bp, Homo sapiens
cagggaagagccgatgctgcag

SEQ ID NO: 7111584 - DNA, 22 bp, Homo sapiens
cagggaaggctgcaaatgttaa

SEQ ID NO: 7111585 - DNA, 22 bp, Homo sapiens
caggcttggcagggaggctggt

SEQ ID NO: 7111586 - DNA, 22 bp, Homo sapiens
caggcttgggagcagagccact

SEQ ID NO: 7111587 - DNA, 22 bp, Homo sapiens
caggcttggttggggcgaggga

SEQ ID NO: 7111588 - DNA, 22 bp, Homo sapiens
caggcttggttggggcgaggga

SEQ ID NO: 7111589 - DNA, 22 bp, Homo sapiens
caggcttggttggggcgaggga

SEQ ID NO: 7111590 - DNA, 22 bp, Homo sapiens
caggcttggagggcagtggcat

SEQ ID NO: 7111591 - DNA, 22 bp, Homo sapiens
caggcttggcagggaggctggt

SEQ ID NO: 7111592 - DNA, 22 bp, Homo sapiens
caggcttggcagggaggctggt

SEQ ID NO: 7111593 - DNA, 22 bp, Homo sapiens
caggctgtctgaatggaggccc

SEQ ID NO: 7111594 - DNA, 22 bp, Homo sapiens
caggctgtctgaatggaggccc

SEQ ID NO: 7111595 - DNA, 22 bp, Homo sapiens
caggctgtctgaatggaggccc

SEQ ID NO: 7111596 - DNA, 22 bp, Homo sapiens
caggctgtccaggctcctttgg

SEQ ID NO: 7111597 - DNA, 22 bp, Homo sapiens
caggctgtccaggctcctttgg

SEQ ID NO: 7111598 - DNA, 22 bp, Homo sapiens
caggctgtctgaatggaggccc

SEQ ID NO: 7111599 - DNA, 22 bp, Homo sapiens
tagaaacaagggagaggattct

SEQ ID NO: 7111600 - DNA, 22 bp, Homo sapiens
tagaaacaagggagaggattct

SEQ ID NO: 7111601 - DNA, 22 bp, Homo sapiens
tagattcttctaggtctttagc

SEQ ID NO: 7111602 - DNA, 22 bp, Homo sapiens
tagattctgaccctctttttac

SEQ ID NO: 7111603 - DNA, 22 bp, Homo sapiens
tagattcatgcagtatgctagt

SEQ ID NO: 7111604 - DNA, 22 bp, Homo sapiens
tagattcagatatttaggacaa

SEQ ID NO: 7111605 - DNA, 22 bp, Homo sapiens
tagatacacacacagtcatgtg

SEQ ID NO: 7111606 - DNA, 22 bp, Homo sapiens
tagatacaggcaagattatgaa

SEQ ID NO: 7111607 - DNA, 22 bp, Homo sapiens
tagattcagatatttaggacaa

SEQ ID NO: 7111608 - DNA, 22 bp, Homo sapiens
cagggacaatggcagagcctga

SEQ ID NO: 7111609 - DNA, 22 bp, Homo sapiens
cagggacaatggcagagcctga

SEQ ID NO: 7111610 - DNA, 22 bp, Homo sapiens
cagggacaaggaataagattag

SEQ ID NO: 7111611 - DNA, 22 bp, Homo sapiens
cagggacaatggcagagcctga

SEQ ID NO: 7111612 - DNA, 22 bp, Homo sapiens
cagggacaaacaaggttgggga

SEQ ID NO: 7111613 - DNA, 22 bp, Homo sapiens
cagggacaaacaaggttgggga

SEQ ID NO: 7111614 - DNA, 22 bp, Homo sapiens
cagggacaaacaaggttgggga

SEQ ID NO: 7111615 - DNA, 22 bp, Homo sapiens
cagggacaaacaaggttgggga

SEQ ID NO: 7111616 - DNA, 22 bp, Homo sapiens
cagggacaaagtgagaaaggaa

SEQ ID NO: 7111617 - DNA, 20 bp, Homo sapiens
cagggacagcagtgggtttt

SEQ ID NO: 7111618 - DNA, 20 bp, Homo sapiens
cagggacagcagtgggtttt

SEQ ID NO: 7111619 - DNA, 20 bp, Homo sapiens
cagggacagcagtgggtttt

SEQ ID NO: 7111620 - DNA, 20 bp, Homo sapiens
cagggacagcagtgggtttt

SEQ ID NO: 7111621 - DNA, 22 bp, Homo sapiens
cagggacagcactaaactcttg

SEQ ID NO: 7111622 - DNA, 22 bp, Homo sapiens
cagggacagcactaaactcttg

SEQ ID NO: 7111623 - DNA, 22 bp, Homo sapiens
cagggacagagactgcaccttg

SEQ ID NO: 7111624 - DNA, 22 bp, Homo sapiens
cagggacagagactgcaccttg

SEQ ID NO: 7111625 - DNA, 22 bp, Homo sapiens
cagggacagagactgcaccttg

SEQ ID NO: 7111626 - DNA, 22 bp, Homo sapiens
cagggacaatggcagagcctga

SEQ ID NO: 7111627 - DNA, 22 bp, Homo sapiens
cagggacagagactgcaccttg

SEQ ID NO: 7111628 - DNA, 22 bp, Homo sapiens
cagggacagagactgcaccttg

SEQ ID NO: 7111629 - DNA, 22 bp, Homo sapiens
caggctgcagtgcagtggctat

SEQ ID NO: 7111630 - DNA, 22 bp, Homo sapiens
caggctgcagtgcagtggctat

SEQ ID NO: 7111631 - DNA, 22 bp, Homo sapiens
caggctgcagtgcagtggctat

SEQ ID NO: 7111632 - DNA, 22 bp, Homo sapiens
caggctgcagtgcagtggctat

SEQ ID NO: 7111633 - DNA, 22 bp, Homo sapiens
caggctgccaaggctggggagg

SEQ ID NO: 7111634 - DNA, 22 bp, Homo sapiens
caggctgccaaggctggggagg

SEQ ID NO: 7111635 - DNA, 22 bp, Homo sapiens
caggctgcccggcaagttgcgc

SEQ ID NO: 7111636 - DNA, 22 bp, Homo sapiens
caggctgcccggcaagttgcgc

SEQ ID NO: 7111637 - DNA, 22 bp, Homo sapiens
caggctgccgtgaagcaggcct

SEQ ID NO: 7111638 - DNA, 22 bp, Homo sapiens
caggctgccgtgaagcaggcct

SEQ ID NO: 7111639 - DNA, 22 bp, Homo sapiens
caggctgccgaggctgcagaat

SEQ ID NO: 7111640 - DNA, 22 bp, Homo sapiens
caggctgccgaggctgcagaat

SEQ ID NO: 7111641 - DNA, 22 bp, Homo sapiens
caggctgccgtgaagcaggcct

SEQ ID NO: 7111642 - DNA, 22 bp, Homo sapiens
caggctgcccggcaagttgcgc

SEQ ID NO: 7111643 - DNA, 22 bp, Homo sapiens
caggctgccctagcttggacat

SEQ ID NO: 7111644 - DNA, 22 bp, Homo sapiens
caggctgccctagcttggacat

SEQ ID NO: 7111645 - DNA, 22 bp, Homo sapiens
caggctgccgaggctgcagaat

SEQ ID NO: 7111646 - DNA, 22 bp, Homo sapiens
caggctgccgaggctgcagaat

SEQ ID NO: 7111647 - DNA, 22 bp, Homo sapiens
caggctgccgaggctgcagaat

SEQ ID NO: 7111648 - DNA, 22 bp, Homo sapiens
caggctggcaatgcgtcaagca

SEQ ID NO: 7111649 - DNA, 22 bp, Homo sapiens
caggctggagttcagtggtgtg

SEQ ID NO: 7111650 - DNA, 22 bp, Homo sapiens
caggctggagttcagtggtgtg

SEQ ID NO: 7111651 - DNA, 22 bp, Homo sapiens
caggctggagttcagtggtgtg

SEQ ID NO: 7111652 - DNA, 22 bp, Homo sapiens
caggctggagttcagtggtgtg

SEQ ID NO: 7111653 - DNA, 22 bp, Homo sapiens
caggctggagttcagtggtgtg

SEQ ID NO: 7111654 - DNA, 22 bp, Homo sapiens
caggctggagtgcagtggtgcc

SEQ ID NO: 7111655 - DNA, 22 bp, Homo sapiens
caggctggagtgcagtggtgcc

SEQ ID NO: 7111656 - DNA, 22 bp, Homo sapiens
caggctggagtgcagtggtgcc

SEQ ID NO: 7111657 - DNA, 22 bp, Homo sapiens
caggctggagttcagtggtgtg

SEQ ID NO: 7111658 - DNA, 22 bp, Homo sapiens
caggctggagttcagtggtgtg

SEQ ID NO: 7111659 - DNA, 22 bp, Homo sapiens
caggctgccgtggggtccaggc

SEQ ID NO: 7111660 - DNA, 22 bp, Homo sapiens
caggctgccgtggggtccaggc

SEQ ID NO: 7111661 - DNA, 22 bp, Homo sapiens
caggctgccgtggggtccaggc

SEQ ID NO: 7111662 - DNA, 22 bp, Homo sapiens
caggctgccgtgaagcaggcct

SEQ ID NO: 7111663 - DNA, 22 bp, Homo sapiens
caggctgccgtgaagcaggcct

SEQ ID NO: 7111664 - DNA, 22 bp, Homo sapiens
caggctgccgtgaagcaggcct

SEQ ID NO: 7111665 - DNA, 22 bp, Homo sapiens
caggctgccgtgaagcaggcct

SEQ ID NO: 7111666 - DNA, 22 bp, Homo sapiens
caggctgggcagcctccccggc

SEQ ID NO: 7111667 - DNA, 22 bp, Homo sapiens
tagaaaagctctaaggcctctc

SEQ ID NO: 7111668 - DNA, 22 bp, Homo sapiens
tagaaaagtatgggactgacat

SEQ ID NO: 7111669 - DNA, 22 bp, Homo sapiens
caggctgggactgacccctgct

SEQ ID NO: 7111670 - DNA, 22 bp, Homo sapiens
caggctgggactgacccctgct

SEQ ID NO: 7111671 - DNA, 22 bp, Homo sapiens
caggctgggactgacccctgct

SEQ ID NO: 7111672 - DNA, 22 bp, Homo sapiens
caggctgggaacgccacccgct

SEQ ID NO: 7111673 - DNA, 22 bp, Homo sapiens
caggctgggaacgccacccgct

SEQ ID NO: 7111674 - DNA, 22 bp, Homo sapiens
caggctggcaatgcgtcaagca

SEQ ID NO: 7111675 - DNA, 22 bp, Homo sapiens
caggctggcaatgcgtcaagca

SEQ ID NO: 7111676 - DNA, 22 bp, Homo sapiens
tagaaaatagggcctgtggagc

SEQ ID NO: 7111677 - DNA, 22 bp, Homo sapiens
tagaaaatagggcctgtggagc

SEQ ID NO: 7111678 - DNA, 22 bp, Homo sapiens
tagaaaatagggcctgtggagc

SEQ ID NO: 7111679 - DNA, 22 bp, Homo sapiens
tagaaaatccagtgtggggaga

SEQ ID NO: 7111680 - DNA, 22 bp, Homo sapiens
tagaaaatggccaagcaggact

SEQ ID NO: 7111681 - DNA, 22 bp, Homo sapiens
tagaaaatggccaagcaggact

SEQ ID NO: 7111682 - DNA, 22 bp, Homo sapiens
tagaaaatggccaagcaggact

SEQ ID NO: 7111683 - DNA, 22 bp, Homo sapiens
tagaaaatggccaagcaggact

SEQ ID NO: 7111684 - DNA, 22 bp, Homo sapiens
tagaaaatggccaagcaggact

SEQ ID NO: 7111685 - DNA, 22 bp, Homo sapiens
tagaaaatgttccactgccatt

SEQ ID NO: 7111686 - DNA, 22 bp, Homo sapiens
tagaaaatgttccactgccatt

SEQ ID NO: 7111687 - DNA, 22 bp, Homo sapiens
tagaaaatgttccactgccatt

SEQ ID NO: 7111688 - DNA, 22 bp, Homo sapiens
tagaaacaaaatctgatgactc

SEQ ID NO: 7111689 - DNA, 22 bp, Homo sapiens
tagaaacaaaatctgatgactc

SEQ ID NO: 7111690 - DNA, 22 bp, Homo sapiens
tagaaacaaagacctgggtgct

SEQ ID NO: 7111691 - DNA, 22 bp, Homo sapiens
tagaaacaaagacctgggtgct

SEQ ID NO: 7111692 - DNA, 22 bp, Homo sapiens
caggcccaggccagtggttccc

SEQ ID NO: 7111693 - DNA, 22 bp, Homo sapiens
caggcccagcccttagccaggt

SEQ ID NO: 7111694 - DNA, 22 bp, Homo sapiens
caggcccagcccttagccaggt

SEQ ID NO: 7111695 - DNA, 22 bp, Homo sapiens
caggcccagcccttagccaggt

SEQ ID NO: 7111696 - DNA, 22 bp, Homo sapiens
caggcccagcccttagccaggt

SEQ ID NO: 7111697 - DNA, 22 bp, Homo sapiens
caggcccagcccttagccaggt

SEQ ID NO: 7111698 - DNA, 22 bp, Homo sapiens
caggcccagcccagcccttcga

SEQ ID NO: 7111699 - DNA, 22 bp, Homo sapiens
caggcccagcccttagccaggt

SEQ ID NO: 7111700 - DNA, 22 bp, Homo sapiens
caggcccagcccttagccaggt

SEQ ID NO: 7111701 - DNA, 22 bp, Homo sapiens
caggcccagcccagcccttcga

SEQ ID NO: 7111702 - DNA, 22 bp, Homo sapiens
caggcccagcccagcccttcga

SEQ ID NO: 7111703 - DNA, 22 bp, Homo sapiens
caggcccagaggcctcttccca

SEQ ID NO: 7111704 - DNA, 22 bp, Homo sapiens
caggcccagcccagcccttcga

SEQ ID NO: 7111705 - DNA, 22 bp, Homo sapiens
caggcccagaggcctcttccca

SEQ ID NO: 7111706 - DNA, 22 bp, Homo sapiens
caggcccagcccagcccttcga

SEQ ID NO: 7111707 - DNA, 22 bp, Homo sapiens
caggcctcctatgagcactagc

SEQ ID NO: 7111708 - DNA, 21 bp, Homo sapiens
caggccgggtgagcaggcagc

SEQ ID NO: 7111709 - DNA, 22 bp, Homo sapiens
caggcctcgaggagacagctac

SEQ ID NO: 7111710 - DNA, 22 bp, Homo sapiens
caggcctcgaggagacagctac

SEQ ID NO: 7111711 - DNA, 22 bp, Homo sapiens
caggcctcctatgagcactagc

SEQ ID NO: 7111712 - DNA, 22 bp, Homo sapiens
caggcccagggagggagaccaa

SEQ ID NO: 7111713 - DNA, 22 bp, Homo sapiens
caggcccagggagggagaccaa

SEQ ID NO: 7111714 - DNA, 22 bp, Homo sapiens
caggcccaggccagtggttccc

SEQ ID NO: 7111715 - DNA, 22 bp, Homo sapiens
caggcccagggagggagaccaa

SEQ ID NO: 7111716 - DNA, 22 bp, Homo sapiens
caggcccagggagggagaccaa

SEQ ID NO: 7111717 - DNA, 22 bp, Homo sapiens
caggccgggcactgcgctaggt

SEQ ID NO: 7111718 - DNA, 22 bp, Homo sapiens
caggccgggcactgcgctaggt

SEQ ID NO: 7111719 - DNA, 22 bp, Homo sapiens
caggccggggcggcgccatctt

SEQ ID NO: 7111720 - DNA, 22 bp, Homo sapiens
caggcctctatggtcagctgag

SEQ ID NO: 7111721 - DNA, 22 bp, Homo sapiens
caggcctctccttagtctggca

SEQ ID NO: 7111722 - DNA, 22 bp, Homo sapiens
caggcctctatggtcagctgag

SEQ ID NO: 7111723 - DNA, 22 bp, Homo sapiens
caggcctctatggtcagctgag

SEQ ID NO: 7111724 - DNA, 22 bp, Homo sapiens
caggcctcgaggagacagctac

SEQ ID NO: 7111725 - DNA, 22 bp, Homo sapiens
caggcctctatggtcagctgag

SEQ ID NO: 7111726 - DNA, 22 bp, Homo sapiens
caggcctcgaggagacagctac

SEQ ID NO: 7111727 - DNA, 22 bp, Homo sapiens
caggcctcgaggagacagctac

SEQ ID NO: 7111728 - DNA, 22 bp, Homo sapiens
caggcctctccttagtctggca

SEQ ID NO: 7111729 - DNA, 22 bp, Homo sapiens
caggcctctccttagtctggca

SEQ ID NO: 7111730 - DNA, 20 bp, Homo sapiens
caggcctctgggggccctgg

SEQ ID NO: 7111731 - DNA, 22 bp, Homo sapiens
caggcctctccttagtctggca

SEQ ID NO: 7111732 - DNA, 19 bp, Homo sapiens
caggcctctggtctgctgt

SEQ ID NO: 7111733 - DNA, 19 bp, Homo sapiens
caggcctctggtctgctgt

SEQ ID NO: 7111734 - DNA, 19 bp, Homo sapiens
caggcctcttaccctctct

SEQ ID NO: 7111735 - DNA, 22 bp, Homo sapiens
tacattgctttctaatacatct

SEQ ID NO: 7111736 - DNA, 22 bp, Homo sapiens
tacattgtacttacaaatagtg

SEQ ID NO: 7111737 - DNA, 22 bp, Homo sapiens
tacattgctttctaatacatct

SEQ ID NO: 7111738 - DNA, 22 bp, Homo sapiens
tacattgctttctaatacatct

SEQ ID NO: 7111739 - DNA, 22 bp, Homo sapiens
tacattgctcattatattgctt

SEQ ID NO: 7111740 - DNA, 19 bp, Homo sapiens
tacattgctggtggggatg

SEQ ID NO: 7111741 - DNA, 22 bp, Homo sapiens
tacatgtttactccaagtcagg

SEQ ID NO: 7111742 - DNA, 22 bp, Homo sapiens
tacattgattcaggatataggc

SEQ ID NO: 7111743 - DNA, 22 bp, Homo sapiens
tacattgctagaaatgtatttt

SEQ ID NO: 7111744 - DNA, 22 bp, Homo sapiens
tacatgttcaaatttgtctttc

SEQ ID NO: 7111745 - DNA, 22 bp, Homo sapiens
tacatgttcaaatttgtctttc

SEQ ID NO: 7111746 - DNA, 22 bp, Homo sapiens
caggcctgcaggaaaggctccc

SEQ ID NO: 7111747 - DNA, 22 bp, Homo sapiens
caggcctgcttcttacccttca

SEQ ID NO: 7111748 - DNA, 22 bp, Homo sapiens
caggcctgagtgtggaagtctt

SEQ ID NO: 7111749 - DNA, 22 bp, Homo sapiens
caggcctgcaggaaaggctccc

SEQ ID NO: 7111750 - DNA, 22 bp, Homo sapiens
caggcctgagacatctgagata

SEQ ID NO: 7111751 - DNA, 22 bp, Homo sapiens
caggcctgagtgtggaagtctt

SEQ ID NO: 7111752 - DNA, 22 bp, Homo sapiens
caggcctgagtgtggaagtctt

SEQ ID NO: 7111753 - DNA, 22 bp, Homo sapiens
caggcctgaccctgagcttcac

SEQ ID NO: 7111754 - DNA, 22 bp, Homo sapiens
caggcctgaccctgagcttcac

SEQ ID NO: 7111755 - DNA, 22 bp, Homo sapiens
caggcctgagacatctgagata

SEQ ID NO: 7111756 - DNA, 22 bp, Homo sapiens
caggcctgagacatctgagata

SEQ ID NO: 7111757 - DNA, 22 bp, Homo sapiens
caggcctgaccctgagcttcac

SEQ ID NO: 7111758 - DNA, 22 bp, Homo sapiens
caggcctcttccatgcagcagc

SEQ ID NO: 7111759 - DNA, 18 bp, Homo sapiens
caggcctcttgatcttcc

SEQ ID NO: 7111760 - DNA, 18 bp, Homo sapiens
caggcctcttgatcttcc

SEQ ID NO: 7111761 - DNA, 18 bp, Homo sapiens
caggcctcttgatcttcc

SEQ ID NO: 7111762 - DNA, 22 bp, Homo sapiens
caggcctgaccctgagcttcac

SEQ ID NO: 7111763 - DNA, 22 bp, Homo sapiens
caggcctgaccctgagcttcac

SEQ ID NO: 7111764 - DNA, 22 bp, Homo sapiens
caggcctgaccctgagcttcac

SEQ ID NO: 7111765 - DNA, 19 bp, Homo sapiens
caggcctcttaccctctct

SEQ ID NO: 7111766 - DNA, 19 bp, Homo sapiens
caggcctcttaccctctct

SEQ ID NO: 7111767 - DNA, 22 bp, Homo sapiens
caggcctcttccatgcagcagc

SEQ ID NO: 7111768 - DNA, 22 bp, Homo sapiens
caggcctcttccatgcagcagc

SEQ ID NO: 7111769 - DNA, 22 bp, Homo sapiens
caggcctcttccatgcagcagc

SEQ ID NO: 7111770 - DNA, 22 bp, Homo sapiens
caggcctcttccatgcagcagc

SEQ ID NO: 7111771 - DNA, 22 bp, Homo sapiens
caggcctcttccatgcagcagc

SEQ ID NO: 7111772 - DNA, 22 bp, Homo sapiens
caggcgagggccctgaggagcc

SEQ ID NO: 7111773 - DNA, 22 bp, Homo sapiens
caggcgctgtggctcccacctg

SEQ ID NO: 7111774 - DNA, 22 bp, Homo sapiens
caggcggccatgatctggcagg

SEQ ID NO: 7111775 - DNA, 22 bp, Homo sapiens
caggcggccatgatctggcagg

SEQ ID NO: 7111776 - DNA, 22 bp, Homo sapiens
caggcgggacgtgggaggatca

SEQ ID NO: 7111777 - DNA, 22 bp, Homo sapiens
caggcgggcaggtgcggcccct

SEQ ID NO: 7111778 - DNA, 22 bp, Homo sapiens
tacatttcctgtcagagatata

SEQ ID NO: 7111779 - DNA, 22 bp, Homo sapiens
caggcctttctggggaagtgag

SEQ ID NO: 7111780 - DNA, 22 bp, Homo sapiens
caggcctttcttggggcttaga

SEQ ID NO: 7111781 - DNA, 18 bp, Homo sapiens
caggcctttgagacagaa

SEQ ID NO: 7111782 - DNA, 18 bp, Homo sapiens
caggcctttgagacagaa

SEQ ID NO: 7111783 - DNA, 22 bp, Homo sapiens
tacatttcctgtcagagatata

SEQ ID NO: 7111784 - DNA, 22 bp, Homo sapiens
tacatttataaggcttctctgt

SEQ ID NO: 7111785 - DNA, 22 bp, Homo sapiens
tacatttacagagccttctctg

SEQ ID NO: 7111786 - DNA, 22 bp, Homo sapiens
tacattgtttgagatagtttgt

SEQ ID NO: 7111787 - DNA, 22 bp, Homo sapiens
tacattgttttttcttgccatc

SEQ ID NO: 7111788 - DNA, 22 bp, Homo sapiens
tacattgtattatccgtgattg

SEQ ID NO: 7111789 - DNA, 22 bp, Homo sapiens
tacattgtctgcaattttctct

SEQ ID NO: 7111790 - DNA, 23 bp, Homo sapiens
tacattgtggatggagtcctggg

SEQ ID NO: 7111791 - DNA, 22 bp, Homo sapiens
tacattgtgttaaaacagaaga

SEQ ID NO: 7111792 - DNA, 22 bp, Homo sapiens
tacattgtgttaaaacagaaga

SEQ ID NO: 7111793 - DNA, 22 bp, Homo sapiens
tacattgttcatgcatgagaaa

SEQ ID NO: 7111794 - DNA, 22 bp, Homo sapiens
tactttaaaaactgataattca

SEQ ID NO: 7111795 - DNA, 22 bp, Homo sapiens
tacttgttgcttttgtgatcca

SEQ ID NO: 7111796 - DNA, 22 bp, Homo sapiens
tacttgttatcatcttttcctt

SEQ ID NO: 7111797 - DNA, 22 bp, Homo sapiens
tacttgttatcccttactcttg

SEQ ID NO: 7111798 - DNA, 22 bp, Homo sapiens
tactgtggtaacattttaaatt

SEQ ID NO: 7111799 - DNA, 22 bp, Homo sapiens
tactgtggttactgctattaga

SEQ ID NO: 7111800 - DNA, 22 bp, Homo sapiens
tactgtgtcttaggatgtggaa

SEQ ID NO: 7111801 - DNA, 22 bp, Homo sapiens
caggctagattggggccagtag

SEQ ID NO: 7111802 - DNA, 22 bp, Homo sapiens
caggctaaggaaaggctcaggt

SEQ ID NO: 7111803 - DNA, 22 bp, Homo sapiens
caggctcaaggctgacttccat

SEQ ID NO: 7111804 - DNA, 22 bp, Homo sapiens
caggctcaaggctgacttccat

SEQ ID NO: 7111805 - DNA, 22 bp, Homo sapiens
tactttaatatatgtgaagttc

SEQ ID NO: 7111806 - DNA, 22 bp, Homo sapiens
tactttaaaaactgataattca

SEQ ID NO: 7111807 - DNA, 22 bp, Homo sapiens
tactttatcagcgtcaaaggta

SEQ ID NO: 7111808 - DNA, 22 bp, Homo sapiens
tactttatattgtggctggcca

SEQ ID NO: 7111809 - DNA, 22 bp, Homo sapiens
tactttatcagcgtcaaaggta

SEQ ID NO: 7111810 - DNA, 22 bp, Homo sapiens
tactttatattgtggctggcca

SEQ ID NO: 7111811 - DNA, 22 bp, Homo sapiens
tactttacagtattagataatt

SEQ ID NO: 7111812 - DNA, 22 bp, Homo sapiens
tactttacagtattagataatt

SEQ ID NO: 7111813 - DNA, 22 bp, Homo sapiens
tactttattgtaaatgctgatg

SEQ ID NO: 7111814 - DNA, 18 bp, Homo sapiens
tactttattccccctcca

SEQ ID NO: 7111815 - DNA, 22 bp, Homo sapiens
tactttattgtaaatgctgatg

SEQ ID NO: 7111816 - DNA, 22 bp, Homo sapiens
tactttattgtaaatgctgatg

SEQ ID NO: 7111817 - DNA, 22 bp, Homo sapiens
tactttattcaggaaggctggt

SEQ ID NO: 7111818 - DNA, 18 bp, Homo sapiens
tactttattccccctcca

SEQ ID NO: 7111819 - DNA, 22 bp, Homo sapiens
tactttattcaggaaggctggt

SEQ ID NO: 7111820 - DNA, 22 bp, Homo sapiens
tactttatcagcgtcaaaggta

SEQ ID NO: 7111821 - DNA, 22 bp, Homo sapiens
caggccagtgtgcttcccaggc

SEQ ID NO: 7111822 - DNA, 22 bp, Homo sapiens
caggccagtgtgcttcccaggc

SEQ ID NO: 7111823 - DNA, 19 bp, Homo sapiens
caggccagtgtcagggggc

SEQ ID NO: 7111824 - DNA, 22 bp, Homo sapiens
caggccagtgtgcttcccaggc

SEQ ID NO: 7111825 - DNA, 22 bp, Homo sapiens
caggccagtgtgcttcccaggc

SEQ ID NO: 7111826 - DNA, 22 bp, Homo sapiens
caggccattaccgctgagaccc

SEQ ID NO: 7111827 - DNA, 22 bp, Homo sapiens
caggcccaaatgcaaccttctt

SEQ ID NO: 7111828 - DNA, 22 bp, Homo sapiens
caggcccaaatgcaaccttctt

SEQ ID NO: 7111829 - DNA, 22 bp, Homo sapiens
caggcccaaatgcaaccttctt

SEQ ID NO: 7111830 - DNA, 22 bp, Homo sapiens
caggcccaagactgatgagtct

SEQ ID NO: 7111831 - DNA, 22 bp, Homo sapiens
caggcccaagactgatgagtct

SEQ ID NO: 7111832 - DNA, 22 bp, Homo sapiens
caggcccaagactgatgagtct

SEQ ID NO: 7111833 - DNA, 22 bp, Homo sapiens
caggcccaagactgatgagtct

SEQ ID NO: 7111834 - DNA, 22 bp, Homo sapiens
caggcccacgaggcacacagag

SEQ ID NO: 7111835 - DNA, 22 bp, Homo sapiens
caggcccaagactgatgagtct

SEQ ID NO: 7111836 - DNA, 22 bp, Homo sapiens
caggcccacgaggcacacagag

SEQ ID NO: 7111837 - DNA, 22 bp, Homo sapiens
caggcccacgaggcacacagag

SEQ ID NO: 7111838 - DNA, 22 bp, Homo sapiens
caggcccacgaggcacacagag

SEQ ID NO: 7111839 - DNA, 22 bp, Homo sapiens
caggcccacgaggcacacagag

SEQ ID NO: 7111840 - DNA, 22 bp, Homo sapiens
caggcccacgaggcacacagag

SEQ ID NO: 7111841 - DNA, 22 bp, Homo sapiens
caggcccacgaggcacacagag

SEQ ID NO: 7111842 - DNA, 22 bp, Homo sapiens
caggcccactgcttgtctagtc

SEQ ID NO: 7111843 - DNA, 22 bp, Homo sapiens
caggcccactgcttgtctagtc

SEQ ID NO: 7111844 - DNA, 22 bp, Homo sapiens
caggcccactgcttgtctagtc

SEQ ID NO: 7111845 - DNA, 22 bp, Homo sapiens
caggcccagaggcctcttccca

SEQ ID NO: 7111846 - DNA, 22 bp, Homo sapiens
caggcccagaggcctcttccca

SEQ ID NO: 7111847 - DNA, 22 bp, Homo sapiens
caggccagggttgagaagagaa

SEQ ID NO: 7111848 - DNA, 22 bp, Homo sapiens
caggccaggtgctctagaatca

SEQ ID NO: 7111849 - DNA, 22 bp, Homo sapiens
caggccaggtggcaggcaaaac

SEQ ID NO: 7111850 - DNA, 22 bp, Homo sapiens
caggccagtgggaaatagggat

SEQ ID NO: 7111851 - DNA, 22 bp, Homo sapiens
caggccagtgggaaatagggat

SEQ ID NO: 7111852 - DNA, 22 bp, Homo sapiens
caggccagtgggaaatagggat

SEQ ID NO: 7111853 - DNA, 19 bp, Homo sapiens
caggccagtgtcagggggc

SEQ ID NO: 7111854 - DNA, 19 bp, Homo sapiens
caggccagtgtcagggggc

SEQ ID NO: 7111855 - DNA, 19 bp, Homo sapiens
caggccagtgtcagggggc

SEQ ID NO: 7111856 - DNA, 22 bp, Homo sapiens
tacaaaacagtgctctggtcct

SEQ ID NO: 7111857 - DNA, 22 bp, Homo sapiens
tacaaaacagtgctctggtcct

SEQ ID NO: 7111858 - DNA, 22 bp, Homo sapiens
tacaaaacagtgctctggtcct

SEQ ID NO: 7111859 - DNA, 22 bp, Homo sapiens
tacaaaacagtgctctggtcct

SEQ ID NO: 7111860 - DNA, 22 bp, Homo sapiens
tacaaaaggaagagggatctta

SEQ ID NO: 7111861 - DNA, 22 bp, Homo sapiens
tacaaaaggaagagggatctta

SEQ ID NO: 7111862 - DNA, 22 bp, Homo sapiens
tacaaaaggaagagggatctta

SEQ ID NO: 7111863 - DNA, 22 bp, Homo sapiens
tacaaaacagtgctctggtcct

SEQ ID NO: 7111864 - DNA, 22 bp, Homo sapiens
caggccagggttgagaagagaa

SEQ ID NO: 7111865 - DNA, 22 bp, Homo sapiens
caggccagagcgcgtggttggg

SEQ ID NO: 7111866 - DNA, 22 bp, Homo sapiens
caggccagagcgcgtggttggg

SEQ ID NO: 7111867 - DNA, 22 bp, Homo sapiens
tacaaaccaaggaacagtgatc

SEQ ID NO: 7111868 - DNA, 22 bp, Homo sapiens
tacaaaccaaggaacagtgatc

SEQ ID NO: 7111869 - DNA, 22 bp, Homo sapiens
tacaaaccaaggaacagtgatc

SEQ ID NO: 7111870 - DNA, 22 bp, Homo sapiens
tacaaaccagcagaataggtcc

SEQ ID NO: 7111871 - DNA, 22 bp, Homo sapiens
tacaaaagtaattacggttttt

SEQ ID NO: 7111872 - DNA, 22 bp, Homo sapiens
caggcatttcgcaaaggctgag

SEQ ID NO: 7111873 - DNA, 21 bp, Homo sapiens
caggccaaaaggttcaacatt

SEQ ID NO: 7111874 - DNA, 22 bp, Homo sapiens
caggccaaaattcaggcattct

SEQ ID NO: 7111875 - DNA, 22 bp, Homo sapiens
tacaaaaaattgatactgacga

SEQ ID NO: 7111876 - DNA, 21 bp, Homo sapiens
caggccaaaaggttcaacatt

SEQ ID NO: 7111877 - DNA, 22 bp, Homo sapiens
tacaaaaaattgatactgacga

SEQ ID NO: 7111878 - DNA, 22 bp, Homo sapiens
tacaaaaaattgatactgacga

SEQ ID NO: 7111879 - DNA, 22 bp, Homo sapiens
tacaaaaaattgatactgacga

SEQ ID NO: 7111880 - DNA, 22 bp, Homo sapiens
caggcattcctctatgaatatt

SEQ ID NO: 7111881 - DNA, 22 bp, Homo sapiens
caggcattcctctatgaatatt

SEQ ID NO: 7111882 - DNA, 22 bp, Homo sapiens
caggcatttcgcaaaggctgag

SEQ ID NO: 7111883 - DNA, 22 bp, Homo sapiens
caggcatggatctggaatcatt

SEQ ID NO: 7111884 - DNA, 22 bp, Homo sapiens
caggcatgggccatgggaagtg

SEQ ID NO: 7111885 - DNA, 22 bp, Homo sapiens
caggcatgggccatgggaagtg

SEQ ID NO: 7111886 - DNA, 22 bp, Homo sapiens
caggcatgtggcccaggggtga

SEQ ID NO: 7111887 - DNA, 22 bp, Homo sapiens
caggcatgtggcccaggggtga

SEQ ID NO: 7111888 - DNA, 22 bp, Homo sapiens
caggcatgtggcccaggggtga

SEQ ID NO: 7111889 - DNA, 22 bp, Homo sapiens
caggcatggagaggcagagact

SEQ ID NO: 7111890 - DNA, 22 bp, Homo sapiens
caggcatggagaggcagagact

SEQ ID NO: 7111891 - DNA, 22 bp, Homo sapiens
caggcatggagaggcagagact

SEQ ID NO: 7111892 - DNA, 22 bp, Homo sapiens
caggcatggatctggaatcatt

SEQ ID NO: 7111893 - DNA, 22 bp, Homo sapiens
caggcatggatctggaatcatt

SEQ ID NO: 7111894 - DNA, 22 bp, Homo sapiens
caggcatggatctggaatcatt

SEQ ID NO: 7111895 - DNA, 22 bp, Homo sapiens
caggcatgggccatgggaagtg

SEQ ID NO: 7111896 - DNA, 22 bp, Homo sapiens
caggcatgggccatgggaagtg

SEQ ID NO: 7111897 - DNA, 22 bp, Homo sapiens
caggcatggaaaagcccagagg

SEQ ID NO: 7111898 - DNA, 22 bp, Homo sapiens
caggcatggaaaagcccagagg

SEQ ID NO: 7111899 - DNA, 22 bp, Homo sapiens
caggcatggagaggcagagact

SEQ ID NO: 7111900 - DNA, 22 bp, Homo sapiens
caggcatggagaggcagagact

SEQ ID NO: 7111901 - DNA, 22 bp, Homo sapiens
caggcatggagaggcagagact

SEQ ID NO: 7111902 - DNA, 22 bp, Homo sapiens
caggcatgcttctgtctgggca

SEQ ID NO: 7111903 - DNA, 22 bp, Homo sapiens
caggcatgatcataggagttta

SEQ ID NO: 7111904 - DNA, 22 bp, Homo sapiens
caggcatgcttctgtctgggca

SEQ ID NO: 7111905 - DNA, 22 bp, Homo sapiens
caggcagggagctggaaaggat

SEQ ID NO: 7111906 - DNA, 22 bp, Homo sapiens
caggcatgatcataggagttta

SEQ ID NO: 7111907 - DNA, 22 bp, Homo sapiens
caggcatgatcataggagttta

SEQ ID NO: 7111908 - DNA, 22 bp, Homo sapiens
taatgtcaaggtgatagatttg

SEQ ID NO: 7111909 - DNA, 22 bp, Homo sapiens
taatgtcagcatagtttatttt

SEQ ID NO: 7111910 - DNA, 22 bp, Homo sapiens
taatgtcagtgacctggtttaa

SEQ ID NO: 7111911 - DNA, 22 bp, Homo sapiens
taatgtctagatcagacctcga

SEQ ID NO: 7111912 - DNA, 22 bp, Homo sapiens
taatgtctagatcagacctcga

SEQ ID NO: 7111913 - DNA, 22 bp, Homo sapiens
taatgtcagtgacctggtttaa

SEQ ID NO: 7111914 - DNA, 22 bp, Homo sapiens
taatgtctgtgtttcagtgcag

SEQ ID NO: 7111915 - DNA, 22 bp, Homo sapiens
taatgtctttaagagcattggg

SEQ ID NO: 7111916 - DNA, 22 bp, Homo sapiens
taatgtgtgtcatcagtagagt

SEQ ID NO: 7111917 - DNA, 22 bp, Homo sapiens
taatgttacactgcatggttca

SEQ ID NO: 7111918 - DNA, 22 bp, Homo sapiens
caggcagggagctggaaaggat

SEQ ID NO: 7111919 - DNA, 22 bp, Homo sapiens
caggcagggagctggaaaggat

SEQ ID NO: 7111920 - DNA, 22 bp, Homo sapiens
caggcagggagctggaaaggat

SEQ ID NO: 7111921 - DNA, 22 bp, Homo sapiens
taatcatatgggtaatccaatg

SEQ ID NO: 7111922 - DNA, 20 bp, Homo sapiens
taatcacttataagacaatg

SEQ ID NO: 7111923 - DNA, 22 bp, Homo sapiens
taatcagaagttacattagggt

SEQ ID NO: 7111924 - DNA, 22 bp, Homo sapiens
taatcactgggcgtttggtact

SEQ ID NO: 7111925 - DNA, 22 bp, Homo sapiens
taatcatatgggtaatccaatg

SEQ ID NO: 7111926 - DNA, 19 bp, Homo sapiens
taatccaaggctgctctta

SEQ ID NO: 7111927 - DNA, 22 bp, Homo sapiens
taatccagcgggtgattgcaca

SEQ ID NO: 7111928 - DNA, 22 bp, Homo sapiens
taatgtacaagaggctagggtg

SEQ ID NO: 7111929 - DNA, 22 bp, Homo sapiens
taatgtacctccagatgttgta

SEQ ID NO: 7111930 - DNA, 22 bp, Homo sapiens
taatgtactgatgggaagtggt

SEQ ID NO: 7111931 - DNA, 22 bp, Homo sapiens
taatgtataacaaatactcatc

SEQ ID NO: 7111932 - DNA, 22 bp, Homo sapiens
taatgtataacaaatactcatc

SEQ ID NO: 7111933 - DNA, 22 bp, Homo sapiens
taatgtataacaaatactcatc

SEQ ID NO: 7111934 - DNA, 22 bp, Homo sapiens
taatgtatttgttcagaagagt

SEQ ID NO: 7111935 - DNA, 22 bp, Homo sapiens
taatgtatttgttcagaagagt

SEQ ID NO: 7111936 - DNA, 20 bp, Homo sapiens
taatgtcaaagtcacaaggt

SEQ ID NO: 7111937 - DNA, 22 bp, Homo sapiens
taatgtcaaggtcattctagag

SEQ ID NO: 7111938 - DNA, 22 bp, Homo sapiens
taatgtcaaggtcattctagag

SEQ ID NO: 7111939 - DNA, 22 bp, Homo sapiens
taatcacagaaacagactgttt

SEQ ID NO: 7111940 - DNA, 22 bp, Homo sapiens
taatcacagaaacagactgttt

SEQ ID NO: 7111941 - DNA, 22 bp, Homo sapiens
taatcacagaaacagactgttt

SEQ ID NO: 7111942 - DNA, 22 bp, Homo sapiens
taatcacagaaatgcccattca

SEQ ID NO: 7111943 - DNA, 22 bp, Homo sapiens
taatcacatcagggtaaatggg

SEQ ID NO: 7111944 - DNA, 22 bp, Homo sapiens
taatatctggcattcaaacatg

SEQ ID NO: 7111945 - DNA, 22 bp, Homo sapiens
taatatctggcattcaaacatg

SEQ ID NO: 7111946 - DNA, 22 bp, Homo sapiens
taatatctacttcatagagttt

SEQ ID NO: 7111947 - DNA, 22 bp, Homo sapiens
taatatctggcattcaaacatg

SEQ ID NO: 7111948 - DNA, 22 bp, Homo sapiens
taatacagatacaaaggaggac

SEQ ID NO: 7111949 - DNA, 22 bp, Homo sapiens
taatacagacaacttgccaaat

SEQ ID NO: 7111950 - DNA, 22 bp, Homo sapiens
taatatgtgttactgacttttt

SEQ ID NO: 7111951 - DNA, 22 bp, Homo sapiens
taatatttctaccctgctgcct

SEQ ID NO: 7111952 - DNA, 22 bp, Homo sapiens
gtgcttaacctagtttctagta

SEQ ID NO: 7111953 - DNA, 22 bp, Homo sapiens
gtgcttaaggcagtctgtcaaa

SEQ ID NO: 7111954 - DNA, 22 bp, Homo sapiens
gtgcttaatacatgtcaataac

SEQ ID NO: 7111955 - DNA, 22 bp, Homo sapiens
gtgcttaatacatgtcaataac

SEQ ID NO: 7111956 - DNA, 22 bp, Homo sapiens
gtgcttcaagttcttaatgttt

SEQ ID NO: 7111957 - DNA, 22 bp, Homo sapiens
gtgcttcactgacctgttttca

SEQ ID NO: 7111958 - DNA, 22 bp, Homo sapiens
gtgcttctctgctctacccggc

SEQ ID NO: 7111959 - DNA, 22 bp, Homo sapiens
gtgcttctctgctctacccggc

SEQ ID NO: 7111960 - DNA, 22 bp, Homo sapiens
gtgcttctcttcacacccaact

SEQ ID NO: 7111961 - DNA, 22 bp, Homo sapiens
cagctattggcaagaagtggtg

SEQ ID NO: 7111962 - DNA, 22 bp, Homo sapiens
cagctattgataaatgttgggg

SEQ ID NO: 7111963 - DNA, 22 bp, Homo sapiens
gtgcttctgccaactaattaac

SEQ ID NO: 7111964 - DNA, 22 bp, Homo sapiens
cagctattgataaatgttgggg

SEQ ID NO: 7111965 - DNA, 22 bp, Homo sapiens
cagctattggcaagaagtggtg

SEQ ID NO: 7111966 - DNA, 22 bp, Homo sapiens
cagctattggtccacaggtatg

SEQ ID NO: 7111967 - DNA, 22 bp, Homo sapiens
cagctattggtccacaggtatg

SEQ ID NO: 7111968 - DNA, 22 bp, Homo sapiens
cagctattggtccacaggtatg

SEQ ID NO: 7111969 - DNA, 22 bp, Homo sapiens
cagctattgttctgtataatga

SEQ ID NO: 7111970 - DNA, 22 bp, Homo sapiens
cagctatttatctttcatgata

SEQ ID NO: 7111971 - DNA, 22 bp, Homo sapiens
cagctatttatctttcatgata

SEQ ID NO: 7111972 - DNA, 22 bp, Homo sapiens
cagctatttgtaggaaaactgt

SEQ ID NO: 7111973 - DNA, 22 bp, Homo sapiens
cagctattttctcattaaggat

SEQ ID NO: 7111974 - DNA, 22 bp, Homo sapiens
cagctatttgtaggaaaactgt

SEQ ID NO: 7111975 - DNA, 22 bp, Homo sapiens
cagctattttctcattaaggat

SEQ ID NO: 7111976 - DNA, 22 bp, Homo sapiens
cagctattttgcctatcatggt

SEQ ID NO: 7111977 - DNA, 22 bp, Homo sapiens
cagctcaagtttcccaggtcag

SEQ ID NO: 7111978 - DNA, 22 bp, Homo sapiens
cagctattttgcctatcatggt

SEQ ID NO: 7111979 - DNA, 22 bp, Homo sapiens
cagctcagacgcaggtcgagca

SEQ ID NO: 7111980 - DNA, 22 bp, Homo sapiens
cagctcagacgcaggtcgagca

SEQ ID NO: 7111981 - DNA, 22 bp, Homo sapiens
cagctcagacgcaggtcgagca

SEQ ID NO: 7111982 - DNA, 22 bp, Homo sapiens
taagtcatcccataacagtgct

SEQ ID NO: 7111983 - DNA, 22 bp, Homo sapiens
taagtattggcctatagctaga

SEQ ID NO: 7111984 - DNA, 22 bp, Homo sapiens
taagtcacttaagtttgcatgt

SEQ ID NO: 7111985 - DNA, 22 bp, Homo sapiens
taagtcacttattccacaagat

SEQ ID NO: 7111986 - DNA, 23 bp, Homo sapiens
cagctcagcacataggaggtact

SEQ ID NO: 7111987 - DNA, 23 bp, Homo sapiens
cagctcagagtgtgtcctgtttc

SEQ ID NO: 7111988 - DNA, 23 bp, Homo sapiens
cagctcagcacataggaggtact

SEQ ID NO: 7111989 - DNA, 22 bp, Homo sapiens
taaggcagcctcagggtagggt

SEQ ID NO: 7111990 - DNA, 22 bp, Homo sapiens
taaggcagcctcagggtagggt

SEQ ID NO: 7111991 - DNA, 22 bp, Homo sapiens
taaggcagctgagcttctaaca

SEQ ID NO: 7111992 - DNA, 22 bp, Homo sapiens
taagtattggcctatagctaga

SEQ ID NO: 7111993 - DNA, 22 bp, Homo sapiens
caggcaccaatagggatcgtgg

SEQ ID NO: 7111994 - DNA, 22 bp, Homo sapiens
taagtcttgaaatatttcctat

SEQ ID NO: 7111995 - DNA, 22 bp, Homo sapiens
taagtcttgaaatatttcctat

SEQ ID NO: 7111996 - DNA, 22 bp, Homo sapiens
taagtcgtggatgattcttcgg

SEQ ID NO: 7111997 - DNA, 22 bp, Homo sapiens
taagtcttcatagtctaatgtc

SEQ ID NO: 7111998 - DNA, 22 bp, Homo sapiens
taagtcctagctttggtaggaa

SEQ ID NO: 7111999 - DNA, 17 bp, Homo sapiens
taagtcctagttatttt

SEQ ID NO: 7112000 - DNA, 22 bp, Homo sapiens
taagtcctattccaggtctctc

SEQ ID NO: 7112001 - DNA, 22 bp, Homo sapiens
taagtcctattccaggtctctc

SEQ ID NO: 7112002 - DNA, 22 bp, Homo sapiens
taagtcctggctggtttgaagc

SEQ ID NO: 7112003 - DNA, 22 bp, Homo sapiens
taagtccttcacctaatcctca

SEQ ID NO: 7112004 - DNA, 22 bp, Homo sapiens
taagtccaagggtatgagttgg

SEQ ID NO: 7112005 - DNA, 22 bp, Homo sapiens
taagtccaagggtatgagttgg

SEQ ID NO: 7112006 - DNA, 22 bp, Homo sapiens
taagtccacaggagttgtgttc

SEQ ID NO: 7112007 - DNA, 22 bp, Homo sapiens
taagtccacaggagttgtgttc

SEQ ID NO: 7112008 - DNA, 22 bp, Homo sapiens
taagtccacaggagttgtgttc

SEQ ID NO: 7112009 - DNA, 22 bp, Homo sapiens
taagtccacaggctgacagcgg

SEQ ID NO: 7112010 - DNA, 22 bp, Homo sapiens
taagtccacaggctgacagcgg

SEQ ID NO: 7112011 - DNA, 22 bp, Homo sapiens
taagtccacctcattcttcagc

SEQ ID NO: 7112012 - DNA, 22 bp, Homo sapiens
taagtccacctcattcttcagc

SEQ ID NO: 7112013 - DNA, 22 bp, Homo sapiens
taagtccacaggctgacagcgg

SEQ ID NO: 7112014 - DNA, 22 bp, Homo sapiens
taagtccactatatccttctct

SEQ ID NO: 7112015 - DNA, 22 bp, Homo sapiens
taagtccagtgttctctctgtg

SEQ ID NO: 7112016 - DNA, 22 bp, Homo sapiens
taagtccagtgttctctctgtg

SEQ ID NO: 7112017 - DNA, 22 bp, Homo sapiens
taagtccataatggcagtaaat

SEQ ID NO: 7112018 - DNA, 22 bp, Homo sapiens
taagtccataatggcagtaaat

SEQ ID NO: 7112019 - DNA, 22 bp, Homo sapiens
taagtcccccacttgccacagg

SEQ ID NO: 7112020 - DNA, 22 bp, Homo sapiens
taagtcctaacagactgggggc

SEQ ID NO: 7112021 - DNA, 22 bp, Homo sapiens
taagtcctaatggcagaagtct

SEQ ID NO: 7112022 - DNA, 22 bp, Homo sapiens
taagtcctagatgattcacaga

SEQ ID NO: 7112023 - DNA, 22 bp, Homo sapiens
taagtcctagatgattcacaga

SEQ ID NO: 7112024 - DNA, 22 bp, Homo sapiens
caggcaccccaggtgagcactg

SEQ ID NO: 7112025 - DNA, 22 bp, Homo sapiens
caggcaccccaggtgagcactg

SEQ ID NO: 7112026 - DNA, 22 bp, Homo sapiens
caggcacccagcccagtcgcac

SEQ ID NO: 7112027 - DNA, 22 bp, Homo sapiens
caggcacccagcccagtcgcac

SEQ ID NO: 7112028 - DNA, 22 bp, Homo sapiens
caggcaccagtgagaagggcct

SEQ ID NO: 7112029 - DNA, 22 bp, Homo sapiens
caggcacctgtgtgtctcaggg

SEQ ID NO: 7112030 - DNA, 22 bp, Homo sapiens
caggcacctttgtgcatgggca

SEQ ID NO: 7112031 - DNA, 22 bp, Homo sapiens
caggcacctcacgtgggtccca

SEQ ID NO: 7112032 - DNA, 22 bp, Homo sapiens
caggcacctcacgtgggtccca

SEQ ID NO: 7112033 - DNA, 22 bp, Homo sapiens
caggcaccctctgaggggaagc

SEQ ID NO: 7112034 - DNA, 22 bp, Homo sapiens
caggcaccctctgaggggaagc

SEQ ID NO: 7112035 - DNA, 22 bp, Homo sapiens
caggcaccccaggtgagcactg

SEQ ID NO: 7112036 - DNA, 22 bp, Homo sapiens
caggcagagttagtgatttagg

SEQ ID NO: 7112037 - DNA, 22 bp, Homo sapiens
caggcagatgctgacaagagtt

SEQ ID NO: 7112038 - DNA, 22 bp, Homo sapiens
caggcagatgctgacaagagtt

SEQ ID NO: 7112039 - DNA, 22 bp, Homo sapiens
caggcagatgctgacaagagtt

SEQ ID NO: 7112040 - DNA, 22 bp, Homo sapiens
caggcagagctgaagatagatg

SEQ ID NO: 7112041 - DNA, 22 bp, Homo sapiens
caggcagagctgaagatagatg

SEQ ID NO: 7112042 - DNA, 22 bp, Homo sapiens
caggcagagttagagcaactgg

SEQ ID NO: 7112043 - DNA, 22 bp, Homo sapiens
caggcagagttagagcaactgg

SEQ ID NO: 7112044 - DNA, 22 bp, Homo sapiens
caggcagagttagagcaactgg

SEQ ID NO: 7112045 - DNA, 21 bp, Homo sapiens
taataattccactacagagta

SEQ ID NO: 7112046 - DNA, 22 bp, Homo sapiens
taataattagttattgatcgtg

SEQ ID NO: 7112047 - DNA, 22 bp, Homo sapiens
caggcagcagccactctggtat

SEQ ID NO: 7112048 - DNA, 22 bp, Homo sapiens
taataattaacagtgatgggtc

SEQ ID NO: 7112049 - DNA, 22 bp, Homo sapiens
taataattaacagtgatgggtc

SEQ ID NO: 7112050 - DNA, 22 bp, Homo sapiens
taataattaacagtgatgggtc

SEQ ID NO: 7112051 - DNA, 22 bp, Homo sapiens
taataattagttattgatcgtg

SEQ ID NO: 7112052 - DNA, 22 bp, Homo sapiens
caggcagatgctgacaagagtt

SEQ ID NO: 7112053 - DNA, 22 bp, Homo sapiens
caggcagatttgctgccctcca

SEQ ID NO: 7112054 - DNA, 22 bp, Homo sapiens
caggcagatttgctgccctcca

SEQ ID NO: 7112055 - DNA, 22 bp, Homo sapiens
caggcagcagaggagtgtggga

SEQ ID NO: 7112056 - DNA, 22 bp, Homo sapiens
caggcagcagaggagtgtggga

SEQ ID NO: 7112057 - DNA, 22 bp, Homo sapiens
caggcagcagaggagtgtggga

SEQ ID NO: 7112058 - DNA, 22 bp, Homo sapiens
taatacagaagtgtattaaaat

SEQ ID NO: 7112059 - DNA, 22 bp, Homo sapiens
taataattttaaagaaggctag

SEQ ID NO: 7112060 - DNA, 22 bp, Homo sapiens
taatacaaggcaggaagcagta

SEQ ID NO: 7112061 - DNA, 22 bp, Homo sapiens
taatacaaggcaggaagcagta

SEQ ID NO: 7112062 - DNA, 22 bp, Homo sapiens
taatacaatggagttgggcccc

SEQ ID NO: 7112063 - DNA, 22 bp, Homo sapiens
taataattggcaatgttgagca

SEQ ID NO: 7112064 - DNA, 22 bp, Homo sapiens
taataattggcaatgttgagca

SEQ ID NO: 7112065 - DNA, 21 bp, Homo sapiens
taataattccactacagagta

SEQ ID NO: 7112066 - DNA, 21 bp, Homo sapiens
taataattccactacagagta

SEQ ID NO: 7112067 - DNA, 21 bp, Homo sapiens
taataattccactacagagta

SEQ ID NO: 7112068 - DNA, 22 bp, Homo sapiens
taataattggcaatgttgagca

SEQ ID NO: 7112069 - DNA, 22 bp, Homo sapiens
taataattttaaagaaggctag

SEQ ID NO: 7112070 - DNA, 22 bp, Homo sapiens
taataattttaaagaaggctag

SEQ ID NO: 7112071 - DNA, 22 bp, Homo sapiens
taataattggctaaccctggga

SEQ ID NO: 7112072 - DNA, 22 bp, Homo sapiens
taataattggcaatgttgagca

SEQ ID NO: 7112073 - DNA, 22 bp, Homo sapiens
taataattggcaatgttgagca

SEQ ID NO: 7112074 - DNA, 22 bp, Homo sapiens
taataattggctaaccctggga

SEQ ID NO: 7112075 - DNA, 22 bp, Homo sapiens
caggtaggcagccggtctctgg

SEQ ID NO: 7112076 - DNA, 22 bp, Homo sapiens
caggtagggatatgatggtgat

SEQ ID NO: 7112077 - DNA, 22 bp, Homo sapiens
caggtagggatatgatggtgat

SEQ ID NO: 7112078 - DNA, 22 bp, Homo sapiens
caggtagggatatgatggtgat

SEQ ID NO: 7112079 - DNA, 22 bp, Homo sapiens
caggtaggggagagctccaaca

SEQ ID NO: 7112080 - DNA, 22 bp, Homo sapiens
caggtaggggagagctccaaca

SEQ ID NO: 7112081 - DNA, 22 bp, Homo sapiens
caggtaggggagagctccaaca

SEQ ID NO: 7112082 - DNA, 22 bp, Homo sapiens
caggtaggtatggtgcagtctt

SEQ ID NO: 7112083 - DNA, 22 bp, Homo sapiens
caggtaggtatggtgcagtctt

SEQ ID NO: 7112084 - DNA, 22 bp, Homo sapiens
caggtaggtatggtgcagtctt

SEQ ID NO: 7112085 - DNA, 22 bp, Homo sapiens
caggtaggtatggtgcagtctt

SEQ ID NO: 7112086 - DNA, 22 bp, Homo sapiens
caggtagtccacagtgagggag

SEQ ID NO: 7112087 - DNA, 22 bp, Homo sapiens
caggtagtccagctctgggacc

SEQ ID NO: 7112088 - DNA, 22 bp, Homo sapiens
caggtcagaggtagatgagatg

SEQ ID NO: 7112089 - DNA, 22 bp, Homo sapiens
caggtcagaggtagatgagatg

SEQ ID NO: 7112090 - DNA, 22 bp, Homo sapiens
caggtcagaggtagatgagatg

SEQ ID NO: 7112091 - DNA, 22 bp, Homo sapiens
caggtcaaaggttagttatgtt

SEQ ID NO: 7112092 - DNA, 22 bp, Homo sapiens
caggtcagaggcgcagccccca

SEQ ID NO: 7112093 - DNA, 22 bp, Homo sapiens
caggtcagaggcgcagccccca

SEQ ID NO: 7112094 - DNA, 22 bp, Homo sapiens
caggtaggatggaagggctcaa

SEQ ID NO: 7112095 - DNA, 22 bp, Homo sapiens
caggtaggaggctccctagtcc

SEQ ID NO: 7112096 - DNA, 22 bp, Homo sapiens
caggtaggatggaagggctcaa

SEQ ID NO: 7112097 - DNA, 22 bp, Homo sapiens
caggtaggatggaagggctcaa

SEQ ID NO: 7112098 - DNA, 22 bp, Homo sapiens
caggtaggaaaagggtgtcagg

SEQ ID NO: 7112099 - DNA, 17 bp, Homo sapiens
caggtacattgctactg

SEQ ID NO: 7112100 - DNA, 22 bp, Homo sapiens
caggtacccaggctctttccaa

SEQ ID NO: 7112101 - DNA, 22 bp, Homo sapiens
caggtagctgctggccatgtac

SEQ ID NO: 7112102 - DNA, 22 bp, Homo sapiens
cagggtttctgttgagaagtcc

SEQ ID NO: 7112103 - DNA, 22 bp, Homo sapiens
cagggtggggctggctatcaaa

SEQ ID NO: 7112104 - DNA, 22 bp, Homo sapiens
caggtaaaaataaatttgtgag

SEQ ID NO: 7112105 - DNA, 22 bp, Homo sapiens
caggtaaaggttaactattaga

SEQ ID NO: 7112106 - DNA, 22 bp, Homo sapiens
caggtaagaccgtttaggcagt

SEQ ID NO: 7112107 - DNA, 22 bp, Homo sapiens
caggtaagaccgtttaggcagt

SEQ ID NO: 7112108 - DNA, 22 bp, Homo sapiens
caggtaaggtcacattctgaag

SEQ ID NO: 7112109 - DNA, 22 bp, Homo sapiens
caggtacaaagctactgcctga

SEQ ID NO: 7112110 - DNA, 22 bp, Homo sapiens
caggtacactcccttgtgctga

SEQ ID NO: 7112111 - DNA, 22 bp, Homo sapiens
caggtacactcccttgtgctga

SEQ ID NO: 7112112 - DNA, 22 bp, Homo sapiens
caggtacactcccttgtgctga

SEQ ID NO: 7112113 - DNA, 22 bp, Homo sapiens
caggtacactcccttgtgctga

SEQ ID NO: 7112114 - DNA, 22 bp, Homo sapiens
caggtgctgtcctgcacatgtc

SEQ ID NO: 7112115 - DNA, 22 bp, Homo sapiens
caggtgctgtgaatcttcataa

SEQ ID NO: 7112116 - DNA, 22 bp, Homo sapiens
caggtgctgtgaatcttcataa

SEQ ID NO: 7112117 - DNA, 22 bp, Homo sapiens
caggtgcttctgtaagaaagac

SEQ ID NO: 7112118 - DNA, 22 bp, Homo sapiens
caggtgctgcgtggcggagctg

SEQ ID NO: 7112119 - DNA, 22 bp, Homo sapiens
caggtgctgcgtggcggagctg

SEQ ID NO: 7112120 - DNA, 22 bp, Homo sapiens
caggtgctgtcctgcacatgtc

SEQ ID NO: 7112121 - DNA, 22 bp, Homo sapiens
caggtgctgtcctgcacatgtc

SEQ ID NO: 7112122 - DNA, 22 bp, Homo sapiens
caggtgctctgctgcaggtaag

SEQ ID NO: 7112123 - DNA, 22 bp, Homo sapiens
caggtgctctgctgcaggtaag

SEQ ID NO: 7112124 - DNA, 22 bp, Homo sapiens
caggtgctgcagggctggcgtc

SEQ ID NO: 7112125 - DNA, 22 bp, Homo sapiens
caggtgctgcagggctggcgtc

SEQ ID NO: 7112126 - DNA, 22 bp, Homo sapiens
caggtgctgcgtggcggagctg

SEQ ID NO: 7112127 - DNA, 22 bp, Homo sapiens
caggtgccgggaatgcagcaat

SEQ ID NO: 7112128 - DNA, 22 bp, Homo sapiens
caggtgcccagctcctgctgtg

SEQ ID NO: 7112129 - DNA, 22 bp, Homo sapiens
caggtgcctcaggatgagacaa

SEQ ID NO: 7112130 - DNA, 22 bp, Homo sapiens
caggtgctcccagagaagtgct

SEQ ID NO: 7112131 - DNA, 22 bp, Homo sapiens
caggtccacagcccatcactgc

SEQ ID NO: 7112132 - DNA, 22 bp, Homo sapiens
caggtccacagcccatcactgc

SEQ ID NO: 7112133 - DNA, 22 bp, Homo sapiens
caggtccaagagatcctcctac

SEQ ID NO: 7112134 - DNA, 22 bp, Homo sapiens
caggtccaattgcgctaaaatc

SEQ ID NO: 7112135 - DNA, 22 bp, Homo sapiens
caggtccaattgcgctaaaatc

SEQ ID NO: 7112136 - DNA, 22 bp, Homo sapiens
caggtccaccatgcctcaagcc

SEQ ID NO: 7112137 - DNA, 22 bp, Homo sapiens
caggtgaagaggataaaaagtt

SEQ ID NO: 7112138 - DNA, 22 bp, Homo sapiens
caggtgaagaggataaaaagtt

SEQ ID NO: 7112139 - DNA, 22 bp, Homo sapiens
caggtgaatcacttgagtccag

SEQ ID NO: 7112140 - DNA, 22 bp, Homo sapiens
caggtgaagaggataaaaagtt

SEQ ID NO: 7112141 - DNA, 22 bp, Homo sapiens
caggtgaatcacttgagtccag

SEQ ID NO: 7112142 - DNA, 22 bp, Homo sapiens
caggtgcccagctcctgctgtg

SEQ ID NO: 7112143 - DNA, 22 bp, Homo sapiens
caggtgacatcaacaggaccac

SEQ ID NO: 7112144 - DNA, 22 bp, Homo sapiens
caggtcagcacttggaggtgca

SEQ ID NO: 7112145 - DNA, 18 bp, Homo sapiens
caggtcagcctggcctca

SEQ ID NO: 7112146 - DNA, 22 bp, Homo sapiens
caggtcagcacttggaggtgca

SEQ ID NO: 7112147 - DNA, 22 bp, Homo sapiens
caggtcagcacttggaggtgca

SEQ ID NO: 7112148 - DNA, 22 bp, Homo sapiens
caggtcagcacttggaggtgca

SEQ ID NO: 7112149 - DNA, 22 bp, Homo sapiens
caggtcagcacttggaggtgca

SEQ ID NO: 7112150 - DNA, 22 bp, Homo sapiens
caggtcagcacttggaggtgca

SEQ ID NO: 7112151 - DNA, 22 bp, Homo sapiens
caggtcagctggtgccccaggt

SEQ ID NO: 7112152 - DNA, 22 bp, Homo sapiens
caggtcagctggtgccccaggt

SEQ ID NO: 7112153 - DNA, 22 bp, Homo sapiens
caggtccaactatttatctgtg

SEQ ID NO: 7112154 - DNA, 22 bp, Homo sapiens
caggtccaactatttatctgtg

SEQ ID NO: 7112155 - DNA, 22 bp, Homo sapiens
caggtccaagagatcctcctac

SEQ ID NO: 7112156 - DNA, 22 bp, Homo sapiens
caggtggccagtactcaaggat

SEQ ID NO: 7112157 - DNA, 22 bp, Homo sapiens
caggtggccagtactcaaggat

SEQ ID NO: 7112158 - DNA, 22 bp, Homo sapiens
caggtggcattgtcccgccagc

SEQ ID NO: 7112159 - DNA, 22 bp, Homo sapiens
caggtggcatgactgcctacaa

SEQ ID NO: 7112160 - DNA, 22 bp, Homo sapiens
caggtggcagaggtctctggaa

SEQ ID NO: 7112161 - DNA, 22 bp, Homo sapiens
caggtggatctctaaggactga

SEQ ID NO: 7112162 - DNA, 22 bp, Homo sapiens
caggtggagctgactgagggca

SEQ ID NO: 7112163 - DNA, 22 bp, Homo sapiens
caggtggagctgactgagggca

SEQ ID NO: 7112164 - DNA, 22 bp, Homo sapiens
caggtggagctgactgagggca

SEQ ID NO: 7112165 - DNA, 22 bp, Homo sapiens
caggtggcaaatgagtagcatt

SEQ ID NO: 7112166 - DNA, 22 bp, Homo sapiens
tattaaatgttatttgggttgt

SEQ ID NO: 7112167 - DNA, 22 bp, Homo sapiens
tattaaatgttatttgggttgt

SEQ ID NO: 7112168 - DNA, 22 bp, Homo sapiens
tattaaattatggatttaggag

SEQ ID NO: 7112169 - DNA, 22 bp, Homo sapiens
tattaaattatggatttaggag

SEQ ID NO: 7112170 - DNA, 20 bp, Homo sapiens
tattaggtagcactgggata

SEQ ID NO: 7112171 - DNA, 22 bp, Homo sapiens
tattaggtatgaactggcaacc

SEQ ID NO: 7112172 - DNA, 22 bp, Homo sapiens
tattaggtgtaccttgttaaac

SEQ ID NO: 7112173 - DNA, 22 bp, Homo sapiens
tattaggttagtgcaaaagttt

SEQ ID NO: 7112174 - DNA, 22 bp, Homo sapiens
tattaggttggtgcaaaagtaa

SEQ ID NO: 7112175 - DNA, 22 bp, Homo sapiens
tattaggttggtgcaaaagtca

SEQ ID NO: 7112176 - DNA, 22 bp, Homo sapiens
tattaggttgttgcaaaagtaa

SEQ ID NO: 7112177 - DNA, 22 bp, Homo sapiens
tattagtaaattccatgggagt

SEQ ID NO: 7112178 - DNA, 22 bp, Homo sapiens
tattagtaatacctgtctcata

SEQ ID NO: 7112179 - DNA, 22 bp, Homo sapiens
tattagtagcttgaaattggtg

SEQ ID NO: 7112180 - DNA, 19 bp, Homo sapiens
caggtggcgctctacaggg

SEQ ID NO: 7112181 - DNA, 19 bp, Homo sapiens
caggtggcgctctacaggg

SEQ ID NO: 7112182 - DNA, 22 bp, Homo sapiens
caggtggctaacggcctcatag

SEQ ID NO: 7112183 - DNA, 23 bp, Homo sapiens
caggtggctccacgaggggtggg

SEQ ID NO: 7112184 - DNA, 23 bp, Homo sapiens
caggtggctccacgaggggtggg

SEQ ID NO: 7112185 - DNA, 22 bp, Homo sapiens
tattatgattcggacgtggcag

SEQ ID NO: 7112186 - DNA, 22 bp, Homo sapiens
tattatgcaaatattcctacct

SEQ ID NO: 7112187 - DNA, 22 bp, Homo sapiens
tattatgcataggcaataatgg

SEQ ID NO: 7112188 - DNA, 22 bp, Homo sapiens
tattatgatcgtgactcaagga

SEQ ID NO: 7112189 - DNA, 22 bp, Homo sapiens
tattatgatcccagccctggag

SEQ ID NO: 7112190 - DNA, 22 bp, Homo sapiens
tattatgaggtatttggacttt

SEQ ID NO: 7112191 - DNA, 22 bp, Homo sapiens
tattatgaggggcagagggcat

SEQ ID NO: 7112192 - DNA, 22 bp, Homo sapiens
tattatgaggcttagggatgac

SEQ ID NO: 7112193 - DNA, 22 bp, Homo sapiens
tattatgaggactggtgtaagg

SEQ ID NO: 7112194 - DNA, 22 bp, Homo sapiens
tattatgagccaggtgctgtct

SEQ ID NO: 7112195 - DNA, 20 bp, Homo sapiens
tattatgacctgtgttctgg

SEQ ID NO: 7112196 - DNA, 22 bp, Homo sapiens
tattatcattggtaatatggtc

SEQ ID NO: 7112197 - DNA, 22 bp, Homo sapiens
tattatcagagctatttggaat

SEQ ID NO: 7112198 - DNA, 22 bp, Homo sapiens
tattatcatgttaattagtggg

SEQ ID NO: 7112199 - DNA, 22 bp, Homo sapiens
tattatcattaactgttgaatt

SEQ ID NO: 7112200 - DNA, 22 bp, Homo sapiens
tattagtgaaagaattagtttg

SEQ ID NO: 7112201 - DNA, 22 bp, Homo sapiens
tattagtctgtaaattgatgct

SEQ ID NO: 7112202 - DNA, 22 bp, Homo sapiens
tattatagactgagggtcaggc

SEQ ID NO: 7112203 - DNA, 22 bp, Homo sapiens
tattatagactgagggtcaggc

SEQ ID NO: 7112204 - DNA, 22 bp, Homo sapiens
tattatatttagtaatgtggag

SEQ ID NO: 7112205 - DNA, 22 bp, Homo sapiens
caggtggggggcttccgagcct

SEQ ID NO: 7112206 - DNA, 22 bp, Homo sapiens
caggtgggtacatcacagagac

SEQ ID NO: 7112207 - DNA, 22 bp, Homo sapiens
caggtgggtacatcacagagac

SEQ ID NO: 7112208 - DNA, 22 bp, Homo sapiens
caggtgggtacatcacagagac

SEQ ID NO: 7112209 - DNA, 22 bp, Homo sapiens
caggtgggtacatcacagagac

SEQ ID NO: 7112210 - DNA, 22 bp, Homo sapiens
tattatggcagcattcagtatg

SEQ ID NO: 7112211 - DNA, 22 bp, Homo sapiens
tattatggggggaacatcactc

SEQ ID NO: 7112212 - DNA, 22 bp, Homo sapiens
tattatggggggaacatcactc

SEQ ID NO: 7112213 - DNA, 22 bp, Homo sapiens
tattatggttgtaggttaacaa

SEQ ID NO: 7112214 - DNA, 22 bp, Homo sapiens
tattatgtaaaggttattgcag

SEQ ID NO: 7112215 - DNA, 22 bp, Homo sapiens
tattattaaatggcagaatttt

SEQ ID NO: 7112216 - DNA, 22 bp, Homo sapiens
tattattaaatggcagaatttt

SEQ ID NO: 7112217 - DNA, 22 bp, Homo sapiens
tattattaaatggcagaatttt

SEQ ID NO: 7112218 - DNA, 22 bp, Homo sapiens
caggtgggtacatcacagagac

SEQ ID NO: 7112219 - DNA, 22 bp, Homo sapiens
caggtgggtacatcacagagac

SEQ ID NO: 7112220 - DNA, 22 bp, Homo sapiens
caggtgggtacatcacagagac

SEQ ID NO: 7112221 - DNA, 18 bp, Homo sapiens
caggtgggtctcctgccc

SEQ ID NO: 7112222 - DNA, 18 bp, Homo sapiens
caggtgggtctcctgccc

SEQ ID NO: 7112223 - DNA, 18 bp, Homo sapiens
caggtgggtctcctgccc

SEQ ID NO: 7112224 - DNA, 18 bp, Homo sapiens
caggtgggtctcctgccc

SEQ ID NO: 7112225 - DNA, 18 bp, Homo sapiens
caggtgggtctcctgccc

SEQ ID NO: 7112226 - DNA, 18 bp, Homo sapiens
caggtgggtctcctgccc

SEQ ID NO: 7112227 - DNA, 18 bp, Homo sapiens
caggtgggtctcctgccc

SEQ ID NO: 7112228 - DNA, 18 bp, Homo sapiens
caggtgggtctcctgccc

SEQ ID NO: 7112229 - DNA, 22 bp, Homo sapiens
cagtattttcaggatttggaag

SEQ ID NO: 7112230 - DNA, 22 bp, Homo sapiens
cagtattttcaggatttggaag

SEQ ID NO: 7112231 - DNA, 22 bp, Homo sapiens
cagtattttccttgttaactta

SEQ ID NO: 7112232 - DNA, 22 bp, Homo sapiens
cagtatttttaagctgctttgt

SEQ ID NO: 7112233 - DNA, 22 bp, Homo sapiens
cagtatttttaagctgctttgt

SEQ ID NO: 7112234 - DNA, 22 bp, Homo sapiens
cagtatattctgcagagcctta

SEQ ID NO: 7112235 - DNA, 22 bp, Homo sapiens
cagtatattttagagaagtccc

SEQ ID NO: 7112236 - DNA, 22 bp, Homo sapiens
cagtatattttagagaagtccc

SEQ ID NO: 7112237 - DNA, 19 bp, Homo sapiens
cagtatcattgcacatagt

SEQ ID NO: 7112238 - DNA, 19 bp, Homo sapiens
cagtatcattgcacatagt

SEQ ID NO: 7112239 - DNA, 19 bp, Homo sapiens
cagtatcattgcacatagt

SEQ ID NO: 7112240 - DNA, 22 bp, Homo sapiens
cagtatctccacatgtaaagtg

SEQ ID NO: 7112241 - DNA, 20 bp, Homo sapiens
cagtatctcgctctcccaat

SEQ ID NO: 7112242 - DNA, 21 bp, Homo sapiens
cagtattttaagcagtgagtt

SEQ ID NO: 7112243 - DNA, 21 bp, Homo sapiens
cagtattttaagcagtgagtt

SEQ ID NO: 7112244 - DNA, 22 bp, Homo sapiens
caggtggtacttaaagtcagaa

SEQ ID NO: 7112245 - DNA, 23 bp, Homo sapiens
caggtggtagagaaaaatccaga

SEQ ID NO: 7112246 - DNA, 22 bp, Homo sapiens
caggtggtcaggcaaggacacg

SEQ ID NO: 7112247 - DNA, 22 bp, Homo sapiens
cagtatatgctctttcatcaaa

SEQ ID NO: 7112248 - DNA, 22 bp, Homo sapiens
caggtgggtgtatgaatgcaaa

SEQ ID NO: 7112249 - DNA, 19 bp, Homo sapiens
caggtggtaatctgagcct

SEQ ID NO: 7112250 - DNA, 22 bp, Homo sapiens
caggtgggtgtatgaatgcaaa

SEQ ID NO: 7112251 - DNA, 22 bp, Homo sapiens
caggtgggtgtatgaatgcaaa

SEQ ID NO: 7112252 - DNA, 22 bp, Homo sapiens
cagtcactggaatagctgagga

SEQ ID NO: 7112253 - DNA, 22 bp, Homo sapiens
cagtcactccagcctgcctcag

SEQ ID NO: 7112254 - DNA, 22 bp, Homo sapiens
cagtcactccagcctgcctcag

SEQ ID NO: 7112255 - DNA, 22 bp, Homo sapiens
cagtcaccttgaggactcagac

SEQ ID NO: 7112256 - DNA, 22 bp, Homo sapiens
cagtcaccttgaggactcagac

SEQ ID NO: 7112257 - DNA, 22 bp, Homo sapiens
cagtcaccttgaggactcagac

SEQ ID NO: 7112258 - DNA, 22 bp, Homo sapiens
cagtcaccatagaataaaacat

SEQ ID NO: 7112259 - DNA, 22 bp, Homo sapiens
cagtcacctagacagaacttac

SEQ ID NO: 7112260 - DNA, 22 bp, Homo sapiens
cagtcacctgaagacttgacca

SEQ ID NO: 7112261 - DNA, 22 bp, Homo sapiens
cagtcaccaccaggtggcagta

SEQ ID NO: 7112262 - DNA, 22 bp, Homo sapiens
cagtcaccaccaggtggcagta

SEQ ID NO: 7112263 - DNA, 22 bp, Homo sapiens
cagtcacatttcgacataacta

SEQ ID NO: 7112264 - DNA, 22 bp, Homo sapiens
cagtcacatttcgacataacta

SEQ ID NO: 7112265 - DNA, 22 bp, Homo sapiens
cagtcacatggatgatggatag

SEQ ID NO: 7112266 - DNA, 22 bp, Homo sapiens
cagtcacatggatgatggatag

SEQ ID NO: 7112267 - DNA, 22 bp, Homo sapiens
cagtcacattgccctgcattta

SEQ ID NO: 7112268 - DNA, 22 bp, Homo sapiens
cagtcacattgccctgcattta

SEQ ID NO: 7112269 - DNA, 22 bp, Homo sapiens
cagtcacaagcgtacctaattt

SEQ ID NO: 7112270 - DNA, 22 bp, Homo sapiens
cagtcaaacttataggcacatt

SEQ ID NO: 7112271 - DNA, 22 bp, Homo sapiens
cagtcaaacttataggcacatt

SEQ ID NO: 7112272 - DNA, 22 bp, Homo sapiens
cagtcacaagcgtacctaattt

SEQ ID NO: 7112273 - DNA, 22 bp, Homo sapiens
cagtcacacaagtggacttggg

SEQ ID NO: 7112274 - DNA, 22 bp, Homo sapiens
cagtcacacaagtggacttggg

SEQ ID NO: 7112275 - DNA, 17 bp, Homo sapiens
cagtcacaggtcttttc

SEQ ID NO: 7112276 - DNA, 22 bp, Homo sapiens
cagtcacataggtatacacata

SEQ ID NO: 7112277 - DNA, 22 bp, Homo sapiens
cagtcacataggtatacacata

SEQ ID NO: 7112278 - DNA, 22 bp, Homo sapiens
cagtcacataggtatacacata

SEQ ID NO: 7112279 - DNA, 22 bp, Homo sapiens
cagtcacagtgacaggatgtgg

SEQ ID NO: 7112280 - DNA, 22 bp, Homo sapiens
cagtcagggacaccagctagga

SEQ ID NO: 7112281 - DNA, 22 bp, Homo sapiens
cagtcagggacaccagctagga

SEQ ID NO: 7112282 - DNA, 22 bp, Homo sapiens
cagtcaggggtgggatcaaggc

SEQ ID NO: 7112283 - DNA, 22 bp, Homo sapiens
cagtcaggggtgggatcaaggc

SEQ ID NO: 7112284 - DNA, 22 bp, Homo sapiens
cagtcattatgggagttaatcc

SEQ ID NO: 7112285 - DNA, 22 bp, Homo sapiens
cagtcattttatttgaaaatta

SEQ ID NO: 7112286 - DNA, 22 bp, Homo sapiens
cagtccaacctgccccttgggc

SEQ ID NO: 7112287 - DNA, 22 bp, Homo sapiens
cagtcactggaatagctgagga

SEQ ID NO: 7112288 - DNA, 22 bp, Homo sapiens
cagtcacttacaaaaatataat

SEQ ID NO: 7112289 - DNA, 22 bp, Homo sapiens
cagtcaggaatgcctccttcct

SEQ ID NO: 7112290 - DNA, 22 bp, Homo sapiens
cagtcaggctgcgcttctctga

SEQ ID NO: 7112291 - DNA, 22 bp, Homo sapiens
cagtcaggctgcgcttctctga

SEQ ID NO: 7112292 - DNA, 20 bp, Homo sapiens
tatttgaaatggccaagtgt

SEQ ID NO: 7112293 - DNA, 22 bp, Homo sapiens
tatttgaagacagggtctttaa

SEQ ID NO: 7112294 - DNA, 22 bp, Homo sapiens
tatttgaagattcttctgatgt

SEQ ID NO: 7112295 - DNA, 22 bp, Homo sapiens
tatttgaagattcttctgatgt

SEQ ID NO: 7112296 - DNA, 22 bp, Homo sapiens
tatttgaagattcttctgatgt

SEQ ID NO: 7112297 - DNA, 22 bp, Homo sapiens
tattttaaagtgaagggtcttg

SEQ ID NO: 7112298 - DNA, 22 bp, Homo sapiens
tattttaaagactgccagccta

SEQ ID NO: 7112299 - DNA, 22 bp, Homo sapiens
tatttgaaggcatacattttga

SEQ ID NO: 7112300 - DNA, 22 bp, Homo sapiens
tatttgaaggcatacattttga

SEQ ID NO: 7112301 - DNA, 22 bp, Homo sapiens
tattttacaaatgggaatgctg

SEQ ID NO: 7112302 - DNA, 22 bp, Homo sapiens
tattttacaaatgggaatgctg

SEQ ID NO: 7112303 - DNA, 22 bp, Homo sapiens
tattttaaagtgaagggtcttg

SEQ ID NO: 7112304 - DNA, 22 bp, Homo sapiens
tattttacagactactttagat

SEQ ID NO: 7112305 - DNA, 22 bp, Homo sapiens
tattttacagactactttagat

SEQ ID NO: 7112306 - DNA, 22 bp, Homo sapiens
tattttacagactactttagat

SEQ ID NO: 7112307 - DNA, 22 bp, Homo sapiens
tcaaaacactattacctttaat

SEQ ID NO: 7112308 - DNA, 22 bp, Homo sapiens
tcaaaacactattacctttaat

SEQ ID NO: 7112309 - DNA, 22 bp, Homo sapiens
tcaaaacactattacctttaat

SEQ ID NO: 7112310 - DNA, 22 bp, Homo sapiens
tcaaaacactattacctttaat

SEQ ID NO: 7112311 - DNA, 22 bp, Homo sapiens
tcaaaacactattacctttaat

SEQ ID NO: 7112312 - DNA, 22 bp, Homo sapiens
tcaaaacactattacctttaat

SEQ ID NO: 7112313 - DNA, 19 bp, Homo sapiens
tcaaaacacaaatggttga

SEQ ID NO: 7112314 - DNA, 19 bp, Homo sapiens
tcaaaacacaaatggttga

SEQ ID NO: 7112315 - DNA, 19 bp, Homo sapiens
tcaaaacacaaatggttga

SEQ ID NO: 7112316 - DNA, 19 bp, Homo sapiens
tcaaaacacaaatggttga

SEQ ID NO: 7112317 - DNA, 22 bp, Homo sapiens
tcaaaaattttctgaggatgag

SEQ ID NO: 7112318 - DNA, 22 bp, Homo sapiens
tcaaaaattttctgaggatgag

SEQ ID NO: 7112319 - DNA, 22 bp, Homo sapiens
tcaaaaattttctgaggatgag

SEQ ID NO: 7112320 - DNA, 22 bp, Homo sapiens
tcaaaacaacactcaggtgtaa

SEQ ID NO: 7112321 - DNA, 22 bp, Homo sapiens
tcaaaacaacactcaggtgtaa

SEQ ID NO: 7112322 - DNA, 22 bp, Homo sapiens
tcaaaacaacactcaggtgtaa

SEQ ID NO: 7112323 - DNA, 22 bp, Homo sapiens
tcaaaacaacactcaggtgtaa

SEQ ID NO: 7112324 - DNA, 22 bp, Homo sapiens
tcaaaacaacactcaggtgtaa

SEQ ID NO: 7112325 - DNA, 22 bp, Homo sapiens
tcaaaacaatcattggatgtgc

SEQ ID NO: 7112326 - DNA, 22 bp, Homo sapiens
tcaaaacaatcattggatgtgc

SEQ ID NO: 7112327 - DNA, 22 bp, Homo sapiens
tcaaaacaatcattggatgtgc

SEQ ID NO: 7112328 - DNA, 22 bp, Homo sapiens
tattttcaccatgtatccctgt

SEQ ID NO: 7112329 - DNA, 22 bp, Homo sapiens
tattttatctgccagagtggag

SEQ ID NO: 7112330 - DNA, 22 bp, Homo sapiens
tattttatctgccagagtggag

SEQ ID NO: 7112331 - DNA, 22 bp, Homo sapiens
tattttcaccatgtatccctgt

SEQ ID NO: 7112332 - DNA, 22 bp, Homo sapiens
tcaaaaatgttttatattggta

SEQ ID NO: 7112333 - DNA, 22 bp, Homo sapiens
tcaaaaatgttttatattggta

SEQ ID NO: 7112334 - DNA, 22 bp, Homo sapiens
tattttatctgccagagtggag

SEQ ID NO: 7112335 - DNA, 22 bp, Homo sapiens
tattttatctgccagagtggag

SEQ ID NO: 7112336 - DNA, 22 bp, Homo sapiens
tattttatctgccagagtggag

SEQ ID NO: 7112337 - DNA, 22 bp, Homo sapiens
tattttatctgccagagtggag

SEQ ID NO: 7112338 - DNA, 22 bp, Homo sapiens
tattttaggtaatatccattgt

SEQ ID NO: 7112339 - DNA, 22 bp, Homo sapiens
tattttactttaaagcgagaga

SEQ ID NO: 7112340 - DNA, 22 bp, Homo sapiens
tattttactttaaagcgagaga

SEQ ID NO: 7112341 - DNA, 22 bp, Homo sapiens
tattttactatttggcaaagtc

SEQ ID NO: 7112342 - DNA, 22 bp, Homo sapiens
tattttacatgacaggtgttta

SEQ ID NO: 7112343 - DNA, 22 bp, Homo sapiens
tattttacatgacaggtgttta

SEQ ID NO: 7112344 - DNA, 22 bp, Homo sapiens
tattttacatgatccagagttg

SEQ ID NO: 7112345 - DNA, 22 bp, Homo sapiens
tcaagcaagtgtttggtgtaaa

SEQ ID NO: 7112346 - DNA, 22 bp, Homo sapiens
tcaagcaaagatacaaatggaa

SEQ ID NO: 7112347 - DNA, 22 bp, Homo sapiens
tcaagatgtccagtgcctataa

SEQ ID NO: 7112348 - DNA, 22 bp, Homo sapiens
tcaagatgtgatgtaacttttg

SEQ ID NO: 7112349 - DNA, 22 bp, Homo sapiens
tcaaaacactattacctttaat

SEQ ID NO: 7112350 - DNA, 22 bp, Homo sapiens
tcaacaagaataccatcctcct

SEQ ID NO: 7112351 - DNA, 22 bp, Homo sapiens
tcaagatgaaccaggacattca

SEQ ID NO: 7112352 - DNA, 20 bp, Homo sapiens
tcaagatgaggtcatactgg

SEQ ID NO: 7112353 - DNA, 22 bp, Homo sapiens
tcaagatgattgcttcaggccc

SEQ ID NO: 7112354 - DNA, 22 bp, Homo sapiens
tcaagatgcatgggtggcataa

SEQ ID NO: 7112355 - DNA, 19 bp, Homo sapiens
tcaagatggatggctccca

SEQ ID NO: 7112356 - DNA, 22 bp, Homo sapiens
tcaagcagcttttacagaagag

SEQ ID NO: 7112357 - DNA, 22 bp, Homo sapiens
tcaagcagcttttacagaagag

SEQ ID NO: 7112358 - DNA, 22 bp, Homo sapiens
tcaagcatcttggtctacgatc

SEQ ID NO: 7112359 - DNA, 22 bp, Homo sapiens
tcaagcaagttgcatattgcta

SEQ ID NO: 7112360 - DNA, 23 bp, Homo sapiens
tcaagcaataattggtaatagtg

SEQ ID NO: 7112361 - DNA, 22 bp, Homo sapiens
tcaagcagagtcaaaagtacca

SEQ ID NO: 7112362 - DNA, 22 bp, Homo sapiens
tcaagcagagtcaaaagtacca

SEQ ID NO: 7112363 - DNA, 22 bp, Homo sapiens
tcaagcggactgagatactctg

SEQ ID NO: 7112364 - DNA, 18 bp, Homo sapiens
tcaagccattctcctgcc

SEQ ID NO: 7112365 - DNA, 22 bp, Homo sapiens
tcaatagagccttctttcaggt

SEQ ID NO: 7112366 - DNA, 22 bp, Homo sapiens
tcaatagagccttctttcaggt

SEQ ID NO: 7112367 - DNA, 22 bp, Homo sapiens
tcaatagagccttctttcaggt

SEQ ID NO: 7112368 - DNA, 22 bp, Homo sapiens
tcaatagataaagctacataaa

SEQ ID NO: 7112369 - DNA, 22 bp, Homo sapiens
tcaatagataaagctacataaa

SEQ ID NO: 7112370 - DNA, 22 bp, Homo sapiens
tcaatagattaggtattagatt

SEQ ID NO: 7112371 - DNA, 22 bp, Homo sapiens
cagggggctcaaaggagagtgc

SEQ ID NO: 7112372 - DNA, 22 bp, Homo sapiens
cagggggctcaaaggagagtgc

SEQ ID NO: 7112373 - DNA, 22 bp, Homo sapiens
cagggggcagcgtagaaaatga

SEQ ID NO: 7112374 - DNA, 22 bp, Homo sapiens
cagggggctgtggctgtccagt

SEQ ID NO: 7112375 - DNA, 22 bp, Homo sapiens
cagggggctgtggctgtccagt

SEQ ID NO: 7112376 - DNA, 22 bp, Homo sapiens
caggggggcaggagtcattgat

SEQ ID NO: 7112377 - DNA, 22 bp, Homo sapiens
caggggggcaggagtcattgat

SEQ ID NO: 7112378 - DNA, 22 bp, Homo sapiens
cagggggtgcaggccctgtgac

SEQ ID NO: 7112379 - DNA, 22 bp, Homo sapiens
cagggggtggtccaggctgcgc

SEQ ID NO: 7112380 - DNA, 22 bp, Homo sapiens
cagggggtggtccaggctgcgc

SEQ ID NO: 7112381 - DNA, 22 bp, Homo sapiens
caggggcctgtcctggcttctg

SEQ ID NO: 7112382 - DNA, 22 bp, Homo sapiens
caggggcctgtcctggcttctg

SEQ ID NO: 7112383 - DNA, 22 bp, Homo sapiens
caggggcgggtaaaaggcctcc

SEQ ID NO: 7112384 - DNA, 22 bp, Homo sapiens
caggggctgtttgcctcaggcc

SEQ ID NO: 7112385 - DNA, 22 bp, Homo sapiens
caggggctgtttgcctcaggcc

SEQ ID NO: 7112386 - DNA, 22 bp, Homo sapiens
caggggcttaagtgacagaagg

SEQ ID NO: 7112387 - DNA, 22 bp, Homo sapiens
caggggcttaagtgacagaagg

SEQ ID NO: 7112388 - DNA, 22 bp, Homo sapiens
caggggcttaagtgacagaagg

SEQ ID NO: 7112389 - DNA, 22 bp, Homo sapiens
caggggcttttcctctataagg

SEQ ID NO: 7112390 - DNA, 22 bp, Homo sapiens
caggggcttttcctctataagg

SEQ ID NO: 7112391 - DNA, 22 bp, Homo sapiens
caggggcttttcctctataagg

SEQ ID NO: 7112392 - DNA, 22 bp, Homo sapiens
cagggctgtggaaaactggtgc

SEQ ID NO: 7112393 - DNA, 22 bp, Homo sapiens
cagggctgtggaaaactggtgc

SEQ ID NO: 7112394 - DNA, 22 bp, Homo sapiens
cagggctgtggaaaactggtgc

SEQ ID NO: 7112395 - DNA, 22 bp, Homo sapiens
cagggctgtggctttgtgctgt

SEQ ID NO: 7112396 - DNA, 22 bp, Homo sapiens
cagggctgtggctttgtgctgt

SEQ ID NO: 7112397 - DNA, 22 bp, Homo sapiens
cagggctgtggctttgtgctgt

SEQ ID NO: 7112398 - DNA, 22 bp, Homo sapiens
cagggctgtggctttgtgctgt

SEQ ID NO: 7112399 - DNA, 17 bp, Homo sapiens
cagggctgtctgcctag

SEQ ID NO: 7112400 - DNA, 17 bp, Homo sapiens
cagggctgtctgcctag

SEQ ID NO: 7112401 - DNA, 17 bp, Homo sapiens
cagggctgtctgcctag

SEQ ID NO: 7112402 - DNA, 17 bp, Homo sapiens
cagggctgtctgcctag

SEQ ID NO: 7112403 - DNA, 17 bp, Homo sapiens
cagggctgtctgcctag

SEQ ID NO: 7112404 - DNA, 22 bp, Homo sapiens
cagggctgtgcccatcttcccc

SEQ ID NO: 7112405 - DNA, 22 bp, Homo sapiens
cagggctgtgcccatcttcccc

SEQ ID NO: 7112406 - DNA, 22 bp, Homo sapiens
cagggctgtgcccatcttcccc

SEQ ID NO: 7112407 - DNA, 17 bp, Homo sapiens
cagggctgtctgcctag

SEQ ID NO: 7112408 - DNA, 22 bp, Homo sapiens
cagggtcatggcacctgcacgg

SEQ ID NO: 7112409 - DNA, 22 bp, Homo sapiens
cagggtcccaggagctgctttc

SEQ ID NO: 7112410 - DNA, 22 bp, Homo sapiens
cagggtcaagagactccagcag

SEQ ID NO: 7112411 - DNA, 22 bp, Homo sapiens
cagggtcaagagactccagcag

SEQ ID NO: 7112412 - DNA, 22 bp, Homo sapiens
cagggtagtaatttaatacaag

SEQ ID NO: 7112413 - DNA, 22 bp, Homo sapiens
cagggtagtaatttaatacaag

SEQ ID NO: 7112414 - DNA, 22 bp, Homo sapiens
cagggtcaccagagatctgcat

SEQ ID NO: 7112415 - DNA, 22 bp, Homo sapiens
cagggtcaccagagatctgcat

SEQ ID NO: 7112416 - DNA, 22 bp, Homo sapiens
cagggtcaggaggatctggctt

SEQ ID NO: 7112417 - DNA, 22 bp, Homo sapiens
cagggtcaggaggatctggctt

SEQ ID NO: 7112418 - DNA, 22 bp, Homo sapiens
cagggtcaggctgctagaagct

SEQ ID NO: 7112419 - DNA, 22 bp, Homo sapiens
cagggtcaggctgctagaagct

SEQ ID NO: 7112420 - DNA, 22 bp, Homo sapiens
cagggtccggctgcctggctgt

SEQ ID NO: 7112421 - DNA, 22 bp, Homo sapiens
cagggtctgatggtcctcactt

SEQ ID NO: 7112422 - DNA, 22 bp, Homo sapiens
cagggtctgatggtcctcactt

SEQ ID NO: 7112423 - DNA, 22 bp, Homo sapiens
cagggtggggctggctatcaaa

SEQ ID NO: 7112424 - DNA, 22 bp, Homo sapiens
cagggtggggctggctatcaaa

SEQ ID NO: 7112425 - DNA, 22 bp, Homo sapiens
cagggtagggcaagggaacctg

SEQ ID NO: 7112426 - DNA, 22 bp, Homo sapiens
cagggtagacagtaggtgtctg

SEQ ID NO: 7112427 - DNA, 22 bp, Homo sapiens
cagggtagacagtaggtgtctg

SEQ ID NO: 7112428 - DNA, 22 bp, Homo sapiens
caggggtgtttttggccaggag

SEQ ID NO: 7112429 - DNA, 22 bp, Homo sapiens
caggggtgtttttggccaggag

SEQ ID NO: 7112430 - DNA, 22 bp, Homo sapiens
caggggtgtttttggccaggag

SEQ ID NO: 7112431 - DNA, 22 bp, Homo sapiens
cagggtacagagttttctaaac

SEQ ID NO: 7112432 - DNA, 22 bp, Homo sapiens
cagggtagacagtaggtgtctg

SEQ ID NO: 7112433 - DNA, 22 bp, Homo sapiens
caggggtggctgcagcagaggt

SEQ ID NO: 7112434 - DNA, 22 bp, Homo sapiens
caggggtggctgcagcagaggt

SEQ ID NO: 7112435 - DNA, 22 bp, Homo sapiens
caggggtggctgcagcagaggt

SEQ ID NO: 7112436 - DNA, 22 bp, Homo sapiens
caggggtgtttttggccaggag

SEQ ID NO: 7112437 - DNA, 22 bp, Homo sapiens
caggggtgtttttggccaggag

SEQ ID NO: 7112438 - DNA, 22 bp, Homo sapiens
caggggtgtttttggccaggag

SEQ ID NO: 7112439 - DNA, 22 bp, Homo sapiens
caggggtgtttttggccaggag

SEQ ID NO: 7112440 - DNA, 22 bp, Homo sapiens
cagggggtggtccaggctgcgc

SEQ ID NO: 7112441 - DNA, 22 bp, Homo sapiens
cagggggtggtccaggctgcgc

SEQ ID NO: 7112442 - DNA, 22 bp, Homo sapiens
caggggtggctgcagcagaggt

SEQ ID NO: 7112443 - DNA, 22 bp, Homo sapiens
caggggtggctgcagcagaggt

SEQ ID NO: 7112444 - DNA, 22 bp, Homo sapiens
caggggtggctgcagcagaggt

SEQ ID NO: 7112445 - DNA, 22 bp, Homo sapiens
cagggctgtctccaaaggcccc

SEQ ID NO: 7112446 - DNA, 22 bp, Homo sapiens
cagggctgtaaattagtgctga

SEQ ID NO: 7112447 - DNA, 22 bp, Homo sapiens
cagggctgtctccaaaggcccc

SEQ ID NO: 7112448 - DNA, 22 bp, Homo sapiens
cagggctgtctccaaaggcccc

SEQ ID NO: 7112449 - DNA, 22 bp, Homo sapiens
cagggctgtaaattagtgctga

SEQ ID NO: 7112450 - DNA, 22 bp, Homo sapiens
cagggctgtaaattagtgctga

SEQ ID NO: 7112451 - DNA, 22 bp, Homo sapiens
cagggctgtaaattagtgctga

SEQ ID NO: 7112452 - DNA, 22 bp, Homo sapiens
cagggctgtaaattagtgctga

SEQ ID NO: 7112453 - DNA, 22 bp, Homo sapiens
cagggctggtttgtcgaagaaa

SEQ ID NO: 7112454 - DNA, 22 bp, Homo sapiens
cagggctggtttgtcgaagaaa

SEQ ID NO: 7112455 - DNA, 22 bp, Homo sapiens
cagggctggtttgtcgaagaaa

SEQ ID NO: 7112456 - DNA, 22 bp, Homo sapiens
cagggctgggttaaaagcaggg

SEQ ID NO: 7112457 - DNA, 23 bp, Homo sapiens
cagggctggtagggaagagcgtg

SEQ ID NO: 7112458 - DNA, 23 bp, Homo sapiens
cagggctggtagggaagagcgtg

SEQ ID NO: 7112459 - DNA, 23 bp, Homo sapiens
cagggctggtagggaagagcgtg

SEQ ID NO: 7112460 - DNA, 23 bp, Homo sapiens
cagggctggtagggaagagcgtg

SEQ ID NO: 7112461 - DNA, 22 bp, Homo sapiens
cagggctggatttcatttctag

SEQ ID NO: 7112462 - DNA, 22 bp, Homo sapiens
tagggaaaagacttcactgttt

SEQ ID NO: 7112463 - DNA, 22 bp, Homo sapiens
tagggaaatatagatttagggc

SEQ ID NO: 7112464 - DNA, 22 bp, Homo sapiens
tagggaaatatagatttagggc

SEQ ID NO: 7112465 - DNA, 22 bp, Homo sapiens
tagggaaatatagatttagggc

SEQ ID NO: 7112466 - DNA, 22 bp, Homo sapiens
tagggaaatatagatttagggc

SEQ ID NO: 7112467 - DNA, 22 bp, Homo sapiens
taggcttccgagtcttggtatc

SEQ ID NO: 7112468 - DNA, 22 bp, Homo sapiens
taggctttccttgttgccatgt

SEQ ID NO: 7112469 - DNA, 22 bp, Homo sapiens
taggctttggaagatcaagcaa

SEQ ID NO: 7112470 - DNA, 22 bp, Homo sapiens
taggctttggaggattaagggg

SEQ ID NO: 7112471 - DNA, 22 bp, Homo sapiens
taggcttttccagtataagaga

SEQ ID NO: 7112472 - DNA, 22 bp, Homo sapiens
taggctgggggtaggaattgag

SEQ ID NO: 7112473 - DNA, 18 bp, Homo sapiens
taggctgggggctgtagt

SEQ ID NO: 7112474 - DNA, 22 bp, Homo sapiens
taggctgggctgagctggacgg

SEQ ID NO: 7112475 - DNA, 22 bp, Homo sapiens
cagggctgagaatttagagaca

SEQ ID NO: 7112476 - DNA, 22 bp, Homo sapiens
taggctgggcctgccttccagg

SEQ ID NO: 7112477 - DNA, 22 bp, Homo sapiens
cagggctgagaatttagagaca

SEQ ID NO: 7112478 - DNA, 22 bp, Homo sapiens
cagggctgaagaaattcaaaag

SEQ ID NO: 7112479 - DNA, 22 bp, Homo sapiens
cagggctgaagaaattcaaaag

SEQ ID NO: 7112480 - DNA, 22 bp, Homo sapiens
cagggctgaagaaattcaaaag

SEQ ID NO: 7112481 - DNA, 22 bp, Homo sapiens
cagggctgaaatcaaggtgtag

SEQ ID NO: 7112482 - DNA, 22 bp, Homo sapiens
cagggctgaactgagcttgtga

SEQ ID NO: 7112483 - DNA, 22 bp, Homo sapiens
cagggctgaactgagcttgtga

SEQ ID NO: 7112484 - DNA, 22 bp, Homo sapiens
cagggctgaaatcaaggtgtag

SEQ ID NO: 7112485 - DNA, 22 bp, Homo sapiens
cagggctgaaatcaaggtgtag

SEQ ID NO: 7112486 - DNA, 22 bp, Homo sapiens
cagggctcttccggagcaggga

SEQ ID NO: 7112487 - DNA, 22 bp, Homo sapiens
cagggctcttccggagcaggga

SEQ ID NO: 7112488 - DNA, 22 bp, Homo sapiens
cagggctgaaatcaaggtgtag

SEQ ID NO: 7112489 - DNA, 22 bp, Homo sapiens
cagggctgaaatcaaggtgtag

SEQ ID NO: 7112490 - DNA, 22 bp, Homo sapiens
cagggctccatgcagggactcc

SEQ ID NO: 7112491 - DNA, 20 bp, Homo sapiens
cagggctctgggcctggcct

SEQ ID NO: 7112492 - DNA, 20 bp, Homo sapiens
cagggctctgggcctggcct

SEQ ID NO: 7112493 - DNA, 22 bp, Homo sapiens
cagggctcttcatcacacagta

SEQ ID NO: 7112494 - DNA, 22 bp, Homo sapiens
cagggctcttcatcacacagta

SEQ ID NO: 7112495 - DNA, 22 bp, Homo sapiens
cagggctcttccggagcaggga

SEQ ID NO: 7112496 - DNA, 22 bp, Homo sapiens
cagggctcttccggagcaggga

SEQ ID NO: 7112497 - DNA, 22 bp, Homo sapiens
cagggctcttccggagcaggga

SEQ ID NO: 7112498 - DNA, 22 bp, Homo sapiens
tagatttgtttccttctctcca

SEQ ID NO: 7112499 - DNA, 22 bp, Homo sapiens
tagatttgtttccttctctcca

SEQ ID NO: 7112500 - DNA, 22 bp, Homo sapiens
tagatttgtttccttctctcca

SEQ ID NO: 7112501 - DNA, 22 bp, Homo sapiens
tagatttgtttccttctctcca

SEQ ID NO: 7112502 - DNA, 22 bp, Homo sapiens
tagatttgcctgggaaagctca

SEQ ID NO: 7112503 - DNA, 22 bp, Homo sapiens
tagatttgctccaatgagttaa

SEQ ID NO: 7112504 - DNA, 22 bp, Homo sapiens
tagatttgtgcaagaagggatt

SEQ ID NO: 7112505 - DNA, 22 bp, Homo sapiens
tagatttgtgtttgggatgaga

SEQ ID NO: 7112506 - DNA, 22 bp, Homo sapiens
tagatttgatgtaagcatagtc

SEQ ID NO: 7112507 - DNA, 19 bp, Homo sapiens
tagatttgatcatctggat

SEQ ID NO: 7112508 - DNA, 22 bp, Homo sapiens
tagatttgatgcaattggattg

SEQ ID NO: 7112509 - DNA, 22 bp, Homo sapiens
tagatttgaatgatgtaaagag

SEQ ID NO: 7112510 - DNA, 22 bp, Homo sapiens
tagattgagcttgacagtgttg

SEQ ID NO: 7112511 - DNA, 22 bp, Homo sapiens
tagattgattgcaaagacaggc

SEQ ID NO: 7112512 - DNA, 22 bp, Homo sapiens
tagattgtagatcatgagactt

SEQ ID NO: 7112513 - DNA, 22 bp, Homo sapiens
tagattgtgaacaagtatttgg

SEQ ID NO: 7112514 - DNA, 22 bp, Homo sapiens
cagggagcagcgctggggcctc

SEQ ID NO: 7112515 - DNA, 22 bp, Homo sapiens
cagggagcagcgctggggcctc

SEQ ID NO: 7112516 - DNA, 22 bp, Homo sapiens
cagggagcaggctctgtccatc

SEQ ID NO: 7112517 - DNA, 22 bp, Homo sapiens
cagggagcagcgctggggcctc

SEQ ID NO: 7112518 - DNA, 22 bp, Homo sapiens
cagggagcaggctctgtccatc

SEQ ID NO: 7112519 - DNA, 22 bp, Homo sapiens
cagggagcaggctctgtccatc

SEQ ID NO: 7112520 - DNA, 22 bp, Homo sapiens
cagggagcaggctctgtccatc

SEQ ID NO: 7112521 - DNA, 22 bp, Homo sapiens
cagggagatcttggctcctggt

SEQ ID NO: 7112522 - DNA, 22 bp, Homo sapiens
cagggagatcttggctcctggt

SEQ ID NO: 7112523 - DNA, 22 bp, Homo sapiens
cagggagcactgcgagcggcag

SEQ ID NO: 7112524 - DNA, 22 bp, Homo sapiens
cagggagcactgcgagcggcag

SEQ ID NO: 7112525 - DNA, 22 bp, Homo sapiens
cagggagcagcatgggcaaagg

SEQ ID NO: 7112526 - DNA, 22 bp, Homo sapiens
cagggagcagcccctagaagta

SEQ ID NO: 7112527 - DNA, 22 bp, Homo sapiens
cagggagcagcccctagaagta

SEQ ID NO: 7112528 - DNA, 22 bp, Homo sapiens
cagggccatgaggcacagggtc

SEQ ID NO: 7112529 - DNA, 22 bp, Homo sapiens
tagcttaaggagtaccagatca

SEQ ID NO: 7112530 - DNA, 22 bp, Homo sapiens
cagggccattggcgtggctgtc

SEQ ID NO: 7112531 - DNA, 22 bp, Homo sapiens
tagcttaacagcaaaactgttg

SEQ ID NO: 7112532 - DNA, 22 bp, Homo sapiens
cagggccatatcttgtgcacca

SEQ ID NO: 7112533 - DNA, 22 bp, Homo sapiens
cagggccatatcttgtgcacca

SEQ ID NO: 7112534 - DNA, 22 bp, Homo sapiens
cagggccagttctcgcagcagt

SEQ ID NO: 7112535 - DNA, 22 bp, Homo sapiens
cagggccagttctcgcagcagt

SEQ ID NO: 7112536 - DNA, 22 bp, Homo sapiens
cagggccagttctcgcagcagt

SEQ ID NO: 7112537 - DNA, 22 bp, Homo sapiens
cagggccatgaggcacagggtc

SEQ ID NO: 7112538 - DNA, 22 bp, Homo sapiens
cagggccatgaggcacagggtc

SEQ ID NO: 7112539 - DNA, 22 bp, Homo sapiens
cagggccagggctatggtgaag

SEQ ID NO: 7112540 - DNA, 22 bp, Homo sapiens
cagggccactgtagatgaggag

SEQ ID NO: 7112541 - DNA, 22 bp, Homo sapiens
cagggccaggctgatggcctgg

SEQ ID NO: 7112542 - DNA, 22 bp, Homo sapiens
cagggccagggctatggtgaag

SEQ ID NO: 7112543 - DNA, 22 bp, Homo sapiens
cagggccagttctcgcagcagt

SEQ ID NO: 7112544 - DNA, 22 bp, Homo sapiens
cagggccagttctcgcagcagt

SEQ ID NO: 7112545 - DNA, 22 bp, Homo sapiens
cagggagccccaattccatgcc

SEQ ID NO: 7112546 - DNA, 22 bp, Homo sapiens
cagggccactgtagatgaggag

SEQ ID NO: 7112547 - DNA, 22 bp, Homo sapiens
cagggccaggctgatggcctgg

SEQ ID NO: 7112548 - DNA, 22 bp, Homo sapiens
cagggccaggctgatggcctgg

SEQ ID NO: 7112549 - DNA, 22 bp, Homo sapiens
taggcagtagcttgagatataa

SEQ ID NO: 7112550 - DNA, 22 bp, Homo sapiens
taggcatgcaaataaatgtgca

SEQ ID NO: 7112551 - DNA, 22 bp, Homo sapiens
taggcatgcaaataaatgtgca

SEQ ID NO: 7112552 - DNA, 22 bp, Homo sapiens
taggcatgtggcatacctatgg

SEQ ID NO: 7112553 - DNA, 22 bp, Homo sapiens
taggcattacctaacattacct

SEQ ID NO: 7112554 - DNA, 22 bp, Homo sapiens
taggcatgtgtttgccatagcc

SEQ ID NO: 7112555 - DNA, 22 bp, Homo sapiens
taggccaaatgacttgatgttt

SEQ ID NO: 7112556 - DNA, 22 bp, Homo sapiens
taggccaacgtggaagggtcca

SEQ ID NO: 7112557 - DNA, 22 bp, Homo sapiens
taggccaaatgacttgatgttt

SEQ ID NO: 7112558 - DNA, 22 bp, Homo sapiens
taggccaaggacagtaaggaca

SEQ ID NO: 7112559 - DNA, 22 bp, Homo sapiens
taggagggccctgaaaatggca

SEQ ID NO: 7112560 - DNA, 22 bp, Homo sapiens
taggaggctcatgttacaggaa

SEQ ID NO: 7112561 - DNA, 22 bp, Homo sapiens
taggcagggattagggttgatt

SEQ ID NO: 7112562 - DNA, 22 bp, Homo sapiens
taggcaggtgtgcactgcccac

SEQ ID NO: 7112563 - DNA, 22 bp, Homo sapiens
taggcaggtgtgcactgcccac

SEQ ID NO: 7112564 - DNA, 22 bp, Homo sapiens
taggcaggtgtgcactgcccac

SEQ ID NO: 7112565 - DNA, 22 bp, Homo sapiens
tagctttaagacatggtgaatg

SEQ ID NO: 7112566 - DNA, 22 bp, Homo sapiens
tagctttaagacatggtgaatg

SEQ ID NO: 7112567 - DNA, 22 bp, Homo sapiens
tagctttaaaaatcatcaaagc

SEQ ID NO: 7112568 - DNA, 22 bp, Homo sapiens
tagcttgttacacagcaatgtt

SEQ ID NO: 7112569 - DNA, 22 bp, Homo sapiens
tagctttaaaaatcatcaaagc

SEQ ID NO: 7112570 - DNA, 22 bp, Homo sapiens
tagcttgactattctatgatgt

SEQ ID NO: 7112571 - DNA, 20 bp, Homo sapiens
tagcttgaagaactccagag

SEQ ID NO: 7112572 - DNA, 22 bp, Homo sapiens
tagcttggaataaaatgagaat

SEQ ID NO: 7112573 - DNA, 22 bp, Homo sapiens
tagcttctaatacttaccaatt

SEQ ID NO: 7112574 - DNA, 22 bp, Homo sapiens
tagcttcatgcttcaccacgct

SEQ ID NO: 7112575 - DNA, 22 bp, Homo sapiens
tagcttctcataatttatgctg

SEQ ID NO: 7112576 - DNA, 22 bp, Homo sapiens
tagcttataaaggttttcaaag

SEQ ID NO: 7112577 - DNA, 19 bp, Homo sapiens
tagcttcacgtggtctaga

SEQ ID NO: 7112578 - DNA, 22 bp, Homo sapiens
tagcttcagtggccctagacac

SEQ ID NO: 7112579 - DNA, 22 bp, Homo sapiens
tagcttcatgcttcaccacgct

SEQ ID NO: 7112580 - DNA, 23 bp, Homo sapiens
cagggccctgctcaatttctcca

SEQ ID NO: 7112581 - DNA, 20 bp, Homo sapiens
cagggcctaagagctgaaaa

SEQ ID NO: 7112582 - DNA, 20 bp, Homo sapiens
cagggcctaagagctgaaaa

SEQ ID NO: 7112583 - DNA, 20 bp, Homo sapiens
cagggcctatgattgagctt

SEQ ID NO: 7112584 - DNA, 22 bp, Homo sapiens
cagggccccagggatgtctgct

SEQ ID NO: 7112585 - DNA, 22 bp, Homo sapiens
cagggccccagggatgtctgct

SEQ ID NO: 7112586 - DNA, 22 bp, Homo sapiens
cagggccccagggatgtctgct

SEQ ID NO: 7112587 - DNA, 22 bp, Homo sapiens
cagggccctaagatacacatca

SEQ ID NO: 7112588 - DNA, 22 bp, Homo sapiens
cagggcccatggctcaggtagg

SEQ ID NO: 7112589 - DNA, 20 bp, Homo sapiens
cagggcctatgattgagctt

SEQ ID NO: 7112590 - DNA, 20 bp, Homo sapiens
cagggcctatgattgagctt

SEQ ID NO: 7112591 - DNA, 22 bp, Homo sapiens
cagggcctcatcctcagagatt

SEQ ID NO: 7112592 - DNA, 22 bp, Homo sapiens
cagggcctcatcctcagagatt

SEQ ID NO: 7112593 - DNA, 22 bp, Homo sapiens
cagggcctcatcctcagagatt

SEQ ID NO: 7112594 - DNA, 22 bp, Homo sapiens
cagggcctcatggccggggtgc

SEQ ID NO: 7112595 - DNA, 22 bp, Homo sapiens
cagggcctcattgtcagtcctg

SEQ ID NO: 7112596 - DNA, 22 bp, Homo sapiens
cagggcctcattgtcagtcctg

SEQ ID NO: 7112597 - DNA, 22 bp, Homo sapiens
cagggctccatgcagggactcc

SEQ ID NO: 7112598 - DNA, 22 bp, Homo sapiens
cagggctccatgcagggactcc

SEQ ID NO: 7112599 - DNA, 22 bp, Homo sapiens
cagggcccatggctcaggtagg

SEQ ID NO: 7112600 - DNA, 22 bp, Homo sapiens
cagggcccagtccctgctgtca

SEQ ID NO: 7112601 - DNA, 22 bp, Homo sapiens
cagggcccaagacacaatgagg

SEQ ID NO: 7112602 - DNA, 22 bp, Homo sapiens
cagggcccaggccactgggttg

SEQ ID NO: 7112603 - DNA, 22 bp, Homo sapiens
cagggcccaggccactgggttg

SEQ ID NO: 7112604 - DNA, 22 bp, Homo sapiens
taggccacaaataagatcctgt

SEQ ID NO: 7112605 - DNA, 22 bp, Homo sapiens
taggccacagagaggagatttc

SEQ ID NO: 7112606 - DNA, 22 bp, Homo sapiens
taggccacagatgagacataag

SEQ ID NO: 7112607 - DNA, 21 bp, Homo sapiens
taggccacatgggttggagat

SEQ ID NO: 7112608 - DNA, 22 bp, Homo sapiens
taggccaccagggttccattta

SEQ ID NO: 7112609 - DNA, 22 bp, Homo sapiens
taggccacgaaggagatgatag

SEQ ID NO: 7112610 - DNA, 22 bp, Homo sapiens
taggccacgaaggagatgatag

SEQ ID NO: 7112611 - DNA, 22 bp, Homo sapiens
taggccacggaaagcaggttgc

SEQ ID NO: 7112612 - DNA, 22 bp, Homo sapiens
taggccactctcctttgtctca

SEQ ID NO: 7112613 - DNA, 22 bp, Homo sapiens
taggccactctcctttgtctca

SEQ ID NO: 7112614 - DNA, 22 bp, Homo sapiens
tttattaattagtgacccaatg

SEQ ID NO: 7112615 - DNA, 22 bp, Homo sapiens
tttattaattagtgacccaatg

SEQ ID NO: 7112616 - DNA, 22 bp, Homo sapiens
tttattaattagtgacccaatg

SEQ ID NO: 7112617 - DNA, 22 bp, Homo sapiens
tttattaattagtgacccaatg

SEQ ID NO: 7112618 - DNA, 22 bp, Homo sapiens
tttattacaccaggttaactca

SEQ ID NO: 7112619 - DNA, 22 bp, Homo sapiens
tttattacaccaggttaactca

SEQ ID NO: 7112620 - DNA, 22 bp, Homo sapiens
tttattagattatcaaagaggt

SEQ ID NO: 7112621 - DNA, 22 bp, Homo sapiens
tttattagattatcaaagaggt

SEQ ID NO: 7112622 - DNA, 22 bp, Homo sapiens
tttattagattatcaaagaggt

SEQ ID NO: 7112623 - DNA, 22 bp, Homo sapiens
tttattagtgcttgtatcactg

SEQ ID NO: 7112624 - DNA, 22 bp, Homo sapiens
tttattagtgcttgtatcactg

SEQ ID NO: 7112625 - DNA, 22 bp, Homo sapiens
tttattagtgcttgtatcactg

SEQ ID NO: 7112626 - DNA, 22 bp, Homo sapiens
tttattatagtggtggggactg

SEQ ID NO: 7112627 - DNA, 22 bp, Homo sapiens
tttattatagtggtggggactg

SEQ ID NO: 7112628 - DNA, 22 bp, Homo sapiens
tttattatagtggtggggactg

SEQ ID NO: 7112629 - DNA, 22 bp, Homo sapiens
tttattatccagtgttgtcatg

SEQ ID NO: 7112630 - DNA, 22 bp, Homo sapiens
tttattatccagtgttgtcatg

SEQ ID NO: 7112631 - DNA, 22 bp, Homo sapiens
tttattatccagtgttgtcatg

SEQ ID NO: 7112632 - DNA, 22 bp, Homo sapiens
tttattattctgttctctctac

SEQ ID NO: 7112633 - DNA, 22 bp, Homo sapiens
tttattattctgttctctctac

SEQ ID NO: 7112634 - DNA, 22 bp, Homo sapiens
tttattattctgttctctctac

SEQ ID NO: 7112635 - DNA, 22 bp, Homo sapiens
tttattattctctggagaatgt

SEQ ID NO: 7112636 - DNA, 22 bp, Homo sapiens
tttattattctctggagaatgt

SEQ ID NO: 7112637 - DNA, 22 bp, Homo sapiens
tttattattctctggagaatgt

SEQ ID NO: 7112638 - DNA, 22 bp, Homo sapiens
tttattatgtacaggcactata

SEQ ID NO: 7112639 - DNA, 22 bp, Homo sapiens
tttattatgtacaggcactata

SEQ ID NO: 7112640 - DNA, 22 bp, Homo sapiens
tttattattctctggagaatgt

SEQ ID NO: 7112641 - DNA, 22 bp, Homo sapiens
tttattattctctggagaatgt

SEQ ID NO: 7112642 - DNA, 22 bp, Homo sapiens
tttattatgatggacaccttcg

SEQ ID NO: 7112643 - DNA, 22 bp, Homo sapiens
tttattatgatggacaccttcg

SEQ ID NO: 7112644 - DNA, 22 bp, Homo sapiens
tttattatgatggacaccttcg

SEQ ID NO: 7112645 - DNA, 22 bp, Homo sapiens
tttattatccagtgttgtcatg

SEQ ID NO: 7112646 - DNA, 22 bp, Homo sapiens
tttattatccagtgttgtcatg

SEQ ID NO: 7112647 - DNA, 22 bp, Homo sapiens
tttattatccagtgttgtcatg

SEQ ID NO: 7112648 - DNA, 22 bp, Homo sapiens
tttattatgtacaggcactata

SEQ ID NO: 7112649 - DNA, 22 bp, Homo sapiens
tttattatgatggacaccttcg

SEQ ID NO: 7112650 - DNA, 22 bp, Homo sapiens
tttattatgatggacaccttcg

SEQ ID NO: 7112651 - DNA, 22 bp, Homo sapiens
tttattatgatggacaccttcg

SEQ ID NO: 7112652 - DNA, 22 bp, Homo sapiens
tttattatgatggacaccttcg

SEQ ID NO: 7112653 - DNA, 22 bp, Homo sapiens
tttatttggcatccagggagaa

SEQ ID NO: 7112654 - DNA, 22 bp, Homo sapiens
tttatttgaatcaggggagaat

SEQ ID NO: 7112655 - DNA, 19 bp, Homo sapiens
tttatttgagacatgcctt

SEQ ID NO: 7112656 - DNA, 19 bp, Homo sapiens
tttatttgagacatgcctt

SEQ ID NO: 7112657 - DNA, 22 bp, Homo sapiens
tttatttcttagtttgccacag

SEQ ID NO: 7112658 - DNA, 22 bp, Homo sapiens
tttatttcttagtttgccacag

SEQ ID NO: 7112659 - DNA, 22 bp, Homo sapiens
tttatttgaatcaggggagaat

SEQ ID NO: 7112660 - DNA, 22 bp, Homo sapiens
tttatttgaatcaggggagaat

SEQ ID NO: 7112661 - DNA, 22 bp, Homo sapiens
tttatttgaatcaggggagaat

SEQ ID NO: 7112662 - DNA, 22 bp, Homo sapiens
tttatttgaatcaggggagaat

SEQ ID NO: 7112663 - DNA, 22 bp, Homo sapiens
tttatttcttagtttgccacag

SEQ ID NO: 7112664 - DNA, 22 bp, Homo sapiens
tttatttcactctccggatact

SEQ ID NO: 7112665 - DNA, 22 bp, Homo sapiens
tttatttcactctccggatact

SEQ ID NO: 7112666 - DNA, 22 bp, Homo sapiens
tttatttggcatccagggagaa

SEQ ID NO: 7112667 - DNA, 22 bp, Homo sapiens
tttatttggcatccagggagaa

SEQ ID NO: 7112668 - DNA, 22 bp, Homo sapiens
tttatttggcatccagggagaa

SEQ ID NO: 7112669 - DNA, 22 bp, Homo sapiens
tttatttggcatccagggagaa

SEQ ID NO: 7112670 - DNA, 22 bp, Homo sapiens
tttatttggcatctctgccaag

SEQ ID NO: 7112671 - DNA, 22 bp, Homo sapiens
tttatttggcatctctgccaag

SEQ ID NO: 7112672 - DNA, 22 bp, Homo sapiens
tttatttggcatctctgccaag

SEQ ID NO: 7112673 - DNA, 22 bp, Homo sapiens
tttatttgtcttgccatttagt

SEQ ID NO: 7112674 - DNA, 22 bp, Homo sapiens
tttatttgtcttgccatttagt

SEQ ID NO: 7112675 - DNA, 22 bp, Homo sapiens
tttatttgtcttgccatttagt

SEQ ID NO: 7112676 - DNA, 22 bp, Homo sapiens
tttcaaaattttgcagtggtaa

SEQ ID NO: 7112677 - DNA, 15 bp, Homo sapiens
tttcaaaatgaggcc

SEQ ID NO: 7112678 - DNA, 22 bp, Homo sapiens
tttcaaaagcgtacgtagtgaa

SEQ ID NO: 7112679 - DNA, 22 bp, Homo sapiens
tttatttgtcttgccatttagt

SEQ ID NO: 7112680 - DNA, 22 bp, Homo sapiens
tttcaaaagcgtacgtagtgaa

SEQ ID NO: 7112681 - DNA, 22 bp, Homo sapiens
tttcaaaattttgcagtggtaa

SEQ ID NO: 7112682 - DNA, 22 bp, Homo sapiens
tttcaaaattttgcagtggtaa

SEQ ID NO: 7112683 - DNA, 22 bp, Homo sapiens
tttcaaacatatcttcattact

SEQ ID NO: 7112684 - DNA, 22 bp, Homo sapiens
tttcaaactgcccagcacacct

SEQ ID NO: 7112685 - DNA, 22 bp, Homo sapiens
tttagttttgatgaaaatgcca

SEQ ID NO: 7112686 - DNA, 22 bp, Homo sapiens
tttagttttgatgaaaatgcca

SEQ ID NO: 7112687 - DNA, 22 bp, Homo sapiens
tttagttttgatgaaaatgcca

SEQ ID NO: 7112688 - DNA, 22 bp, Homo sapiens
tttagttttaactgaaagctat

SEQ ID NO: 7112689 - DNA, 22 bp, Homo sapiens
tttagttttaactgaaagctat

SEQ ID NO: 7112690 - DNA, 22 bp, Homo sapiens
tttataaacagtaccacggtgc

SEQ ID NO: 7112691 - DNA, 22 bp, Homo sapiens
tttataaccaagttctgcttgt

SEQ ID NO: 7112692 - DNA, 22 bp, Homo sapiens
tttataaacagtaccacggtgc

SEQ ID NO: 7112693 - DNA, 22 bp, Homo sapiens
tttataaacagtaccacggtgc

SEQ ID NO: 7112694 - DNA, 22 bp, Homo sapiens
tttataaaatagactgggtcta

SEQ ID NO: 7112695 - DNA, 22 bp, Homo sapiens
tttataaaatagactgggtcta

SEQ ID NO: 7112696 - DNA, 22 bp, Homo sapiens
tttataaaatagactgggtcta

SEQ ID NO: 7112697 - DNA, 22 bp, Homo sapiens
tttatagatgtctgtattataa

SEQ ID NO: 7112698 - DNA, 22 bp, Homo sapiens
tttatagatgtctgtattataa

SEQ ID NO: 7112699 - DNA, 22 bp, Homo sapiens
tttatacatggagaatttttgc

SEQ ID NO: 7112700 - DNA, 22 bp, Homo sapiens
tttatactccactctgcaagcg

SEQ ID NO: 7112701 - DNA, 22 bp, Homo sapiens
tttatacttcataatgtctatt

SEQ ID NO: 7112702 - DNA, 22 bp, Homo sapiens
tttatacttcataatgtctatt

SEQ ID NO: 7112703 - DNA, 22 bp, Homo sapiens
tttatacatggagaatttttgc

SEQ ID NO: 7112704 - DNA, 22 bp, Homo sapiens
tttatacatggagaatttttgc

SEQ ID NO: 7112705 - DNA, 23 bp, Homo sapiens
tttatacaagaaaccgctggcct

SEQ ID NO: 7112706 - DNA, 22 bp, Homo sapiens
tttataatagatttggggcggc

SEQ ID NO: 7112707 - DNA, 17 bp, Homo sapiens
tttataattggcctctt

SEQ ID NO: 7112708 - DNA, 22 bp, Homo sapiens
tttataattatctctactctta

SEQ ID NO: 7112709 - DNA, 22 bp, Homo sapiens
tttataattatctctactctta

SEQ ID NO: 7112710 - DNA, 22 bp, Homo sapiens
tttatataacagagactgctat

SEQ ID NO: 7112711 - DNA, 22 bp, Homo sapiens
tttatataacagagactgctat

SEQ ID NO: 7112712 - DNA, 22 bp, Homo sapiens
tttatataacagagactgctat

SEQ ID NO: 7112713 - DNA, 22 bp, Homo sapiens
tttatataacagagactgctat

SEQ ID NO: 7112714 - DNA, 22 bp, Homo sapiens
tttatagttatatacagatgtt

SEQ ID NO: 7112715 - DNA, 22 bp, Homo sapiens
tttatagttatatacagatgtt

SEQ ID NO: 7112716 - DNA, 22 bp, Homo sapiens
tttatagtcgtctcagtaataa

SEQ ID NO: 7112717 - DNA, 20 bp, Homo sapiens
tttatagtgatcaatttata

SEQ ID NO: 7112718 - DNA, 20 bp, Homo sapiens
tttatagtgatcaatttata

SEQ ID NO: 7112719 - DNA, 22 bp, Homo sapiens
tttatagtcgtctcagtaataa

SEQ ID NO: 7112720 - DNA, 22 bp, Homo sapiens
tttatagtcgtctcagtaataa

SEQ ID NO: 7112721 - DNA, 22 bp, Homo sapiens
tttatagtagcatgatttatag

SEQ ID NO: 7112722 - DNA, 22 bp, Homo sapiens
tttatagtcgtctcagtaataa

SEQ ID NO: 7112723 - DNA, 22 bp, Homo sapiens
tttatagtagcatgatttataa

SEQ ID NO: 7112724 - DNA, 22 bp, Homo sapiens
tttataggatatgggggaagga

SEQ ID NO: 7112725 - DNA, 23 bp, Homo sapiens
tttatagcagcatgatttatagt

SEQ ID NO: 7112726 - DNA, 23 bp, Homo sapiens
tttatagcagcatgatttataat

SEQ ID NO: 7112727 - DNA, 22 bp, Homo sapiens
tttattaaaactgttggctctg

SEQ ID NO: 7112728 - DNA, 22 bp, Homo sapiens
tttatgtttgcattttcaaaga

SEQ ID NO: 7112729 - DNA, 22 bp, Homo sapiens
tttattaaaactgttggctctg

SEQ ID NO: 7112730 - DNA, 22 bp, Homo sapiens
tttattaaaactgttggctctg

SEQ ID NO: 7112731 - DNA, 22 bp, Homo sapiens
tttattaaaactgttggctctg

SEQ ID NO: 7112732 - DNA, 21 bp, Homo sapiens
tttattaacaactgtggacgt

SEQ ID NO: 7112733 - DNA, 21 bp, Homo sapiens
tttattaacaactgtggacgt

SEQ ID NO: 7112734 - DNA, 21 bp, Homo sapiens
tttattaacaactgtggacgt

SEQ ID NO: 7112735 - DNA, 21 bp, Homo sapiens
tttattaacaactgtggacgt

SEQ ID NO: 7112736 - DNA, 21 bp, Homo sapiens
tttattaacaactgtggacgt

SEQ ID NO: 7112737 - DNA, 22 bp, Homo sapiens
tttattaagatgcgaatgctga

SEQ ID NO: 7112738 - DNA, 22 bp, Homo sapiens
tttattaagatgcgaatgctga

SEQ ID NO: 7112739 - DNA, 22 bp, Homo sapiens
tttattaagatgcgaatgctga

SEQ ID NO: 7112740 - DNA, 22 bp, Homo sapiens
tttattaagatgcgaatgctga

SEQ ID NO: 7112741 - DNA, 22 bp, Homo sapiens
tttattaagatgcgaatgctga

SEQ ID NO: 7112742 - DNA, 22 bp, Homo sapiens
tttattaagatgcgaatgctga

SEQ ID NO: 7112743 - DNA, 22 bp, Homo sapiens
tttattaagatgcgaatgctga

SEQ ID NO: 7112744 - DNA, 22 bp, Homo sapiens
tttattaagatgcgaatgctga

SEQ ID NO: 7112745 - DNA, 22 bp, Homo sapiens
tttattaagatgcgaatgctga

SEQ ID NO: 7112746 - DNA, 22 bp, Homo sapiens
tttattaatgtagcatccatgg

SEQ ID NO: 7112747 - DNA, 22 bp, Homo sapiens
tttattaatgtagcatccatgg

SEQ ID NO: 7112748 - DNA, 22 bp, Homo sapiens
tttagttattgttacagtatga

SEQ ID NO: 7112749 - DNA, 22 bp, Homo sapiens
tttagttattgttacagtatga

SEQ ID NO: 7112750 - DNA, 22 bp, Homo sapiens
tttagaaattgcagagtgggtg

SEQ ID NO: 7112751 - DNA, 20 bp, Homo sapiens
tttagaagaatgagcacttt

SEQ ID NO: 7112752 - DNA, 22 bp, Homo sapiens
tttagaaattcatctatggcct

SEQ ID NO: 7112753 - DNA, 22 bp, Homo sapiens
tttagaaattcatctatggcct

SEQ ID NO: 7112754 - DNA, 22 bp, Homo sapiens
tttacttttggtaaggtcattt

SEQ ID NO: 7112755 - DNA, 22 bp, Homo sapiens
tttagaaattgcagagtgggtg

SEQ ID NO: 7112756 - DNA, 22 bp, Homo sapiens
tttagaaattgcagagtgggtg

SEQ ID NO: 7112757 - DNA, 22 bp, Homo sapiens
tttactttgtgtcaagtcaaga

SEQ ID NO: 7112758 - DNA, 22 bp, Homo sapiens
tttactttgtgtcaagtcaaga

SEQ ID NO: 7112759 - DNA, 22 bp, Homo sapiens
tttactttgtgtcaagtcaaga

SEQ ID NO: 7112760 - DNA, 22 bp, Homo sapiens
tttactttgtgtcaagtcaaga

SEQ ID NO: 7112761 - DNA, 22 bp, Homo sapiens
tttactttgtgtcaagtcaaga

SEQ ID NO: 7112762 - DNA, 22 bp, Homo sapiens
tttacttttggtaaggtcattt

SEQ ID NO: 7112763 - DNA, 22 bp, Homo sapiens
tttactttctcaagtatatagg

SEQ ID NO: 7112764 - DNA, 22 bp, Homo sapiens
tttactttctcaagtatatagg

SEQ ID NO: 7112765 - DNA, 22 bp, Homo sapiens
tttactttgtgtcaagtcaaga

SEQ ID NO: 7112766 - DNA, 22 bp, Homo sapiens
tttactttgtgtcaagtcaaga

SEQ ID NO: 7112767 - DNA, 22 bp, Homo sapiens
tttactttctcaagtatatagg

SEQ ID NO: 7112768 - DNA, 22 bp, Homo sapiens
tttactgagtgacctagaataa

SEQ ID NO: 7112769 - DNA, 21 bp, Homo sapiens
tttactgagcacttactatgt

SEQ ID NO: 7112770 - DNA, 21 bp, Homo sapiens
tttactgagcacttactatgt

SEQ ID NO: 7112771 - DNA, 22 bp, Homo sapiens
tttactgaatttggtatattcc

SEQ ID NO: 7112772 - DNA, 22 bp, Homo sapiens
tttactgaatttggtatattcc

SEQ ID NO: 7112773 - DNA, 22 bp, Homo sapiens
tttactgaactgctagtacagg

SEQ ID NO: 7112774 - DNA, 18 bp, Homo sapiens
tttactcataggcctgac

SEQ ID NO: 7112775 - DNA, 18 bp, Homo sapiens
tttactcataggcctgac

SEQ ID NO: 7112776 - DNA, 19 bp, Homo sapiens
tttactctccaaggtgagt

SEQ ID NO: 7112777 - DNA, 22 bp, Homo sapiens
tttactcttgctacacaactgt

SEQ ID NO: 7112778 - DNA, 22 bp, Homo sapiens
tttactgaactgctagtacagg

SEQ ID NO: 7112779 - DNA, 22 bp, Homo sapiens
tttactgtctcagagagacaaa

SEQ ID NO: 7112780 - DNA, 22 bp, Homo sapiens
tttactgtgtccatctgtgact

SEQ ID NO: 7112781 - DNA, 22 bp, Homo sapiens
tttacttgatatggagctgagg

SEQ ID NO: 7112782 - DNA, 22 bp, Homo sapiens
tttactttctcaagtatatagg

SEQ ID NO: 7112783 - DNA, 22 bp, Homo sapiens
tttactttctcaagtatatagg

SEQ ID NO: 7112784 - DNA, 22 bp, Homo sapiens
tttactaacaccatacatgctg

SEQ ID NO: 7112785 - DNA, 22 bp, Homo sapiens
tttacgtgaaggtgttatgtgt

SEQ ID NO: 7112786 - DNA, 22 bp, Homo sapiens
tttactaagcccagttatatgc

SEQ ID NO: 7112787 - DNA, 22 bp, Homo sapiens
tttactcaagtatgcatttatg

SEQ ID NO: 7112788 - DNA, 22 bp, Homo sapiens
tttacgaaaagtgactaatagg

SEQ ID NO: 7112789 - DNA, 22 bp, Homo sapiens
tttaccatcctcttttagaatt

SEQ ID NO: 7112790 - DNA, 22 bp, Homo sapiens
tttaccatcctcttttagaatt

SEQ ID NO: 7112791 - DNA, 22 bp, Homo sapiens
tttaccatctgccacagatatg

SEQ ID NO: 7112792 - DNA, 22 bp, Homo sapiens
tttaccattattaaaattaagt

SEQ ID NO: 7112793 - DNA, 22 bp, Homo sapiens
tttacaaggcagaactgattaa

SEQ ID NO: 7112794 - DNA, 22 bp, Homo sapiens
tttacaagtcagggactgttct

SEQ ID NO: 7112795 - DNA, 22 bp, Homo sapiens
tttaccatacatcaaaatattt

SEQ ID NO: 7112796 - DNA, 22 bp, Homo sapiens
tttacaaggatcaagggatctc

SEQ ID NO: 7112797 - DNA, 22 bp, Homo sapiens
tttacaaggcagaactgattaa

SEQ ID NO: 7112798 - DNA, 22 bp, Homo sapiens
tttacaacgttcctggtgctaa

SEQ ID NO: 7112799 - DNA, 22 bp, Homo sapiens
tttacaacctcatattctgatg

SEQ ID NO: 7112800 - DNA, 23 bp, Homo sapiens
ttgtttttagaggtggcatgaga

SEQ ID NO: 7112801 - DNA, 22 bp, Homo sapiens
ttgtttttaaacatgtgactga

SEQ ID NO: 7112802 - DNA, 22 bp, Homo sapiens
ttgtttttagagaagccctgaa

SEQ ID NO: 7112803 - DNA, 22 bp, Homo sapiens
ttgtttttatgaacatccagga

SEQ ID NO: 7112804 - DNA, 22 bp, Homo sapiens
tttaaaaaactagtctgagtct

SEQ ID NO: 7112805 - DNA, 22 bp, Homo sapiens
tttaaaaaactagtctgagtct

SEQ ID NO: 7112806 - DNA, 22 bp, Homo sapiens
ttgtttttatgaacatccagga

SEQ ID NO: 7112807 - DNA, 23 bp, Homo sapiens
tttaaaagttgtaatgtaggctt

SEQ ID NO: 7112808 - DNA, 22 bp, Homo sapiens
tttaaaatcagatgggagttgg

SEQ ID NO: 7112809 - DNA, 22 bp, Homo sapiens
tttaaaatcagatgggagttgg

SEQ ID NO: 7112810 - DNA, 23 bp, Homo sapiens
tttaaaagttgtaatgtaggctt

SEQ ID NO: 7112811 - DNA, 22 bp, Homo sapiens
tttaaaaaactagtctgagtct

SEQ ID NO: 7112812 - DNA, 22 bp, Homo sapiens
tttaaaaaactagtctgagtct

SEQ ID NO: 7112813 - DNA, 22 bp, Homo sapiens
tttaaaaaactagtctgagtct

SEQ ID NO: 7112814 - DNA, 22 bp, Homo sapiens
tttaaaagttatcatctgtcca

SEQ ID NO: 7112815 - DNA, 22 bp, Homo sapiens
tttaaaatcagatgggagttgg

SEQ ID NO: 7112816 - DNA, 22 bp, Homo sapiens
tttaaaatttagacctctccac

SEQ ID NO: 7112817 - DNA, 22 bp, Homo sapiens
tttaaaatttagacctctccac

SEQ ID NO: 7112818 - DNA, 22 bp, Homo sapiens
tttaaaatttagacctctccac

SEQ ID NO: 7112819 - DNA, 22 bp, Homo sapiens
tttaaaatttagacctctccac

SEQ ID NO: 7112820 - DNA, 22 bp, Homo sapiens
tttaaacatatctgttgaggga

SEQ ID NO: 7112821 - DNA, 22 bp, Homo sapiens
tttaaacaaataggattgccta

SEQ ID NO: 7112822 - DNA, 22 bp, Homo sapiens
tttaatgttaaatttgtagatg

SEQ ID NO: 7112823 - DNA, 22 bp, Homo sapiens
tttaatgttaaatttgtagatg

SEQ ID NO: 7112824 - DNA, 22 bp, Homo sapiens
tttaatgttaaatttgtagatg

SEQ ID NO: 7112825 - DNA, 22 bp, Homo sapiens
tttaatgtttgagtcagtatat

SEQ ID NO: 7112826 - DNA, 22 bp, Homo sapiens
tttaatgtttgagtcagtatat

SEQ ID NO: 7112827 - DNA, 22 bp, Homo sapiens
tttaatgttaaatttgtagatg

SEQ ID NO: 7112828 - DNA, 22 bp, Homo sapiens
tttaattagcaagccagagagc

SEQ ID NO: 7112829 - DNA, 22 bp, Homo sapiens
tttaatgtttgagtcagtatat

SEQ ID NO: 7112830 - DNA, 22 bp, Homo sapiens
tttaattagcaagccagagagc

SEQ ID NO: 7112831 - DNA, 22 bp, Homo sapiens
tttaattctggcataatagctc

SEQ ID NO: 7112832 - DNA, 22 bp, Homo sapiens
tttaattgattcacagtctgta

SEQ ID NO: 7112833 - DNA, 22 bp, Homo sapiens
tttaattgattcacagtctgta

SEQ ID NO: 7112834 - DNA, 22 bp, Homo sapiens
tttaattgttgtgggtacatag

SEQ ID NO: 7112835 - DNA, 22 bp, Homo sapiens
tttaattgttgtgggtacatag

SEQ ID NO: 7112836 - DNA, 22 bp, Homo sapiens
tttaatttgaaatgagtaaccc

SEQ ID NO: 7112837 - DNA, 22 bp, Homo sapiens
tttaatttgaaatgagtaaccc

SEQ ID NO: 7112838 - DNA, 22 bp, Homo sapiens
tttaatttgaaatgagtaaccc

SEQ ID NO: 7112839 - DNA, 22 bp, Homo sapiens
tttaattgcatttaaagatgga

SEQ ID NO: 7112840 - DNA, 22 bp, Homo sapiens
tttaattgcatttaaagatgga

SEQ ID NO: 7112841 - DNA, 22 bp, Homo sapiens
tttaattgcatttaaagatgga

SEQ ID NO: 7112842 - DNA, 22 bp, Homo sapiens
tttaattgcatttaaagatgga

SEQ ID NO: 7112843 - DNA, 22 bp, Homo sapiens
tttaattgcatttaaagatgga

SEQ ID NO: 7112844 - DNA, 22 bp, Homo sapiens
tttaattgattcacagtctgta

SEQ ID NO: 7112845 - DNA, 22 bp, Homo sapiens
tttaattgcatttaaagatgga

SEQ ID NO: 7112846 - DNA, 22 bp, Homo sapiens
tttacaacctcatattctgatg

SEQ ID NO: 7112847 - DNA, 22 bp, Homo sapiens
tttaattttctgggcccagcag

SEQ ID NO: 7112848 - DNA, 22 bp, Homo sapiens
tttaattttcctggtaggcctg

SEQ ID NO: 7112849 - DNA, 22 bp, Homo sapiens
tttaattttctgggcccagcag

SEQ ID NO: 7112850 - DNA, 22 bp, Homo sapiens
tttaattttcctcttcctggag

SEQ ID NO: 7112851 - DNA, 22 bp, Homo sapiens
tttaattttcctcttcctggag

SEQ ID NO: 7112852 - DNA, 22 bp, Homo sapiens
tttaattttcctggtaggcctg

SEQ ID NO: 7112853 - DNA, 21 bp, Homo sapiens
tttaatttgcatgtatgacgc

SEQ ID NO: 7112854 - DNA, 21 bp, Homo sapiens
tttaatttgcatgtatgacgc

SEQ ID NO: 7112855 - DNA, 21 bp, Homo sapiens
tttaatttgcatgtatgacgc

SEQ ID NO: 7112856 - DNA, 22 bp, Homo sapiens
tttaatttgtatttctagaggg

SEQ ID NO: 7112857 - DNA, 21 bp, Homo sapiens
tttaatttgcatgtatgacgc

SEQ ID NO: 7112858 - DNA, 22 bp, Homo sapiens
tttaatttgtatttctagaggg

SEQ ID NO: 7112859 - DNA, 22 bp, Homo sapiens
tttaattttcctcttcctggag

SEQ ID NO: 7112860 - DNA, 22 bp, Homo sapiens
tttaattttcctcttcctggag

SEQ ID NO: 7112861 - DNA, 22 bp, Homo sapiens
ttgttagtttatataatgtagt

SEQ ID NO: 7112862 - DNA, 22 bp, Homo sapiens
ttgttataaagactaaatatgt

SEQ ID NO: 7112863 - DNA, 22 bp, Homo sapiens
ttgttataaagactaaatatgt

SEQ ID NO: 7112864 - DNA, 22 bp, Homo sapiens
ttgttatcaatgaatcaaaact

SEQ ID NO: 7112865 - DNA, 22 bp, Homo sapiens
ttgttattattactaagtcttc

SEQ ID NO: 7112866 - DNA, 22 bp, Homo sapiens
ttgttattattactaagtcttc

SEQ ID NO: 7112867 - DNA, 22 bp, Homo sapiens
ttgtttaaagaacttctgactt

SEQ ID NO: 7112868 - DNA, 21 bp, Homo sapiens
ttgtttcccagagctcgctcc

SEQ ID NO: 7112869 - DNA, 22 bp, Homo sapiens
ttgtttcattttggctaaactg

SEQ ID NO: 7112870 - DNA, 22 bp, Homo sapiens
ttgtttcattttggctaaactg

SEQ ID NO: 7112871 - DNA, 22 bp, Homo sapiens
ttgtttaagccacccaatctgt

SEQ ID NO: 7112872 - DNA, 20 bp, Homo sapiens
ttgtttaaaggtgaagaggc

SEQ ID NO: 7112873 - DNA, 20 bp, Homo sapiens
ttgtttaaaggtgaagaggc

SEQ ID NO: 7112874 - DNA, 22 bp, Homo sapiens
ttgtttaagccacccaatctgt

SEQ ID NO: 7112875 - DNA, 20 bp, Homo sapiens
ttgttagaggaatgccatag

SEQ ID NO: 7112876 - DNA, 20 bp, Homo sapiens
ttgttagaggaatgccatag

SEQ ID NO: 7112877 - DNA, 20 bp, Homo sapiens
ttgttagaggaatgccatag

SEQ ID NO: 7112878 - DNA, 20 bp, Homo sapiens
ttgttagaggaatgccatag

SEQ ID NO: 7112879 - DNA, 20 bp, Homo sapiens
ttgttagaggaatgccatag

SEQ ID NO: 7112880 - DNA, 22 bp, Homo sapiens
ttgttagatatttcttagaaga

SEQ ID NO: 7112881 - DNA, 22 bp, Homo sapiens
ttgttagatatttcttagaaga

SEQ ID NO: 7112882 - DNA, 22 bp, Homo sapiens
ttgttacgtgatgtgtcagggt

SEQ ID NO: 7112883 - DNA, 22 bp, Homo sapiens
ttgttaaaaatagatttccagg

SEQ ID NO: 7112884 - DNA, 22 bp, Homo sapiens
ttgttaaaaatagatttccagg

SEQ ID NO: 7112885 - DNA, 22 bp, Homo sapiens
ttgttaaaaatagatttccagg

SEQ ID NO: 7112886 - DNA, 22 bp, Homo sapiens
ttgttaaaaatagatttccagg

SEQ ID NO: 7112887 - DNA, 22 bp, Homo sapiens
ttgtgttttcttatggcataaa

SEQ ID NO: 7112888 - DNA, 22 bp, Homo sapiens
ttgtgttttcttatggcataaa

SEQ ID NO: 7112889 - DNA, 22 bp, Homo sapiens
ttgttaaaaatagatttccagg

SEQ ID NO: 7112890 - DNA, 22 bp, Homo sapiens
ttgttacagcagtgatttcaga

SEQ ID NO: 7112891 - DNA, 22 bp, Homo sapiens
ttgtgtgtgagccttcaccaca

SEQ ID NO: 7112892 - DNA, 22 bp, Homo sapiens
ttgtgtgtgagccttcaccaca

SEQ ID NO: 7112893 - DNA, 22 bp, Homo sapiens
ttgtgtgtgagccttcaccaca

SEQ ID NO: 7112894 - DNA, 22 bp, Homo sapiens
ttgtgtgtgagccttcaccaca

SEQ ID NO: 7112895 - DNA, 22 bp, Homo sapiens
ttgtgtgtgagccttcaccaca

SEQ ID NO: 7112896 - DNA, 22 bp, Homo sapiens
ttgtgtgtcttcttcactgccc

SEQ ID NO: 7112897 - DNA, 22 bp, Homo sapiens
ttgtgtgtcttcttcactgccc

SEQ ID NO: 7112898 - DNA, 19 bp, Homo sapiens
ttgtgtgtcagtcagagtt

SEQ ID NO: 7112899 - DNA, 22 bp, Homo sapiens
ttgtgtgtcttcttcactgccc

SEQ ID NO: 7112900 - DNA, 22 bp, Homo sapiens
ttgtgtgtcttcttcactgccc

SEQ ID NO: 7112901 - DNA, 22 bp, Homo sapiens
ttgtgtgtcttcttcactgccc

SEQ ID NO: 7112902 - DNA, 19 bp, Homo sapiens
ttgtgtgtcagtcagagtt

SEQ ID NO: 7112903 - DNA, 19 bp, Homo sapiens
ttgtgtgtcagtcagagtt

SEQ ID NO: 7112904 - DNA, 19 bp, Homo sapiens
ttgtgtgtcagtcagagtt

SEQ ID NO: 7112905 - DNA, 19 bp, Homo sapiens
ttgtgactggctctgcata

SEQ ID NO: 7112906 - DNA, 19 bp, Homo sapiens
ttgtgtgtcagtcagagtt

SEQ ID NO: 7112907 - DNA, 22 bp, Homo sapiens
ttgtgaatggtgccgcaataaa

SEQ ID NO: 7112908 - DNA, 22 bp, Homo sapiens
ttgtgacaatacagcatggaga

SEQ ID NO: 7112909 - DNA, 22 bp, Homo sapiens
ttgtgacagagatcacgtggcc

SEQ ID NO: 7112910 - DNA, 22 bp, Homo sapiens
ttgtgtgtgtaactttatgaga

SEQ ID NO: 7112911 - DNA, 22 bp, Homo sapiens
ttgtgtgtgtaactttatgaga

SEQ ID NO: 7112912 - DNA, 22 bp, Homo sapiens
ttgtgtgtttgtagaaaatcca

SEQ ID NO: 7112913 - DNA, 22 bp, Homo sapiens
ttgtgtgtgtaactttatgaga

SEQ ID NO: 7112914 - DNA, 22 bp, Homo sapiens
ttgtgtgtgtaactttatgaga

SEQ ID NO: 7112915 - DNA, 22 bp, Homo sapiens
ttgtgtgtgtaactttatgaga

SEQ ID NO: 7112916 - DNA, 22 bp, Homo sapiens
ttgtgtgtttgtagaaaatcca

SEQ ID NO: 7112917 - DNA, 22 bp, Homo sapiens
ttgtgttaaggtgcatctagtg

SEQ ID NO: 7112918 - DNA, 22 bp, Homo sapiens
ttgtgtgtgtaactttatgaga

SEQ ID NO: 7112919 - DNA, 22 bp, Homo sapiens
ttgtgtgtttgtagaaaatcca

SEQ ID NO: 7112920 - DNA, 22 bp, Homo sapiens
ttgtgtgtttgtagaaaatcca

SEQ ID NO: 7112921 - DNA, 22 bp, Homo sapiens
ttgtgtgtttgtagaaaatcca

SEQ ID NO: 7112922 - DNA, 22 bp, Homo sapiens
ttgtgtgtttgtagaaaatcca

SEQ ID NO: 7112923 - DNA, 21 bp, Homo sapiens
ttgtgtttccccagtcacttt

SEQ ID NO: 7112924 - DNA, 21 bp, Homo sapiens
ttgtgtttccccagtcacttt

SEQ ID NO: 7112925 - DNA, 22 bp, Homo sapiens
ttgtgtttctggccaagatgga

SEQ ID NO: 7112926 - DNA, 22 bp, Homo sapiens
ttgtgtttctgtgatatgtaaa

SEQ ID NO: 7112927 - DNA, 22 bp, Homo sapiens
ttgtgtttctgtgatatgtaaa

SEQ ID NO: 7112928 - DNA, 22 bp, Homo sapiens
ttgtgtttctgtgatatgtaaa

SEQ ID NO: 7112929 - DNA, 22 bp, Homo sapiens
ttgtgtttcccttgcatattcc

SEQ ID NO: 7112930 - DNA, 22 bp, Homo sapiens
ttgtgtttgatgctgacacgca

SEQ ID NO: 7112931 - DNA, 22 bp, Homo sapiens
ttgtgttttcttatggcataaa

SEQ ID NO: 7112932 - DNA, 22 bp, Homo sapiens
ttgtttcctttctatacaggat

SEQ ID NO: 7112933 - DNA, 20 bp, Homo sapiens
ttgtttcctggctgttctgc

SEQ ID NO: 7112934 - DNA, 20 bp, Homo sapiens
ttgtttcctggctgttctgc

SEQ ID NO: 7112935 - DNA, 22 bp, Homo sapiens
ttgtttccctggatctagagct

SEQ ID NO: 7112936 - DNA, 22 bp, Homo sapiens
ttgtttctctggtcttgagtga

SEQ ID NO: 7112937 - DNA, 22 bp, Homo sapiens
ttgtttctcctggtgcctgata

SEQ ID NO: 7112938 - DNA, 22 bp, Homo sapiens
ttgtttctcctggtgcctgata

SEQ ID NO: 7112939 - DNA, 22 bp, Homo sapiens
ttgtttctccagtctaggaaaa

SEQ ID NO: 7112940 - DNA, 20 bp, Homo sapiens
ttgtttctgctattttctaa

SEQ ID NO: 7112941 - DNA, 22 bp, Homo sapiens
ttgtttctgagttttcatgtat

SEQ ID NO: 7112942 - DNA, 22 bp, Homo sapiens
ttgtttctgagttttcatgtat

SEQ ID NO: 7112943 - DNA, 22 bp, Homo sapiens
ttgtttctgagttttcatgtat

SEQ ID NO: 7112944 - DNA, 22 bp, Homo sapiens
ttgtttctctggtcttgagtga

SEQ ID NO: 7112945 - DNA, 22 bp, Homo sapiens
ttgtttcttcaggcttttagga

SEQ ID NO: 7112946 - DNA, 20 bp, Homo sapiens
ttgtttctgctattttctaa

SEQ ID NO: 7112947 - DNA, 20 bp, Homo sapiens
ttgtttctgctattttctaa

SEQ ID NO: 7112948 - DNA, 20 bp, Homo sapiens
ttgtttctgctattttctaa

SEQ ID NO: 7112949 - DNA, 22 bp, Homo sapiens
ttgtttgtaaggctcttagaat

SEQ ID NO: 7112950 - DNA, 22 bp, Homo sapiens
ttgtttgactaaattggtatca

SEQ ID NO: 7112951 - DNA, 22 bp, Homo sapiens
ttgtttgactaaattggtatca

SEQ ID NO: 7112952 - DNA, 23 bp, Homo sapiens
ttgtttctttgtattgtctctat

SEQ ID NO: 7112953 - DNA, 22 bp, Homo sapiens
ttgtttgaataacagacaaatt

SEQ ID NO: 7112954 - DNA, 22 bp, Homo sapiens
ttgtttgtaaggctcttagaat

SEQ ID NO: 7112955 - DNA, 22 bp, Homo sapiens
ttgtttgtaaggctcttagaat

SEQ ID NO: 7112956 - DNA, 22 bp, Homo sapiens
ttgtttgtatgctgagaagaat

SEQ ID NO: 7112957 - DNA, 22 bp, Homo sapiens
ttgtttgtatgctgagaagaat

SEQ ID NO: 7112958 - DNA, 22 bp, Homo sapiens
ttgtttgtatgctgagaagaat

SEQ ID NO: 7112959 - DNA, 22 bp, Homo sapiens
ttgtttgtcataatatcattac

SEQ ID NO: 7112960 - DNA, 22 bp, Homo sapiens
ttgtttgtcataatatcattac

SEQ ID NO: 7112961 - DNA, 22 bp, Homo sapiens
ttgtttctttgaagtttctaga

SEQ ID NO: 7112962 - DNA, 17 bp, Homo sapiens
ttgtttcttctctgtgg

SEQ ID NO: 7112963 - DNA, 22 bp, Homo sapiens
ttgtttcttcaggcttttagga

SEQ ID NO: 7112964 - DNA, 22 bp, Homo sapiens
ttgttttaacctagtgtttatg

SEQ ID NO: 7112965 - DNA, 22 bp, Homo sapiens
ttgttttaacctagtgtttatg

SEQ ID NO: 7112966 - DNA, 20 bp, Homo sapiens
ttgttttaaatcctggatga

SEQ ID NO: 7112967 - DNA, 22 bp, Homo sapiens
ttgttttaacctagtgtttatg

SEQ ID NO: 7112968 - DNA, 22 bp, Homo sapiens
ttgttttaacctagtgtttatg

SEQ ID NO: 7112969 - DNA, 22 bp, Homo sapiens
ttgttttaacgactcagcttgt

SEQ ID NO: 7112970 - DNA, 22 bp, Homo sapiens
ttgttttaacgactcagcttgt

SEQ ID NO: 7112971 - DNA, 22 bp, Homo sapiens
ttgttttaacgactcagcttgt

SEQ ID NO: 7112972 - DNA, 22 bp, Homo sapiens
ttgtttgtgctatttaatgtag

SEQ ID NO: 7112973 - DNA, 22 bp, Homo sapiens
ttgtttgtgctatttaatgtag

SEQ ID NO: 7112974 - DNA, 22 bp, Homo sapiens
ttgtttgtgctatttaatgtag

SEQ ID NO: 7112975 - DNA, 22 bp, Homo sapiens
ttgtttgtgctatttaatgtag

SEQ ID NO: 7112976 - DNA, 22 bp, Homo sapiens
ttgtttgtgctatttaatgtag

SEQ ID NO: 7112977 - DNA, 17 bp, Homo sapiens
ttgtttgttcttgcccc

SEQ ID NO: 7112978 - DNA, 17 bp, Homo sapiens
ttgtttgttcttgcccc

SEQ ID NO: 7112979 - DNA, 17 bp, Homo sapiens
ttgtttgttcttgcccc

SEQ ID NO: 7112980 - DNA, 17 bp, Homo sapiens
ttgtttgttcttgcccc

SEQ ID NO: 7112981 - DNA, 20 bp, Homo sapiens
ttgttttaaatcctggatga

SEQ ID NO: 7112982 - DNA, 18 bp, Homo sapiens
ttgttttaagactctgtc

SEQ ID NO: 7112983 - DNA, 18 bp, Homo sapiens
ttgttttaagactctgtc

SEQ ID NO: 7112984 - DNA, 18 bp, Homo sapiens
ttgttttaagactctgtc

SEQ ID NO: 7112985 - DNA, 22 bp, Homo sapiens
ttgttttaagccagtctgccta

SEQ ID NO: 7112986 - DNA, 22 bp, Homo sapiens
ttgttttaagccagtctgccta

SEQ ID NO: 7112987 - DNA, 22 bp, Homo sapiens
ttgttttaagccagtctgccta

SEQ ID NO: 7112988 - DNA, 22 bp, Homo sapiens
ttgttttaatgagggaggttga

SEQ ID NO: 7112989 - DNA, 22 bp, Homo sapiens
ttgttttaatgagggaggttga

SEQ ID NO: 7112990 - DNA, 22 bp, Homo sapiens
ttgttttaatgagggaggttga

SEQ ID NO: 7112991 - DNA, 22 bp, Homo sapiens
ttgttttagtaggtacactgag

SEQ ID NO: 7112992 - DNA, 22 bp, Homo sapiens
ttgttttagtaggtacactgag

SEQ ID NO: 7112993 - DNA, 22 bp, Homo sapiens
ttgttttagtaggtacactgag

SEQ ID NO: 7112994 - DNA, 22 bp, Homo sapiens
ttgttttagtaggtacactgag

SEQ ID NO: 7112995 - DNA, 22 bp, Homo sapiens
ttgttttagtaggtacactgag

SEQ ID NO: 7112996 - DNA, 22 bp, Homo sapiens
ttgttttatctttctacagact

SEQ ID NO: 7112997 - DNA, 22 bp, Homo sapiens
ttgttttatctttctacagact

SEQ ID NO: 7112998 - DNA, 22 bp, Homo sapiens
ttgttttatctttctacagact

SEQ ID NO: 7112999 - DNA, 22 bp, Homo sapiens
ttgttttatctttctacagact

SEQ ID NO: 7113000 - DNA, 22 bp, Homo sapiens
ttgttttatctttctacagact

SEQ ID NO: 7113001 - DNA, 22 bp, Homo sapiens
ttgttttattctgcaatttccc

SEQ ID NO: 7113002 - DNA, 22 bp, Homo sapiens
ttgttttattctgcaatttccc

SEQ ID NO: 7113003 - DNA, 22 bp, Homo sapiens
ttgttttattctgcaatttccc

SEQ ID NO: 7113004 - DNA, 22 bp, Homo sapiens
ttgttttattctgcaatttccc

SEQ ID NO: 7113005 - DNA, 22 bp, Homo sapiens
ttgttttattctgcaatttccc

SEQ ID NO: 7113006 - DNA, 22 bp, Homo sapiens
ttgttttcacagctttgcccgg

SEQ ID NO: 7113007 - DNA, 22 bp, Homo sapiens
ttgttttcacagctttgcccgg

SEQ ID NO: 7113008 - DNA, 22 bp, Homo sapiens
ttgttttcacagctttgcccgg

SEQ ID NO: 7113009 - DNA, 22 bp, Homo sapiens
ttgttttcacagctttgcccgg

SEQ ID NO: 7113010 - DNA, 22 bp, Homo sapiens
ttgttttcacagctttgcccgg

SEQ ID NO: 7113011 - DNA, 22 bp, Homo sapiens
ttgttttcagggtgtcattcac

SEQ ID NO: 7113012 - DNA, 22 bp, Homo sapiens
ttgttttcagggtgtcattcac

SEQ ID NO: 7113013 - DNA, 22 bp, Homo sapiens
ttgttttcctgggataccaacc

SEQ ID NO: 7113014 - DNA, 22 bp, Homo sapiens
ttgttttcctgggataccaacc

SEQ ID NO: 7113015 - DNA, 22 bp, Homo sapiens
ttgttttctccactgcatctta

SEQ ID NO: 7113016 - DNA, 22 bp, Homo sapiens
ttgttttctccactgcatctta

SEQ ID NO: 7113017 - DNA, 22 bp, Homo sapiens
ttgttttctccactgcatctta

SEQ ID NO: 7113018 - DNA, 22 bp, Homo sapiens
ttgttttctccactgcatctta

SEQ ID NO: 7113019 - DNA, 22 bp, Homo sapiens
ttgttttctccactgcatctta

SEQ ID NO: 7113020 - DNA, 22 bp, Homo sapiens
ttgttttcctgggataccaacc

SEQ ID NO: 7113021 - DNA, 22 bp, Homo sapiens
ttgttttctccactgcatctta

SEQ ID NO: 7113022 - DNA, 22 bp, Homo sapiens
ttgttttctccactgcatctta

SEQ ID NO: 7113023 - DNA, 22 bp, Homo sapiens
ttgttttcttgtatatagcctc

SEQ ID NO: 7113024 - DNA, 22 bp, Homo sapiens
ttgttttgagccctggacttgc

SEQ ID NO: 7113025 - DNA, 22 bp, Homo sapiens
ttgttttgctaaagggtcatca

SEQ ID NO: 7113026 - DNA, 22 bp, Homo sapiens
ttgttttgagccctggacttgc

SEQ ID NO: 7113027 - DNA, 22 bp, Homo sapiens
ttgtttttaaacatgtgactga

SEQ ID NO: 7113028 - DNA, 22 bp, Homo sapiens
ttgcaagacacttggaagcaca

SEQ ID NO: 7113029 - DNA, 22 bp, Homo sapiens
ttgcaagagagtctgaaaaatg

SEQ ID NO: 7113030 - DNA, 22 bp, Homo sapiens
ttgcaagaggtgattttattga

SEQ ID NO: 7113031 - DNA, 22 bp, Homo sapiens
ttgcaagagagtctgaaaaatg

SEQ ID NO: 7113032 - DNA, 22 bp, Homo sapiens
ttgcaacttctcccatcactct

SEQ ID NO: 7113033 - DNA, 22 bp, Homo sapiens
ttgcaagaaataatcgaataga

SEQ ID NO: 7113034 - DNA, 20 bp, Homo sapiens
ttgcaagctttcaagatagc

SEQ ID NO: 7113035 - DNA, 22 bp, Homo sapiens
ttgcaatgcccgtagcatccta

SEQ ID NO: 7113036 - DNA, 22 bp, Homo sapiens
ttgcaattaacatatgtcaact

SEQ ID NO: 7113037 - DNA, 18 bp, Homo sapiens
ttggggtgaggccaggaa

SEQ ID NO: 7113038 - DNA, 22 bp, Homo sapiens
ttgcaagttttacttacctgga

SEQ ID NO: 7113039 - DNA, 22 bp, Homo sapiens
ttgcaagttttacttacctgga

SEQ ID NO: 7113040 - DNA, 20 bp, Homo sapiens
ttgcaataaatgaaagacca

SEQ ID NO: 7113041 - DNA, 22 bp, Homo sapiens
ttgcaaattatataagggatgc

SEQ ID NO: 7113042 - DNA, 22 bp, Homo sapiens
ttgcaaattattttagtccctt

SEQ ID NO: 7113043 - DNA, 22 bp, Homo sapiens
ttgcaaattattttagtccctt

SEQ ID NO: 7113044 - DNA, 22 bp, Homo sapiens
ttgcaaattcatggatctgaat

SEQ ID NO: 7113045 - DNA, 22 bp, Homo sapiens
ttgcaaattcatggatctgaat

SEQ ID NO: 7113046 - DNA, 22 bp, Homo sapiens
ttgcaaattccaatccaatatt

SEQ ID NO: 7113047 - DNA, 22 bp, Homo sapiens
ttgcaaattccaatccaatatt

SEQ ID NO: 7113048 - DNA, 22 bp, Homo sapiens
ttgcaaattcgtcactgttaaa

SEQ ID NO: 7113049 - DNA, 22 bp, Homo sapiens
ttgcaaattcgtcactgttaaa

SEQ ID NO: 7113050 - DNA, 22 bp, Homo sapiens
ttgcaaattgcaagagttggat

SEQ ID NO: 7113051 - DNA, 18 bp, Homo sapiens
ttgcaaattcttccctgt

SEQ ID NO: 7113052 - DNA, 18 bp, Homo sapiens
ttgcaaattcttccctgt

SEQ ID NO: 7113053 - DNA, 23 bp, Homo sapiens
ttgcaaatttcagttagttcatg

SEQ ID NO: 7113054 - DNA, 22 bp, Homo sapiens
ttgcaaattgcaagagttggat

SEQ ID NO: 7113055 - DNA, 23 bp, Homo sapiens
ttgcaaatttcagttagttcatg

SEQ ID NO: 7113056 - DNA, 19 bp, Homo sapiens
ttggtggtggttttggttc

SEQ ID NO: 7113057 - DNA, 23 bp, Homo sapiens
ttggtgtcagggaactttggaat

SEQ ID NO: 7113058 - DNA, 22 bp, Homo sapiens
ttggtgtgactaaggcagtgtg

SEQ ID NO: 7113059 - DNA, 22 bp, Homo sapiens
ttggtgtgccagagctgacatg

SEQ ID NO: 7113060 - DNA, 22 bp, Homo sapiens
ttggtgtgccagagctgacatg

SEQ ID NO: 7113061 - DNA, 22 bp, Homo sapiens
ttggtgggagagatgagggttg

SEQ ID NO: 7113062 - DNA, 22 bp, Homo sapiens
ttggtgggcacaggggagaagt

SEQ ID NO: 7113063 - DNA, 22 bp, Homo sapiens
ttggtgggcacaggggagaagt

SEQ ID NO: 7113064 - DNA, 22 bp, Homo sapiens
ttggtgggttaatgagtgactg

SEQ ID NO: 7113065 - DNA, 22 bp, Homo sapiens
ttggtgggttaatgagtgactg

SEQ ID NO: 7113066 - DNA, 22 bp, Homo sapiens
ttggtgggagaagactctggtt

SEQ ID NO: 7113067 - DNA, 22 bp, Homo sapiens
ttggtggacctcatcagaaccg

SEQ ID NO: 7113068 - DNA, 22 bp, Homo sapiens
ttggtggagtcattggcatatg

SEQ ID NO: 7113069 - DNA, 22 bp, Homo sapiens
ttggtgggagaagactctggtt

SEQ ID NO: 7113070 - DNA, 22 bp, Homo sapiens
ttggtgggagagatgagggttg

SEQ ID NO: 7113071 - DNA, 22 bp, Homo sapiens
ttggtgagtgctatgtaccaca

SEQ ID NO: 7113072 - DNA, 22 bp, Homo sapiens
ttggtgcaaaattagagaacca

SEQ ID NO: 7113073 - DNA, 19 bp, Homo sapiens
ttggtgcacacatgggccc

SEQ ID NO: 7113074 - DNA, 19 bp, Homo sapiens
ttggtgcacacatgggccc

SEQ ID NO: 7113075 - DNA, 22 bp, Homo sapiens
ttggtgctctctatgacatgaa

SEQ ID NO: 7113076 - DNA, 22 bp, Homo sapiens
ttggtgagtatggacacagaga

SEQ ID NO: 7113077 - DNA, 22 bp, Homo sapiens
ttggtgacttgcagaaacagct

SEQ ID NO: 7113078 - DNA, 22 bp, Homo sapiens
ttggtgagtatggacacagaga

SEQ ID NO: 7113079 - DNA, 22 bp, Homo sapiens
ttggtcttttctattaaatata

SEQ ID NO: 7113080 - DNA, 22 bp, Homo sapiens
ttggtcttttctattaaatata

SEQ ID NO: 7113081 - DNA, 22 bp, Homo sapiens
ttggggtgttggatggagcaag

SEQ ID NO: 7113082 - DNA, 22 bp, Homo sapiens
ttggtcatagcattcaaaatgg

SEQ ID NO: 7113083 - DNA, 22 bp, Homo sapiens
ttggtcatagcattcaaaatgg

SEQ ID NO: 7113084 - DNA, 22 bp, Homo sapiens
ttggtcatacattgtcctatag

SEQ ID NO: 7113085 - DNA, 22 bp, Homo sapiens
ttggtcatatgttactccaggg

SEQ ID NO: 7113086 - DNA, 22 bp, Homo sapiens
ttggtcatatgttactccaggg

SEQ ID NO: 7113087 - DNA, 22 bp, Homo sapiens
ttggtcatattaattcaatcgg

SEQ ID NO: 7113088 - DNA, 22 bp, Homo sapiens
ttggtcatcatgaaggatttta

SEQ ID NO: 7113089 - DNA, 22 bp, Homo sapiens
ttggtcatcttccgtttcctca

SEQ ID NO: 7113090 - DNA, 22 bp, Homo sapiens
ttggtcatcatgcttgggtcta

SEQ ID NO: 7113091 - DNA, 22 bp, Homo sapiens
ttggtcatgcataatgtatctg

SEQ ID NO: 7113092 - DNA, 20 bp, Homo sapiens
ttggtcatttacttgttctt

SEQ ID NO: 7113093 - DNA, 22 bp, Homo sapiens
ttggtcatttttcctgtgctca

SEQ ID NO: 7113094 - DNA, 22 bp, Homo sapiens
ttggggtgttggatggagcaag

SEQ ID NO: 7113095 - DNA, 22 bp, Homo sapiens
ttggggtgttcagggtacttct

SEQ ID NO: 7113096 - DNA, 22 bp, Homo sapiens
ttggggtgttggatggagcaag

SEQ ID NO: 7113097 - DNA, 22 bp, Homo sapiens
ttggggtgttggatggagcaag

SEQ ID NO: 7113098 - DNA, 18 bp, Homo sapiens
ttggggtgaggccaggaa

SEQ ID NO: 7113099 - DNA, 22 bp, Homo sapiens
ttggggtggaagtgaggatcat

SEQ ID NO: 7113100 - DNA, 22 bp, Homo sapiens
ttggggtggaagtgaggatcat

SEQ ID NO: 7113101 - DNA, 22 bp, Homo sapiens
ttggggtgtgtgaaattatgtc

SEQ ID NO: 7113102 - DNA, 22 bp, Homo sapiens
ttggtccctcatggacacatga

SEQ ID NO: 7113103 - DNA, 22 bp, Homo sapiens
ttggtcctcagtttccctatct

SEQ ID NO: 7113104 - DNA, 22 bp, Homo sapiens
ttggtcctgcagaggggtctgg

SEQ ID NO: 7113105 - DNA, 22 bp, Homo sapiens
ttggtcctgccccctccaggtc

SEQ ID NO: 7113106 - DNA, 22 bp, Homo sapiens
ttggtctgcagggagggctgga

SEQ ID NO: 7113107 - DNA, 22 bp, Homo sapiens
ttggtctggagtatgatgataa

SEQ ID NO: 7113108 - DNA, 18 bp, Homo sapiens
ttggtctgggtggaaacc

SEQ ID NO: 7113109 - DNA, 22 bp, Homo sapiens
ttggtcttgagtggcttgttaa

SEQ ID NO: 7113110 - DNA, 22 bp, Homo sapiens
ttggtcttgtggcatctttcca

SEQ ID NO: 7113111 - DNA, 22 bp, Homo sapiens
ttgtgaatagtgccgctataaa

SEQ ID NO: 7113112 - DNA, 22 bp, Homo sapiens
ttgtgaatagtgctgcaataaa

SEQ ID NO: 7113113 - DNA, 22 bp, Homo sapiens
ttgtgaatgcttaatatgtttc

SEQ ID NO: 7113114 - DNA, 22 bp, Homo sapiens
ttgtgaatgcttaatatgtttc

SEQ ID NO: 7113115 - DNA, 22 bp, Homo sapiens
ttgtgaatggtgccgcaataaa

SEQ ID NO: 7113116 - DNA, 22 bp, Homo sapiens
ttgtgaatagtgccgcaataaa

SEQ ID NO: 7113117 - DNA, 22 bp, Homo sapiens
ttgtgaaatgtttcaaaatagt

SEQ ID NO: 7113118 - DNA, 22 bp, Homo sapiens
ttgtgaaatgtttcaaaatagt

SEQ ID NO: 7113119 - DNA, 22 bp, Homo sapiens
ttgtgaaatgtttcaaaatagt

SEQ ID NO: 7113120 - DNA, 22 bp, Homo sapiens
ttgtgaatagtgccacaataaa

SEQ ID NO: 7113121 - DNA, 22 bp, Homo sapiens
ttgtgaatagtgccgcaataaa

SEQ ID NO: 7113122 - DNA, 22 bp, Homo sapiens
ttgtctggtcaaatcacttgta

SEQ ID NO: 7113123 - DNA, 22 bp, Homo sapiens
ttgtctgtaaagacggccacca

SEQ ID NO: 7113124 - DNA, 22 bp, Homo sapiens
ttgtctgtaaagacggccacca

SEQ ID NO: 7113125 - DNA, 22 bp, Homo sapiens
ttgtctgtccaggcaccccaag

SEQ ID NO: 7113126 - DNA, 22 bp, Homo sapiens
ttgtctgaattcttctaggcag

SEQ ID NO: 7113127 - DNA, 22 bp, Homo sapiens
ttgtctgacttctttagttact

SEQ ID NO: 7113128 - DNA, 22 bp, Homo sapiens
ttgtctctgtgtggcttcccta

SEQ ID NO: 7113129 - DNA, 22 bp, Homo sapiens
ttgtctctgggacatggtatta

SEQ ID NO: 7113130 - DNA, 22 bp, Homo sapiens
ttgtctgaaaaggtaaatattt

SEQ ID NO: 7113131 - DNA, 22 bp, Homo sapiens
ttgtctgaaagatcattacatt

SEQ ID NO: 7113132 - DNA, 22 bp, Homo sapiens
ttgtctatttgttcaggtaagg

SEQ ID NO: 7113133 - DNA, 22 bp, Homo sapiens
ttgtctctcattcctgcaactc

SEQ ID NO: 7113134 - DNA, 22 bp, Homo sapiens
ttgtctctcattcctgcaactc

SEQ ID NO: 7113135 - DNA, 22 bp, Homo sapiens
ttggttcagtaggcatgcctgg

SEQ ID NO: 7113136 - DNA, 22 bp, Homo sapiens
ttggttaccttcagaaatgagt

SEQ ID NO: 7113137 - DNA, 22 bp, Homo sapiens
ttggttcagtaggcatgcctgg

SEQ ID NO: 7113138 - DNA, 22 bp, Homo sapiens
ttggtttccttaacagcctaaa

SEQ ID NO: 7113139 - DNA, 22 bp, Homo sapiens
ttggtttaggaactggcttgga

SEQ ID NO: 7113140 - DNA, 22 bp, Homo sapiens
ttggtttagagagtgtggttac

SEQ ID NO: 7113141 - DNA, 23 bp, Homo sapiens
ttgtccttctgaaatatatctgg

SEQ ID NO: 7113142 - DNA, 22 bp, Homo sapiens
ttgtccttccagactcttccac

SEQ ID NO: 7113143 - DNA, 23 bp, Homo sapiens
ttgtccttctgaaatatatctgg

SEQ ID NO: 7113144 - DNA, 23 bp, Homo sapiens
ttgtaaaacagtgtgacggttcc

SEQ ID NO: 7113145 - DNA, 22 bp, Homo sapiens
ttgtccttacctcaatctggaa

SEQ ID NO: 7113146 - DNA, 22 bp, Homo sapiens
ttgtccttagatgtggcctcca

SEQ ID NO: 7113147 - DNA, 21 bp, Homo sapiens
ttggttttctgagtctgtaca

SEQ ID NO: 7113148 - DNA, 22 bp, Homo sapiens
ttggttttgggatgtacaaagg

SEQ ID NO: 7113149 - DNA, 22 bp, Homo sapiens
ttgtccttcttcattcagtccc

SEQ ID NO: 7113150 - DNA, 22 bp, Homo sapiens
ttgtccttgtgatagtttgctg

SEQ ID NO: 7113151 - DNA, 22 bp, Homo sapiens
ttgtccttgtgcaagacccagc

SEQ ID NO: 7113152 - DNA, 22 bp, Homo sapiens
ttgtccttgttcctaacccctc

SEQ ID NO: 7113153 - DNA, 21 bp, Homo sapiens
ttgtcctttagggcttgtctg

SEQ ID NO: 7113154 - DNA, 21 bp, Homo sapiens
ttgtcctttagggcttgtctg

SEQ ID NO: 7113155 - DNA, 22 bp, Homo sapiens
ttgtcgggcttacgcagggcca

SEQ ID NO: 7113156 - DNA, 22 bp, Homo sapiens
ttgtcgggcttacgcagggcca

SEQ ID NO: 7113157 - DNA, 22 bp, Homo sapiens
ttgtctaaggaggtagaggact

SEQ ID NO: 7113158 - DNA, 22 bp, Homo sapiens
ttgtctaatgagctccacttca

SEQ ID NO: 7113159 - DNA, 17 bp, Homo sapiens
ttgtctacctagcagaa

SEQ ID NO: 7113160 - DNA, 22 bp, Homo sapiens
ttgtctatacatcaataatgat

SEQ ID NO: 7113161 - DNA, 22 bp, Homo sapiens
tttcttcatagaccttgtcttg

SEQ ID NO: 7113162 - DNA, 22 bp, Homo sapiens
tttcttcagccttcacaacctg

SEQ ID NO: 7113163 - DNA, 22 bp, Homo sapiens
tttcttcagtaacacaaaccat

SEQ ID NO: 7113164 - DNA, 22 bp, Homo sapiens
tttcttcagtaacacaaaccat

SEQ ID NO: 7113165 - DNA, 22 bp, Homo sapiens
tttcttcagccttcacaacctg

SEQ ID NO: 7113166 - DNA, 22 bp, Homo sapiens
tttcttcattcaccttcacccc

SEQ ID NO: 7113167 - DNA, 22 bp, Homo sapiens
tttcttcattcaccttcacccc

SEQ ID NO: 7113168 - DNA, 22 bp, Homo sapiens
tttcttcattgacaaggaaaaa

SEQ ID NO: 7113169 - DNA, 22 bp, Homo sapiens
tttcttcattgacaaggaaaaa

SEQ ID NO: 7113170 - DNA, 22 bp, Homo sapiens
tttcttcattgacaaggaaaaa

SEQ ID NO: 7113171 - DNA, 22 bp, Homo sapiens
tttcttccccactgcaggctct

SEQ ID NO: 7113172 - DNA, 21 bp, Homo sapiens
tttcttcccttggcttctgag

SEQ ID NO: 7113173 - DNA, 22 bp, Homo sapiens
tttcttcctaaatatgatttcc

SEQ ID NO: 7113174 - DNA, 22 bp, Homo sapiens
tttcttcattgatgtcaggtgg

SEQ ID NO: 7113175 - DNA, 19 bp, Homo sapiens
tttcttccaaagactatgg

SEQ ID NO: 7113176 - DNA, 21 bp, Homo sapiens
tttcttcactttgccccatgt

SEQ ID NO: 7113177 - DNA, 22 bp, Homo sapiens
tttcttcagagagagctttccc

SEQ ID NO: 7113178 - DNA, 22 bp, Homo sapiens
tttcttcagccactccaaactg

SEQ ID NO: 7113179 - DNA, 22 bp, Homo sapiens
tttcttcagccactccaaactg

SEQ ID NO: 7113180 - DNA, 22 bp, Homo sapiens
tttcttatgtgcagagtgagta

SEQ ID NO: 7113181 - DNA, 22 bp, Homo sapiens
tttcttcaattgctaacaagga

SEQ ID NO: 7113182 - DNA, 22 bp, Homo sapiens
tttcttcaattgctaacaagga

SEQ ID NO: 7113183 - DNA, 22 bp, Homo sapiens
tttcttcaattgctaacaagga

SEQ ID NO: 7113184 - DNA, 22 bp, Homo sapiens
tttcttatggggtagtccttta

SEQ ID NO: 7113185 - DNA, 21 bp, Homo sapiens
tttctgtctctgccactagtt

SEQ ID NO: 7113186 - DNA, 21 bp, Homo sapiens
tttctgtctctgccactagtt

SEQ ID NO: 7113187 - DNA, 21 bp, Homo sapiens
tttctgtctctgccactagtt

SEQ ID NO: 7113188 - DNA, 19 bp, Homo sapiens
tttctgtctgtgttttgcc

SEQ ID NO: 7113189 - DNA, 22 bp, Homo sapiens
tttctgtcattactttcctccc

SEQ ID NO: 7113190 - DNA, 22 bp, Homo sapiens
tttctgtattttgtcataacct

SEQ ID NO: 7113191 - DNA, 22 bp, Homo sapiens
tttctgtcatagttatctttgt

SEQ ID NO: 7113192 - DNA, 22 bp, Homo sapiens
tttctgtatttaaaagatctgg

SEQ ID NO: 7113193 - DNA, 22 bp, Homo sapiens
tttctgtaggggatatctttga

SEQ ID NO: 7113194 - DNA, 22 bp, Homo sapiens
tttctgttaggcatcattttaa

SEQ ID NO: 7113195 - DNA, 22 bp, Homo sapiens
tttctgttaggcatcattttaa

SEQ ID NO: 7113196 - DNA, 19 bp, Homo sapiens
tttctgttagaaggataca

SEQ ID NO: 7113197 - DNA, 19 bp, Homo sapiens
tttctgttagaaggataca

SEQ ID NO: 7113198 - DNA, 22 bp, Homo sapiens
tttctgttaggcatcattttaa

SEQ ID NO: 7113199 - DNA, 22 bp, Homo sapiens
tttctgttaggcatcattttaa

SEQ ID NO: 7113200 - DNA, 19 bp, Homo sapiens
tttctgttagaaggataca

SEQ ID NO: 7113201 - DNA, 23 bp, Homo sapiens
tttctgttgggtatatatccaag

SEQ ID NO: 7113202 - DNA, 23 bp, Homo sapiens
tttctgttgggtatatatccaag

SEQ ID NO: 7113203 - DNA, 23 bp, Homo sapiens
tttctgttgggtatatatccaag

SEQ ID NO: 7113204 - DNA, 22 bp, Homo sapiens
tttctgttgtacttaaactagg

SEQ ID NO: 7113205 - DNA, 22 bp, Homo sapiens
tttcttcctgctttgtcccatg

SEQ ID NO: 7113206 - DNA, 22 bp, Homo sapiens
tttcttcctgctttgtcccatg

SEQ ID NO: 7113207 - DNA, 22 bp, Homo sapiens
tttcttcctatgtatcttgctg

SEQ ID NO: 7113208 - DNA, 22 bp, Homo sapiens
tttcttcctaaatatgatttcc

SEQ ID NO: 7113209 - DNA, 22 bp, Homo sapiens
tttcttctaagatttcaaacta

SEQ ID NO: 7113210 - DNA, 22 bp, Homo sapiens
tttcttctaagatttcaaacta

SEQ ID NO: 7113211 - DNA, 22 bp, Homo sapiens
tttcttctaggactaataagag

SEQ ID NO: 7113212 - DNA, 22 bp, Homo sapiens
tttcttctaggactaataagag

SEQ ID NO: 7113213 - DNA, 22 bp, Homo sapiens
tttcttctaggactaataagag

SEQ ID NO: 7113214 - DNA, 23 bp, Homo sapiens
tttcttctcgaagagggagctta

SEQ ID NO: 7113215 - DNA, 23 bp, Homo sapiens
tttcttctcgaagagggagctta

SEQ ID NO: 7113216 - DNA, 22 bp, Homo sapiens
tttcttctcgacaccttatccc

SEQ ID NO: 7113217 - DNA, 22 bp, Homo sapiens
tttcttctcgacaccttatccc

SEQ ID NO: 7113218 - DNA, 22 bp, Homo sapiens
tttcttctcacccaggacagag

SEQ ID NO: 7113219 - DNA, 22 bp, Homo sapiens
tttcttctcacccaggacagag

SEQ ID NO: 7113220 - DNA, 22 bp, Homo sapiens
tttcttctcatccctgaaatca

SEQ ID NO: 7113221 - DNA, 22 bp, Homo sapiens
tttcttctcatccctgaaatca

SEQ ID NO: 7113222 - DNA, 22 bp, Homo sapiens
tttcttctcatccctgaaatca

SEQ ID NO: 7113223 - DNA, 22 bp, Homo sapiens
tttcttctatgtgtgatatttt

SEQ ID NO: 7113224 - DNA, 22 bp, Homo sapiens
tttcttctatgtgtgatatttt

SEQ ID NO: 7113225 - DNA, 22 bp, Homo sapiens
tttcttctatgtgtgatatttt

SEQ ID NO: 7113226 - DNA, 22 bp, Homo sapiens
tttcttgtctttagtatctggc

SEQ ID NO: 7113227 - DNA, 20 bp, Homo sapiens
tttcttgtcggctgttgctg

SEQ ID NO: 7113228 - DNA, 20 bp, Homo sapiens
tttcttgtcggctgttgctg

SEQ ID NO: 7113229 - DNA, 20 bp, Homo sapiens
tttcttgtacttggagaagg

SEQ ID NO: 7113230 - DNA, 20 bp, Homo sapiens
tttcttgtcggctgttgctg

SEQ ID NO: 7113231 - DNA, 22 bp, Homo sapiens
tttcttctgagatcagggagaa

SEQ ID NO: 7113232 - DNA, 22 bp, Homo sapiens
tttcttgtaagatgtttattaa

SEQ ID NO: 7113233 - DNA, 22 bp, Homo sapiens
tttcttgtaagatgtttattaa

SEQ ID NO: 7113234 - DNA, 22 bp, Homo sapiens
tttcttgtaagatgtttattaa

SEQ ID NO: 7113235 - DNA, 22 bp, Homo sapiens
tttcttgtacactggaatttat

SEQ ID NO: 7113236 - DNA, 20 bp, Homo sapiens
tttcttgtacttggagaagg

SEQ ID NO: 7113237 - DNA, 22 bp, Homo sapiens
tttcttctgagatcagggagaa

SEQ ID NO: 7113238 - DNA, 22 bp, Homo sapiens
tttcttctgagatcagggagaa

SEQ ID NO: 7113239 - DNA, 22 bp, Homo sapiens
tttcttctctgattaaggctca

SEQ ID NO: 7113240 - DNA, 22 bp, Homo sapiens
tttcttctctaatctcaatgat

SEQ ID NO: 7113241 - DNA, 22 bp, Homo sapiens
tttcttctctaatctcaatgat

SEQ ID NO: 7113242 - DNA, 22 bp, Homo sapiens
tttcttctctgattaaggctca

SEQ ID NO: 7113243 - DNA, 22 bp, Homo sapiens
tttcttctctgattaaggctca

SEQ ID NO: 7113244 - DNA, 22 bp, Homo sapiens
tttcttctctgattaaggctca

SEQ ID NO: 7113245 - DNA, 22 bp, Homo sapiens
tttctttatcatagcatctttg

SEQ ID NO: 7113246 - DNA, 22 bp, Homo sapiens
tttctttaattctcacagcaat

SEQ ID NO: 7113247 - DNA, 22 bp, Homo sapiens
tttctttaggctgtgttgccaa

SEQ ID NO: 7113248 - DNA, 22 bp, Homo sapiens
tttctttatcatagcatctttg

SEQ ID NO: 7113249 - DNA, 22 bp, Homo sapiens
tttctttatcctcctttgcaca

SEQ ID NO: 7113250 - DNA, 22 bp, Homo sapiens
tttctttaaaggaactctgttt

SEQ ID NO: 7113251 - DNA, 22 bp, Homo sapiens
tttctttaattctcacagcaat

SEQ ID NO: 7113252 - DNA, 22 bp, Homo sapiens
tttctttaattctcacagcaat

SEQ ID NO: 7113253 - DNA, 22 bp, Homo sapiens
tttcttgtctttagtatctggc

SEQ ID NO: 7113254 - DNA, 22 bp, Homo sapiens
tttcttgtctttagtatctggc

SEQ ID NO: 7113255 - DNA, 22 bp, Homo sapiens
tttcttgtgcctaattttgggc

SEQ ID NO: 7113256 - DNA, 22 bp, Homo sapiens
tttcttgtgcctaattttgggc

SEQ ID NO: 7113257 - DNA, 22 bp, Homo sapiens
tttcttgtttcatggtgtctca

SEQ ID NO: 7113258 - DNA, 22 bp, Homo sapiens
tttcttgtttcatggtgtctca

SEQ ID NO: 7113259 - DNA, 22 bp, Homo sapiens
tttcttgtttcatggtgtctca

SEQ ID NO: 7113260 - DNA, 22 bp, Homo sapiens
tttctcttcactgtgtgcctca

SEQ ID NO: 7113261 - DNA, 22 bp, Homo sapiens
tttctctgggctgttggcagcc

SEQ ID NO: 7113262 - DNA, 22 bp, Homo sapiens
tttctcggcagagatgatgggc

SEQ ID NO: 7113263 - DNA, 22 bp, Homo sapiens
tttctcggcagagatgatgggc

SEQ ID NO: 7113264 - DNA, 22 bp, Homo sapiens
tttctctagctattcattaaat

SEQ ID NO: 7113265 - DNA, 22 bp, Homo sapiens
tttctctagctattcattaaat

SEQ ID NO: 7113266 - DNA, 22 bp, Homo sapiens
tttctccttgtgtctcctttga

SEQ ID NO: 7113267 - DNA, 22 bp, Homo sapiens
tttctccttgtgtctcctttga

SEQ ID NO: 7113268 - DNA, 22 bp, Homo sapiens
tttctcctgtgaggtcagaagt

SEQ ID NO: 7113269 - DNA, 22 bp, Homo sapiens
tttctcctgtgaggtcagaagt

SEQ ID NO: 7113270 - DNA, 22 bp, Homo sapiens
tttctcctgtgtaagccgccca

SEQ ID NO: 7113271 - DNA, 22 bp, Homo sapiens
tttctcctgtgtaagccgccca

SEQ ID NO: 7113272 - DNA, 22 bp, Homo sapiens
tttctcctgtgtaagccgccca

SEQ ID NO: 7113273 - DNA, 17 bp, Homo sapiens
tttctccttccatctca

SEQ ID NO: 7113274 - DNA, 17 bp, Homo sapiens
tttctccttccatctca

SEQ ID NO: 7113275 - DNA, 17 bp, Homo sapiens
tttctccttccatctca

SEQ ID NO: 7113276 - DNA, 22 bp, Homo sapiens
tttctcctgtgaggtcagaagt

SEQ ID NO: 7113277 - DNA, 22 bp, Homo sapiens
tttctcctgctagaacaaggag

SEQ ID NO: 7113278 - DNA, 22 bp, Homo sapiens
tttctcctgctagaacaaggag

SEQ ID NO: 7113279 - DNA, 22 bp, Homo sapiens
tttctcctgcccagatgcctgg

SEQ ID NO: 7113280 - DNA, 22 bp, Homo sapiens
tttctcctgcccagatgcctgg

SEQ ID NO: 7113281 - DNA, 22 bp, Homo sapiens
tttctcctgagttccacgctac

SEQ ID NO: 7113282 - DNA, 22 bp, Homo sapiens
tttctcctgagttccacgctac

SEQ ID NO: 7113283 - DNA, 22 bp, Homo sapiens
tttctcctgagttccacgctac

SEQ ID NO: 7113284 - DNA, 22 bp, Homo sapiens
tttctctttgacaggaatcaga

SEQ ID NO: 7113285 - DNA, 22 bp, Homo sapiens
tttctctttgacaggaatcaga

SEQ ID NO: 7113286 - DNA, 22 bp, Homo sapiens
tttctctttgacaggaatcaga

SEQ ID NO: 7113287 - DNA, 22 bp, Homo sapiens
tttctgaaaactgaagtagtgc

SEQ ID NO: 7113288 - DNA, 22 bp, Homo sapiens
tttctcttgcgatatgctacac

SEQ ID NO: 7113289 - DNA, 22 bp, Homo sapiens
tttctctttcaatctgcagtac

SEQ ID NO: 7113290 - DNA, 22 bp, Homo sapiens
tttctcttgcgatatgctacac

SEQ ID NO: 7113291 - DNA, 22 bp, Homo sapiens
tttctctttcaatctgcagtac

SEQ ID NO: 7113292 - DNA, 22 bp, Homo sapiens
tttctcttgcgatatgctacac

SEQ ID NO: 7113293 - DNA, 22 bp, Homo sapiens
tttctcttgcgatatgctacac

SEQ ID NO: 7113294 - DNA, 22 bp, Homo sapiens
tttctgaaatctcttttgagga

SEQ ID NO: 7113295 - DNA, 22 bp, Homo sapiens
tttctgaaatctcttttgagga

SEQ ID NO: 7113296 - DNA, 22 bp, Homo sapiens
tttctgaaatgctggctttgga

SEQ ID NO: 7113297 - DNA, 22 bp, Homo sapiens
tttctgaacaaagccattatca

SEQ ID NO: 7113298 - DNA, 22 bp, Homo sapiens
tttctgaacaaagccattatca

SEQ ID NO: 7113299 - DNA, 22 bp, Homo sapiens
tttctgaaaactgaagtagtgc

SEQ ID NO: 7113300 - DNA, 22 bp, Homo sapiens
tttctgaaacatggtctttgta

SEQ ID NO: 7113301 - DNA, 22 bp, Homo sapiens
tttctgaagatacagctttgct

SEQ ID NO: 7113302 - DNA, 22 bp, Homo sapiens
tttctgaacttggtactggagc

SEQ ID NO: 7113303 - DNA, 21 bp, Homo sapiens
tttctgaaggcaacatctatc

SEQ ID NO: 7113304 - DNA, 22 bp, Homo sapiens
tttctgaagggcagcagactct

SEQ ID NO: 7113305 - DNA, 21 bp, Homo sapiens
tttctgaaggcaacatctatc

SEQ ID NO: 7113306 - DNA, 21 bp, Homo sapiens
tttctgaaggcaacatctatc

SEQ ID NO: 7113307 - DNA, 22 bp, Homo sapiens
tttctgaataactctatgatat

SEQ ID NO: 7113308 - DNA, 22 bp, Homo sapiens
tttctgaataactctatgatat

SEQ ID NO: 7113309 - DNA, 23 bp, Homo sapiens
tttctgaagttgagatggacttt

SEQ ID NO: 7113310 - DNA, 22 bp, Homo sapiens
tttctgaaggttaaggaattag

SEQ ID NO: 7113311 - DNA, 22 bp, Homo sapiens
tttctgacctgcaacagtttac

SEQ ID NO: 7113312 - DNA, 22 bp, Homo sapiens
tttctgacctgcaacagtttac

SEQ ID NO: 7113313 - DNA, 22 bp, Homo sapiens
tttctgactccagagaggaata

SEQ ID NO: 7113314 - DNA, 22 bp, Homo sapiens
tttctgaatttactcaaggtca

SEQ ID NO: 7113315 - DNA, 22 bp, Homo sapiens
tttctgacacatcagttgtaaa

SEQ ID NO: 7113316 - DNA, 18 bp, Homo sapiens
tttctgaatgtctatttc

SEQ ID NO: 7113317 - DNA, 18 bp, Homo sapiens
tttctgaatgtctatttc

SEQ ID NO: 7113318 - DNA, 22 bp, Homo sapiens
tttctgaattcctaggatgttg

SEQ ID NO: 7113319 - DNA, 22 bp, Homo sapiens
tttctgcatctctacagttgtt

SEQ ID NO: 7113320 - DNA, 22 bp, Homo sapiens
tttctgcatcttgaaacagagc

SEQ ID NO: 7113321 - DNA, 22 bp, Homo sapiens
tttctgcatcttgaaacagagc

SEQ ID NO: 7113322 - DNA, 22 bp, Homo sapiens
tttctgcatgcatttaattaaa

SEQ ID NO: 7113323 - DNA, 22 bp, Homo sapiens
tttctgcattgtcctcttggtt

SEQ ID NO: 7113324 - DNA, 22 bp, Homo sapiens
tttctgagaaattaaacacttt

SEQ ID NO: 7113325 - DNA, 22 bp, Homo sapiens
tttctgaggaattaatacagaa

SEQ ID NO: 7113326 - DNA, 22 bp, Homo sapiens
tttctgaggaattaatacagaa

SEQ ID NO: 7113327 - DNA, 22 bp, Homo sapiens
tttctgacttttatatgcatat

SEQ ID NO: 7113328 - DNA, 22 bp, Homo sapiens
tttctgccaaccatttaaactc

SEQ ID NO: 7113329 - DNA, 22 bp, Homo sapiens
tttctgccagtcactgctctag

SEQ ID NO: 7113330 - DNA, 22 bp, Homo sapiens
tttctgcatttacaaaatgagg

SEQ ID NO: 7113331 - DNA, 22 bp, Homo sapiens
tttctgctcgctctcaatcagg

SEQ ID NO: 7113332 - DNA, 22 bp, Homo sapiens
tttctgccgttccctgctctgt

SEQ ID NO: 7113333 - DNA, 22 bp, Homo sapiens
tttctgccttgtagactagaat

SEQ ID NO: 7113334 - DNA, 22 bp, Homo sapiens
tttctgctgtgctttcttgcgt

SEQ ID NO: 7113335 - DNA, 22 bp, Homo sapiens
tttctgcttaggactctgtgga

SEQ ID NO: 7113336 - DNA, 22 bp, Homo sapiens
tttctgcttaggactctgtgga

SEQ ID NO: 7113337 - DNA, 22 bp, Homo sapiens
tttctgctttctatccttgtca

SEQ ID NO: 7113338 - DNA, 22 bp, Homo sapiens
tttctggaaacgggttcaagct

SEQ ID NO: 7113339 - DNA, 22 bp, Homo sapiens
tttctggaaagcaagatacatt

SEQ ID NO: 7113340 - DNA, 22 bp, Homo sapiens
tttctggaaagcaagatacatt

SEQ ID NO: 7113341 - DNA, 22 bp, Homo sapiens
tttctggacagcaagatcagtt

SEQ ID NO: 7113342 - DNA, 22 bp, Homo sapiens
tttctggcagcgggacaggggt

SEQ ID NO: 7113343 - DNA, 22 bp, Homo sapiens
tttctgtagggatttcacagtt

SEQ ID NO: 7113344 - DNA, 22 bp, Homo sapiens
tttctgtagggatttcacagtt

SEQ ID NO: 7113345 - DNA, 22 bp, Homo sapiens
tttctgtacctcctcttgcccc

SEQ ID NO: 7113346 - DNA, 22 bp, Homo sapiens
tttctgtacacccactattcat

SEQ ID NO: 7113347 - DNA, 22 bp, Homo sapiens
tttctgtaagttcaggctttcc

SEQ ID NO: 7113348 - DNA, 22 bp, Homo sapiens
tttcaaagggaagttatgaagt

SEQ ID NO: 7113349 - DNA, 20 bp, Homo sapiens
tttcaaaggcacctatgaag

SEQ ID NO: 7113350 - DNA, 22 bp, Homo sapiens
tttcagagtcagctcctctcta

SEQ ID NO: 7113351 - DNA, 22 bp, Homo sapiens
tttcagagtctggctgcagcct

SEQ ID NO: 7113352 - DNA, 22 bp, Homo sapiens
tttcagagttagtagagcatgt

SEQ ID NO: 7113353 - DNA, 22 bp, Homo sapiens
tttcagagttatgtaagaaaat

SEQ ID NO: 7113354 - DNA, 22 bp, Homo sapiens
tttcaaagaccattaactatca

SEQ ID NO: 7113355 - DNA, 22 bp, Homo sapiens
tttcaaagaccattaactatca

SEQ ID NO: 7113356 - DNA, 22 bp, Homo sapiens
tttcaaagacagccatatttgt

SEQ ID NO: 7113357 - DNA, 22 bp, Homo sapiens
tttcaaagacagccatatttgt

SEQ ID NO: 7113358 - DNA, 22 bp, Homo sapiens
tttcaaagacagccatatttgt

SEQ ID NO: 7113359 - DNA, 22 bp, Homo sapiens
tttcaaagacagccatatttgt

SEQ ID NO: 7113360 - DNA, 22 bp, Homo sapiens
tttcaaactttactcttgaatc

SEQ ID NO: 7113361 - DNA, 22 bp, Homo sapiens
tttcaaagagttgtaaattact

SEQ ID NO: 7113362 - DNA, 22 bp, Homo sapiens
tttcaaagagttgtaaattact

SEQ ID NO: 7113363 - DNA, 22 bp, Homo sapiens
tttcaaagagaggcagaaggaa

SEQ ID NO: 7113364 - DNA, 19 bp, Homo sapiens
tttcaggagctatgcaggg

SEQ ID NO: 7113365 - DNA, 22 bp, Homo sapiens
tttcagtcatgagttgttttca

SEQ ID NO: 7113366 - DNA, 22 bp, Homo sapiens
tttcagtgaaagctactgttag

SEQ ID NO: 7113367 - DNA, 22 bp, Homo sapiens
tttcagtgcccagagctttgca

SEQ ID NO: 7113368 - DNA, 22 bp, Homo sapiens
tttcagggaagtgttgaaaagg

SEQ ID NO: 7113369 - DNA, 22 bp, Homo sapiens
tttcagagttgtcttcttgacc

SEQ ID NO: 7113370 - DNA, 22 bp, Homo sapiens
tttcagataaatatgggactaa

SEQ ID NO: 7113371 - DNA, 22 bp, Homo sapiens
tttcagatgcaattaattttca

SEQ ID NO: 7113372 - DNA, 22 bp, Homo sapiens
tttcagatggtatatacagtag

SEQ ID NO: 7113373 - DNA, 22 bp, Homo sapiens
tttcagatggtatatacagtag

SEQ ID NO: 7113374 - DNA, 22 bp, Homo sapiens
tttcagatgtgtgtctctgaag

SEQ ID NO: 7113375 - DNA, 22 bp, Homo sapiens
tttcagatgtgtgtctctgaag

SEQ ID NO: 7113376 - DNA, 22 bp, Homo sapiens
tttcagattatctcaactttgg

SEQ ID NO: 7113377 - DNA, 17 bp, Homo sapiens
tttcagattcactttct

SEQ ID NO: 7113378 - DNA, 20 bp, Homo sapiens
tttcagatttacagaaatgt

SEQ ID NO: 7113379 - DNA, 20 bp, Homo sapiens
tttcagatttacagaaatgt

SEQ ID NO: 7113380 - DNA, 22 bp, Homo sapiens
tttcagcactttaggcagcagg

SEQ ID NO: 7113381 - DNA, 22 bp, Homo sapiens
tttcagcactttaggcagcagg

SEQ ID NO: 7113382 - DNA, 22 bp, Homo sapiens
tttcctcttcgattaagtttgg

SEQ ID NO: 7113383 - DNA, 22 bp, Homo sapiens
tttcctcttctggcaggcaggg

SEQ ID NO: 7113384 - DNA, 22 bp, Homo sapiens
tttcctctgctgccattgcccc

SEQ ID NO: 7113385 - DNA, 22 bp, Homo sapiens
tttccaaagctgagttgagcaa

SEQ ID NO: 7113386 - DNA, 22 bp, Homo sapiens
tttccaaaggaggaaccagttt

SEQ ID NO: 7113387 - DNA, 22 bp, Homo sapiens
tttccaaaggaggaaccagttt

SEQ ID NO: 7113388 - DNA, 22 bp, Homo sapiens
tttccaaaggagtaccacgcat

SEQ ID NO: 7113389 - DNA, 22 bp, Homo sapiens
tttccaaaggctaaactcagtt

SEQ ID NO: 7113390 - DNA, 22 bp, Homo sapiens
tttccaaaggctaaactcagtt

SEQ ID NO: 7113391 - DNA, 16 bp, Homo sapiens
tttccaaagggcagct

SEQ ID NO: 7113392 - DNA, 22 bp, Homo sapiens
tttccaaaggtggcaggaacaa

SEQ ID NO: 7113393 - DNA, 22 bp, Homo sapiens
tttccaaaggtggcaggaacaa

SEQ ID NO: 7113394 - DNA, 22 bp, Homo sapiens
tttccaaagttgccataagctt

SEQ ID NO: 7113395 - DNA, 22 bp, Homo sapiens
tttccaaagttgccataagctt

SEQ ID NO: 7113396 - DNA, 22 bp, Homo sapiens
tttcattgtctacatatgacat

SEQ ID NO: 7113397 - DNA, 22 bp, Homo sapiens
tttcattgtgatgcttttatca

SEQ ID NO: 7113398 - DNA, 22 bp, Homo sapiens
tttcatttcatagaattgtgtt

SEQ ID NO: 7113399 - DNA, 22 bp, Homo sapiens
tttcattgtccccaggcaagac

SEQ ID NO: 7113400 - DNA, 22 bp, Homo sapiens
tttcattgtctacatatgacat

SEQ ID NO: 7113401 - DNA, 22 bp, Homo sapiens
tttcattgtcatctatcttaga

SEQ ID NO: 7113402 - DNA, 22 bp, Homo sapiens
tttcattgccataaggtgggat

SEQ ID NO: 7113403 - DNA, 22 bp, Homo sapiens
tttcattgccataaggtgggat

SEQ ID NO: 7113404 - DNA, 22 bp, Homo sapiens
tttcattgcctttggaaggtct

SEQ ID NO: 7113405 - DNA, 22 bp, Homo sapiens
tttcattggctccctgatgaat

SEQ ID NO: 7113406 - DNA, 22 bp, Homo sapiens
tttcattgtcaataaactgtat

SEQ ID NO: 7113407 - DNA, 22 bp, Homo sapiens
tttcattttggttatgccataa

SEQ ID NO: 7113408 - DNA, 22 bp, Homo sapiens
tttcattttggttatgccataa

SEQ ID NO: 7113409 - DNA, 22 bp, Homo sapiens
tttccaaaagtttgttctgtgc

SEQ ID NO: 7113410 - DNA, 22 bp, Homo sapiens
tttccaaaatgaatctaatgca

SEQ ID NO: 7113411 - DNA, 22 bp, Homo sapiens
tttccaaacccagcgagctaca

SEQ ID NO: 7113412 - DNA, 22 bp, Homo sapiens
tttccaaacccagcgagctaca

SEQ ID NO: 7113413 - DNA, 22 bp, Homo sapiens
tttcattttggttatgccataa

SEQ ID NO: 7113414 - DNA, 22 bp, Homo sapiens
tttcatttcatagaattgtgtt

SEQ ID NO: 7113415 - DNA, 22 bp, Homo sapiens
tttcatttcatagaattgtgtt

SEQ ID NO: 7113416 - DNA, 22 bp, Homo sapiens
tttcattttggttatgccataa

SEQ ID NO: 7113417 - DNA, 22 bp, Homo sapiens
tttcattttggttatgccataa

SEQ ID NO: 7113418 - DNA, 22 bp, Homo sapiens
tttcctggaagttattcctcat

SEQ ID NO: 7113419 - DNA, 22 bp, Homo sapiens
tttcctgagccagagtttcatt

SEQ ID NO: 7113420 - DNA, 22 bp, Homo sapiens
tttcctgttgccatcaagaatg

SEQ ID NO: 7113421 - DNA, 22 bp, Homo sapiens
tttcctgtgactaatctggaca

SEQ ID NO: 7113422 - DNA, 22 bp, Homo sapiens
tttcctgtgcttaacaaatatt

SEQ ID NO: 7113423 - DNA, 22 bp, Homo sapiens
tttcctgtgcttaacaaatatt

SEQ ID NO: 7113424 - DNA, 22 bp, Homo sapiens
tttcctggaccaactgagattg

SEQ ID NO: 7113425 - DNA, 22 bp, Homo sapiens
tttcctggaccaactgagattg

SEQ ID NO: 7113426 - DNA, 22 bp, Homo sapiens
tttcctggaccaactgagattg

SEQ ID NO: 7113427 - DNA, 22 bp, Homo sapiens
tttcctggagggtccccagcag

SEQ ID NO: 7113428 - DNA, 22 bp, Homo sapiens
tttcctggagggtccccagcag

SEQ ID NO: 7113429 - DNA, 22 bp, Homo sapiens
tttcctggccaaatgctttgtg

SEQ ID NO: 7113430 - DNA, 22 bp, Homo sapiens
tttcctggccaaatgctttgtg

SEQ ID NO: 7113431 - DNA, 22 bp, Homo sapiens
tttcctggctctgtggccttgt

SEQ ID NO: 7113432 - DNA, 22 bp, Homo sapiens
tttcctggctctgtggccttgt

SEQ ID NO: 7113433 - DNA, 22 bp, Homo sapiens
tttcctggttggggacgtggtt

SEQ ID NO: 7113434 - DNA, 22 bp, Homo sapiens
tttcctggttggggacgtggtt

SEQ ID NO: 7113435 - DNA, 22 bp, Homo sapiens
tttcctggttggggacgtggtt

SEQ ID NO: 7113436 - DNA, 22 bp, Homo sapiens
tttcctggtttgaagcagcagc

SEQ ID NO: 7113437 - DNA, 22 bp, Homo sapiens
tttcctgttgccatcaagaatg

SEQ ID NO: 7113438 - DNA, 22 bp, Homo sapiens
tttccttccaggttcctaaggc

SEQ ID NO: 7113439 - DNA, 22 bp, Homo sapiens
tttccttctcagggagcttcaa

SEQ ID NO: 7113440 - DNA, 22 bp, Homo sapiens
tttccttccttgctagcctgag

SEQ ID NO: 7113441 - DNA, 22 bp, Homo sapiens
tttccttcctaaggtgaagcaa

SEQ ID NO: 7113442 - DNA, 22 bp, Homo sapiens
tttccttcctaaggtgaagcaa

SEQ ID NO: 7113443 - DNA, 22 bp, Homo sapiens
tttctaagtgtattgagcttgg

SEQ ID NO: 7113444 - DNA, 22 bp, Homo sapiens
tttctaatagttgagtcagcta

SEQ ID NO: 7113445 - DNA, 22 bp, Homo sapiens
tttctaatatcacttccagctg

SEQ ID NO: 7113446 - DNA, 22 bp, Homo sapiens
tttctaatatcacttccagctg

SEQ ID NO: 7113447 - DNA, 22 bp, Homo sapiens
tttctaatatgctctaagtcaa

SEQ ID NO: 7113448 - DNA, 22 bp, Homo sapiens
tttctaagtatcttgcagtttt

SEQ ID NO: 7113449 - DNA, 22 bp, Homo sapiens
tttctaagtaaacacagcatac

SEQ ID NO: 7113450 - DNA, 21 bp, Homo sapiens
tttctaagtaactggcagcat

SEQ ID NO: 7113451 - DNA, 22 bp, Homo sapiens
tttctaagtaaacacagcatac

SEQ ID NO: 7113452 - DNA, 22 bp, Homo sapiens
tttctaagtaaacacagcatac

SEQ ID NO: 7113453 - DNA, 22 bp, Homo sapiens
tttctacattcaaaaactacca

SEQ ID NO: 7113454 - DNA, 22 bp, Homo sapiens
tttctacattcaaaaactacca

SEQ ID NO: 7113455 - DNA, 22 bp, Homo sapiens
tttctacattcaaaaactacca

SEQ ID NO: 7113456 - DNA, 22 bp, Homo sapiens
tttctacattcaaaaactacca

SEQ ID NO: 7113457 - DNA, 22 bp, Homo sapiens
tttctacattcaaaaactacca

SEQ ID NO: 7113458 - DNA, 22 bp, Homo sapiens
tttctacattcaaaaactacca

SEQ ID NO: 7113459 - DNA, 22 bp, Homo sapiens
tttctacatttgtaaccagatt

SEQ ID NO: 7113460 - DNA, 22 bp, Homo sapiens
tttctacatttgtaaccagatt

SEQ ID NO: 7113461 - DNA, 22 bp, Homo sapiens
tttctacatttgtaaccagatt

SEQ ID NO: 7113462 - DNA, 22 bp, Homo sapiens
tttctactaagaaagttgatta

SEQ ID NO: 7113463 - DNA, 22 bp, Homo sapiens
tttctactcaactgagagttgt

SEQ ID NO: 7113464 - DNA, 22 bp, Homo sapiens
tttctaattgtggccgaggtag

SEQ ID NO: 7113465 - DNA, 22 bp, Homo sapiens
tttctacatgttttctattgaa

SEQ ID NO: 7113466 - DNA, 22 bp, Homo sapiens
tttctacatgttttctattgaa

SEQ ID NO: 7113467 - DNA, 22 bp, Homo sapiens
tttctacatgttttctattgaa

SEQ ID NO: 7113468 - DNA, 22 bp, Homo sapiens
tttctacatgttttctattgaa

SEQ ID NO: 7113469 - DNA, 22 bp, Homo sapiens
tttctaatgttctcagggattg

SEQ ID NO: 7113470 - DNA, 19 bp, Homo sapiens
tttctaatgtgtttttctt

SEQ ID NO: 7113471 - DNA, 22 bp, Homo sapiens
tttctaattctaactggcagag

SEQ ID NO: 7113472 - DNA, 22 bp, Homo sapiens
tttctaattctaactggcagag

SEQ ID NO: 7113473 - DNA, 22 bp, Homo sapiens
tttctaatctttagttacaaaa

SEQ ID NO: 7113474 - DNA, 22 bp, Homo sapiens
tttctaatctgattctcctacc

SEQ ID NO: 7113475 - DNA, 22 bp, Homo sapiens
tttctaatctttagttacaaaa

SEQ ID NO: 7113476 - DNA, 22 bp, Homo sapiens
tttctaatctttagttacaaaa

SEQ ID NO: 7113477 - DNA, 22 bp, Homo sapiens
tttctaatctttagttacaaaa

SEQ ID NO: 7113478 - DNA, 21 bp, Homo sapiens
tttctcataaaatactcatta

SEQ ID NO: 7113479 - DNA, 21 bp, Homo sapiens
tttctcataaaatactcatta

SEQ ID NO: 7113480 - DNA, 22 bp, Homo sapiens
tttctcagttctctgcaaggag

SEQ ID NO: 7113481 - DNA, 21 bp, Homo sapiens
tttctcataaaatactcatta

SEQ ID NO: 7113482 - DNA, 22 bp, Homo sapiens
tttctcatagtcatgcctctta

SEQ ID NO: 7113483 - DNA, 22 bp, Homo sapiens
tttctcagttctctgcaaggag

SEQ ID NO: 7113484 - DNA, 22 bp, Homo sapiens
tttctcagtgcagtttctacgt

SEQ ID NO: 7113485 - DNA, 22 bp, Homo sapiens
tttctattttaaaggcatatgg

SEQ ID NO: 7113486 - DNA, 22 bp, Homo sapiens
tttctattttaaaggcatatgg

SEQ ID NO: 7113487 - DNA, 22 bp, Homo sapiens
tttctatttacagtgctaggta

SEQ ID NO: 7113488 - DNA, 22 bp, Homo sapiens
tttctattttaaaggcatatgg

SEQ ID NO: 7113489 - DNA, 22 bp, Homo sapiens
tttctattgtaagtctcctata

SEQ ID NO: 7113490 - DNA, 22 bp, Homo sapiens
tttctattgtaagtctcctata

SEQ ID NO: 7113491 - DNA, 22 bp, Homo sapiens
tttctacttctcctgaatgtct

SEQ ID NO: 7113492 - DNA, 22 bp, Homo sapiens
tttctacttctcctgaatgtct

SEQ ID NO: 7113493 - DNA, 22 bp, Homo sapiens
tttctactttggaatgcactga

SEQ ID NO: 7113494 - DNA, 22 bp, Homo sapiens
tttctagaaacattatctctat

SEQ ID NO: 7113495 - DNA, 22 bp, Homo sapiens
tttctagaaaccaagatattgt

SEQ ID NO: 7113496 - DNA, 22 bp, Homo sapiens
tttctagaaatagagatagagt

SEQ ID NO: 7113497 - DNA, 22 bp, Homo sapiens
tttctcctctccagagtgcagt

SEQ ID NO: 7113498 - DNA, 22 bp, Homo sapiens
tttctcctcatgactggttgtg

SEQ ID NO: 7113499 - DNA, 22 bp, Homo sapiens
tttctcctccagagagacacag

SEQ ID NO: 7113500 - DNA, 22 bp, Homo sapiens
tttctccctttataagactgta

SEQ ID NO: 7113501 - DNA, 22 bp, Homo sapiens
tttctcctaactcaaatttaag

SEQ ID NO: 7113502 - DNA, 22 bp, Homo sapiens
tttctcctcatgactggttgtg

SEQ ID NO: 7113503 - DNA, 22 bp, Homo sapiens
tttctccccagtctaatctgga

SEQ ID NO: 7113504 - DNA, 22 bp, Homo sapiens
tttctcatagtcatgcctctta

SEQ ID NO: 7113505 - DNA, 22 bp, Homo sapiens
tttctcatagtcatgcctctta

SEQ ID NO: 7113506 - DNA, 22 bp, Homo sapiens
tttctcatctggaaacagtgct

SEQ ID NO: 7113507 - DNA, 22 bp, Homo sapiens
tttctcatctggaaacagtgct

SEQ ID NO: 7113508 - DNA, 22 bp, Homo sapiens
tttctcatggaacatagctcct

SEQ ID NO: 7113509 - DNA, 22 bp, Homo sapiens
tttctcatggaacatagctcct

SEQ ID NO: 7113510 - DNA, 22 bp, Homo sapiens
tttctcatggaacatagctcct

SEQ ID NO: 7113511 - DNA, 22 bp, Homo sapiens
tttctcatggaacatcgtttag

SEQ ID NO: 7113512 - DNA, 22 bp, Homo sapiens
tttctcatggacccttcatgat

SEQ ID NO: 7113513 - DNA, 22 bp, Homo sapiens
tttctcatggacccttcatgat

SEQ ID NO: 7113514 - DNA, 22 bp, Homo sapiens
tttctcatggacccttcatgat

SEQ ID NO: 7113515 - DNA, 22 bp, Homo sapiens
tttctcatggacccttcatgat

SEQ ID NO: 7113516 - DNA, 22 bp, Homo sapiens
tttctcatggacccttcatgat

SEQ ID NO: 7113517 - DNA, 22 bp, Homo sapiens
tttctcatggacccttcatgat

SEQ ID NO: 7113518 - DNA, 22 bp, Homo sapiens
tttctcatggacccttcatgat

SEQ ID NO: 7113519 - DNA, 16 bp, Homo sapiens
tttctcattgtcatca

SEQ ID NO: 7113520 - DNA, 21 bp, Homo sapiens
tttctccaagtgactgattcc

SEQ ID NO: 7113521 - DNA, 21 bp, Homo sapiens
tttctccaagtgactgattcc

SEQ ID NO: 7113522 - DNA, 22 bp, Homo sapiens
tttctccaatgtatcagcacac

SEQ ID NO: 7113523 - DNA, 22 bp, Homo sapiens
tttctccaatgtatcagcacac

SEQ ID NO: 7113524 - DNA, 22 bp, Homo sapiens
tttctccacgccagcttgctta

SEQ ID NO: 7113525 - DNA, 22 bp, Homo sapiens
tttctccacttctcttgccaac

SEQ ID NO: 7113526 - DNA, 22 bp, Homo sapiens
tttctccacttctcttgccaac

SEQ ID NO: 7113527 - DNA, 22 bp, Homo sapiens
tttgttcacctagcaaactttt

SEQ ID NO: 7113528 - DNA, 22 bp, Homo sapiens
tttgttcacctagcaaactttt

SEQ ID NO: 7113529 - DNA, 22 bp, Homo sapiens
tttgtcataactctgctgcaag

SEQ ID NO: 7113530 - DNA, 23 bp, Homo sapiens
tttgttcactcctgggaaagaca

SEQ ID NO: 7113531 - DNA, 22 bp, Homo sapiens
tttgttcactgagcaatgatta

SEQ ID NO: 7113532 - DNA, 22 bp, Homo sapiens
tttgttcactgagcaatgatta

SEQ ID NO: 7113533 - DNA, 22 bp, Homo sapiens
tttgttcagagatgttcaagct

SEQ ID NO: 7113534 - DNA, 22 bp, Homo sapiens
tttgttctgaagcaagtaggga

SEQ ID NO: 7113535 - DNA, 22 bp, Homo sapiens
tttgtcaagtttgcaaatacgt

SEQ ID NO: 7113536 - DNA, 22 bp, Homo sapiens
tttgtcaataactaccaacagg

SEQ ID NO: 7113537 - DNA, 22 bp, Homo sapiens
tttgtcaaatcaaaccacattc

SEQ ID NO: 7113538 - DNA, 22 bp, Homo sapiens
tttgtattccatatcatgccat

SEQ ID NO: 7113539 - DNA, 22 bp, Homo sapiens
tttgtatttttcccagctagct

SEQ ID NO: 7113540 - DNA, 22 bp, Homo sapiens
tttgtatttttcccagctagct

SEQ ID NO: 7113541 - DNA, 22 bp, Homo sapiens
tttgtatttttcccagctagct

SEQ ID NO: 7113542 - DNA, 22 bp, Homo sapiens
tttgttggttgcactggtgggt

SEQ ID NO: 7113543 - DNA, 22 bp, Homo sapiens
tttgttggttgcactggtgggt

SEQ ID NO: 7113544 - DNA, 22 bp, Homo sapiens
tttgttcttgcaacagttatta

SEQ ID NO: 7113545 - DNA, 22 bp, Homo sapiens
tttgttcttgcaacagttatta

SEQ ID NO: 7113546 - DNA, 22 bp, Homo sapiens
tttgttctgcatcacagaaaaa

SEQ ID NO: 7113547 - DNA, 22 bp, Homo sapiens
tttgttctgcatcacagaaaaa

SEQ ID NO: 7113548 - DNA, 22 bp, Homo sapiens
tttgttcttagtatctgtgtgc

SEQ ID NO: 7113549 - DNA, 22 bp, Homo sapiens
tttgttcttgcaacagttatta

SEQ ID NO: 7113550 - DNA, 22 bp, Homo sapiens
tttgttcttgcaacagttatta

SEQ ID NO: 7113551 - DNA, 22 bp, Homo sapiens
tttgtttacaaaaataagcagt

SEQ ID NO: 7113552 - DNA, 22 bp, Homo sapiens
tttgttgtgaacagaataatat

SEQ ID NO: 7113553 - DNA, 22 bp, Homo sapiens
tttgttgtcatcagtgatgagt

SEQ ID NO: 7113554 - DNA, 22 bp, Homo sapiens
tttgttgttagagtatgtgaaa

SEQ ID NO: 7113555 - DNA, 22 bp, Homo sapiens
tttgttgtgataatggtctgca

SEQ ID NO: 7113556 - DNA, 22 bp, Homo sapiens
tttgttgttagagtatgtgaaa

SEQ ID NO: 7113557 - DNA, 22 bp, Homo sapiens
tttgttgttagagtatgtgaaa

SEQ ID NO: 7113558 - DNA, 22 bp, Homo sapiens
tttgttgtgaacagaataatat

SEQ ID NO: 7113559 - DNA, 22 bp, Homo sapiens
tttgttgtgataatggtctgca

SEQ ID NO: 7113560 - DNA, 22 bp, Homo sapiens
tttgtagatagaaaaatgatta

SEQ ID NO: 7113561 - DNA, 22 bp, Homo sapiens
tttgtagatagaaaaatgatta

SEQ ID NO: 7113562 - DNA, 22 bp, Homo sapiens
tttgtagactaccagtaattgt

SEQ ID NO: 7113563 - DNA, 22 bp, Homo sapiens
tttgtagagaataaaacaaatt

SEQ ID NO: 7113564 - DNA, 22 bp, Homo sapiens
tttgtagaataatatctttctg

SEQ ID NO: 7113565 - DNA, 22 bp, Homo sapiens
tttgtagacgtcagaagttact

SEQ ID NO: 7113566 - DNA, 22 bp, Homo sapiens
tttgtagaactatacttacatt

SEQ ID NO: 7113567 - DNA, 22 bp, Homo sapiens
tttgtagaactgtagaacaatg

SEQ ID NO: 7113568 - DNA, 22 bp, Homo sapiens
tttgtactatggtttttcacta

SEQ ID NO: 7113569 - DNA, 22 bp, Homo sapiens
tttgtactcaggctcagcctct

SEQ ID NO: 7113570 - DNA, 23 bp, Homo sapiens
tttgtacattgaggaggcagaat

SEQ ID NO: 7113571 - DNA, 22 bp, Homo sapiens
tttgtactctcagaattcagaa

SEQ ID NO: 7113572 - DNA, 22 bp, Homo sapiens
tttgtactgaccaattatttga

SEQ ID NO: 7113573 - DNA, 23 bp, Homo sapiens
tttgtactgcattatgagacaca

SEQ ID NO: 7113574 - DNA, 22 bp, Homo sapiens
tttgtactgccacagctgacgt

SEQ ID NO: 7113575 - DNA, 22 bp, Homo sapiens
tttgtactgttgaaattgctgg

SEQ ID NO: 7113576 - DNA, 22 bp, Homo sapiens
tttgtatgtgataagactattc

SEQ ID NO: 7113577 - DNA, 22 bp, Homo sapiens
tttgtattacaaagtcacagta

SEQ ID NO: 7113578 - DNA, 22 bp, Homo sapiens
tttgtatgtgataagactattc

SEQ ID NO: 7113579 - DNA, 22 bp, Homo sapiens
tttgtatgtgataagactattc

SEQ ID NO: 7113580 - DNA, 22 bp, Homo sapiens
tttgtattacaaagtcacagta

SEQ ID NO: 7113581 - DNA, 22 bp, Homo sapiens
tttgtattacaaagtcacagta

SEQ ID NO: 7113582 - DNA, 22 bp, Homo sapiens
tttgtatgggcagaaattagat

SEQ ID NO: 7113583 - DNA, 22 bp, Homo sapiens
tttgtatgggcagaaattagat

SEQ ID NO: 7113584 - DNA, 22 bp, Homo sapiens
tttgtatgaactggtatgtagg

SEQ ID NO: 7113585 - DNA, 22 bp, Homo sapiens
tttgtatgaatgcatattttca

SEQ ID NO: 7113586 - DNA, 22 bp, Homo sapiens
tttgtatgaatgcatattttca

SEQ ID NO: 7113587 - DNA, 22 bp, Homo sapiens
tttgtatgaactggtatgtagg

SEQ ID NO: 7113588 - DNA, 22 bp, Homo sapiens
tttgtagcagcatgatttataa

SEQ ID NO: 7113589 - DNA, 22 bp, Homo sapiens
tttgtagagggtaattgacaga

SEQ ID NO: 7113590 - DNA, 22 bp, Homo sapiens
tttgtagatagaaaaatgatta

SEQ ID NO: 7113591 - DNA, 22 bp, Homo sapiens
tttgtagattcattgaactttt

SEQ ID NO: 7113592 - DNA, 22 bp, Homo sapiens
tttgtataaatgaagatgctgg

SEQ ID NO: 7113593 - DNA, 22 bp, Homo sapiens
tttgtataaatgaagatgctgg

SEQ ID NO: 7113594 - DNA, 22 bp, Homo sapiens
tttgtataaattggagcaatgt

SEQ ID NO: 7113595 - DNA, 22 bp, Homo sapiens
tttgtataaattggagcaatgt

SEQ ID NO: 7113596 - DNA, 22 bp, Homo sapiens
tttgtataagaacattctagca

SEQ ID NO: 7113597 - DNA, 22 bp, Homo sapiens
ttttagaagttcacttgggttt

SEQ ID NO: 7113598 - DNA, 22 bp, Homo sapiens
ttttagaagttcacttgggttt

SEQ ID NO: 7113599 - DNA, 22 bp, Homo sapiens
ttttagaagttcacttgggttt

SEQ ID NO: 7113600 - DNA, 22 bp, Homo sapiens
ttttagaagttcatgtgggatt

SEQ ID NO: 7113601 - DNA, 22 bp, Homo sapiens
tttgttttgaactagctcagaa

SEQ ID NO: 7113602 - DNA, 22 bp, Homo sapiens
tttgttttgaactagctcagaa

SEQ ID NO: 7113603 - DNA, 22 bp, Homo sapiens
tttgttttcaatgtgtcattca

SEQ ID NO: 7113604 - DNA, 22 bp, Homo sapiens
tttgttttcaatgtgtcattca

SEQ ID NO: 7113605 - DNA, 22 bp, Homo sapiens
tttgttttcaatgtgtcattca

SEQ ID NO: 7113606 - DNA, 22 bp, Homo sapiens
tttgttttctgtaggcctttcc

SEQ ID NO: 7113607 - DNA, 22 bp, Homo sapiens
tttgttttctgtaggcctttcc

SEQ ID NO: 7113608 - DNA, 22 bp, Homo sapiens
tttgttttctgtaggcctttcc

SEQ ID NO: 7113609 - DNA, 22 bp, Homo sapiens
tttgttttgaactagctcagaa

SEQ ID NO: 7113610 - DNA, 22 bp, Homo sapiens
tttgttttgaactagctcagaa

SEQ ID NO: 7113611 - DNA, 21 bp, Homo sapiens
tttgtttgtatcagaatggcc

SEQ ID NO: 7113612 - DNA, 22 bp, Homo sapiens
tttgttttcaatgtgtcattca

SEQ ID NO: 7113613 - DNA, 22 bp, Homo sapiens
tttgttttcaatgtgtcattca

SEQ ID NO: 7113614 - DNA, 22 bp, Homo sapiens
tttgtttctgcaatacctatag

SEQ ID NO: 7113615 - DNA, 22 bp, Homo sapiens
tttgtttctgcaatacctatag

SEQ ID NO: 7113616 - DNA, 22 bp, Homo sapiens
tttgtttgccacacaaaacagt

SEQ ID NO: 7113617 - DNA, 22 bp, Homo sapiens
tttgtttgccacacaaaacagt

SEQ ID NO: 7113618 - DNA, 22 bp, Homo sapiens
tttgtttgcggcacatagtttg

SEQ ID NO: 7113619 - DNA, 22 bp, Homo sapiens
tttgtttggcaacttggtaaag

SEQ ID NO: 7113620 - DNA, 22 bp, Homo sapiens
tttgtttagatggtaaatcagt

SEQ ID NO: 7113621 - DNA, 22 bp, Homo sapiens
tttgtttcgcagcctctctctg

SEQ ID NO: 7113622 - DNA, 22 bp, Homo sapiens
tttgtttagagaattgaagcag

SEQ ID NO: 7113623 - DNA, 22 bp, Homo sapiens
tttgtttagatggtaaatcagt

SEQ ID NO: 7113624 - DNA, 22 bp, Homo sapiens
tttgtttagatggtaaatcagt

SEQ ID NO: 7113625 - DNA, 22 bp, Homo sapiens
ttttagtttggatttctaaagc

SEQ ID NO: 7113626 - DNA, 22 bp, Homo sapiens
ttttagtttggatttctaaagc

SEQ ID NO: 7113627 - DNA, 22 bp, Homo sapiens
ttttagaagttcatgtgggatt

SEQ ID NO: 7113628 - DNA, 22 bp, Homo sapiens
ttttagaatcaggttgtctggg

SEQ ID NO: 7113629 - DNA, 22 bp, Homo sapiens
ttttagaatcaggttgtctggg

SEQ ID NO: 7113630 - DNA, 22 bp, Homo sapiens
ttttagtttggatttctaaagc

SEQ ID NO: 7113631 - DNA, 22 bp, Homo sapiens
ttttataaagagagtcagttgg

SEQ ID NO: 7113632 - DNA, 22 bp, Homo sapiens
ttttataaagagagtcagttgg

SEQ ID NO: 7113633 - DNA, 22 bp, Homo sapiens
ttttataaagagagtcagttgg

SEQ ID NO: 7113634 - DNA, 22 bp, Homo sapiens
ttttataaagagagtcagttgg

SEQ ID NO: 7113635 - DNA, 22 bp, Homo sapiens
ttttataagcaagaaagggaaa

SEQ ID NO: 7113636 - DNA, 22 bp, Homo sapiens
ttttatagctgaatagtattcc

SEQ ID NO: 7113637 - DNA, 22 bp, Homo sapiens
ttttatagctgaatagtattcc

SEQ ID NO: 7113638 - DNA, 22 bp, Homo sapiens
ttttatatggcacattggttgg

SEQ ID NO: 7113639 - DNA, 22 bp, Homo sapiens
ttttatatggcacattggttgg

SEQ ID NO: 7113640 - DNA, 22 bp, Homo sapiens
ttttatatggcacattggttgg

SEQ ID NO: 7113641 - DNA, 22 bp, Homo sapiens
ttttatacttaagacagagttt

SEQ ID NO: 7113642 - DNA, 22 bp, Homo sapiens
ttttatagctgaatagtattcc

SEQ ID NO: 7113643 - DNA, 22 bp, Homo sapiens
ttttatagctgaatagtattcc

SEQ ID NO: 7113644 - DNA, 22 bp, Homo sapiens
ttttatagctgaatagtattcc

SEQ ID NO: 7113645 - DNA, 22 bp, Homo sapiens
ttttatacacatgaacatgcag

SEQ ID NO: 7113646 - DNA, 22 bp, Homo sapiens
ttttatacacatgaacatgcag

SEQ ID NO: 7113647 - DNA, 22 bp, Homo sapiens
ttttatacttaagacagagttt

SEQ ID NO: 7113648 - DNA, 22 bp, Homo sapiens
ttttatatggcacattggttgg

SEQ ID NO: 7113649 - DNA, 22 bp, Homo sapiens
ttttatatggcacattggttgg

SEQ ID NO: 7113650 - DNA, 20 bp, Homo sapiens
ttttatatgtagggtatatg

SEQ ID NO: 7113651 - DNA, 20 bp, Homo sapiens
ttttatatgtagggtatatg

SEQ ID NO: 7113652 - DNA, 20 bp, Homo sapiens
ttttatatgtagggtatatg

SEQ ID NO: 7113653 - DNA, 22 bp, Homo sapiens
ttttatattgagtgagagttcc

SEQ ID NO: 7113654 - DNA, 22 bp, Homo sapiens
ttttatattgagtgagagttcc

SEQ ID NO: 7113655 - DNA, 22 bp, Homo sapiens
ttttatattgagtgagagttcc

SEQ ID NO: 7113656 - DNA, 22 bp, Homo sapiens
ttttatattgagtgagagttcc

SEQ ID NO: 7113657 - DNA, 22 bp, Homo sapiens
ttttatattgagtgagagttcc

SEQ ID NO: 7113658 - DNA, 22 bp, Homo sapiens
ttttatcaatcattaagacatt

SEQ ID NO: 7113659 - DNA, 22 bp, Homo sapiens
ttttatcaatcattaagacatt

SEQ ID NO: 7113660 - DNA, 22 bp, Homo sapiens
ttttatcaatcattaagacatt

SEQ ID NO: 7113661 - DNA, 22 bp, Homo sapiens
ttttatcaatcattaagacatt

SEQ ID NO: 7113662 - DNA, 22 bp, Homo sapiens
ttttatcagcagggataacaag

SEQ ID NO: 7113663 - DNA, 22 bp, Homo sapiens
ttttatcagcagggataacaag

SEQ ID NO: 7113664 - DNA, 22 bp, Homo sapiens
ttttatcagcagggataacaag

SEQ ID NO: 7113665 - DNA, 22 bp, Homo sapiens
ttttatcagcagggataacaag

SEQ ID NO: 7113666 - DNA, 22 bp, Homo sapiens
ttttatcaatcattaagacatt

SEQ ID NO: 7113667 - DNA, 22 bp, Homo sapiens
ttttatcagcagggataacaag

SEQ ID NO: 7113668 - DNA, 22 bp, Homo sapiens
tttgtacatgtaagattgcatc

SEQ ID NO: 7113669 - DNA, 22 bp, Homo sapiens
tttgtacatgtaagattgcatc

SEQ ID NO: 7113670 - DNA, 23 bp, Homo sapiens
tttgtacattgaggaggcagaat

SEQ ID NO: 7113671 - DNA, 19 bp, Homo sapiens
tttggcaggagataggatg

SEQ ID NO: 7113672 - DNA, 19 bp, Homo sapiens
tttggcaggagataggatg

SEQ ID NO: 7113673 - DNA, 22 bp, Homo sapiens
tttgtaatgataatgttaaatt

SEQ ID NO: 7113674 - DNA, 17 bp, Homo sapiens
tttgtacaacattttaa

SEQ ID NO: 7113675 - DNA, 22 bp, Homo sapiens
tttggcagctaaggcagctcgc

SEQ ID NO: 7113676 - DNA, 22 bp, Homo sapiens
tttggcagctcttgactgttct

SEQ ID NO: 7113677 - DNA, 22 bp, Homo sapiens
tttggcagcttccatattcact

SEQ ID NO: 7113678 - DNA, 22 bp, Homo sapiens
tttggcagagtcatttcagaaa

SEQ ID NO: 7113679 - DNA, 22 bp, Homo sapiens
tttggcagagtaaggcctgctt

SEQ ID NO: 7113680 - DNA, 22 bp, Homo sapiens
tttggcagagtgtgggcatttg

SEQ ID NO: 7113681 - DNA, 23 bp, Homo sapiens
tttggcagaagcacattattgtg

SEQ ID NO: 7113682 - DNA, 22 bp, Homo sapiens
tttggcagaattgatggtcctt

SEQ ID NO: 7113683 - DNA, 22 bp, Homo sapiens
tttggcagaggaagaaggcaca

SEQ ID NO: 7113684 - DNA, 22 bp, Homo sapiens
tttggcagaattgatggtcctt

SEQ ID NO: 7113685 - DNA, 22 bp, Homo sapiens
tttggcagaggaagaaggcaca

SEQ ID NO: 7113686 - DNA, 22 bp, Homo sapiens
tttggcactgttctaggtgcaa

SEQ ID NO: 7113687 - DNA, 22 bp, Homo sapiens
tttggcacttggcagttgagtt

SEQ ID NO: 7113688 - DNA, 22 bp, Homo sapiens
tttggcacttggcagttgagtt

SEQ ID NO: 7113689 - DNA, 22 bp, Homo sapiens
tttggcagaaataagtggggca

SEQ ID NO: 7113690 - DNA, 19 bp, Homo sapiens
tttggcactctgaagtgtt

SEQ ID NO: 7113691 - DNA, 19 bp, Homo sapiens
tttggcactctgaagtgtt

SEQ ID NO: 7113692 - DNA, 22 bp, Homo sapiens
tttggcactgttctaggtgcaa

SEQ ID NO: 7113693 - DNA, 22 bp, Homo sapiens
tttggcaagaaaatgtgattga

SEQ ID NO: 7113694 - DNA, 22 bp, Homo sapiens
tttggcaacggagaacttactc

SEQ ID NO: 7113695 - DNA, 22 bp, Homo sapiens
tttggcaagtgggaaattagta

SEQ ID NO: 7113696 - DNA, 22 bp, Homo sapiens
tttggcacattctgtcacattc

SEQ ID NO: 7113697 - DNA, 22 bp, Homo sapiens
tttggcaccaaaggagaagatc

SEQ ID NO: 7113698 - DNA, 22 bp, Homo sapiens
tttggcaccaaaggagaagatc

SEQ ID NO: 7113699 - DNA, 22 bp, Homo sapiens
tttggcaccaaaggagaagatc

SEQ ID NO: 7113700 - DNA, 22 bp, Homo sapiens
tttgcagtctggcctgctttgg

SEQ ID NO: 7113701 - DNA, 22 bp, Homo sapiens
tttggaacccagcccatcggaa

SEQ ID NO: 7113702 - DNA, 22 bp, Homo sapiens
tttgcagtgattcttgcagtga

SEQ ID NO: 7113703 - DNA, 22 bp, Homo sapiens
tttggaacaagacaaaacatta

SEQ ID NO: 7113704 - DNA, 22 bp, Homo sapiens
tttggaagacagggcaggaaag

SEQ ID NO: 7113705 - DNA, 22 bp, Homo sapiens
tttggaagatagttcggcagtt

SEQ ID NO: 7113706 - DNA, 22 bp, Homo sapiens
tttggaagggaaagaaagtact

SEQ ID NO: 7113707 - DNA, 22 bp, Homo sapiens
tttggaagggaaagaaagtact

SEQ ID NO: 7113708 - DNA, 22 bp, Homo sapiens
tttggaagggaaccaaaacatg

SEQ ID NO: 7113709 - DNA, 22 bp, Homo sapiens
tttggacaagttactggtttcc

SEQ ID NO: 7113710 - DNA, 22 bp, Homo sapiens
tttggacaagttactggtttcc

SEQ ID NO: 7113711 - DNA, 22 bp, Homo sapiens
tttggacaagttactggtttcc

SEQ ID NO: 7113712 - DNA, 22 bp, Homo sapiens
tttggaaggtgaggcatgaagg

SEQ ID NO: 7113713 - DNA, 22 bp, Homo sapiens
tttggaagtaaatgagtgtttt

SEQ ID NO: 7113714 - DNA, 22 bp, Homo sapiens
tttggacatgttgagtctgata

SEQ ID NO: 7113715 - DNA, 19 bp, Homo sapiens
tttggacagagtgtccagg

SEQ ID NO: 7113716 - DNA, 22 bp, Homo sapiens
tttggactactgggaccttgtg

SEQ ID NO: 7113717 - DNA, 22 bp, Homo sapiens
tttggactatctgtgtggcttt

SEQ ID NO: 7113718 - DNA, 22 bp, Homo sapiens
tttggactcaatggtttgctgc

SEQ ID NO: 7113719 - DNA, 22 bp, Homo sapiens
tttggactgcatgatgatctgg

SEQ ID NO: 7113720 - DNA, 22 bp, Homo sapiens
tttggacttagcctgcagaatt

SEQ ID NO: 7113721 - DNA, 22 bp, Homo sapiens
tttggatatgtttctgtcttct

SEQ ID NO: 7113722 - DNA, 22 bp, Homo sapiens
tttggagagagttaaatatgtt

SEQ ID NO: 7113723 - DNA, 22 bp, Homo sapiens
tttggagagagttaaatatgtt

SEQ ID NO: 7113724 - DNA, 22 bp, Homo sapiens
tttggagaagttgctaaagtgt

SEQ ID NO: 7113725 - DNA, 22 bp, Homo sapiens
tttggagaatgttttggtcaga

SEQ ID NO: 7113726 - DNA, 20 bp, Homo sapiens
tttggagagaaagaagtagt

SEQ ID NO: 7113727 - DNA, 23 bp, Homo sapiens
tttggacttgtgactcttctcct

SEQ ID NO: 7113728 - DNA, 22 bp, Homo sapiens
tttggagaaaagttgagaccat

SEQ ID NO: 7113729 - DNA, 22 bp, Homo sapiens
tttggagaaatggctgatcaaa

SEQ ID NO: 7113730 - DNA, 22 bp, Homo sapiens
tttggagagatgaagttctgtg

SEQ ID NO: 7113731 - DNA, 22 bp, Homo sapiens
tttggagagatgaagttctgtg

SEQ ID NO: 7113732 - DNA, 22 bp, Homo sapiens
tttggagatagggcctagcaat

SEQ ID NO: 7113733 - DNA, 22 bp, Homo sapiens
tttggagagcagctaggccctt

SEQ ID NO: 7113734 - DNA, 22 bp, Homo sapiens
tttggagatggagagagggcat

SEQ ID NO: 7113735 - DNA, 22 bp, Homo sapiens
tttggagatggagagagggcat

SEQ ID NO: 7113736 - DNA, 22 bp, Homo sapiens
tttgcaaataccatgaaacttg

SEQ ID NO: 7113737 - DNA, 22 bp, Homo sapiens
tttgcaaataccatgaaacttg

SEQ ID NO: 7113738 - DNA, 22 bp, Homo sapiens
tttgcaaataccatgaaacttg

SEQ ID NO: 7113739 - DNA, 20 bp, Homo sapiens
tttgatttcacaaggccagt

SEQ ID NO: 7113740 - DNA, 20 bp, Homo sapiens
tttgatttcacaaggccagt

SEQ ID NO: 7113741 - DNA, 22 bp, Homo sapiens
tttgattttcagcaatagtggc

SEQ ID NO: 7113742 - DNA, 22 bp, Homo sapiens
tttgattttcagcaatagtggc

SEQ ID NO: 7113743 - DNA, 22 bp, Homo sapiens
tttgattttcagcaatagtggc

SEQ ID NO: 7113744 - DNA, 22 bp, Homo sapiens
tttctttccatgagcctatgta

SEQ ID NO: 7113745 - DNA, 22 bp, Homo sapiens
tttctttccatgagcctatgta

SEQ ID NO: 7113746 - DNA, 22 bp, Homo sapiens
tttctttccatgagcctatgta

SEQ ID NO: 7113747 - DNA, 22 bp, Homo sapiens
tttctttccatacatattgcta

SEQ ID NO: 7113748 - DNA, 22 bp, Homo sapiens
tttctttccatacatattgcta

SEQ ID NO: 7113749 - DNA, 22 bp, Homo sapiens
tttctttctcgtaaacttagtt

SEQ ID NO: 7113750 - DNA, 18 bp, Homo sapiens
tttctttctgcctggggc

SEQ ID NO: 7113751 - DNA, 22 bp, Homo sapiens
tttctttccagagtgattggca

SEQ ID NO: 7113752 - DNA, 22 bp, Homo sapiens
tttctttccagagtgattggca

SEQ ID NO: 7113753 - DNA, 22 bp, Homo sapiens
tttctttccatacatattgcta

SEQ ID NO: 7113754 - DNA, 22 bp, Homo sapiens
tttctttccatacatattgcta

SEQ ID NO: 7113755 - DNA, 22 bp, Homo sapiens
tttctttccatacatattgcta

SEQ ID NO: 7113756 - DNA, 22 bp, Homo sapiens
tttctttcaattctcctaatgc

SEQ ID NO: 7113757 - DNA, 22 bp, Homo sapiens
tttctttcaattctcctaatgc

SEQ ID NO: 7113758 - DNA, 22 bp, Homo sapiens
tttgcaatttgtgctgcaaatg

SEQ ID NO: 7113759 - DNA, 22 bp, Homo sapiens
tttgcaatagtcctggcctgta

SEQ ID NO: 7113760 - DNA, 22 bp, Homo sapiens
tttgcaatggtagttgttgctc

SEQ ID NO: 7113761 - DNA, 23 bp, Homo sapiens
tttgcaaattggacacaaccaca

SEQ ID NO: 7113762 - DNA, 23 bp, Homo sapiens
tttgcaaattggacacaaccaca

SEQ ID NO: 7113763 - DNA, 22 bp, Homo sapiens
tttgcagtcaaatttgctaaat

SEQ ID NO: 7113764 - DNA, 22 bp, Homo sapiens
tttgcagtagacatcttatttt

SEQ ID NO: 7113765 - DNA, 22 bp, Homo sapiens
tttgcagcctccctggcagaag

SEQ ID NO: 7113766 - DNA, 22 bp, Homo sapiens
tttgcagagtacctgaagagga

SEQ ID NO: 7113767 - DNA, 22 bp, Homo sapiens
tttgcagagtgcagaagcatct

SEQ ID NO: 7113768 - DNA, 22 bp, Homo sapiens
tttgcagatgagaaaactgtgg

SEQ ID NO: 7113769 - DNA, 22 bp, Homo sapiens
tttgcagatgagaaaactgtgg

SEQ ID NO: 7113770 - DNA, 22 bp, Homo sapiens
tttgcagcaattcgttatacag

SEQ ID NO: 7113771 - DNA, 22 bp, Homo sapiens
tttgcacacacaataacaaatg

SEQ ID NO: 7113772 - DNA, 22 bp, Homo sapiens
tttgcacacattcttagaaatg

SEQ ID NO: 7113773 - DNA, 22 bp, Homo sapiens
tttgcacacattcttagaaatg

SEQ ID NO: 7113774 - DNA, 22 bp, Homo sapiens
tttgcacagatgggatacagca

SEQ ID NO: 7113775 - DNA, 22 bp, Homo sapiens
tttgcacagatgggatacagca

SEQ ID NO: 7113776 - DNA, 22 bp, Homo sapiens
tttgcactagcatttgtccatg

SEQ ID NO: 7113777 - DNA, 22 bp, Homo sapiens
tttgcacttaacttatttgaaa

SEQ ID NO: 7113778 - DNA, 22 bp, Homo sapiens
tttgcacttcctaatgtgtttt

SEQ ID NO: 7113779 - DNA, 22 bp, Homo sapiens
tttgcagaagaaaacatgaaca

SEQ ID NO: 7113780 - DNA, 22 bp, Homo sapiens
ttttcctttggaagatgcatat

SEQ ID NO: 7113781 - DNA, 22 bp, Homo sapiens
ttttcctttgattcccagatgt

SEQ ID NO: 7113782 - DNA, 22 bp, Homo sapiens
ttttcctttcatcaggacaaag

SEQ ID NO: 7113783 - DNA, 22 bp, Homo sapiens
ttttcctttcatcaggacaaag

SEQ ID NO: 7113784 - DNA, 22 bp, Homo sapiens
ttttcctttgaaaggtgagggc

SEQ ID NO: 7113785 - DNA, 20 bp, Homo sapiens
ttttccttgttgccgctgct

SEQ ID NO: 7113786 - DNA, 22 bp, Homo sapiens
ttttccttctgatactccattt

SEQ ID NO: 7113787 - DNA, 20 bp, Homo sapiens
ttttccttctgagtatgttg

SEQ ID NO: 7113788 - DNA, 22 bp, Homo sapiens
ttttccttctgatactccattt

SEQ ID NO: 7113789 - DNA, 19 bp, Homo sapiens
ttttccttctcctcttaat

SEQ ID NO: 7113790 - DNA, 22 bp, Homo sapiens
ttttatgagaatgcgccacttg

SEQ ID NO: 7113791 - DNA, 22 bp, Homo sapiens
ttttatgagaatgcgccacttg

SEQ ID NO: 7113792 - DNA, 19 bp, Homo sapiens
ttttccttctcctcttaat

SEQ ID NO: 7113793 - DNA, 20 bp, Homo sapiens
ttttccttctgagtatgttg

SEQ ID NO: 7113794 - DNA, 22 bp, Homo sapiens
ttttatgaagataattttctga

SEQ ID NO: 7113795 - DNA, 22 bp, Homo sapiens
ttttatgaagataattttctga

SEQ ID NO: 7113796 - DNA, 22 bp, Homo sapiens
ttttatgaagataattttctga

SEQ ID NO: 7113797 - DNA, 22 bp, Homo sapiens
ttttatgaagataattttctga

SEQ ID NO: 7113798 - DNA, 22 bp, Homo sapiens
ttttatgaagataattttctga

SEQ ID NO: 7113799 - DNA, 22 bp, Homo sapiens
ttttatcttcattcctatctac

SEQ ID NO: 7113800 - DNA, 22 bp, Homo sapiens
ttttatcttcattcctatctac

SEQ ID NO: 7113801 - DNA, 22 bp, Homo sapiens
ttttatctgcttcattagttga

SEQ ID NO: 7113802 - DNA, 22 bp, Homo sapiens
ttttatctgcttcattagttga

SEQ ID NO: 7113803 - DNA, 22 bp, Homo sapiens
ttttatctgtgacatctggcag

SEQ ID NO: 7113804 - DNA, 22 bp, Homo sapiens
ttttatcattacccagctgaaa

SEQ ID NO: 7113805 - DNA, 22 bp, Homo sapiens
ttttatcattacccagctgaaa

SEQ ID NO: 7113806 - DNA, 22 bp, Homo sapiens
ttttatcattacccagctgaaa

SEQ ID NO: 7113807 - DNA, 22 bp, Homo sapiens
ttttatctacctatgctcattt

SEQ ID NO: 7113808 - DNA, 22 bp, Homo sapiens
ttttatctacctatgctcattt

SEQ ID NO: 7113809 - DNA, 22 bp, Homo sapiens
ttttatctacctatgctcattt

SEQ ID NO: 7113810 - DNA, 22 bp, Homo sapiens
ttttctatctcctagaactgcc

SEQ ID NO: 7113811 - DNA, 22 bp, Homo sapiens
ttttctatctcctagaactgcc

SEQ ID NO: 7113812 - DNA, 22 bp, Homo sapiens
ttttctatctcctagaactgcc

SEQ ID NO: 7113813 - DNA, 22 bp, Homo sapiens
ttttctaatttagttaccctcc

SEQ ID NO: 7113814 - DNA, 22 bp, Homo sapiens
ttttctatctcctagaactgcc

SEQ ID NO: 7113815 - DNA, 22 bp, Homo sapiens
ttttctatctcctagaactgcc

SEQ ID NO: 7113816 - DNA, 22 bp, Homo sapiens
ttttctattaactcattttgca

SEQ ID NO: 7113817 - DNA, 22 bp, Homo sapiens
ttttctattaactcattttgca

SEQ ID NO: 7113818 - DNA, 22 bp, Homo sapiens
ttttctattaactcattttgca

SEQ ID NO: 7113819 - DNA, 22 bp, Homo sapiens
ttttctttaatctggtggggtg

SEQ ID NO: 7113820 - DNA, 22 bp, Homo sapiens
ttttctttaatctggtggggtg

SEQ ID NO: 7113821 - DNA, 22 bp, Homo sapiens
ttttctttaatctggtggggtg

SEQ ID NO: 7113822 - DNA, 22 bp, Homo sapiens
ttttgaaagagtcctgctacag

SEQ ID NO: 7113823 - DNA, 22 bp, Homo sapiens
ttttcgtttatttgacatgtaa

SEQ ID NO: 7113824 - DNA, 22 bp, Homo sapiens
ttttcgtttatttgacatgtaa

SEQ ID NO: 7113825 - DNA, 23 bp, Homo sapiens
ttttcctttggacaggctgtatt

SEQ ID NO: 7113826 - DNA, 23 bp, Homo sapiens
ttttcctttggacaggctgtatt

SEQ ID NO: 7113827 - DNA, 22 bp, Homo sapiens
ttttcctttggaagatgcatat

SEQ ID NO: 7113828 - DNA, 22 bp, Homo sapiens
ttttctaacatctagtaatttg

SEQ ID NO: 7113829 - DNA, 22 bp, Homo sapiens
ttttctaacatctagtaatttg

SEQ ID NO: 7113830 - DNA, 22 bp, Homo sapiens
ttttctaacatctagtaatttg

SEQ ID NO: 7113831 - DNA, 22 bp, Homo sapiens
ttttctaacatctagtaatttg

SEQ ID NO: 7113832 - DNA, 22 bp, Homo sapiens
tttttcatgagactagaagtca

SEQ ID NO: 7113833 - DNA, 22 bp, Homo sapiens
tttttcatgagactagaagtca

SEQ ID NO: 7113834 - DNA, 22 bp, Homo sapiens
tttttcattgcagcctctctcc

SEQ ID NO: 7113835 - DNA, 22 bp, Homo sapiens
tttttcatgagactagaagtca

SEQ ID NO: 7113836 - DNA, 22 bp, Homo sapiens
tttttcatgagactagaagtca

SEQ ID NO: 7113837 - DNA, 22 bp, Homo sapiens
tttttcatgagactagaagtca

SEQ ID NO: 7113838 - DNA, 22 bp, Homo sapiens
ttttggccacatccttttgagt

SEQ ID NO: 7113839 - DNA, 22 bp, Homo sapiens
tttttcatctgattgataactc

SEQ ID NO: 7113840 - DNA, 22 bp, Homo sapiens
ttttggcagattacttaatatg

SEQ ID NO: 7113841 - DNA, 22 bp, Homo sapiens
ttttggcagcaggtatggggca

SEQ ID NO: 7113842 - DNA, 22 bp, Homo sapiens
ttttggcagccacatgcacttg

SEQ ID NO: 7113843 - DNA, 22 bp, Homo sapiens
ttttggcaggatatgcaccagc

SEQ ID NO: 7113844 - DNA, 22 bp, Homo sapiens
ttttggcatcacttgccatcta

SEQ ID NO: 7113845 - DNA, 22 bp, Homo sapiens
ttttggcactttgtctgattct

SEQ ID NO: 7113846 - DNA, 22 bp, Homo sapiens
tttttccagggttagatgttta

SEQ ID NO: 7113847 - DNA, 22 bp, Homo sapiens
tttttccagggttagatgttta

SEQ ID NO: 7113848 - DNA, 22 bp, Homo sapiens
tttttccagggttagatgttta

SEQ ID NO: 7113849 - DNA, 22 bp, Homo sapiens
tttttcccaaaggcaattgcct

SEQ ID NO: 7113850 - DNA, 22 bp, Homo sapiens
tttttcccatatagaaagccaa

SEQ ID NO: 7113851 - DNA, 22 bp, Homo sapiens
tttttcattgcagcctctctcc

SEQ ID NO: 7113852 - DNA, 22 bp, Homo sapiens
tttttcattgcagcctctctcc

SEQ ID NO: 7113853 - DNA, 22 bp, Homo sapiens
tttttcattgcagcctctctcc

SEQ ID NO: 7113854 - DNA, 22 bp, Homo sapiens
tttttccacataccctaggcca

SEQ ID NO: 7113855 - DNA, 22 bp, Homo sapiens
tttttccaccgtacttcctgag

SEQ ID NO: 7113856 - DNA, 22 bp, Homo sapiens
tttttccaccgtacttcctgag

SEQ ID NO: 7113857 - DNA, 22 bp, Homo sapiens
tttttcctagcgatttgtcagc

SEQ ID NO: 7113858 - DNA, 22 bp, Homo sapiens
tttttcctagtgctttctggta

SEQ ID NO: 7113859 - DNA, 20 bp, Homo sapiens
tttttccttctctacaggca

SEQ ID NO: 7113860 - DNA, 22 bp, Homo sapiens
tttttccttaggggttactcac

SEQ ID NO: 7113861 - DNA, 22 bp, Homo sapiens
ttttgcagccacatctgacctg

SEQ ID NO: 7113862 - DNA, 22 bp, Homo sapiens
ttttgcatctggtgaagaccag

SEQ ID NO: 7113863 - DNA, 20 bp, Homo sapiens
ttttgcagagaaggcgactg

SEQ ID NO: 7113864 - DNA, 22 bp, Homo sapiens
ttttgcatctggtgaagaccag

SEQ ID NO: 7113865 - DNA, 22 bp, Homo sapiens
ttttgcagaatgggaaggtagt

SEQ ID NO: 7113866 - DNA, 22 bp, Homo sapiens
ttttgcagaatgggaaggtagt

SEQ ID NO: 7113867 - DNA, 22 bp, Homo sapiens
ttttgcagaatgggaaggtagt

SEQ ID NO: 7113868 - DNA, 22 bp, Homo sapiens
ttttgatatcatgatgaacaga

SEQ ID NO: 7113869 - DNA, 22 bp, Homo sapiens
ttttgatatcatgatgaacaga

SEQ ID NO: 7113870 - DNA, 23 bp, Homo sapiens
ttttgcaataagtcactggaata

SEQ ID NO: 7113871 - DNA, 22 bp, Homo sapiens
ttttggcaaaggcattctcttt

SEQ ID NO: 7113872 - DNA, 22 bp, Homo sapiens
ttttggcaaagagatagcatga

SEQ ID NO: 7113873 - DNA, 21 bp, Homo sapiens
ttttggcaaggtgcatgtttc

SEQ ID NO: 7113874 - DNA, 22 bp, Homo sapiens
ttttggcaagctgggagatatt

SEQ ID NO: 7113875 - DNA, 22 bp, Homo sapiens
ttttggcactgcgtctacatgg

SEQ ID NO: 7113876 - DNA, 23 bp, Homo sapiens
ttttgacaggaggaaggtgttga

SEQ ID NO: 7113877 - DNA, 22 bp, Homo sapiens
ttttgagatggagtcttgctct

SEQ ID NO: 7113878 - DNA, 22 bp, Homo sapiens
ttttgagatggagtcttgctct

SEQ ID NO: 7113879 - DNA, 22 bp, Homo sapiens
ttttgagatggtgtctcgctcc

SEQ ID NO: 7113880 - DNA, 22 bp, Homo sapiens
ttttgatatcatgatgaacaga

SEQ ID NO: 7113881 - DNA, 22 bp, Homo sapiens
ttttgaagaagatgggaattta

SEQ ID NO: 7113882 - DNA, 22 bp, Homo sapiens
ttttgaagaagatgggaattta

SEQ ID NO: 7113883 - DNA, 19 bp, Homo sapiens
ttttgaagtatgagacagg

SEQ ID NO: 7113884 - DNA, 19 bp, Homo sapiens
ttttgaagtatgagacagg

SEQ ID NO: 7113885 - DNA, 22 bp, Homo sapiens
ttttgaataattcagaaacagc

SEQ ID NO: 7113886 - DNA, 22 bp, Homo sapiens
ttttgaataattcagaaacagc

SEQ ID NO: 7113887 - DNA, 22 bp, Homo sapiens
ttttgaaagccaggtttgtatg

SEQ ID NO: 7113888 - DNA, 22 bp, Homo sapiens
ttttgaaagccaggtttgtatg

SEQ ID NO: 7113889 - DNA, 22 bp, Homo sapiens
ttttgaaagccaggtttgtatg

SEQ ID NO: 7113890 - DNA, 22 bp, Homo sapiens
ttttttgtcttgaagaaatggt

SEQ ID NO: 7113891 - DNA, 22 bp, Homo sapiens
ttttttgtcttgaagaaatggt

SEQ ID NO: 7113892 - DNA, 22 bp, Homo sapiens
ttttttgtcttgaagaaatggt

SEQ ID NO: 7113893 - DNA, 22 bp, Homo sapiens
ttttttgtcttgaagaaatggt

SEQ ID NO: 7113894 - DNA, 22 bp, Homo sapiens
ttttttgtcttgaagaaatggt

SEQ ID NO: 7113895 - DNA, 22 bp, Homo sapiens
ttttttgtcttgaagaaatggt

SEQ ID NO: 7113896 - DNA, 22 bp, Homo sapiens
tttttgtagtcattagaagagg

SEQ ID NO: 7113897 - DNA, 22 bp, Homo sapiens
ttttttgtagcaagcgcagata

SEQ ID NO: 7113898 - DNA, 22 bp, Homo sapiens
ttttttgtcccagagagcctgg

SEQ ID NO: 7113899 - DNA, 22 bp, Homo sapiens
ttttttgtcccagagagcctgg

SEQ ID NO: 7113900 - DNA, 22 bp, Homo sapiens
ttttttgtcccagagagcctgg

SEQ ID NO: 7113901 - DNA, 22 bp, Homo sapiens
tttttgctgataagcagaattc

SEQ ID NO: 7113902 - DNA, 22 bp, Homo sapiens
tttttgcaccaacctaatagaa

SEQ ID NO: 7113903 - DNA, 22 bp, Homo sapiens
tttttgcaccaacctaatagaa

SEQ ID NO: 7113904 - DNA, 22 bp, Homo sapiens
tttttgctaatccccagccact

SEQ ID NO: 7113905 - DNA, 22 bp, Homo sapiens
tttttgctccacaactttgaag

SEQ ID NO: 7113906 - DNA, 22 bp, Homo sapiens
tttttgctccacaactttgaag

SEQ ID NO: 7113907 - DNA, 22 bp, Homo sapiens
tttttgcaccaacctaatagaa

SEQ ID NO: 7113908 - DNA, 22 bp, Homo sapiens
tttttgaaggctgatgtgatta

SEQ ID NO: 7113909 - DNA, 22 bp, Homo sapiens
tttttgaaggctgatgtgatta

SEQ ID NO: 7113910 - DNA, 22 bp, Homo sapiens
tttttgaaggctgatgtgatta

SEQ ID NO: 7113911 - DNA, 22 bp, Homo sapiens
tttttcttgtgctggatctaat

SEQ ID NO: 7113912 - DNA, 22 bp, Homo sapiens
tttttctactggtgttggtgta

SEQ ID NO: 7113913 - DNA, 22 bp, Homo sapiens
tttttctactggtgttggtgta

SEQ ID NO: 7113914 - DNA, 22 bp, Homo sapiens
tttttctagaccttaaaggcca

SEQ ID NO: 7113915 - DNA, 22 bp, Homo sapiens
tttttccttggatgtgtctctc

SEQ ID NO: 7113916 - DNA, 22 bp, Homo sapiens
tttttctaatggcttaggatgt

SEQ ID NO: 7113917 - DNA, 22 bp, Homo sapiens
tttttctaatggcttaggatgt

SEQ ID NO: 7113918 - DNA, 22 bp, Homo sapiens
tttttctactgcccacattgta

SEQ ID NO: 7113919 - DNA, 22 bp, Homo sapiens
tttttctactgcccacattgta

SEQ ID NO: 7113920 - DNA, 23 bp, Homo sapiens
ttttttgtcttgctaggctgccc

SEQ ID NO: 7113921 - DNA, 23 bp, Homo sapiens
ttttttgtcttgctaggctgccc

SEQ ID NO: 7113922 - DNA, 23 bp, Homo sapiens
ttttttgtcttgctaggctgccc

SEQ ID NO: 7113923 - DNA, 20 bp, Homo sapiens
ttgcaaagtgaatagcaatt

SEQ ID NO: 7113924 - DNA, 22 bp, Homo sapiens
ttgcaaataaacaagtatacat

SEQ ID NO: 7113925 - DNA, 22 bp, Homo sapiens
ttgcaaataaacaagtatacat

SEQ ID NO: 7113926 - DNA, 22 bp, Homo sapiens
ttgcaaagagataatcctaggc

SEQ ID NO: 7113927 - DNA, 22 bp, Homo sapiens
ttgcaaagagataatcctaggc

SEQ ID NO: 7113928 - DNA, 23 bp, Homo sapiens
ttgcaaagggcaaaggtcatgtg

SEQ ID NO: 7113929 - DNA, 23 bp, Homo sapiens
ttgcaaagggcaaaggtcatgtg

SEQ ID NO: 7113930 - DNA, 22 bp, Homo sapiens
ttgcaaaggggaataaagcaat

SEQ ID NO: 7113931 - DNA, 22 bp, Homo sapiens
ttgattttaaaatagtgacact

SEQ ID NO: 7113932 - DNA, 22 bp, Homo sapiens
ttgattttaaaatagtgacact

SEQ ID NO: 7113933 - DNA, 21 bp, Homo sapiens
ttgattttaggaagtttgtca

SEQ ID NO: 7113934 - DNA, 21 bp, Homo sapiens
ttgattttaggaagtttgtca

SEQ ID NO: 7113935 - DNA, 22 bp, Homo sapiens
ttgattttaaaatagtgacact

SEQ ID NO: 7113936 - DNA, 21 bp, Homo sapiens
ttgattttaggaagtttgtca

SEQ ID NO: 7113937 - DNA, 21 bp, Homo sapiens
ttgattttaggaagtttgtca

SEQ ID NO: 7113938 - DNA, 21 bp, Homo sapiens
ttgattttaggaagtttgtca

SEQ ID NO: 7113939 - DNA, 21 bp, Homo sapiens
ttgattttaggaagtttgtca

SEQ ID NO: 7113940 - DNA, 22 bp, Homo sapiens
ttgatttttccagcttctagag

SEQ ID NO: 7113941 - DNA, 22 bp, Homo sapiens
ttgattttgcctgatctgagag

SEQ ID NO: 7113942 - DNA, 22 bp, Homo sapiens
ttgattttgcctgatctgagag

SEQ ID NO: 7113943 - DNA, 22 bp, Homo sapiens
ttgattttcaattcattgacaa

SEQ ID NO: 7113944 - DNA, 22 bp, Homo sapiens
ttgatttatagaatgttcaagc

SEQ ID NO: 7113945 - DNA, 23 bp, Homo sapiens
ttgatttagctgggattgcatgc

SEQ ID NO: 7113946 - DNA, 23 bp, Homo sapiens
ttgatttagctgggattgcatgc

SEQ ID NO: 7113947 - DNA, 22 bp, Homo sapiens
ttgatttcttactcttccaagg

SEQ ID NO: 7113948 - DNA, 22 bp, Homo sapiens
ttgatttcttactcttccaagg

SEQ ID NO: 7113949 - DNA, 22 bp, Homo sapiens
ttgatttgattgtaatggctct

SEQ ID NO: 7113950 - DNA, 22 bp, Homo sapiens
ttgattttaaaatagtgacact

SEQ ID NO: 7113951 - DNA, 22 bp, Homo sapiens
ttgcaaatatgttctcctattc

SEQ ID NO: 7113952 - DNA, 22 bp, Homo sapiens
ttgcaaatatgttctcctattc

SEQ ID NO: 7113953 - DNA, 22 bp, Homo sapiens
ttgcaaatattcccctaggtct

SEQ ID NO: 7113954 - DNA, 22 bp, Homo sapiens
ttgcaaatattcccctaggtct

SEQ ID NO: 7113955 - DNA, 20 bp, Homo sapiens
ttgcaaatatcgtgggtcag

SEQ ID NO: 7113956 - DNA, 20 bp, Homo sapiens
ttgcaaatatcgtgggtcag

SEQ ID NO: 7113957 - DNA, 20 bp, Homo sapiens
ttgcaaatatctattgattg

SEQ ID NO: 7113958 - DNA, 20 bp, Homo sapiens
ttgcaaatatctattgattg

SEQ ID NO: 7113959 - DNA, 22 bp, Homo sapiens
ttgcaaataatagcctgaaact

SEQ ID NO: 7113960 - DNA, 22 bp, Homo sapiens
ttgcaaataatagcctgaaact

SEQ ID NO: 7113961 - DNA, 22 bp, Homo sapiens
ttgcaaataaacaagtatacat

SEQ ID NO: 7113962 - DNA, 22 bp, Homo sapiens
ttgcaaatattgtttacctttc

SEQ ID NO: 7113963 - DNA, 22 bp, Homo sapiens
ttgcaaatattgtttacctttc

SEQ ID NO: 7113964 - DNA, 22 bp, Homo sapiens
ttgcaaatcacaagagcagagc

SEQ ID NO: 7113965 - DNA, 22 bp, Homo sapiens
ttgcaaatcacaagagcagagc

SEQ ID NO: 7113966 - DNA, 22 bp, Homo sapiens
ttgcaaatcagaagtatagatt

SEQ ID NO: 7113967 - DNA, 22 bp, Homo sapiens
ttgcaaatcagaagtatagatt

SEQ ID NO: 7113968 - DNA, 22 bp, Homo sapiens
ttgcaaatctcttgtgtttggt

SEQ ID NO: 7113969 - DNA, 22 bp, Homo sapiens
ttgcaaatctcttgtgtttggt

SEQ ID NO: 7113970 - DNA, 22 bp, Homo sapiens
ttgcaaatctttgccagaaggc

SEQ ID NO: 7113971 - DNA, 22 bp, Homo sapiens
ttgcaaatctttgccagaaggc

SEQ ID NO: 7113972 - DNA, 22 bp, Homo sapiens
ttgcaaatctttgccagaaggc

SEQ ID NO: 7113973 - DNA, 22 bp, Homo sapiens
ttgcaaatgaccattgccacat

SEQ ID NO: 7113974 - DNA, 22 bp, Homo sapiens
ttgcaaatgtgagtttagactg

SEQ ID NO: 7113975 - DNA, 22 bp, Homo sapiens
ttgcaaatggtaccaagggtct

SEQ ID NO: 7113976 - DNA, 22 bp, Homo sapiens
ttgcaaatgtgaataattacac

SEQ ID NO: 7113977 - DNA, 22 bp, Homo sapiens
ttgcaaatgtgaataattacac

SEQ ID NO: 7113978 - DNA, 22 bp, Homo sapiens
ttgcaaatgaccattgccacat

SEQ ID NO: 7113979 - DNA, 22 bp, Homo sapiens
ttgcaaatggaggcctggcagc

SEQ ID NO: 7113980 - DNA, 22 bp, Homo sapiens
ttgcaaatggaggcctggcagc

SEQ ID NO: 7113981 - DNA, 22 bp, Homo sapiens
ttgcaaatggtaccaagggtct

SEQ ID NO: 7113982 - DNA, 22 bp, Homo sapiens
ttgcaaatgggcaaagcagatc

SEQ ID NO: 7113983 - DNA, 22 bp, Homo sapiens
ttgcaaatgggcaaagcagatc

SEQ ID NO: 7113984 - DNA, 22 bp, Homo sapiens
ttgcaaatgttatactgccagt

SEQ ID NO: 7113985 - DNA, 22 bp, Homo sapiens
ttgcaaatgttatactgccagt

SEQ ID NO: 7113986 - DNA, 22 bp, Homo sapiens
ttgcaaatgtttcataacagta

SEQ ID NO: 7113987 - DNA, 22 bp, Homo sapiens
ttgcaaatgtttcataacagta

SEQ ID NO: 7113988 - DNA, 22 bp, Homo sapiens
ttgcaaatgtggttagggcttt

SEQ ID NO: 7113989 - DNA, 22 bp, Homo sapiens
ttgcaaatgtggttagggcttt

SEQ ID NO: 7113990 - DNA, 22 bp, Homo sapiens
ttgcaaatgtgagtttagactg

SEQ ID NO: 7113991 - DNA, 22 bp, Homo sapiens
ttgcaaattatataagggatgc

SEQ ID NO: 7113992 - DNA, 22 bp, Homo sapiens
ttgcaaattaaagaggatagca

SEQ ID NO: 7113993 - DNA, 22 bp, Homo sapiens
ttgcaaattaaagaggatagca

SEQ ID NO: 7113994 - DNA, 22 bp, Homo sapiens
ttgcaaatgtttcataacagta

SEQ ID NO: 7113995 - DNA, 22 bp, Homo sapiens
ttgcaaattaaagaggatagca

SEQ ID NO: 7113996 - DNA, 22 bp, Homo sapiens
ttgattcagtaaagctaaattt

SEQ ID NO: 7113997 - DNA, 22 bp, Homo sapiens
ttgattctacttaaaacatatg

SEQ ID NO: 7113998 - DNA, 22 bp, Homo sapiens
ttgattctgggctcatttcttt

SEQ ID NO: 7113999 - DNA, 22 bp, Homo sapiens
ttgattctgatcctttgctagc

SEQ ID NO: 7114000 - DNA, 22 bp, Homo sapiens
ttgattctgatcctttgctagc

SEQ ID NO: 7114001 - DNA, 22 bp, Homo sapiens
ttgattctgatcctttgctagc

SEQ ID NO: 7114002 - DNA, 22 bp, Homo sapiens
ttgattctgatcctgtctggag

SEQ ID NO: 7114003 - DNA, 22 bp, Homo sapiens
ttgattctatgttgttgtctca

SEQ ID NO: 7114004 - DNA, 22 bp, Homo sapiens
ttgattcaaccacttaataatc

SEQ ID NO: 7114005 - DNA, 22 bp, Homo sapiens
ttgattcaaaggggacaagtgg

SEQ ID NO: 7114006 - DNA, 22 bp, Homo sapiens
ttgattactatgtgttgaaagc

SEQ ID NO: 7114007 - DNA, 22 bp, Homo sapiens
ttgattaaaatgagacatcatt

SEQ ID NO: 7114008 - DNA, 22 bp, Homo sapiens
ttgatgtttccccttggacatt

SEQ ID NO: 7114009 - DNA, 22 bp, Homo sapiens
ttgatgttcataaatgatacag

SEQ ID NO: 7114010 - DNA, 22 bp, Homo sapiens
ttgatgtacagaattgttcaca

SEQ ID NO: 7114011 - DNA, 22 bp, Homo sapiens
ttgatgaacacagataatcagt

SEQ ID NO: 7114012 - DNA, 22 bp, Homo sapiens
ttgatgaaggtagatttgaaat

SEQ ID NO: 7114013 - DNA, 22 bp, Homo sapiens
ttgatgaattgctagattgcta

SEQ ID NO: 7114014 - DNA, 22 bp, Homo sapiens
ttgatcttggactttccagcct

SEQ ID NO: 7114015 - DNA, 22 bp, Homo sapiens
ttgatcttggactttccagcct

SEQ ID NO: 7114016 - DNA, 22 bp, Homo sapiens
ttgatctttataatagttttga

SEQ ID NO: 7114017 - DNA, 22 bp, Homo sapiens
ttgatctttataatagttttga

SEQ ID NO: 7114018 - DNA, 22 bp, Homo sapiens
ttgatctcattgttctcctcag

SEQ ID NO: 7114019 - DNA, 22 bp, Homo sapiens
ttgatctcttgtgtatggtaga

SEQ ID NO: 7114020 - DNA, 22 bp, Homo sapiens
ttgatctgcctcattcttgttc

SEQ ID NO: 7114021 - DNA, 22 bp, Homo sapiens
ttgatcttacagtgttcttcca

SEQ ID NO: 7114022 - DNA, 22 bp, Homo sapiens
ttgatcttcatcgaaatattgt

SEQ ID NO: 7114023 - DNA, 22 bp, Homo sapiens
ttgatcttacagtgttcttcca

SEQ ID NO: 7114024 - DNA, 22 bp, Homo sapiens
ttgatcttcatcgaaatattgt

SEQ ID NO: 7114025 - DNA, 22 bp, Homo sapiens
ttgatcttcatttgttctgtat

SEQ ID NO: 7114026 - DNA, 22 bp, Homo sapiens
ttgatgtaaagtgattcatggg

SEQ ID NO: 7114027 - DNA, 22 bp, Homo sapiens
ttgatgtaaagatagtttctgt

SEQ ID NO: 7114028 - DNA, 21 bp, Homo sapiens
ttgatggtgggtgatgctctg

SEQ ID NO: 7114029 - DNA, 22 bp, Homo sapiens
ttgatgagaccattgccgcgtc

SEQ ID NO: 7114030 - DNA, 22 bp, Homo sapiens
ttgatgagttatccatttgact

SEQ ID NO: 7114031 - DNA, 22 bp, Homo sapiens
ttgatgatgcacatttataatt

SEQ ID NO: 7114032 - DNA, 20 bp, Homo sapiens
ttgaggcatgtctagaagta

SEQ ID NO: 7114033 - DNA, 22 bp, Homo sapiens
ttgaggcagggcatggtggccc

SEQ ID NO: 7114034 - DNA, 22 bp, Homo sapiens
ttgaggccaaaaagtcctatga

SEQ ID NO: 7114035 - DNA, 22 bp, Homo sapiens
ttgaggccccatggatgagaac

SEQ ID NO: 7114036 - DNA, 22 bp, Homo sapiens
ttgagtctgtgccctatgctgt

SEQ ID NO: 7114037 - DNA, 22 bp, Homo sapiens
ttgagtgagaattacatcagct

SEQ ID NO: 7114038 - DNA, 22 bp, Homo sapiens
ttgagtggttcctcagttgact

SEQ ID NO: 7114039 - DNA, 22 bp, Homo sapiens
ttgagtgtaaggaatgtggggc

SEQ ID NO: 7114040 - DNA, 22 bp, Homo sapiens
ttgagtgtaaggaatgtggggc

SEQ ID NO: 7114041 - DNA, 22 bp, Homo sapiens
ttgatcaagtgggaaatagtaa

SEQ ID NO: 7114042 - DNA, 22 bp, Homo sapiens
ttgatcaagtgggaaatagtaa

SEQ ID NO: 7114043 - DNA, 22 bp, Homo sapiens
ttgatccctggaaattgaaatg

SEQ ID NO: 7114044 - DNA, 22 bp, Homo sapiens
ttgatctctgttgctgtctttg

SEQ ID NO: 7114045 - DNA, 20 bp, Homo sapiens
ttgagcagcagtgctgtgtc

SEQ ID NO: 7114046 - DNA, 22 bp, Homo sapiens
ttgagcacttattggtgttagg

SEQ ID NO: 7114047 - DNA, 22 bp, Homo sapiens
ttgagcacttgagcagttgatg

SEQ ID NO: 7114048 - DNA, 22 bp, Homo sapiens
ttgagcacattccctttcatgg

SEQ ID NO: 7114049 - DNA, 22 bp, Homo sapiens
ttgagcacattccctttcatgg

SEQ ID NO: 7114050 - DNA, 22 bp, Homo sapiens
ttgagcacttattggtgttagg

SEQ ID NO: 7114051 - DNA, 22 bp, Homo sapiens
ttgagcaattaggaaataaaga

SEQ ID NO: 7114052 - DNA, 22 bp, Homo sapiens
ttgagcaattaggaaataaaga

SEQ ID NO: 7114053 - DNA, 22 bp, Homo sapiens
ttgagcaatgtcactgaggctt

SEQ ID NO: 7114054 - DNA, 22 bp, Homo sapiens
ttgagcaattaggaaataaaga

SEQ ID NO: 7114055 - DNA, 22 bp, Homo sapiens
ttgagcacaactcttggagagc

SEQ ID NO: 7114056 - DNA, 22 bp, Homo sapiens
ttgagcacaggtgaacagcatc

SEQ ID NO: 7114057 - DNA, 22 bp, Homo sapiens
ttgagcacaggtgaacagcatc

SEQ ID NO: 7114058 - DNA, 22 bp, Homo sapiens
ttgagcaggaactagaagatag

SEQ ID NO: 7114059 - DNA, 19 bp, Homo sapiens
ttgagcagtgcttagcacc

SEQ ID NO: 7114060 - DNA, 22 bp, Homo sapiens
ttgagcatatgcatttccaatt

SEQ ID NO: 7114061 - DNA, 22 bp, Homo sapiens
ttgagcatatgcatttccaatt

SEQ ID NO: 7114062 - DNA, 22 bp, Homo sapiens
ttgagcatcaattaagtgagtt

SEQ ID NO: 7114063 - DNA, 22 bp, Homo sapiens
ttgagcatctgaggattttcct

SEQ ID NO: 7114064 - DNA, 22 bp, Homo sapiens
ttgagcatcttatagaaagagc

SEQ ID NO: 7114065 - DNA, 22 bp, Homo sapiens
ttgagcaaaggagtaaaatgca

SEQ ID NO: 7114066 - DNA, 22 bp, Homo sapiens
ttgagcaaagcagccattcatt

SEQ ID NO: 7114067 - DNA, 22 bp, Homo sapiens
ttgagcaaaggagtaaaatgca

SEQ ID NO: 7114068 - DNA, 22 bp, Homo sapiens
ttgagcaaaggagtaaaatgca

SEQ ID NO: 7114069 - DNA, 22 bp, Homo sapiens
ttgagcaaatcagaagtttaga

SEQ ID NO: 7114070 - DNA, 22 bp, Homo sapiens
ttgagcaaatcagattgtaatt

SEQ ID NO: 7114071 - DNA, 22 bp, Homo sapiens
ttgagcaaatcagaagtttaga

SEQ ID NO: 7114072 - DNA, 22 bp, Homo sapiens
ttgagcaaatcagattgtaatt

SEQ ID NO: 7114073 - DNA, 22 bp, Homo sapiens
ttgagcaagagtaggaactgaa

SEQ ID NO: 7114074 - DNA, 22 bp, Homo sapiens
ttgagcaagagtaggaactgaa

SEQ ID NO: 7114075 - DNA, 22 bp, Homo sapiens
ttgagcaagagtaggaactgaa

SEQ ID NO: 7114076 - DNA, 22 bp, Homo sapiens
ttgagcaagcctgcggcgggaa

SEQ ID NO: 7114077 - DNA, 22 bp, Homo sapiens
ttgagcaagtgtacgagcaggc

SEQ ID NO: 7114078 - DNA, 20 bp, Homo sapiens
ttgagcaatcagtaaaggat

SEQ ID NO: 7114079 - DNA, 20 bp, Homo sapiens
ttgagcaatcagtaaaggat

SEQ ID NO: 7114080 - DNA, 20 bp, Homo sapiens
ttgagcaatcagtaaaggat

SEQ ID NO: 7114081 - DNA, 22 bp, Homo sapiens
ttgagcaatgctgcaaagagat

SEQ ID NO: 7114082 - DNA, 22 bp, Homo sapiens
ttgagcaatgctgcaaagagat

SEQ ID NO: 7114083 - DNA, 22 bp, Homo sapiens
ttgagcaatgctgcaaagagat

SEQ ID NO: 7114084 - DNA, 22 bp, Homo sapiens
ttgagcaatgtcactgaggctt

SEQ ID NO: 7114085 - DNA, 22 bp, Homo sapiens
ttgagcccaggaggcctgggtg

SEQ ID NO: 7114086 - DNA, 22 bp, Homo sapiens
ttgagcccaggaggcctgggtg

SEQ ID NO: 7114087 - DNA, 22 bp, Homo sapiens
ttgagcatcttatagaaagagc

SEQ ID NO: 7114088 - DNA, 22 bp, Homo sapiens
ttgagcatgtaactacacaggg

SEQ ID NO: 7114089 - DNA, 21 bp, Homo sapiens
ttgagcatgtaccctttgcct

SEQ ID NO: 7114090 - DNA, 21 bp, Homo sapiens
ttgagcatgtaccctttgcct

SEQ ID NO: 7114091 - DNA, 21 bp, Homo sapiens
ttgagcatgtactttgtgctt

SEQ ID NO: 7114092 - DNA, 22 bp, Homo sapiens
ttgagcatgtaactacacaggg

SEQ ID NO: 7114093 - DNA, 23 bp, Homo sapiens
ttgagcatttgtggatactgaaa

SEQ ID NO: 7114094 - DNA, 23 bp, Homo sapiens
ttgagcatttgtggatactgaaa

SEQ ID NO: 7114095 - DNA, 22 bp, Homo sapiens
ttgagcatttgttttgaaagag

SEQ ID NO: 7114096 - DNA, 22 bp, Homo sapiens
ttgagcccaggaggcctgggtg

SEQ ID NO: 7114097 - DNA, 22 bp, Homo sapiens
ttgagcccaggaggcctgggtg

SEQ ID NO: 7114098 - DNA, 22 bp, Homo sapiens
ttgagccctacctcagactttc

SEQ ID NO: 7114099 - DNA, 23 bp, Homo sapiens
ttgagctcagtagctctgctggt

SEQ ID NO: 7114100 - DNA, 22 bp, Homo sapiens
ttgagctcagtgactcgacttt

SEQ ID NO: 7114101 - DNA, 22 bp, Homo sapiens
ttgaggcacacacaggttgcat

SEQ ID NO: 7114102 - DNA, 22 bp, Homo sapiens
ttgaggagtgtttagggtgagg

SEQ ID NO: 7114103 - DNA, 22 bp, Homo sapiens
ttgaattataagtgtgtctact

SEQ ID NO: 7114104 - DNA, 22 bp, Homo sapiens
ttgaattagactttgctacagg

SEQ ID NO: 7114105 - DNA, 22 bp, Homo sapiens
ttgaatggcttctaggttctcc

SEQ ID NO: 7114106 - DNA, 22 bp, Homo sapiens
ttgaatgatcctatctagcaca

SEQ ID NO: 7114107 - DNA, 22 bp, Homo sapiens
ttgaatgcagtcatgaaaagtt

SEQ ID NO: 7114108 - DNA, 22 bp, Homo sapiens
ttgaatgcatctttgagctcct

SEQ ID NO: 7114109 - DNA, 22 bp, Homo sapiens
ttgaatgcatggttcactctgt

SEQ ID NO: 7114110 - DNA, 17 bp, Homo sapiens
ttgaatgcattacttgg

SEQ ID NO: 7114111 - DNA, 17 bp, Homo sapiens
ttgaatgcattacttgg

SEQ ID NO: 7114112 - DNA, 22 bp, Homo sapiens
ttgaatgaggaagagcactggc

SEQ ID NO: 7114113 - DNA, 22 bp, Homo sapiens
ttgaatgagtgttttactcatg

SEQ ID NO: 7114114 - DNA, 22 bp, Homo sapiens
ttgaatgagtgttttactcatg

SEQ ID NO: 7114115 - DNA, 22 bp, Homo sapiens
ttgaatgagaagttattgccat

SEQ ID NO: 7114116 - DNA, 22 bp, Homo sapiens
ttgaatgaatggtccatataga

SEQ ID NO: 7114117 - DNA, 20 bp, Homo sapiens
ttgaatgaatgtctggctca

SEQ ID NO: 7114118 - DNA, 22 bp, Homo sapiens
ttgaagctgccgtttttctcca

SEQ ID NO: 7114119 - DNA, 22 bp, Homo sapiens
ttgaagcaaattctgtgcagta

SEQ ID NO: 7114120 - DNA, 22 bp, Homo sapiens
ttgaagcaaattctgtgcagta

SEQ ID NO: 7114121 - DNA, 22 bp, Homo sapiens
ttgaagcaaggcgaatcttgtg

SEQ ID NO: 7114122 - DNA, 21 bp, Homo sapiens
ttgaagcaagggtggctctga

SEQ ID NO: 7114123 - DNA, 22 bp, Homo sapiens
ttgaagcacaatgtcttttatc

SEQ ID NO: 7114124 - DNA, 22 bp, Homo sapiens
ttgaagcagagaaatacttgaa

SEQ ID NO: 7114125 - DNA, 22 bp, Homo sapiens
ttgaagcagagaaatacttgaa

SEQ ID NO: 7114126 - DNA, 22 bp, Homo sapiens
ttgaagcagctcaggaggctta

SEQ ID NO: 7114127 - DNA, 22 bp, Homo sapiens
ttgaagcaggaaaatttctatt

SEQ ID NO: 7114128 - DNA, 22 bp, Homo sapiens
ttgaagcatggtacttgttcaa

SEQ ID NO: 7114129 - DNA, 22 bp, Homo sapiens
ttgaagcatggtacttgttcaa

SEQ ID NO: 7114130 - DNA, 22 bp, Homo sapiens
ttgaagcattgtggcttgtatt

SEQ ID NO: 7114131 - DNA, 22 bp, Homo sapiens
ttgaagcatttctttgagcttc

SEQ ID NO: 7114132 - DNA, 22 bp, Homo sapiens
ttgaagcatttctttgagcttc

SEQ ID NO: 7114133 - DNA, 22 bp, Homo sapiens
ttgaagcatttgctatagcatt

SEQ ID NO: 7114134 - DNA, 22 bp, Homo sapiens
ttgaagatggtagcaatttcct

SEQ ID NO: 7114135 - DNA, 22 bp, Homo sapiens
ttgaagatctttgcattgcagg

SEQ ID NO: 7114136 - DNA, 22 bp, Homo sapiens
ttgaagatggatcgccactctc

SEQ ID NO: 7114137 - DNA, 22 bp, Homo sapiens
ttgaagatggtagcaatttcct

SEQ ID NO: 7114138 - DNA, 22 bp, Homo sapiens
ttgaagagtctttctttccccc

SEQ ID NO: 7114139 - DNA, 22 bp, Homo sapiens
ttgaagagtgcattagcatatt

SEQ ID NO: 7114140 - DNA, 22 bp, Homo sapiens
ttgaagagtgccttccagacat

SEQ ID NO: 7114141 - DNA, 22 bp, Homo sapiens
ttgaagagtgcattagcatatt

SEQ ID NO: 7114142 - DNA, 22 bp, Homo sapiens
ttgaagagtgtccttgtaaaaa

SEQ ID NO: 7114143 - DNA, 22 bp, Homo sapiens
ttgaagagtgtccttgtaaaaa

SEQ ID NO: 7114144 - DNA, 22 bp, Homo sapiens
ttgaagagtttgatagagttga

SEQ ID NO: 7114145 - DNA, 22 bp, Homo sapiens
ttgaagagttttatgccaacct

SEQ ID NO: 7114146 - DNA, 22 bp, Homo sapiens
ttgaagagtaaagtgttttctc

SEQ ID NO: 7114147 - DNA, 22 bp, Homo sapiens
ttgaagaggactttgcagctgt

SEQ ID NO: 7114148 - DNA, 20 bp, Homo sapiens
ttgaagaggatatatcgctc

SEQ ID NO: 7114149 - DNA, 22 bp, Homo sapiens
ttgaagagtagaaaatgcaaat

SEQ ID NO: 7114150 - DNA, 20 bp, Homo sapiens
ttgaagagtcaggtagggcc

SEQ ID NO: 7114151 - DNA, 22 bp, Homo sapiens
ttgaagagtcgcttaacctgtg

SEQ ID NO: 7114152 - DNA, 22 bp, Homo sapiens
ttgaagagtctagattggttat

SEQ ID NO: 7114153 - DNA, 22 bp, Homo sapiens
ttgaagagaatcagaaggttga

SEQ ID NO: 7114154 - DNA, 22 bp, Homo sapiens
ttgaagagacaatttggaaagc

SEQ ID NO: 7114155 - DNA, 22 bp, Homo sapiens
ttgaagagacaatttggaaagc

SEQ ID NO: 7114156 - DNA, 22 bp, Homo sapiens
ttgaagagacgatttttccacc

SEQ ID NO: 7114157 - DNA, 22 bp, Homo sapiens
ttgaagagcaccagcattttga

SEQ ID NO: 7114158 - DNA, 22 bp, Homo sapiens
ttgaagagctgcttgataccct

SEQ ID NO: 7114159 - DNA, 22 bp, Homo sapiens
ttctttccttgcctcagtgaag

SEQ ID NO: 7114160 - DNA, 22 bp, Homo sapiens
ttctttctcaacatgaatgttt

SEQ ID NO: 7114161 - DNA, 22 bp, Homo sapiens
ttctttcccttccagcagctcc

SEQ ID NO: 7114162 - DNA, 22 bp, Homo sapiens
ttctttcccttccagcagctcc

SEQ ID NO: 7114163 - DNA, 21 bp, Homo sapiens
ttctttccccagaggactaaa

SEQ ID NO: 7114164 - DNA, 22 bp, Homo sapiens
ttctttccccatggagttcgga

SEQ ID NO: 7114165 - DNA, 22 bp, Homo sapiens
ttgaagaacataatagctactt

SEQ ID NO: 7114166 - DNA, 19 bp, Homo sapiens
ttgaagaataaaaacacat

SEQ ID NO: 7114167 - DNA, 22 bp, Homo sapiens
ttgaagacaagggcaggggttc

SEQ ID NO: 7114168 - DNA, 22 bp, Homo sapiens
ttgaagacctttagtgctatgt

SEQ ID NO: 7114169 - DNA, 22 bp, Homo sapiens
ttgaagactaatttagataatg

SEQ ID NO: 7114170 - DNA, 22 bp, Homo sapiens
ttgaagagaaccgcggcttatt

SEQ ID NO: 7114171 - DNA, 22 bp, Homo sapiens
ttctttatgttaatgaatctat

SEQ ID NO: 7114172 - DNA, 22 bp, Homo sapiens
ttctttattagtttagtgagct

SEQ ID NO: 7114173 - DNA, 22 bp, Homo sapiens
ttctttattagtttagtgagct

SEQ ID NO: 7114174 - DNA, 22 bp, Homo sapiens
ttctttattagtttagtgagct

SEQ ID NO: 7114175 - DNA, 22 bp, Homo sapiens
ttctttattgagacttcattgt

SEQ ID NO: 7114176 - DNA, 22 bp, Homo sapiens
ttctttatgcttctgtttaggc

SEQ ID NO: 7114177 - DNA, 22 bp, Homo sapiens
ttctttatggaatggtgatagt

SEQ ID NO: 7114178 - DNA, 22 bp, Homo sapiens
ttctttatggaatggtgatagt

SEQ ID NO: 7114179 - DNA, 22 bp, Homo sapiens
ttctttatgcttctgtttaggc

SEQ ID NO: 7114180 - DNA, 22 bp, Homo sapiens
ttctttatgcttctgtttaggc

SEQ ID NO: 7114181 - DNA, 22 bp, Homo sapiens
ttctttatgcttctgtttaggc

SEQ ID NO: 7114182 - DNA, 22 bp, Homo sapiens
ttctttatcctatttgtaggtg

SEQ ID NO: 7114183 - DNA, 22 bp, Homo sapiens
ttctttcactcaagaaggatct

SEQ ID NO: 7114184 - DNA, 22 bp, Homo sapiens
ttctttcaatagctggcatatg

SEQ ID NO: 7114185 - DNA, 22 bp, Homo sapiens
ttctttcaatagctggcatatg

SEQ ID NO: 7114186 - DNA, 23 bp, Homo sapiens
ttctttcaagaagttcacagtgc

SEQ ID NO: 7114187 - DNA, 22 bp, Homo sapiens
ttctttattgagacttcattgt

SEQ ID NO: 7114188 - DNA, 19 bp, Homo sapiens
ttctttccacatcttctct

SEQ ID NO: 7114189 - DNA, 19 bp, Homo sapiens
ttctttccacatcttctct

SEQ ID NO: 7114190 - DNA, 22 bp, Homo sapiens
ttctttccaaccagatattggt

SEQ ID NO: 7114191 - DNA, 22 bp, Homo sapiens
ttctttccacagaggggatgat

SEQ ID NO: 7114192 - DNA, 22 bp, Homo sapiens
ttctttcagaacacaagtgatt

SEQ ID NO: 7114193 - DNA, 20 bp, Homo sapiens
ttctttcatctacacgttgt

SEQ ID NO: 7114194 - DNA, 20 bp, Homo sapiens
ttctttcatctacacgttgt

SEQ ID NO: 7114195 - DNA, 22 bp, Homo sapiens
ttctgagaatgcttctggaatc

SEQ ID NO: 7114196 - DNA, 22 bp, Homo sapiens
ttctgagacagcaaagattctt

SEQ ID NO: 7114197 - DNA, 22 bp, Homo sapiens
ttctgagacagcaaagattctt

SEQ ID NO: 7114198 - DNA, 22 bp, Homo sapiens
ttctgagacatcatacttttag

SEQ ID NO: 7114199 - DNA, 22 bp, Homo sapiens
ttctgagacttgagattaattt

SEQ ID NO: 7114200 - DNA, 22 bp, Homo sapiens
ttctgagagagcctctcatgtt

SEQ ID NO: 7114201 - DNA, 22 bp, Homo sapiens
ttctgagagagcctctcatgtt

SEQ ID NO: 7114202 - DNA, 22 bp, Homo sapiens
ttctgagagctgaagaaatgtt

SEQ ID NO: 7114203 - DNA, 22 bp, Homo sapiens
ttctgagagctgaagaaatgtt

SEQ ID NO: 7114204 - DNA, 22 bp, Homo sapiens
ttctgagaggtttgcattttca

SEQ ID NO: 7114205 - DNA, 22 bp, Homo sapiens
ttctgagagtaaacatagcctg

SEQ ID NO: 7114206 - DNA, 22 bp, Homo sapiens
ttctgagagtaaacatagcctg

SEQ ID NO: 7114207 - DNA, 22 bp, Homo sapiens
ttctgagagtgccagaagttct

SEQ ID NO: 7114208 - DNA, 22 bp, Homo sapiens
ttctgagagtgccagaagttct

SEQ ID NO: 7114209 - DNA, 22 bp, Homo sapiens
ttctgagagtgccagaagttct

SEQ ID NO: 7114210 - DNA, 20 bp, Homo sapiens
ttctgagagttcacagcccc

SEQ ID NO: 7114211 - DNA, 22 bp, Homo sapiens
ttctgagagttgtagtgtatcc

SEQ ID NO: 7114212 - DNA, 22 bp, Homo sapiens
ttctgagatgaggaggaaaaag

SEQ ID NO: 7114213 - DNA, 22 bp, Homo sapiens
ttctgagatgaggaggaaaaag

SEQ ID NO: 7114214 - DNA, 22 bp, Homo sapiens
ttctgagatgcgttagaaattt

SEQ ID NO: 7114215 - DNA, 22 bp, Homo sapiens
ttctgagatgcgttagaaattt

SEQ ID NO: 7114216 - DNA, 22 bp, Homo sapiens
ttctgagatgtgaatctgtcaa

SEQ ID NO: 7114217 - DNA, 20 bp, Homo sapiens
ttctgagattaggttacaaa

SEQ ID NO: 7114218 - DNA, 20 bp, Homo sapiens
ttctgagattaggttacaaa

SEQ ID NO: 7114219 - DNA, 22 bp, Homo sapiens
ttctgagattatcatacaacat

SEQ ID NO: 7114220 - DNA, 22 bp, Homo sapiens
ttctgagaagtaaaatggcgtt

SEQ ID NO: 7114221 - DNA, 22 bp, Homo sapiens
ttctgagaaggctgtggacaca

SEQ ID NO: 7114222 - DNA, 22 bp, Homo sapiens
ttctgacctcaggtgatccgtc

SEQ ID NO: 7114223 - DNA, 22 bp, Homo sapiens
ttctgagaaatgggttcacata

SEQ ID NO: 7114224 - DNA, 22 bp, Homo sapiens
ttctgagaaatgggttcacata

SEQ ID NO: 7114225 - DNA, 22 bp, Homo sapiens
ttctgagaaatgggttcacata

SEQ ID NO: 7114226 - DNA, 22 bp, Homo sapiens
ttctgacatatccagtctcagt

SEQ ID NO: 7114227 - DNA, 22 bp, Homo sapiens
ttctgacctcaggtgatccgtc

SEQ ID NO: 7114228 - DNA, 22 bp, Homo sapiens
ttctgacagtaatcagtttgct

SEQ ID NO: 7114229 - DNA, 22 bp, Homo sapiens
ttctgacagcaaaactcagcct

SEQ ID NO: 7114230 - DNA, 22 bp, Homo sapiens
ttctgacatatccagtctcagt

SEQ ID NO: 7114231 - DNA, 22 bp, Homo sapiens
ttctgacacattactacatgga

SEQ ID NO: 7114232 - DNA, 22 bp, Homo sapiens
ttctgacacattactacatgga

SEQ ID NO: 7114233 - DNA, 22 bp, Homo sapiens
ttctgacacattactacatgga

SEQ ID NO: 7114234 - DNA, 22 bp, Homo sapiens
ttctgaatttctgtgtatctta

SEQ ID NO: 7114235 - DNA, 22 bp, Homo sapiens
ttctgacaattcagtaacagca

SEQ ID NO: 7114236 - DNA, 22 bp, Homo sapiens
ttctgacaattcagtaacagca

SEQ ID NO: 7114237 - DNA, 22 bp, Homo sapiens
ttctgacaattcagtaacagca

SEQ ID NO: 7114238 - DNA, 22 bp, Homo sapiens
ttctgaatgatagtcttgaact

SEQ ID NO: 7114239 - DNA, 22 bp, Homo sapiens
ttctagttactcttaaatgctg

SEQ ID NO: 7114240 - DNA, 22 bp, Homo sapiens
ttctagtgtccttggacttgct

SEQ ID NO: 7114241 - DNA, 22 bp, Homo sapiens
ttctagttgagggagacaaata

SEQ ID NO: 7114242 - DNA, 22 bp, Homo sapiens
ttctagttttcagtccaccagg

SEQ ID NO: 7114243 - DNA, 22 bp, Homo sapiens
ttctagtttagggctcttcaac

SEQ ID NO: 7114244 - DNA, 20 bp, Homo sapiens
ttctatacatatcactgaaa

SEQ ID NO: 7114245 - DNA, 22 bp, Homo sapiens
ttctataggactcccttgaata

SEQ ID NO: 7114246 - DNA, 22 bp, Homo sapiens
ttctcttttagaggctccatga

SEQ ID NO: 7114247 - DNA, 22 bp, Homo sapiens
ttctcttttagaggctccatga

SEQ ID NO: 7114248 - DNA, 22 bp, Homo sapiens
ttctcttttagaggctccatga

SEQ ID NO: 7114249 - DNA, 22 bp, Homo sapiens
ttctcttttcaccagttgctaa

SEQ ID NO: 7114250 - DNA, 22 bp, Homo sapiens
ttctcttttgtgatgtgagatg

SEQ ID NO: 7114251 - DNA, 22 bp, Homo sapiens
ttctgaagggctaagtgtctat

SEQ ID NO: 7114252 - DNA, 22 bp, Homo sapiens
ttctgaaggtcagcagcttggt

SEQ ID NO: 7114253 - DNA, 22 bp, Homo sapiens
ttctgaatcctcgaaacatagc

SEQ ID NO: 7114254 - DNA, 22 bp, Homo sapiens
ttctgctgctgctgcacccaat

SEQ ID NO: 7114255 - DNA, 22 bp, Homo sapiens
ttctgctgcctactcctgggga

SEQ ID NO: 7114256 - DNA, 22 bp, Homo sapiens
ttctgctcttggctttgctggt

SEQ ID NO: 7114257 - DNA, 22 bp, Homo sapiens
ttctgctctgacttgcaaggaa

SEQ ID NO: 7114258 - DNA, 22 bp, Homo sapiens
ttctgctctgacttgcaaggaa

SEQ ID NO: 7114259 - DNA, 22 bp, Homo sapiens
ttctgctctaatgtacaccagc

SEQ ID NO: 7114260 - DNA, 21 bp, Homo sapiens
ttctgctccagctcctctggg

SEQ ID NO: 7114261 - DNA, 22 bp, Homo sapiens
ttctgctcagtagtaagagtgc

SEQ ID NO: 7114262 - DNA, 22 bp, Homo sapiens
ttctgccttacgatattttcaa

SEQ ID NO: 7114263 - DNA, 22 bp, Homo sapiens
ttctgcctggcaggaggactgt

SEQ ID NO: 7114264 - DNA, 22 bp, Homo sapiens
ttctgcctggcaggaggactgt

SEQ ID NO: 7114265 - DNA, 22 bp, Homo sapiens
ttctgcctggcaggaggactgt

SEQ ID NO: 7114266 - DNA, 22 bp, Homo sapiens
ttctgcctgccccagagaggcc

SEQ ID NO: 7114267 - DNA, 22 bp, Homo sapiens
ttctgagctacatagtactggg

SEQ ID NO: 7114268 - DNA, 22 bp, Homo sapiens
ttctgcctgccccagagaggcc

SEQ ID NO: 7114269 - DNA, 22 bp, Homo sapiens
ttctgcctgccccagagaggcc

SEQ ID NO: 7114270 - DNA, 22 bp, Homo sapiens
ttctgcctgccccagagaggcc

SEQ ID NO: 7114271 - DNA, 22 bp, Homo sapiens
ttctgagcctcattcatgaggc

SEQ ID NO: 7114272 - DNA, 22 bp, Homo sapiens
ttctgagctacatagtactggg

SEQ ID NO: 7114273 - DNA, 22 bp, Homo sapiens
ttctgagattatcatacaacat

SEQ ID NO: 7114274 - DNA, 22 bp, Homo sapiens
ttctgagattgttaggcactaa

SEQ ID NO: 7114275 - DNA, 22 bp, Homo sapiens
ttctgagcaagctggacagtct

SEQ ID NO: 7114276 - DNA, 22 bp, Homo sapiens
ttctgagcacgttcatttaaat

SEQ ID NO: 7114277 - DNA, 21 bp, Homo sapiens
ttctgagcactcatcactgtc

SEQ ID NO: 7114278 - DNA, 17 bp, Homo sapiens
ttctgagccacttcctt

SEQ ID NO: 7114279 - DNA, 22 bp, Homo sapiens
ttctgagccagagtcagttatg

SEQ ID NO: 7114280 - DNA, 21 bp, Homo sapiens
ttctgccttcccctagctggg

SEQ ID NO: 7114281 - DNA, 21 bp, Homo sapiens
ttctgccttcccctagctggg

SEQ ID NO: 7114282 - DNA, 22 bp, Homo sapiens
ttctgccttcagtcctctgact

SEQ ID NO: 7114283 - DNA, 22 bp, Homo sapiens
ttctgccttcagtcctctgact

SEQ ID NO: 7114284 - DNA, 22 bp, Homo sapiens
ttctgccttggcagggtggtcc

SEQ ID NO: 7114285 - DNA, 18 bp, Homo sapiens
ttctgcggtgacagatat

SEQ ID NO: 7114286 - DNA, 21 bp, Homo sapiens
ttctgccttcgaggtctcagg

SEQ ID NO: 7114287 - DNA, 21 bp, Homo sapiens
ttctgccttcgaggtctcagg

SEQ ID NO: 7114288 - DNA, 19 bp, Homo sapiens
ttctgctagaccatttgtt

SEQ ID NO: 7114289 - DNA, 22 bp, Homo sapiens
ttctggaaatcagcagagggtg

SEQ ID NO: 7114290 - DNA, 22 bp, Homo sapiens
ttctggaaagcatttgaggccc

SEQ ID NO: 7114291 - DNA, 22 bp, Homo sapiens
ttctggaaatcagcagagggtg

SEQ ID NO: 7114292 - DNA, 22 bp, Homo sapiens
ttctgggcaccaccacagactt

SEQ ID NO: 7114293 - DNA, 22 bp, Homo sapiens
ttctggaaagcatttgaggccc

SEQ ID NO: 7114294 - DNA, 22 bp, Homo sapiens
ttctggaaagatttgcgtgtaa

SEQ ID NO: 7114295 - DNA, 22 bp, Homo sapiens
ttctggaaagatttgcgtgtaa

SEQ ID NO: 7114296 - DNA, 22 bp, Homo sapiens
ttctggaaagatttgcgtgtaa

SEQ ID NO: 7114297 - DNA, 22 bp, Homo sapiens
ttctggaaagaaggctaaggtc

SEQ ID NO: 7114298 - DNA, 22 bp, Homo sapiens
ttctggaaaccctcagccagtg

SEQ ID NO: 7114299 - DNA, 22 bp, Homo sapiens
ttctggaaagaaggctaaggtc

SEQ ID NO: 7114300 - DNA, 22 bp, Homo sapiens
ttctggaaaccctcagccagtg

SEQ ID NO: 7114301 - DNA, 19 bp, Homo sapiens
ttctggaaacccaggtaat

SEQ ID NO: 7114302 - DNA, 22 bp, Homo sapiens
ttctggaaaagaaagttaagat

SEQ ID NO: 7114303 - DNA, 19 bp, Homo sapiens
ttctgggcagcacatgaat

SEQ ID NO: 7114304 - DNA, 20 bp, Homo sapiens
ttctgggcagccatgtactt

SEQ ID NO: 7114305 - DNA, 22 bp, Homo sapiens
ttctgcttctgtgtgtcccagg

SEQ ID NO: 7114306 - DNA, 22 bp, Homo sapiens
ttctgcttttctctgtctgagt

SEQ ID NO: 7114307 - DNA, 22 bp, Homo sapiens
ttctgctttggttccatggatg

SEQ ID NO: 7114308 - DNA, 22 bp, Homo sapiens
ttctgggctaccttcccggcag

SEQ ID NO: 7114309 - DNA, 22 bp, Homo sapiens
ttctgggctcacagagcagcag

SEQ ID NO: 7114310 - DNA, 21 bp, Homo sapiens
ttctgggccggagaaggggcg

SEQ ID NO: 7114311 - DNA, 22 bp, Homo sapiens
ttctgggcctcctaggacaggc

SEQ ID NO: 7114312 - DNA, 22 bp, Homo sapiens
ttctgggcccaaccctagagtg

SEQ ID NO: 7114313 - DNA, 22 bp, Homo sapiens
ttctgggcccactgtagcatcc

SEQ ID NO: 7114314 - DNA, 22 bp, Homo sapiens
ttctgggctgtccagagggtga

SEQ ID NO: 7114315 - DNA, 23 bp, Homo sapiens
ttctgggctgtggaagcctcggg

SEQ ID NO: 7114316 - DNA, 22 bp, Homo sapiens
ttctgggcttggctgtttccat

SEQ ID NO: 7114317 - DNA, 22 bp, Homo sapiens
ttctggggccaattgccactgc

SEQ ID NO: 7114318 - DNA, 22 bp, Homo sapiens
ttctggggccaattgccactgc

SEQ ID NO: 7114319 - DNA, 19 bp, Homo sapiens
ttctggggcctggccttgg

SEQ ID NO: 7114320 - DNA, 22 bp, Homo sapiens
ttctggggctaatacagaggtc

SEQ ID NO: 7114321 - DNA, 22 bp, Homo sapiens
ttctgggggaatacagctatga

SEQ ID NO: 7114322 - DNA, 22 bp, Homo sapiens
ttctgggggaatacagctatga

SEQ ID NO: 7114323 - DNA, 22 bp, Homo sapiens
ttctgggggccaggacagtggt

SEQ ID NO: 7114324 - DNA, 17 bp, Homo sapiens
ttctgggtcccagggcc

SEQ ID NO: 7114325 - DNA, 22 bp, Homo sapiens
ttctggtaccgtgtcagaaacc

SEQ ID NO: 7114326 - DNA, 22 bp, Homo sapiens
ttctggtaccgtgtcagaaacc

SEQ ID NO: 7114327 - DNA, 22 bp, Homo sapiens
ttctggtagcctcaaatttgag

SEQ ID NO: 7114328 - DNA, 22 bp, Homo sapiens
ttctggtatgggaaatttcaag

SEQ ID NO: 7114329 - DNA, 19 bp, Homo sapiens
ttctggtctggaatcaagg

SEQ ID NO: 7114330 - DNA, 22 bp, Homo sapiens
ttctgttagaattttgaaaata

SEQ ID NO: 7114331 - DNA, 22 bp, Homo sapiens
ttctgttatcattaagcattat

SEQ ID NO: 7114332 - DNA, 22 bp, Homo sapiens
ttctggtggccagaagtctgaa

SEQ ID NO: 7114333 - DNA, 22 bp, Homo sapiens
ttctggtgtgttctctctaggc

SEQ ID NO: 7114334 - DNA, 22 bp, Homo sapiens
ttctggttctcaggaatgctaa

SEQ ID NO: 7114335 - DNA, 22 bp, Homo sapiens
ttctggtttaagaaagtgctgg

SEQ ID NO: 7114336 - DNA, 22 bp, Homo sapiens
ttctgttctgatacttgtttct

SEQ ID NO: 7114337 - DNA, 22 bp, Homo sapiens
ttctgtttactcagaaatacaa

SEQ ID NO: 7114338 - DNA, 22 bp, Homo sapiens
ttctgtttataatttgcagttg

SEQ ID NO: 7114339 - DNA, 22 bp, Homo sapiens
ttctgtttataatttgcagttg

SEQ ID NO: 7114340 - DNA, 22 bp, Homo sapiens
ttctgtttataatttgcagttg

SEQ ID NO: 7114341 - DNA, 22 bp, Homo sapiens
ttctgtttataatttgcagttg

SEQ ID NO: 7114342 - DNA, 22 bp, Homo sapiens
ttctgtttataatttgcagttg

SEQ ID NO: 7114343 - DNA, 22 bp, Homo sapiens
ttctgtttataatttgcagttg

SEQ ID NO: 7114344 - DNA, 22 bp, Homo sapiens
ttctgtttattcctaggagctc

SEQ ID NO: 7114345 - DNA, 22 bp, Homo sapiens
ttctgtttattcctaggagctc

SEQ ID NO: 7114346 - DNA, 22 bp, Homo sapiens
ttctgtttcctgccttcccatt

SEQ ID NO: 7114347 - DNA, 22 bp, Homo sapiens
ttctgtttcctgccttcccatt

SEQ ID NO: 7114348 - DNA, 22 bp, Homo sapiens
ttctgtttcctgccttcccatt

SEQ ID NO: 7114349 - DNA, 22 bp, Homo sapiens
ttctgttttagaaataagtagt

SEQ ID NO: 7114350 - DNA, 22 bp, Homo sapiens
ttctgttttagaaataagtagt

SEQ ID NO: 7114351 - DNA, 22 bp, Homo sapiens
ttctgtttgtgaactggctgag

SEQ ID NO: 7114352 - DNA, 22 bp, Homo sapiens
ttctgtttgtgaactggctgag

SEQ ID NO: 7114353 - DNA, 22 bp, Homo sapiens
ttctgtttgtgaactggctgag

SEQ ID NO: 7114354 - DNA, 22 bp, Homo sapiens
ttctgtttgtgaactggctgag

SEQ ID NO: 7114355 - DNA, 22 bp, Homo sapiens
ttctgtttgccatatatagtag

SEQ ID NO: 7114356 - DNA, 22 bp, Homo sapiens
ttctgtttgccatatatagtag

SEQ ID NO: 7114357 - DNA, 22 bp, Homo sapiens
ttctgtttgccatatatagtag

SEQ ID NO: 7114358 - DNA, 22 bp, Homo sapiens
ttctgtttctggggtctctgac

SEQ ID NO: 7114359 - DNA, 22 bp, Homo sapiens
ttctgtttctggggtctctgac

SEQ ID NO: 7114360 - DNA, 22 bp, Homo sapiens
ttctgtttctggggtctctgac

SEQ ID NO: 7114361 - DNA, 21 bp, Homo sapiens
ttctgttttttgtaccagggc

SEQ ID NO: 7114362 - DNA, 22 bp, Homo sapiens
ttctgttttgcacagacttgaa

SEQ ID NO: 7114363 - DNA, 22 bp, Homo sapiens
ttctgttttgcacagacttgaa

SEQ ID NO: 7114364 - DNA, 22 bp, Homo sapiens
ttcttaaaacttatggacaggt

SEQ ID NO: 7114365 - DNA, 22 bp, Homo sapiens
ttcttaaaacttatggacaggt

SEQ ID NO: 7114366 - DNA, 22 bp, Homo sapiens
ttcttaaaacttatggacaggt

SEQ ID NO: 7114367 - DNA, 22 bp, Homo sapiens
ttcttacactcttaaaaatcat

SEQ ID NO: 7114368 - DNA, 22 bp, Homo sapiens
ttcttacagagtttacagagcc

SEQ ID NO: 7114369 - DNA, 22 bp, Homo sapiens
ttcttacagagtttacagagcc

SEQ ID NO: 7114370 - DNA, 22 bp, Homo sapiens
ttcttacatattttcatatggt

SEQ ID NO: 7114371 - DNA, 22 bp, Homo sapiens
ttcttacagagtttacagagcc

SEQ ID NO: 7114372 - DNA, 22 bp, Homo sapiens
ttcttacagatttggtgaatga

SEQ ID NO: 7114373 - DNA, 22 bp, Homo sapiens
ttcttacagatttggtgaatga

SEQ ID NO: 7114374 - DNA, 22 bp, Homo sapiens
ttcttacagatttggtgaatga

SEQ ID NO: 7114375 - DNA, 22 bp, Homo sapiens
ttcttacagccctattactaaa

SEQ ID NO: 7114376 - DNA, 22 bp, Homo sapiens
ttcttacagccctattactaaa

SEQ ID NO: 7114377 - DNA, 22 bp, Homo sapiens
ttcttacattactttacatgtg

SEQ ID NO: 7114378 - DNA, 22 bp, Homo sapiens
ttcttacattactttacatgtg

SEQ ID NO: 7114379 - DNA, 22 bp, Homo sapiens
ttcttacatctataaagttggg

SEQ ID NO: 7114380 - DNA, 22 bp, Homo sapiens
ttcttcttgtctgccctcacat

SEQ ID NO: 7114381 - DNA, 22 bp, Homo sapiens
ttcttctttatctcagtatcct

SEQ ID NO: 7114382 - DNA, 22 bp, Homo sapiens
ttcttctttatctcagtatcct

SEQ ID NO: 7114383 - DNA, 22 bp, Homo sapiens
ttcttctttccaattacatggt

SEQ ID NO: 7114384 - DNA, 22 bp, Homo sapiens
ttcttctttccaattacatggt

SEQ ID NO: 7114385 - DNA, 22 bp, Homo sapiens
ttcttctttcctataattaatt

SEQ ID NO: 7114386 - DNA, 22 bp, Homo sapiens
ttcttctttcctataattaatt

SEQ ID NO: 7114387 - DNA, 22 bp, Homo sapiens
ttcttgaatcactttagagata

SEQ ID NO: 7114388 - DNA, 22 bp, Homo sapiens
ttcttgaatcactttagagata

SEQ ID NO: 7114389 - DNA, 22 bp, Homo sapiens
ttcttgagtatctgcacagtgc

SEQ ID NO: 7114390 - DNA, 19 bp, Homo sapiens
ttcttgagacctcagtctg

SEQ ID NO: 7114391 - DNA, 20 bp, Homo sapiens
ttcttgaatacccaacccca

SEQ ID NO: 7114392 - DNA, 20 bp, Homo sapiens
ttcttgaatacccaacccca

SEQ ID NO: 7114393 - DNA, 22 bp, Homo sapiens
ttcttgaatagggattgataaa

SEQ ID NO: 7114394 - DNA, 22 bp, Homo sapiens
ttcttgaaggggatataaatag

SEQ ID NO: 7114395 - DNA, 22 bp, Homo sapiens
ttcttgaaggggatataaatag

SEQ ID NO: 7114396 - DNA, 22 bp, Homo sapiens
ttctttatcagttactcatagg

SEQ ID NO: 7114397 - DNA, 22 bp, Homo sapiens
ttctttatcagttactcatagg

SEQ ID NO: 7114398 - DNA, 22 bp, Homo sapiens
ttctttatcagttactcatagg

SEQ ID NO: 7114399 - DNA, 23 bp, Homo sapiens
ttctttataaatcaatgggatgt

SEQ ID NO: 7114400 - DNA, 22 bp, Homo sapiens
ttctttatagctattggatgag

SEQ ID NO: 7114401 - DNA, 22 bp, Homo sapiens
ttctttatagctattggatgag

SEQ ID NO: 7114402 - DNA, 22 bp, Homo sapiens
ttctttatatctgctagtgggt

SEQ ID NO: 7114403 - DNA, 18 bp, Homo sapiens
ttctttaattcagtttga

SEQ ID NO: 7114404 - DNA, 18 bp, Homo sapiens
ttctttaattcagtttga

SEQ ID NO: 7114405 - DNA, 18 bp, Homo sapiens
ttctttaattcagtttga

SEQ ID NO: 7114406 - DNA, 22 bp, Homo sapiens
ttcttgctcaatgtctgtttaa

SEQ ID NO: 7114407 - DNA, 22 bp, Homo sapiens
ttctttaaaatagtgagaaaga

SEQ ID NO: 7114408 - DNA, 22 bp, Homo sapiens
ttctttaaaatagtgagaaaga

SEQ ID NO: 7114409 - DNA, 22 bp, Homo sapiens
ttctttaaatgaattctctgta

SEQ ID NO: 7114410 - DNA, 22 bp, Homo sapiens
ttctttaaatgaattctctgta

SEQ ID NO: 7114411 - DNA, 18 bp, Homo sapiens
ttctttaattcagtttga

SEQ ID NO: 7114412 - DNA, 18 bp, Homo sapiens
ttctttaattcagtttga

SEQ ID NO: 7114413 - DNA, 18 bp, Homo sapiens
ttctttaattcagtttga

SEQ ID NO: 7114414 - DNA, 22 bp, Homo sapiens
ttcttgatgcttgtttaaaggt

SEQ ID NO: 7114415 - DNA, 22 bp, Homo sapiens
ttcttgcaggtcactcactgag

SEQ ID NO: 7114416 - DNA, 22 bp, Homo sapiens
ttcttgcatcactctgctgttc

SEQ ID NO: 7114417 - DNA, 22 bp, Homo sapiens
ttcttgccatatttcagccctt

SEQ ID NO: 7114418 - DNA, 22 bp, Homo sapiens
ttcaactaatgtttattttatg

SEQ ID NO: 7114419 - DNA, 22 bp, Homo sapiens
ttcaaccaggttaattcactac

SEQ ID NO: 7114420 - DNA, 22 bp, Homo sapiens
ttcaaccattgtgtaagacagt

SEQ ID NO: 7114421 - DNA, 22 bp, Homo sapiens
ttcaactagaggtgattttgcc

SEQ ID NO: 7114422 - DNA, 22 bp, Homo sapiens
ttcaactagatttatacaattc

SEQ ID NO: 7114423 - DNA, 22 bp, Homo sapiens
ttcaacatttgaaatgaatgaa

SEQ ID NO: 7114424 - DNA, 22 bp, Homo sapiens
ttcaactttatgcatatgtatt

SEQ ID NO: 7114425 - DNA, 22 bp, Homo sapiens
ttcaactgggcggatctgagaa

SEQ ID NO: 7114426 - DNA, 22 bp, Homo sapiens
ttcaactagatttatacaattc

SEQ ID NO: 7114427 - DNA, 22 bp, Homo sapiens
ttcaactattatgaataaaatt

SEQ ID NO: 7114428 - DNA, 22 bp, Homo sapiens
ttcaactattatgaataaaatt

SEQ ID NO: 7114429 - DNA, 22 bp, Homo sapiens
ttcaactattatgaataaaatt

SEQ ID NO: 7114430 - DNA, 22 bp, Homo sapiens
ttcaactcttcaagatcacatc

SEQ ID NO: 7114431 - DNA, 21 bp, Homo sapiens
ttcaacagcataatgtaggaa

SEQ ID NO: 7114432 - DNA, 22 bp, Homo sapiens
ttcaacagcttccaaagtgtgt

SEQ ID NO: 7114433 - DNA, 22 bp, Homo sapiens
ttcaacagggcatgatgagacg

SEQ ID NO: 7114434 - DNA, 22 bp, Homo sapiens
ttcaacactgtttggctgagta

SEQ ID NO: 7114435 - DNA, 22 bp, Homo sapiens
ttcaacagatatttattgagca

SEQ ID NO: 7114436 - DNA, 22 bp, Homo sapiens
ttcaacaatgcacttgagtata

SEQ ID NO: 7114437 - DNA, 22 bp, Homo sapiens
ttcaacaattaagtatcagcct

SEQ ID NO: 7114438 - DNA, 22 bp, Homo sapiens
ttcaacaattaagtatcagcct

SEQ ID NO: 7114439 - DNA, 22 bp, Homo sapiens
ttcaacacaggaacatgatata

SEQ ID NO: 7114440 - DNA, 22 bp, Homo sapiens
ttcaacatcaagaatgcatgga

SEQ ID NO: 7114441 - DNA, 22 bp, Homo sapiens
ttcaacatcattgtaagcctct

SEQ ID NO: 7114442 - DNA, 22 bp, Homo sapiens
ttcaacatgctttatttctaaa

SEQ ID NO: 7114443 - DNA, 22 bp, Homo sapiens
ttcaacatgctttatttctaaa

SEQ ID NO: 7114444 - DNA, 22 bp, Homo sapiens
ttcaacatgctttatttctaaa

SEQ ID NO: 7114445 - DNA, 22 bp, Homo sapiens
ttcaacatgttctacataaggg

SEQ ID NO: 7114446 - DNA, 22 bp, Homo sapiens
ttcaaaggaaaggcagtgtcaa

SEQ ID NO: 7114447 - DNA, 17 bp, Homo sapiens
ttcaaagcttatcaagg

SEQ ID NO: 7114448 - DNA, 22 bp, Homo sapiens
ttcaaaggaggtgctgggtctt

SEQ ID NO: 7114449 - DNA, 23 bp, Homo sapiens
ttcaaaggcaatatgctgagaaa

SEQ ID NO: 7114450 - DNA, 22 bp, Homo sapiens
ttcaaaggcaggatagcagctg

SEQ ID NO: 7114451 - DNA, 22 bp, Homo sapiens
ttcaaagtaccgtacttaatgg

SEQ ID NO: 7114452 - DNA, 22 bp, Homo sapiens
ttcaaagtaccgtacttaatgg

SEQ ID NO: 7114453 - DNA, 22 bp, Homo sapiens
ttcaacaaactgttcacgaatg

SEQ ID NO: 7114454 - DNA, 21 bp, Homo sapiens
ttcaacaaagggaataagttt

SEQ ID NO: 7114455 - DNA, 22 bp, Homo sapiens
ttcaacaagtatttattgagca

SEQ ID NO: 7114456 - DNA, 22 bp, Homo sapiens
ttcaacaagtcttttttcactg

SEQ ID NO: 7114457 - DNA, 22 bp, Homo sapiens
ttcaacaagtagtacacacagt

SEQ ID NO: 7114458 - DNA, 22 bp, Homo sapiens
ttcaacaagtagtacacacagt

SEQ ID NO: 7114459 - DNA, 23 bp, Homo sapiens
ttcaacaaatatggccaccagaa

SEQ ID NO: 7114460 - DNA, 22 bp, Homo sapiens
ttcaacaaatatttattgagct

SEQ ID NO: 7114461 - DNA, 22 bp, Homo sapiens
ttcaacaacttggttcaaatgg

SEQ ID NO: 7114462 - DNA, 22 bp, Homo sapiens
ttagataaagtgatgtaggcta

SEQ ID NO: 7114463 - DNA, 22 bp, Homo sapiens
ttagagtgtagcaggaagaggc

SEQ ID NO: 7114464 - DNA, 22 bp, Homo sapiens
ttagaggttctatgtgtctgga

SEQ ID NO: 7114465 - DNA, 22 bp, Homo sapiens
ttagaggtgtcaggagcacagg

SEQ ID NO: 7114466 - DNA, 22 bp, Homo sapiens
ttagaggtgtgaccttgggcaa

SEQ ID NO: 7114467 - DNA, 22 bp, Homo sapiens
ttagaggtgtcaggagcacagg

SEQ ID NO: 7114468 - DNA, 22 bp, Homo sapiens
ttagaggttctatgtgtctgga

SEQ ID NO: 7114469 - DNA, 21 bp, Homo sapiens
ttagagttgccattatatgta

SEQ ID NO: 7114470 - DNA, 22 bp, Homo sapiens
ttagagttcagcatgactttga

SEQ ID NO: 7114471 - DNA, 22 bp, Homo sapiens
ttcaattctgatgaaggcaata

SEQ ID NO: 7114472 - DNA, 22 bp, Homo sapiens
ttcaattctgatgaaggcaata

SEQ ID NO: 7114473 - DNA, 22 bp, Homo sapiens
ttcaattctaaactaatattct

SEQ ID NO: 7114474 - DNA, 22 bp, Homo sapiens
ttcaatgtttcttatcaagttg

SEQ ID NO: 7114475 - DNA, 22 bp, Homo sapiens
ttcaactttggagatttaataa

SEQ ID NO: 7114476 - DNA, 22 bp, Homo sapiens
ttcaatgcatatagatatagaa

SEQ ID NO: 7114477 - DNA, 22 bp, Homo sapiens
ttcaatgtctatgtacatttta

SEQ ID NO: 7114478 - DNA, 22 bp, Homo sapiens
ttcacaaaaatgctgaacagtt

SEQ ID NO: 7114479 - DNA, 22 bp, Homo sapiens
ttcacaaaacactattttctgg

SEQ ID NO: 7114480 - DNA, 22 bp, Homo sapiens
ttcacaaaacactattttctgg

SEQ ID NO: 7114481 - DNA, 22 bp, Homo sapiens
ttcacaaaatggtttgttgatg

SEQ ID NO: 7114482 - DNA, 22 bp, Homo sapiens
ttcacaaaatggtttgttgatg

SEQ ID NO: 7114483 - DNA, 22 bp, Homo sapiens
ttcacaaacaccagaatggcta

SEQ ID NO: 7114484 - DNA, 22 bp, Homo sapiens
ttcacaaaaatgctgaacagtt

SEQ ID NO: 7114485 - DNA, 22 bp, Homo sapiens
ttcaatttgtgctaaggcaccg

SEQ ID NO: 7114486 - DNA, 22 bp, Homo sapiens
ttcaatttgtgctaaggcaccg

SEQ ID NO: 7114487 - DNA, 22 bp, Homo sapiens
ttcaattttgcagaggaatgca

SEQ ID NO: 7114488 - DNA, 22 bp, Homo sapiens
ttcaatttcataatatctagct

SEQ ID NO: 7114489 - DNA, 22 bp, Homo sapiens
ttcaatttagtgatgttgttgg

SEQ ID NO: 7114490 - DNA, 22 bp, Homo sapiens
ttcacaatagctggcatcatct

SEQ ID NO: 7114491 - DNA, 22 bp, Homo sapiens
ttcacaatagctggcatcatct

SEQ ID NO: 7114492 - DNA, 22 bp, Homo sapiens
ttcacaatagctggcatcatct

SEQ ID NO: 7114493 - DNA, 22 bp, Homo sapiens
ttcacaataggagcatgcaaat

SEQ ID NO: 7114494 - DNA, 22 bp, Homo sapiens
ttcacaagtcattagctgcata

SEQ ID NO: 7114495 - DNA, 18 bp, Homo sapiens
ttcacaagggcttggttt

SEQ ID NO: 7114496 - DNA, 22 bp, Homo sapiens
ttcacaagtcattagctgcata

SEQ ID NO: 7114497 - DNA, 19 bp, Homo sapiens
ttcacaagtgatgtctctc

SEQ ID NO: 7114498 - DNA, 22 bp, Homo sapiens
ttcacaaagctggagcatttcc

SEQ ID NO: 7114499 - DNA, 20 bp, Homo sapiens
ttcacaactctaggggaggt

SEQ ID NO: 7114500 - DNA, 20 bp, Homo sapiens
ttcacaactcttagaagctg

SEQ ID NO: 7114501 - DNA, 20 bp, Homo sapiens
ttcacaactcttagaagctg

SEQ ID NO: 7114502 - DNA, 22 bp, Homo sapiens
ttcacaaagctggagcatttcc

SEQ ID NO: 7114503 - DNA, 22 bp, Homo sapiens
ttcacaaagctggagcatttcc

SEQ ID NO: 7114504 - DNA, 22 bp, Homo sapiens
ttcacaaagctggagcatttcc

SEQ ID NO: 7114505 - DNA, 22 bp, Homo sapiens
ttcacagtcacccttctccatg

SEQ ID NO: 7114506 - DNA, 22 bp, Homo sapiens
ttcacagtcacccttctccatg

SEQ ID NO: 7114507 - DNA, 22 bp, Homo sapiens
ttcacagtcacccttctccatg

SEQ ID NO: 7114508 - DNA, 22 bp, Homo sapiens
ttcacagtataggtttccagcg

SEQ ID NO: 7114509 - DNA, 22 bp, Homo sapiens
ttcacagtataggtttccagcg

SEQ ID NO: 7114510 - DNA, 22 bp, Homo sapiens
ttcacagtataggtttccagcg

SEQ ID NO: 7114511 - DNA, 22 bp, Homo sapiens
ttcacaggtgagcattaggccg

SEQ ID NO: 7114512 - DNA, 22 bp, Homo sapiens
ttcacagtaacagggggatatg

SEQ ID NO: 7114513 - DNA, 22 bp, Homo sapiens
ttcacagtaagtaggatagttg

SEQ ID NO: 7114514 - DNA, 22 bp, Homo sapiens
ttcacagtaatgtgcccaggta

SEQ ID NO: 7114515 - DNA, 22 bp, Homo sapiens
ttcacagtgagctatgtcttgt

SEQ ID NO: 7114516 - DNA, 22 bp, Homo sapiens
ttcacagtctatcttggttttt

SEQ ID NO: 7114517 - DNA, 22 bp, Homo sapiens
ttcacagtgccagggggcaggc

SEQ ID NO: 7114518 - DNA, 22 bp, Homo sapiens
ttcacagtgctcacagttcagt

SEQ ID NO: 7114519 - DNA, 22 bp, Homo sapiens
ttcacagtgctgcacctggctt

SEQ ID NO: 7114520 - DNA, 22 bp, Homo sapiens
ttcatgatagtatctattcaat

SEQ ID NO: 7114521 - DNA, 23 bp, Homo sapiens
ttcatgatgattaatcagctaca

SEQ ID NO: 7114522 - DNA, 22 bp, Homo sapiens
ttcatgatggcagcatttatag

SEQ ID NO: 7114523 - DNA, 22 bp, Homo sapiens
ttcatgcatggccttactccct

SEQ ID NO: 7114524 - DNA, 22 bp, Homo sapiens
ttcatgcactatttcttctagc

SEQ ID NO: 7114525 - DNA, 18 bp, Homo sapiens
ttcatcatgactctgtgg

SEQ ID NO: 7114526 - DNA, 18 bp, Homo sapiens
ttcatcatgactctgtgg

SEQ ID NO: 7114527 - DNA, 22 bp, Homo sapiens
ttcatcatgatgttcccctcta

SEQ ID NO: 7114528 - DNA, 22 bp, Homo sapiens
ttcatcattacagtcatgttat

SEQ ID NO: 7114529 - DNA, 22 bp, Homo sapiens
ttcatcattacagtcatgttat

SEQ ID NO: 7114530 - DNA, 22 bp, Homo sapiens
ttcatcattacagtcatgttat

SEQ ID NO: 7114531 - DNA, 22 bp, Homo sapiens
ttcatcattgccagtctttaaa

SEQ ID NO: 7114532 - DNA, 22 bp, Homo sapiens
ttcatgcttttaccgctgttaa

SEQ ID NO: 7114533 - DNA, 22 bp, Homo sapiens
ttcatggagttgagaaggctaa

SEQ ID NO: 7114534 - DNA, 22 bp, Homo sapiens
ttcatggcaggagtcagaagct

SEQ ID NO: 7114535 - DNA, 22 bp, Homo sapiens
ttcatgccagccctgtgtggta

SEQ ID NO: 7114536 - DNA, 22 bp, Homo sapiens
ttcatgccagccctgtgtggta

SEQ ID NO: 7114537 - DNA, 22 bp, Homo sapiens
ttcatgctcctgccctttttgg

SEQ ID NO: 7114538 - DNA, 20 bp, Homo sapiens
ttcatgctggaggggctggc

SEQ ID NO: 7114539 - DNA, 22 bp, Homo sapiens
ttcatgctgtgtctacaactta

SEQ ID NO: 7114540 - DNA, 22 bp, Homo sapiens
ttcatgctgtgtctacaactta

SEQ ID NO: 7114541 - DNA, 22 bp, Homo sapiens
ttcatgcttgttcctccacctg

SEQ ID NO: 7114542 - DNA, 22 bp, Homo sapiens
ttcagtgtcaatttttaaatat

SEQ ID NO: 7114543 - DNA, 22 bp, Homo sapiens
ttcagtgtatcttgtcagggag

SEQ ID NO: 7114544 - DNA, 22 bp, Homo sapiens
ttcagtgtacagtgaagggatt

SEQ ID NO: 7114545 - DNA, 22 bp, Homo sapiens
ttcagtgtatattttttgagta

SEQ ID NO: 7114546 - DNA, 22 bp, Homo sapiens
ttcagtgtcacaagagcaagcc

SEQ ID NO: 7114547 - DNA, 22 bp, Homo sapiens
ttcatcatcagaactgttcact

SEQ ID NO: 7114548 - DNA, 22 bp, Homo sapiens
ttcatcatcagaactgttcact

SEQ ID NO: 7114549 - DNA, 22 bp, Homo sapiens
ttcatcatctacaaccaggacc

SEQ ID NO: 7114550 - DNA, 22 bp, Homo sapiens
ttcagtgccgtgctgggtcgct

SEQ ID NO: 7114551 - DNA, 22 bp, Homo sapiens
ttcagtgcctgtccacagcttc

SEQ ID NO: 7114552 - DNA, 22 bp, Homo sapiens
ttcagtgctaaaaagtctcaag

SEQ ID NO: 7114553 - DNA, 22 bp, Homo sapiens
ttcagtgcttacaggtttcttt

SEQ ID NO: 7114554 - DNA, 22 bp, Homo sapiens
ttcagtgcttacaggtttcttt

SEQ ID NO: 7114555 - DNA, 22 bp, Homo sapiens
ttcagtgacttacctggagcca

SEQ ID NO: 7114556 - DNA, 22 bp, Homo sapiens
ttcagtgagtgaatgaatgaat

SEQ ID NO: 7114557 - DNA, 22 bp, Homo sapiens
ttcagtgcacagtactgagact

SEQ ID NO: 7114558 - DNA, 22 bp, Homo sapiens
ttcagtgcagacgccgaagccc

SEQ ID NO: 7114559 - DNA, 22 bp, Homo sapiens
ttcatgtctgccttttcaagtg

SEQ ID NO: 7114560 - DNA, 22 bp, Homo sapiens
ttcatgtaggctgcaatgcaca

SEQ ID NO: 7114561 - DNA, 22 bp, Homo sapiens
ttcatgtaggctgcaatgcaca

SEQ ID NO: 7114562 - DNA, 22 bp, Homo sapiens
ttcatgtaccgtgtaccaggca

SEQ ID NO: 7114563 - DNA, 22 bp, Homo sapiens
ttcatgtaccgtgtaccaggca

SEQ ID NO: 7114564 - DNA, 22 bp, Homo sapiens
ttcatgtagcttagcagagagg

SEQ ID NO: 7114565 - DNA, 20 bp, Homo sapiens
ttcatggtgtatttctttct

SEQ ID NO: 7114566 - DNA, 22 bp, Homo sapiens
ttcatgtaataggatgtgttaa

SEQ ID NO: 7114567 - DNA, 20 bp, Homo sapiens
ttcatgggagcaaagaggcc

SEQ ID NO: 7114568 - DNA, 20 bp, Homo sapiens
ttcatgggagcaaagaggcc

SEQ ID NO: 7114569 - DNA, 20 bp, Homo sapiens
ttcatgggagcaaagaggcc

SEQ ID NO: 7114570 - DNA, 20 bp, Homo sapiens
ttcatgggagcaaagaggcc

SEQ ID NO: 7114571 - DNA, 23 bp, Homo sapiens
ttcatgtggacctagaggcctgt

SEQ ID NO: 7114572 - DNA, 22 bp, Homo sapiens
ttcatgtgataaatgtgtgact

SEQ ID NO: 7114573 - DNA, 22 bp, Homo sapiens
ttcatgtgccagagctgaaaat

SEQ ID NO: 7114574 - DNA, 23 bp, Homo sapiens
ttcatgttccctccttctggtga

SEQ ID NO: 7114575 - DNA, 22 bp, Homo sapiens
ttccaatttgtggtgagttaat

SEQ ID NO: 7114576 - DNA, 22 bp, Homo sapiens
ttcatgtttcctcttgtgctgc

SEQ ID NO: 7114577 - DNA, 22 bp, Homo sapiens
ttcatgtttgcctatttgactt

SEQ ID NO: 7114578 - DNA, 22 bp, Homo sapiens
ttcatgtttcatttgttactat

SEQ ID NO: 7114579 - DNA, 22 bp, Homo sapiens
ttcatgttgtagtatgtatcag

SEQ ID NO: 7114580 - DNA, 19 bp, Homo sapiens
ttcacattggaagaagtag

SEQ ID NO: 7114581 - DNA, 19 bp, Homo sapiens
ttcacattggaagaagtag

SEQ ID NO: 7114582 - DNA, 22 bp, Homo sapiens
ttcacattccgcggctattttc

SEQ ID NO: 7114583 - DNA, 22 bp, Homo sapiens
ttcacattctcacaagaggaaa

SEQ ID NO: 7114584 - DNA, 22 bp, Homo sapiens
ttcacattgaaggtgctttctt

SEQ ID NO: 7114585 - DNA, 22 bp, Homo sapiens
ttcacattataatcagttctgc

SEQ ID NO: 7114586 - DNA, 22 bp, Homo sapiens
ttcacattataatcagttctgc

SEQ ID NO: 7114587 - DNA, 22 bp, Homo sapiens
ttcacattatcaggattgtttc

SEQ ID NO: 7114588 - DNA, 22 bp, Homo sapiens
ttcacattcagaaaaagcccgt

SEQ ID NO: 7114589 - DNA, 22 bp, Homo sapiens
ttcacattccgcggctattttc

SEQ ID NO: 7114590 - DNA, 22 bp, Homo sapiens
ttcacagtgctgcacctggctt

SEQ ID NO: 7114591 - DNA, 21 bp, Homo sapiens
ttcacagtggataactttctg

SEQ ID NO: 7114592 - DNA, 22 bp, Homo sapiens
ttcacagtggccctctctgagt

SEQ ID NO: 7114593 - DNA, 22 bp, Homo sapiens
ttcacagtggccctctctgagt

SEQ ID NO: 7114594 - DNA, 22 bp, Homo sapiens
ttcacagtggctaagttctgca

SEQ ID NO: 7114595 - DNA, 22 bp, Homo sapiens
ttcacagtggctaagttctgca

SEQ ID NO: 7114596 - DNA, 22 bp, Homo sapiens
ttcacagtggctaagttctgca

SEQ ID NO: 7114597 - DNA, 22 bp, Homo sapiens
ttcacagtggctgacaggctgg

SEQ ID NO: 7114598 - DNA, 22 bp, Homo sapiens
ttcacagtggctgacaggctgg

SEQ ID NO: 7114599 - DNA, 22 bp, Homo sapiens
ttcacagtggctgtgccatttg

SEQ ID NO: 7114600 - DNA, 22 bp, Homo sapiens
ttcacagtggctgtgccatttg

SEQ ID NO: 7114601 - DNA, 22 bp, Homo sapiens
ttcacagtggctgtgccatttg

SEQ ID NO: 7114602 - DNA, 22 bp, Homo sapiens
ttcacagtggcttaggctatgg

SEQ ID NO: 7114603 - DNA, 22 bp, Homo sapiens
ttcacattagccaagagatgga

SEQ ID NO: 7114604 - DNA, 22 bp, Homo sapiens
ttcacattagccaagagatgga

SEQ ID NO: 7114605 - DNA, 22 bp, Homo sapiens
ttcacattagtggttctatata

SEQ ID NO: 7114606 - DNA, 22 bp, Homo sapiens
ttcaggaggtgagcaagaaggg

SEQ ID NO: 7114607 - DNA, 22 bp, Homo sapiens
ttcaggaggtgagcaagaaggg

SEQ ID NO: 7114608 - DNA, 22 bp, Homo sapiens
ttcaggagctggctgcgaagga

SEQ ID NO: 7114609 - DNA, 22 bp, Homo sapiens
ttcaggaggtgagcaagaaggg

SEQ ID NO: 7114610 - DNA, 22 bp, Homo sapiens
ttcaggagaaagttcagtactt

SEQ ID NO: 7114611 - DNA, 22 bp, Homo sapiens
ttcaggagaattccaagaagta

SEQ ID NO: 7114612 - DNA, 22 bp, Homo sapiens
ttcaggagaattccaagaagta

SEQ ID NO: 7114613 - DNA, 22 bp, Homo sapiens
ttcaggagaattccaagaagta

SEQ ID NO: 7114614 - DNA, 22 bp, Homo sapiens
ttcaggagctagggatgtgaaa

SEQ ID NO: 7114615 - DNA, 22 bp, Homo sapiens
ttcaggagctagggatgtgaaa

SEQ ID NO: 7114616 - DNA, 22 bp, Homo sapiens
ttcaggtgtggccagaggagaa

SEQ ID NO: 7114617 - DNA, 22 bp, Homo sapiens
ttcaggtttttaagttctgcct

SEQ ID NO: 7114618 - DNA, 22 bp, Homo sapiens
ttcagtaaaacactgcaatgtc

SEQ ID NO: 7114619 - DNA, 22 bp, Homo sapiens
ttcagtaagcacttctagagct

SEQ ID NO: 7114620 - DNA, 18 bp, Homo sapiens
ttcaggtcagaaagatgg

SEQ ID NO: 7114621 - DNA, 18 bp, Homo sapiens
ttcaggtcagaaagatgg

SEQ ID NO: 7114622 - DNA, 21 bp, Homo sapiens
ttcaggtgagatcatgttgac

SEQ ID NO: 7114623 - DNA, 22 bp, Homo sapiens
ttcaggtgggccttttgagcat

SEQ ID NO: 7114624 - DNA, 21 bp, Homo sapiens
ttcaggtgagatcatgttgac

SEQ ID NO: 7114625 - DNA, 22 bp, Homo sapiens
ttcagtatacttcataacattt

SEQ ID NO: 7114626 - DNA, 22 bp, Homo sapiens
ttcagtatacttcataacattt

SEQ ID NO: 7114627 - DNA, 22 bp, Homo sapiens
ttcagtatattactcttgtcaa

SEQ ID NO: 7114628 - DNA, 22 bp, Homo sapiens
ttcagtaaggataataaacaga

SEQ ID NO: 7114629 - DNA, 22 bp, Homo sapiens
ttcagtagggccctcacacagt

SEQ ID NO: 7114630 - DNA, 22 bp, Homo sapiens
ttcagtatacattatctaattg

SEQ ID NO: 7114631 - DNA, 22 bp, Homo sapiens
ttcagtatgctgaatgattttt

SEQ ID NO: 7114632 - DNA, 22 bp, Homo sapiens
ttcagtatgctgaatgattttt

SEQ ID NO: 7114633 - DNA, 22 bp, Homo sapiens
ttcagtatgctgaatgattttt

SEQ ID NO: 7114634 - DNA, 22 bp, Homo sapiens
ttcagtctcatggatgtgaaat

SEQ ID NO: 7114635 - DNA, 22 bp, Homo sapiens
ttcagtctcaagtgctgctcac

SEQ ID NO: 7114636 - DNA, 22 bp, Homo sapiens
ttcagtctcctcattttacaaa

SEQ ID NO: 7114637 - DNA, 20 bp, Homo sapiens
ttcagtctcctgcttccttc

SEQ ID NO: 7114638 - DNA, 22 bp, Homo sapiens
ttcagtatgttggacgttatgt

SEQ ID NO: 7114639 - DNA, 22 bp, Homo sapiens
ttcagtattcaaatatgtctta

SEQ ID NO: 7114640 - DNA, 22 bp, Homo sapiens
ttcagtattcaaatatgtctta

SEQ ID NO: 7114641 - DNA, 22 bp, Homo sapiens
ttcagtatttcatgactttctt

SEQ ID NO: 7114642 - DNA, 22 bp, Homo sapiens
ttcagtcagtgactaagcagtt

SEQ ID NO: 7114643 - DNA, 22 bp, Homo sapiens
ttcagtcagtgactaagcagtt

SEQ ID NO: 7114644 - DNA, 22 bp, Homo sapiens
ttcagtccatcaggcgtggcat

SEQ ID NO: 7114645 - DNA, 22 bp, Homo sapiens
ttcagtcccttgcttaaattta

SEQ ID NO: 7114646 - DNA, 22 bp, Homo sapiens
ttccttctccagaacttctagg

SEQ ID NO: 7114647 - DNA, 22 bp, Homo sapiens
ttccttctccagaacttctagg

SEQ ID NO: 7114648 - DNA, 22 bp, Homo sapiens
ttccttctattcagctccaaga

SEQ ID NO: 7114649 - DNA, 22 bp, Homo sapiens
ttccttctgaagcctttgtgtt

SEQ ID NO: 7114650 - DNA, 22 bp, Homo sapiens
ttctaagagagtacaagcaatt

SEQ ID NO: 7114651 - DNA, 22 bp, Homo sapiens
ttctaagagtcattaatggcct

SEQ ID NO: 7114652 - DNA, 22 bp, Homo sapiens
ttctaagattcatgaggacagg

SEQ ID NO: 7114653 - DNA, 22 bp, Homo sapiens
ttccttaatgaatcaggccatt

SEQ ID NO: 7114654 - DNA, 23 bp, Homo sapiens
ttccttaactgttaagattgtct

SEQ ID NO: 7114655 - DNA, 22 bp, Homo sapiens
ttcctgttcaggaaagttgtgt

SEQ ID NO: 7114656 - DNA, 22 bp, Homo sapiens
ttcctgttcaggaaagttgtgt

SEQ ID NO: 7114657 - DNA, 22 bp, Homo sapiens
ttcctgttagccattattagct

SEQ ID NO: 7114658 - DNA, 22 bp, Homo sapiens
ttcctgtgtgttggtggcagaa

SEQ ID NO: 7114659 - DNA, 22 bp, Homo sapiens
ttcctgtgtgttggtggcagaa

SEQ ID NO: 7114660 - DNA, 22 bp, Homo sapiens
ttcctgtggctgtcactcctgg

SEQ ID NO: 7114661 - DNA, 22 bp, Homo sapiens
ttcctgtggctgtcactcctgg

SEQ ID NO: 7114662 - DNA, 23 bp, Homo sapiens
ttcctgtggtatattttataggg

SEQ ID NO: 7114663 - DNA, 22 bp, Homo sapiens
ttcctgtggtccagagtcatcc

SEQ ID NO: 7114664 - DNA, 22 bp, Homo sapiens
ttcctgtggtccagagtcatcc

SEQ ID NO: 7114665 - DNA, 22 bp, Homo sapiens
ttcctgtggtgtttcccagaca

SEQ ID NO: 7114666 - DNA, 17 bp, Homo sapiens
ttcctgtggtttgatct

SEQ ID NO: 7114667 - DNA, 22 bp, Homo sapiens
ttcctgtgtacgtgtttcgctg

SEQ ID NO: 7114668 - DNA, 22 bp, Homo sapiens
ttcctgtgtcccgggcaccctg

SEQ ID NO: 7114669 - DNA, 22 bp, Homo sapiens
ttcctgtgtcctatttcgactt

SEQ ID NO: 7114670 - DNA, 22 bp, Homo sapiens
ttcctgtgtgaccgagacagtg

SEQ ID NO: 7114671 - DNA, 22 bp, Homo sapiens
ttcctgtgtgaccgagacagtg

SEQ ID NO: 7114672 - DNA, 22 bp, Homo sapiens
ttcctgtgtgaccgagacagtg

SEQ ID NO: 7114673 - DNA, 22 bp, Homo sapiens
ttcctgtgtgactcaagtggtt

SEQ ID NO: 7114674 - DNA, 22 bp, Homo sapiens
ttcctgtgtgctctcatttagt

SEQ ID NO: 7114675 - DNA, 22 bp, Homo sapiens
ttcctgtgtgttggtggcagaa

SEQ ID NO: 7114676 - DNA, 22 bp, Homo sapiens
ttcctgtggccttacatctgtg

SEQ ID NO: 7114677 - DNA, 22 bp, Homo sapiens
ttcctgtgcttaattctcactg

SEQ ID NO: 7114678 - DNA, 22 bp, Homo sapiens
ttcctgtgcttattcttctctg

SEQ ID NO: 7114679 - DNA, 22 bp, Homo sapiens
ttcctgtggccttacatctgtg

SEQ ID NO: 7114680 - DNA, 22 bp, Homo sapiens
ttcctgtggccttacatctgtg

SEQ ID NO: 7114681 - DNA, 22 bp, Homo sapiens
ttcctgtgcctcaggtctcagc

SEQ ID NO: 7114682 - DNA, 22 bp, Homo sapiens
ttcctgtgatattagccactgt

SEQ ID NO: 7114683 - DNA, 22 bp, Homo sapiens
ttcctgtgatattagccactgt

SEQ ID NO: 7114684 - DNA, 22 bp, Homo sapiens
ttcctgtgaagccggtggtctc

SEQ ID NO: 7114685 - DNA, 19 bp, Homo sapiens
ttcctgtgctgctgtgtcc

SEQ ID NO: 7114686 - DNA, 20 bp, Homo sapiens
ttcctgtcctctctttcagg

SEQ ID NO: 7114687 - DNA, 22 bp, Homo sapiens
ttcctgtgaaatataggtccat

SEQ ID NO: 7114688 - DNA, 22 bp, Homo sapiens
ttcctgtgaagatctgggtgct

SEQ ID NO: 7114689 - DNA, 22 bp, Homo sapiens
ttcctgtatgtcagtgaagagc

SEQ ID NO: 7114690 - DNA, 22 bp, Homo sapiens
ttcctgtattctaaagggaaag

SEQ ID NO: 7114691 - DNA, 22 bp, Homo sapiens
ttcctgtattctaaagggaaag

SEQ ID NO: 7114692 - DNA, 22 bp, Homo sapiens
ttcctgtattttgcgaattttc

SEQ ID NO: 7114693 - DNA, 22 bp, Homo sapiens
ttcctgtccgcaatggcctggg

SEQ ID NO: 7114694 - DNA, 22 bp, Homo sapiens
ttcctgaaaatacagggagaga

SEQ ID NO: 7114695 - DNA, 21 bp, Homo sapiens
ttcctcttgcttccgccttgc

SEQ ID NO: 7114696 - DNA, 22 bp, Homo sapiens
ttcctctttagggctggccagg

SEQ ID NO: 7114697 - DNA, 22 bp, Homo sapiens
ttcctcttattttcccagtgat

SEQ ID NO: 7114698 - DNA, 22 bp, Homo sapiens
ttcctcttccatcttcccaggg

SEQ ID NO: 7114699 - DNA, 22 bp, Homo sapiens
ttcctctttgcatcctcaactc

SEQ ID NO: 7114700 - DNA, 22 bp, Homo sapiens
ttcctctttgcatcctcaactc

SEQ ID NO: 7114701 - DNA, 22 bp, Homo sapiens
ttcctgaaaatacagggagacc

SEQ ID NO: 7114702 - DNA, 22 bp, Homo sapiens
ttctacttctgacactgtttgt

SEQ ID NO: 7114703 - DNA, 22 bp, Homo sapiens
ttctactttagcatgctcattc

SEQ ID NO: 7114704 - DNA, 22 bp, Homo sapiens
ttctactttctctgtcattaaa

SEQ ID NO: 7114705 - DNA, 19 bp, Homo sapiens
ttctactttgtttccccct

SEQ ID NO: 7114706 - DNA, 16 bp, Homo sapiens
ttctagaaaagaaggt

SEQ ID NO: 7114707 - DNA, 21 bp, Homo sapiens
ttctagaaaagtatgggactg

SEQ ID NO: 7114708 - DNA, 22 bp, Homo sapiens
ttctagaaacacatgcaaacag

SEQ ID NO: 7114709 - DNA, 22 bp, Homo sapiens
ttctagaaactggagcaaacag

SEQ ID NO: 7114710 - DNA, 22 bp, Homo sapiens
ttctagaaactggagcaaacag

SEQ ID NO: 7114711 - DNA, 22 bp, Homo sapiens
ttctagaaacacatgcaaacag

SEQ ID NO: 7114712 - DNA, 22 bp, Homo sapiens
ttctacaatatgaataatgaag

SEQ ID NO: 7114713 - DNA, 22 bp, Homo sapiens
ttctacaatatgaataatgaag

SEQ ID NO: 7114714 - DNA, 20 bp, Homo sapiens
ttctacaaaactgattctga

SEQ ID NO: 7114715 - DNA, 22 bp, Homo sapiens
ttctacaaatatttactgttcc

SEQ ID NO: 7114716 - DNA, 22 bp, Homo sapiens
ttctacaaatatttactgttcc

SEQ ID NO: 7114717 - DNA, 22 bp, Homo sapiens
ttctacaaatatttactgttcc

SEQ ID NO: 7114718 - DNA, 22 bp, Homo sapiens
ttctacaatatgaataatgaag

SEQ ID NO: 7114719 - DNA, 22 bp, Homo sapiens
ttctacaatatgaataatgaag

SEQ ID NO: 7114720 - DNA, 22 bp, Homo sapiens
ttctaatacacggtatgacttt

SEQ ID NO: 7114721 - DNA, 22 bp, Homo sapiens
ttctaatacacggtatgacttt

SEQ ID NO: 7114722 - DNA, 22 bp, Homo sapiens
ttctaatagctgcctatgtatt

SEQ ID NO: 7114723 - DNA, 22 bp, Homo sapiens
ttctaatagctgcctatgtatt

SEQ ID NO: 7114724 - DNA, 22 bp, Homo sapiens
ttctaatagctgcctatgtatt

SEQ ID NO: 7114725 - DNA, 22 bp, Homo sapiens
ttctaatcccagctctactact

SEQ ID NO: 7114726 - DNA, 22 bp, Homo sapiens
ttctaatgaaagtggaccatgg

SEQ ID NO: 7114727 - DNA, 22 bp, Homo sapiens
ttctaatgaaatctgtacagta

SEQ ID NO: 7114728 - DNA, 22 bp, Homo sapiens
ttctaattgtgtttgcatatct

SEQ ID NO: 7114729 - DNA, 22 bp, Homo sapiens
ttctaatgatttcattcaaagc

SEQ ID NO: 7114730 - DNA, 22 bp, Homo sapiens
ttctaatgatttcattcaaagc

SEQ ID NO: 7114731 - DNA, 19 bp, Homo sapiens
ttctaatgttacattttgg

SEQ ID NO: 7114732 - DNA, 22 bp, Homo sapiens
ttctagggatctgctgctgttt

SEQ ID NO: 7114733 - DNA, 22 bp, Homo sapiens
ttctagggatggtaggtacaaa

SEQ ID NO: 7114734 - DNA, 22 bp, Homo sapiens
ttctagggaatgggatgaggat

SEQ ID NO: 7114735 - DNA, 22 bp, Homo sapiens
ttctaggggagaggaagaagtg

SEQ ID NO: 7114736 - DNA, 22 bp, Homo sapiens
ttctaggggggatcttggtcca

SEQ ID NO: 7114737 - DNA, 22 bp, Homo sapiens
ttctagggttcgagtataatcc

SEQ ID NO: 7114738 - DNA, 22 bp, Homo sapiens
ttctagcatgccttttagcaca

SEQ ID NO: 7114739 - DNA, 20 bp, Homo sapiens
ttctagcatacttacaagga

SEQ ID NO: 7114740 - DNA, 22 bp, Homo sapiens
ttctagaatgttttgaaaggga

SEQ ID NO: 7114741 - DNA, 22 bp, Homo sapiens
ttctagcacaagatatgaaagt

SEQ ID NO: 7114742 - DNA, 22 bp, Homo sapiens
ttctagaaactggagcaaacag

SEQ ID NO: 7114743 - DNA, 22 bp, Homo sapiens
ttctagaaatccgtaagtgaat

SEQ ID NO: 7114744 - DNA, 22 bp, Homo sapiens
ttctagaaatccgtaagtgaat

SEQ ID NO: 7114745 - DNA, 22 bp, Homo sapiens
ttctagaaccatgacttcaggg

SEQ ID NO: 7114746 - DNA, 22 bp, Homo sapiens
ttctagaacaggcaaaaccaat

SEQ ID NO: 7114747 - DNA, 22 bp, Homo sapiens
ttctagaaccatgacttcaggg

SEQ ID NO: 7114748 - DNA, 21 bp, Homo sapiens
ttctagaaccgtgggcggttc

SEQ ID NO: 7114749 - DNA, 19 bp, Homo sapiens
ttctagaactgttctctca

SEQ ID NO: 7114750 - DNA, 22 bp, Homo sapiens
ttctagaagaactagccaggaa

SEQ ID NO: 7114751 - DNA, 22 bp, Homo sapiens
ttctagaagctctaggggagaa

SEQ ID NO: 7114752 - DNA, 22 bp, Homo sapiens
ttctagaagctgaaaaggggga

SEQ ID NO: 7114753 - DNA, 22 bp, Homo sapiens
ttctagaaggcaggctgggcca

SEQ ID NO: 7114754 - DNA, 22 bp, Homo sapiens
ttctagaagtgtctatgtctgt

SEQ ID NO: 7114755 - DNA, 22 bp, Homo sapiens
ttctagaagtgtctatgtctgt

SEQ ID NO: 7114756 - DNA, 22 bp, Homo sapiens
ttctagaagtgtctatgtctgt

SEQ ID NO: 7114757 - DNA, 20 bp, Homo sapiens
ttctagaagtttgctaccca

SEQ ID NO: 7114758 - DNA, 22 bp, Homo sapiens
ttctagaatccttgtctacttt

SEQ ID NO: 7114759 - DNA, 22 bp, Homo sapiens
ttctagaatgatatgaggtact

SEQ ID NO: 7114760 - DNA, 20 bp, Homo sapiens
ttctagaatgcccagggaca

SEQ ID NO: 7114761 - DNA, 22 bp, Homo sapiens
ttccacacttaaggaatatgat

SEQ ID NO: 7114762 - DNA, 19 bp, Homo sapiens
ttccacacagctctcgggc

SEQ ID NO: 7114763 - DNA, 22 bp, Homo sapiens
ttccacactttcacacgaggtc

SEQ ID NO: 7114764 - DNA, 22 bp, Homo sapiens
ttccacaattcagattgttgcc

SEQ ID NO: 7114765 - DNA, 23 bp, Homo sapiens
ttccacaatgaaaataaagcagg

SEQ ID NO: 7114766 - DNA, 23 bp, Homo sapiens
ttccacaatgaaaataaagcagg

SEQ ID NO: 7114767 - DNA, 22 bp, Homo sapiens
ttccacaatgccaggggcatca

SEQ ID NO: 7114768 - DNA, 22 bp, Homo sapiens
ttccacaaacacatcctgagca

SEQ ID NO: 7114769 - DNA, 22 bp, Homo sapiens
ttccacaaatcaattctgctga

SEQ ID NO: 7114770 - DNA, 22 bp, Homo sapiens
ttccacaacaaccaagcatata

SEQ ID NO: 7114771 - DNA, 22 bp, Homo sapiens
ttccacaagatgtttcttagaa

SEQ ID NO: 7114772 - DNA, 22 bp, Homo sapiens
ttccacaaggccttgtcctgct

SEQ ID NO: 7114773 - DNA, 22 bp, Homo sapiens
ttccacaagtgatatctagctg

SEQ ID NO: 7114774 - DNA, 21 bp, Homo sapiens
ttccacagtgagaactgcaag

SEQ ID NO: 7114775 - DNA, 22 bp, Homo sapiens
ttccacagtggctgtagttctg

SEQ ID NO: 7114776 - DNA, 22 bp, Homo sapiens
ttccacagtggctgtagttctg

SEQ ID NO: 7114777 - DNA, 20 bp, Homo sapiens
ttccacatctttgcacatgc

SEQ ID NO: 7114778 - DNA, 20 bp, Homo sapiens
ttccacatctttgcacatgc

SEQ ID NO: 7114779 - DNA, 22 bp, Homo sapiens
ttccacatagatcacaggtgtt

SEQ ID NO: 7114780 - DNA, 22 bp, Homo sapiens
ttccacatgttagctggttaaa

SEQ ID NO: 7114781 - DNA, 22 bp, Homo sapiens
ttccacattccttacattcata

SEQ ID NO: 7114782 - DNA, 22 bp, Homo sapiens
ttccacattccttacattcata

SEQ ID NO: 7114783 - DNA, 22 bp, Homo sapiens
ttccacattccttacattcata

SEQ ID NO: 7114784 - DNA, 22 bp, Homo sapiens
ttccagaacaatgtggacgtat

SEQ ID NO: 7114785 - DNA, 22 bp, Homo sapiens
ttccagaaccttcctgctggaa

SEQ ID NO: 7114786 - DNA, 22 bp, Homo sapiens
ttccagaactcaagaaatgccc

SEQ ID NO: 7114787 - DNA, 22 bp, Homo sapiens
ttccacagatgaaaattaagtt

SEQ ID NO: 7114788 - DNA, 22 bp, Homo sapiens
ttccacagatgtatgaagtggt

SEQ ID NO: 7114789 - DNA, 22 bp, Homo sapiens
ttccacagccatcactgttgct

SEQ ID NO: 7114790 - DNA, 22 bp, Homo sapiens
ttccacagatgtatgaagtggt

SEQ ID NO: 7114791 - DNA, 22 bp, Homo sapiens
ttccacagcccaagctggtggc

SEQ ID NO: 7114792 - DNA, 22 bp, Homo sapiens
ttccacagcccaagctggtggc

SEQ ID NO: 7114793 - DNA, 22 bp, Homo sapiens
ttccacaggactaaatgtcatc

SEQ ID NO: 7114794 - DNA, 22 bp, Homo sapiens
ttccacaggtttcagactgttc

SEQ ID NO: 7114795 - DNA, 22 bp, Homo sapiens
ttccacaggtttcagactgttc

SEQ ID NO: 7114796 - DNA, 22 bp, Homo sapiens
ttccacagtcatcctgggaatt

SEQ ID NO: 7114797 - DNA, 22 bp, Homo sapiens
ttccacagtcatcctgggaatt

SEQ ID NO: 7114798 - DNA, 21 bp, Homo sapiens
ttccacagtcctgaggattca

SEQ ID NO: 7114799 - DNA, 21 bp, Homo sapiens
ttccacagtcctgaggattca

SEQ ID NO: 7114800 - DNA, 21 bp, Homo sapiens
ttccacagtgagaactgcaag

SEQ ID NO: 7114801 - DNA, 22 bp, Homo sapiens
ttcctaactggcctttatggat

SEQ ID NO: 7114802 - DNA, 22 bp, Homo sapiens
ttcctaactctggcacctagtc

SEQ ID NO: 7114803 - DNA, 22 bp, Homo sapiens
ttcctaactctggcacctagtc

SEQ ID NO: 7114804 - DNA, 22 bp, Homo sapiens
ttcctaacctctagctgcatat

SEQ ID NO: 7114805 - DNA, 22 bp, Homo sapiens
ttcctaacgccagtattttcat

SEQ ID NO: 7114806 - DNA, 22 bp, Homo sapiens
ttcctaacgccagtattttcat

SEQ ID NO: 7114807 - DNA, 22 bp, Homo sapiens
ttcctaacctctagctgcatat

SEQ ID NO: 7114808 - DNA, 22 bp, Homo sapiens
ttcctaacacagtgtaagcaag

SEQ ID NO: 7114809 - DNA, 22 bp, Homo sapiens
ttcctaacaagtctatctttga

SEQ ID NO: 7114810 - DNA, 22 bp, Homo sapiens
ttcctaacacagtgtaagcaag

SEQ ID NO: 7114811 - DNA, 22 bp, Homo sapiens
ttcctaactggcctttatggat

SEQ ID NO: 7114812 - DNA, 22 bp, Homo sapiens
ttcctaagtccaccccggctct

SEQ ID NO: 7114813 - DNA, 22 bp, Homo sapiens
ttcctaatcacgaacattattt

SEQ ID NO: 7114814 - DNA, 22 bp, Homo sapiens
ttcctaatcacgaacattattt

SEQ ID NO: 7114815 - DNA, 22 bp, Homo sapiens
ttcctaatggcaaaacatgttt

SEQ ID NO: 7114816 - DNA, 22 bp, Homo sapiens
ttcctaatgtctactttagttc

SEQ ID NO: 7114817 - DNA, 22 bp, Homo sapiens
ttcctaacaagtctatctttga

SEQ ID NO: 7114818 - DNA, 22 bp, Homo sapiens
ttccctggggaaggtgaccttt

SEQ ID NO: 7114819 - DNA, 22 bp, Homo sapiens
ttcctaacaaggggtattcatc

SEQ ID NO: 7114820 - DNA, 22 bp, Homo sapiens
ttcctaacaaggggtattcatc

SEQ ID NO: 7114821 - DNA, 22 bp, Homo sapiens
ttccctggccctggcacgctct

SEQ ID NO: 7114822 - DNA, 22 bp, Homo sapiens
ttccctggcatgagtgtaagat

SEQ ID NO: 7114823 - DNA, 22 bp, Homo sapiens
ttccctggaggagtagtgaaat

SEQ ID NO: 7114824 - DNA, 22 bp, Homo sapiens
ttccctggaaagccatgcagtc

SEQ ID NO: 7114825 - DNA, 22 bp, Homo sapiens
ttccctggaaagccatgcagtc

SEQ ID NO: 7114826 - DNA, 22 bp, Homo sapiens
ttccctggaacatcatggtcta

SEQ ID NO: 7114827 - DNA, 22 bp, Homo sapiens
ttccctggaacatcatggtcta

SEQ ID NO: 7114828 - DNA, 22 bp, Homo sapiens
ttccagagcagttttcagatca

SEQ ID NO: 7114829 - DNA, 22 bp, Homo sapiens
ttccagagcccatgctctaggc

SEQ ID NO: 7114830 - DNA, 20 bp, Homo sapiens
ttccagagatctgcatttta

SEQ ID NO: 7114831 - DNA, 22 bp, Homo sapiens
ttccagactatcagcagcagga

SEQ ID NO: 7114832 - DNA, 22 bp, Homo sapiens
ttcctcttatatagccttggcc

SEQ ID NO: 7114833 - DNA, 22 bp, Homo sapiens
ttcctctgtagttgctgatgaa

SEQ ID NO: 7114834 - DNA, 22 bp, Homo sapiens
ttcctctgtagttgctgatgaa

SEQ ID NO: 7114835 - DNA, 22 bp, Homo sapiens
ttcctctgtagttgctgatgaa

SEQ ID NO: 7114836 - DNA, 22 bp, Homo sapiens
ttcctctgtatgctttgctgct

SEQ ID NO: 7114837 - DNA, 22 bp, Homo sapiens
ttcctccagcctggagcacttc

SEQ ID NO: 7114838 - DNA, 22 bp, Homo sapiens
ttcctccagcctggagcacttc

SEQ ID NO: 7114839 - DNA, 22 bp, Homo sapiens
ttcctccagccatgattgtaaa

SEQ ID NO: 7114840 - DNA, 22 bp, Homo sapiens
ttcctcatggggttccttcaga

SEQ ID NO: 7114841 - DNA, 22 bp, Homo sapiens
ttcctcatctgtgcacctcact

SEQ ID NO: 7114842 - DNA, 22 bp, Homo sapiens
ttcctcatctgtgcacctcact

SEQ ID NO: 7114843 - DNA, 22 bp, Homo sapiens
ttcctcatctgtgcacctcact

SEQ ID NO: 7114844 - DNA, 22 bp, Homo sapiens
ttcctcagttagtgcctgaggc

SEQ ID NO: 7114845 - DNA, 22 bp, Homo sapiens
ttcctcatggggttccttcaga

SEQ ID NO: 7114846 - DNA, 18 bp, Homo sapiens
ttcctccacagagcgctg

SEQ ID NO: 7114847 - DNA, 22 bp, Homo sapiens
ttcctccacgtgacaggagcca

SEQ ID NO: 7114848 - DNA, 22 bp, Homo sapiens
ttcctccagaagctgtagggga

SEQ ID NO: 7114849 - DNA, 22 bp, Homo sapiens
ttcctccagaagctgtagggga

SEQ ID NO: 7114850 - DNA, 22 bp, Homo sapiens
ttcctcagttagtgcctgaggc

SEQ ID NO: 7114851 - DNA, 22 bp, Homo sapiens
ttcctcagttagtgcctgaggc

SEQ ID NO: 7114852 - DNA, 22 bp, Homo sapiens
ttcctcagttagtgcctgaggc

SEQ ID NO: 7114853 - DNA, 22 bp, Homo sapiens
ttcctcagttagtgcctgaggc

SEQ ID NO: 7114854 - DNA, 22 bp, Homo sapiens
ttcctcaggtgctacaaagcag

SEQ ID NO: 7114855 - DNA, 22 bp, Homo sapiens
ttcctcaggtgctacaaagcag

SEQ ID NO: 7114856 - DNA, 22 bp, Homo sapiens
ttcctcagtgatggattcaacg

SEQ ID NO: 7114857 - DNA, 22 bp, Homo sapiens
ttcctcagtgcccccatacggt

SEQ ID NO: 7114858 - DNA, 22 bp, Homo sapiens
ttcctcagggcggatgggcagg

SEQ ID NO: 7114859 - DNA, 22 bp, Homo sapiens
ttcctcaggcttccctttgtcc

SEQ ID NO: 7114860 - DNA, 22 bp, Homo sapiens
ttcctcaggcttccctttgtcc

SEQ ID NO: 7114861 - DNA, 22 bp, Homo sapiens
ttcctcagggaggctagcagta

SEQ ID NO: 7114862 - DNA, 22 bp, Homo sapiens
ttcctcagggaggctagcagta

SEQ ID NO: 7114863 - DNA, 22 bp, Homo sapiens
ttcctcagggaggctagcagta

SEQ ID NO: 7114864 - DNA, 22 bp, Homo sapiens
ttcctcaggctgctttcacata

SEQ ID NO: 7114865 - DNA, 22 bp, Homo sapiens
ttcctcaggctgctttcacata

SEQ ID NO: 7114866 - DNA, 22 bp, Homo sapiens
ttcctcagctttagactatgaa

SEQ ID NO: 7114867 - DNA, 22 bp, Homo sapiens
ttcctcaggactgttgacttcc

SEQ ID NO: 7114868 - DNA, 22 bp, Homo sapiens
ttcctcaggactgttgacttcc

SEQ ID NO: 7114869 - DNA, 20 bp, Homo sapiens
ttcctcaggagaggatgtta

SEQ ID NO: 7114870 - DNA, 20 bp, Homo sapiens
ttcctcaggagaggatgtta

SEQ ID NO: 7114871 - DNA, 22 bp, Homo sapiens
ttcctcagctttagactatgaa

SEQ ID NO: 7114872 - DNA, 22 bp, Homo sapiens
ttcctcagctgtttgggctcat

SEQ ID NO: 7114873 - DNA, 22 bp, Homo sapiens
ttcctcagctgtgtcctggcga

SEQ ID NO: 7114874 - DNA, 22 bp, Homo sapiens
ttcctcagccagcacttagggg

SEQ ID NO: 7114875 - DNA, 22 bp, Homo sapiens
ttcctcagctcagcgagagaga

SEQ ID NO: 7114876 - DNA, 22 bp, Homo sapiens
ttcctcagctcagcgagagaga

SEQ ID NO: 7114877 - DNA, 22 bp, Homo sapiens
ttcctcagctggcctgattggg

SEQ ID NO: 7114878 - DNA, 22 bp, Homo sapiens
ttcctcagctggcctgattggg

SEQ ID NO: 7114879 - DNA, 22 bp, Homo sapiens
ttcctcagccaaggctgggatc

SEQ ID NO: 7114880 - DNA, 22 bp, Homo sapiens
ttcctcagccagcacttagggg

SEQ ID NO: 7114881 - DNA, 22 bp, Homo sapiens
ttcctcagccaaggctgggatc

SEQ ID NO: 7114882 - DNA, 22 bp, Homo sapiens
ttcctcagcacaaagccaagat

SEQ ID NO: 7114883 - DNA, 22 bp, Homo sapiens
ttcctcagagggcgctggggaa

SEQ ID NO: 7114884 - DNA, 22 bp, Homo sapiens
ttcctcagagggcgctggggaa

SEQ ID NO: 7114885 - DNA, 22 bp, Homo sapiens
ttcctcagagagacagaaacta

SEQ ID NO: 7114886 - DNA, 22 bp, Homo sapiens
ttcctcagagagacagaaacta

SEQ ID NO: 7114887 - DNA, 22 bp, Homo sapiens
ttcctcagaccctcattgtgag

SEQ ID NO: 7114888 - DNA, 22 bp, Homo sapiens
ttcctcagaccctcattgtgag

SEQ ID NO: 7114889 - DNA, 22 bp, Homo sapiens
ttcctcacctaattgggagggg

SEQ ID NO: 7114890 - DNA, 22 bp, Homo sapiens
ttcctcagaaaatactgtccaa

SEQ ID NO: 7114891 - DNA, 22 bp, Homo sapiens
ttcctcagaaaatactgtccaa

SEQ ID NO: 7114892 - DNA, 22 bp, Homo sapiens
ttcctcagaaaatactgtccaa

SEQ ID NO: 7114893 - DNA, 22 bp, Homo sapiens
ttcctagctataaagctcttcc

SEQ ID NO: 7114894 - DNA, 22 bp, Homo sapiens
ttcctagggcagagccgctggg

SEQ ID NO: 7114895 - DNA, 22 bp, Homo sapiens
ttcctagggcagagccgctggg

SEQ ID NO: 7114896 - DNA, 22 bp, Homo sapiens
ttcctacaattagagcctcttt

SEQ ID NO: 7114897 - DNA, 22 bp, Homo sapiens
ttcctagaatggttagaaaata

SEQ ID NO: 7114898 - DNA, 22 bp, Homo sapiens
ttcctagaatggttagaaaata

SEQ ID NO: 7114899 - DNA, 22 bp, Homo sapiens
ttcctcaacaacttccctacag

SEQ ID NO: 7114900 - DNA, 20 bp, Homo sapiens
ttcctcacaagtccctcggc

SEQ ID NO: 7114901 - DNA, 22 bp, Homo sapiens
ttcctcacactcccccattcga

SEQ ID NO: 7114902 - DNA, 22 bp, Homo sapiens
ttcctcacactcccccattcga

SEQ ID NO: 7114903 - DNA, 22 bp, Homo sapiens
ttcctcacactcccccattcga

SEQ ID NO: 7114904 - DNA, 22 bp, Homo sapiens
tgttattctgatgtgcaggata

SEQ ID NO: 7114905 - DNA, 22 bp, Homo sapiens
tgttattctggccagcaccgtt

SEQ ID NO: 7114906 - DNA, 22 bp, Homo sapiens
tgttattgaggttacttataag

SEQ ID NO: 7114907 - DNA, 22 bp, Homo sapiens
tgttattgaggttacttataag

SEQ ID NO: 7114908 - DNA, 22 bp, Homo sapiens
tgttattctagtggatcacgtc

SEQ ID NO: 7114909 - DNA, 23 bp, Homo sapiens
tgttattccaggttaatgtactt

SEQ ID NO: 7114910 - DNA, 22 bp, Homo sapiens
tgttattgatatctaatgctct

SEQ ID NO: 7114911 - DNA, 22 bp, Homo sapiens
tgttattgatatctaatgctct

SEQ ID NO: 7114912 - DNA, 22 bp, Homo sapiens
tgttattgatatctaatgctct

SEQ ID NO: 7114913 - DNA, 22 bp, Homo sapiens
tgttattgtcgctgcactggga

SEQ ID NO: 7114914 - DNA, 22 bp, Homo sapiens
tgttatttatctgagcatttat

SEQ ID NO: 7114915 - DNA, 22 bp, Homo sapiens
tgttatttatctgagcatttat

SEQ ID NO: 7114916 - DNA, 22 bp, Homo sapiens
tgttatttctttgccatatctt

SEQ ID NO: 7114917 - DNA, 22 bp, Homo sapiens
tgttatttctttgccatatctt

SEQ ID NO: 7114918 - DNA, 22 bp, Homo sapiens
tgttatttgggaaagttgtaca

SEQ ID NO: 7114919 - DNA, 22 bp, Homo sapiens
tgttatttgggaaagttgtaca

SEQ ID NO: 7114920 - DNA, 22 bp, Homo sapiens
tgttatttgggaaagttgtaca

SEQ ID NO: 7114921 - DNA, 22 bp, Homo sapiens
tgttatttatctgagcatttat

SEQ ID NO: 7114922 - DNA, 22 bp, Homo sapiens
tgttatttatctgagcatttat

SEQ ID NO: 7114923 - DNA, 22 bp, Homo sapiens
tgttatttatctgagcatttat

SEQ ID NO: 7114924 - DNA, 22 bp, Homo sapiens
tgttatttatttcacctccaga

SEQ ID NO: 7114925 - DNA, 22 bp, Homo sapiens
tgttatgagtcctcatatacta

SEQ ID NO: 7114926 - DNA, 22 bp, Homo sapiens
tgttatgagaaagacattaggt

SEQ ID NO: 7114927 - DNA, 18 bp, Homo sapiens
tgttatgagactctagga

SEQ ID NO: 7114928 - DNA, 22 bp, Homo sapiens
tgttatgatctcactatgacta

SEQ ID NO: 7114929 - DNA, 21 bp, Homo sapiens
tgttatgtgcttcaagaagtg

SEQ ID NO: 7114930 - DNA, 22 bp, Homo sapiens
tgttatgaacttctagaaaaca

SEQ ID NO: 7114931 - DNA, 19 bp, Homo sapiens
tgttatgactttgcctttt

SEQ ID NO: 7114932 - DNA, 22 bp, Homo sapiens
tgttatgaactgcctatggact

SEQ ID NO: 7114933 - DNA, 22 bp, Homo sapiens
tgttatgaactgcctatggaga

SEQ ID NO: 7114934 - DNA, 22 bp, Homo sapiens
tgttatctggttgtctgattac

SEQ ID NO: 7114935 - DNA, 22 bp, Homo sapiens
tgttatctggttgtctgattac

SEQ ID NO: 7114936 - DNA, 22 bp, Homo sapiens
tgttatctgagcaacgtcgacg

SEQ ID NO: 7114937 - DNA, 22 bp, Homo sapiens
tgttatctcagactgagttact

SEQ ID NO: 7114938 - DNA, 22 bp, Homo sapiens
tgttatcctcagctcacctcta

SEQ ID NO: 7114939 - DNA, 22 bp, Homo sapiens
tgttatcagagagaggtgctgt

SEQ ID NO: 7114940 - DNA, 22 bp, Homo sapiens
tgttatcacttagacatgctag

SEQ ID NO: 7114941 - DNA, 22 bp, Homo sapiens
tgttatcacttgtaaaagcaat

SEQ ID NO: 7114942 - DNA, 22 bp, Homo sapiens
tgttatcacttgtaaaagcaat

SEQ ID NO: 7114943 - DNA, 22 bp, Homo sapiens
tgttatcacttgtaaaagcaat

SEQ ID NO: 7114944 - DNA, 22 bp, Homo sapiens
tgttaaaaatgcagattcctat

SEQ ID NO: 7114945 - DNA, 22 bp, Homo sapiens
tgttaaaaatgcagattcctat

SEQ ID NO: 7114946 - DNA, 22 bp, Homo sapiens
tgttcctaaatatgaatggaga

SEQ ID NO: 7114947 - DNA, 22 bp, Homo sapiens
tgttcagaacaaaggtaaatga

SEQ ID NO: 7114948 - DNA, 22 bp, Homo sapiens
tgttcagaacaaaggtaaatga

SEQ ID NO: 7114949 - DNA, 22 bp, Homo sapiens
tgttcagaacaaaggtaaatga

SEQ ID NO: 7114950 - DNA, 22 bp, Homo sapiens
tgttcagaacaaaggtaaatga

SEQ ID NO: 7114951 - DNA, 22 bp, Homo sapiens
tgttcagaacaaaggtaaatga

SEQ ID NO: 7114952 - DNA, 22 bp, Homo sapiens
tgttcacatgtacatgaatatt

SEQ ID NO: 7114953 - DNA, 22 bp, Homo sapiens
tgttcactggaacacagctgta

SEQ ID NO: 7114954 - DNA, 22 bp, Homo sapiens
tgttcactggaacacagctgta

SEQ ID NO: 7114955 - DNA, 22 bp, Homo sapiens
tgttcagaaaacagataactaa

SEQ ID NO: 7114956 - DNA, 20 bp, Homo sapiens
tgttcagaaatgcagagagg

SEQ ID NO: 7114957 - DNA, 22 bp, Homo sapiens
tgttcctgaatgcctggctggc

SEQ ID NO: 7114958 - DNA, 22 bp, Homo sapiens
tgttcctgacggccaaagaggt

SEQ ID NO: 7114959 - DNA, 21 bp, Homo sapiens
tgttcaaacgtacacatttct

SEQ ID NO: 7114960 - DNA, 22 bp, Homo sapiens
tgttcaaatcttttgcttattt

SEQ ID NO: 7114961 - DNA, 22 bp, Homo sapiens
tgttatttgggaaagttgtaca

SEQ ID NO: 7114962 - DNA, 22 bp, Homo sapiens
tgttatttgggaaagttgtaca

SEQ ID NO: 7114963 - DNA, 21 bp, Homo sapiens
tgttcaaacgtacacatttct

SEQ ID NO: 7114964 - DNA, 22 bp, Homo sapiens
tgttcacaaggtgatgctttga

SEQ ID NO: 7114965 - DNA, 22 bp, Homo sapiens
tgttcacacagtctatacggat

SEQ ID NO: 7114966 - DNA, 22 bp, Homo sapiens
tgttcacatgtacatgaatatt

SEQ ID NO: 7114967 - DNA, 22 bp, Homo sapiens
tgttcacatgtacatgaatatt

SEQ ID NO: 7114968 - DNA, 22 bp, Homo sapiens
tgttcactccatgggaattgtg

SEQ ID NO: 7114969 - DNA, 22 bp, Homo sapiens
tgtgttgtgacattcttggatg

SEQ ID NO: 7114970 - DNA, 22 bp, Homo sapiens
tgtgttgtgacattcttggatg

SEQ ID NO: 7114971 - DNA, 22 bp, Homo sapiens
tgtgttgtgacattcttggatg

SEQ ID NO: 7114972 - DNA, 22 bp, Homo sapiens
tgtgttggaaatagggtctttg

SEQ ID NO: 7114973 - DNA, 22 bp, Homo sapiens
tgtgttggctgccggcacagga

SEQ ID NO: 7114974 - DNA, 22 bp, Homo sapiens
tgtgttggtagatctgaggtct

SEQ ID NO: 7114975 - DNA, 22 bp, Homo sapiens
tgtgttcttaaaagcagtgata

SEQ ID NO: 7114976 - DNA, 22 bp, Homo sapiens
tgtgttcttaaaagcagtgata

SEQ ID NO: 7114977 - DNA, 22 bp, Homo sapiens
tgtgttctggctgtgacagctg

SEQ ID NO: 7114978 - DNA, 22 bp, Homo sapiens
tgtgttctggctgtgacagctg

SEQ ID NO: 7114979 - DNA, 22 bp, Homo sapiens
tgtgttctggaaagctcactga

SEQ ID NO: 7114980 - DNA, 22 bp, Homo sapiens
tgtgttctggaaagctcactga

SEQ ID NO: 7114981 - DNA, 19 bp, Homo sapiens
tgtgttcaaactccatctc

SEQ ID NO: 7114982 - DNA, 22 bp, Homo sapiens
tgtgttaattccacaaacattc

SEQ ID NO: 7114983 - DNA, 22 bp, Homo sapiens
tgtgttatctatctcgatgctt

SEQ ID NO: 7114984 - DNA, 22 bp, Homo sapiens
tgtgtgcagcggcaggtgaagt

SEQ ID NO: 7114985 - DNA, 22 bp, Homo sapiens
tgtgtgcaggcactgtgccaga

SEQ ID NO: 7114986 - DNA, 22 bp, Homo sapiens
tgtgtgcacttaatgcaatcat

SEQ ID NO: 7114987 - DNA, 22 bp, Homo sapiens
tgtgtgcagacagatattactt

SEQ ID NO: 7114988 - DNA, 22 bp, Homo sapiens
tgtgtgcagcctctgtctttgg

SEQ ID NO: 7114989 - DNA, 22 bp, Homo sapiens
tgtgtgcaggcactgtgccaga

SEQ ID NO: 7114990 - DNA, 22 bp, Homo sapiens
tgtgtgcatacacacggtaaca

SEQ ID NO: 7114991 - DNA, 21 bp, Homo sapiens
tgtgtgcatatgcatgtacat

SEQ ID NO: 7114992 - DNA, 21 bp, Homo sapiens
tgtgtgcatatgcatgtacat

SEQ ID NO: 7114993 - DNA, 20 bp, Homo sapiens
tgtgtgcatctgtatgtatt

SEQ ID NO: 7114994 - DNA, 20 bp, Homo sapiens
tgtgtgcatctgtatgtatt

SEQ ID NO: 7114995 - DNA, 22 bp, Homo sapiens
tgtgtgcaattcttaacataca

SEQ ID NO: 7114996 - DNA, 22 bp, Homo sapiens
tgtgtgcacaaagagtacatgg

SEQ ID NO: 7114997 - DNA, 22 bp, Homo sapiens
tgtgtgcacaaagagtacatgg

SEQ ID NO: 7114998 - DNA, 22 bp, Homo sapiens
tgtgtgcacaaagagtacatgg

SEQ ID NO: 7114999 - DNA, 20 bp, Homo sapiens
tgtgtgcacacatgacattc

SEQ ID NO: 7115000 - DNA, 20 bp, Homo sapiens
tgtgtgcacacatgacattc

SEQ ID NO: 7115001 - DNA, 22 bp, Homo sapiens
tgtgtgcacaggagtgtttgaa

SEQ ID NO: 7115002 - DNA, 22 bp, Homo sapiens
tgtgtgcacaggagtgtttgaa

SEQ ID NO: 7115003 - DNA, 22 bp, Homo sapiens
tgtgtgcacatgatttgaaatg

SEQ ID NO: 7115004 - DNA, 22 bp, Homo sapiens
tgtgtgcacatgatttgaaatg

SEQ ID NO: 7115005 - DNA, 22 bp, Homo sapiens
tgtgtgcacgctgggagctgga

SEQ ID NO: 7115006 - DNA, 22 bp, Homo sapiens
tgtgtgcactgccttttgtgga

SEQ ID NO: 7115007 - DNA, 22 bp, Homo sapiens
tgtgtgcacttaatgcaatcat

SEQ ID NO: 7115008 - DNA, 22 bp, Homo sapiens
tgtgttgtgacattcttggatg

SEQ ID NO: 7115009 - DNA, 22 bp, Homo sapiens
tgtgttgttagtaccagcagtc

SEQ ID NO: 7115010 - DNA, 22 bp, Homo sapiens
tgtgttgttttaagctgctgca

SEQ ID NO: 7115011 - DNA, 22 bp, Homo sapiens
tgtgttgttttaagctgctgca

SEQ ID NO: 7115012 - DNA, 22 bp, Homo sapiens
tgtgttgttttaagctgctgca

SEQ ID NO: 7115013 - DNA, 22 bp, Homo sapiens
tgtgttgttttaagctgctgca

SEQ ID NO: 7115014 - DNA, 22 bp, Homo sapiens
tgtgtttaaagaggaagtgaga

SEQ ID NO: 7115015 - DNA, 23 bp, Homo sapiens
tgtgtttacctgaggatcttgtt

SEQ ID NO: 7115016 - DNA, 23 bp, Homo sapiens
tgtgtttacctgaggatcttgtt

SEQ ID NO: 7115017 - DNA, 22 bp, Homo sapiens
tgtgtttacttctatgcagttt

SEQ ID NO: 7115018 - DNA, 22 bp, Homo sapiens
tgtgtttagagagcacattcag

SEQ ID NO: 7115019 - DNA, 22 bp, Homo sapiens
tgtgtttagagagcacattcag

SEQ ID NO: 7115020 - DNA, 22 bp, Homo sapiens
tgtgtttagagagcacattcag

SEQ ID NO: 7115021 - DNA, 22 bp, Homo sapiens
tgtgtttatagtgtatcttcca

SEQ ID NO: 7115022 - DNA, 22 bp, Homo sapiens
tgtgtttatagtgtatcttcca

SEQ ID NO: 7115023 - DNA, 22 bp, Homo sapiens
tgtgtttcagaaccttctttca

SEQ ID NO: 7115024 - DNA, 22 bp, Homo sapiens
tgtgtttcagaaccttctttca

SEQ ID NO: 7115025 - DNA, 22 bp, Homo sapiens
tgtgtttatagtgtatcttcca

SEQ ID NO: 7115026 - DNA, 22 bp, Homo sapiens
tgtgtttctctgaggggtccct

SEQ ID NO: 7115027 - DNA, 22 bp, Homo sapiens
tgtgtttctgagaatcccacct

SEQ ID NO: 7115028 - DNA, 21 bp, Homo sapiens
tgtgtttgagactatgtttcc

SEQ ID NO: 7115029 - DNA, 22 bp, Homo sapiens
tgtgtttcagaaccttctttca

SEQ ID NO: 7115030 - DNA, 21 bp, Homo sapiens
tgtgtttgagactatgtttcc

SEQ ID NO: 7115031 - DNA, 21 bp, Homo sapiens
tgtgtttgagactatgtttcc

SEQ ID NO: 7115032 - DNA, 21 bp, Homo sapiens
tgtgtttgagactatgtttcc

SEQ ID NO: 7115033 - DNA, 22 bp, Homo sapiens
tgtgtttgaggcatgttgcaga

SEQ ID NO: 7115034 - DNA, 22 bp, Homo sapiens
tgtgtttgaggcatgttgcaga

SEQ ID NO: 7115035 - DNA, 22 bp, Homo sapiens
tgtgtttgaggcatgttgcaga

SEQ ID NO: 7115036 - DNA, 21 bp, Homo sapiens
tgtgttttaatgatattctgt

SEQ ID NO: 7115037 - DNA, 21 bp, Homo sapiens
tgtgttttaatgatattctgt

SEQ ID NO: 7115038 - DNA, 22 bp, Homo sapiens
tgtgttttacaaattctcttaa

SEQ ID NO: 7115039 - DNA, 22 bp, Homo sapiens
tgtgttttacaaattctcttaa

SEQ ID NO: 7115040 - DNA, 22 bp, Homo sapiens
tgtgttttacaaattctcttaa

SEQ ID NO: 7115041 - DNA, 22 bp, Homo sapiens
tgtgtttgcaatgggaatgaga

SEQ ID NO: 7115042 - DNA, 22 bp, Homo sapiens
tgtgtttgggggagatgcattt

SEQ ID NO: 7115043 - DNA, 22 bp, Homo sapiens
tgtgtttgggggagatgcattt

SEQ ID NO: 7115044 - DNA, 22 bp, Homo sapiens
tgtgtttgttagactaatgtta

SEQ ID NO: 7115045 - DNA, 22 bp, Homo sapiens
tgtgtttgttagactaatgtta

SEQ ID NO: 7115046 - DNA, 22 bp, Homo sapiens
tgtgttttaaatggaaatttga

SEQ ID NO: 7115047 - DNA, 22 bp, Homo sapiens
tgtgttttaaatggaaatttga

SEQ ID NO: 7115048 - DNA, 22 bp, Homo sapiens
tgtgttttatctattgtatctt

SEQ ID NO: 7115049 - DNA, 22 bp, Homo sapiens
tgtgttttacaaattctcttaa

SEQ ID NO: 7115050 - DNA, 22 bp, Homo sapiens
tgtgttttatctattgtatctt

SEQ ID NO: 7115051 - DNA, 22 bp, Homo sapiens
tgtgttttccagaatggtgttt

SEQ ID NO: 7115052 - DNA, 22 bp, Homo sapiens
tgtgttttccagaatggtgttt

SEQ ID NO: 7115053 - DNA, 22 bp, Homo sapiens
tgtgttttcctccctggcgttt

SEQ ID NO: 7115054 - DNA, 21 bp, Homo sapiens
tgtgttttctctctgggaggt

SEQ ID NO: 7115055 - DNA, 22 bp, Homo sapiens
tgtgttttgaactcatctactg

SEQ ID NO: 7115056 - DNA, 22 bp, Homo sapiens
tgtgttttgaactcatctactg

SEQ ID NO: 7115057 - DNA, 22 bp, Homo sapiens
tgtgttttggaaggaacatgca

SEQ ID NO: 7115058 - DNA, 20 bp, Homo sapiens
tgtgttttgcagggcattta

SEQ ID NO: 7115059 - DNA, 22 bp, Homo sapiens
tgtgttttggaaggaacatgca

SEQ ID NO: 7115060 - DNA, 22 bp, Homo sapiens
tgtgttttgtgtgacccagctc

SEQ ID NO: 7115061 - DNA, 22 bp, Homo sapiens
tgttaaaaatgcagattcctat

SEQ ID NO: 7115062 - DNA, 22 bp, Homo sapiens
tgttctcttttcctgctgagcc

SEQ ID NO: 7115063 - DNA, 22 bp, Homo sapiens
tgttctcttttcctgctgagcc

SEQ ID NO: 7115064 - DNA, 22 bp, Homo sapiens
tgttctgccagcacttctcagc

SEQ ID NO: 7115065 - DNA, 22 bp, Homo sapiens
tgttctcttccacggcgctcgg

SEQ ID NO: 7115066 - DNA, 22 bp, Homo sapiens
tgttctggggttgagagacaat

SEQ ID NO: 7115067 - DNA, 22 bp, Homo sapiens
tgttctgtgcatctagccagta

SEQ ID NO: 7115068 - DNA, 17 bp, Homo sapiens
tgttctgttggaaagca

SEQ ID NO: 7115069 - DNA, 17 bp, Homo sapiens
tgttctgttggaaagca

SEQ ID NO: 7115070 - DNA, 21 bp, Homo sapiens
tgtttaagtactcctttctgg

SEQ ID NO: 7115071 - DNA, 21 bp, Homo sapiens
tgtttaagtactcctttctgg

SEQ ID NO: 7115072 - DNA, 22 bp, Homo sapiens
tgtttaagtagtctcagggcct

SEQ ID NO: 7115073 - DNA, 22 bp, Homo sapiens
tgtttaagtgctggtagggttg

SEQ ID NO: 7115074 - DNA, 22 bp, Homo sapiens
tgtttaagttctgctccttatt

SEQ ID NO: 7115075 - DNA, 22 bp, Homo sapiens
tgtttaataattctatgatagt

SEQ ID NO: 7115076 - DNA, 22 bp, Homo sapiens
tgtttaataattctatgatagt

SEQ ID NO: 7115077 - DNA, 22 bp, Homo sapiens
tgttctcagtaattctatttta

SEQ ID NO: 7115078 - DNA, 22 bp, Homo sapiens
tgttctcattgttttcatccag

SEQ ID NO: 7115079 - DNA, 22 bp, Homo sapiens
tgttctctaagaaaagaagcat

SEQ ID NO: 7115080 - DNA, 22 bp, Homo sapiens
tgttctcactggatgcttcaca

SEQ ID NO: 7115081 - DNA, 22 bp, Homo sapiens
tgttcctgtttctgcgtagttt

SEQ ID NO: 7115082 - DNA, 22 bp, Homo sapiens
tgttccttctggcttttacatc

SEQ ID NO: 7115083 - DNA, 22 bp, Homo sapiens
tgttccttttaaatgagtcagt

SEQ ID NO: 7115084 - DNA, 22 bp, Homo sapiens
tgttccttttactgcatgcgta

SEQ ID NO: 7115085 - DNA, 22 bp, Homo sapiens
tgttctaagctgccaaaatgct

SEQ ID NO: 7115086 - DNA, 22 bp, Homo sapiens
tgtttaataattctatgatagt

SEQ ID NO: 7115087 - DNA, 22 bp, Homo sapiens
tgtttaataattctatgatagt

SEQ ID NO: 7115088 - DNA, 22 bp, Homo sapiens
tgtttaataattctatgatagt

SEQ ID NO: 7115089 - DNA, 22 bp, Homo sapiens
tgtttaataattctatgatagt

SEQ ID NO: 7115090 - DNA, 21 bp, Homo sapiens
tgtttaatacatatttgtgga

SEQ ID NO: 7115091 - DNA, 22 bp, Homo sapiens
tgtttaatcttcaggacagtct

SEQ ID NO: 7115092 - DNA, 22 bp, Homo sapiens
tgtttaatgaagatggtttttc

SEQ ID NO: 7115093 - DNA, 22 bp, Homo sapiens
tgtttaatgaagatggtttttc

SEQ ID NO: 7115094 - DNA, 22 bp, Homo sapiens
tgtttaatctataaaatggaga

SEQ ID NO: 7115095 - DNA, 22 bp, Homo sapiens
tgtttaatctataaaatggaga

SEQ ID NO: 7115096 - DNA, 22 bp, Homo sapiens
tgtttaatgcattgaccttggg

SEQ ID NO: 7115097 - DNA, 22 bp, Homo sapiens
tgtttaattcaccatcatgttc

SEQ ID NO: 7115098 - DNA, 22 bp, Homo sapiens
tgtttaattcaccatcatgttc

SEQ ID NO: 7115099 - DNA, 22 bp, Homo sapiens
tgtttaattcaccatcatgttc

SEQ ID NO: 7115100 - DNA, 22 bp, Homo sapiens
tgtttaattcaccatcatgttc

SEQ ID NO: 7115101 - DNA, 22 bp, Homo sapiens
tgtttaattcaccatcatgttc

SEQ ID NO: 7115102 - DNA, 22 bp, Homo sapiens
tgtttaattgggccaacagcgg

SEQ ID NO: 7115103 - DNA, 22 bp, Homo sapiens
tgtttaattgggccaacagcgg

SEQ ID NO: 7115104 - DNA, 22 bp, Homo sapiens
tgtttaatttcacaaagttgac

SEQ ID NO: 7115105 - DNA, 22 bp, Homo sapiens
tgtttaatttcacaaagttgac

SEQ ID NO: 7115106 - DNA, 22 bp, Homo sapiens
tgtttaatttcacaaagttgac

SEQ ID NO: 7115107 - DNA, 22 bp, Homo sapiens
tgtttaatttttcatgagccaa

SEQ ID NO: 7115108 - DNA, 22 bp, Homo sapiens
tgtttacagggtgattttacct

SEQ ID NO: 7115109 - DNA, 22 bp, Homo sapiens
tgtttacacttcaaggttaagg

SEQ ID NO: 7115110 - DNA, 22 bp, Homo sapiens
tgtttacacttcaaggttaagg

SEQ ID NO: 7115111 - DNA, 22 bp, Homo sapiens
tgtttacacttcaaggttaagg

SEQ ID NO: 7115112 - DNA, 22 bp, Homo sapiens
tgtttacaaggagaatttgagg

SEQ ID NO: 7115113 - DNA, 22 bp, Homo sapiens
tgtttacaaggagaatttgagg

SEQ ID NO: 7115114 - DNA, 22 bp, Homo sapiens
tgtttacaagccacttgttaag

SEQ ID NO: 7115115 - DNA, 22 bp, Homo sapiens
tgtttacaaaaccgtggtactg

SEQ ID NO: 7115116 - DNA, 22 bp, Homo sapiens
tgtttacaaaaccgtggtactg

SEQ ID NO: 7115117 - DNA, 22 bp, Homo sapiens
tgtttacaaggagtttatattg

SEQ ID NO: 7115118 - DNA, 22 bp, Homo sapiens
tgtttacaaggagtttatattg

SEQ ID NO: 7115119 - DNA, 22 bp, Homo sapiens
tgtttacaaggagtttatattg

SEQ ID NO: 7115120 - DNA, 22 bp, Homo sapiens
tgtttacaaggagaatttgagg

SEQ ID NO: 7115121 - DNA, 22 bp, Homo sapiens
tgtttacaaggagtttatattg

SEQ ID NO: 7115122 - DNA, 22 bp, Homo sapiens
tgtttacatgcataagcttaag

SEQ ID NO: 7115123 - DNA, 22 bp, Homo sapiens
tgtttacatgcataagcttaag

SEQ ID NO: 7115124 - DNA, 22 bp, Homo sapiens
tgtttacatgcataagcttaag

SEQ ID NO: 7115125 - DNA, 22 bp, Homo sapiens
tgtttactcactgtatccacaa

SEQ ID NO: 7115126 - DNA, 22 bp, Homo sapiens
tgtttcaactgttaagatatgc

SEQ ID NO: 7115127 - DNA, 22 bp, Homo sapiens
tgtttcaagtttgctcaaagga

SEQ ID NO: 7115128 - DNA, 22 bp, Homo sapiens
tgtttcatgtggacatagttgt

SEQ ID NO: 7115129 - DNA, 22 bp, Homo sapiens
tgtttcatgtggacatagttgt

SEQ ID NO: 7115130 - DNA, 22 bp, Homo sapiens
tgtttcatgaagtctggatatc

SEQ ID NO: 7115131 - DNA, 22 bp, Homo sapiens
tgtttcatgattgctgtcattt

SEQ ID NO: 7115132 - DNA, 22 bp, Homo sapiens
tgtttcatgattgctgtcattt

SEQ ID NO: 7115133 - DNA, 22 bp, Homo sapiens
tgtttcagtccctgtgttcaat

SEQ ID NO: 7115134 - DNA, 22 bp, Homo sapiens
tgtttcagtccctgtgttcaat

SEQ ID NO: 7115135 - DNA, 20 bp, Homo sapiens
tgtttcataagctgtcctat

SEQ ID NO: 7115136 - DNA, 22 bp, Homo sapiens
tgtttcatgaaacatgtttagg

SEQ ID NO: 7115137 - DNA, 22 bp, Homo sapiens
tgtttcatgaaacatgtttagg

SEQ ID NO: 7115138 - DNA, 22 bp, Homo sapiens
tgtttcattagtactgacaata

SEQ ID NO: 7115139 - DNA, 22 bp, Homo sapiens
tgtttccaactgtgatcttact

SEQ ID NO: 7115140 - DNA, 22 bp, Homo sapiens
tgtttccaactgtgatcttact

SEQ ID NO: 7115141 - DNA, 22 bp, Homo sapiens
tgttttctcttgaaaagcagtc

SEQ ID NO: 7115142 - DNA, 22 bp, Homo sapiens
tgttttctcttgaaaagcagtc

SEQ ID NO: 7115143 - DNA, 22 bp, Homo sapiens
tgttttcagtcatatagcaggt

SEQ ID NO: 7115144 - DNA, 22 bp, Homo sapiens
tgttttctcttgaaaagcagtc

SEQ ID NO: 7115145 - DNA, 22 bp, Homo sapiens
tgttttcagatgcagggacaca

SEQ ID NO: 7115146 - DNA, 22 bp, Homo sapiens
tgttttcagatgcagggacaca

SEQ ID NO: 7115147 - DNA, 22 bp, Homo sapiens
tgttttcagatgcagggacaca

SEQ ID NO: 7115148 - DNA, 22 bp, Homo sapiens
tgttttcagtcatatagcaggt

SEQ ID NO: 7115149 - DNA, 22 bp, Homo sapiens
tgttttcagtcatatagcaggt

SEQ ID NO: 7115150 - DNA, 22 bp, Homo sapiens
tgtttgcaaccccttgtgagaa

SEQ ID NO: 7115151 - DNA, 22 bp, Homo sapiens
tgtttgcaaccccttgtgagaa

SEQ ID NO: 7115152 - DNA, 22 bp, Homo sapiens
tgtttgcacattcgtttcaata

SEQ ID NO: 7115153 - DNA, 19 bp, Homo sapiens
tgttttcaagtgggattat

SEQ ID NO: 7115154 - DNA, 22 bp, Homo sapiens
tgttttcacaatgatgtcagat

SEQ ID NO: 7115155 - DNA, 22 bp, Homo sapiens
tgttttcacaatgatgtcagat

SEQ ID NO: 7115156 - DNA, 22 bp, Homo sapiens
tgttttcacaatgatgtcagat

SEQ ID NO: 7115157 - DNA, 22 bp, Homo sapiens
tgttttcacaatgatgtcagat

SEQ ID NO: 7115158 - DNA, 22 bp, Homo sapiens
tgtttgaaaagtggagatttat

SEQ ID NO: 7115159 - DNA, 22 bp, Homo sapiens
tgtttgaaactttgatcactaa

SEQ ID NO: 7115160 - DNA, 22 bp, Homo sapiens
tgtttgaaagcacctacatttt

SEQ ID NO: 7115161 - DNA, 22 bp, Homo sapiens
tgtttgaaagcacctacatttt

SEQ ID NO: 7115162 - DNA, 22 bp, Homo sapiens
tgtttgaactgaataacatagt

SEQ ID NO: 7115163 - DNA, 22 bp, Homo sapiens
tgtttccttctgtctctttgga

SEQ ID NO: 7115164 - DNA, 22 bp, Homo sapiens
tgtttcctaagtgtctctgaag

SEQ ID NO: 7115165 - DNA, 22 bp, Homo sapiens
tgtttcctaagtgtctctgaag

SEQ ID NO: 7115166 - DNA, 22 bp, Homo sapiens
tgtttcttgataaagcagaaaa

SEQ ID NO: 7115167 - DNA, 22 bp, Homo sapiens
tgtttcttgataaagcagaaaa

SEQ ID NO: 7115168 - DNA, 23 bp, Homo sapiens
tgtttctagaatcattgatgtct

SEQ ID NO: 7115169 - DNA, 20 bp, Homo sapiens
tgtttcttttaatgagcggc

SEQ ID NO: 7115170 - DNA, 22 bp, Homo sapiens
tgtttgaaaagtggagatttat

SEQ ID NO: 7115171 - DNA, 22 bp, Homo sapiens
tgtttctttgtagatattcttt

SEQ ID NO: 7115172 - DNA, 22 bp, Homo sapiens
tgtttctttgtagatattcttt

SEQ ID NO: 7115173 - DNA, 22 bp, Homo sapiens
tgtttctttgtagatattcttt

SEQ ID NO: 7115174 - DNA, 22 bp, Homo sapiens
tgtttctttgtagatattcttt

SEQ ID NO: 7115175 - DNA, 22 bp, Homo sapiens
tgtttctttgtagatattcttt

SEQ ID NO: 7115176 - DNA, 20 bp, Homo sapiens
tgtttctttaaggtgagaca

SEQ ID NO: 7115177 - DNA, 22 bp, Homo sapiens
tgtttcttgggtgctcacatca

SEQ ID NO: 7115178 - DNA, 22 bp, Homo sapiens
tgtttcttgggtgctcacatca

SEQ ID NO: 7115179 - DNA, 22 bp, Homo sapiens
tgtttcttgggtgctcacatca

SEQ ID NO: 7115180 - DNA, 22 bp, Homo sapiens
tgtttcttgggtgctcacatca

SEQ ID NO: 7115181 - DNA, 22 bp, Homo sapiens
tccccagtaagcctgcactgtg

SEQ ID NO: 7115182 - DNA, 22 bp, Homo sapiens
tccccaggtcctgtcggctcct

SEQ ID NO: 7115183 - DNA, 22 bp, Homo sapiens
tccccaggtcctgtcggctcct

SEQ ID NO: 7115184 - DNA, 22 bp, Homo sapiens
tccccaggtcctgtcggctcct

SEQ ID NO: 7115185 - DNA, 22 bp, Homo sapiens
tccccaggtcctgtcggctcct

SEQ ID NO: 7115186 - DNA, 22 bp, Homo sapiens
tcccccaactcttagcactgta

SEQ ID NO: 7115187 - DNA, 22 bp, Homo sapiens
tccccatgtctgcagggagggt

SEQ ID NO: 7115188 - DNA, 22 bp, Homo sapiens
tcccccaaatgaatgaggaata

SEQ ID NO: 7115189 - DNA, 22 bp, Homo sapiens
tcccccaaatgaatgaggaata

SEQ ID NO: 7115190 - DNA, 22 bp, Homo sapiens
tcccccactctaaaggagcctt

SEQ ID NO: 7115191 - DNA, 22 bp, Homo sapiens
tcccccactctaaaggagcctt

SEQ ID NO: 7115192 - DNA, 22 bp, Homo sapiens
tcccccaggctggagtgcagtg

SEQ ID NO: 7115193 - DNA, 20 bp, Homo sapiens
tcccccactgtttctgctac

SEQ ID NO: 7115194 - DNA, 17 bp, Homo sapiens
tcccccagggctctctc

SEQ ID NO: 7115195 - DNA, 22 bp, Homo sapiens
tcccccaggctggagtgcagtg

SEQ ID NO: 7115196 - DNA, 22 bp, Homo sapiens
tcccccatcccaaggaggtcat

SEQ ID NO: 7115197 - DNA, 22 bp, Homo sapiens
tccccccagcctttcacatgag

SEQ ID NO: 7115198 - DNA, 22 bp, Homo sapiens
tccccctcattacctcattcaa

SEQ ID NO: 7115199 - DNA, 22 bp, Homo sapiens
tcccctcctctcctgatatggg

SEQ ID NO: 7115200 - DNA, 22 bp, Homo sapiens
tcccctcctgcctttgcggtgg

SEQ ID NO: 7115201 - DNA, 22 bp, Homo sapiens
tcccctccaactccaactatgg

SEQ ID NO: 7115202 - DNA, 22 bp, Homo sapiens
tcccctcccttccaacagagct

SEQ ID NO: 7115203 - DNA, 23 bp, Homo sapiens
tcccctcaggcagccagtgccct

SEQ ID NO: 7115204 - DNA, 23 bp, Homo sapiens
tcccctcaggcagccagtgccct

SEQ ID NO: 7115205 - DNA, 22 bp, Homo sapiens
tcccctgcagatgagggcagtg

SEQ ID NO: 7115206 - DNA, 22 bp, Homo sapiens
tcccctggcacctagtcctact

SEQ ID NO: 7115207 - DNA, 22 bp, Homo sapiens
tgtggacacctattaccagtga

SEQ ID NO: 7115208 - DNA, 22 bp, Homo sapiens
tgtggacactacgataggggaa

SEQ ID NO: 7115209 - DNA, 22 bp, Homo sapiens
tgtggacactagcagatacggt

SEQ ID NO: 7115210 - DNA, 22 bp, Homo sapiens
tgtggacagagcagaaggtcat

SEQ ID NO: 7115211 - DNA, 22 bp, Homo sapiens
tgtggacagagcagaaggtcat

SEQ ID NO: 7115212 - DNA, 22 bp, Homo sapiens
tgtggacagagccctggtttgg

SEQ ID NO: 7115213 - DNA, 22 bp, Homo sapiens
tgtggacagctcttcccatatg

SEQ ID NO: 7115214 - DNA, 22 bp, Homo sapiens
tgtggacagctctttgagtgct

SEQ ID NO: 7115215 - DNA, 22 bp, Homo sapiens
tgtggacagctctttgagtgct

SEQ ID NO: 7115216 - DNA, 22 bp, Homo sapiens
tcccctctctgcgctcccaggt

SEQ ID NO: 7115217 - DNA, 22 bp, Homo sapiens
tcccctctctgcgctcccaggt

SEQ ID NO: 7115218 - DNA, 22 bp, Homo sapiens
tcccctctggaggctgcagggg

SEQ ID NO: 7115219 - DNA, 22 bp, Homo sapiens
tcccctctggaggctgcagggg

SEQ ID NO: 7115220 - DNA, 22 bp, Homo sapiens
tcccctctggttgacccaggag

SEQ ID NO: 7115221 - DNA, 22 bp, Homo sapiens
tcccctctttctggaaacacaa

SEQ ID NO: 7115222 - DNA, 22 bp, Homo sapiens
tgtggactgtgctgccacagtg

SEQ ID NO: 7115223 - DNA, 22 bp, Homo sapiens
tgtggactgaaagaaccggcag

SEQ ID NO: 7115224 - DNA, 22 bp, Homo sapiens
tgtggactgaaagaaccggcag

SEQ ID NO: 7115225 - DNA, 22 bp, Homo sapiens
tgtggactggcgggacgcaatg

SEQ ID NO: 7115226 - DNA, 22 bp, Homo sapiens
tgtggactggcgggacgcaatg

SEQ ID NO: 7115227 - DNA, 22 bp, Homo sapiens
tgtggactctgagatccggaga

SEQ ID NO: 7115228 - DNA, 22 bp, Homo sapiens
tgtggactctgagatccggaga

SEQ ID NO: 7115229 - DNA, 22 bp, Homo sapiens
tgtggactctggagtcagacag

SEQ ID NO: 7115230 - DNA, 22 bp, Homo sapiens
tgtggactctggagtcagacag

SEQ ID NO: 7115231 - DNA, 22 bp, Homo sapiens
tgtggacgtcattaaagcagtg

SEQ ID NO: 7115232 - DNA, 22 bp, Homo sapiens
tgtggacgtcattaaagcagtg

SEQ ID NO: 7115233 - DNA, 22 bp, Homo sapiens
tgtggacgtcattaaagcagtg

SEQ ID NO: 7115234 - DNA, 22 bp, Homo sapiens
tgtggactaagcaagggacata

SEQ ID NO: 7115235 - DNA, 22 bp, Homo sapiens
tgtggactagagaattctgttg

SEQ ID NO: 7115236 - DNA, 22 bp, Homo sapiens
tgtggactagtgtttggatttt

SEQ ID NO: 7115237 - DNA, 22 bp, Homo sapiens
tgtggactagtgtttggatttt

SEQ ID NO: 7115238 - DNA, 20 bp, Homo sapiens
tgtggactcagtttcttgct

SEQ ID NO: 7115239 - DNA, 20 bp, Homo sapiens
tgtggactcagtttcttgct

SEQ ID NO: 7115240 - DNA, 22 bp, Homo sapiens
tgtggactcgcatggctgaggc

SEQ ID NO: 7115241 - DNA, 22 bp, Homo sapiens
tgtggacaggcagttggtggga

SEQ ID NO: 7115242 - DNA, 22 bp, Homo sapiens
tgtggacaggcagttggtggga

SEQ ID NO: 7115243 - DNA, 22 bp, Homo sapiens
tgtggacagtgatccctagtca

SEQ ID NO: 7115244 - DNA, 22 bp, Homo sapiens
tgtggacagtgatccctagtca

SEQ ID NO: 7115245 - DNA, 22 bp, Homo sapiens
tgtggacatactaggcctaggc

SEQ ID NO: 7115246 - DNA, 22 bp, Homo sapiens
tgtggacatactaggcctaggc

SEQ ID NO: 7115247 - DNA, 22 bp, Homo sapiens
tgtggacatactaggcctaggc

SEQ ID NO: 7115248 - DNA, 22 bp, Homo sapiens
tgtggacatagaagcatgtgga

SEQ ID NO: 7115249 - DNA, 22 bp, Homo sapiens
tgtggacatagaagcatgtgga

SEQ ID NO: 7115250 - DNA, 22 bp, Homo sapiens
tgtggacatagaagcatgtgga

SEQ ID NO: 7115251 - DNA, 22 bp, Homo sapiens
tgtggacatagaagcatgtgga

SEQ ID NO: 7115252 - DNA, 18 bp, Homo sapiens
tgtggacatggctcttca

SEQ ID NO: 7115253 - DNA, 22 bp, Homo sapiens
tgtggacattttttgtcagtag

SEQ ID NO: 7115254 - DNA, 22 bp, Homo sapiens
tgtggacattttttgtcagtag

SEQ ID NO: 7115255 - DNA, 22 bp, Homo sapiens
tgtggactttagtaggtgagag

SEQ ID NO: 7115256 - DNA, 22 bp, Homo sapiens
tgtggactgtgctgccacagtg

SEQ ID NO: 7115257 - DNA, 22 bp, Homo sapiens
tgtggacttgaaattacttttc

SEQ ID NO: 7115258 - DNA, 22 bp, Homo sapiens
tgtggacttgaaattacttttc

SEQ ID NO: 7115259 - DNA, 22 bp, Homo sapiens
tgtggactttattttagggagg

SEQ ID NO: 7115260 - DNA, 22 bp, Homo sapiens
tgtggactttggcattggactt

SEQ ID NO: 7115261 - DNA, 22 bp, Homo sapiens
tgtggactttggcattggactt

SEQ ID NO: 7115262 - DNA, 22 bp, Homo sapiens
tgtggagaagaaggccactgca

SEQ ID NO: 7115263 - DNA, 22 bp, Homo sapiens
tgtggagatgtgagcaagggga

SEQ ID NO: 7115264 - DNA, 22 bp, Homo sapiens
tgtggaggattctgatgccagc

SEQ ID NO: 7115265 - DNA, 22 bp, Homo sapiens
tgtggaggattctgatgccagc

SEQ ID NO: 7115266 - DNA, 22 bp, Homo sapiens
tgtggagctcagaagtagcagt

SEQ ID NO: 7115267 - DNA, 22 bp, Homo sapiens
tgtggagatgtgagcaagggga

SEQ ID NO: 7115268 - DNA, 22 bp, Homo sapiens
tgtggagcaattggtggtgtct

SEQ ID NO: 7115269 - DNA, 22 bp, Homo sapiens
tgtggagcccccaggagtgggg

SEQ ID NO: 7115270 - DNA, 21 bp, Homo sapiens
tgtggcagatgttgggaggca

SEQ ID NO: 7115271 - DNA, 21 bp, Homo sapiens
tgtggcagatgttgggaggca

SEQ ID NO: 7115272 - DNA, 21 bp, Homo sapiens
tgtggcagatgttgggaggca

SEQ ID NO: 7115273 - DNA, 21 bp, Homo sapiens
tgtggcagatgttgggaggca

SEQ ID NO: 7115274 - DNA, 21 bp, Homo sapiens
tgtggcagatgttgggaggca

SEQ ID NO: 7115275 - DNA, 22 bp, Homo sapiens
tgtggcagctgctgcaggagct

SEQ ID NO: 7115276 - DNA, 22 bp, Homo sapiens
tgtggcagctgctgcaggagct

SEQ ID NO: 7115277 - DNA, 22 bp, Homo sapiens
tgtggcagctgctgcaggagct

SEQ ID NO: 7115278 - DNA, 22 bp, Homo sapiens
tgtggcagctgctgcaggagct

SEQ ID NO: 7115279 - DNA, 22 bp, Homo sapiens
tgtggcagaggaggcagcgtcc

SEQ ID NO: 7115280 - DNA, 22 bp, Homo sapiens
tgtggcagaggaggcagcgtcc

SEQ ID NO: 7115281 - DNA, 22 bp, Homo sapiens
tgtggcagaggaggcagcgtcc

SEQ ID NO: 7115282 - DNA, 22 bp, Homo sapiens
tgtggcagagtaaggacccagt

SEQ ID NO: 7115283 - DNA, 22 bp, Homo sapiens
tgtggcagaaggctaaggtgtc

SEQ ID NO: 7115284 - DNA, 22 bp, Homo sapiens
tgtggcagaaccagaattcaaa

SEQ ID NO: 7115285 - DNA, 22 bp, Homo sapiens
tgtggcacttacatcctagttt

SEQ ID NO: 7115286 - DNA, 22 bp, Homo sapiens
tgtggcacttctctccttgtaa

SEQ ID NO: 7115287 - DNA, 22 bp, Homo sapiens
tgtggcacttgcaaatattttg

SEQ ID NO: 7115288 - DNA, 22 bp, Homo sapiens
tgtggcacttgcaaatattttg

SEQ ID NO: 7115289 - DNA, 22 bp, Homo sapiens
tgtggcacttctctccttgtaa

SEQ ID NO: 7115290 - DNA, 22 bp, Homo sapiens
tgtggcagaaagcatgtggaca

SEQ ID NO: 7115291 - DNA, 22 bp, Homo sapiens
tgtggcacagaagaaagagagg

SEQ ID NO: 7115292 - DNA, 22 bp, Homo sapiens
tgtggcacatacacaggagggc

SEQ ID NO: 7115293 - DNA, 20 bp, Homo sapiens
tgtggatgaggtaaggatag

SEQ ID NO: 7115294 - DNA, 22 bp, Homo sapiens
tgtggcacagaaagatgaaggg

SEQ ID NO: 7115295 - DNA, 22 bp, Homo sapiens
tgtggataatgcactatccata

SEQ ID NO: 7115296 - DNA, 22 bp, Homo sapiens
tgtggaggattctgatgccagc

SEQ ID NO: 7115297 - DNA, 22 bp, Homo sapiens
tgtggaggattctgatgccagc

SEQ ID NO: 7115298 - DNA, 22 bp, Homo sapiens
tgtggaggattctgatgccagc

SEQ ID NO: 7115299 - DNA, 22 bp, Homo sapiens
tgtggaggattctgatgccagc

SEQ ID NO: 7115300 - DNA, 22 bp, Homo sapiens
tgtggaggtttaagtaatggga

SEQ ID NO: 7115301 - DNA, 22 bp, Homo sapiens
tgtggaggtttaagtaatggga

SEQ ID NO: 7115302 - DNA, 22 bp, Homo sapiens
tgtggccagccacaggcatggt

SEQ ID NO: 7115303 - DNA, 20 bp, Homo sapiens
tgtggccagctctctactgg

SEQ ID NO: 7115304 - DNA, 20 bp, Homo sapiens
tgtggccagctctctactgg

SEQ ID NO: 7115305 - DNA, 20 bp, Homo sapiens
tgtggccagctctctactgg

SEQ ID NO: 7115306 - DNA, 22 bp, Homo sapiens
tgtggccagcaggtggctgtgt

SEQ ID NO: 7115307 - DNA, 22 bp, Homo sapiens
tgtggccagccacaggcatggt

SEQ ID NO: 7115308 - DNA, 22 bp, Homo sapiens
tgtggccagccacaggcatggt

SEQ ID NO: 7115309 - DNA, 22 bp, Homo sapiens
tgtggccagccacaggcatggt

SEQ ID NO: 7115310 - DNA, 22 bp, Homo sapiens
tgtggccaggaaaaggagatgg

SEQ ID NO: 7115311 - DNA, 22 bp, Homo sapiens
tgtggccaggaaaaggagatgg

SEQ ID NO: 7115312 - DNA, 22 bp, Homo sapiens
tgtggccaggaaaaggagatgg

SEQ ID NO: 7115313 - DNA, 22 bp, Homo sapiens
tgtggccaggcccctgatggtg

SEQ ID NO: 7115314 - DNA, 22 bp, Homo sapiens
tgtggccaggcccctgatggtg

SEQ ID NO: 7115315 - DNA, 22 bp, Homo sapiens
tgtggccaggcccctgatggtg

SEQ ID NO: 7115316 - DNA, 22 bp, Homo sapiens
tgtggccagggggccatgtccc

SEQ ID NO: 7115317 - DNA, 22 bp, Homo sapiens
tgtggccagggggccatgtccc

SEQ ID NO: 7115318 - DNA, 22 bp, Homo sapiens
tgtggccagggggccatgtccc

SEQ ID NO: 7115319 - DNA, 22 bp, Homo sapiens
tgtggccataaagcttaaaatg

SEQ ID NO: 7115320 - DNA, 22 bp, Homo sapiens
tgtggccatatactttgttgtg

SEQ ID NO: 7115321 - DNA, 22 bp, Homo sapiens
tgtggccatggtcagaatattg

SEQ ID NO: 7115322 - DNA, 22 bp, Homo sapiens
tgtggccatggtcagaatattg

SEQ ID NO: 7115323 - DNA, 19 bp, Homo sapiens
tgtggccatggttcagctg

SEQ ID NO: 7115324 - DNA, 19 bp, Homo sapiens
tgtggccatggttcagctg

SEQ ID NO: 7115325 - DNA, 20 bp, Homo sapiens
tgtggccatgttccaactca

SEQ ID NO: 7115326 - DNA, 20 bp, Homo sapiens
tgtggccatgttccaactca

SEQ ID NO: 7115327 - DNA, 20 bp, Homo sapiens
tgtggccatgttccaactca

SEQ ID NO: 7115328 - DNA, 20 bp, Homo sapiens
tgtggccatgttccaactca

SEQ ID NO: 7115329 - DNA, 22 bp, Homo sapiens
tgtggccattcttgaggtcgac

SEQ ID NO: 7115330 - DNA, 22 bp, Homo sapiens
tgtggccattcttgaggtcgac

SEQ ID NO: 7115331 - DNA, 22 bp, Homo sapiens
tgtggcccagatgagtgtgcta

SEQ ID NO: 7115332 - DNA, 22 bp, Homo sapiens
tgtggcctagttaaggacgcct

SEQ ID NO: 7115333 - DNA, 22 bp, Homo sapiens
tgtggcctagttaaggacgcct

SEQ ID NO: 7115334 - DNA, 22 bp, Homo sapiens
tgtggcagtataagagctagaa

SEQ ID NO: 7115335 - DNA, 22 bp, Homo sapiens
tgtggcagtctcactggagggc

SEQ ID NO: 7115336 - DNA, 22 bp, Homo sapiens
tgtggcagtctcactggagggc

SEQ ID NO: 7115337 - DNA, 22 bp, Homo sapiens
tgtggcagctgctgcaggagct

SEQ ID NO: 7115338 - DNA, 18 bp, Homo sapiens
tgtggcaggggtgggaga

SEQ ID NO: 7115339 - DNA, 18 bp, Homo sapiens
tgtggcaggggtgggaga

SEQ ID NO: 7115340 - DNA, 22 bp, Homo sapiens
tgtggcagtaaaattgggcaac

SEQ ID NO: 7115341 - DNA, 22 bp, Homo sapiens
tgtggcagtaaaattgggcaac

SEQ ID NO: 7115342 - DNA, 22 bp, Homo sapiens
tgtggcagtaaaattgggcaac

SEQ ID NO: 7115343 - DNA, 22 bp, Homo sapiens
tgtggcagtataagagctagaa

SEQ ID NO: 7115344 - DNA, 22 bp, Homo sapiens
tgtggcagtctcactggagggc

SEQ ID NO: 7115345 - DNA, 22 bp, Homo sapiens
tgtggcagtctcactggagggc

SEQ ID NO: 7115346 - DNA, 22 bp, Homo sapiens
tgtggccaaaataaaatgaggt

SEQ ID NO: 7115347 - DNA, 22 bp, Homo sapiens
tgtggccaccagagctgctatt

SEQ ID NO: 7115348 - DNA, 22 bp, Homo sapiens
tgtggccaccagagctgctatt

SEQ ID NO: 7115349 - DNA, 22 bp, Homo sapiens
tgtggccactgtttcttttcct

SEQ ID NO: 7115350 - DNA, 22 bp, Homo sapiens
tgtggccaccagagctgctatt

SEQ ID NO: 7115351 - DNA, 22 bp, Homo sapiens
tgtggccagaggtactatttta

SEQ ID NO: 7115352 - DNA, 22 bp, Homo sapiens
tgtggccagaggtactatttta

SEQ ID NO: 7115353 - DNA, 22 bp, Homo sapiens
tgtggccagcaggtggctgtgt

SEQ ID NO: 7115354 - DNA, 22 bp, Homo sapiens
tgtggggaggctgcagtgctgc

SEQ ID NO: 7115355 - DNA, 22 bp, Homo sapiens
tgtggggaggctgcagtgctgc

SEQ ID NO: 7115356 - DNA, 19 bp, Homo sapiens
tgtggggagtcagggggct

SEQ ID NO: 7115357 - DNA, 22 bp, Homo sapiens
tgtggggaggctgcagtgctgc

SEQ ID NO: 7115358 - DNA, 19 bp, Homo sapiens
tgtggcctggggacaggcc

SEQ ID NO: 7115359 - DNA, 19 bp, Homo sapiens
tgtggcctggggacaggcc

SEQ ID NO: 7115360 - DNA, 17 bp, Homo sapiens
tgtggccttctgagctt

SEQ ID NO: 7115361 - DNA, 22 bp, Homo sapiens
tgtggggactttcaaagccaat

SEQ ID NO: 7115362 - DNA, 22 bp, Homo sapiens
tgtggcctcaaggctgccctca

SEQ ID NO: 7115363 - DNA, 22 bp, Homo sapiens
tgtggcctccccacttctgggg

SEQ ID NO: 7115364 - DNA, 22 bp, Homo sapiens
tgtggcctcctgttcctgggta

SEQ ID NO: 7115365 - DNA, 22 bp, Homo sapiens
tgtggcctcctgttcctgggta

SEQ ID NO: 7115366 - DNA, 20 bp, Homo sapiens
tgtggcctctagagacagcc

SEQ ID NO: 7115367 - DNA, 20 bp, Homo sapiens
tgtggcctctagagacagcc

SEQ ID NO: 7115368 - DNA, 22 bp, Homo sapiens
tgtggcctctcaggcttgatca

SEQ ID NO: 7115369 - DNA, 22 bp, Homo sapiens
tgtggcctgattttgcatctct

SEQ ID NO: 7115370 - DNA, 22 bp, Homo sapiens
tgtggcctgattttgcatctct

SEQ ID NO: 7115371 - DNA, 22 bp, Homo sapiens
tgtggcctgattttgcatctct

SEQ ID NO: 7115372 - DNA, 23 bp, Homo sapiens
tgtggcctgcagctctggtttgg

SEQ ID NO: 7115373 - DNA, 22 bp, Homo sapiens
tgtggcctggaaggggctgctc

SEQ ID NO: 7115374 - DNA, 22 bp, Homo sapiens
tgtggcctgggaaatgagtgtt

SEQ ID NO: 7115375 - DNA, 22 bp, Homo sapiens
tgtggcctgggagctgaggtct

SEQ ID NO: 7115376 - DNA, 19 bp, Homo sapiens
tgtggtctctgttctcagg

SEQ ID NO: 7115377 - DNA, 22 bp, Homo sapiens
tgtggtcccaaggcaactggaa

SEQ ID NO: 7115378 - DNA, 22 bp, Homo sapiens
tgtggtcccaaggcaactggaa

SEQ ID NO: 7115379 - DNA, 22 bp, Homo sapiens
tgtggtcctctcaactgaaggt

SEQ ID NO: 7115380 - DNA, 22 bp, Homo sapiens
tgtggtctccccagtgccagct

SEQ ID NO: 7115381 - DNA, 22 bp, Homo sapiens
tgtggtgccgagagtctggacg

SEQ ID NO: 7115382 - DNA, 18 bp, Homo sapiens
tgtggtggagctgccttc

SEQ ID NO: 7115383 - DNA, 18 bp, Homo sapiens
tgtggtggagctgccttc

SEQ ID NO: 7115384 - DNA, 22 bp, Homo sapiens
tgtgggtggtaaaatacaatga

SEQ ID NO: 7115385 - DNA, 22 bp, Homo sapiens
tgtgggtggcatcgtcctggcc

SEQ ID NO: 7115386 - DNA, 19 bp, Homo sapiens
tgtggggagtcagggggct

SEQ ID NO: 7115387 - DNA, 19 bp, Homo sapiens
tgtggggagtcagggggct

SEQ ID NO: 7115388 - DNA, 22 bp, Homo sapiens
tgtgggtgctcagagtaccccc

SEQ ID NO: 7115389 - DNA, 22 bp, Homo sapiens
tgtgggtggagtgatattagct

SEQ ID NO: 7115390 - DNA, 22 bp, Homo sapiens
tgtgggtgttctcacttagata

SEQ ID NO: 7115391 - DNA, 22 bp, Homo sapiens
tgtggtagagggcagatgggca

SEQ ID NO: 7115392 - DNA, 22 bp, Homo sapiens
tgtggtagagggcagatgggca

SEQ ID NO: 7115393 - DNA, 22 bp, Homo sapiens
tgtggtagagggcagatgggca

SEQ ID NO: 7115394 - DNA, 22 bp, Homo sapiens
tgtggtagtctcagggcagtat

SEQ ID NO: 7115395 - DNA, 22 bp, Homo sapiens
tgtggtatcaccatccactagt

SEQ ID NO: 7115396 - DNA, 22 bp, Homo sapiens
tgtggtggtaatgagccagatg

SEQ ID NO: 7115397 - DNA, 22 bp, Homo sapiens
tgtggtggtaatgagccagatg

SEQ ID NO: 7115398 - DNA, 22 bp, Homo sapiens
tgtggtgtatcaggaagccaat

SEQ ID NO: 7115399 - DNA, 22 bp, Homo sapiens
tgtggtgtgtctcacaaatgca

SEQ ID NO: 7115400 - DNA, 22 bp, Homo sapiens
tgtggttgaaggttattactta

SEQ ID NO: 7115401 - DNA, 22 bp, Homo sapiens
tgtggtttactgtggcgctgct

SEQ ID NO: 7115402 - DNA, 22 bp, Homo sapiens
tgtggtttttcagttgctggag

SEQ ID NO: 7115403 - DNA, 22 bp, Homo sapiens
tgtggtggctattctggtctca

SEQ ID NO: 7115404 - DNA, 18 bp, Homo sapiens
tgtggtggagctgccttc

SEQ ID NO: 7115405 - DNA, 22 bp, Homo sapiens
tgtggtggctattctggtctca

SEQ ID NO: 7115406 - DNA, 22 bp, Homo sapiens
tgtgtaaagcttgttccagaaa

SEQ ID NO: 7115407 - DNA, 22 bp, Homo sapiens
tgtgtaaaatctgattaatact

SEQ ID NO: 7115408 - DNA, 22 bp, Homo sapiens
tgtgtaaaagattagtttacta

SEQ ID NO: 7115409 - DNA, 22 bp, Homo sapiens
tgtgtaaatggcatctctcagc

SEQ ID NO: 7115410 - DNA, 22 bp, Homo sapiens
tgtgtaaatggactgtgaatta

SEQ ID NO: 7115411 - DNA, 22 bp, Homo sapiens
tgtgtaacaatctacacttagg

SEQ ID NO: 7115412 - DNA, 22 bp, Homo sapiens
tgtgtaagtgccaggcacaagt

SEQ ID NO: 7115413 - DNA, 22 bp, Homo sapiens
tgtgtaatatttcgtggcatgt

SEQ ID NO: 7115414 - DNA, 22 bp, Homo sapiens
tgtgtacaaactaacaacatat

SEQ ID NO: 7115415 - DNA, 22 bp, Homo sapiens
tgtgtcagatttaggctcaaac

SEQ ID NO: 7115416 - DNA, 19 bp, Homo sapiens
tgtgtcagatttgctcctt

SEQ ID NO: 7115417 - DNA, 22 bp, Homo sapiens
tgtgtcagcacagtatcaatta

SEQ ID NO: 7115418 - DNA, 22 bp, Homo sapiens
tgtgtcagcacagtatcaatta

SEQ ID NO: 7115419 - DNA, 22 bp, Homo sapiens
tgtgtcagcaggggagggaact

SEQ ID NO: 7115420 - DNA, 22 bp, Homo sapiens
tgtgtcagcaggggagggaact

SEQ ID NO: 7115421 - DNA, 19 bp, Homo sapiens
tgtgtcagcagggggcttc

SEQ ID NO: 7115422 - DNA, 22 bp, Homo sapiens
tgtgtcagcatcctttgggaca

SEQ ID NO: 7115423 - DNA, 22 bp, Homo sapiens
tgtgtcaggagatagcaaaggg

SEQ ID NO: 7115424 - DNA, 22 bp, Homo sapiens
tgtgtcaggagatagcaaaggg

SEQ ID NO: 7115425 - DNA, 20 bp, Homo sapiens
tgtgtcaggccctgattaaa

SEQ ID NO: 7115426 - DNA, 20 bp, Homo sapiens
tgtgtcaggccctgattaaa

SEQ ID NO: 7115427 - DNA, 22 bp, Homo sapiens
tgtgtcaggccttatcggtggc

SEQ ID NO: 7115428 - DNA, 22 bp, Homo sapiens
tgtgtgagacaattggctgtgg

SEQ ID NO: 7115429 - DNA, 22 bp, Homo sapiens
tgtgtgagacaattggctgtgg

SEQ ID NO: 7115430 - DNA, 22 bp, Homo sapiens
tgtgtgagacaattggctgtgg

SEQ ID NO: 7115431 - DNA, 20 bp, Homo sapiens
tgtgtgaattagggcatgtt

SEQ ID NO: 7115432 - DNA, 20 bp, Homo sapiens
tgtgtgaatttcagagccgc

SEQ ID NO: 7115433 - DNA, 20 bp, Homo sapiens
tgtgtgaatttcagagccgc

SEQ ID NO: 7115434 - DNA, 22 bp, Homo sapiens
tgtgtgacacattgatatgtgc

SEQ ID NO: 7115435 - DNA, 22 bp, Homo sapiens
tgtgtgacacattgatatgtgc

SEQ ID NO: 7115436 - DNA, 22 bp, Homo sapiens
tgtgtgacctggggtgagatag

SEQ ID NO: 7115437 - DNA, 22 bp, Homo sapiens
tgtgtgacctggggtgagatag

SEQ ID NO: 7115438 - DNA, 22 bp, Homo sapiens
tgtgtgattccacttatatggg

SEQ ID NO: 7115439 - DNA, 22 bp, Homo sapiens
tgtgtgattgcacttatatgag

SEQ ID NO: 7115440 - DNA, 22 bp, Homo sapiens
tgtgtgattgcaggagatgtgg

SEQ ID NO: 7115441 - DNA, 22 bp, Homo sapiens
tgtgtgattgcaggagatgtgg

SEQ ID NO: 7115442 - DNA, 22 bp, Homo sapiens
tgtgtgattgcaggagatgtgg

SEQ ID NO: 7115443 - DNA, 22 bp, Homo sapiens
tgtgtgattgcaggagatgtgg

SEQ ID NO: 7115444 - DNA, 19 bp, Homo sapiens
tgtgtgcaaatggaagcca

SEQ ID NO: 7115445 - DNA, 19 bp, Homo sapiens
tgtgtgcaaatggaagcca

SEQ ID NO: 7115446 - DNA, 22 bp, Homo sapiens
tgtgtgcaagtgacattagaaa

SEQ ID NO: 7115447 - DNA, 20 bp, Homo sapiens
tgtgtcttcctttctttatg

SEQ ID NO: 7115448 - DNA, 22 bp, Homo sapiens
tgtgtcttacataattacatgt

SEQ ID NO: 7115449 - DNA, 20 bp, Homo sapiens
tgtgtcttcctttctttatg

SEQ ID NO: 7115450 - DNA, 20 bp, Homo sapiens
tgtgtgaacacggactctgt

SEQ ID NO: 7115451 - DNA, 22 bp, Homo sapiens
tgtgtctttgttccaggtacga

SEQ ID NO: 7115452 - DNA, 22 bp, Homo sapiens
tgtgtctttggcgatgtctgga

SEQ ID NO: 7115453 - DNA, 20 bp, Homo sapiens
tgtgtcttcctttctttatg

SEQ ID NO: 7115454 - DNA, 22 bp, Homo sapiens
tgtgtcctgtgcaaggggatga

SEQ ID NO: 7115455 - DNA, 22 bp, Homo sapiens
tgtgtcctgtccccttgctgct

SEQ ID NO: 7115456 - DNA, 22 bp, Homo sapiens
tgtgtcctgtgatctctagggt

SEQ ID NO: 7115457 - DNA, 22 bp, Homo sapiens
tgtgtcctggtgttaattttat

SEQ ID NO: 7115458 - DNA, 22 bp, Homo sapiens
tgtgtcctgtccccttgctgct

SEQ ID NO: 7115459 - DNA, 22 bp, Homo sapiens
tgtgtcctcatgtggcagagag

SEQ ID NO: 7115460 - DNA, 22 bp, Homo sapiens
tgtgtcctccagggagatgtaa

SEQ ID NO: 7115461 - DNA, 22 bp, Homo sapiens
tgtgtcctcttacctctgaccc

SEQ ID NO: 7115462 - DNA, 22 bp, Homo sapiens
tgtgtcctgcagacagactcag

SEQ ID NO: 7115463 - DNA, 22 bp, Homo sapiens
tgtgtcctgcaggtgctgcctg

SEQ ID NO: 7115464 - DNA, 22 bp, Homo sapiens
tgtgtcctgcagacagactcag

SEQ ID NO: 7115465 - DNA, 22 bp, Homo sapiens
tgtgtcctgcaggtgctgcctg

SEQ ID NO: 7115466 - DNA, 23 bp, Homo sapiens
tgtgtccttaactgtatatacta

SEQ ID NO: 7115467 - DNA, 22 bp, Homo sapiens
tgtgtccttatgaaaatactgt

SEQ ID NO: 7115468 - DNA, 22 bp, Homo sapiens
tgtgtccttccagtttttcctg

SEQ ID NO: 7115469 - DNA, 22 bp, Homo sapiens
tgtgtccttctgggagtcccag

SEQ ID NO: 7115470 - DNA, 22 bp, Homo sapiens
tgtgtcctttctaatgcccaga

SEQ ID NO: 7115471 - DNA, 22 bp, Homo sapiens
tgtgtcctttctaatgcccaga

SEQ ID NO: 7115472 - DNA, 22 bp, Homo sapiens
tgtgtcctttcttaagagtgag

SEQ ID NO: 7115473 - DNA, 22 bp, Homo sapiens
tgtgtcctttggaggatcagcg

SEQ ID NO: 7115474 - DNA, 22 bp, Homo sapiens
tgtgtcctttggaggatcagcg

SEQ ID NO: 7115475 - DNA, 22 bp, Homo sapiens
tgtgtctaggctcatgcttgct

SEQ ID NO: 7115476 - DNA, 22 bp, Homo sapiens
tgtgtctcaagtcagagcatca

SEQ ID NO: 7115477 - DNA, 22 bp, Homo sapiens
tgtgtctgttttgctcaccatt

SEQ ID NO: 7115478 - DNA, 22 bp, Homo sapiens
tgtgtcaggccttatcggtggc

SEQ ID NO: 7115479 - DNA, 21 bp, Homo sapiens
tgtgtcagtctttggaagcaa

SEQ ID NO: 7115480 - DNA, 22 bp, Homo sapiens
tgtgtcatattagtattgagag

SEQ ID NO: 7115481 - DNA, 22 bp, Homo sapiens
tgtgtcatctgtgttacataat

SEQ ID NO: 7115482 - DNA, 22 bp, Homo sapiens
tgtgtccaacccagggacaagt

SEQ ID NO: 7115483 - DNA, 22 bp, Homo sapiens
tgtgtccaacccagggacaagt

SEQ ID NO: 7115484 - DNA, 22 bp, Homo sapiens
tgtgtccactgaatgtgtatta

SEQ ID NO: 7115485 - DNA, 20 bp, Homo sapiens
tgtgtccatcatctgggcac

SEQ ID NO: 7115486 - DNA, 22 bp, Homo sapiens
tgtgtccatctgacaggagagg

SEQ ID NO: 7115487 - DNA, 22 bp, Homo sapiens
tgtgtccattcaggcactgacc

SEQ ID NO: 7115488 - DNA, 22 bp, Homo sapiens
tgtgtcctactgaggagctcct

SEQ ID NO: 7115489 - DNA, 19 bp, Homo sapiens
tgtgtcctagcagccagtc

SEQ ID NO: 7115490 - DNA, 19 bp, Homo sapiens
tgtgtcctagcagccagtc

SEQ ID NO: 7115491 - DNA, 19 bp, Homo sapiens
tgtgtcctagcagccagtc

SEQ ID NO: 7115492 - DNA, 19 bp, Homo sapiens
tgtgtcctagcagccagtc

SEQ ID NO: 7115493 - DNA, 22 bp, Homo sapiens
tgtgtcctatgaaagagggtta

SEQ ID NO: 7115494 - DNA, 22 bp, Homo sapiens
tgtgtcctcactgtatgcaagg

SEQ ID NO: 7115495 - DNA, 22 bp, Homo sapiens
tgtgtcctcagggaagcagaga

SEQ ID NO: 7115496 - DNA, 22 bp, Homo sapiens
tgtgtcctcagggaagcagaga

SEQ ID NO: 7115497 - DNA, 22 bp, Homo sapiens
tgtgtcctcatgaggtttgcag

SEQ ID NO: 7115498 - DNA, 22 bp, Homo sapiens
ttaattatgcaaaaggccccat

SEQ ID NO: 7115499 - DNA, 22 bp, Homo sapiens
ttaattcagtcaaagaaaccat

SEQ ID NO: 7115500 - DNA, 22 bp, Homo sapiens
ttaattatgagaaagggaaaag

SEQ ID NO: 7115501 - DNA, 22 bp, Homo sapiens
ttaattagagctgatgttcata

SEQ ID NO: 7115502 - DNA, 22 bp, Homo sapiens
ttaattagtagaggcatttagt

SEQ ID NO: 7115503 - DNA, 22 bp, Homo sapiens
ttaattatgagaaagggaaaag

SEQ ID NO: 7115504 - DNA, 22 bp, Homo sapiens
ttaattacaaaacacataggtt

SEQ ID NO: 7115505 - DNA, 22 bp, Homo sapiens
ttaattactaagcacaatgcaa

SEQ ID NO: 7115506 - DNA, 22 bp, Homo sapiens
ttaattactaagcacaatgcaa

SEQ ID NO: 7115507 - DNA, 22 bp, Homo sapiens
ttaattagagctgatgttcata

SEQ ID NO: 7115508 - DNA, 22 bp, Homo sapiens
ttaataaacaggtgcagctgaa

SEQ ID NO: 7115509 - DNA, 22 bp, Homo sapiens
ttaataaagtatgaattggaaa

SEQ ID NO: 7115510 - DNA, 22 bp, Homo sapiens
ttaataaagtatgaattggaaa

SEQ ID NO: 7115511 - DNA, 22 bp, Homo sapiens
ttaataaacaggtgcagctgaa

SEQ ID NO: 7115512 - DNA, 22 bp, Homo sapiens
ttaataaacaggtgcagctgaa

SEQ ID NO: 7115513 - DNA, 22 bp, Homo sapiens
ttaataaacaggtgcagctgaa

SEQ ID NO: 7115514 - DNA, 22 bp, Homo sapiens
ttaatttatacataatcacagg

SEQ ID NO: 7115515 - DNA, 22 bp, Homo sapiens
ttaatttatacataatcacagg

SEQ ID NO: 7115516 - DNA, 22 bp, Homo sapiens
ttaattgttggaaatagattat

SEQ ID NO: 7115517 - DNA, 22 bp, Homo sapiens
ttaattgttggaaatagattat

SEQ ID NO: 7115518 - DNA, 22 bp, Homo sapiens
ttaatttaagaaacggcaggcc

SEQ ID NO: 7115519 - DNA, 22 bp, Homo sapiens
ttaatttaagaaacggcaggcc

SEQ ID NO: 7115520 - DNA, 22 bp, Homo sapiens
ttaatttatacataatcacagg

SEQ ID NO: 7115521 - DNA, 22 bp, Homo sapiens
ttaatttatacataatcacagg

SEQ ID NO: 7115522 - DNA, 22 bp, Homo sapiens
ttaatttatacataatcacagg

SEQ ID NO: 7115523 - DNA, 22 bp, Homo sapiens
ttaatttatacataatcacagg

SEQ ID NO: 7115524 - DNA, 22 bp, Homo sapiens
ttaatttatacataatcacagg

SEQ ID NO: 7115525 - DNA, 22 bp, Homo sapiens
ttaatttatgtccaaaccagat

SEQ ID NO: 7115526 - DNA, 22 bp, Homo sapiens
ttaatttatgtccaaaccagat

SEQ ID NO: 7115527 - DNA, 22 bp, Homo sapiens
ttaatttatgtccaaaccagat

SEQ ID NO: 7115528 - DNA, 22 bp, Homo sapiens
ttaattgagccagaaagtatct

SEQ ID NO: 7115529 - DNA, 22 bp, Homo sapiens
ttaattgagccagaaagtatct

SEQ ID NO: 7115530 - DNA, 22 bp, Homo sapiens
ttaattctagtttaacacttag

SEQ ID NO: 7115531 - DNA, 22 bp, Homo sapiens
ttaattctagtttaacacttag

SEQ ID NO: 7115532 - DNA, 22 bp, Homo sapiens
ttaattctagtttaacacttag

SEQ ID NO: 7115533 - DNA, 22 bp, Homo sapiens
ttaattgatataaagaacttca

SEQ ID NO: 7115534 - DNA, 22 bp, Homo sapiens
ttaattgatataaagaacttca

SEQ ID NO: 7115535 - DNA, 22 bp, Homo sapiens
ttaattggcctcttagaggtta

SEQ ID NO: 7115536 - DNA, 22 bp, Homo sapiens
ttaattgggtgcaacagctgaa

SEQ ID NO: 7115537 - DNA, 22 bp, Homo sapiens
ttaattgtaaagtttgcctgtt

SEQ ID NO: 7115538 - DNA, 22 bp, Homo sapiens
ttaattgtctgtgagtacctga

SEQ ID NO: 7115539 - DNA, 22 bp, Homo sapiens
ttaattgttggaaatagattat

SEQ ID NO: 7115540 - DNA, 22 bp, Homo sapiens
ttaaggtgctttatttagctct

SEQ ID NO: 7115541 - DNA, 17 bp, Homo sapiens
ttaaggtggatcagcac

SEQ ID NO: 7115542 - DNA, 17 bp, Homo sapiens
ttaaggtggatcagcac

SEQ ID NO: 7115543 - DNA, 22 bp, Homo sapiens
ttaaggttcagaaatcaatacc

SEQ ID NO: 7115544 - DNA, 22 bp, Homo sapiens
ttaaggttgagctcacttttat

SEQ ID NO: 7115545 - DNA, 22 bp, Homo sapiens
ttaagggccattatggatgggt

SEQ ID NO: 7115546 - DNA, 22 bp, Homo sapiens
ttaaggtagtcagcctctgtgt

SEQ ID NO: 7115547 - DNA, 21 bp, Homo sapiens
ttaaggtcacttctgagccta

SEQ ID NO: 7115548 - DNA, 22 bp, Homo sapiens
ttaaggctggtcccctctgcgt

SEQ ID NO: 7115549 - DNA, 22 bp, Homo sapiens
ttaaggctggtcccctctgcgt

SEQ ID NO: 7115550 - DNA, 22 bp, Homo sapiens
ttaaggattagtcaaagagggc

SEQ ID NO: 7115551 - DNA, 22 bp, Homo sapiens
ttaagtgagcttgaataatctt

SEQ ID NO: 7115552 - DNA, 22 bp, Homo sapiens
ttaagtcacttatctaaagaca

SEQ ID NO: 7115553 - DNA, 22 bp, Homo sapiens
ttaagtcacttatctaaagaca

SEQ ID NO: 7115554 - DNA, 22 bp, Homo sapiens
ttaagtcacttatctaaagaca

SEQ ID NO: 7115555 - DNA, 22 bp, Homo sapiens
ttaagtcatttctgattataga

SEQ ID NO: 7115556 - DNA, 22 bp, Homo sapiens
ttaagtaagaccttatgtcttg

SEQ ID NO: 7115557 - DNA, 22 bp, Homo sapiens
ttaagtaagaccttatgtcttg

SEQ ID NO: 7115558 - DNA, 22 bp, Homo sapiens
ttaagtatatccatttgactgg

SEQ ID NO: 7115559 - DNA, 22 bp, Homo sapiens
ttaagtatatccatttgactgg

SEQ ID NO: 7115560 - DNA, 22 bp, Homo sapiens
ttaagtcaatatcaatctcagc

SEQ ID NO: 7115561 - DNA, 22 bp, Homo sapiens
ttaagtcaatatcaatctcagc

SEQ ID NO: 7115562 - DNA, 22 bp, Homo sapiens
ttaagtgcctacttgtgagtta

SEQ ID NO: 7115563 - DNA, 22 bp, Homo sapiens
ttaagtgcaaaaatgaaagtat

SEQ ID NO: 7115564 - DNA, 22 bp, Homo sapiens
ttaagtgcacaatgaggtcaca

SEQ ID NO: 7115565 - DNA, 22 bp, Homo sapiens
ttaagtgcaaaaatgaaagtat

SEQ ID NO: 7115566 - DNA, 22 bp, Homo sapiens
ttaagtgtcataatttccaaga

SEQ ID NO: 7115567 - DNA, 22 bp, Homo sapiens
ttaagtgtgtattatctcatta

SEQ ID NO: 7115568 - DNA, 22 bp, Homo sapiens
ttaagtgtttagtaagagatgt

SEQ ID NO: 7115569 - DNA, 22 bp, Homo sapiens
ttaagttttaaagctagagtct

SEQ ID NO: 7115570 - DNA, 22 bp, Homo sapiens
ttaacttgtcagaaaatacagt

SEQ ID NO: 7115571 - DNA, 22 bp, Homo sapiens
ttaacttgtcagaaaatacagt

SEQ ID NO: 7115572 - DNA, 20 bp, Homo sapiens
ttaagaaaagcacatcctgc

SEQ ID NO: 7115573 - DNA, 22 bp, Homo sapiens
ttaagaagccacacacctcttt

SEQ ID NO: 7115574 - DNA, 21 bp, Homo sapiens
ttaagacacacagattaagga

SEQ ID NO: 7115575 - DNA, 22 bp, Homo sapiens
ttaagaatggaatgaggaattt

SEQ ID NO: 7115576 - DNA, 22 bp, Homo sapiens
ttaagaatggaatgaggaattt

SEQ ID NO: 7115577 - DNA, 22 bp, Homo sapiens
ttaagaaggtactcaaagatct

SEQ ID NO: 7115578 - DNA, 22 bp, Homo sapiens
ttaagaatggaatgaggaattt

SEQ ID NO: 7115579 - DNA, 22 bp, Homo sapiens
ttaagaatggaatgaggaattt

SEQ ID NO: 7115580 - DNA, 22 bp, Homo sapiens
ttaagagatttaggaacattat

SEQ ID NO: 7115581 - DNA, 22 bp, Homo sapiens
ttaagagcaacatatggtgaca

SEQ ID NO: 7115582 - DNA, 22 bp, Homo sapiens
ttaagagaagagtatctagaac

SEQ ID NO: 7115583 - DNA, 22 bp, Homo sapiens
ttaagagaagagtatctagaac

SEQ ID NO: 7115584 - DNA, 22 bp, Homo sapiens
ttaagagaagagtatctagaac

SEQ ID NO: 7115585 - DNA, 22 bp, Homo sapiens
ttaagagaagagtatctagaac

SEQ ID NO: 7115586 - DNA, 22 bp, Homo sapiens
ttaagagacaggagaatgatgt

SEQ ID NO: 7115587 - DNA, 22 bp, Homo sapiens
ttaagagacaggagaatgatgt

SEQ ID NO: 7115588 - DNA, 22 bp, Homo sapiens
ttaagacatttttggagattat

SEQ ID NO: 7115589 - DNA, 21 bp, Homo sapiens
ttaagacctgcatcatcatta

SEQ ID NO: 7115590 - DNA, 22 bp, Homo sapiens
ttaagacttttcaaaggcaaac

SEQ ID NO: 7115591 - DNA, 22 bp, Homo sapiens
ttaacatgtcttgacttcatct

SEQ ID NO: 7115592 - DNA, 22 bp, Homo sapiens
ttaacatgtcttgacttcatct

SEQ ID NO: 7115593 - DNA, 22 bp, Homo sapiens
ttaacattaaaagcagcatttt

SEQ ID NO: 7115594 - DNA, 22 bp, Homo sapiens
ttaacattgtccttagcagatt

SEQ ID NO: 7115595 - DNA, 22 bp, Homo sapiens
ttaacattgtccttagcagatt

SEQ ID NO: 7115596 - DNA, 22 bp, Homo sapiens
ttaacatttagtgtacccctgt

SEQ ID NO: 7115597 - DNA, 22 bp, Homo sapiens
ttaacatttcttttccactcat

SEQ ID NO: 7115598 - DNA, 22 bp, Homo sapiens
ttaacatttgtgaagcatttag

SEQ ID NO: 7115599 - DNA, 22 bp, Homo sapiens
ttaacatttgtgaagcatttag

SEQ ID NO: 7115600 - DNA, 22 bp, Homo sapiens
ttaaccaaataaaagcagactc

SEQ ID NO: 7115601 - DNA, 22 bp, Homo sapiens
ttaaccaggacatcagatggct

SEQ ID NO: 7115602 - DNA, 22 bp, Homo sapiens
ttaaccaggacatcagatggct

SEQ ID NO: 7115603 - DNA, 22 bp, Homo sapiens
ttaaccagtacttattgagcac

SEQ ID NO: 7115604 - DNA, 22 bp, Homo sapiens
ttaacgaattgtgcataattcc

SEQ ID NO: 7115605 - DNA, 22 bp, Homo sapiens
ttaactgctaccattattttcc

SEQ ID NO: 7115606 - DNA, 22 bp, Homo sapiens
ttaactggggaagcatttcatg

SEQ ID NO: 7115607 - DNA, 22 bp, Homo sapiens
ttaactgttccaaatgctgtag

SEQ ID NO: 7115608 - DNA, 22 bp, Homo sapiens
ttaacacatccctgctctaccc

SEQ ID NO: 7115609 - DNA, 22 bp, Homo sapiens
ttaacacttgaactctacatgt

SEQ ID NO: 7115610 - DNA, 22 bp, Homo sapiens
ttaacagacatatatatttgta

SEQ ID NO: 7115611 - DNA, 22 bp, Homo sapiens
ttaacagagaacatagaagtag

SEQ ID NO: 7115612 - DNA, 22 bp, Homo sapiens
ttaacagaggacacatcaaact

SEQ ID NO: 7115613 - DNA, 22 bp, Homo sapiens
ttaacagaggacacatcaaact

SEQ ID NO: 7115614 - DNA, 22 bp, Homo sapiens
ttaacatacatcatgaacaatg

SEQ ID NO: 7115615 - DNA, 22 bp, Homo sapiens
ttaacatacatcatgaacaatg

SEQ ID NO: 7115616 - DNA, 22 bp, Homo sapiens
ttaacagcttgtaatagaaggg

SEQ ID NO: 7115617 - DNA, 22 bp, Homo sapiens
ttaacaggttatattgtacagg

SEQ ID NO: 7115618 - DNA, 22 bp, Homo sapiens
ttaacaggttatattgtacagg

SEQ ID NO: 7115619 - DNA, 22 bp, Homo sapiens
tgttttgttcactgcattgtcc

SEQ ID NO: 7115620 - DNA, 19 bp, Homo sapiens
tgttttgttaaagcagtcc

SEQ ID NO: 7115621 - DNA, 19 bp, Homo sapiens
tgttttgttaaagcagtcc

SEQ ID NO: 7115622 - DNA, 22 bp, Homo sapiens
tgttttgtctaatctaaattct

SEQ ID NO: 7115623 - DNA, 22 bp, Homo sapiens
tgttttgtccttttctatatac

SEQ ID NO: 7115624 - DNA, 22 bp, Homo sapiens
tgttttgtctaatctaaattct

SEQ ID NO: 7115625 - DNA, 22 bp, Homo sapiens
tgttttgtgcacttctatagca

SEQ ID NO: 7115626 - DNA, 22 bp, Homo sapiens
tgttttgtgcatttacaacatg

SEQ ID NO: 7115627 - DNA, 22 bp, Homo sapiens
tgttttgtgcatttacaacatg

SEQ ID NO: 7115628 - DNA, 22 bp, Homo sapiens
tgttttgtgcatttacaacatg

SEQ ID NO: 7115629 - DNA, 23 bp, Homo sapiens
tgttttcttgtcctggtataatt

SEQ ID NO: 7115630 - DNA, 23 bp, Homo sapiens
tgttttcttgtcctggtataatt

SEQ ID NO: 7115631 - DNA, 22 bp, Homo sapiens
tgttttgcttctctgtttccca

SEQ ID NO: 7115632 - DNA, 22 bp, Homo sapiens
tgttttggaggtcctcactaga

SEQ ID NO: 7115633 - DNA, 22 bp, Homo sapiens
tgttttggagtggactttgcat

SEQ ID NO: 7115634 - DNA, 22 bp, Homo sapiens
tgttttgggtcactttccttgg

SEQ ID NO: 7115635 - DNA, 22 bp, Homo sapiens
tgttttggtggtacatgctgga

SEQ ID NO: 7115636 - DNA, 22 bp, Homo sapiens
tgttttggtggtctataggaaa

SEQ ID NO: 7115637 - DNA, 22 bp, Homo sapiens
tgttttgtagctaatagctatt

SEQ ID NO: 7115638 - DNA, 22 bp, Homo sapiens
tgttttgtagctaatagctatt

SEQ ID NO: 7115639 - DNA, 22 bp, Homo sapiens
tgttttgtccttttctatatac

SEQ ID NO: 7115640 - DNA, 22 bp, Homo sapiens
tgttttgtccttttctatatac

SEQ ID NO: 7115641 - DNA, 22 bp, Homo sapiens
tgttttctgtgtagagatcaca

SEQ ID NO: 7115642 - DNA, 22 bp, Homo sapiens
tgttttctgtgtagagatcaca

SEQ ID NO: 7115643 - DNA, 22 bp, Homo sapiens
tgttttctgggtggaaggtact

SEQ ID NO: 7115644 - DNA, 22 bp, Homo sapiens
tgttttctgggtggaaggtact

SEQ ID NO: 7115645 - DNA, 22 bp, Homo sapiens
tgttttctgtgtagagatcaca

SEQ ID NO: 7115646 - DNA, 22 bp, Homo sapiens
tgttttctgtgtagagatcaca

SEQ ID NO: 7115647 - DNA, 22 bp, Homo sapiens
tgttttcttcctaattgctcat

SEQ ID NO: 7115648 - DNA, 22 bp, Homo sapiens
tgttttcttcctaattgctcat

SEQ ID NO: 7115649 - DNA, 22 bp, Homo sapiens
tgttttcttcctaattgctcat

SEQ ID NO: 7115650 - DNA, 22 bp, Homo sapiens
tgttttcttcctaattgctcat

SEQ ID NO: 7115651 - DNA, 22 bp, Homo sapiens
tgttttcttctgtaccgtgcca

SEQ ID NO: 7115652 - DNA, 22 bp, Homo sapiens
tgttttcttctgtaccgtgcca

SEQ ID NO: 7115653 - DNA, 22 bp, Homo sapiens
tgttttcttctgtaccgtgcca

SEQ ID NO: 7115654 - DNA, 22 bp, Homo sapiens
tgttttctgatggttaatgagt

SEQ ID NO: 7115655 - DNA, 22 bp, Homo sapiens
tgttttctgatggttaatgagt

SEQ ID NO: 7115656 - DNA, 22 bp, Homo sapiens
tgttttctgatggttaatgagt

SEQ ID NO: 7115657 - DNA, 22 bp, Homo sapiens
tgttttctgatggttaatgagt

SEQ ID NO: 7115658 - DNA, 22 bp, Homo sapiens
tgttttctgattctcgtgtggt

SEQ ID NO: 7115659 - DNA, 22 bp, Homo sapiens
tgttttctgatggttaatgagt

SEQ ID NO: 7115660 - DNA, 22 bp, Homo sapiens
tgttttctgattctcgtgtggt

SEQ ID NO: 7115661 - DNA, 22 bp, Homo sapiens
tgttttctgattctcgtgtggt

SEQ ID NO: 7115662 - DNA, 17 bp, Homo sapiens
tgttttctgctaccttt

SEQ ID NO: 7115663 - DNA, 17 bp, Homo sapiens
tgttttctgctaccttt

SEQ ID NO: 7115664 - DNA, 17 bp, Homo sapiens
tgttttctgctaccttt

SEQ ID NO: 7115665 - DNA, 17 bp, Homo sapiens
tgttttctgctaccttt

SEQ ID NO: 7115666 - DNA, 22 bp, Homo sapiens
tgttttctgggtggaaggtact

SEQ ID NO: 7115667 - DNA, 22 bp, Homo sapiens
ttaaatattttcagcagggtca

SEQ ID NO: 7115668 - DNA, 22 bp, Homo sapiens
ttaaatattttcagcagggtca

SEQ ID NO: 7115669 - DNA, 22 bp, Homo sapiens
ttaaatattttcagcagggtca

SEQ ID NO: 7115670 - DNA, 22 bp, Homo sapiens
ttaaatattatgttgtctgcaa

SEQ ID NO: 7115671 - DNA, 22 bp, Homo sapiens
ttaaatattatgttgtctgcaa

SEQ ID NO: 7115672 - DNA, 22 bp, Homo sapiens
ttaaatattatgttgtctgcaa

SEQ ID NO: 7115673 - DNA, 22 bp, Homo sapiens
ttaaatattatgttgtctgcaa

SEQ ID NO: 7115674 - DNA, 22 bp, Homo sapiens
ttaaatattatgttgtctgcaa

SEQ ID NO: 7115675 - DNA, 22 bp, Homo sapiens
ttaaatattatgttgtctgcaa

SEQ ID NO: 7115676 - DNA, 22 bp, Homo sapiens
ttaaatagtcaaatcagtggca

SEQ ID NO: 7115677 - DNA, 22 bp, Homo sapiens
ttaaatattatgttgtctgcaa

SEQ ID NO: 7115678 - DNA, 22 bp, Homo sapiens
ttaaatattatgttgtctgcaa

SEQ ID NO: 7115679 - DNA, 22 bp, Homo sapiens
ttaaatagtcaaatcagtggca

SEQ ID NO: 7115680 - DNA, 22 bp, Homo sapiens
ttaaatagtcaaatcagtggca

SEQ ID NO: 7115681 - DNA, 21 bp, Homo sapiens
ttaaagcctccctcataagga

SEQ ID NO: 7115682 - DNA, 22 bp, Homo sapiens
ttaaagcatgttgcttaacagg

SEQ ID NO: 7115683 - DNA, 22 bp, Homo sapiens
ttaaagccatctagattttgag

SEQ ID NO: 7115684 - DNA, 21 bp, Homo sapiens
ttaaagcctccctcataagga

SEQ ID NO: 7115685 - DNA, 22 bp, Homo sapiens
ttaaagcctgactgtggactac

SEQ ID NO: 7115686 - DNA, 22 bp, Homo sapiens
ttaaagctaggtggaacaaatt

SEQ ID NO: 7115687 - DNA, 22 bp, Homo sapiens
tgtttttaaataatgatagaaa

SEQ ID NO: 7115688 - DNA, 22 bp, Homo sapiens
tgtttttaaataatgatagaaa

SEQ ID NO: 7115689 - DNA, 22 bp, Homo sapiens
tgttttgtttatgagagcacag

SEQ ID NO: 7115690 - DNA, 22 bp, Homo sapiens
tgtttttaaaatgtcctggtta

SEQ ID NO: 7115691 - DNA, 22 bp, Homo sapiens
tgtttttaaaatgtcctggtta

SEQ ID NO: 7115692 - DNA, 22 bp, Homo sapiens
tgtttttatctctgtgtacaac

SEQ ID NO: 7115693 - DNA, 22 bp, Homo sapiens
tgtttttatctctgtgtacaac

SEQ ID NO: 7115694 - DNA, 22 bp, Homo sapiens
ttaaagccatctagattttgag

SEQ ID NO: 7115695 - DNA, 22 bp, Homo sapiens
ttaaagcatgttgcttaacagg

SEQ ID NO: 7115696 - DNA, 22 bp, Homo sapiens
ttaaagcatgttgcttaacagg

SEQ ID NO: 7115697 - DNA, 22 bp, Homo sapiens
ttaaagcatcctgtcagtctgt

SEQ ID NO: 7115698 - DNA, 22 bp, Homo sapiens
ttaaagcatcctgtcagtctgt

SEQ ID NO: 7115699 - DNA, 22 bp, Homo sapiens
ttaaagcatcctgtcagtctgt

SEQ ID NO: 7115700 - DNA, 22 bp, Homo sapiens
ttaaagcatgctgcttttccat

SEQ ID NO: 7115701 - DNA, 22 bp, Homo sapiens
ttaaagcatcctgtcagtctgt

SEQ ID NO: 7115702 - DNA, 22 bp, Homo sapiens
ttaaagcatgctgcttttccat

SEQ ID NO: 7115703 - DNA, 22 bp, Homo sapiens
tgtttttcaaatattgctctgt

SEQ ID NO: 7115704 - DNA, 22 bp, Homo sapiens
ttaaagcatcacactattaatt

SEQ ID NO: 7115705 - DNA, 22 bp, Homo sapiens
ttaaagcatcacactattaatt

SEQ ID NO: 7115706 - DNA, 22 bp, Homo sapiens
ttaaatgagatgttcagatatt

SEQ ID NO: 7115707 - DNA, 22 bp, Homo sapiens
ttaaatgacttttattattctc

SEQ ID NO: 7115708 - DNA, 22 bp, Homo sapiens
ttaaatgacttttattattctc

SEQ ID NO: 7115709 - DNA, 22 bp, Homo sapiens
ttaaatgacgggactgggtttt

SEQ ID NO: 7115710 - DNA, 22 bp, Homo sapiens
ttaaatgacgggactgggtttt

SEQ ID NO: 7115711 - DNA, 22 bp, Homo sapiens
ttaaatgacttttattattctc

SEQ ID NO: 7115712 - DNA, 22 bp, Homo sapiens
ttaaatgaacgagatatgcaac

SEQ ID NO: 7115713 - DNA, 22 bp, Homo sapiens
ttaaatgaacgagatatgcaac

SEQ ID NO: 7115714 - DNA, 22 bp, Homo sapiens
ttaaatattttcagcagggtca

SEQ ID NO: 7115715 - DNA, 22 bp, Homo sapiens
ttaaatattttcagcagggtca

SEQ ID NO: 7115716 - DNA, 22 bp, Homo sapiens
ttaaatattttcagcagggtca

SEQ ID NO: 7115717 - DNA, 22 bp, Homo sapiens
ttaaatcaggcatcatttcagt

SEQ ID NO: 7115718 - DNA, 22 bp, Homo sapiens
ttaaatgaacgagatatgcaac

SEQ ID NO: 7115719 - DNA, 22 bp, Homo sapiens
ttaaatgatgcatatcatttag

SEQ ID NO: 7115720 - DNA, 22 bp, Homo sapiens
ttaaatgaggctgatgtagatt

SEQ ID NO: 7115721 - DNA, 22 bp, Homo sapiens
ttaaatgaggctgatgtagatt

SEQ ID NO: 7115722 - DNA, 22 bp, Homo sapiens
ttaaatgaggctgatgtagatt

SEQ ID NO: 7115723 - DNA, 22 bp, Homo sapiens
ttaaatgagatgttcagatatt

SEQ ID NO: 7115724 - DNA, 22 bp, Homo sapiens
ttaaatgagatgttcagatatt

SEQ ID NO: 7115725 - DNA, 22 bp, Homo sapiens
ttaaatgatgcatatcatttag

SEQ ID NO: 7115726 - DNA, 22 bp, Homo sapiens
ttaaatgatgcatatcatttag

SEQ ID NO: 7115727 - DNA, 22 bp, Homo sapiens
ttaaatgatgcatatcatttag

SEQ ID NO: 7115728 - DNA, 22 bp, Homo sapiens
ttaaatgatgcatatcatttag

SEQ ID NO: 7115729 - DNA, 22 bp, Homo sapiens
ttaaatgtcaatagattgcttg

SEQ ID NO: 7115730 - DNA, 22 bp, Homo sapiens
ttaaatgctcacataaaggtag

SEQ ID NO: 7115731 - DNA, 22 bp, Homo sapiens
ttaaatgctcacataaaggtag

SEQ ID NO: 7115732 - DNA, 22 bp, Homo sapiens
ttaaatgctcacataaaggtag

SEQ ID NO: 7115733 - DNA, 22 bp, Homo sapiens
ttaaattaggactctagttctg

SEQ ID NO: 7115734 - DNA, 22 bp, Homo sapiens
ttaaattaggactctagttctg

SEQ ID NO: 7115735 - DNA, 22 bp, Homo sapiens
ttaaattaggactctagttctg

SEQ ID NO: 7115736 - DNA, 22 bp, Homo sapiens
ttaaattaggactctagttctg

SEQ ID NO: 7115737 - DNA, 22 bp, Homo sapiens
ttaaattagtcaagcttctctg

SEQ ID NO: 7115738 - DNA, 22 bp, Homo sapiens
ttaacaaaaatatcaggcatca

SEQ ID NO: 7115739 - DNA, 22 bp, Homo sapiens
ttaacaaaaatatcaggcatca

SEQ ID NO: 7115740 - DNA, 22 bp, Homo sapiens
ttaacaaaaatatcaggcatca

SEQ ID NO: 7115741 - DNA, 22 bp, Homo sapiens
ttaacaaaaatatcaggcatca

SEQ ID NO: 7115742 - DNA, 22 bp, Homo sapiens
ttaaatgtttaatctaacttga

SEQ ID NO: 7115743 - DNA, 22 bp, Homo sapiens
ttaaatgtttaatctaacttga

SEQ ID NO: 7115744 - DNA, 22 bp, Homo sapiens
ttaaatgtgatttcatttatgt

SEQ ID NO: 7115745 - DNA, 22 bp, Homo sapiens
ttaaatgtgatttcatttatgt

SEQ ID NO: 7115746 - DNA, 22 bp, Homo sapiens
ttaaatgtgatttcatttatgt

SEQ ID NO: 7115747 - DNA, 22 bp, Homo sapiens
ttaaatgtgatcctggtatgca

SEQ ID NO: 7115748 - DNA, 22 bp, Homo sapiens
ttaaatgtgatttcatttatgt

SEQ ID NO: 7115749 - DNA, 22 bp, Homo sapiens
ttaaatgtgatttcatttatgt

SEQ ID NO: 7115750 - DNA, 22 bp, Homo sapiens
ttaacaaatatttcccatgccc

SEQ ID NO: 7115751 - DNA, 22 bp, Homo sapiens
ttaacaatagagtttcttcagg

SEQ ID NO: 7115752 - DNA, 22 bp, Homo sapiens
ttaacaatagagtttcttcagg

SEQ ID NO: 7115753 - DNA, 22 bp, Homo sapiens
ttaacaatagagtttcttcagg

SEQ ID NO: 7115754 - DNA, 22 bp, Homo sapiens
ttaacaatagagtttcttcagg

SEQ ID NO: 7115755 - DNA, 22 bp, Homo sapiens
ttaacaaagtaacgggaaaaga

SEQ ID NO: 7115756 - DNA, 22 bp, Homo sapiens
ttaacaaagctctgttcctttt

SEQ ID NO: 7115757 - DNA, 22 bp, Homo sapiens
ttaacaaagctctgttcctttt

SEQ ID NO: 7115758 - DNA, 22 bp, Homo sapiens
ttaacaaagctctgttcctttt

SEQ ID NO: 7115759 - DNA, 22 bp, Homo sapiens
ttaacacatatttatcaattgc

SEQ ID NO: 7115760 - DNA, 22 bp, Homo sapiens
ttaacacatatttatcaattgc

SEQ ID NO: 7115761 - DNA, 22 bp, Homo sapiens
ttaacacagggggagacaaagt

SEQ ID NO: 7115762 - DNA, 22 bp, Homo sapiens
ttaacacagggggagacaaagt

SEQ ID NO: 7115763 - DNA, 22 bp, Homo sapiens
ttaacaatagagtttcttcagg

SEQ ID NO: 7115764 - DNA, 22 bp, Homo sapiens
ttaacacagggggagacaaagt

SEQ ID NO: 7115765 - DNA, 22 bp, Homo sapiens
ttacaggtgggaaaactaagct

SEQ ID NO: 7115766 - DNA, 22 bp, Homo sapiens
ttacaggtggagaagtaaggct

SEQ ID NO: 7115767 - DNA, 22 bp, Homo sapiens
ttacaggtgagaaaactgaggc

SEQ ID NO: 7115768 - DNA, 22 bp, Homo sapiens
ttacaggtgagaaaactgaggc

SEQ ID NO: 7115769 - DNA, 22 bp, Homo sapiens
ttacaggtggagaagtaaggct

SEQ ID NO: 7115770 - DNA, 22 bp, Homo sapiens
ttacaggtcagtttgactgaat

SEQ ID NO: 7115771 - DNA, 22 bp, Homo sapiens
ttacaggtcagtttgactgaat

SEQ ID NO: 7115772 - DNA, 21 bp, Homo sapiens
ttacaggtcatccaagtcacc

SEQ ID NO: 7115773 - DNA, 21 bp, Homo sapiens
ttacaggtcatccaagtcacc

SEQ ID NO: 7115774 - DNA, 22 bp, Homo sapiens
ttacaggtctgtgtcatcatct

SEQ ID NO: 7115775 - DNA, 22 bp, Homo sapiens
ttacaggtctgtgtcatcatct

SEQ ID NO: 7115776 - DNA, 22 bp, Homo sapiens
ttacaggtctgtgtcatcatct

SEQ ID NO: 7115777 - DNA, 22 bp, Homo sapiens
ttacaggtgagaaaactgaggc

SEQ ID NO: 7115778 - DNA, 22 bp, Homo sapiens
ttacaggtgggaaaactaagct

SEQ ID NO: 7115779 - DNA, 22 bp, Homo sapiens
ttacaggtgggaaaactaagct

SEQ ID NO: 7115780 - DNA, 22 bp, Homo sapiens
ttacaggtgtggaaattgagta

SEQ ID NO: 7115781 - DNA, 22 bp, Homo sapiens
ttacaggtgtggaaattgagta

SEQ ID NO: 7115782 - DNA, 22 bp, Homo sapiens
ttacaggtgtgagccaccccac

SEQ ID NO: 7115783 - DNA, 22 bp, Homo sapiens
ttacaggtgtggaaattgagta

SEQ ID NO: 7115784 - DNA, 22 bp, Homo sapiens
ttacaggttaagtgacacttaa

SEQ ID NO: 7115785 - DNA, 22 bp, Homo sapiens
ttacaggttaagtgacacttaa

SEQ ID NO: 7115786 - DNA, 19 bp, Homo sapiens
ttacaggttgacatcaatt

SEQ ID NO: 7115787 - DNA, 19 bp, Homo sapiens
ttacaggttgacatcaatt

SEQ ID NO: 7115788 - DNA, 22 bp, Homo sapiens
ttacaggttgtgtattcagtga

SEQ ID NO: 7115789 - DNA, 22 bp, Homo sapiens
ttacaggttgtgtattcagtga

SEQ ID NO: 7115790 - DNA, 22 bp, Homo sapiens
ttacaggttgtgtattcagtga

SEQ ID NO: 7115791 - DNA, 22 bp, Homo sapiens
ttacagtacagaaaataacaga

SEQ ID NO: 7115792 - DNA, 22 bp, Homo sapiens
ttacacttctaaaaaaagcagg

SEQ ID NO: 7115793 - DNA, 22 bp, Homo sapiens
ttacacttctgaaagcctaggt

SEQ ID NO: 7115794 - DNA, 22 bp, Homo sapiens
ttacacttagggtttgtcagag

SEQ ID NO: 7115795 - DNA, 22 bp, Homo sapiens
ttacacttacctgtccattgaa

SEQ ID NO: 7115796 - DNA, 22 bp, Homo sapiens
ttacacttatctagagccatgg

SEQ ID NO: 7115797 - DNA, 22 bp, Homo sapiens
ttacacttctaaaaaaagcagg

SEQ ID NO: 7115798 - DNA, 19 bp, Homo sapiens
ttacacttctgctttgtga

SEQ ID NO: 7115799 - DNA, 22 bp, Homo sapiens
ttacacttgaaaacaggattta

SEQ ID NO: 7115800 - DNA, 22 bp, Homo sapiens
ttacacttgaaaacaggattta

SEQ ID NO: 7115801 - DNA, 22 bp, Homo sapiens
ttacacttgggtgtggatttta

SEQ ID NO: 7115802 - DNA, 22 bp, Homo sapiens
ttacacttgggtgtggatttta

SEQ ID NO: 7115803 - DNA, 22 bp, Homo sapiens
ttacacttgtaaatggcatgta

SEQ ID NO: 7115804 - DNA, 22 bp, Homo sapiens
ttacacttgtaattatataacg

SEQ ID NO: 7115805 - DNA, 22 bp, Homo sapiens
ttacactttggcaagctattaa

SEQ ID NO: 7115806 - DNA, 22 bp, Homo sapiens
ttacactttaaatccagcttgt

SEQ ID NO: 7115807 - DNA, 22 bp, Homo sapiens
ttacactttaaatccagcttgt

SEQ ID NO: 7115808 - DNA, 22 bp, Homo sapiens
ttacactttggcaagctattaa

SEQ ID NO: 7115809 - DNA, 22 bp, Homo sapiens
ttacactttggcaagctattaa

SEQ ID NO: 7115810 - DNA, 20 bp, Homo sapiens
ttacactttgtagcattttt

SEQ ID NO: 7115811 - DNA, 20 bp, Homo sapiens
ttacactttgtagcattttt

SEQ ID NO: 7115812 - DNA, 22 bp, Homo sapiens
ttacagggatcccataaatgtc

SEQ ID NO: 7115813 - DNA, 22 bp, Homo sapiens
ttacagggaaccaatccagtgt

SEQ ID NO: 7115814 - DNA, 22 bp, Homo sapiens
ttacagggggatgagattgtga

SEQ ID NO: 7115815 - DNA, 22 bp, Homo sapiens
ttacagggttgcagcattgacg

SEQ ID NO: 7115816 - DNA, 21 bp, Homo sapiens
ttacaggtaacacttcctttc

SEQ ID NO: 7115817 - DNA, 21 bp, Homo sapiens
ttacaggtaacacttcctttc

SEQ ID NO: 7115818 - DNA, 22 bp, Homo sapiens
ttacaggtacttgctgctgaaa

SEQ ID NO: 7115819 - DNA, 22 bp, Homo sapiens
ttacaggtacttgctgctgaaa

SEQ ID NO: 7115820 - DNA, 22 bp, Homo sapiens
ttacaggtattttattgagcag

SEQ ID NO: 7115821 - DNA, 22 bp, Homo sapiens
ttacaggtattttattgagcag

SEQ ID NO: 7115822 - DNA, 22 bp, Homo sapiens
ttacatgaatacataaccattc

SEQ ID NO: 7115823 - DNA, 19 bp, Homo sapiens
ttacatgacatatgaagga

SEQ ID NO: 7115824 - DNA, 22 bp, Homo sapiens
ttacattttggggtaaggataa

SEQ ID NO: 7115825 - DNA, 22 bp, Homo sapiens
ttacatcattgagacatacata

SEQ ID NO: 7115826 - DNA, 22 bp, Homo sapiens
ttacatcattgagacatacata

SEQ ID NO: 7115827 - DNA, 22 bp, Homo sapiens
ttacatcattgagacatacata

SEQ ID NO: 7115828 - DNA, 22 bp, Homo sapiens
ttacatcagcaagagtgtatgt

SEQ ID NO: 7115829 - DNA, 22 bp, Homo sapiens
ttacatcactttacttaataat

SEQ ID NO: 7115830 - DNA, 22 bp, Homo sapiens
ttacatcactttacttaataat

SEQ ID NO: 7115831 - DNA, 22 bp, Homo sapiens
ttacatcagaaggaaacagcgt

SEQ ID NO: 7115832 - DNA, 22 bp, Homo sapiens
ttacatattatccaaaactgct

SEQ ID NO: 7115833 - DNA, 22 bp, Homo sapiens
ttacatattatccaaaactgct

SEQ ID NO: 7115834 - DNA, 22 bp, Homo sapiens
ttacatattatccaaaactgct

SEQ ID NO: 7115835 - DNA, 22 bp, Homo sapiens
ttacagtggtcatttgggaaaa

SEQ ID NO: 7115836 - DNA, 22 bp, Homo sapiens
ttacatagttaaatagtacagc

SEQ ID NO: 7115837 - DNA, 22 bp, Homo sapiens
ttacagtgaagtaccattaaaa

SEQ ID NO: 7115838 - DNA, 22 bp, Homo sapiens
ttacagtgacagttgctatgat

SEQ ID NO: 7115839 - DNA, 22 bp, Homo sapiens
ttacagtgacagttgctatgat

SEQ ID NO: 7115840 - DNA, 22 bp, Homo sapiens
ttacagtgactcacattaacaa

SEQ ID NO: 7115841 - DNA, 22 bp, Homo sapiens
ttacagtgagggtgacatttac

SEQ ID NO: 7115842 - DNA, 22 bp, Homo sapiens
ttacagtgctcttcaagacttc

SEQ ID NO: 7115843 - DNA, 22 bp, Homo sapiens
ttacagtggcagagttgggtag

SEQ ID NO: 7115844 - DNA, 20 bp, Homo sapiens
ttacagtgggaccttcctga

SEQ ID NO: 7115845 - DNA, 22 bp, Homo sapiens
ttacagtcagtgaatggaaggg

SEQ ID NO: 7115846 - DNA, 22 bp, Homo sapiens
ttacagtcttaaactcctgggc

SEQ ID NO: 7115847 - DNA, 22 bp, Homo sapiens
ttacagtgaagattcaggttcc

SEQ ID NO: 7115848 - DNA, 22 bp, Homo sapiens
ttaattttaacctgtttgtgtc

SEQ ID NO: 7115849 - DNA, 22 bp, Homo sapiens
ttaattttctcatctgtgaaat

SEQ ID NO: 7115850 - DNA, 22 bp, Homo sapiens
ttaattttctcatctgtgaaat

SEQ ID NO: 7115851 - DNA, 22 bp, Homo sapiens
ttaattttctcatctgtgaaat

SEQ ID NO: 7115852 - DNA, 22 bp, Homo sapiens
ttaattttctcatctgtgaaat

SEQ ID NO: 7115853 - DNA, 22 bp, Homo sapiens
ttaatttgaccataaatatctt

SEQ ID NO: 7115854 - DNA, 21 bp, Homo sapiens
ttaatttattcatgatagcta

SEQ ID NO: 7115855 - DNA, 21 bp, Homo sapiens
ttaatttattcatgatagcta

SEQ ID NO: 7115856 - DNA, 21 bp, Homo sapiens
ttaatttattcatgatagcta

SEQ ID NO: 7115857 - DNA, 21 bp, Homo sapiens
ttaatttattcatgatagcta

SEQ ID NO: 7115858 - DNA, 21 bp, Homo sapiens
ttaatttattcatgatagcta

SEQ ID NO: 7115859 - DNA, 22 bp, Homo sapiens
ttacaaacaacagacatttatt

SEQ ID NO: 7115860 - DNA, 22 bp, Homo sapiens
ttacaaacaacagacatttatt

SEQ ID NO: 7115861 - DNA, 22 bp, Homo sapiens
ttaatttttatgtatagtgtgt

SEQ ID NO: 7115862 - DNA, 22 bp, Homo sapiens
ttaatttttatgtatagtgtgt

SEQ ID NO: 7115863 - DNA, 22 bp, Homo sapiens
ttacaaacaacagacatttatt

SEQ ID NO: 7115864 - DNA, 22 bp, Homo sapiens
ttaattttgatgaggttcagtt

SEQ ID NO: 7115865 - DNA, 22 bp, Homo sapiens
ttaattttgatgaggttcagtt

SEQ ID NO: 7115866 - DNA, 22 bp, Homo sapiens
ttaatttttatgtatagtgtgt

SEQ ID NO: 7115867 - DNA, 22 bp, Homo sapiens
ttaatttttatgtatagtgtgt

SEQ ID NO: 7115868 - DNA, 22 bp, Homo sapiens
ttaatttttatgtatagtgtgt

SEQ ID NO: 7115869 - DNA, 22 bp, Homo sapiens
ttaatttttatgtatagtgtgt

SEQ ID NO: 7115870 - DNA, 22 bp, Homo sapiens
ttacaaactgtcatatagtatt

SEQ ID NO: 7115871 - DNA, 22 bp, Homo sapiens
ttacaaagaaaattaggcattt

SEQ ID NO: 7115872 - DNA, 22 bp, Homo sapiens
ttacaaagaaaattaggcattt

SEQ ID NO: 7115873 - DNA, 22 bp, Homo sapiens
ttacaaactgtcatatagtatt

SEQ ID NO: 7115874 - DNA, 22 bp, Homo sapiens
ttacaaactgtcatatagtatt

SEQ ID NO: 7115875 - DNA, 22 bp, Homo sapiens
ttacacaaagctccccaaatag

SEQ ID NO: 7115876 - DNA, 22 bp, Homo sapiens
ttacacaaagctccccaaatag

SEQ ID NO: 7115877 - DNA, 22 bp, Homo sapiens
ttacacaaagttagctcttgca

SEQ ID NO: 7115878 - DNA, 22 bp, Homo sapiens
ttacacaacagtgcatcagcag

SEQ ID NO: 7115879 - DNA, 22 bp, Homo sapiens
ttacacaacatctgtattatta

SEQ ID NO: 7115880 - DNA, 22 bp, Homo sapiens
ttacacaacatctgtattatta

SEQ ID NO: 7115881 - DNA, 22 bp, Homo sapiens
ttacacaacatctgtattatta

SEQ ID NO: 7115882 - DNA, 22 bp, Homo sapiens
ttacacaagttctttaacctat

SEQ ID NO: 7115883 - DNA, 22 bp, Homo sapiens
ttacacaatatatggtacttgg

SEQ ID NO: 7115884 - DNA, 22 bp, Homo sapiens
ttacacaatatatggtacttgg

SEQ ID NO: 7115885 - DNA, 22 bp, Homo sapiens
ttacacagtatccaaggttctt

SEQ ID NO: 7115886 - DNA, 22 bp, Homo sapiens
ttacacaggcacttaaaatgca

SEQ ID NO: 7115887 - DNA, 17 bp, Homo sapiens
ttacacaggagagctct

SEQ ID NO: 7115888 - DNA, 17 bp, Homo sapiens
ttacacaggagagctct

SEQ ID NO: 7115889 - DNA, 22 bp, Homo sapiens
ttacacagcttctatccttgaa

SEQ ID NO: 7115890 - DNA, 22 bp, Homo sapiens
ttacacagatggttagtagagg

SEQ ID NO: 7115891 - DNA, 22 bp, Homo sapiens
ttacacagatggttagtagagg

SEQ ID NO: 7115892 - DNA, 22 bp, Homo sapiens
ttacacagatggttagtagagg

SEQ ID NO: 7115893 - DNA, 22 bp, Homo sapiens
ttacacagatggttagtagagg

SEQ ID NO: 7115894 - DNA, 22 bp, Homo sapiens
ttacacaattactcactcctgg

SEQ ID NO: 7115895 - DNA, 22 bp, Homo sapiens
ttacacaattttattgacctaa

SEQ ID NO: 7115896 - DNA, 22 bp, Homo sapiens
ttacacagaaacactgttcaga

SEQ ID NO: 7115897 - DNA, 22 bp, Homo sapiens
ttacacagacatggcatcatga

SEQ ID NO: 7115898 - DNA, 22 bp, Homo sapiens
ttacacagaaattttattgcct

SEQ ID NO: 7115899 - DNA, 22 bp, Homo sapiens
ttacacagaaacactgttcaga

SEQ ID NO: 7115900 - DNA, 22 bp, Homo sapiens
ttacacatgctcacttatttgt

SEQ ID NO: 7115901 - DNA, 22 bp, Homo sapiens
ttacacagttggtaggggcaga

SEQ ID NO: 7115902 - DNA, 22 bp, Homo sapiens
ttacacatctagacccattttt

SEQ ID NO: 7115903 - DNA, 22 bp, Homo sapiens
ttacacatctagacccattttt

SEQ ID NO: 7115904 - DNA, 22 bp, Homo sapiens
ttacacagttggtaggggcaga

SEQ ID NO: 7115905 - DNA, 22 bp, Homo sapiens
ttacacagtggttaagtctggg

SEQ ID NO: 7115906 - DNA, 22 bp, Homo sapiens
ttacacagtggttaagtctggg

SEQ ID NO: 7115907 - DNA, 22 bp, Homo sapiens
ttacacagtggttaagtctggg

SEQ ID NO: 7115908 - DNA, 22 bp, Homo sapiens
ttacacagtgcacaagcagagt

SEQ ID NO: 7115909 - DNA, 22 bp, Homo sapiens
ttacacagtgcacaagcagagt

SEQ ID NO: 7115910 - DNA, 22 bp, Homo sapiens
ttacacattaacaggcagctaa

SEQ ID NO: 7115911 - DNA, 22 bp, Homo sapiens
ttacacattaacaggcagctaa

SEQ ID NO: 7115912 - DNA, 22 bp, Homo sapiens
ttacacattgcagatcaaaatg

SEQ ID NO: 7115913 - DNA, 22 bp, Homo sapiens
ttacacattgcagatcaaaatg

SEQ ID NO: 7115914 - DNA, 22 bp, Homo sapiens
ttactatctttccagtttggct

SEQ ID NO: 7115915 - DNA, 19 bp, Homo sapiens
ttactagtctcagttatgg

SEQ ID NO: 7115916 - DNA, 22 bp, Homo sapiens
ttactgaaagtatacatttctg

SEQ ID NO: 7115917 - DNA, 22 bp, Homo sapiens
ttactgaaaattcttcaggatt

SEQ ID NO: 7115918 - DNA, 20 bp, Homo sapiens
ttactcataggaccacaagc

SEQ ID NO: 7115919 - DNA, 22 bp, Homo sapiens
ttactcattgctggatctagaa

SEQ ID NO: 7115920 - DNA, 22 bp, Homo sapiens
ttactagcaggattcagattct

SEQ ID NO: 7115921 - DNA, 18 bp, Homo sapiens
ttactacagcactttctt

SEQ ID NO: 7115922 - DNA, 22 bp, Homo sapiens
ttacattttggggtaaggataa

SEQ ID NO: 7115923 - DNA, 22 bp, Homo sapiens
ttactgaaataatgaaacacat

SEQ ID NO: 7115924 - DNA, 22 bp, Homo sapiens
ttactgaaccctacttttacag

SEQ ID NO: 7115925 - DNA, 22 bp, Homo sapiens
ttactgaaggtggatagtgagt

SEQ ID NO: 7115926 - DNA, 22 bp, Homo sapiens
ttactgaattgcactccagcgt

SEQ ID NO: 7115927 - DNA, 22 bp, Homo sapiens
ttactgcaacataatgtagtct

SEQ ID NO: 7115928 - DNA, 22 bp, Homo sapiens
ttactgcacgtgggacatatat

SEQ ID NO: 7115929 - DNA, 22 bp, Homo sapiens
ttactgggaatgttatggagaa

SEQ ID NO: 7115930 - DNA, 22 bp, Homo sapiens
ttactgggcggggagtggaagc

SEQ ID NO: 7115931 - DNA, 22 bp, Homo sapiens
ttactgtagaagagaatgattc

SEQ ID NO: 7115932 - DNA, 22 bp, Homo sapiens
ttactgtagaagagaatgattc

SEQ ID NO: 7115933 - DNA, 22 bp, Homo sapiens
ttactgtagcttgacatatgtc

SEQ ID NO: 7115934 - DNA, 22 bp, Homo sapiens
ttactgtagcttgacatatgtc

SEQ ID NO: 7115935 - DNA, 22 bp, Homo sapiens
ttactgtatacacaagtggtga

SEQ ID NO: 7115936 - DNA, 22 bp, Homo sapiens
ttactgtgtttggctttagatg

SEQ ID NO: 7115937 - DNA, 22 bp, Homo sapiens
ttactgtttgaaaaatgaatgt

SEQ ID NO: 7115938 - DNA, 22 bp, Homo sapiens
ttacttacagacagtagactct

SEQ ID NO: 7115939 - DNA, 22 bp, Homo sapiens
ttacttcagattgtggaaggca

SEQ ID NO: 7115940 - DNA, 21 bp, Homo sapiens
ttacttctgcttgttattgtc

SEQ ID NO: 7115941 - DNA, 22 bp, Homo sapiens
ttacttcttacaaaagaaatat

SEQ ID NO: 7115942 - DNA, 22 bp, Homo sapiens
ttacttcttgtctcatgcctat

SEQ ID NO: 7115943 - DNA, 22 bp, Homo sapiens
ttacttctttggccttcagcca

SEQ ID NO: 7115944 - DNA, 22 bp, Homo sapiens
ttacttgaaaaccaccagtatt

SEQ ID NO: 7115945 - DNA, 19 bp, Homo sapiens
ttacttggcaaagtcagtc

SEQ ID NO: 7115946 - DNA, 22 bp, Homo sapiens
ttacttgtgcaccaccctaata

SEQ ID NO: 7115947 - DNA, 22 bp, Homo sapiens
ttactttaagggtgtcttatta

SEQ ID NO: 7115948 - DNA, 22 bp, Homo sapiens
ttactttaagggtgtcttatta

SEQ ID NO: 7115949 - DNA, 22 bp, Homo sapiens
ttactttagatcatactgtgtg

SEQ ID NO: 7115950 - DNA, 22 bp, Homo sapiens
ttacttgaaatgtgataagaga

SEQ ID NO: 7115951 - DNA, 22 bp, Homo sapiens
ttacttgaaggcagaaaagttt

SEQ ID NO: 7115952 - DNA, 22 bp, Homo sapiens
ttacttgaaggcagaaaagttt

SEQ ID NO: 7115953 - DNA, 22 bp, Homo sapiens
ttacttgatgatgtataaagtc

SEQ ID NO: 7115954 - DNA, 22 bp, Homo sapiens
ttacttgatgtatgatgagtag

SEQ ID NO: 7115955 - DNA, 22 bp, Homo sapiens
ttacttgatttgaaaatcatag

SEQ ID NO: 7115956 - DNA, 22 bp, Homo sapiens
ttacttggaggcctgttaccag

SEQ ID NO: 7115957 - DNA, 22 bp, Homo sapiens
ttagagcaggagttgacagatt

SEQ ID NO: 7115958 - DNA, 22 bp, Homo sapiens
ttagagatacatttgtagcttg

SEQ ID NO: 7115959 - DNA, 22 bp, Homo sapiens
ttagagagaaccatcaggatct

SEQ ID NO: 7115960 - DNA, 22 bp, Homo sapiens
ttagagatgtcccaaaatgaag

SEQ ID NO: 7115961 - DNA, 22 bp, Homo sapiens
ttagagattggttgacagattt

SEQ ID NO: 7115962 - DNA, 22 bp, Homo sapiens
ttagagattggttgacagattt

SEQ ID NO: 7115963 - DNA, 22 bp, Homo sapiens
ttagagattgtctagtattgtg

SEQ ID NO: 7115964 - DNA, 22 bp, Homo sapiens
ttagagagaaccatcaggatct

SEQ ID NO: 7115965 - DNA, 22 bp, Homo sapiens
ttagacatgtttgctaaaatga

SEQ ID NO: 7115966 - DNA, 22 bp, Homo sapiens
ttagactttaagctgggtgcag

SEQ ID NO: 7115967 - DNA, 22 bp, Homo sapiens
ttagagaaaagcttgcttgctt

SEQ ID NO: 7115968 - DNA, 22 bp, Homo sapiens
ttagacatcagtgcttctcagc

SEQ ID NO: 7115969 - DNA, 22 bp, Homo sapiens
ttagacatcaagaagccaatgt

SEQ ID NO: 7115970 - DNA, 22 bp, Homo sapiens
ttagacatgatggtgcagagag

SEQ ID NO: 7115971 - DNA, 22 bp, Homo sapiens
ttagagaaatgggtactgcata

SEQ ID NO: 7115972 - DNA, 22 bp, Homo sapiens
ttagagaaccaatgaatagtct

SEQ ID NO: 7115973 - DNA, 22 bp, Homo sapiens
ttagagaagatgaaccatcgtt

SEQ ID NO: 7115974 - DNA, 22 bp, Homo sapiens
ttagaagtaaggtcagatttct

SEQ ID NO: 7115975 - DNA, 20 bp, Homo sapiens
ttagaagggccagatgaagg

SEQ ID NO: 7115976 - DNA, 22 bp, Homo sapiens
ttagaaagctttccatagtcaa

SEQ ID NO: 7115977 - DNA, 22 bp, Homo sapiens
ttagaagcatcacctgttctgg

SEQ ID NO: 7115978 - DNA, 22 bp, Homo sapiens
ttactttgggtcctgcttataa

SEQ ID NO: 7115979 - DNA, 22 bp, Homo sapiens
ttactttggcaaactcctgccc

SEQ ID NO: 7115980 - DNA, 22 bp, Homo sapiens
ttactttgggtcctgcttataa

SEQ ID NO: 7115981 - DNA, 22 bp, Homo sapiens
ttactttgggtcctgcttataa

SEQ ID NO: 7115982 - DNA, 22 bp, Homo sapiens
ttactttgggtcctgcttataa

SEQ ID NO: 7115983 - DNA, 18 bp, Homo sapiens
ttactttgtatagcctag

SEQ ID NO: 7115984 - DNA, 18 bp, Homo sapiens
ttactttgtatagcctag

SEQ ID NO: 7115985 - DNA, 18 bp, Homo sapiens
ttactttgtatagcctag

SEQ ID NO: 7115986 - DNA, 18 bp, Homo sapiens
ttactttgtatagcctag

SEQ ID NO: 7115987 - DNA, 22 bp, Homo sapiens
ttactttgttctcaagatatgt

SEQ ID NO: 7115988 - DNA, 22 bp, Homo sapiens
ttactttgttctcaagatatgt

SEQ ID NO: 7115989 - DNA, 22 bp, Homo sapiens
ttactttgctttctcattacag

SEQ ID NO: 7115990 - DNA, 22 bp, Homo sapiens
ttactttggatggtcaagaaag

SEQ ID NO: 7115991 - DNA, 22 bp, Homo sapiens
ttactttggatggtcaagaaag

SEQ ID NO: 7115992 - DNA, 22 bp, Homo sapiens
ttactttggcaaactcctgccc

SEQ ID NO: 7115993 - DNA, 22 bp, Homo sapiens
ttactttgcagatgtgtatgtc

SEQ ID NO: 7115994 - DNA, 22 bp, Homo sapiens
ttactttgcagatgtgtatgtc

SEQ ID NO: 7115995 - DNA, 22 bp, Homo sapiens
ttactttgcatttgtggtagtc

SEQ ID NO: 7115996 - DNA, 22 bp, Homo sapiens
ttactttgccttttagtgtagg

SEQ ID NO: 7115997 - DNA, 22 bp, Homo sapiens
ttactttgccttttagtgtagg

SEQ ID NO: 7115998 - DNA, 22 bp, Homo sapiens
ttactttgcttcaggaagagga

SEQ ID NO: 7115999 - DNA, 22 bp, Homo sapiens
ttactttgcttcaggaagagga

SEQ ID NO: 7116000 - DNA, 22 bp, Homo sapiens
ttactttgctttctcattacag

SEQ ID NO: 7116001 - DNA, 22 bp, Homo sapiens
ttactttgctttctcattacag

SEQ ID NO: 7116002 - DNA, 22 bp, Homo sapiens
ttactttgctttctcattacag

SEQ ID NO: 7116003 - DNA, 22 bp, Homo sapiens
ttactttatgtgatggattagt

SEQ ID NO: 7116004 - DNA, 22 bp, Homo sapiens
ttactttgaatgtcacaagcaa

SEQ ID NO: 7116005 - DNA, 22 bp, Homo sapiens
ttactttgatgatcaatgagcg

SEQ ID NO: 7116006 - DNA, 22 bp, Homo sapiens
ttactttgatgatcaatgagcg

SEQ ID NO: 7116007 - DNA, 22 bp, Homo sapiens
ttactttgatgatcaatgagcg

SEQ ID NO: 7116008 - DNA, 22 bp, Homo sapiens
ttactttagatcatactgtgtg

SEQ ID NO: 7116009 - DNA, 22 bp, Homo sapiens
ttactttagggatgttttgctt

SEQ ID NO: 7116010 - DNA, 22 bp, Homo sapiens
ttactttatagaacactggggg

SEQ ID NO: 7116011 - DNA, 22 bp, Homo sapiens
ttactttatgtgatggattagt

SEQ ID NO: 7116012 - DNA, 22 bp, Homo sapiens
ttactttgtttgcacttcacct

SEQ ID NO: 7116013 - DNA, 22 bp, Homo sapiens
ttactttgtttgcacttcacct

SEQ ID NO: 7116014 - DNA, 20 bp, Homo sapiens
ttactttgtttggatgacat

SEQ ID NO: 7116015 - DNA, 22 bp, Homo sapiens
ttacttttctattcgatatgtg

SEQ ID NO: 7116016 - DNA, 22 bp, Homo sapiens
ttagaaacaaaatagttatttg

SEQ ID NO: 7116017 - DNA, 22 bp, Homo sapiens
ttagaaacccagactcttaggt

SEQ ID NO: 7116018 - DNA, 22 bp, Homo sapiens
ttagaaacccagactcttaggt

SEQ ID NO: 7116019 - DNA, 22 bp, Homo sapiens
ttagaaactcaactctgggaat

SEQ ID NO: 7116020 - DNA, 22 bp, Homo sapiens
ttagaaactttggaggatagat

SEQ ID NO: 7116021 - DNA, 22 bp, Homo sapiens
ttagaaagagtataccagaaac

SEQ ID NO: 7116022 - DNA, 22 bp, Homo sapiens
ggtcaagaatttggccgtggct

SEQ ID NO: 7116023 - DNA, 22 bp, Homo sapiens
ggtcaacttcttatggtagctt

SEQ ID NO: 7116024 - DNA, 22 bp, Homo sapiens
ggtcaacttgagaagctagtac

SEQ ID NO: 7116025 - DNA, 22 bp, Homo sapiens
ggtcaacttgagaagctagtac

SEQ ID NO: 7116026 - DNA, 22 bp, Homo sapiens
ggtcacaaggcagataataagg

SEQ ID NO: 7116027 - DNA, 22 bp, Homo sapiens
ggtcacaaggtactgtaagaaa

SEQ ID NO: 7116028 - DNA, 22 bp, Homo sapiens
ggtcacagctttttcagcagca

SEQ ID NO: 7116029 - DNA, 22 bp, Homo sapiens
ggtcacagctttttcagcagca

SEQ ID NO: 7116030 - DNA, 22 bp, Homo sapiens
ggtcacagggaagggctctcaa

SEQ ID NO: 7116031 - DNA, 20 bp, Homo sapiens
cagatatcagaagcacagcc

SEQ ID NO: 7116032 - DNA, 22 bp, Homo sapiens
cagatatgataggattagcaca

SEQ ID NO: 7116033 - DNA, 22 bp, Homo sapiens
ggtattagttgtatggctctgc

SEQ ID NO: 7116034 - DNA, 21 bp, Homo sapiens
ggtattctgtgtcacctttgg

SEQ ID NO: 7116035 - DNA, 22 bp, Homo sapiens
ggtattgttctagctttaaagg

SEQ ID NO: 7116036 - DNA, 22 bp, Homo sapiens
ggtatttactgagagccactct

SEQ ID NO: 7116037 - DNA, 22 bp, Homo sapiens
ggtatttactgagagccactct

SEQ ID NO: 7116038 - DNA, 22 bp, Homo sapiens
ggtatttatagtggtgcttagt

SEQ ID NO: 7116039 - DNA, 22 bp, Homo sapiens
ggtatttatagtggtgcttagt

SEQ ID NO: 7116040 - DNA, 22 bp, Homo sapiens
ggtatttatatgtctgaagctg

SEQ ID NO: 7116041 - DNA, 22 bp, Homo sapiens
ggtcaacactgtgaccaacagg

SEQ ID NO: 7116042 - DNA, 22 bp, Homo sapiens
ggtcaacttagataagatggag

SEQ ID NO: 7116043 - DNA, 22 bp, Homo sapiens
ggtcaacttagataagatggag

SEQ ID NO: 7116044 - DNA, 23 bp, Homo sapiens
cagatgaggttggcagcatggtc

SEQ ID NO: 7116045 - DNA, 22 bp, Homo sapiens
cagatgagggctggaggtgagc

SEQ ID NO: 7116046 - DNA, 22 bp, Homo sapiens
cagatgagggctggaggtgagc

SEQ ID NO: 7116047 - DNA, 23 bp, Homo sapiens
cagatgaggttggcagcatggtc

SEQ ID NO: 7116048 - DNA, 23 bp, Homo sapiens
cagatgaggttggcagcatggtc

SEQ ID NO: 7116049 - DNA, 22 bp, Homo sapiens
cagatgaggacagatgactggg

SEQ ID NO: 7116050 - DNA, 21 bp, Homo sapiens
cagatgacccacatggtgtct

SEQ ID NO: 7116051 - DNA, 22 bp, Homo sapiens
cagatgaccgtcttccagccag

SEQ ID NO: 7116052 - DNA, 19 bp, Homo sapiens
cagatgagaaaagtgaggt

SEQ ID NO: 7116053 - DNA, 19 bp, Homo sapiens
cagatgagaaaagtgaggt

SEQ ID NO: 7116054 - DNA, 19 bp, Homo sapiens
cagatgagaaaagtgaggt

SEQ ID NO: 7116055 - DNA, 22 bp, Homo sapiens
cagatgagagtggccagggttc

SEQ ID NO: 7116056 - DNA, 22 bp, Homo sapiens
cagatgagagtggccagggttc

SEQ ID NO: 7116057 - DNA, 22 bp, Homo sapiens
ggtcctgcgtctggctcgcccg

SEQ ID NO: 7116058 - DNA, 22 bp, Homo sapiens
ggtcctgctggctcagctgagc

SEQ ID NO: 7116059 - DNA, 22 bp, Homo sapiens
ggtcctggcagctctgtgtcca

SEQ ID NO: 7116060 - DNA, 22 bp, Homo sapiens
ggtcctggcagtctttggttgt

SEQ ID NO: 7116061 - DNA, 22 bp, Homo sapiens
ggtcctgggaagatgctcatga

SEQ ID NO: 7116062 - DNA, 22 bp, Homo sapiens
ggtcctggcagctctgtgtcca

SEQ ID NO: 7116063 - DNA, 22 bp, Homo sapiens
cagatgttgttcctgcctgtag

SEQ ID NO: 7116064 - DNA, 22 bp, Homo sapiens
cagatgtttgtctatatgcttt

SEQ ID NO: 7116065 - DNA, 19 bp, Homo sapiens
cagatgttttcagttcatt

SEQ ID NO: 7116066 - DNA, 22 bp, Homo sapiens
cagatgcagcaaaatgacaggc

SEQ ID NO: 7116067 - DNA, 22 bp, Homo sapiens
cagatgcagcaaaatgacaggc

SEQ ID NO: 7116068 - DNA, 22 bp, Homo sapiens
cagatgcacattctcatcagca

SEQ ID NO: 7116069 - DNA, 23 bp, Homo sapiens
cagatgaggttggcagcatggtc

SEQ ID NO: 7116070 - DNA, 22 bp, Homo sapiens
cagatgcagcaaaatgacaggc

SEQ ID NO: 7116071 - DNA, 22 bp, Homo sapiens
cagatgcatgagttcattagga

SEQ ID NO: 7116072 - DNA, 22 bp, Homo sapiens
ggtcctcaatcccaacaaggca

SEQ ID NO: 7116073 - DNA, 22 bp, Homo sapiens
ggtcctcaatcccaacaaggca

SEQ ID NO: 7116074 - DNA, 19 bp, Homo sapiens
ggtcctcagcagagcatgc

SEQ ID NO: 7116075 - DNA, 19 bp, Homo sapiens
ggtcctcagcagagcatgc

SEQ ID NO: 7116076 - DNA, 22 bp, Homo sapiens
ggtcctctccagcgccacagtg

SEQ ID NO: 7116077 - DNA, 22 bp, Homo sapiens
ggtcctctccagcgccacagtg

SEQ ID NO: 7116078 - DNA, 22 bp, Homo sapiens
ggtcctctcccaagagcgcatc

SEQ ID NO: 7116079 - DNA, 18 bp, Homo sapiens
ggtcctgaatgcctgcta

SEQ ID NO: 7116080 - DNA, 22 bp, Homo sapiens
ggtcctgcattgccagcaagct

SEQ ID NO: 7116081 - DNA, 22 bp, Homo sapiens
ggtagtgaggtgaaagagaggt

SEQ ID NO: 7116082 - DNA, 22 bp, Homo sapiens
ggtatcaaagaagggggtgcca

SEQ ID NO: 7116083 - DNA, 22 bp, Homo sapiens
ggtatgctgtgcggacgcagac

SEQ ID NO: 7116084 - DNA, 22 bp, Homo sapiens
ggtatggatcagatgggctcaa

SEQ ID NO: 7116085 - DNA, 22 bp, Homo sapiens
ggtattcaatcagtgttcattc

SEQ ID NO: 7116086 - DNA, 22 bp, Homo sapiens
ggtattcacaatatttaaagag

SEQ ID NO: 7116087 - DNA, 22 bp, Homo sapiens
ggtattcacaatatttaaagag

SEQ ID NO: 7116088 - DNA, 22 bp, Homo sapiens
gggttcagtccctcttgctact

SEQ ID NO: 7116089 - DNA, 22 bp, Homo sapiens
gggttcagtccctcttgctact

SEQ ID NO: 7116090 - DNA, 22 bp, Homo sapiens
gggttcctggctcctgtgtggt

SEQ ID NO: 7116091 - DNA, 22 bp, Homo sapiens
gggttaaagcaggaagcatctt

SEQ ID NO: 7116092 - DNA, 22 bp, Homo sapiens
gggttaaaacaggaagatcagc

SEQ ID NO: 7116093 - DNA, 22 bp, Homo sapiens
gggttaaacatgctatatgagt

SEQ ID NO: 7116094 - DNA, 22 bp, Homo sapiens
gggttaaagagcccaatgtatg

SEQ ID NO: 7116095 - DNA, 22 bp, Homo sapiens
gggtgttgattttacactaaaa

SEQ ID NO: 7116096 - DNA, 22 bp, Homo sapiens
gggtgtttatgtattatgatgt

SEQ ID NO: 7116097 - DNA, 20 bp, Homo sapiens
gggtgtgtgcagggcctggt

SEQ ID NO: 7116098 - DNA, 22 bp, Homo sapiens
gggtgtgtgcagggtggcactc

SEQ ID NO: 7116099 - DNA, 22 bp, Homo sapiens
gggtgtgttcctaaggaaacca

SEQ ID NO: 7116100 - DNA, 22 bp, Homo sapiens
gggtgtgcaggtcatggcgtct

SEQ ID NO: 7116101 - DNA, 21 bp, Homo sapiens
gggtgtggaaattacatcctg

SEQ ID NO: 7116102 - DNA, 22 bp, Homo sapiens
gggtgggatctgtggagcctca

SEQ ID NO: 7116103 - DNA, 22 bp, Homo sapiens
gggtgggatctgtggagcctca

SEQ ID NO: 7116104 - DNA, 20 bp, Homo sapiens
gggtgtggcctgggaatttg

SEQ ID NO: 7116105 - DNA, 22 bp, Homo sapiens
gggtgtggctgcgtgccaataa

SEQ ID NO: 7116106 - DNA, 22 bp, Homo sapiens
gggtgtgtcttttgctcctgga

SEQ ID NO: 7116107 - DNA, 20 bp, Homo sapiens
gggtgtgtgcagggcctggt

SEQ ID NO: 7116108 - DNA, 22 bp, Homo sapiens
gggtgtgtcttttgctcctgga

SEQ ID NO: 7116109 - DNA, 20 bp, Homo sapiens
gggtgtgggcccggccaggc

SEQ ID NO: 7116110 - DNA, 20 bp, Homo sapiens
gggtgtgggcccggccaggc

SEQ ID NO: 7116111 - DNA, 20 bp, Homo sapiens
gggtcctgacttggtctcct

SEQ ID NO: 7116112 - DNA, 22 bp, Homo sapiens
gggtcctgcgtgggcccaggac

SEQ ID NO: 7116113 - DNA, 18 bp, Homo sapiens
gggtcctgtgggagacag

SEQ ID NO: 7116114 - DNA, 22 bp, Homo sapiens
gggtacttaatatttacggggt

SEQ ID NO: 7116115 - DNA, 22 bp, Homo sapiens
gggtagccagacaaggggatgc

SEQ ID NO: 7116116 - DNA, 22 bp, Homo sapiens
gggtaggaaatccagaggtggc

SEQ ID NO: 7116117 - DNA, 22 bp, Homo sapiens
gggtaggaaatccagaggtggc

SEQ ID NO: 7116118 - DNA, 22 bp, Homo sapiens
gggtaggaaatccagaggtggc

SEQ ID NO: 7116119 - DNA, 22 bp, Homo sapiens
gggtaggaaatccagaggtggc

SEQ ID NO: 7116120 - DNA, 19 bp, Homo sapiens
gggtcccaaaagatgtgct

SEQ ID NO: 7116121 - DNA, 22 bp, Homo sapiens
gggtcccaggaaggagcagtgt

SEQ ID NO: 7116122 - DNA, 22 bp, Homo sapiens
gggtccagtagttggtggccgt

SEQ ID NO: 7116123 - DNA, 20 bp, Homo sapiens
gggtacagatatgcagtgaa

SEQ ID NO: 7116124 - DNA, 22 bp, Homo sapiens
gggtacagccgttggttgccgg

SEQ ID NO: 7116125 - DNA, 20 bp, Homo sapiens
gggtacagttctgcagttac

SEQ ID NO: 7116126 - DNA, 22 bp, Homo sapiens
gggtacagttcttccagtgtca

SEQ ID NO: 7116127 - DNA, 22 bp, Homo sapiens
gggtacagttcttccagtgtca

SEQ ID NO: 7116128 - DNA, 22 bp, Homo sapiens
gggtacagttcttccagtgtca

SEQ ID NO: 7116129 - DNA, 22 bp, Homo sapiens
gggtaaatctcttttcatggct

SEQ ID NO: 7116130 - DNA, 22 bp, Homo sapiens
gggtaacgttggaatttttgtg

SEQ ID NO: 7116131 - DNA, 22 bp, Homo sapiens
gggtaaggtcagccagaagttc

SEQ ID NO: 7116132 - DNA, 22 bp, Homo sapiens
gggtaattggggccttgcagtg

SEQ ID NO: 7116133 - DNA, 21 bp, Homo sapiens
ggggttggcaagagcagagac

SEQ ID NO: 7116134 - DNA, 20 bp, Homo sapiens
ggggttggctggcacaggga

SEQ ID NO: 7116135 - DNA, 20 bp, Homo sapiens
ggggttggctggcacaggga

SEQ ID NO: 7116136 - DNA, 20 bp, Homo sapiens
ggggttggctggcacaggga

SEQ ID NO: 7116137 - DNA, 20 bp, Homo sapiens
ggggttggctggcacaggga

SEQ ID NO: 7116138 - DNA, 22 bp, Homo sapiens
ggggttggtttaaatgcttgag

SEQ ID NO: 7116139 - DNA, 22 bp, Homo sapiens
gggtaaatctcttttcatggct

SEQ ID NO: 7116140 - DNA, 22 bp, Homo sapiens
gggtaaatctcttttcatggct

SEQ ID NO: 7116141 - DNA, 19 bp, Homo sapiens
ggggcctgtgatggtcaca

SEQ ID NO: 7116142 - DNA, 22 bp, Homo sapiens
ggggccttggatctgtgccccg

SEQ ID NO: 7116143 - DNA, 22 bp, Homo sapiens
ggggccttggatctgtgccccg

SEQ ID NO: 7116144 - DNA, 19 bp, Homo sapiens
ggggcctgtgatggtcaca

SEQ ID NO: 7116145 - DNA, 19 bp, Homo sapiens
ggggcctgtgatggtcaca

SEQ ID NO: 7116146 - DNA, 19 bp, Homo sapiens
ggggcctgtgatggtcaca

SEQ ID NO: 7116147 - DNA, 22 bp, Homo sapiens
ggggcctgtagagcttcaggga

SEQ ID NO: 7116148 - DNA, 22 bp, Homo sapiens
ggggcctgtagagcttcaggga

SEQ ID NO: 7116149 - DNA, 22 bp, Homo sapiens
ggggcctgtagagcttcaggga

SEQ ID NO: 7116150 - DNA, 22 bp, Homo sapiens
ggggcctgtagagcttcaggga

SEQ ID NO: 7116151 - DNA, 22 bp, Homo sapiens
ggggtgagtgctcagccccgga

SEQ ID NO: 7116152 - DNA, 22 bp, Homo sapiens
ggggtgagctgggcctgtgcct

SEQ ID NO: 7116153 - DNA, 22 bp, Homo sapiens
ggggccttttctgaatgtggaa

SEQ ID NO: 7116154 - DNA, 22 bp, Homo sapiens
ggggcgactgtatcttggggca

SEQ ID NO: 7116155 - DNA, 22 bp, Homo sapiens
ggggccttttctgaatgtggaa

SEQ ID NO: 7116156 - DNA, 22 bp, Homo sapiens
ggggccttttctgaatgtggaa

SEQ ID NO: 7116157 - DNA, 22 bp, Homo sapiens
ggggcagagtctggactgttgt

SEQ ID NO: 7116158 - DNA, 22 bp, Homo sapiens
ggggcagatggaacagagcaca

SEQ ID NO: 7116159 - DNA, 22 bp, Homo sapiens
ggggcagctaccggaagtaggg

SEQ ID NO: 7116160 - DNA, 22 bp, Homo sapiens
ggggcagcctccaggaaagctg

SEQ ID NO: 7116161 - DNA, 22 bp, Homo sapiens
ggggcagctaccggaagtaggg

SEQ ID NO: 7116162 - DNA, 22 bp, Homo sapiens
ggggcagctaccggaagtaggg

SEQ ID NO: 7116163 - DNA, 22 bp, Homo sapiens
ggggcagatggaacagagcaca

SEQ ID NO: 7116164 - DNA, 22 bp, Homo sapiens
ggggcagatggaacagagcaca

SEQ ID NO: 7116165 - DNA, 22 bp, Homo sapiens
ggggcagatggaacagagcaca

SEQ ID NO: 7116166 - DNA, 22 bp, Homo sapiens
ggggcagatggaacagagcaca

SEQ ID NO: 7116167 - DNA, 22 bp, Homo sapiens
ggggcagcctccaggaaagctg

SEQ ID NO: 7116168 - DNA, 22 bp, Homo sapiens
ggggcagcctccaggaaagctg

SEQ ID NO: 7116169 - DNA, 23 bp, Homo sapiens
ggggcctgcaccggtctgcgcgg

SEQ ID NO: 7116170 - DNA, 22 bp, Homo sapiens
ggggcctctgggaacccctgtg

SEQ ID NO: 7116171 - DNA, 23 bp, Homo sapiens
ggggcctgcaccggtctgcgcgg

SEQ ID NO: 7116172 - DNA, 21 bp, Homo sapiens
ggggcctctccacacagccgg

SEQ ID NO: 7116173 - DNA, 21 bp, Homo sapiens
ggggcctctccacacagccgg

SEQ ID NO: 7116174 - DNA, 21 bp, Homo sapiens
ggggcctctccacacagccgg

SEQ ID NO: 7116175 - DNA, 22 bp, Homo sapiens
ggggcctctgcagtcacgctgg

SEQ ID NO: 7116176 - DNA, 22 bp, Homo sapiens
ggggcagagtagctggggtgtg

SEQ ID NO: 7116177 - DNA, 22 bp, Homo sapiens
ggggcagagtagctggggtgtg

SEQ ID NO: 7116178 - DNA, 21 bp, Homo sapiens
ggggcagagctaggccctgca

SEQ ID NO: 7116179 - DNA, 21 bp, Homo sapiens
ggggcagagctaggccctgca

SEQ ID NO: 7116180 - DNA, 22 bp, Homo sapiens
ggggcagagagaaggaagcttg

SEQ ID NO: 7116181 - DNA, 22 bp, Homo sapiens
ggggcagagcatagctccaatt

SEQ ID NO: 7116182 - DNA, 22 bp, Homo sapiens
ggggcagagcatagctccaatt

SEQ ID NO: 7116183 - DNA, 21 bp, Homo sapiens
ggggcagagctaggccctgca

SEQ ID NO: 7116184 - DNA, 22 bp, Homo sapiens
ggggaggaagctctcagttcca

SEQ ID NO: 7116185 - DNA, 22 bp, Homo sapiens
ggggaggaagctctcagttcca

SEQ ID NO: 7116186 - DNA, 22 bp, Homo sapiens
ggggaggaagctctcagttcca

SEQ ID NO: 7116187 - DNA, 22 bp, Homo sapiens
ggggaggaagctctcagttcca

SEQ ID NO: 7116188 - DNA, 22 bp, Homo sapiens
ggggaggaagctctcagttcca

SEQ ID NO: 7116189 - DNA, 22 bp, Homo sapiens
ggggcagaagtagtgcccctga

SEQ ID NO: 7116190 - DNA, 22 bp, Homo sapiens
ggggcagaagtagtgcccctga

SEQ ID NO: 7116191 - DNA, 22 bp, Homo sapiens
ggggcagaagtagtgcccctga

SEQ ID NO: 7116192 - DNA, 22 bp, Homo sapiens
ggggcagagaataaaaacctaa

SEQ ID NO: 7116193 - DNA, 22 bp, Homo sapiens
ggggcagagaataaaaacctaa

SEQ ID NO: 7116194 - DNA, 22 bp, Homo sapiens
ggggcagagagaaggaagcttg

SEQ ID NO: 7116195 - DNA, 22 bp, Homo sapiens
ggggcagagagaaggaagcttg

SEQ ID NO: 7116196 - DNA, 22 bp, Homo sapiens
gggctgtaggagctggaatggg

SEQ ID NO: 7116197 - DNA, 22 bp, Homo sapiens
gggctggatctcctgcaggcag

SEQ ID NO: 7116198 - DNA, 22 bp, Homo sapiens
gggctggatctcctgcaggcag

SEQ ID NO: 7116199 - DNA, 22 bp, Homo sapiens
gggctggatctcacgtgagacc

SEQ ID NO: 7116200 - DNA, 22 bp, Homo sapiens
gggctggatctcacgtgagacc

SEQ ID NO: 7116201 - DNA, 22 bp, Homo sapiens
gggctggatctcacgtgagacc

SEQ ID NO: 7116202 - DNA, 21 bp, Homo sapiens
gggctggatattggaaagagg

SEQ ID NO: 7116203 - DNA, 21 bp, Homo sapiens
gggctggatattggaaagagg

SEQ ID NO: 7116204 - DNA, 21 bp, Homo sapiens
gggctggatattggaaagagg

SEQ ID NO: 7116205 - DNA, 22 bp, Homo sapiens
gggctgtaggagctggaatggg

SEQ ID NO: 7116206 - DNA, 22 bp, Homo sapiens
gggctgtaggagctggaatggg

SEQ ID NO: 7116207 - DNA, 22 bp, Homo sapiens
gggctgtccgcacatctggaat

SEQ ID NO: 7116208 - DNA, 22 bp, Homo sapiens
gggctgtgagagtggggctgct

SEQ ID NO: 7116209 - DNA, 22 bp, Homo sapiens
gggctgtgagagtggggctgct

SEQ ID NO: 7116210 - DNA, 22 bp, Homo sapiens
gggctgtgagagtggggctgct

SEQ ID NO: 7116211 - DNA, 22 bp, Homo sapiens
gggctgtgagagtggggctgct

SEQ ID NO: 7116212 - DNA, 22 bp, Homo sapiens
gggctgtgagagtggggctgct

SEQ ID NO: 7116213 - DNA, 18 bp, Homo sapiens
gggctgtgagatgggaag

SEQ ID NO: 7116214 - DNA, 18 bp, Homo sapiens
gggctgtgagatgggaag

SEQ ID NO: 7116215 - DNA, 18 bp, Homo sapiens
gggctgtgagatgggaag

SEQ ID NO: 7116216 - DNA, 18 bp, Homo sapiens
gggctgtgagatgggaag

SEQ ID NO: 7116217 - DNA, 22 bp, Homo sapiens
gggctgtgaggtgagaacttac

SEQ ID NO: 7116218 - DNA, 22 bp, Homo sapiens
gggctgtgcctcaggtggggtc

SEQ ID NO: 7116219 - DNA, 22 bp, Homo sapiens
gggctgtgcctcaggtggggtc

SEQ ID NO: 7116220 - DNA, 22 bp, Homo sapiens
gggctgtgcctcaggtggggtc

SEQ ID NO: 7116221 - DNA, 22 bp, Homo sapiens
gggctgtgcctcaggtggggtc

SEQ ID NO: 7116222 - DNA, 22 bp, Homo sapiens
gggctgtgcctcaggtggggtc

SEQ ID NO: 7116223 - DNA, 22 bp, Homo sapiens
gggctgtgcctcaggtggggtc

SEQ ID NO: 7116224 - DNA, 22 bp, Homo sapiens
gggctgtgcctcaggtggggtc

SEQ ID NO: 7116225 - DNA, 20 bp, Homo sapiens
gggctgtgcctcctcgtggt

SEQ ID NO: 7116226 - DNA, 22 bp, Homo sapiens
gggctgtgctgagtaggaggtg

SEQ ID NO: 7116227 - DNA, 22 bp, Homo sapiens
gggctgtgctgagtaggaggtg

SEQ ID NO: 7116228 - DNA, 22 bp, Homo sapiens
gggctgtgctgagtaggaggtg

SEQ ID NO: 7116229 - DNA, 22 bp, Homo sapiens
gggctgtgctgagtaggaggtg

SEQ ID NO: 7116230 - DNA, 22 bp, Homo sapiens
gggctgtgctgagtaggaggtg

SEQ ID NO: 7116231 - DNA, 22 bp, Homo sapiens
gggctgtggagccgcgagggct

SEQ ID NO: 7116232 - DNA, 22 bp, Homo sapiens
gggctgtggagccgcgagggct

SEQ ID NO: 7116233 - DNA, 22 bp, Homo sapiens
gggctgtggagccgcgagggct

SEQ ID NO: 7116234 - DNA, 22 bp, Homo sapiens
gggctgtggagccgcgagggct

SEQ ID NO: 7116235 - DNA, 22 bp, Homo sapiens
gggctgtgtaatgtgctctttt

SEQ ID NO: 7116236 - DNA, 22 bp, Homo sapiens
gggctgtgtactatgaggaggg

SEQ ID NO: 7116237 - DNA, 22 bp, Homo sapiens
gggctgtgtactatgaggaggg

SEQ ID NO: 7116238 - DNA, 22 bp, Homo sapiens
gggctgtgtactatgaggaggg

SEQ ID NO: 7116239 - DNA, 22 bp, Homo sapiens
gggctgtgtactatgaggaggg

SEQ ID NO: 7116240 - DNA, 22 bp, Homo sapiens
gggctgtgtactatgaggaggg

SEQ ID NO: 7116241 - DNA, 22 bp, Homo sapiens
gggctgtgtactatgaggaggg

SEQ ID NO: 7116242 - DNA, 22 bp, Homo sapiens
gggctggaggtgagcaggacag

SEQ ID NO: 7116243 - DNA, 22 bp, Homo sapiens
gggctggaggtgagcaggacag

SEQ ID NO: 7116244 - DNA, 22 bp, Homo sapiens
gggctggaggtgagcaggacag

SEQ ID NO: 7116245 - DNA, 22 bp, Homo sapiens
gggctggaggtgagcaggacag

SEQ ID NO: 7116246 - DNA, 22 bp, Homo sapiens
gggctggaggtgagcaggacag

SEQ ID NO: 7116247 - DNA, 19 bp, Homo sapiens
gggctggagggatagagcc

SEQ ID NO: 7116248 - DNA, 19 bp, Homo sapiens
gggctggagggatagagcc

SEQ ID NO: 7116249 - DNA, 22 bp, Homo sapiens
gggctggaggtgagcaggacag

SEQ ID NO: 7116250 - DNA, 22 bp, Homo sapiens
gggctggagtcttctgaaagcc

SEQ ID NO: 7116251 - DNA, 22 bp, Homo sapiens
gggctggagttgggaagacaaa

SEQ ID NO: 7116252 - DNA, 22 bp, Homo sapiens
gggctggagttgggaagacaaa

SEQ ID NO: 7116253 - DNA, 22 bp, Homo sapiens
gggctggagttgggaagacaaa

SEQ ID NO: 7116254 - DNA, 22 bp, Homo sapiens
gggctggaggagatccagaggc

SEQ ID NO: 7116255 - DNA, 21 bp, Homo sapiens
gggctggaggatgggaagccc

SEQ ID NO: 7116256 - DNA, 22 bp, Homo sapiens
gggctggaggcctgcctggtta

SEQ ID NO: 7116257 - DNA, 22 bp, Homo sapiens
gggctggaggcctgcctggtta

SEQ ID NO: 7116258 - DNA, 22 bp, Homo sapiens
gggctggaggcctgcctggtta

SEQ ID NO: 7116259 - DNA, 19 bp, Homo sapiens
gggctggagggatagagcc

SEQ ID NO: 7116260 - DNA, 19 bp, Homo sapiens
gggctggagggatagagcc

SEQ ID NO: 7116261 - DNA, 19 bp, Homo sapiens
gggctggagggatagagcc

SEQ ID NO: 7116262 - DNA, 22 bp, Homo sapiens
gggctggaggaccggcctcgga

SEQ ID NO: 7116263 - DNA, 22 bp, Homo sapiens
gggctgagtgggcctcttactt

SEQ ID NO: 7116264 - DNA, 22 bp, Homo sapiens
gggctggaggaccggcctcgga

SEQ ID NO: 7116265 - DNA, 22 bp, Homo sapiens
cagagccactgtctgccaggca

SEQ ID NO: 7116266 - DNA, 22 bp, Homo sapiens
cagagccagaactagaccttgt

SEQ ID NO: 7116267 - DNA, 21 bp, Homo sapiens
cagagccagactgctgaattt

SEQ ID NO: 7116268 - DNA, 22 bp, Homo sapiens
cagagccagagacctgctgtgc

SEQ ID NO: 7116269 - DNA, 22 bp, Homo sapiens
cagagccagagacctgctgtgc

SEQ ID NO: 7116270 - DNA, 22 bp, Homo sapiens
cagagaagagtctggcctctct

SEQ ID NO: 7116271 - DNA, 22 bp, Homo sapiens
cagagaagaaagtgactataat

SEQ ID NO: 7116272 - DNA, 22 bp, Homo sapiens
cagagaagaaagtgactataat

SEQ ID NO: 7116273 - DNA, 22 bp, Homo sapiens
cagagaattaattgtggctaag

SEQ ID NO: 7116274 - DNA, 22 bp, Homo sapiens
cagagacaacaagtttaactat

SEQ ID NO: 7116275 - DNA, 22 bp, Homo sapiens
cagagacaacaagtttaactat

SEQ ID NO: 7116276 - DNA, 22 bp, Homo sapiens
cagagaataaaagggcattcct

SEQ ID NO: 7116277 - DNA, 22 bp, Homo sapiens
cagagacaacaagtttaactat

SEQ ID NO: 7116278 - DNA, 22 bp, Homo sapiens
cagagacaacctggtagagaaa

SEQ ID NO: 7116279 - DNA, 22 bp, Homo sapiens
cagagacaacctggtagagaaa

SEQ ID NO: 7116280 - DNA, 22 bp, Homo sapiens
cagagaactccagtggctggcg

SEQ ID NO: 7116281 - DNA, 22 bp, Homo sapiens
cagacttgaaagagactcagtt

SEQ ID NO: 7116282 - DNA, 22 bp, Homo sapiens
cagactgtgtctgaacctggtc

SEQ ID NO: 7116283 - DNA, 20 bp, Homo sapiens
gggaggcattggtccctcac

SEQ ID NO: 7116284 - DNA, 20 bp, Homo sapiens
gggaggcattggtccctcac

SEQ ID NO: 7116285 - DNA, 20 bp, Homo sapiens
gggaggcattggtccctcac

SEQ ID NO: 7116286 - DNA, 22 bp, Homo sapiens
cagagacacttaacaggaatgg

SEQ ID NO: 7116287 - DNA, 22 bp, Homo sapiens
cagagacagaaaatggatctag

SEQ ID NO: 7116288 - DNA, 22 bp, Homo sapiens
cagagacacttaacaggaatgg

SEQ ID NO: 7116289 - DNA, 22 bp, Homo sapiens
cagagacacttaacaggaatgg

SEQ ID NO: 7116290 - DNA, 22 bp, Homo sapiens
cagagacacttaacaggaatgg

SEQ ID NO: 7116291 - DNA, 22 bp, Homo sapiens
cagagacacttaacaggaatgg

SEQ ID NO: 7116292 - DNA, 22 bp, Homo sapiens
cagagacaacctggtagagaaa

SEQ ID NO: 7116293 - DNA, 22 bp, Homo sapiens
cagagacaacctggtagagaaa

SEQ ID NO: 7116294 - DNA, 22 bp, Homo sapiens
cagagacaacctggtagagaaa

SEQ ID NO: 7116295 - DNA, 22 bp, Homo sapiens
cagagacaatgtctctgcttgt

SEQ ID NO: 7116296 - DNA, 22 bp, Homo sapiens
cagagacaatgtctctgcttgt

SEQ ID NO: 7116297 - DNA, 22 bp, Homo sapiens
cagagacaccccagaaaataag

SEQ ID NO: 7116298 - DNA, 22 bp, Homo sapiens
gggatgagagctgggacagaag

SEQ ID NO: 7116299 - DNA, 22 bp, Homo sapiens
gggatgagagctgggacagaag

SEQ ID NO: 7116300 - DNA, 22 bp, Homo sapiens
gggatgagagtagggtgtgaaa

SEQ ID NO: 7116301 - DNA, 22 bp, Homo sapiens
gggatgagagctgggacagaag

SEQ ID NO: 7116302 - DNA, 22 bp, Homo sapiens
gggatgagagctgggacagaag

SEQ ID NO: 7116303 - DNA, 22 bp, Homo sapiens
gggatgagagctgggacagaag

SEQ ID NO: 7116304 - DNA, 22 bp, Homo sapiens
gggatgagagctgggacagaag

SEQ ID NO: 7116305 - DNA, 22 bp, Homo sapiens
gggatctgctccagagggaaaa

SEQ ID NO: 7116306 - DNA, 23 bp, Homo sapiens
gggatctgtaaacctggagaacc

SEQ ID NO: 7116307 - DNA, 23 bp, Homo sapiens
gggatctgtaagttgaagacaaa

SEQ ID NO: 7116308 - DNA, 20 bp, Homo sapiens
gggatcttccaggctctcct

SEQ ID NO: 7116309 - DNA, 22 bp, Homo sapiens
gggatcttgaaacagctggatt

SEQ ID NO: 7116310 - DNA, 22 bp, Homo sapiens
gggatcttgggaacacccttac

SEQ ID NO: 7116311 - DNA, 21 bp, Homo sapiens
gggatcttgtactggcgtgga

SEQ ID NO: 7116312 - DNA, 22 bp, Homo sapiens
gggatcttgtttaatattgttt

SEQ ID NO: 7116313 - DNA, 22 bp, Homo sapiens
gggatctttctgatgctgtggc

SEQ ID NO: 7116314 - DNA, 22 bp, Homo sapiens
cagagcagaagcggtcctcaca

SEQ ID NO: 7116315 - DNA, 22 bp, Homo sapiens
cagagcagaaacctgggtgatt

SEQ ID NO: 7116316 - DNA, 22 bp, Homo sapiens
cagagcagaagcggtcctcaca

SEQ ID NO: 7116317 - DNA, 22 bp, Homo sapiens
cagagcagaagcggtcctcaca

SEQ ID NO: 7116318 - DNA, 22 bp, Homo sapiens
cagagcagaagcggtcctcaca

SEQ ID NO: 7116319 - DNA, 22 bp, Homo sapiens
cagagcagaaacctgggtgatt

SEQ ID NO: 7116320 - DNA, 22 bp, Homo sapiens
cagagcactgcttggaggattt

SEQ ID NO: 7116321 - DNA, 22 bp, Homo sapiens
cagagcagaaacctgggtgatt

SEQ ID NO: 7116322 - DNA, 22 bp, Homo sapiens
cagagcagaaacctgggtgatt

SEQ ID NO: 7116323 - DNA, 22 bp, Homo sapiens
gggatgagagctgggacagaag

SEQ ID NO: 7116324 - DNA, 22 bp, Homo sapiens
cagagaggaggctatatgcaaa

SEQ ID NO: 7116325 - DNA, 22 bp, Homo sapiens
cagagaggaggctatatgcaaa

SEQ ID NO: 7116326 - DNA, 22 bp, Homo sapiens
cagagaggatggattccatagc

SEQ ID NO: 7116327 - DNA, 22 bp, Homo sapiens
cagagcacctgctcattgccag

SEQ ID NO: 7116328 - DNA, 22 bp, Homo sapiens
cagagcacctgctcattgccag

SEQ ID NO: 7116329 - DNA, 22 bp, Homo sapiens
cagagccaaacctcagggcccg

SEQ ID NO: 7116330 - DNA, 22 bp, Homo sapiens
cagagccaaacctcagggcccg

SEQ ID NO: 7116331 - DNA, 22 bp, Homo sapiens
cagagcatgaataaaagttaca

SEQ ID NO: 7116332 - DNA, 22 bp, Homo sapiens
cagagcatgtcaactagcttta

SEQ ID NO: 7116333 - DNA, 22 bp, Homo sapiens
cagagcatgtcaactagcttta

SEQ ID NO: 7116334 - DNA, 22 bp, Homo sapiens
cagagcattaaaaccagctctg

SEQ ID NO: 7116335 - DNA, 22 bp, Homo sapiens
cagagcattaaaaccagctctg

SEQ ID NO: 7116336 - DNA, 22 bp, Homo sapiens
cagagcattaaaaccagctctg

SEQ ID NO: 7116337 - DNA, 22 bp, Homo sapiens
cagagcattgagggtctgccaa

SEQ ID NO: 7116338 - DNA, 22 bp, Homo sapiens
cagagcattgagggtctgccaa

SEQ ID NO: 7116339 - DNA, 22 bp, Homo sapiens
cagagcatttggaagccacgtg

SEQ ID NO: 7116340 - DNA, 22 bp, Homo sapiens
cagagccaacgccacctgccca

SEQ ID NO: 7116341 - DNA, 22 bp, Homo sapiens
cagagccaacgccacctgccca

SEQ ID NO: 7116342 - DNA, 20 bp, Homo sapiens
cagagccaagagcagcatct

SEQ ID NO: 7116343 - DNA, 22 bp, Homo sapiens
cagagccacagcctccagattt

SEQ ID NO: 7116344 - DNA, 22 bp, Homo sapiens
cagagcataattgacatgaggt

SEQ ID NO: 7116345 - DNA, 22 bp, Homo sapiens
cagagcataattgacatgaggt

SEQ ID NO: 7116346 - DNA, 22 bp, Homo sapiens
cagagcataattgacatgaggt

SEQ ID NO: 7116347 - DNA, 19 bp, Homo sapiens
cagagcagtggttcctgaa

SEQ ID NO: 7116348 - DNA, 22 bp, Homo sapiens
cagagcataattgacatgaggt

SEQ ID NO: 7116349 - DNA, 22 bp, Homo sapiens
cagagcataattgacatgaggt

SEQ ID NO: 7116350 - DNA, 22 bp, Homo sapiens
cagagcatcgcgcagagagcct

SEQ ID NO: 7116351 - DNA, 22 bp, Homo sapiens
cagagcatcgcgcagagagcct

SEQ ID NO: 7116352 - DNA, 22 bp, Homo sapiens
cagagcatcgcgcagagagcct

SEQ ID NO: 7116353 - DNA, 22 bp, Homo sapiens
cagagcagtggggttggtcaga

SEQ ID NO: 7116354 - DNA, 22 bp, Homo sapiens
cagagcagtggggttggtcaga

SEQ ID NO: 7116355 - DNA, 22 bp, Homo sapiens
cagagcagtggagagtaggtct

SEQ ID NO: 7116356 - DNA, 22 bp, Homo sapiens
cagagcagtggagagtaggtct

SEQ ID NO: 7116357 - DNA, 19 bp, Homo sapiens
cagagcagtggttcctgaa

SEQ ID NO: 7116358 - DNA, 19 bp, Homo sapiens
cagagcagtggttcctgaa

SEQ ID NO: 7116359 - DNA, 20 bp, Homo sapiens
cagagcagtgcccaggcggc

SEQ ID NO: 7116360 - DNA, 20 bp, Homo sapiens
cagagcagtgcccaggcggc

SEQ ID NO: 7116361 - DNA, 22 bp, Homo sapiens
cagagcagtggagagtaggtct

SEQ ID NO: 7116362 - DNA, 22 bp, Homo sapiens
cagagcagtggagagtaggtct

SEQ ID NO: 7116363 - DNA, 22 bp, Homo sapiens
cagagcagtggagagtaggtct

SEQ ID NO: 7116364 - DNA, 22 bp, Homo sapiens
cagagcagtgaggagttgtgta

SEQ ID NO: 7116365 - DNA, 22 bp, Homo sapiens
cagagcagtgaggagttgtgta

SEQ ID NO: 7116366 - DNA, 20 bp, Homo sapiens
cagagcagtgcccaggcggc

SEQ ID NO: 7116367 - DNA, 20 bp, Homo sapiens
cagagcagtgcccaggcggc

SEQ ID NO: 7116368 - DNA, 22 bp, Homo sapiens
cagagcagacgttgagattaag

SEQ ID NO: 7116369 - DNA, 22 bp, Homo sapiens
cagagcagacgttgagattaag

SEQ ID NO: 7116370 - DNA, 22 bp, Homo sapiens
cagagcagacgttgagattaag

SEQ ID NO: 7116371 - DNA, 18 bp, Homo sapiens
cagagcagaggtggagcg

SEQ ID NO: 7116372 - DNA, 18 bp, Homo sapiens
cagagcagaggtggagcg

SEQ ID NO: 7116373 - DNA, 22 bp, Homo sapiens
cagagcagaaggtccaagcctg

SEQ ID NO: 7116374 - DNA, 22 bp, Homo sapiens
cagagcagaaggtccaagcctg

SEQ ID NO: 7116375 - DNA, 17 bp, Homo sapiens
gggcagggactcctggg

SEQ ID NO: 7116376 - DNA, 18 bp, Homo sapiens
cagagcagaggtggagcg

SEQ ID NO: 7116377 - DNA, 22 bp, Homo sapiens
gggcaggggtagcattccaagt

SEQ ID NO: 7116378 - DNA, 22 bp, Homo sapiens
gggcaggggtagcattccaagt

SEQ ID NO: 7116379 - DNA, 22 bp, Homo sapiens
gggcaggggtagcattccaagt

SEQ ID NO: 7116380 - DNA, 22 bp, Homo sapiens
gggcaggggtagcattccaagt

SEQ ID NO: 7116381 - DNA, 22 bp, Homo sapiens
gggcaggggtagcattccaagt

SEQ ID NO: 7116382 - DNA, 22 bp, Homo sapiens
gggcaggggtagcattccaagt

SEQ ID NO: 7116383 - DNA, 22 bp, Homo sapiens
gggcaggggtagcattccaagt

SEQ ID NO: 7116384 - DNA, 22 bp, Homo sapiens
gggcaggggtcagtggccccaa

SEQ ID NO: 7116385 - DNA, 22 bp, Homo sapiens
gggcaggggtcagtggccccaa

SEQ ID NO: 7116386 - DNA, 22 bp, Homo sapiens
gggcaggggtcagtggccccaa

SEQ ID NO: 7116387 - DNA, 22 bp, Homo sapiens
gggcaggggtcagtggccccaa

SEQ ID NO: 7116388 - DNA, 22 bp, Homo sapiens
gggcaggggtcagtggccccaa

SEQ ID NO: 7116389 - DNA, 22 bp, Homo sapiens
cagagcagtgaggagttgtgta

SEQ ID NO: 7116390 - DNA, 22 bp, Homo sapiens
cagagcagtctggagatccagc

SEQ ID NO: 7116391 - DNA, 22 bp, Homo sapiens
cagagcaggggtttcccaggtt

SEQ ID NO: 7116392 - DNA, 22 bp, Homo sapiens
cagagcagtgaggagttgtgta

SEQ ID NO: 7116393 - DNA, 22 bp, Homo sapiens
cagagcaggggtttcccaggtt

SEQ ID NO: 7116394 - DNA, 22 bp, Homo sapiens
cagagcaggggtttcccaggtt

SEQ ID NO: 7116395 - DNA, 22 bp, Homo sapiens
cagagcaggcccactgccctcc

SEQ ID NO: 7116396 - DNA, 22 bp, Homo sapiens
gggcaggtaggtgaaataatga

SEQ ID NO: 7116397 - DNA, 22 bp, Homo sapiens
gggcaggtactgggtggtgagc

SEQ ID NO: 7116398 - DNA, 22 bp, Homo sapiens
gggcaggggtcagtggccccaa

SEQ ID NO: 7116399 - DNA, 22 bp, Homo sapiens
gggcaggggtcagtggccccaa

SEQ ID NO: 7116400 - DNA, 22 bp, Homo sapiens
gggcaggggtcagtggccccaa

SEQ ID NO: 7116401 - DNA, 22 bp, Homo sapiens
gggcaggtacaagatgcttctt

SEQ ID NO: 7116402 - DNA, 22 bp, Homo sapiens
gggcaggggtcagtggccccaa

SEQ ID NO: 7116403 - DNA, 22 bp, Homo sapiens
gggcaggtacaagatgcttctt

SEQ ID NO: 7116404 - DNA, 22 bp, Homo sapiens
gggcaggtactgggtggtgagc

SEQ ID NO: 7116405 - DNA, 22 bp, Homo sapiens
gggcaggtactgggtggtgagc

SEQ ID NO: 7116406 - DNA, 22 bp, Homo sapiens
gggaggcagtgctggaggctgg

SEQ ID NO: 7116407 - DNA, 22 bp, Homo sapiens
gggaggcagtgctggaggctgg

SEQ ID NO: 7116408 - DNA, 22 bp, Homo sapiens
gggaggcagtgctggaggctgg

SEQ ID NO: 7116409 - DNA, 22 bp, Homo sapiens
gggaggcagtgctggaggctgg

SEQ ID NO: 7116410 - DNA, 22 bp, Homo sapiens
gggaggcagtgctggaggctgg

SEQ ID NO: 7116411 - DNA, 22 bp, Homo sapiens
gggaggcagtgctggaggctgg

SEQ ID NO: 7116412 - DNA, 22 bp, Homo sapiens
gggaggcatgtgttatccactt

SEQ ID NO: 7116413 - DNA, 22 bp, Homo sapiens
gggaggcatgtgttatccactt

SEQ ID NO: 7116414 - DNA, 22 bp, Homo sapiens
gggaggcatgtgttatccactt

SEQ ID NO: 7116415 - DNA, 22 bp, Homo sapiens
gggaggagtgaagattcacctg

SEQ ID NO: 7116416 - DNA, 22 bp, Homo sapiens
gggaggagggtgctggctaaac

SEQ ID NO: 7116417 - DNA, 22 bp, Homo sapiens
gggaggagtgaagattcacctg

SEQ ID NO: 7116418 - DNA, 22 bp, Homo sapiens
gggaggagtgaagattcacctg

SEQ ID NO: 7116419 - DNA, 22 bp, Homo sapiens
gggaggcacgaggcgcgcagtg

SEQ ID NO: 7116420 - DNA, 22 bp, Homo sapiens
gggaggcacgaggcgcgcagtg

SEQ ID NO: 7116421 - DNA, 22 bp, Homo sapiens
gggaggcacgaggcgcgcagtg

SEQ ID NO: 7116422 - DNA, 22 bp, Homo sapiens
gggaggcacgaggcgcgcagtg

SEQ ID NO: 7116423 - DNA, 22 bp, Homo sapiens
gggaggcacgaggcgcgcagtg

SEQ ID NO: 7116424 - DNA, 22 bp, Homo sapiens
gggaggcagtgctggaggctgg

SEQ ID NO: 7116425 - DNA, 22 bp, Homo sapiens
gggaggcagtgctggaggctgg

SEQ ID NO: 7116426 - DNA, 22 bp, Homo sapiens
gggaggcagtgctggaggctgg

SEQ ID NO: 7116427 - DNA, 21 bp, Homo sapiens
gggagctggaaactgggtgac

SEQ ID NO: 7116428 - DNA, 21 bp, Homo sapiens
gggagctggaaactgggtgac

SEQ ID NO: 7116429 - DNA, 22 bp, Homo sapiens
gggagctgctgaacacaagggt

SEQ ID NO: 7116430 - DNA, 21 bp, Homo sapiens
gggagctggaaactgggtgac

SEQ ID NO: 7116431 - DNA, 21 bp, Homo sapiens
gggagctggaaactgggtgac

SEQ ID NO: 7116432 - DNA, 21 bp, Homo sapiens
gggagctggaaactgggtgac

SEQ ID NO: 7116433 - DNA, 20 bp, Homo sapiens
gggagctggaattgtcttag

SEQ ID NO: 7116434 - DNA, 21 bp, Homo sapiens
gggagctggaaactgggtgac

SEQ ID NO: 7116435 - DNA, 21 bp, Homo sapiens
gggagctggaaactgggtgac

SEQ ID NO: 7116436 - DNA, 20 bp, Homo sapiens
gggagctggaattgtcttag

SEQ ID NO: 7116437 - DNA, 20 bp, Homo sapiens
gggagctggaattgtcttag

SEQ ID NO: 7116438 - DNA, 22 bp, Homo sapiens
gggagctgccaccacccctggg

SEQ ID NO: 7116439 - DNA, 22 bp, Homo sapiens
gggagctgccaccacccctggg

SEQ ID NO: 7116440 - DNA, 22 bp, Homo sapiens
gggagctgccttagaccggagg

SEQ ID NO: 7116441 - DNA, 22 bp, Homo sapiens
gggagctgccttagaccggagg

SEQ ID NO: 7116442 - DNA, 22 bp, Homo sapiens
gggagctgccttagaccggagg

SEQ ID NO: 7116443 - DNA, 22 bp, Homo sapiens
gggagctgcggtcttgcgaaga

SEQ ID NO: 7116444 - DNA, 22 bp, Homo sapiens
gggagctgcggtcttgcgaaga

SEQ ID NO: 7116445 - DNA, 22 bp, Homo sapiens
gggagctgctgaacacaagggt

SEQ ID NO: 7116446 - DNA, 22 bp, Homo sapiens
gggagctgctgaacacaagggt

SEQ ID NO: 7116447 - DNA, 22 bp, Homo sapiens
gggagctgctgaacacaagggt

SEQ ID NO: 7116448 - DNA, 22 bp, Homo sapiens
cagacacaccaggcccattctg

SEQ ID NO: 7116449 - DNA, 22 bp, Homo sapiens
cagacacagatatgcatatggc

SEQ ID NO: 7116450 - DNA, 22 bp, Homo sapiens
cagacacagatatgcatatggc

SEQ ID NO: 7116451 - DNA, 22 bp, Homo sapiens
cagacacagatatgcatatggc

SEQ ID NO: 7116452 - DNA, 22 bp, Homo sapiens
cagacacaccaggcccattctg

SEQ ID NO: 7116453 - DNA, 22 bp, Homo sapiens
cagacacagatatgcatatggc

SEQ ID NO: 7116454 - DNA, 22 bp, Homo sapiens
cagacacacaagcaatctaagt

SEQ ID NO: 7116455 - DNA, 22 bp, Homo sapiens
cagacacacaccctggcctagc

SEQ ID NO: 7116456 - DNA, 22 bp, Homo sapiens
cagacacacaccctggcctagc

SEQ ID NO: 7116457 - DNA, 22 bp, Homo sapiens
cagacacacaccctggcctagc

SEQ ID NO: 7116458 - DNA, 22 bp, Homo sapiens
cagacacaccaggcccattctg

SEQ ID NO: 7116459 - DNA, 18 bp, Homo sapiens
cagacactctgctctgca

SEQ ID NO: 7116460 - DNA, 22 bp, Homo sapiens
cagacactattgtgtataaatc

SEQ ID NO: 7116461 - DNA, 18 bp, Homo sapiens
cagacactctgctctgca

SEQ ID NO: 7116462 - DNA, 18 bp, Homo sapiens
cagacactctgctctgca

SEQ ID NO: 7116463 - DNA, 22 bp, Homo sapiens
cagacactatgctaaggtacta

SEQ ID NO: 7116464 - DNA, 22 bp, Homo sapiens
cagacactatgctaaggtacta

SEQ ID NO: 7116465 - DNA, 22 bp, Homo sapiens
cagacactattgtgtataaatc

SEQ ID NO: 7116466 - DNA, 22 bp, Homo sapiens
cagacactaggtgacagagtgc

SEQ ID NO: 7116467 - DNA, 22 bp, Homo sapiens
cagacactaggtgacagagtgc

SEQ ID NO: 7116468 - DNA, 22 bp, Homo sapiens
cagacacagcaattctgtgttg

SEQ ID NO: 7116469 - DNA, 22 bp, Homo sapiens
cagacacagcaattctgtgttg

SEQ ID NO: 7116470 - DNA, 22 bp, Homo sapiens
cagacacagcaattctgtgttg

SEQ ID NO: 7116471 - DNA, 22 bp, Homo sapiens
cagacacagcaattctgtgttg

SEQ ID NO: 7116472 - DNA, 22 bp, Homo sapiens
gggagctgccaccacccctggg

SEQ ID NO: 7116473 - DNA, 22 bp, Homo sapiens
gggagctgccaccacccctggg

SEQ ID NO: 7116474 - DNA, 22 bp, Homo sapiens
gggagctgcacacgccccggaa

SEQ ID NO: 7116475 - DNA, 22 bp, Homo sapiens
gggagctgatgatgtaagtccc

SEQ ID NO: 7116476 - DNA, 22 bp, Homo sapiens
gggagctgatgatgtaagtccc

SEQ ID NO: 7116477 - DNA, 22 bp, Homo sapiens
gggagctgcacacgccccggaa

SEQ ID NO: 7116478 - DNA, 22 bp, Homo sapiens
gggagctgcacacgccccggaa

SEQ ID NO: 7116479 - DNA, 22 bp, Homo sapiens
gggagctgcacacgccccggaa

SEQ ID NO: 7116480 - DNA, 22 bp, Homo sapiens
gggagccacagtagcagctact

SEQ ID NO: 7116481 - DNA, 22 bp, Homo sapiens
gggagctgatcaggtggattca

SEQ ID NO: 7116482 - DNA, 22 bp, Homo sapiens
gggagccacagtagcagctact

SEQ ID NO: 7116483 - DNA, 22 bp, Homo sapiens
gggagctgatcaggtggattca

SEQ ID NO: 7116484 - DNA, 22 bp, Homo sapiens
gggagctgatgatgtaagtccc

SEQ ID NO: 7116485 - DNA, 18 bp, Homo sapiens
cagacactctgctctgca

SEQ ID NO: 7116486 - DNA, 22 bp, Homo sapiens
cagacactgcagcagtctccca

SEQ ID NO: 7116487 - DNA, 22 bp, Homo sapiens
cagacactgcagcagtctccca

SEQ ID NO: 7116488 - DNA, 22 bp, Homo sapiens
cagacacttattgagcaagtac

SEQ ID NO: 7116489 - DNA, 22 bp, Homo sapiens
cagacacttattgagcaagtac

SEQ ID NO: 7116490 - DNA, 22 bp, Homo sapiens
cagacagaaggaaggccaacat

SEQ ID NO: 7116491 - DNA, 22 bp, Homo sapiens
cagacagaaggaaggccaacat

SEQ ID NO: 7116492 - DNA, 22 bp, Homo sapiens
cagacagaaggaaggccaacat

SEQ ID NO: 7116493 - DNA, 22 bp, Homo sapiens
cagacagaaggctccttgaggt

SEQ ID NO: 7116494 - DNA, 22 bp, Homo sapiens
gggagcagttaaaatgattcct

SEQ ID NO: 7116495 - DNA, 22 bp, Homo sapiens
cagacagaaggaaggccaacat

SEQ ID NO: 7116496 - DNA, 22 bp, Homo sapiens
gggagccaaggagagaggcctt

SEQ ID NO: 7116497 - DNA, 22 bp, Homo sapiens
gggagccaaggagagaggcctt

SEQ ID NO: 7116498 - DNA, 22 bp, Homo sapiens
ggctggcacagagggctggtgt

SEQ ID NO: 7116499 - DNA, 22 bp, Homo sapiens
ggctggcacagagggctggtgt

SEQ ID NO: 7116500 - DNA, 22 bp, Homo sapiens
ggctggcaagtgtctgctcatg

SEQ ID NO: 7116501 - DNA, 22 bp, Homo sapiens
ggctggcaagtgtctgctcatg

SEQ ID NO: 7116502 - DNA, 22 bp, Homo sapiens
ggctggcacccttggggatagg

SEQ ID NO: 7116503 - DNA, 22 bp, Homo sapiens
ggctggcacccttggggatagg

SEQ ID NO: 7116504 - DNA, 19 bp, Homo sapiens
ggctggcaagtgacagtgt

SEQ ID NO: 7116505 - DNA, 22 bp, Homo sapiens
ggctggcaagtgtctgctcatg

SEQ ID NO: 7116506 - DNA, 22 bp, Homo sapiens
ggctggcactgaggagagctct

SEQ ID NO: 7116507 - DNA, 22 bp, Homo sapiens
ggctggcacgaagccctgctgg

SEQ ID NO: 7116508 - DNA, 22 bp, Homo sapiens
ggctggcactctgtccagtgtc

SEQ ID NO: 7116509 - DNA, 22 bp, Homo sapiens
ggctggcactctgtccagtgtc

SEQ ID NO: 7116510 - DNA, 22 bp, Homo sapiens
ggctggcacgaagccctgctgg

SEQ ID NO: 7116511 - DNA, 22 bp, Homo sapiens
ggctggcacctgccctccgctg

SEQ ID NO: 7116512 - DNA, 22 bp, Homo sapiens
ggctggcacctgccctccgctg

SEQ ID NO: 7116513 - DNA, 22 bp, Homo sapiens
ggctggcagaagtgtgctggct

SEQ ID NO: 7116514 - DNA, 22 bp, Homo sapiens
ggctggcagaagtgtgctggct

SEQ ID NO: 7116515 - DNA, 22 bp, Homo sapiens
ggctggcactgaggagagctct

SEQ ID NO: 7116516 - DNA, 22 bp, Homo sapiens
cagaaaatagagtttctctgag

SEQ ID NO: 7116517 - DNA, 22 bp, Homo sapiens
cagaaaatagagtttctctgag

SEQ ID NO: 7116518 - DNA, 22 bp, Homo sapiens
cagaaacactgtatttagggaa

SEQ ID NO: 7116519 - DNA, 22 bp, Homo sapiens
cagaaacactgtatttagggaa

SEQ ID NO: 7116520 - DNA, 22 bp, Homo sapiens
cagaaacacttgtagagaagtt

SEQ ID NO: 7116521 - DNA, 22 bp, Homo sapiens
cagaaacacttgtagagaagtt

SEQ ID NO: 7116522 - DNA, 22 bp, Homo sapiens
cagaaacacttgtagagaagtt

SEQ ID NO: 7116523 - DNA, 22 bp, Homo sapiens
cagaaacacttgtagagaagtt

SEQ ID NO: 7116524 - DNA, 22 bp, Homo sapiens
cagaaacacttgtagagaagtt

SEQ ID NO: 7116525 - DNA, 22 bp, Homo sapiens
cagaaacacttgtagagaagtt

SEQ ID NO: 7116526 - DNA, 22 bp, Homo sapiens
cagaaacacttgtagagaagtt

SEQ ID NO: 7116527 - DNA, 22 bp, Homo sapiens
cagaatttttcactcaatcttc

SEQ ID NO: 7116528 - DNA, 22 bp, Homo sapiens
cagaatttagcacaatgtatgg

SEQ ID NO: 7116529 - DNA, 22 bp, Homo sapiens
cagacaaagcggaaactgttta

SEQ ID NO: 7116530 - DNA, 22 bp, Homo sapiens
cagacaaagcggaaactgttta

SEQ ID NO: 7116531 - DNA, 22 bp, Homo sapiens
cagacaagaaagaatcaagcca

SEQ ID NO: 7116532 - DNA, 22 bp, Homo sapiens
cagacacacaagcaatctaagt

SEQ ID NO: 7116533 - DNA, 22 bp, Homo sapiens
cagacacacaagcaatctaagt

SEQ ID NO: 7116534 - DNA, 22 bp, Homo sapiens
cagaattatagttgctttttaa

SEQ ID NO: 7116535 - DNA, 22 bp, Homo sapiens
cagaattcgaatgagcagaatc

SEQ ID NO: 7116536 - DNA, 22 bp, Homo sapiens
cagaattgagagaggctgttct

SEQ ID NO: 7116537 - DNA, 22 bp, Homo sapiens
cagaatttagaaaacaacataa

SEQ ID NO: 7116538 - DNA, 22 bp, Homo sapiens
cagaataaacagaaacgtagct

SEQ ID NO: 7116539 - DNA, 22 bp, Homo sapiens
cagaataaaggtacaattgagt

SEQ ID NO: 7116540 - DNA, 22 bp, Homo sapiens
cagaataaaggtacaattgagt

SEQ ID NO: 7116541 - DNA, 22 bp, Homo sapiens
cagaataaaggtacaattgagt

SEQ ID NO: 7116542 - DNA, 22 bp, Homo sapiens
cagaataaaggtacaattgagt

SEQ ID NO: 7116543 - DNA, 22 bp, Homo sapiens
cagaataagctgtgttgtcaag

SEQ ID NO: 7116544 - DNA, 22 bp, Homo sapiens
cagaaacagacatgacgcagta

SEQ ID NO: 7116545 - DNA, 22 bp, Homo sapiens
cagaaacagacatgacgcagta

SEQ ID NO: 7116546 - DNA, 22 bp, Homo sapiens
cagaaacagacatgacgcagta

SEQ ID NO: 7116547 - DNA, 22 bp, Homo sapiens
cagaaacagagaaatattggct

SEQ ID NO: 7116548 - DNA, 22 bp, Homo sapiens
cagaaacagagaaatattggct

SEQ ID NO: 7116549 - DNA, 22 bp, Homo sapiens
cagaaacagagaaatattggct

SEQ ID NO: 7116550 - DNA, 22 bp, Homo sapiens
cagaaacaggcaacgtgtgcac

SEQ ID NO: 7116551 - DNA, 22 bp, Homo sapiens
cagaaacaggcaacgtgtgcac

SEQ ID NO: 7116552 - DNA, 22 bp, Homo sapiens
cagaaacaggcaacgtgtgcac

SEQ ID NO: 7116553 - DNA, 23 bp, Homo sapiens
gtgagcagcaccatgaggctaga

SEQ ID NO: 7116554 - DNA, 22 bp, Homo sapiens
gtgagcagagatcgcgtgattg

SEQ ID NO: 7116555 - DNA, 23 bp, Homo sapiens
gtgagcagcaccatgaggctaga

SEQ ID NO: 7116556 - DNA, 23 bp, Homo sapiens
gtgagcagcccactaggaatgcc

SEQ ID NO: 7116557 - DNA, 23 bp, Homo sapiens
gtgagcagcccactaggaatgcc

SEQ ID NO: 7116558 - DNA, 22 bp, Homo sapiens
cagccctcatctcagcttcttt

SEQ ID NO: 7116559 - DNA, 22 bp, Homo sapiens
cagccctcatctcagcttcttt

SEQ ID NO: 7116560 - DNA, 18 bp, Homo sapiens
gtgagcagagagcatcac

SEQ ID NO: 7116561 - DNA, 18 bp, Homo sapiens
gtgagcagagagcatcac

SEQ ID NO: 7116562 - DNA, 22 bp, Homo sapiens
gtgagcaatttggtattaattt

SEQ ID NO: 7116563 - DNA, 22 bp, Homo sapiens
gtgagagtgtttggaaatagaa

SEQ ID NO: 7116564 - DNA, 22 bp, Homo sapiens
gtgagagtaccacctcaacatc

SEQ ID NO: 7116565 - DNA, 22 bp, Homo sapiens
gtgagagtggtttatgtccatg

SEQ ID NO: 7116566 - DNA, 22 bp, Homo sapiens
gtgagagtgtttggaaatagaa

SEQ ID NO: 7116567 - DNA, 22 bp, Homo sapiens
gtgagcaattcaaaggcaggaa

SEQ ID NO: 7116568 - DNA, 22 bp, Homo sapiens
gtgagcaattcaaaggcaggaa

SEQ ID NO: 7116569 - DNA, 22 bp, Homo sapiens
gtgagcaaaggttaaacattta

SEQ ID NO: 7116570 - DNA, 22 bp, Homo sapiens
cagccctcctttcactcccagg

SEQ ID NO: 7116571 - DNA, 22 bp, Homo sapiens
cagccctcctaccctgccaggc

SEQ ID NO: 7116572 - DNA, 22 bp, Homo sapiens
cagccctcctaccctgccaggc

SEQ ID NO: 7116573 - DNA, 22 bp, Homo sapiens
cagccctcctaccctgccaggc

SEQ ID NO: 7116574 - DNA, 22 bp, Homo sapiens
cagccctcctaccctgccaggc

SEQ ID NO: 7116575 - DNA, 20 bp, Homo sapiens
cagccctccagtggaggcag

SEQ ID NO: 7116576 - DNA, 20 bp, Homo sapiens
cagccctccagtggaggcag

SEQ ID NO: 7116577 - DNA, 22 bp, Homo sapiens
cagccctcctaccctgccaggc

SEQ ID NO: 7116578 - DNA, 22 bp, Homo sapiens
cagccctcctaccctgccaggc

SEQ ID NO: 7116579 - DNA, 22 bp, Homo sapiens
cagccctcctaccctgccaggc

SEQ ID NO: 7116580 - DNA, 22 bp, Homo sapiens
cagccctctgaagaggcgcttg

SEQ ID NO: 7116581 - DNA, 22 bp, Homo sapiens
cagccctctgaagaggcgcttg

SEQ ID NO: 7116582 - DNA, 22 bp, Homo sapiens
cagccctctctgggccccaagg

SEQ ID NO: 7116583 - DNA, 22 bp, Homo sapiens
cagccctctctgggccccaagg

SEQ ID NO: 7116584 - DNA, 19 bp, Homo sapiens
cagccctcttaccactgtg

SEQ ID NO: 7116585 - DNA, 19 bp, Homo sapiens
cagccctcttaccactgtg

SEQ ID NO: 7116586 - DNA, 22 bp, Homo sapiens
cagccctctgaagaggcgcttg

SEQ ID NO: 7116587 - DNA, 19 bp, Homo sapiens
cagccctcttaccactgtg

SEQ ID NO: 7116588 - DNA, 19 bp, Homo sapiens
cagccctcttaccactgtg

SEQ ID NO: 7116589 - DNA, 19 bp, Homo sapiens
cagccctcttaccactgtg

SEQ ID NO: 7116590 - DNA, 22 bp, Homo sapiens
cagccctgaaacaacctcctct

SEQ ID NO: 7116591 - DNA, 22 bp, Homo sapiens
gtgagagggctgggctcatgat

SEQ ID NO: 7116592 - DNA, 22 bp, Homo sapiens
gtgagaggttcctgttagaact

SEQ ID NO: 7116593 - DNA, 22 bp, Homo sapiens
gtgagagggctgggctcatgat

SEQ ID NO: 7116594 - DNA, 22 bp, Homo sapiens
gtgagagggctgggctcatgat

SEQ ID NO: 7116595 - DNA, 22 bp, Homo sapiens
gtgaatttctgactaaaagtgc

SEQ ID NO: 7116596 - DNA, 22 bp, Homo sapiens
gtgagagattgattgtagcggc

SEQ ID NO: 7116597 - DNA, 22 bp, Homo sapiens
gtgagagcctgtctggatgtcg

SEQ ID NO: 7116598 - DNA, 22 bp, Homo sapiens
gtgagagctcagctgccctggg

SEQ ID NO: 7116599 - DNA, 22 bp, Homo sapiens
gtgagagctgctagactgttat

SEQ ID NO: 7116600 - DNA, 22 bp, Homo sapiens
gtcctgtgcccagaccctctgt

SEQ ID NO: 7116601 - DNA, 22 bp, Homo sapiens
gtcctgtgcccagaccctctgt

SEQ ID NO: 7116602 - DNA, 22 bp, Homo sapiens
gtcctgtgccctgggtggcgct

SEQ ID NO: 7116603 - DNA, 22 bp, Homo sapiens
gtcctgtgccgaggtgggaagc

SEQ ID NO: 7116604 - DNA, 22 bp, Homo sapiens
gtcctgtgctcagacatggggg

SEQ ID NO: 7116605 - DNA, 22 bp, Homo sapiens
gtgaatttctgactaaaagtgc

SEQ ID NO: 7116606 - DNA, 22 bp, Homo sapiens
gtcctggttttcacagaccttt

SEQ ID NO: 7116607 - DNA, 22 bp, Homo sapiens
gtcctgtgacctgcatcctgag

SEQ ID NO: 7116608 - DNA, 22 bp, Homo sapiens
gtcctgtgacctgcatcctgag

SEQ ID NO: 7116609 - DNA, 22 bp, Homo sapiens
gtcctgtgacctgcatcctgag

SEQ ID NO: 7116610 - DNA, 22 bp, Homo sapiens
gtcctgtgagattcatgctcaa

SEQ ID NO: 7116611 - DNA, 22 bp, Homo sapiens
gtcctgtgacctgcatcctgag

SEQ ID NO: 7116612 - DNA, 22 bp, Homo sapiens
gtcctgtgagattcatgctcaa

SEQ ID NO: 7116613 - DNA, 22 bp, Homo sapiens
gtcctgtgatgagtaccaggtg

SEQ ID NO: 7116614 - DNA, 22 bp, Homo sapiens
gtcctgtgatgagtaccaggtg

SEQ ID NO: 7116615 - DNA, 22 bp, Homo sapiens
gtcctggtggagtctctgggga

SEQ ID NO: 7116616 - DNA, 22 bp, Homo sapiens
gtcctggtgggacaatggacat

SEQ ID NO: 7116617 - DNA, 22 bp, Homo sapiens
gtcctggtggagtctctgggga

SEQ ID NO: 7116618 - DNA, 17 bp, Homo sapiens
gtcctggtgtgtgagga

SEQ ID NO: 7116619 - DNA, 22 bp, Homo sapiens
gtcctggtgccacctgcgggat

SEQ ID NO: 7116620 - DNA, 22 bp, Homo sapiens
gtcctggtgctggtcattgtcg

SEQ ID NO: 7116621 - DNA, 22 bp, Homo sapiens
gtcctggtgctggtcattgtcg

SEQ ID NO: 7116622 - DNA, 22 bp, Homo sapiens
gtcctggtataattgtttaaaa

SEQ ID NO: 7116623 - DNA, 22 bp, Homo sapiens
gtcctggtataattgtttaaaa

SEQ ID NO: 7116624 - DNA, 22 bp, Homo sapiens
gtcctggtcctgcctccccatg

SEQ ID NO: 7116625 - DNA, 22 bp, Homo sapiens
gtcctggtcctgcctccccatg

SEQ ID NO: 7116626 - DNA, 22 bp, Homo sapiens
gtcctggtgaggtagtgggagg

SEQ ID NO: 7116627 - DNA, 22 bp, Homo sapiens
cagccctgtccctgagggacct

SEQ ID NO: 7116628 - DNA, 22 bp, Homo sapiens
cagccctgtccctgagggacct

SEQ ID NO: 7116629 - DNA, 22 bp, Homo sapiens
cagccctgtctatgactgatga

SEQ ID NO: 7116630 - DNA, 22 bp, Homo sapiens
cagccctgtctatgactgatga

SEQ ID NO: 7116631 - DNA, 22 bp, Homo sapiens
cagccctgtctatgactgatga

SEQ ID NO: 7116632 - DNA, 22 bp, Homo sapiens
cagccctgtctatgactgatga

SEQ ID NO: 7116633 - DNA, 22 bp, Homo sapiens
cagccctgtctatgactgatga

SEQ ID NO: 7116634 - DNA, 22 bp, Homo sapiens
cagccctgtccagcagagggtg

SEQ ID NO: 7116635 - DNA, 22 bp, Homo sapiens
cagccctgtccagcagagggtg

SEQ ID NO: 7116636 - DNA, 22 bp, Homo sapiens
cagccctgtccctgagggacct

SEQ ID NO: 7116637 - DNA, 22 bp, Homo sapiens
cagccctgtccctgagggacct

SEQ ID NO: 7116638 - DNA, 22 bp, Homo sapiens
cagccctgtccctgagggacct

SEQ ID NO: 7116639 - DNA, 22 bp, Homo sapiens
cagccctgtccctgagggacct

SEQ ID NO: 7116640 - DNA, 22 bp, Homo sapiens
cagccctgtccaatgtctgctc

SEQ ID NO: 7116641 - DNA, 22 bp, Homo sapiens
cagccctgtccagcagagggtg

SEQ ID NO: 7116642 - DNA, 22 bp, Homo sapiens
cagccctgtccagcagagggtg

SEQ ID NO: 7116643 - DNA, 22 bp, Homo sapiens
cagccctgtccagcagagggtg

SEQ ID NO: 7116644 - DNA, 22 bp, Homo sapiens
cagccctggtgccaaggttccc

SEQ ID NO: 7116645 - DNA, 22 bp, Homo sapiens
cagccctggtgccaaggttccc

SEQ ID NO: 7116646 - DNA, 22 bp, Homo sapiens
cagccctggtgccaaggttccc

SEQ ID NO: 7116647 - DNA, 22 bp, Homo sapiens
cagccctgtccaatgtctgctc

SEQ ID NO: 7116648 - DNA, 22 bp, Homo sapiens
cagccctgtccaatgtctgctc

SEQ ID NO: 7116649 - DNA, 22 bp, Homo sapiens
cagccctggcccaggtgcctta

SEQ ID NO: 7116650 - DNA, 22 bp, Homo sapiens
cagccctggccccaggtggtct

SEQ ID NO: 7116651 - DNA, 22 bp, Homo sapiens
cagccctggccccaggtggtct

SEQ ID NO: 7116652 - DNA, 22 bp, Homo sapiens
cagccctggcccaggtgcctta

SEQ ID NO: 7116653 - DNA, 22 bp, Homo sapiens
cagccagaacctaggatgagct

SEQ ID NO: 7116654 - DNA, 22 bp, Homo sapiens
cagccagaacctaggatgagct

SEQ ID NO: 7116655 - DNA, 22 bp, Homo sapiens
cagccagaacctaggatgagct

SEQ ID NO: 7116656 - DNA, 22 bp, Homo sapiens
gtccagagtagtcgagtattct

SEQ ID NO: 7116657 - DNA, 22 bp, Homo sapiens
gtccagcaggatgcaagtgcca

SEQ ID NO: 7116658 - DNA, 22 bp, Homo sapiens
cagccagctggtgcggcagagc

SEQ ID NO: 7116659 - DNA, 22 bp, Homo sapiens
cagccagctggtgcggcagagc

SEQ ID NO: 7116660 - DNA, 22 bp, Homo sapiens
cagccagctgtcccaagtgcct

SEQ ID NO: 7116661 - DNA, 22 bp, Homo sapiens
cagccagctgtcccaagtgcct

SEQ ID NO: 7116662 - DNA, 22 bp, Homo sapiens
cagccagcttcagatccaagcc

SEQ ID NO: 7116663 - DNA, 22 bp, Homo sapiens
cagccagcttcagatccaagcc

SEQ ID NO: 7116664 - DNA, 22 bp, Homo sapiens
cagccaggacagggaaactagt

SEQ ID NO: 7116665 - DNA, 22 bp, Homo sapiens
cagccaggacagggaaactagt

SEQ ID NO: 7116666 - DNA, 22 bp, Homo sapiens
cagccagcttcagatccaagcc

SEQ ID NO: 7116667 - DNA, 22 bp, Homo sapiens
cagccaggacagggaaactagt

SEQ ID NO: 7116668 - DNA, 22 bp, Homo sapiens
cagccaggagcctctgcaacta

SEQ ID NO: 7116669 - DNA, 22 bp, Homo sapiens
cagccaggagcctctgcaacta

SEQ ID NO: 7116670 - DNA, 22 bp, Homo sapiens
cagccaggactcccatttagga

SEQ ID NO: 7116671 - DNA, 22 bp, Homo sapiens
cagccaggactcccatttagga

SEQ ID NO: 7116672 - DNA, 22 bp, Homo sapiens
cagccaggagcctctgcaacta

SEQ ID NO: 7116673 - DNA, 22 bp, Homo sapiens
cagccaggagcctctgcaacta

SEQ ID NO: 7116674 - DNA, 22 bp, Homo sapiens
cagccaggagctccccctgctc

SEQ ID NO: 7116675 - DNA, 22 bp, Homo sapiens
cagccaggagctccccctgctc

SEQ ID NO: 7116676 - DNA, 22 bp, Homo sapiens
cagccaggagctccccctgctc

SEQ ID NO: 7116677 - DNA, 22 bp, Homo sapiens
cagccaggagctccccctgctc

SEQ ID NO: 7116678 - DNA, 22 bp, Homo sapiens
cagccaggagctccccctgctc

SEQ ID NO: 7116679 - DNA, 22 bp, Homo sapiens
cagccaggagcctctgcaacta

SEQ ID NO: 7116680 - DNA, 22 bp, Homo sapiens
cagccaggagcctctgcaacta

SEQ ID NO: 7116681 - DNA, 22 bp, Homo sapiens
cagccaggagctccccctgctc

SEQ ID NO: 7116682 - DNA, 22 bp, Homo sapiens
cagccaggagctccccctgctc

SEQ ID NO: 7116683 - DNA, 22 bp, Homo sapiens
cagccaggcccccgagtcgttg

SEQ ID NO: 7116684 - DNA, 22 bp, Homo sapiens
cagccaggcccccgagtcgttg

SEQ ID NO: 7116685 - DNA, 22 bp, Homo sapiens
cagccaggcccagatcatgctg

SEQ ID NO: 7116686 - DNA, 22 bp, Homo sapiens
cagccaggcccagatcatgctg

SEQ ID NO: 7116687 - DNA, 22 bp, Homo sapiens
cagccaggatggagaactgttg

SEQ ID NO: 7116688 - DNA, 22 bp, Homo sapiens
cagccaggatggagaactgttg

SEQ ID NO: 7116689 - DNA, 22 bp, Homo sapiens
cagccaggatggagaactgttg

SEQ ID NO: 7116690 - DNA, 22 bp, Homo sapiens
cagccaggcccagatcatgctg

SEQ ID NO: 7116691 - DNA, 22 bp, Homo sapiens
cagccaggcccagatcatgctg

SEQ ID NO: 7116692 - DNA, 22 bp, Homo sapiens
cagccaggatggagaactgttg

SEQ ID NO: 7116693 - DNA, 22 bp, Homo sapiens
cagccaggcccagatcatgctg

SEQ ID NO: 7116694 - DNA, 22 bp, Homo sapiens
cagccaggcccagatcatgctg

SEQ ID NO: 7116695 - DNA, 22 bp, Homo sapiens
cagccaggcccagatcatgctg

SEQ ID NO: 7116696 - DNA, 22 bp, Homo sapiens
gtccagagaggcaggaggctac

SEQ ID NO: 7116697 - DNA, 22 bp, Homo sapiens
gtccagagctggcacactgtca

SEQ ID NO: 7116698 - DNA, 22 bp, Homo sapiens
gtccagagatggacgagcagat

SEQ ID NO: 7116699 - DNA, 22 bp, Homo sapiens
gtccagagatggacgagcagat

SEQ ID NO: 7116700 - DNA, 22 bp, Homo sapiens
gtccagagggctgcaggatgct

SEQ ID NO: 7116701 - DNA, 22 bp, Homo sapiens
gtccagagggctgcaggatgct

SEQ ID NO: 7116702 - DNA, 22 bp, Homo sapiens
gtccagagggctgcaggatgct

SEQ ID NO: 7116703 - DNA, 22 bp, Homo sapiens
gtccagagggctgcaggatgct

SEQ ID NO: 7116704 - DNA, 22 bp, Homo sapiens
cagcatctcctgtgcagaggga

SEQ ID NO: 7116705 - DNA, 22 bp, Homo sapiens
cagcatctcctgtgcagaggga

SEQ ID NO: 7116706 - DNA, 22 bp, Homo sapiens
cagcatctcgtggctggataga

SEQ ID NO: 7116707 - DNA, 22 bp, Homo sapiens
cagcatctctgcaccctccccc

SEQ ID NO: 7116708 - DNA, 22 bp, Homo sapiens
cagcatctctgcctgcctgcaa

SEQ ID NO: 7116709 - DNA, 22 bp, Homo sapiens
cagcatctctgcctgcctgcaa

SEQ ID NO: 7116710 - DNA, 22 bp, Homo sapiens
cagcatctctgcaccctccccc

SEQ ID NO: 7116711 - DNA, 22 bp, Homo sapiens
cagcatctctgcctgcctgcaa

SEQ ID NO: 7116712 - DNA, 22 bp, Homo sapiens
cagcatctctgggagaagcatc

SEQ ID NO: 7116713 - DNA, 22 bp, Homo sapiens
cagcatctctgggagaagcatc

SEQ ID NO: 7116714 - DNA, 22 bp, Homo sapiens
cagcatctctttttgcattcct

SEQ ID NO: 7116715 - DNA, 22 bp, Homo sapiens
cagcatctctgggagaagcatc

SEQ ID NO: 7116716 - DNA, 22 bp, Homo sapiens
cagcatctctttttgcattcct

SEQ ID NO: 7116717 - DNA, 22 bp, Homo sapiens
cagcatctgaccaatatctaca

SEQ ID NO: 7116718 - DNA, 22 bp, Homo sapiens
cagcatctggatttcctccact

SEQ ID NO: 7116719 - DNA, 22 bp, Homo sapiens
cagcatctggatttcctccact

SEQ ID NO: 7116720 - DNA, 19 bp, Homo sapiens
cagcatctgagccgtgtcc

SEQ ID NO: 7116721 - DNA, 22 bp, Homo sapiens
cagcatctggatttcctccact

SEQ ID NO: 7116722 - DNA, 22 bp, Homo sapiens
cagcatctggatttcctccact

SEQ ID NO: 7116723 - DNA, 22 bp, Homo sapiens
cagcatctggggaacattcaag

SEQ ID NO: 7116724 - DNA, 22 bp, Homo sapiens
cagcatctggggaacattcaag

SEQ ID NO: 7116725 - DNA, 22 bp, Homo sapiens
cagcatctgtaggactcctctt

SEQ ID NO: 7116726 - DNA, 22 bp, Homo sapiens
cagcatctgtaggactcctctt

SEQ ID NO: 7116727 - DNA, 22 bp, Homo sapiens
cagcatctgtatcctaggctga

SEQ ID NO: 7116728 - DNA, 22 bp, Homo sapiens
cagcatctgtatcctaggctga

SEQ ID NO: 7116729 - DNA, 22 bp, Homo sapiens
cagcatctgttcccaacgagat

SEQ ID NO: 7116730 - DNA, 22 bp, Homo sapiens
cagcatctgttcccaacgagat

SEQ ID NO: 7116731 - DNA, 22 bp, Homo sapiens
cagcatctgttggatggataag

SEQ ID NO: 7116732 - DNA, 22 bp, Homo sapiens
gtccagagaggcaggaggctac

SEQ ID NO: 7116733 - DNA, 22 bp, Homo sapiens
gtcacaggaaagggtgtaaggg

SEQ ID NO: 7116734 - DNA, 22 bp, Homo sapiens
gtcacagatctcttgagtcaag

SEQ ID NO: 7116735 - DNA, 18 bp, Homo sapiens
gtcacagcagagaactgc

SEQ ID NO: 7116736 - DNA, 22 bp, Homo sapiens
gtcacactcagaatgactagag

SEQ ID NO: 7116737 - DNA, 22 bp, Homo sapiens
gtcacactcttccctccacatg

SEQ ID NO: 7116738 - DNA, 22 bp, Homo sapiens
gtcacagaggctgccagggttg

SEQ ID NO: 7116739 - DNA, 22 bp, Homo sapiens
gtcacagagttattaattgtgt

SEQ ID NO: 7116740 - DNA, 22 bp, Homo sapiens
gtcacagatctcttgagtcaag

SEQ ID NO: 7116741 - DNA, 22 bp, Homo sapiens
gtcacaggcagtaactaggacc

SEQ ID NO: 7116742 - DNA, 22 bp, Homo sapiens
gtcacaggcctggatgaggggc

SEQ ID NO: 7116743 - DNA, 22 bp, Homo sapiens
gtcagagttccaaattaatcaa

SEQ ID NO: 7116744 - DNA, 21 bp, Homo sapiens
gtcacacaggcctggagctga

SEQ ID NO: 7116745 - DNA, 21 bp, Homo sapiens
gtcacacaggcctggagctga

SEQ ID NO: 7116746 - DNA, 22 bp, Homo sapiens
gtcacacagagccctgtgctca

SEQ ID NO: 7116747 - DNA, 22 bp, Homo sapiens
gtcacacagagccctgtgctca

SEQ ID NO: 7116748 - DNA, 22 bp, Homo sapiens
gtcacacacatttctttggtgc

SEQ ID NO: 7116749 - DNA, 21 bp, Homo sapiens
gtcacacaggcctggagctga

SEQ ID NO: 7116750 - DNA, 21 bp, Homo sapiens
gtcacacaggcctggagctga

SEQ ID NO: 7116751 - DNA, 22 bp, Homo sapiens
gtcacacagggcctccaaatca

SEQ ID NO: 7116752 - DNA, 22 bp, Homo sapiens
gtcacacaggttgaaatgcagt

SEQ ID NO: 7116753 - DNA, 22 bp, Homo sapiens
gtcacactagggccaagtggag

SEQ ID NO: 7116754 - DNA, 22 bp, Homo sapiens
gtcacactagggccaagtggag

SEQ ID NO: 7116755 - DNA, 22 bp, Homo sapiens
gtattttacttacgcatgactt

SEQ ID NO: 7116756 - DNA, 22 bp, Homo sapiens
gtattttatggcatgcagtggc

SEQ ID NO: 7116757 - DNA, 22 bp, Homo sapiens
gtattttatggcatgcagtggc

SEQ ID NO: 7116758 - DNA, 22 bp, Homo sapiens
gtattttatggcatgcagtggc

SEQ ID NO: 7116759 - DNA, 22 bp, Homo sapiens
gtagggagcccagagcccagtg

SEQ ID NO: 7116760 - DNA, 20 bp, Homo sapiens
gtagggaaggaatctgcagg

SEQ ID NO: 7116761 - DNA, 22 bp, Homo sapiens
gtcagcacctctttggggagct

SEQ ID NO: 7116762 - DNA, 22 bp, Homo sapiens
gtcagcacttttccgaggcaga

SEQ ID NO: 7116763 - DNA, 22 bp, Homo sapiens
gtcagcacttttccgaggcaga

SEQ ID NO: 7116764 - DNA, 22 bp, Homo sapiens
gtcagcacctctttggggagct

SEQ ID NO: 7116765 - DNA, 19 bp, Homo sapiens
gtcagcaccatggacaggg

SEQ ID NO: 7116766 - DNA, 19 bp, Homo sapiens
gtcagcaccatggacaggg

SEQ ID NO: 7116767 - DNA, 22 bp, Homo sapiens
gtcagcaattcaagagctctta

SEQ ID NO: 7116768 - DNA, 22 bp, Homo sapiens
gtcagcaattcaagagctctta

SEQ ID NO: 7116769 - DNA, 22 bp, Homo sapiens
gtcagcaaaaaatttatgtgag

SEQ ID NO: 7116770 - DNA, 22 bp, Homo sapiens
gtcagcaagatgaatcagcagg

SEQ ID NO: 7116771 - DNA, 22 bp, Homo sapiens
gtcagcaaggaaaatgtgtcac

SEQ ID NO: 7116772 - DNA, 22 bp, Homo sapiens
gtcagcaaggtgcaagcggctg

SEQ ID NO: 7116773 - DNA, 22 bp, Homo sapiens
gtcagcaatagttagtttacaa

SEQ ID NO: 7116774 - DNA, 21 bp, Homo sapiens
gtcagcagatccagcacttgt

SEQ ID NO: 7116775 - DNA, 21 bp, Homo sapiens
gtcagcagatccagcacttgt

SEQ ID NO: 7116776 - DNA, 22 bp, Homo sapiens
gtcagcagcatgtttaatcaaa

SEQ ID NO: 7116777 - DNA, 22 bp, Homo sapiens
gtcagcagggctccctggcagg

SEQ ID NO: 7116778 - DNA, 22 bp, Homo sapiens
gtcagcagggctccctggcagg

SEQ ID NO: 7116779 - DNA, 22 bp, Homo sapiens
gtcagcagggtccccttgagtg

SEQ ID NO: 7116780 - DNA, 22 bp, Homo sapiens
gtcagcagtgtcagctctgggg

SEQ ID NO: 7116781 - DNA, 22 bp, Homo sapiens
gtcagcagtgtcagctctgggg

SEQ ID NO: 7116782 - DNA, 22 bp, Homo sapiens
cagcagtgtctccagcatcaca

SEQ ID NO: 7116783 - DNA, 22 bp, Homo sapiens
cagcagtgtctccagcatcaca

SEQ ID NO: 7116784 - DNA, 22 bp, Homo sapiens
cagcatccctcaggggcctctg

SEQ ID NO: 7116785 - DNA, 22 bp, Homo sapiens
cagcatcccagagcccagagct

SEQ ID NO: 7116786 - DNA, 22 bp, Homo sapiens
cagcatcccagagcccagagct

SEQ ID NO: 7116787 - DNA, 22 bp, Homo sapiens
cagcatcccagagcccagagct

SEQ ID NO: 7116788 - DNA, 22 bp, Homo sapiens
cagcatccctcaggggcctctg

SEQ ID NO: 7116789 - DNA, 22 bp, Homo sapiens
cagcatccggcagcccgggcct

SEQ ID NO: 7116790 - DNA, 22 bp, Homo sapiens
cagcatccgttctcaggactga

SEQ ID NO: 7116791 - DNA, 22 bp, Homo sapiens
cagcatccgttctcaggactga

SEQ ID NO: 7116792 - DNA, 22 bp, Homo sapiens
cagcatccgttctcaggactga

SEQ ID NO: 7116793 - DNA, 22 bp, Homo sapiens
cagcatcctttgctggtttccc

SEQ ID NO: 7116794 - DNA, 22 bp, Homo sapiens
cagcatctaatcttcatgccgg

SEQ ID NO: 7116795 - DNA, 22 bp, Homo sapiens
cagcatctaatcttcatgccgg

SEQ ID NO: 7116796 - DNA, 20 bp, Homo sapiens
cagcatctagtgagatttgc

SEQ ID NO: 7116797 - DNA, 22 bp, Homo sapiens
cagcatctcacttcccagaagg

SEQ ID NO: 7116798 - DNA, 22 bp, Homo sapiens
cagcatctcacttcccagaagg

SEQ ID NO: 7116799 - DNA, 22 bp, Homo sapiens
cagcatctcacttcccagaagg

SEQ ID NO: 7116800 - DNA, 22 bp, Homo sapiens
cagcatctcattcattcatgtt

SEQ ID NO: 7116801 - DNA, 22 bp, Homo sapiens
cagcatctcatttgacttctgc

SEQ ID NO: 7116802 - DNA, 22 bp, Homo sapiens
cagcatctcatttgacttctgc

SEQ ID NO: 7116803 - DNA, 22 bp, Homo sapiens
cagcatctccatggctttggag

SEQ ID NO: 7116804 - DNA, 22 bp, Homo sapiens
cagcatctcccaggcatttgcc

SEQ ID NO: 7116805 - DNA, 22 bp, Homo sapiens
cagcatctcctgtgcagaggga

SEQ ID NO: 7116806 - DNA, 22 bp, Homo sapiens
cagattctgggcccagcttgtc

SEQ ID NO: 7116807 - DNA, 22 bp, Homo sapiens
cagattctgggcccagcttgtc

SEQ ID NO: 7116808 - DNA, 20 bp, Homo sapiens
cagattctccactaacatat

SEQ ID NO: 7116809 - DNA, 22 bp, Homo sapiens
cagattctcactgtattcaggt

SEQ ID NO: 7116810 - DNA, 22 bp, Homo sapiens
cagattccggtcatctctcctt

SEQ ID NO: 7116811 - DNA, 22 bp, Homo sapiens
cagattccggtcatctctcctt

SEQ ID NO: 7116812 - DNA, 22 bp, Homo sapiens
cagattactttgtagcagtcag

SEQ ID NO: 7116813 - DNA, 22 bp, Homo sapiens
cagattaacacggagcttaaca

SEQ ID NO: 7116814 - DNA, 22 bp, Homo sapiens
cagattaagtgctcaacagtgt

SEQ ID NO: 7116815 - DNA, 22 bp, Homo sapiens
cagattaagtgctcaacagtgt

SEQ ID NO: 7116816 - DNA, 22 bp, Homo sapiens
cagatttaagatatttgtattg

SEQ ID NO: 7116817 - DNA, 22 bp, Homo sapiens
cagatttaggtcactagaattt

SEQ ID NO: 7116818 - DNA, 22 bp, Homo sapiens
cagatttaggcttagtccaagc

SEQ ID NO: 7116819 - DNA, 22 bp, Homo sapiens
cagatttaggcttagtccaagc

SEQ ID NO: 7116820 - DNA, 22 bp, Homo sapiens
cagatttaggtcactagaattt

SEQ ID NO: 7116821 - DNA, 22 bp, Homo sapiens
cagatttatgcaaaaaggaaga

SEQ ID NO: 7116822 - DNA, 22 bp, Homo sapiens
cagatttgccacttactcgttg

SEQ ID NO: 7116823 - DNA, 22 bp, Homo sapiens
cagatttgccacttactcgttg

SEQ ID NO: 7116824 - DNA, 22 bp, Homo sapiens
cagatttggggtctcctgttag

SEQ ID NO: 7116825 - DNA, 22 bp, Homo sapiens
cagattttgatgaatgtggaaa

SEQ ID NO: 7116826 - DNA, 22 bp, Homo sapiens
cagattttgatgaatgtggaaa

SEQ ID NO: 7116827 - DNA, 22 bp, Homo sapiens
cagcaaaagccagcataagctc

SEQ ID NO: 7116828 - DNA, 22 bp, Homo sapiens
cagcaaaagccagcataagctc

SEQ ID NO: 7116829 - DNA, 20 bp, Homo sapiens
cagcaaaatgaaaatggatt

SEQ ID NO: 7116830 - DNA, 20 bp, Homo sapiens
cagcaaaatgaaaatggatt

SEQ ID NO: 7116831 - DNA, 22 bp, Homo sapiens
cagcagcctacaatgcacagaa

SEQ ID NO: 7116832 - DNA, 22 bp, Homo sapiens
cagcagcctacaatgcacagaa

SEQ ID NO: 7116833 - DNA, 22 bp, Homo sapiens
cagcagcccacgcgtgctgtcc

SEQ ID NO: 7116834 - DNA, 22 bp, Homo sapiens
cagcagccgagagggggctctg

SEQ ID NO: 7116835 - DNA, 22 bp, Homo sapiens
cagcagccgagagggggctctg

SEQ ID NO: 7116836 - DNA, 22 bp, Homo sapiens
cagcagccgagagggggctctg

SEQ ID NO: 7116837 - DNA, 20 bp, Homo sapiens
cagcagccattctagtagta

SEQ ID NO: 7116838 - DNA, 20 bp, Homo sapiens
cagcagccattctagtagta

SEQ ID NO: 7116839 - DNA, 20 bp, Homo sapiens
cagcagccattctagtagta

SEQ ID NO: 7116840 - DNA, 22 bp, Homo sapiens
cagcagccatgtaccacactca

SEQ ID NO: 7116841 - DNA, 20 bp, Homo sapiens
cagcagccattctagtagta

SEQ ID NO: 7116842 - DNA, 20 bp, Homo sapiens
cagcagccattctagtagta

SEQ ID NO: 7116843 - DNA, 20 bp, Homo sapiens
cagcagccattctagtagta

SEQ ID NO: 7116844 - DNA, 22 bp, Homo sapiens
cagcagcccacgcgtgctgtcc

SEQ ID NO: 7116845 - DNA, 19 bp, Homo sapiens
cagcagccagggggcccct

SEQ ID NO: 7116846 - DNA, 19 bp, Homo sapiens
cagcagccagggggcccct

SEQ ID NO: 7116847 - DNA, 22 bp, Homo sapiens
cagcagccactagagggctcac

SEQ ID NO: 7116848 - DNA, 22 bp, Homo sapiens
cagcagccagacaagatacatc

SEQ ID NO: 7116849 - DNA, 22 bp, Homo sapiens
cagcagcagccccaggaaggtt

SEQ ID NO: 7116850 - DNA, 22 bp, Homo sapiens
cagcagcagccccaggaaggtt

SEQ ID NO: 7116851 - DNA, 22 bp, Homo sapiens
cagcagccactagagggctcac

SEQ ID NO: 7116852 - DNA, 22 bp, Homo sapiens
cagcaaaggtagaagcacagga

SEQ ID NO: 7116853 - DNA, 22 bp, Homo sapiens
cagcagcagccccaggaaggtt

SEQ ID NO: 7116854 - DNA, 22 bp, Homo sapiens
cagcagcagccccaggaaggtt

SEQ ID NO: 7116855 - DNA, 22 bp, Homo sapiens
cagcaaagcaggctcctagaac

SEQ ID NO: 7116856 - DNA, 22 bp, Homo sapiens
cagcaaagcaggctcctagaac

SEQ ID NO: 7116857 - DNA, 22 bp, Homo sapiens
cagcaaagcaggctcctagaac

SEQ ID NO: 7116858 - DNA, 22 bp, Homo sapiens
cagcaaagcaggctcctagaac

SEQ ID NO: 7116859 - DNA, 22 bp, Homo sapiens
cagcaaagcttaatttatatct

SEQ ID NO: 7116860 - DNA, 22 bp, Homo sapiens
cagcaaagcttaatttatatct

SEQ ID NO: 7116861 - DNA, 22 bp, Homo sapiens
cagcaaagcttgttccttcctg

SEQ ID NO: 7116862 - DNA, 22 bp, Homo sapiens
cagcaaagcttgttccttcctg

SEQ ID NO: 7116863 - DNA, 22 bp, Homo sapiens
cagcaaaggggatgcgtcctaa

SEQ ID NO: 7116864 - DNA, 22 bp, Homo sapiens
cagcaaaggggatgcgtcctaa

SEQ ID NO: 7116865 - DNA, 22 bp, Homo sapiens
cagcaaaggtagaagcacagga

SEQ ID NO: 7116866 - DNA, 22 bp, Homo sapiens
cagcaaaggtagaagcacagga

SEQ ID NO: 7116867 - DNA, 22 bp, Homo sapiens
cagcaaaggtagaagcacagga

SEQ ID NO: 7116868 - DNA, 22 bp, Homo sapiens
cagcagcctagggttccatcat

SEQ ID NO: 7116869 - DNA, 22 bp, Homo sapiens
cagcagcctagggttccatcat

SEQ ID NO: 7116870 - DNA, 22 bp, Homo sapiens
cagcagcctagaagctctacca

SEQ ID NO: 7116871 - DNA, 23 bp, Homo sapiens
gtacacatagtgtagttatattt

SEQ ID NO: 7116872 - DNA, 22 bp, Homo sapiens
gtacacataggttactgattaa

SEQ ID NO: 7116873 - DNA, 22 bp, Homo sapiens
gtacacataggttactgattaa

SEQ ID NO: 7116874 - DNA, 22 bp, Homo sapiens
gtacacatactattcaaagaga

SEQ ID NO: 7116875 - DNA, 22 bp, Homo sapiens
gtacacaggcagcccagtgctg

SEQ ID NO: 7116876 - DNA, 22 bp, Homo sapiens
gtacacagagtggtggaagaaa

SEQ ID NO: 7116877 - DNA, 22 bp, Homo sapiens
gtacacagagtggtggaagaaa

SEQ ID NO: 7116878 - DNA, 22 bp, Homo sapiens
gtacacagatgcttgagaatct

SEQ ID NO: 7116879 - DNA, 22 bp, Homo sapiens
gtacacattatgcttctctaaa

SEQ ID NO: 7116880 - DNA, 22 bp, Homo sapiens
gtacacattgtctgtttacttc

SEQ ID NO: 7116881 - DNA, 22 bp, Homo sapiens
gtacacattatgcttctctaaa

SEQ ID NO: 7116882 - DNA, 20 bp, Homo sapiens
gtacacttcatgtttcacct

SEQ ID NO: 7116883 - DNA, 22 bp, Homo sapiens
gtacacttgactcataggaaat

SEQ ID NO: 7116884 - DNA, 22 bp, Homo sapiens
gtacacttgactcataggaaat

SEQ ID NO: 7116885 - DNA, 22 bp, Homo sapiens
gtacacttgtcttgaacagcct

SEQ ID NO: 7116886 - DNA, 22 bp, Homo sapiens
gtactaaacagagaaccaatat

SEQ ID NO: 7116887 - DNA, 22 bp, Homo sapiens
gtactagagatgtgtgcgggta

SEQ ID NO: 7116888 - DNA, 22 bp, Homo sapiens
gtactattatatctaaatcact

SEQ ID NO: 7116889 - DNA, 22 bp, Homo sapiens
gtactctcttgaaggcctttct

SEQ ID NO: 7116890 - DNA, 22 bp, Homo sapiens
gtactgaaaagttttctaatct

SEQ ID NO: 7116891 - DNA, 22 bp, Homo sapiens
gtaggcagtggttggaagagaa

SEQ ID NO: 7116892 - DNA, 22 bp, Homo sapiens
gtaggcagtggttggaagagaa

SEQ ID NO: 7116893 - DNA, 22 bp, Homo sapiens
gtaggcagtctctcaggtgatc

SEQ ID NO: 7116894 - DNA, 22 bp, Homo sapiens
gtaggcagtctctcaggtgatc

SEQ ID NO: 7116895 - DNA, 22 bp, Homo sapiens
gtaggccagtgtgaaacctggt

SEQ ID NO: 7116896 - DNA, 22 bp, Homo sapiens
gtaggccatggtggttgtctct

SEQ ID NO: 7116897 - DNA, 22 bp, Homo sapiens
gtaggccatggtggttgtctct

SEQ ID NO: 7116898 - DNA, 22 bp, Homo sapiens
gtaggctgtgtgaggctagaga

SEQ ID NO: 7116899 - DNA, 22 bp, Homo sapiens
gtaggcaggtggaggagtgaag

SEQ ID NO: 7116900 - DNA, 22 bp, Homo sapiens
gtaggcaggtggaggagtgaag

SEQ ID NO: 7116901 - DNA, 22 bp, Homo sapiens
gtaggcagggctgtggggagaa

SEQ ID NO: 7116902 - DNA, 22 bp, Homo sapiens
gtagaaatatttatctctgaga

SEQ ID NO: 7116903 - DNA, 22 bp, Homo sapiens
gtagaaaaagcagtaagtctca

SEQ ID NO: 7116904 - DNA, 22 bp, Homo sapiens
gtagaaaaagcagtaagtctca

SEQ ID NO: 7116905 - DNA, 22 bp, Homo sapiens
gtagaaaaagcagtaagtctca

SEQ ID NO: 7116906 - DNA, 22 bp, Homo sapiens
gtagaaatagtggttgacagga

SEQ ID NO: 7116907 - DNA, 22 bp, Homo sapiens
gtagaaaattaggatgaggctt

SEQ ID NO: 7116908 - DNA, 22 bp, Homo sapiens
gtagaaaattaggatgaggctt

SEQ ID NO: 7116909 - DNA, 22 bp, Homo sapiens
gtagaaatagtggttgacagga

SEQ ID NO: 7116910 - DNA, 22 bp, Homo sapiens
gtagaaatatttatctctgaga

SEQ ID NO: 7116911 - DNA, 22 bp, Homo sapiens
gtagaaatatttatctctgaga

SEQ ID NO: 7116912 - DNA, 22 bp, Homo sapiens
gtactttagagtaaaatagacc

SEQ ID NO: 7116913 - DNA, 22 bp, Homo sapiens
gtacttccagccaagtgagaca

SEQ ID NO: 7116914 - DNA, 22 bp, Homo sapiens
gtacttccctgggaggcaagca

SEQ ID NO: 7116915 - DNA, 22 bp, Homo sapiens
gtacttccgtggactaattgtt

SEQ ID NO: 7116916 - DNA, 22 bp, Homo sapiens
gtacttccgtggactaattgtt

SEQ ID NO: 7116917 - DNA, 22 bp, Homo sapiens
caagaagtcatttagcctctca

SEQ ID NO: 7116918 - DNA, 22 bp, Homo sapiens
caagaaggctatatgggccagg

SEQ ID NO: 7116919 - DNA, 22 bp, Homo sapiens
caagaagtgtcagctttttaaa

SEQ ID NO: 7116920 - DNA, 22 bp, Homo sapiens
caagaataaaatacatgttgat

SEQ ID NO: 7116921 - DNA, 22 bp, Homo sapiens
caagaagctttccctgcttgca

SEQ ID NO: 7116922 - DNA, 22 bp, Homo sapiens
caagaagccgagctacaggctc

SEQ ID NO: 7116923 - DNA, 22 bp, Homo sapiens
caagaagaggtgattggtaagt

SEQ ID NO: 7116924 - DNA, 22 bp, Homo sapiens
caagaagcccttcctgggtgga

SEQ ID NO: 7116925 - DNA, 22 bp, Homo sapiens
caagaagcccttcctgggtgga

SEQ ID NO: 7116926 - DNA, 22 bp, Homo sapiens
gctggagaaacaggaggaggaa

SEQ ID NO: 7116927 - DNA, 22 bp, Homo sapiens
gctggagaaacaggaggaggaa

SEQ ID NO: 7116928 - DNA, 22 bp, Homo sapiens
gctggacaggccacatggagga

SEQ ID NO: 7116929 - DNA, 22 bp, Homo sapiens
gctggacatccatcctgtagaa

SEQ ID NO: 7116930 - DNA, 20 bp, Homo sapiens
gctggaagggctagagggct

SEQ ID NO: 7116931 - DNA, 22 bp, Homo sapiens
gctggaagtaaaaacttactag

SEQ ID NO: 7116932 - DNA, 22 bp, Homo sapiens
gctggacatccatcctgtagaa

SEQ ID NO: 7116933 - DNA, 22 bp, Homo sapiens
gctggactagaagcagggctca

SEQ ID NO: 7116934 - DNA, 22 bp, Homo sapiens
gctggactagaagcagggctca

SEQ ID NO: 7116935 - DNA, 22 bp, Homo sapiens
gctggacttcatgcattcctgt

SEQ ID NO: 7116936 - DNA, 22 bp, Homo sapiens
caagaatataaatactttcaaa

SEQ ID NO: 7116937 - DNA, 22 bp, Homo sapiens
caagaatagctacctcccatat

SEQ ID NO: 7116938 - DNA, 22 bp, Homo sapiens
caagaatagctacctcccatat

SEQ ID NO: 7116939 - DNA, 22 bp, Homo sapiens
caagaatataaatactttcaaa

SEQ ID NO: 7116940 - DNA, 22 bp, Homo sapiens
caagaatataaatactttcaaa

SEQ ID NO: 7116941 - DNA, 22 bp, Homo sapiens
caagaatatatatggagtggag

SEQ ID NO: 7116942 - DNA, 22 bp, Homo sapiens
caagaatatatatggagtggag

SEQ ID NO: 7116943 - DNA, 22 bp, Homo sapiens
caagaatcaacattatttagtg

SEQ ID NO: 7116944 - DNA, 22 bp, Homo sapiens
caagaataaaatacatgttgat

SEQ ID NO: 7116945 - DNA, 22 bp, Homo sapiens
caagaataaaatacatgttgat

SEQ ID NO: 7116946 - DNA, 22 bp, Homo sapiens
caagaataaaatacatgttgat

SEQ ID NO: 7116947 - DNA, 22 bp, Homo sapiens
caagaataaaatacatgttgat

SEQ ID NO: 7116948 - DNA, 22 bp, Homo sapiens
caagaataaccagacaatagca

SEQ ID NO: 7116949 - DNA, 22 bp, Homo sapiens
caagaataaccagacaatagca

SEQ ID NO: 7116950 - DNA, 22 bp, Homo sapiens
caagaataaccagacaatagca

SEQ ID NO: 7116951 - DNA, 22 bp, Homo sapiens
caagaataaccagacaatagca

SEQ ID NO: 7116952 - DNA, 22 bp, Homo sapiens
caagaatagctacctcccatat

SEQ ID NO: 7116953 - DNA, 22 bp, Homo sapiens
caagaatagctacctcccatat

SEQ ID NO: 7116954 - DNA, 19 bp, Homo sapiens
caagacaaagcccatcttc

SEQ ID NO: 7116955 - DNA, 22 bp, Homo sapiens
caagacaagatctaagcatgct

SEQ ID NO: 7116956 - DNA, 22 bp, Homo sapiens
caagaattaagaattttgatgt

SEQ ID NO: 7116957 - DNA, 22 bp, Homo sapiens
caagaattgtacaaactgggtg

SEQ ID NO: 7116958 - DNA, 22 bp, Homo sapiens
caagaattgtacaaactgggtg

SEQ ID NO: 7116959 - DNA, 22 bp, Homo sapiens
gctgctttttggatttggcaca

SEQ ID NO: 7116960 - DNA, 22 bp, Homo sapiens
gctggaaaaggaggcaaaatat

SEQ ID NO: 7116961 - DNA, 22 bp, Homo sapiens
gctgcttttgagttaaagtcat

SEQ ID NO: 7116962 - DNA, 22 bp, Homo sapiens
gctgctttttggatttggcaca

SEQ ID NO: 7116963 - DNA, 22 bp, Homo sapiens
gctggaaatgaatggagaggtg

SEQ ID NO: 7116964 - DNA, 22 bp, Homo sapiens
gctggaagaatgagtgcctcgt

SEQ ID NO: 7116965 - DNA, 20 bp, Homo sapiens
gctggaagggctagagggct

SEQ ID NO: 7116966 - DNA, 20 bp, Homo sapiens
gctggaagggctagagggct

SEQ ID NO: 7116967 - DNA, 22 bp, Homo sapiens
gctgctttgacagtgggaacag

SEQ ID NO: 7116968 - DNA, 22 bp, Homo sapiens
gctgctttgatatgcaaggaac

SEQ ID NO: 7116969 - DNA, 22 bp, Homo sapiens
gctgctttgcagtagagtaata

SEQ ID NO: 7116970 - DNA, 22 bp, Homo sapiens
gctgctttgacagtgggaacag

SEQ ID NO: 7116971 - DNA, 22 bp, Homo sapiens
gctgctttctgttaggaattgg

SEQ ID NO: 7116972 - DNA, 22 bp, Homo sapiens
gctgctttgaaagaggagcttt

SEQ ID NO: 7116973 - DNA, 22 bp, Homo sapiens
gctgctttctgaaggtgcactg

SEQ ID NO: 7116974 - DNA, 22 bp, Homo sapiens
gctgctttctgttaggaattgg

SEQ ID NO: 7116975 - DNA, 22 bp, Homo sapiens
gctgctttgcagtagagtaata

SEQ ID NO: 7116976 - DNA, 22 bp, Homo sapiens
gctgctttgcagtagagtaata

SEQ ID NO: 7116977 - DNA, 22 bp, Homo sapiens
gctgctttggaaagcatggaaa

SEQ ID NO: 7116978 - DNA, 22 bp, Homo sapiens
gctgctttggggatgaatgaga

SEQ ID NO: 7116979 - DNA, 22 bp, Homo sapiens
gctgctttgtctgtaaaatgga

SEQ ID NO: 7116980 - DNA, 22 bp, Homo sapiens
gctgctttgtctgtaaaatgga

SEQ ID NO: 7116981 - DNA, 22 bp, Homo sapiens
gctgctttgtgaaaatcattca

SEQ ID NO: 7116982 - DNA, 22 bp, Homo sapiens
gctgcttttcacagagacaaga

SEQ ID NO: 7116983 - DNA, 22 bp, Homo sapiens
gctgcctgcctagttccacagt

SEQ ID NO: 7116984 - DNA, 22 bp, Homo sapiens
gctgcctgccttgcctggagga

SEQ ID NO: 7116985 - DNA, 22 bp, Homo sapiens
gctgctggcgctgggcgtccgg

SEQ ID NO: 7116986 - DNA, 22 bp, Homo sapiens
gctgctggccgcccagcttctc

SEQ ID NO: 7116987 - DNA, 22 bp, Homo sapiens
gctgctggcgctgggcgtccgg

SEQ ID NO: 7116988 - DNA, 22 bp, Homo sapiens
gctgcctgccttgcctggagga

SEQ ID NO: 7116989 - DNA, 22 bp, Homo sapiens
gctgctggccgcccagcttctc

SEQ ID NO: 7116990 - DNA, 22 bp, Homo sapiens
gctgcctgcacagagctgcttt

SEQ ID NO: 7116991 - DNA, 18 bp, Homo sapiens
gctgcctgcattcctcac

SEQ ID NO: 7116992 - DNA, 22 bp, Homo sapiens
gctgcctgccctgggtcatctg

SEQ ID NO: 7116993 - DNA, 22 bp, Homo sapiens
gctggctgaggtctagctcttt

SEQ ID NO: 7116994 - DNA, 22 bp, Homo sapiens
gctggctgaggtctagctcttt

SEQ ID NO: 7116995 - DNA, 22 bp, Homo sapiens
caagcccttccgggaacagttg

SEQ ID NO: 7116996 - DNA, 22 bp, Homo sapiens
caagcctcagaatcttctccat

SEQ ID NO: 7116997 - DNA, 22 bp, Homo sapiens
caagcctcagaatcttctccat

SEQ ID NO: 7116998 - DNA, 22 bp, Homo sapiens
caagcctgtctcaccagtgcta

SEQ ID NO: 7116999 - DNA, 22 bp, Homo sapiens
caagcccaggattccccagtta

SEQ ID NO: 7117000 - DNA, 22 bp, Homo sapiens
gctggctgagttctgtcgtctg

SEQ ID NO: 7117001 - DNA, 22 bp, Homo sapiens
caagccattctcctgcctcagc

SEQ ID NO: 7117002 - DNA, 22 bp, Homo sapiens
caagcccactgctcagagccaa

SEQ ID NO: 7117003 - DNA, 22 bp, Homo sapiens
caagcccactgctcagagccaa

SEQ ID NO: 7117004 - DNA, 22 bp, Homo sapiens
caagcccactgctcagagccaa

SEQ ID NO: 7117005 - DNA, 22 bp, Homo sapiens
caagcccagatcctgcgtgtct

SEQ ID NO: 7117006 - DNA, 22 bp, Homo sapiens
caagcccaggattccccagtta

SEQ ID NO: 7117007 - DNA, 22 bp, Homo sapiens
gctggcccagggtcacctagga

SEQ ID NO: 7117008 - DNA, 22 bp, Homo sapiens
gctggctctttttgccgggctc

SEQ ID NO: 7117009 - DNA, 20 bp, Homo sapiens
gctggctgaactgaaagcaa

SEQ ID NO: 7117010 - DNA, 20 bp, Homo sapiens
gctggctgaactgaaagcaa

SEQ ID NO: 7117011 - DNA, 22 bp, Homo sapiens
gctggctgacagatttggggtg

SEQ ID NO: 7117012 - DNA, 17 bp, Homo sapiens
gctggctgacccatgcc

SEQ ID NO: 7117013 - DNA, 17 bp, Homo sapiens
gctggctgacccatgcc

SEQ ID NO: 7117014 - DNA, 17 bp, Homo sapiens
gctggctgacccatgcc

SEQ ID NO: 7117015 - DNA, 17 bp, Homo sapiens
gctggctgacccatgcc

SEQ ID NO: 7117016 - DNA, 22 bp, Homo sapiens
gctggggagcaagagtagtgag

SEQ ID NO: 7117017 - DNA, 22 bp, Homo sapiens
gctggggagcaagagtagtgag

SEQ ID NO: 7117018 - DNA, 22 bp, Homo sapiens
gctggggagcaagagtagtgag

SEQ ID NO: 7117019 - DNA, 22 bp, Homo sapiens
gctggggagcaagagtagtgag

SEQ ID NO: 7117020 - DNA, 22 bp, Homo sapiens
gctggggagcaagagtagtgag

SEQ ID NO: 7117021 - DNA, 22 bp, Homo sapiens
gctggggagcaagagtagtgag

SEQ ID NO: 7117022 - DNA, 22 bp, Homo sapiens
gctggggagcaagagtagtgag

SEQ ID NO: 7117023 - DNA, 22 bp, Homo sapiens
gctggggagcaagagtagtgag

SEQ ID NO: 7117024 - DNA, 22 bp, Homo sapiens
gctggggagcaagagtagtgag

SEQ ID NO: 7117025 - DNA, 22 bp, Homo sapiens
gctggggagaattgggttatct

SEQ ID NO: 7117026 - DNA, 22 bp, Homo sapiens
gctggggagaattgggttatct

SEQ ID NO: 7117027 - DNA, 22 bp, Homo sapiens
gctggggactccccaccatagc

SEQ ID NO: 7117028 - DNA, 22 bp, Homo sapiens
gctggggagaattgggttatct

SEQ ID NO: 7117029 - DNA, 22 bp, Homo sapiens
gctggggagaattgggttatct

SEQ ID NO: 7117030 - DNA, 22 bp, Homo sapiens
gctggggactccccaccatagc

SEQ ID NO: 7117031 - DNA, 22 bp, Homo sapiens
gctggggaccagctgtctctga

SEQ ID NO: 7117032 - DNA, 22 bp, Homo sapiens
gctggggactccccaccatagc

SEQ ID NO: 7117033 - DNA, 22 bp, Homo sapiens
gctggggactccccaccatagc

SEQ ID NO: 7117034 - DNA, 22 bp, Homo sapiens
gctggggaccagctgtctctga

SEQ ID NO: 7117035 - DNA, 22 bp, Homo sapiens
gctggggaccagctgtctctga

SEQ ID NO: 7117036 - DNA, 22 bp, Homo sapiens
gctggggaccagctgtctctga

SEQ ID NO: 7117037 - DNA, 19 bp, Homo sapiens
gctggggaatggatattga

SEQ ID NO: 7117038 - DNA, 19 bp, Homo sapiens
gctggggaatggatattga

SEQ ID NO: 7117039 - DNA, 20 bp, Homo sapiens
gctgggctttgactgacaca

SEQ ID NO: 7117040 - DNA, 20 bp, Homo sapiens
gctgggctttgactgacaca

SEQ ID NO: 7117041 - DNA, 22 bp, Homo sapiens
caagctgcagcgcctgcgccgg

SEQ ID NO: 7117042 - DNA, 23 bp, Homo sapiens
caagctgcagtttggttggtggg

SEQ ID NO: 7117043 - DNA, 22 bp, Homo sapiens
gctgggctcagacctagtgaac

SEQ ID NO: 7117044 - DNA, 22 bp, Homo sapiens
gctgggcttgtggccagctggg

SEQ ID NO: 7117045 - DNA, 22 bp, Homo sapiens
caagcctcagaatcttctccat

SEQ ID NO: 7117046 - DNA, 22 bp, Homo sapiens
caagcgtggctgctctgatgga

SEQ ID NO: 7117047 - DNA, 22 bp, Homo sapiens
caagcgtggctgctctgatgga

SEQ ID NO: 7117048 - DNA, 22 bp, Homo sapiens
caagctactcaggcaagatgtg

SEQ ID NO: 7117049 - DNA, 22 bp, Homo sapiens
caagctacttagaaagcacagt

SEQ ID NO: 7117050 - DNA, 22 bp, Homo sapiens
caagctccttacatccacaggg

SEQ ID NO: 7117051 - DNA, 22 bp, Homo sapiens
caagctccttacatccacaggg

SEQ ID NO: 7117052 - DNA, 22 bp, Homo sapiens
caagctccttacatccacaggg

SEQ ID NO: 7117053 - DNA, 22 bp, Homo sapiens
caagctacttagaaagcacagt

SEQ ID NO: 7117054 - DNA, 22 bp, Homo sapiens
gctgccctgcatctgtgccttc

SEQ ID NO: 7117055 - DNA, 22 bp, Homo sapiens
gctgccctgcatctgtgccttc

SEQ ID NO: 7117056 - DNA, 22 bp, Homo sapiens
gctgccctgactccagcagcct

SEQ ID NO: 7117057 - DNA, 21 bp, Homo sapiens
gctgccctggctcagcattca

SEQ ID NO: 7117058 - DNA, 22 bp, Homo sapiens
gctgccctctctggccccacac

SEQ ID NO: 7117059 - DNA, 22 bp, Homo sapiens
gctgccctctctggccccacac

SEQ ID NO: 7117060 - DNA, 22 bp, Homo sapiens
gctgccctcccagggcaagctt

SEQ ID NO: 7117061 - DNA, 22 bp, Homo sapiens
gctgccctctctggccccacac

SEQ ID NO: 7117062 - DNA, 22 bp, Homo sapiens
gctgccctctctggccccacac

SEQ ID NO: 7117063 - DNA, 22 bp, Homo sapiens
gctgccctctgtgacccggccc

SEQ ID NO: 7117064 - DNA, 22 bp, Homo sapiens
gctgccctctgtgacccggccc

SEQ ID NO: 7117065 - DNA, 22 bp, Homo sapiens
gctgccctgacaagctactccc

SEQ ID NO: 7117066 - DNA, 22 bp, Homo sapiens
gctgccctgacaagctactccc

SEQ ID NO: 7117067 - DNA, 22 bp, Homo sapiens
gctgccctgactccagcagcct

SEQ ID NO: 7117068 - DNA, 22 bp, Homo sapiens
gctgccctgactccagcagcct

SEQ ID NO: 7117069 - DNA, 22 bp, Homo sapiens
caaagtgctaggattacaggcc

SEQ ID NO: 7117070 - DNA, 22 bp, Homo sapiens
caaagtgctaggattacaggcc

SEQ ID NO: 7117071 - DNA, 22 bp, Homo sapiens
caaagtgcctgtaccactttgc

SEQ ID NO: 7117072 - DNA, 22 bp, Homo sapiens
caaagtgcctgtaccactttgc

SEQ ID NO: 7117073 - DNA, 22 bp, Homo sapiens
caaagtgagagaatggcagaaa

SEQ ID NO: 7117074 - DNA, 22 bp, Homo sapiens
caaagtgcagaaggaactgggt

SEQ ID NO: 7117075 - DNA, 22 bp, Homo sapiens
caaagtgcagaaggaactgggt

SEQ ID NO: 7117076 - DNA, 22 bp, Homo sapiens
caaagtgctaggattacaggcg

SEQ ID NO: 7117077 - DNA, 22 bp, Homo sapiens
caaagtgctaggattacaggcg

SEQ ID NO: 7117078 - DNA, 22 bp, Homo sapiens
caaagtgctaggattataggtg

SEQ ID NO: 7117079 - DNA, 22 bp, Homo sapiens
caaagtgctaggattataggtg

SEQ ID NO: 7117080 - DNA, 18 bp, Homo sapiens
gctgccctagctcccctc

SEQ ID NO: 7117081 - DNA, 18 bp, Homo sapiens
gctgccctagctcccctc

SEQ ID NO: 7117082 - DNA, 22 bp, Homo sapiens
gctgccctccagttcccacagt

SEQ ID NO: 7117083 - DNA, 22 bp, Homo sapiens
gctgccctccagttcccacagt

SEQ ID NO: 7117084 - DNA, 22 bp, Homo sapiens
gctctggatccggctgggtctg

SEQ ID NO: 7117085 - DNA, 17 bp, Homo sapiens
gctctggcacaggattg

SEQ ID NO: 7117086 - DNA, 17 bp, Homo sapiens
gctctggcacaggattg

SEQ ID NO: 7117087 - DNA, 17 bp, Homo sapiens
gctctggcacaggattg

SEQ ID NO: 7117088 - DNA, 22 bp, Homo sapiens
caaagtcagccagctagtaggt

SEQ ID NO: 7117089 - DNA, 22 bp, Homo sapiens
caaagtcagctgccagtcccaa

SEQ ID NO: 7117090 - DNA, 22 bp, Homo sapiens
gctctggaggctggaagaccat

SEQ ID NO: 7117091 - DNA, 23 bp, Homo sapiens
gctctggagctgggcctggcagg

SEQ ID NO: 7117092 - DNA, 23 bp, Homo sapiens
gctctggagctgggcctggcagg

SEQ ID NO: 7117093 - DNA, 22 bp, Homo sapiens
gctctggaggctggaagaccat

SEQ ID NO: 7117094 - DNA, 22 bp, Homo sapiens
gctctggaggctggaagaccat

SEQ ID NO: 7117095 - DNA, 22 bp, Homo sapiens
gctctggatccggctgggtctg

SEQ ID NO: 7117096 - DNA, 22 bp, Homo sapiens
gctctggatccggctgggtctg

SEQ ID NO: 7117097 - DNA, 22 bp, Homo sapiens
caaagtcagggaagagtggctg

SEQ ID NO: 7117098 - DNA, 22 bp, Homo sapiens
caaagtcataaaacttgtaagt

SEQ ID NO: 7117099 - DNA, 22 bp, Homo sapiens
caaagtcataaaacttgtaagt

SEQ ID NO: 7117100 - DNA, 22 bp, Homo sapiens
caaagtcatggggatgcaggtc

SEQ ID NO: 7117101 - DNA, 22 bp, Homo sapiens
caaagtccatagtttacaatag

SEQ ID NO: 7117102 - DNA, 22 bp, Homo sapiens
caaagtccatagtttacaatag

SEQ ID NO: 7117103 - DNA, 22 bp, Homo sapiens
caaagtcccagctgcttagaga

SEQ ID NO: 7117104 - DNA, 22 bp, Homo sapiens
caaagtcctagaacagtgcttg

SEQ ID NO: 7117105 - DNA, 22 bp, Homo sapiens
caaagtcctagaacagtgcttg

SEQ ID NO: 7117106 - DNA, 22 bp, Homo sapiens
caaagtcttcagttgattctga

SEQ ID NO: 7117107 - DNA, 22 bp, Homo sapiens
caaagtcttggtgatcaacttt

SEQ ID NO: 7117108 - DNA, 22 bp, Homo sapiens
gctctggagagccataggccct

SEQ ID NO: 7117109 - DNA, 22 bp, Homo sapiens
gctctggactggggcctgagaa

SEQ ID NO: 7117110 - DNA, 22 bp, Homo sapiens
gctctggagatggagccttgag

SEQ ID NO: 7117111 - DNA, 22 bp, Homo sapiens
gctctggagatggagccttgag

SEQ ID NO: 7117112 - DNA, 22 bp, Homo sapiens
gctctggagcactggaaacact

SEQ ID NO: 7117113 - DNA, 22 bp, Homo sapiens
gctctggaccctgccagcctta

SEQ ID NO: 7117114 - DNA, 22 bp, Homo sapiens
gctctggaccctgccagcctta

SEQ ID NO: 7117115 - DNA, 22 bp, Homo sapiens
gctctggaccctggagtggctg

SEQ ID NO: 7117116 - DNA, 22 bp, Homo sapiens
gctctggaccctggagtggctg

SEQ ID NO: 7117117 - DNA, 22 bp, Homo sapiens
gctctggactggggcctgagaa

SEQ ID NO: 7117118 - DNA, 22 bp, Homo sapiens
gctctggaagcatctgagagga

SEQ ID NO: 7117119 - DNA, 22 bp, Homo sapiens
gctctggaccctgccagcctta

SEQ ID NO: 7117120 - DNA, 22 bp, Homo sapiens
gctctggaacctgccaggatgc

SEQ ID NO: 7117121 - DNA, 22 bp, Homo sapiens
gctctggaacctgccaggatgc

SEQ ID NO: 7117122 - DNA, 22 bp, Homo sapiens
gctctggaagcatctgagagga

SEQ ID NO: 7117123 - DNA, 22 bp, Homo sapiens
gctctggaagcatctgagagga

SEQ ID NO: 7117124 - DNA, 22 bp, Homo sapiens
gctctggaacctgccaggatgc

SEQ ID NO: 7117125 - DNA, 22 bp, Homo sapiens
caagaacattgtgatcacttca

SEQ ID NO: 7117126 - DNA, 22 bp, Homo sapiens
caagaagaggtgattggtaagt

SEQ ID NO: 7117127 - DNA, 22 bp, Homo sapiens
caagaacagtttgccaaattgg

SEQ ID NO: 7117128 - DNA, 22 bp, Homo sapiens
caagaaattctgttcagatagc

SEQ ID NO: 7117129 - DNA, 22 bp, Homo sapiens
caagaaatttcttaagaactaa

SEQ ID NO: 7117130 - DNA, 22 bp, Homo sapiens
caagaaatttcttaagaactaa

SEQ ID NO: 7117131 - DNA, 22 bp, Homo sapiens
caagaaatttcttaagaactaa

SEQ ID NO: 7117132 - DNA, 22 bp, Homo sapiens
caagaaatttcttaagaactaa

SEQ ID NO: 7117133 - DNA, 22 bp, Homo sapiens
caagaaatttcttaagaactaa

SEQ ID NO: 7117134 - DNA, 22 bp, Homo sapiens
gctgcctgatgtccagcaggac

SEQ ID NO: 7117135 - DNA, 22 bp, Homo sapiens
gctgcctgatgtccagcaggac

SEQ ID NO: 7117136 - DNA, 22 bp, Homo sapiens
gctgcctgatgtccagcaggac

SEQ ID NO: 7117137 - DNA, 22 bp, Homo sapiens
gctgcctgatttacatagtgaa

SEQ ID NO: 7117138 - DNA, 22 bp, Homo sapiens
gctgcctgcacagagctgcttt

SEQ ID NO: 7117139 - DNA, 22 bp, Homo sapiens
caactttctgttaaatgttagt

SEQ ID NO: 7117140 - DNA, 22 bp, Homo sapiens
caactttggccccttcctagct

SEQ ID NO: 7117141 - DNA, 22 bp, Homo sapiens
caactttgtgtgacctagatag

SEQ ID NO: 7117142 - DNA, 22 bp, Homo sapiens
caacttttctgtgaatttaagt

SEQ ID NO: 7117143 - DNA, 22 bp, Homo sapiens
caacttttctgtgaatttaagt

SEQ ID NO: 7117144 - DNA, 22 bp, Homo sapiens
caacttttgacacgtgtgctaa

SEQ ID NO: 7117145 - DNA, 23 bp, Homo sapiens
caacttttggctacatgcttagc

SEQ ID NO: 7117146 - DNA, 23 bp, Homo sapiens
caacttttggctacatgcttagc

SEQ ID NO: 7117147 - DNA, 22 bp, Homo sapiens
caagaaactttattctgccata

SEQ ID NO: 7117148 - DNA, 22 bp, Homo sapiens
caagaaatctagaagtcagtgg

SEQ ID NO: 7117149 - DNA, 22 bp, Homo sapiens
caagaaatctagaagtcagtgg

SEQ ID NO: 7117150 - DNA, 22 bp, Homo sapiens
caagaaatctagaagtcagtgg

SEQ ID NO: 7117151 - DNA, 22 bp, Homo sapiens
caagaaatgggatttgactgcc

SEQ ID NO: 7117152 - DNA, 22 bp, Homo sapiens
caagaaatgggatttgactgcc

SEQ ID NO: 7117153 - DNA, 22 bp, Homo sapiens
caagaaatgggatttgactgcc

SEQ ID NO: 7117154 - DNA, 22 bp, Homo sapiens
caagaaatggggaggggagttg

SEQ ID NO: 7117155 - DNA, 22 bp, Homo sapiens
caagaaatgtttactgagcatc

SEQ ID NO: 7117156 - DNA, 22 bp, Homo sapiens
caagaaattctgttcagatagc

SEQ ID NO: 7117157 - DNA, 22 bp, Homo sapiens
caagaaattctgttcagatagc

SEQ ID NO: 7117158 - DNA, 22 bp, Homo sapiens
caagaaattctgttcagatagc

SEQ ID NO: 7117159 - DNA, 22 bp, Homo sapiens
caagaaattctgttcagatagc

SEQ ID NO: 7117160 - DNA, 22 bp, Homo sapiens
caacaatatgctgagtttttca

SEQ ID NO: 7117161 - DNA, 22 bp, Homo sapiens
caacaatatgctgagtttttca

SEQ ID NO: 7117162 - DNA, 22 bp, Homo sapiens
caacaagggacagtgttctaaa

SEQ ID NO: 7117163 - DNA, 22 bp, Homo sapiens
caacaatatgccagactcaatt

SEQ ID NO: 7117164 - DNA, 22 bp, Homo sapiens
caaattttgtgtgttctctagt

SEQ ID NO: 7117165 - DNA, 22 bp, Homo sapiens
caacaacatgggattcatttct

SEQ ID NO: 7117166 - DNA, 22 bp, Homo sapiens
caacaacatgggattcatttct

SEQ ID NO: 7117167 - DNA, 22 bp, Homo sapiens
gctgccctgtctgcagcaggac

SEQ ID NO: 7117168 - DNA, 22 bp, Homo sapiens
gctgccctgtccggctctcctg

SEQ ID NO: 7117169 - DNA, 22 bp, Homo sapiens
gctgccctgtccggctctcctg

SEQ ID NO: 7117170 - DNA, 22 bp, Homo sapiens
gctgccctgtccggctctcctg

SEQ ID NO: 7117171 - DNA, 22 bp, Homo sapiens
gctgccctgtctgcagcaggac

SEQ ID NO: 7117172 - DNA, 22 bp, Homo sapiens
gctgccctgtctgcagcaggac

SEQ ID NO: 7117173 - DNA, 22 bp, Homo sapiens
caactacatccacactttgtta

SEQ ID NO: 7117174 - DNA, 22 bp, Homo sapiens
caacacattgaagctatgatga

SEQ ID NO: 7117175 - DNA, 22 bp, Homo sapiens
caacaccttgatcttggacttc

SEQ ID NO: 7117176 - DNA, 22 bp, Homo sapiens
caacactgacaatggactgatt

SEQ ID NO: 7117177 - DNA, 22 bp, Homo sapiens
caactttagcaatgttagtata

SEQ ID NO: 7117178 - DNA, 22 bp, Homo sapiens
caacacattgaagctatgatga

SEQ ID NO: 7117179 - DNA, 22 bp, Homo sapiens
caacacattgaagctatgatga

SEQ ID NO: 7117180 - DNA, 22 bp, Homo sapiens
caacacattgaagctatgatga

SEQ ID NO: 7117181 - DNA, 22 bp, Homo sapiens
caacacaggttctgcaaaggaa

SEQ ID NO: 7117182 - DNA, 22 bp, Homo sapiens
caacacaggttctgcaaaggaa

SEQ ID NO: 7117183 - DNA, 22 bp, Homo sapiens
caacacaggttctgcaaaggaa

SEQ ID NO: 7117184 - DNA, 22 bp, Homo sapiens
caacacagccattcccctagaa

SEQ ID NO: 7117185 - DNA, 22 bp, Homo sapiens
caacacaggggttatgccatgg

SEQ ID NO: 7117186 - DNA, 22 bp, Homo sapiens
caacacaggttctgcaaaggaa

SEQ ID NO: 7117187 - DNA, 23 bp, Homo sapiens
ggaagctcacgtagtcctgcact

SEQ ID NO: 7117188 - DNA, 22 bp, Homo sapiens
ggaagcctaaagcccaggtctc

SEQ ID NO: 7117189 - DNA, 22 bp, Homo sapiens
ggaagctgaacttagcaaggaa

SEQ ID NO: 7117190 - DNA, 22 bp, Homo sapiens
ggaagctgaacttagcaaggaa

SEQ ID NO: 7117191 - DNA, 22 bp, Homo sapiens
ggaagctgccagtccaccagct

SEQ ID NO: 7117192 - DNA, 22 bp, Homo sapiens
ggaagctgccagtccaccagct

SEQ ID NO: 7117193 - DNA, 22 bp, Homo sapiens
ggaagctgccagtccaccagct

SEQ ID NO: 7117194 - DNA, 22 bp, Homo sapiens
ggaagctggacaggctttgagt

SEQ ID NO: 7117195 - DNA, 22 bp, Homo sapiens
ggaagctgaatccagagacagg

SEQ ID NO: 7117196 - DNA, 22 bp, Homo sapiens
ggaagctgaatccagagacagg

SEQ ID NO: 7117197 - DNA, 22 bp, Homo sapiens
ggaagctgaatccagagacagg

SEQ ID NO: 7117198 - DNA, 22 bp, Homo sapiens
ggaagctgaggcccagtgaagg

SEQ ID NO: 7117199 - DNA, 22 bp, Homo sapiens
ggaagctgaatccagagacagg

SEQ ID NO: 7117200 - DNA, 22 bp, Homo sapiens
ggaagctgaggcccagtgaagg

SEQ ID NO: 7117201 - DNA, 20 bp, Homo sapiens
ggaagctgtgggtccccagg

SEQ ID NO: 7117202 - DNA, 22 bp, Homo sapiens
ggaagctgtgctctcaggcctc

SEQ ID NO: 7117203 - DNA, 22 bp, Homo sapiens
ggaagctgtgctctcaggcctc

SEQ ID NO: 7117204 - DNA, 22 bp, Homo sapiens
ggaagctgtgctctcaggcctc

SEQ ID NO: 7117205 - DNA, 22 bp, Homo sapiens
ggaagctggtaattgttgggac

SEQ ID NO: 7117206 - DNA, 22 bp, Homo sapiens
ggaagctggcatatgtaatcct

SEQ ID NO: 7117207 - DNA, 22 bp, Homo sapiens
ggaagctggcatatgtaatcct

SEQ ID NO: 7117208 - DNA, 22 bp, Homo sapiens
ggaagctgggatctctctcccg

SEQ ID NO: 7117209 - DNA, 22 bp, Homo sapiens
cacaaatgactgaaacgactgt

SEQ ID NO: 7117210 - DNA, 19 bp, Homo sapiens
cacaaatgatgaggacctg

SEQ ID NO: 7117211 - DNA, 22 bp, Homo sapiens
cacaaatgactgaaacgactgt

SEQ ID NO: 7117212 - DNA, 22 bp, Homo sapiens
cacaaatgactgaaacgactgt

SEQ ID NO: 7117213 - DNA, 20 bp, Homo sapiens
ggaagctgtgggtccccagg

SEQ ID NO: 7117214 - DNA, 22 bp, Homo sapiens
cacaaataccagtttcctaaca

SEQ ID NO: 7117215 - DNA, 19 bp, Homo sapiens
cacaacttcgcttgattcc

SEQ ID NO: 7117216 - DNA, 20 bp, Homo sapiens
ggacaggaagacaacctacc

SEQ ID NO: 7117217 - DNA, 23 bp, Homo sapiens
cacaactaatcagaatctctagg

SEQ ID NO: 7117218 - DNA, 17 bp, Homo sapiens
cacaactggctgattga

SEQ ID NO: 7117219 - DNA, 20 bp, Homo sapiens
cacaactgtccacatgctcc

SEQ ID NO: 7117220 - DNA, 22 bp, Homo sapiens
cacaacttagcagcttgaaaca

SEQ ID NO: 7117221 - DNA, 22 bp, Homo sapiens
cacaaatggccgtgttcaaaga

SEQ ID NO: 7117222 - DNA, 22 bp, Homo sapiens
cacaaatggccgtgttcaaaga

SEQ ID NO: 7117223 - DNA, 22 bp, Homo sapiens
cacaaatggttgtagacattaa

SEQ ID NO: 7117224 - DNA, 22 bp, Homo sapiens
cacaaatggttgtagacattaa

SEQ ID NO: 7117225 - DNA, 22 bp, Homo sapiens
cacaaatggttgtagacattaa

SEQ ID NO: 7117226 - DNA, 22 bp, Homo sapiens
cacaaatgtagtagcttaaaac

SEQ ID NO: 7117227 - DNA, 22 bp, Homo sapiens
cacaaatgtgcagaaatgtgag

SEQ ID NO: 7117228 - DNA, 22 bp, Homo sapiens
cacaaatgtgcagaaatgtgag

SEQ ID NO: 7117229 - DNA, 23 bp, Homo sapiens
cacaactaatcagaatctctagg

SEQ ID NO: 7117230 - DNA, 22 bp, Homo sapiens
ggacatggagcatgtagagaaa

SEQ ID NO: 7117231 - DNA, 22 bp, Homo sapiens
ggacatggagctccatggaggc

SEQ ID NO: 7117232 - DNA, 22 bp, Homo sapiens
ggacatggaagtatggagtgga

SEQ ID NO: 7117233 - DNA, 22 bp, Homo sapiens
ggacatggagctccatggaggc

SEQ ID NO: 7117234 - DNA, 23 bp, Homo sapiens
ggacatgtctctgggtattttga

SEQ ID NO: 7117235 - DNA, 22 bp, Homo sapiens
ggacatgtgcaacttctttgga

SEQ ID NO: 7117236 - DNA, 23 bp, Homo sapiens
ggacatgtctctgggtattttga

SEQ ID NO: 7117237 - DNA, 22 bp, Homo sapiens
ggacatgttccttttcatcttt

SEQ ID NO: 7117238 - DNA, 22 bp, Homo sapiens
ggacatgttccttttcatcttt

SEQ ID NO: 7117239 - DNA, 22 bp, Homo sapiens
ggacattgaagctggaaaggga

SEQ ID NO: 7117240 - DNA, 22 bp, Homo sapiens
ggacatttagaacagagtattt

SEQ ID NO: 7117241 - DNA, 22 bp, Homo sapiens
ggacatttagaacagagtattt

SEQ ID NO: 7117242 - DNA, 22 bp, Homo sapiens
ggaccagagaagtgagcacctg

SEQ ID NO: 7117243 - DNA, 22 bp, Homo sapiens
ggaccacagtgcatggcctgta

SEQ ID NO: 7117244 - DNA, 18 bp, Homo sapiens
ggaccacatcaacttgaa

SEQ ID NO: 7117245 - DNA, 22 bp, Homo sapiens
ggacatttttcttcctacaatg

SEQ ID NO: 7117246 - DNA, 22 bp, Homo sapiens
ggacatttttcttcctacaatg

SEQ ID NO: 7117247 - DNA, 22 bp, Homo sapiens
ggacatttttcttcctacaatg

SEQ ID NO: 7117248 - DNA, 22 bp, Homo sapiens
ggaccaaatgctttttaattga

SEQ ID NO: 7117249 - DNA, 22 bp, Homo sapiens
ggaccacaatatttgtgaggtt

SEQ ID NO: 7117250 - DNA, 22 bp, Homo sapiens
ggacatttagtttcattgggca

SEQ ID NO: 7117251 - DNA, 22 bp, Homo sapiens
ggacatttagaacagagtattt

SEQ ID NO: 7117252 - DNA, 22 bp, Homo sapiens
ggacatttagtttcattgggca

SEQ ID NO: 7117253 - DNA, 22 bp, Homo sapiens
ggacatttcataagaccattct

SEQ ID NO: 7117254 - DNA, 22 bp, Homo sapiens
ggacatttcataagaccattct

SEQ ID NO: 7117255 - DNA, 22 bp, Homo sapiens
ggacatttctattgagctaaga

SEQ ID NO: 7117256 - DNA, 19 bp, Homo sapiens
ggacatttgagttgtttat

SEQ ID NO: 7117257 - DNA, 19 bp, Homo sapiens
ggacatttgagttgtttat

SEQ ID NO: 7117258 - DNA, 22 bp, Homo sapiens
ggacatttgcacctacctcagc

SEQ ID NO: 7117259 - DNA, 22 bp, Homo sapiens
ggacatttgcacctacctcagc

SEQ ID NO: 7117260 - DNA, 20 bp, Homo sapiens
ggagagcagggaagacagta

SEQ ID NO: 7117261 - DNA, 22 bp, Homo sapiens
ggagagcagggaggctgctctg

SEQ ID NO: 7117262 - DNA, 22 bp, Homo sapiens
ggagagcagggaggctgctctg

SEQ ID NO: 7117263 - DNA, 22 bp, Homo sapiens
ggagagcagggaggctgctctg

SEQ ID NO: 7117264 - DNA, 22 bp, Homo sapiens
ggagagcagggtcctgagatac

SEQ ID NO: 7117265 - DNA, 22 bp, Homo sapiens
ggagagcagggtcctgagatac

SEQ ID NO: 7117266 - DNA, 22 bp, Homo sapiens
ggagagcagggtcctgagatac

SEQ ID NO: 7117267 - DNA, 22 bp, Homo sapiens
ggagagcattcttagtctgttt

SEQ ID NO: 7117268 - DNA, 22 bp, Homo sapiens
ggagagcattcttagtctgttt

SEQ ID NO: 7117269 - DNA, 20 bp, Homo sapiens
ggagagccacatagtctccc

SEQ ID NO: 7117270 - DNA, 22 bp, Homo sapiens
ggagagataggagtcctggact

SEQ ID NO: 7117271 - DNA, 22 bp, Homo sapiens
ggagagataggagtcctggact

SEQ ID NO: 7117272 - DNA, 22 bp, Homo sapiens
ggagagatggtaaccctggggc

SEQ ID NO: 7117273 - DNA, 22 bp, Homo sapiens
ggagagaggagcccactgctgt

SEQ ID NO: 7117274 - DNA, 22 bp, Homo sapiens
ggagagaggctggccgtgatga

SEQ ID NO: 7117275 - DNA, 22 bp, Homo sapiens
ggagagaggctggccgtgatga

SEQ ID NO: 7117276 - DNA, 22 bp, Homo sapiens
ggagagaggctggccgtgatga

SEQ ID NO: 7117277 - DNA, 22 bp, Homo sapiens
ggagaaggtgctggtcactgtg

SEQ ID NO: 7117278 - DNA, 22 bp, Homo sapiens
ggagaaggtgctggtcactgtg

SEQ ID NO: 7117279 - DNA, 22 bp, Homo sapiens
ggagaaggtggctcagcaaagg

SEQ ID NO: 7117280 - DNA, 22 bp, Homo sapiens
ggagaaggtggctcagcaaagg

SEQ ID NO: 7117281 - DNA, 22 bp, Homo sapiens
ggagagaggagcccactgctgt

SEQ ID NO: 7117282 - DNA, 22 bp, Homo sapiens
ggagagaggagcccactgctgt

SEQ ID NO: 7117283 - DNA, 22 bp, Homo sapiens
ggagagaggagcccactgctgt

SEQ ID NO: 7117284 - DNA, 22 bp, Homo sapiens
ggagaagggtatgtgtggcgga

SEQ ID NO: 7117285 - DNA, 22 bp, Homo sapiens
ggagaagggtatgtgtggcgga

SEQ ID NO: 7117286 - DNA, 22 bp, Homo sapiens
ggagaagggccaattccatgta

SEQ ID NO: 7117287 - DNA, 22 bp, Homo sapiens
ggagaagggtatgtgtggcgga

SEQ ID NO: 7117288 - DNA, 22 bp, Homo sapiens
ggagaagggtatgtgtggcgga

SEQ ID NO: 7117289 - DNA, 22 bp, Homo sapiens
ggagaagggtatgtgtggcgga

SEQ ID NO: 7117290 - DNA, 22 bp, Homo sapiens
ggagaagggtatgtgtggcgga

SEQ ID NO: 7117291 - DNA, 22 bp, Homo sapiens
ggagaagggtatgtgtggcgga

SEQ ID NO: 7117292 - DNA, 22 bp, Homo sapiens
ggagaagggtatgtgtggcgga

SEQ ID NO: 7117293 - DNA, 22 bp, Homo sapiens
ggagaaggtgctggtcactgtg

SEQ ID NO: 7117294 - DNA, 22 bp, Homo sapiens
ggagaaggtgctggtcactgtg

SEQ ID NO: 7117295 - DNA, 22 bp, Homo sapiens
ggagaaggtgctggtcactgtg

SEQ ID NO: 7117296 - DNA, 22 bp, Homo sapiens
ggagaaggtgctggtcactgtg

SEQ ID NO: 7117297 - DNA, 22 bp, Homo sapiens
ggagaaggtgctggtcactgtg

SEQ ID NO: 7117298 - DNA, 22 bp, Homo sapiens
ggagaagggacagactcagctt

SEQ ID NO: 7117299 - DNA, 22 bp, Homo sapiens
ggagaagggacagactcagctt

SEQ ID NO: 7117300 - DNA, 22 bp, Homo sapiens
ggagaagggacagactcagctt

SEQ ID NO: 7117301 - DNA, 22 bp, Homo sapiens
ggagaagggacagactcagctt

SEQ ID NO: 7117302 - DNA, 22 bp, Homo sapiens
ggagaagggacagactcagctt

SEQ ID NO: 7117303 - DNA, 22 bp, Homo sapiens
ggagaagggacagactcagctt

SEQ ID NO: 7117304 - DNA, 22 bp, Homo sapiens
ggagaagggacagactcagctt

SEQ ID NO: 7117305 - DNA, 22 bp, Homo sapiens
ggagaagggcatggtagtttta

SEQ ID NO: 7117306 - DNA, 22 bp, Homo sapiens
ggagaagggcatggtagtttta

SEQ ID NO: 7117307 - DNA, 22 bp, Homo sapiens
ggagaagggcatggtagtttta

SEQ ID NO: 7117308 - DNA, 22 bp, Homo sapiens
ggagaagggccaattccatgta

SEQ ID NO: 7117309 - DNA, 22 bp, Homo sapiens
ggagaagggccaattccatgta

SEQ ID NO: 7117310 - DNA, 22 bp, Homo sapiens
ggagaagggccaattccatgta

SEQ ID NO: 7117311 - DNA, 22 bp, Homo sapiens
ggagaagggccaattccatgta

SEQ ID NO: 7117312 - DNA, 22 bp, Homo sapiens
cacacaggtaagcctctttcaa

SEQ ID NO: 7117313 - DNA, 22 bp, Homo sapiens
cacacagggagaaagaaagcct

SEQ ID NO: 7117314 - DNA, 22 bp, Homo sapiens
cacacaggatgaagcagcagaa

SEQ ID NO: 7117315 - DNA, 22 bp, Homo sapiens
cacacaggatgaagcagcagaa

SEQ ID NO: 7117316 - DNA, 22 bp, Homo sapiens
cacacaggatgaagcagcagaa

SEQ ID NO: 7117317 - DNA, 20 bp, Homo sapiens
ggaccagctgtctgaggggc

SEQ ID NO: 7117318 - DNA, 22 bp, Homo sapiens
cacacaggagagtgctggaggt

SEQ ID NO: 7117319 - DNA, 22 bp, Homo sapiens
cacacaggagagtgctggaggt

SEQ ID NO: 7117320 - DNA, 22 bp, Homo sapiens
cacacaggatgaagcagcagaa

SEQ ID NO: 7117321 - DNA, 22 bp, Homo sapiens
cacacaggatgaagcagcagaa

SEQ ID NO: 7117322 - DNA, 22 bp, Homo sapiens
ggagaagggacagactcagctt

SEQ ID NO: 7117323 - DNA, 22 bp, Homo sapiens
ggagaagggaactgagtttttg

SEQ ID NO: 7117324 - DNA, 22 bp, Homo sapiens
ggagaagggaactgagtttttg

SEQ ID NO: 7117325 - DNA, 22 bp, Homo sapiens
ggagaaggcacacccacctctg

SEQ ID NO: 7117326 - DNA, 22 bp, Homo sapiens
ggagaaggcgaagtcattcttt

SEQ ID NO: 7117327 - DNA, 22 bp, Homo sapiens
ggagaaggcgaagtcattcttt

SEQ ID NO: 7117328 - DNA, 22 bp, Homo sapiens
ggagaaggcgaagtcattcttt

SEQ ID NO: 7117329 - DNA, 21 bp, Homo sapiens
cacacagtggagtgcccttgc

SEQ ID NO: 7117330 - DNA, 21 bp, Homo sapiens
cacacagtggagtgcccttgc

SEQ ID NO: 7117331 - DNA, 22 bp, Homo sapiens
ggactgggtaggagcccagggc

SEQ ID NO: 7117332 - DNA, 21 bp, Homo sapiens
cacacagtgatctatccacat

SEQ ID NO: 7117333 - DNA, 21 bp, Homo sapiens
cacacagtgatctatccacat

SEQ ID NO: 7117334 - DNA, 22 bp, Homo sapiens
cacacagtggagtattactcag

SEQ ID NO: 7117335 - DNA, 22 bp, Homo sapiens
cacacagtaggcactcattaat

SEQ ID NO: 7117336 - DNA, 22 bp, Homo sapiens
cacacagtaggcactcattaat

SEQ ID NO: 7117337 - DNA, 22 bp, Homo sapiens
cacacagtagtatgaggcaaaa

SEQ ID NO: 7117338 - DNA, 22 bp, Homo sapiens
caatttcagtgctgtggagagg

SEQ ID NO: 7117339 - DNA, 22 bp, Homo sapiens
caatttcaggtggataggtttt

SEQ ID NO: 7117340 - DNA, 17 bp, Homo sapiens
caatttcataggttttg

SEQ ID NO: 7117341 - DNA, 22 bp, Homo sapiens
caatttcactaataatatttac

SEQ ID NO: 7117342 - DNA, 22 bp, Homo sapiens
caatttcactaatgatgtgggg

SEQ ID NO: 7117343 - DNA, 22 bp, Homo sapiens
caatttcaggtggataggtttt

SEQ ID NO: 7117344 - DNA, 22 bp, Homo sapiens
caatttcaatgaggccacaggg

SEQ ID NO: 7117345 - DNA, 22 bp, Homo sapiens
caatttcaatacaaaatacatt

SEQ ID NO: 7117346 - DNA, 22 bp, Homo sapiens
caatttcaatacaaaatacatt

SEQ ID NO: 7117347 - DNA, 22 bp, Homo sapiens
caatttcactaataatatttac

SEQ ID NO: 7117348 - DNA, 22 bp, Homo sapiens
caatttcactaataatatttac

SEQ ID NO: 7117349 - DNA, 22 bp, Homo sapiens
caatttcatgccatgtattgct

SEQ ID NO: 7117350 - DNA, 22 bp, Homo sapiens
caatttcatgccatgtattgct

SEQ ID NO: 7117351 - DNA, 22 bp, Homo sapiens
caatttcatgccatgtattgct

SEQ ID NO: 7117352 - DNA, 22 bp, Homo sapiens
caatttcatggataaaagatgt

SEQ ID NO: 7117353 - DNA, 20 bp, Homo sapiens
caatttcatcatttcctgtg

SEQ ID NO: 7117354 - DNA, 22 bp, Homo sapiens
caatttcatcttgtgcttcaat

SEQ ID NO: 7117355 - DNA, 22 bp, Homo sapiens
caatttcattaatagatataga

SEQ ID NO: 7117356 - DNA, 22 bp, Homo sapiens
caatttccttcatagatgactg

SEQ ID NO: 7117357 - DNA, 22 bp, Homo sapiens
ggaagagcctggggtgtcaggc

SEQ ID NO: 7117358 - DNA, 22 bp, Homo sapiens
caatttcattaatagatataga

SEQ ID NO: 7117359 - DNA, 22 bp, Homo sapiens
caatttcattaatagatataga

SEQ ID NO: 7117360 - DNA, 19 bp, Homo sapiens
caatatatagtgagtggat

SEQ ID NO: 7117361 - DNA, 22 bp, Homo sapiens
caatcacaaagagacaagtgtc

SEQ ID NO: 7117362 - DNA, 22 bp, Homo sapiens
caatcacaaagagacaagtgtc

SEQ ID NO: 7117363 - DNA, 22 bp, Homo sapiens
caatcactgacctgcagatgca

SEQ ID NO: 7117364 - DNA, 22 bp, Homo sapiens
caatcactgggatattggtgtg

SEQ ID NO: 7117365 - DNA, 22 bp, Homo sapiens
caatcagatatgtgacatattt

SEQ ID NO: 7117366 - DNA, 22 bp, Homo sapiens
caatcagatatgtgacatattt

SEQ ID NO: 7117367 - DNA, 22 bp, Homo sapiens
caatgttttgttgaatgaatag

SEQ ID NO: 7117368 - DNA, 22 bp, Homo sapiens
caatgttttgttgaatgaatag

SEQ ID NO: 7117369 - DNA, 22 bp, Homo sapiens
caatgttttgttgaatgaatag

SEQ ID NO: 7117370 - DNA, 22 bp, Homo sapiens
caatgttttgttgaatgaatag

SEQ ID NO: 7117371 - DNA, 22 bp, Homo sapiens
caatccatcaattacacaggct

SEQ ID NO: 7117372 - DNA, 22 bp, Homo sapiens
caatgttttcaactgacaagta

SEQ ID NO: 7117373 - DNA, 22 bp, Homo sapiens
caatgttttcaactgacaagta

SEQ ID NO: 7117374 - DNA, 22 bp, Homo sapiens
caatcatttatgcttgcggagg

SEQ ID NO: 7117375 - DNA, 22 bp, Homo sapiens
caatccagtttctgtcagctac

SEQ ID NO: 7117376 - DNA, 22 bp, Homo sapiens
caattctgaggcctgctttgtt

SEQ ID NO: 7117377 - DNA, 19 bp, Homo sapiens
caattctgcaacactgtcc

SEQ ID NO: 7117378 - DNA, 22 bp, Homo sapiens
caattctgaggcctgctttgtt

SEQ ID NO: 7117379 - DNA, 22 bp, Homo sapiens
caattcccagctgccgggctgc

SEQ ID NO: 7117380 - DNA, 22 bp, Homo sapiens
caattcattacattgcaaagac

SEQ ID NO: 7117381 - DNA, 22 bp, Homo sapiens
caattcattacattgcaaagac

SEQ ID NO: 7117382 - DNA, 22 bp, Homo sapiens
caattcttggagaagaagcata

SEQ ID NO: 7117383 - DNA, 22 bp, Homo sapiens
caattctgcaagtgactgacct

SEQ ID NO: 7117384 - DNA, 22 bp, Homo sapiens
caatttcaatacaaaatacatt

SEQ ID NO: 7117385 - DNA, 22 bp, Homo sapiens
caatttcaagattctgttcttt

SEQ ID NO: 7117386 - DNA, 22 bp, Homo sapiens
caattgtatgtgagaaataaat

SEQ ID NO: 7117387 - DNA, 22 bp, Homo sapiens
caattgtcgttgacatccttca

SEQ ID NO: 7117388 - DNA, 22 bp, Homo sapiens
caattgacaatgacagtgtcaa

SEQ ID NO: 7117389 - DNA, 22 bp, Homo sapiens
caattgacaatgacagtgtcaa

SEQ ID NO: 7117390 - DNA, 22 bp, Homo sapiens
caattgcaatagagaaaagagt

SEQ ID NO: 7117391 - DNA, 22 bp, Homo sapiens
caattgctgatatgcagaagac

SEQ ID NO: 7117392 - DNA, 22 bp, Homo sapiens
caataagatgtattgagcagag

SEQ ID NO: 7117393 - DNA, 22 bp, Homo sapiens
caaggctgtgcagggtccatat

SEQ ID NO: 7117394 - DNA, 22 bp, Homo sapiens
caaggctgtgttagctgccctc

SEQ ID NO: 7117395 - DNA, 22 bp, Homo sapiens
caaggctgtgttagctgccctc

SEQ ID NO: 7117396 - DNA, 22 bp, Homo sapiens
caataagtaataggcatctaat

SEQ ID NO: 7117397 - DNA, 22 bp, Homo sapiens
caatactgcatctttgcccttt

SEQ ID NO: 7117398 - DNA, 22 bp, Homo sapiens
caatactgggcaggagagtaca

SEQ ID NO: 7117399 - DNA, 22 bp, Homo sapiens
caaggctgtgcagggtccatat

SEQ ID NO: 7117400 - DNA, 22 bp, Homo sapiens
caaggctgtgcagggtccatat

SEQ ID NO: 7117401 - DNA, 22 bp, Homo sapiens
caaggctgtctccagcttccaa

SEQ ID NO: 7117402 - DNA, 22 bp, Homo sapiens
caaggctgtctccagcttccaa

SEQ ID NO: 7117403 - DNA, 22 bp, Homo sapiens
caaggctgcttcagactagtga

SEQ ID NO: 7117404 - DNA, 22 bp, Homo sapiens
caaggctgcttcagactagtga

SEQ ID NO: 7117405 - DNA, 22 bp, Homo sapiens
caaggctggagtgtaatggcat

SEQ ID NO: 7117406 - DNA, 22 bp, Homo sapiens
caaggctgctggcttctgagct

SEQ ID NO: 7117407 - DNA, 22 bp, Homo sapiens
caaggctgcttcagactagtga

SEQ ID NO: 7117408 - DNA, 22 bp, Homo sapiens
gctggggaggcagcagagaaca

SEQ ID NO: 7117409 - DNA, 22 bp, Homo sapiens
gctggggaggcagcagagaaca

SEQ ID NO: 7117410 - DNA, 22 bp, Homo sapiens
gctggggagctagacctcagca

SEQ ID NO: 7117411 - DNA, 22 bp, Homo sapiens
gctggggagctagacctcagca

SEQ ID NO: 7117412 - DNA, 22 bp, Homo sapiens
gctggggagctagacctcagca

SEQ ID NO: 7117413 - DNA, 22 bp, Homo sapiens
gctggggagctagacctcagca

SEQ ID NO: 7117414 - DNA, 22 bp, Homo sapiens
caaggctgcaaaactacatggg

SEQ ID NO: 7117415 - DNA, 22 bp, Homo sapiens
caaggctgcaaaactacatggg

SEQ ID NO: 7117416 - DNA, 22 bp, Homo sapiens
caaggctctgcttctatcacat

SEQ ID NO: 7117417 - DNA, 22 bp, Homo sapiens
caaggctgagaaattctgccct

SEQ ID NO: 7117418 - DNA, 22 bp, Homo sapiens
caaggctgatcattttcccata

SEQ ID NO: 7117419 - DNA, 22 bp, Homo sapiens
caaggctgctggcttctgagct

SEQ ID NO: 7117420 - DNA, 22 bp, Homo sapiens
caaggctgcactgttgccatag

SEQ ID NO: 7117421 - DNA, 22 bp, Homo sapiens
caaggctgctgcgggtcgcacc

SEQ ID NO: 7117422 - DNA, 22 bp, Homo sapiens
caatagcagacctagaaagcaa

SEQ ID NO: 7117423 - DNA, 22 bp, Homo sapiens
caatagcagacctagaaagcaa

SEQ ID NO: 7117424 - DNA, 22 bp, Homo sapiens
caatagcagcttctgaatgcaa

SEQ ID NO: 7117425 - DNA, 22 bp, Homo sapiens
caatagagacctggattctccc

SEQ ID NO: 7117426 - DNA, 22 bp, Homo sapiens
caatagataactgagatagact

SEQ ID NO: 7117427 - DNA, 22 bp, Homo sapiens
caatagatatttgctgactgcc

SEQ ID NO: 7117428 - DNA, 22 bp, Homo sapiens
caatagcagacctagaaagcaa

SEQ ID NO: 7117429 - DNA, 20 bp, Homo sapiens
caatagaatgtggagataag

SEQ ID NO: 7117430 - DNA, 22 bp, Homo sapiens
caatagaaggcacagataggta

SEQ ID NO: 7117431 - DNA, 22 bp, Homo sapiens
caatagaaggcacagataggta

SEQ ID NO: 7117432 - DNA, 22 bp, Homo sapiens
caatagaaggcacagataggta

SEQ ID NO: 7117433 - DNA, 18 bp, Homo sapiens
caatagaaacagtaggaa

SEQ ID NO: 7117434 - DNA, 18 bp, Homo sapiens
caatagaaacagtaggaa

SEQ ID NO: 7117435 - DNA, 22 bp, Homo sapiens
caatactttagtaaaatggccc

SEQ ID NO: 7117436 - DNA, 22 bp, Homo sapiens
caatagaaaactcaatacttaa

SEQ ID NO: 7117437 - DNA, 22 bp, Homo sapiens
caatagaaaactcaatacttaa

SEQ ID NO: 7117438 - DNA, 22 bp, Homo sapiens
caatagcaggtctacagagaga

SEQ ID NO: 7117439 - DNA, 22 bp, Homo sapiens
caatagtaaattacggaggaga

SEQ ID NO: 7117440 - DNA, 22 bp, Homo sapiens
caatagtatttattgaacacct

SEQ ID NO: 7117441 - DNA, 22 bp, Homo sapiens
caatagttcggtcctgaaggcc

SEQ ID NO: 7117442 - DNA, 22 bp, Homo sapiens
caatagtaaattacggaggaga

SEQ ID NO: 7117443 - DNA, 22 bp, Homo sapiens
caatagtgtctgcttgtttcta

SEQ ID NO: 7117444 - DNA, 22 bp, Homo sapiens
caatatagagagaaaattatgt

SEQ ID NO: 7117445 - DNA, 22 bp, Homo sapiens
caatatataatgagtactttcc

SEQ ID NO: 7117446 - DNA, 19 bp, Homo sapiens
caatatatagtgagtggat

SEQ ID NO: 7117447 - DNA, 22 bp, Homo sapiens
caatatataggaacaacttagg

SEQ ID NO: 7117448 - DNA, 22 bp, Homo sapiens
caatatataggaacaacttagg

SEQ ID NO: 7117449 - DNA, 22 bp, Homo sapiens
caatatataggaacaacttagg

SEQ ID NO: 7117450 - DNA, 22 bp, Homo sapiens
caatatataatgagtactttcc

SEQ ID NO: 7117451 - DNA, 22 bp, Homo sapiens
caatatataatgagtactttcc

SEQ ID NO: 7117452 - DNA, 22 bp, Homo sapiens
caatatataggaacaacttagg

SEQ ID NO: 7117453 - DNA, 22 bp, Homo sapiens
cactcaggctgtgtcaggagga

SEQ ID NO: 7117454 - DNA, 22 bp, Homo sapiens
cactcagaggtttgattgctca

SEQ ID NO: 7117455 - DNA, 22 bp, Homo sapiens
cactcagaggtttgattgctca

SEQ ID NO: 7117456 - DNA, 22 bp, Homo sapiens
cactattttctcttcagatggc

SEQ ID NO: 7117457 - DNA, 21 bp, Homo sapiens
cactcaataaatgtcatatgc

SEQ ID NO: 7117458 - DNA, 22 bp, Homo sapiens
cactcacttatttctaacagaa

SEQ ID NO: 7117459 - DNA, 21 bp, Homo sapiens
cactccacttagaacagggtt

SEQ ID NO: 7117460 - DNA, 21 bp, Homo sapiens
cactccacttagaacagggtt

SEQ ID NO: 7117461 - DNA, 21 bp, Homo sapiens
cactccacttagaacagggtt

SEQ ID NO: 7117462 - DNA, 21 bp, Homo sapiens
cactccacttagaacagggtt

SEQ ID NO: 7117463 - DNA, 21 bp, Homo sapiens
cactccacttagaacagggtt

SEQ ID NO: 7117464 - DNA, 22 bp, Homo sapiens
cactcagggatcaggtaaattc

SEQ ID NO: 7117465 - DNA, 22 bp, Homo sapiens
cactcagggtacaatggagggc

SEQ ID NO: 7117466 - DNA, 21 bp, Homo sapiens
cactcagggtatgtgccaggc

SEQ ID NO: 7117467 - DNA, 22 bp, Homo sapiens
cactcatattggaacaagcttg

SEQ ID NO: 7117468 - DNA, 22 bp, Homo sapiens
cactcatattggaacaagcttg

SEQ ID NO: 7117469 - DNA, 22 bp, Homo sapiens
cactccaagacctactttctct

SEQ ID NO: 7117470 - DNA, 21 bp, Homo sapiens
cactatttatatatgccagct

SEQ ID NO: 7117471 - DNA, 22 bp, Homo sapiens
cactatgcttacatgcttatat

SEQ ID NO: 7117472 - DNA, 22 bp, Homo sapiens
cactatttatacttcctgatcc

SEQ ID NO: 7117473 - DNA, 22 bp, Homo sapiens
cactatttcctggattttgacg

SEQ ID NO: 7117474 - DNA, 22 bp, Homo sapiens
cactatttcctggattttgacg

SEQ ID NO: 7117475 - DNA, 22 bp, Homo sapiens
cactatatctctttcatctttt

SEQ ID NO: 7117476 - DNA, 22 bp, Homo sapiens
cactatatctctttcatctttt

SEQ ID NO: 7117477 - DNA, 22 bp, Homo sapiens
cactataatcctgttttagaac

SEQ ID NO: 7117478 - DNA, 22 bp, Homo sapiens
cactatatctgttcttgtttat

SEQ ID NO: 7117479 - DNA, 22 bp, Homo sapiens
cactatctactattgtggttat

SEQ ID NO: 7117480 - DNA, 22 bp, Homo sapiens
cactatcttgtagggcatggca

SEQ ID NO: 7117481 - DNA, 22 bp, Homo sapiens
cactataatcctgttttagaac

SEQ ID NO: 7117482 - DNA, 19 bp, Homo sapiens
cactagtctagatgggatg

SEQ ID NO: 7117483 - DNA, 22 bp, Homo sapiens
cactagtggccccatgtggttg

SEQ ID NO: 7117484 - DNA, 22 bp, Homo sapiens
cacggcctgtaaggacccagga

SEQ ID NO: 7117485 - DNA, 22 bp, Homo sapiens
cactaggctggagtgcagtggc

SEQ ID NO: 7117486 - DNA, 17 bp, Homo sapiens
cactagtagtctctggc

SEQ ID NO: 7117487 - DNA, 22 bp, Homo sapiens
cactagtcctggtttcatgcta

SEQ ID NO: 7117488 - DNA, 19 bp, Homo sapiens
cactagtctagatgggatg

SEQ ID NO: 7117489 - DNA, 22 bp, Homo sapiens
ggccagggaggagaggcccctg

SEQ ID NO: 7117490 - DNA, 22 bp, Homo sapiens
ggccagggccaaggctttccca

SEQ ID NO: 7117491 - DNA, 22 bp, Homo sapiens
cacgccagccggacactgggcc

SEQ ID NO: 7117492 - DNA, 23 bp, Homo sapiens
cacggcagcctccgagggtgctg

SEQ ID NO: 7117493 - DNA, 23 bp, Homo sapiens
cacggcagcctccgagggtgctg

SEQ ID NO: 7117494 - DNA, 22 bp, Homo sapiens
cactgcactccagcctgggaga

SEQ ID NO: 7117495 - DNA, 22 bp, Homo sapiens
cactgcactccagcctgggaga

SEQ ID NO: 7117496 - DNA, 22 bp, Homo sapiens
cactgcactccagcctgggaga

SEQ ID NO: 7117497 - DNA, 22 bp, Homo sapiens
cactgcactccagcctgggaga

SEQ ID NO: 7117498 - DNA, 22 bp, Homo sapiens
cactgcactccagcctgggaga

SEQ ID NO: 7117499 - DNA, 22 bp, Homo sapiens
cactgcactccagcctgggaga

SEQ ID NO: 7117500 - DNA, 21 bp, Homo sapiens
cactctcccaatccttgctga

SEQ ID NO: 7117501 - DNA, 22 bp, Homo sapiens
cactctctcaggctttccttgt

SEQ ID NO: 7117502 - DNA, 22 bp, Homo sapiens
cactctgaactattaacttggg

SEQ ID NO: 7117503 - DNA, 22 bp, Homo sapiens
cactgcactccagcctgggaga

SEQ ID NO: 7117504 - DNA, 22 bp, Homo sapiens
cactgcactccagcctgggaga

SEQ ID NO: 7117505 - DNA, 22 bp, Homo sapiens
cactgcactccagcctgcgcaa

SEQ ID NO: 7117506 - DNA, 22 bp, Homo sapiens
cactgcactccagcctgggaga

SEQ ID NO: 7117507 - DNA, 22 bp, Homo sapiens
cactgcactccagcctgggaga

SEQ ID NO: 7117508 - DNA, 22 bp, Homo sapiens
cactgcaacctccacctcctgg

SEQ ID NO: 7117509 - DNA, 22 bp, Homo sapiens
cactgcactccagcctggcctg

SEQ ID NO: 7117510 - DNA, 22 bp, Homo sapiens
cactctccagcacaccccattt

SEQ ID NO: 7117511 - DNA, 21 bp, Homo sapiens
cactctcccaatccttgctga

SEQ ID NO: 7117512 - DNA, 22 bp, Homo sapiens
cactctccagcacaccccattt

SEQ ID NO: 7117513 - DNA, 21 bp, Homo sapiens
cactctcccaatccttgctga

SEQ ID NO: 7117514 - DNA, 21 bp, Homo sapiens
cactctcccaatccttgctga

SEQ ID NO: 7117515 - DNA, 22 bp, Homo sapiens
cactctcacatgccctgtcagt

SEQ ID NO: 7117516 - DNA, 22 bp, Homo sapiens
cactctcactgagctcatgcca

SEQ ID NO: 7117517 - DNA, 23 bp, Homo sapiens
cactcctgtttctaagccagcat

SEQ ID NO: 7117518 - DNA, 22 bp, Homo sapiens
cactcctgttccactaaatgag

SEQ ID NO: 7117519 - DNA, 22 bp, Homo sapiens
cactcctgttccactaaatgag

SEQ ID NO: 7117520 - DNA, 23 bp, Homo sapiens
cactcctgtttctaagccagcat

SEQ ID NO: 7117521 - DNA, 22 bp, Homo sapiens
cactccctctagttgcattctg

SEQ ID NO: 7117522 - DNA, 22 bp, Homo sapiens
cactcccttcaggagcctagga

SEQ ID NO: 7117523 - DNA, 21 bp, Homo sapiens
cactccacttagaacagggtt

SEQ ID NO: 7117524 - DNA, 22 bp, Homo sapiens
cactccagcctcagtgacagag

SEQ ID NO: 7117525 - DNA, 22 bp, Homo sapiens
cactccaggtcccagttcctgg

SEQ ID NO: 7117526 - DNA, 22 bp, Homo sapiens
cacctgggctaaactatgcagg

SEQ ID NO: 7117527 - DNA, 22 bp, Homo sapiens
cacctgggctaaactatgcagg

SEQ ID NO: 7117528 - DNA, 22 bp, Homo sapiens
cacctggctgtgaagcctgggt

SEQ ID NO: 7117529 - DNA, 23 bp, Homo sapiens
cacctggcttgagttggtgggtc

SEQ ID NO: 7117530 - DNA, 23 bp, Homo sapiens
cacctggcttgagttggtgggtc

SEQ ID NO: 7117531 - DNA, 23 bp, Homo sapiens
cacctggcttgagttggtgggtc

SEQ ID NO: 7117532 - DNA, 22 bp, Homo sapiens
cacctggcccagctccagtgct

SEQ ID NO: 7117533 - DNA, 22 bp, Homo sapiens
cacctggcctacagggaccagc

SEQ ID NO: 7117534 - DNA, 20 bp, Homo sapiens
cacctggctgactgtctcca

SEQ ID NO: 7117535 - DNA, 22 bp, Homo sapiens
cacctggctggaagtgctccgg

SEQ ID NO: 7117536 - DNA, 22 bp, Homo sapiens
cacctggctgtgaagcctgggt

SEQ ID NO: 7117537 - DNA, 22 bp, Homo sapiens
cacctgcctgctagagcctgac

SEQ ID NO: 7117538 - DNA, 22 bp, Homo sapiens
cacctgctccctcagttccagc

SEQ ID NO: 7117539 - DNA, 22 bp, Homo sapiens
cacctgctccctcagttccagc

SEQ ID NO: 7117540 - DNA, 22 bp, Homo sapiens
cacctggcagctgttggccacg

SEQ ID NO: 7117541 - DNA, 22 bp, Homo sapiens
cacctggcccagctccagtgct

SEQ ID NO: 7117542 - DNA, 22 bp, Homo sapiens
ggccaggctggtctcagacttc

SEQ ID NO: 7117543 - DNA, 22 bp, Homo sapiens
ggccaggctgctgggaccccgc

SEQ ID NO: 7117544 - DNA, 22 bp, Homo sapiens
ggccaggctgctgggaccccgc

SEQ ID NO: 7117545 - DNA, 22 bp, Homo sapiens
ggccaggctgctgggaccccgc

SEQ ID NO: 7117546 - DNA, 22 bp, Homo sapiens
ggccaggctgccctgggagcag

SEQ ID NO: 7117547 - DNA, 22 bp, Homo sapiens
ggccaggctgctgggaccccgc

SEQ ID NO: 7117548 - DNA, 22 bp, Homo sapiens
ggccaggctgccctgggagcag

SEQ ID NO: 7117549 - DNA, 22 bp, Homo sapiens
ggccaggctgccctgggagcag

SEQ ID NO: 7117550 - DNA, 22 bp, Homo sapiens
cacctgggctttctctgggact

SEQ ID NO: 7117551 - DNA, 22 bp, Homo sapiens
ggccaggctgccctgggagcag

SEQ ID NO: 7117552 - DNA, 22 bp, Homo sapiens
ggccaggctgccctgggagcag

SEQ ID NO: 7117553 - DNA, 22 bp, Homo sapiens
ggccaggctgccctgggagcag

SEQ ID NO: 7117554 - DNA, 22 bp, Homo sapiens
ggccaggctgctgggaccccgc

SEQ ID NO: 7117555 - DNA, 22 bp, Homo sapiens
ggccaggctggtctcagacttc

SEQ ID NO: 7117556 - DNA, 22 bp, Homo sapiens
ggccaggctggtctcagacttc

SEQ ID NO: 7117557 - DNA, 22 bp, Homo sapiens
ggccaggctggtctcagacttc

SEQ ID NO: 7117558 - DNA, 22 bp, Homo sapiens
ggccaggctggtctcagacttc

SEQ ID NO: 7117559 - DNA, 22 bp, Homo sapiens
ggccaggctggtctcagacttc

SEQ ID NO: 7117560 - DNA, 22 bp, Homo sapiens
ggccaggctggtctcagacttc

SEQ ID NO: 7117561 - DNA, 22 bp, Homo sapiens
ggccaggctggttccttgacct

SEQ ID NO: 7117562 - DNA, 22 bp, Homo sapiens
ggccaggctggttccttgacct

SEQ ID NO: 7117563 - DNA, 22 bp, Homo sapiens
ggccaggctggttccttgacct

SEQ ID NO: 7117564 - DNA, 22 bp, Homo sapiens
ggccaggctggttccttgacct

SEQ ID NO: 7117565 - DNA, 22 bp, Homo sapiens
ggccaggctggttccttgacct

SEQ ID NO: 7117566 - DNA, 22 bp, Homo sapiens
caccctgggctgggcctgttaa

SEQ ID NO: 7117567 - DNA, 22 bp, Homo sapiens
caccctgtacaaatggacatct

SEQ ID NO: 7117568 - DNA, 22 bp, Homo sapiens
cacctgcccagcacctgggatc

SEQ ID NO: 7117569 - DNA, 22 bp, Homo sapiens
caccaggctggagtgcagaggt

SEQ ID NO: 7117570 - DNA, 22 bp, Homo sapiens
caccaggctggagtgcagaggt

SEQ ID NO: 7117571 - DNA, 22 bp, Homo sapiens
caccaggctggagtgcagaggt

SEQ ID NO: 7117572 - DNA, 22 bp, Homo sapiens
caccaggctggagtgcagaggt

SEQ ID NO: 7117573 - DNA, 22 bp, Homo sapiens
caccaggctggagtgcagaggt

SEQ ID NO: 7117574 - DNA, 22 bp, Homo sapiens
caccaggctggagtgcagaggt

SEQ ID NO: 7117575 - DNA, 22 bp, Homo sapiens
cacctgccccagtcttggagct

SEQ ID NO: 7117576 - DNA, 22 bp, Homo sapiens
cacctgccctttcttgctccac

SEQ ID NO: 7117577 - DNA, 22 bp, Homo sapiens
cacctgcctcatttgtccctgc

SEQ ID NO: 7117578 - DNA, 22 bp, Homo sapiens
cacctgcctgcaggggctccac

SEQ ID NO: 7117579 - DNA, 22 bp, Homo sapiens
cacctgcctgcaggggctccac

SEQ ID NO: 7117580 - DNA, 22 bp, Homo sapiens
cacctgcctgcaggggctccac

SEQ ID NO: 7117581 - DNA, 22 bp, Homo sapiens
cacctgcctgctagagcctgac

SEQ ID NO: 7117582 - DNA, 22 bp, Homo sapiens
cacctgcctgctagagcctgac

SEQ ID NO: 7117583 - DNA, 22 bp, Homo sapiens
cacctgcctgctagagcctgac

SEQ ID NO: 7117584 - DNA, 22 bp, Homo sapiens
caccaggctgaaccagagggga

SEQ ID NO: 7117585 - DNA, 20 bp, Homo sapiens
caccaggcgctctgagaaca

SEQ ID NO: 7117586 - DNA, 22 bp, Homo sapiens
caccaggcacatagtaggcact

SEQ ID NO: 7117587 - DNA, 22 bp, Homo sapiens
caccaggcacagctctcctgct

SEQ ID NO: 7117588 - DNA, 22 bp, Homo sapiens
caccaggataaaacctctagat

SEQ ID NO: 7117589 - DNA, 22 bp, Homo sapiens
caccaggatgggcaggtaggtc

SEQ ID NO: 7117590 - DNA, 22 bp, Homo sapiens
caccaggcacagctctcctgct

SEQ ID NO: 7117591 - DNA, 22 bp, Homo sapiens
caccaggctgaaccagagggga

SEQ ID NO: 7117592 - DNA, 22 bp, Homo sapiens
caccaggctgagcctctcatct

SEQ ID NO: 7117593 - DNA, 22 bp, Homo sapiens
caccaggctgcccaggacaggg

SEQ ID NO: 7117594 - DNA, 22 bp, Homo sapiens
caccaggctgcccaggacaggg

SEQ ID NO: 7117595 - DNA, 22 bp, Homo sapiens
caccaggctgcccaggacaggg

SEQ ID NO: 7117596 - DNA, 22 bp, Homo sapiens
caccaggctgcccaggacaggg

SEQ ID NO: 7117597 - DNA, 22 bp, Homo sapiens
caccaggctgcccaggacaggg

SEQ ID NO: 7117598 - DNA, 22 bp, Homo sapiens
cactgcactccagcctgggtca

SEQ ID NO: 7117599 - DNA, 22 bp, Homo sapiens
cactgcactccagcctgggtca

SEQ ID NO: 7117600 - DNA, 22 bp, Homo sapiens
cactgcactccagcctgggtca

SEQ ID NO: 7117601 - DNA, 22 bp, Homo sapiens
cactgcactccagcctgggcaa

SEQ ID NO: 7117602 - DNA, 22 bp, Homo sapiens
cactgcactccagcctgggaga

SEQ ID NO: 7117603 - DNA, 22 bp, Homo sapiens
cactgcactccagcctgggaga

SEQ ID NO: 7117604 - DNA, 22 bp, Homo sapiens
cactgcactccagcctgggcaa

SEQ ID NO: 7117605 - DNA, 22 bp, Homo sapiens
cactgcactccagcctgggcaa

SEQ ID NO: 7117606 - DNA, 22 bp, Homo sapiens
cactgcactccagcctgggcca

SEQ ID NO: 7117607 - DNA, 22 bp, Homo sapiens
cactgcactccagcctgggcga

SEQ ID NO: 7117608 - DNA, 22 bp, Homo sapiens
cactgcactccagcctgggtca

SEQ ID NO: 7117609 - DNA, 22 bp, Homo sapiens
cactgcactccagcctgggtca

SEQ ID NO: 7117610 - DNA, 22 bp, Homo sapiens
cactgcactccagcctgggtca

SEQ ID NO: 7117611 - DNA, 22 bp, Homo sapiens
cactgcactccagcctgggtca

SEQ ID NO: 7117612 - DNA, 22 bp, Homo sapiens
cactgcactccagcctgggtca

SEQ ID NO: 7117613 - DNA, 22 bp, Homo sapiens
cactgcactccagcctgggtca

SEQ ID NO: 7117614 - DNA, 22 bp, Homo sapiens
cactgcactccagcctgggtca

SEQ ID NO: 7117615 - DNA, 22 bp, Homo sapiens
cactgcactccagcctgggtga

SEQ ID NO: 7117616 - DNA, 22 bp, Homo sapiens
cactgcactccagcctgggtga

SEQ ID NO: 7117617 - DNA, 22 bp, Homo sapiens
cactgcactccagcctgggtga

SEQ ID NO: 7117618 - DNA, 22 bp, Homo sapiens
cactgcactccagcctgggtca

SEQ ID NO: 7117619 - DNA, 22 bp, Homo sapiens
cactgcactccagcctgggtca

SEQ ID NO: 7117620 - DNA, 22 bp, Homo sapiens
cactgcactccagcctgggtga

SEQ ID NO: 7117621 - DNA, 22 bp, Homo sapiens
cactgcactccagcctgggtga

SEQ ID NO: 7117622 - DNA, 22 bp, Homo sapiens
cactgcactccagcctgggtga

SEQ ID NO: 7117623 - DNA, 22 bp, Homo sapiens
cactgcactccagcctgggtga

SEQ ID NO: 7117624 - DNA, 22 bp, Homo sapiens
cactgcactccagcctgggtga

SEQ ID NO: 7117625 - DNA, 22 bp, Homo sapiens
cactgcactccagcctgggtga

SEQ ID NO: 7117626 - DNA, 22 bp, Homo sapiens
cactgcactccagcttgggtga

SEQ ID NO: 7117627 - DNA, 22 bp, Homo sapiens
cactgcactccagcttgggtga

SEQ ID NO: 7117628 - DNA, 22 bp, Homo sapiens
cactgggagcagctccaacatt

SEQ ID NO: 7117629 - DNA, 22 bp, Homo sapiens
cactgggagtacaaagaatggg

SEQ ID NO: 7117630 - DNA, 22 bp, Homo sapiens
cactgcactccagcttgggtga

SEQ ID NO: 7117631 - DNA, 22 bp, Homo sapiens
cactgcactccagctgggtgac

SEQ ID NO: 7117632 - DNA, 22 bp, Homo sapiens
cactgcactccagcttgggcaa

SEQ ID NO: 7117633 - DNA, 22 bp, Homo sapiens
cactgcactccagcctgggtga

SEQ ID NO: 7117634 - DNA, 22 bp, Homo sapiens
cactgcactccagcctgggtga

SEQ ID NO: 7117635 - DNA, 22 bp, Homo sapiens
cactgcactccagcctgggtga

SEQ ID NO: 7117636 - DNA, 22 bp, Homo sapiens
cactgggagtcgtaagacacgg

SEQ ID NO: 7117637 - DNA, 22 bp, Homo sapiens
cactgggagtcgtaagacacgg

SEQ ID NO: 7117638 - DNA, 22 bp, Homo sapiens
cactgggagtcgtaagacacgg

SEQ ID NO: 7117639 - DNA, 22 bp, Homo sapiens
cactgggagtcgtaagacacgg

SEQ ID NO: 7117640 - DNA, 22 bp, Homo sapiens
cactgggatttggggtgtctta

SEQ ID NO: 7117641 - DNA, 22 bp, Homo sapiens
cactgggcaattctgagcctaa

SEQ ID NO: 7117642 - DNA, 22 bp, Homo sapiens
cactggtgatgaggcagttagg

SEQ ID NO: 7117643 - DNA, 22 bp, Homo sapiens
cactggtgccagagaacagaat

SEQ ID NO: 7117644 - DNA, 23 bp, Homo sapiens
cactggtggggtttaaaagaagc

SEQ ID NO: 7117645 - DNA, 22 bp, Homo sapiens
cactggtgtacaggaggtaaaa

SEQ ID NO: 7117646 - DNA, 22 bp, Homo sapiens
cactggtgtattagagctagaa

SEQ ID NO: 7117647 - DNA, 22 bp, Homo sapiens
cactggtgtattagagctagaa

SEQ ID NO: 7117648 - DNA, 22 bp, Homo sapiens
cactggtgtctgagcagggtga

SEQ ID NO: 7117649 - DNA, 22 bp, Homo sapiens
cactggtgtctgagcagggtga

SEQ ID NO: 7117650 - DNA, 22 bp, Homo sapiens
cactggttgcctctttctgttc

SEQ ID NO: 7117651 - DNA, 22 bp, Homo sapiens
cactggttggctgagatccata

SEQ ID NO: 7117652 - DNA, 22 bp, Homo sapiens
cactgtacccatttaaataaat

SEQ ID NO: 7117653 - DNA, 22 bp, Homo sapiens
cactgtacccatttaaataaat

SEQ ID NO: 7117654 - DNA, 22 bp, Homo sapiens
cactgtactgggttgaaggacg

SEQ ID NO: 7117655 - DNA, 21 bp, Homo sapiens
cactgtatagcaggagaaaac

SEQ ID NO: 7117656 - DNA, 21 bp, Homo sapiens
cactgtatagcaggagaaaac

SEQ ID NO: 7117657 - DNA, 22 bp, Homo sapiens
cactgtactgtgaataaggagg

SEQ ID NO: 7117658 - DNA, 22 bp, Homo sapiens
cactgtactgtgaataaggagg

SEQ ID NO: 7117659 - DNA, 22 bp, Homo sapiens
cactgtcacgttctgaaactgt

SEQ ID NO: 7117660 - DNA, 22 bp, Homo sapiens
cactgtccaatagatacataat

SEQ ID NO: 7117661 - DNA, 22 bp, Homo sapiens
ggctctgcttgaggccagcctg

SEQ ID NO: 7117662 - DNA, 22 bp, Homo sapiens
ggctctgcttgaggccagcctg

SEQ ID NO: 7117663 - DNA, 22 bp, Homo sapiens
ggctctgcttctcacctgttcc

SEQ ID NO: 7117664 - DNA, 22 bp, Homo sapiens
ggctctgcttctcacctgttcc

SEQ ID NO: 7117665 - DNA, 22 bp, Homo sapiens
ggctctgcttcagaaggctcat

SEQ ID NO: 7117666 - DNA, 22 bp, Homo sapiens
ggctctgcttcagaaggctcat

SEQ ID NO: 7117667 - DNA, 22 bp, Homo sapiens
ggctctgcttcctggaattgtg

SEQ ID NO: 7117668 - DNA, 22 bp, Homo sapiens
ggctctgcttcctggaattgtg

SEQ ID NO: 7117669 - DNA, 22 bp, Homo sapiens
ggctctgcttcctggaattgtg

SEQ ID NO: 7117670 - DNA, 22 bp, Homo sapiens
ggctctgctggtaagatgcctc

SEQ ID NO: 7117671 - DNA, 22 bp, Homo sapiens
ggctctgctggattgaggccag

SEQ ID NO: 7117672 - DNA, 22 bp, Homo sapiens
ggctctgctggattgaggccag

SEQ ID NO: 7117673 - DNA, 22 bp, Homo sapiens
ggctctgctggattgaggccag

SEQ ID NO: 7117674 - DNA, 22 bp, Homo sapiens
ggctctgctggtaagatgcctc

SEQ ID NO: 7117675 - DNA, 22 bp, Homo sapiens
ggctctgctggtaagatgcctc

SEQ ID NO: 7117676 - DNA, 22 bp, Homo sapiens
ggctctgctggtaagatgcctc

SEQ ID NO: 7117677 - DNA, 22 bp, Homo sapiens
ggctctgcttcagaaggctcat

SEQ ID NO: 7117678 - DNA, 22 bp, Homo sapiens
ggctctgcttcagaaggctcat

SEQ ID NO: 7117679 - DNA, 22 bp, Homo sapiens
cacttgggagcattgcacatgt

SEQ ID NO: 7117680 - DNA, 22 bp, Homo sapiens
cacttgggattaggggctaggt

SEQ ID NO: 7117681 - DNA, 22 bp, Homo sapiens
cacttggtgagaaaagcacagg

SEQ ID NO: 7117682 - DNA, 22 bp, Homo sapiens
cacttgttggtggtgaaatcac

SEQ ID NO: 7117683 - DNA, 22 bp, Homo sapiens
cacttgttggtggtgaaatcac

SEQ ID NO: 7117684 - DNA, 22 bp, Homo sapiens
cacttgttggtggtgaaatcac

SEQ ID NO: 7117685 - DNA, 22 bp, Homo sapiens
cacttgttggtggtgaaatcac

SEQ ID NO: 7117686 - DNA, 22 bp, Homo sapiens
cacttgttggtggtgaaatcac

SEQ ID NO: 7117687 - DNA, 22 bp, Homo sapiens
cacttgttggtggtgaaatcac

SEQ ID NO: 7117688 - DNA, 22 bp, Homo sapiens
cacttgttggtggtgaaatcac

SEQ ID NO: 7117689 - DNA, 22 bp, Homo sapiens
ggctggcaagtcagtgctgatg

SEQ ID NO: 7117690 - DNA, 22 bp, Homo sapiens
ggctggcaaaaaccttctctga

SEQ ID NO: 7117691 - DNA, 22 bp, Homo sapiens
ggctggatttttggaaggagag

SEQ ID NO: 7117692 - DNA, 17 bp, Homo sapiens
ggctgctgtgctggtgc

SEQ ID NO: 7117693 - DNA, 20 bp, Homo sapiens
ggctgctgtgggcagagagg

SEQ ID NO: 7117694 - DNA, 17 bp, Homo sapiens
ggctgctgtgctggtgc

SEQ ID NO: 7117695 - DNA, 17 bp, Homo sapiens
ggctgctgtgctggtgc

SEQ ID NO: 7117696 - DNA, 17 bp, Homo sapiens
ggctgctgtgctggtgc

SEQ ID NO: 7117697 - DNA, 22 bp, Homo sapiens
cacttctctgataatctcagtt

SEQ ID NO: 7117698 - DNA, 22 bp, Homo sapiens
cacttctcacaaagtgacattc

SEQ ID NO: 7117699 - DNA, 22 bp, Homo sapiens
cacttctcacaaagtgacattc

SEQ ID NO: 7117700 - DNA, 22 bp, Homo sapiens
cacttccagagtctgggctggg

SEQ ID NO: 7117701 - DNA, 22 bp, Homo sapiens
cacttccgcacagtgagagcca

SEQ ID NO: 7117702 - DNA, 22 bp, Homo sapiens
cacttgaacccgggaggctgag

SEQ ID NO: 7117703 - DNA, 22 bp, Homo sapiens
cacttgatatcttatatttaat

SEQ ID NO: 7117704 - DNA, 22 bp, Homo sapiens
cacttgatggaagagcagaaga

SEQ ID NO: 7117705 - DNA, 22 bp, Homo sapiens
cacttgcagactttgcctggtt

SEQ ID NO: 7117706 - DNA, 22 bp, Homo sapiens
cacttgctggatggtggctcag

SEQ ID NO: 7117707 - DNA, 17 bp, Homo sapiens
cacttgctggtctacct

SEQ ID NO: 7117708 - DNA, 22 bp, Homo sapiens
cacttgcttaccggagaggtgc

SEQ ID NO: 7117709 - DNA, 22 bp, Homo sapiens
cacttgggacaaagcttctgct

SEQ ID NO: 7117710 - DNA, 22 bp, Homo sapiens
ggctctggaaagtgtccttgat

SEQ ID NO: 7117711 - DNA, 22 bp, Homo sapiens
ggctctggaaagtgtccttgat

SEQ ID NO: 7117712 - DNA, 22 bp, Homo sapiens
ggctctggaaagtgtccttgat

SEQ ID NO: 7117713 - DNA, 20 bp, Homo sapiens
ggctctggaatctggtgggc

SEQ ID NO: 7117714 - DNA, 20 bp, Homo sapiens
ggctctggaatctggtgggc

SEQ ID NO: 7117715 - DNA, 20 bp, Homo sapiens
ggctctgcttgtgagcagcc

SEQ ID NO: 7117716 - DNA, 20 bp, Homo sapiens
ggctctgcttgtgagcagcc

SEQ ID NO: 7117717 - DNA, 22 bp, Homo sapiens
ggctctggaaagtgtccttgat

SEQ ID NO: 7117718 - DNA, 22 bp, Homo sapiens
ggctctggaaagtgtccttgat

SEQ ID NO: 7117719 - DNA, 20 bp, Homo sapiens
ggctctgcttgtgagcagcc

SEQ ID NO: 7117720 - DNA, 22 bp, Homo sapiens
cactgtggagcaaatttattta

SEQ ID NO: 7117721 - DNA, 22 bp, Homo sapiens
cactgtggatacagaaattagt

SEQ ID NO: 7117722 - DNA, 20 bp, Homo sapiens
ggctctggaatctggtgggc

SEQ ID NO: 7117723 - DNA, 20 bp, Homo sapiens
ggctctggaatctggtgggc

SEQ ID NO: 7117724 - DNA, 22 bp, Homo sapiens
cacttaaatctgttgagaaaaa

SEQ ID NO: 7117725 - DNA, 22 bp, Homo sapiens
cacttatttatgcagaaaagtt

SEQ ID NO: 7117726 - DNA, 22 bp, Homo sapiens
cacttatctcatttaatcacca

SEQ ID NO: 7117727 - DNA, 22 bp, Homo sapiens
cacttattatgggctaggaact

SEQ ID NO: 7117728 - DNA, 22 bp, Homo sapiens
cacttaaatctgttgagaaaaa

SEQ ID NO: 7117729 - DNA, 22 bp, Homo sapiens
cacttaaatgttcctacagcag

SEQ ID NO: 7117730 - DNA, 19 bp, Homo sapiens
cacttcacatggtgaaagc

SEQ ID NO: 7117731 - DNA, 22 bp, Homo sapiens
cacttcaattaacttcagcatt

SEQ ID NO: 7117732 - DNA, 22 bp, Homo sapiens
cacttcaattaacttcagcatt

SEQ ID NO: 7117733 - DNA, 22 bp, Homo sapiens
cacttcaaggaatatctagaaa

SEQ ID NO: 7117734 - DNA, 22 bp, Homo sapiens
cacttcaaggaatatctagaaa

SEQ ID NO: 7117735 - DNA, 22 bp, Homo sapiens
cacttcattgggaccagggctg

SEQ ID NO: 7117736 - DNA, 22 bp, Homo sapiens
cacttccagagtctgggctggg

SEQ ID NO: 7117737 - DNA, 22 bp, Homo sapiens
cacttcagctacaatcacatga

SEQ ID NO: 7117738 - DNA, 22 bp, Homo sapiens
cacttcattgggaccagggctg

SEQ ID NO: 7117739 - DNA, 22 bp, Homo sapiens
ggcaaggggtcaggctgagaca

SEQ ID NO: 7117740 - DNA, 22 bp, Homo sapiens
ggcaaggggtcaggctgagaca

SEQ ID NO: 7117741 - DNA, 22 bp, Homo sapiens
cacagtgcgaaagaaacccagc

SEQ ID NO: 7117742 - DNA, 22 bp, Homo sapiens
ggcaagggacggccgtgagaca

SEQ ID NO: 7117743 - DNA, 22 bp, Homo sapiens
ggcaaggggtcaggctgagaca

SEQ ID NO: 7117744 - DNA, 22 bp, Homo sapiens
ggcaagggttgaagataaggta

SEQ ID NO: 7117745 - DNA, 22 bp, Homo sapiens
ggcaagggttgaagataaggta

SEQ ID NO: 7117746 - DNA, 22 bp, Homo sapiens
ggcaagggttgaagataaggta

SEQ ID NO: 7117747 - DNA, 22 bp, Homo sapiens
ggcaaggtgatgaatgtctaca

SEQ ID NO: 7117748 - DNA, 22 bp, Homo sapiens
ggcaagtggtagaacatctgag

SEQ ID NO: 7117749 - DNA, 22 bp, Homo sapiens
ggcaagtggaggtgttcatcag

SEQ ID NO: 7117750 - DNA, 22 bp, Homo sapiens
cacagtgacagctatacagaga

SEQ ID NO: 7117751 - DNA, 22 bp, Homo sapiens
cacagtgacattagtgagaaaa

SEQ ID NO: 7117752 - DNA, 22 bp, Homo sapiens
cacagtgacattagtgagaaaa

SEQ ID NO: 7117753 - DNA, 22 bp, Homo sapiens
cacagtgactggcacctagtat

SEQ ID NO: 7117754 - DNA, 22 bp, Homo sapiens
cacagtgcaatcggccacaaat

SEQ ID NO: 7117755 - DNA, 22 bp, Homo sapiens
cacagtgcactaagctccgggg

SEQ ID NO: 7117756 - DNA, 19 bp, Homo sapiens
cacagtgcagccatttctc

SEQ ID NO: 7117757 - DNA, 19 bp, Homo sapiens
cacagtgcagccatttctc

SEQ ID NO: 7117758 - DNA, 22 bp, Homo sapiens
cacagtgcatgatgggcagaag

SEQ ID NO: 7117759 - DNA, 22 bp, Homo sapiens
cacaggtgtatgaatatgtcca

SEQ ID NO: 7117760 - DNA, 22 bp, Homo sapiens
cacaggtgctcctcggggagct

SEQ ID NO: 7117761 - DNA, 22 bp, Homo sapiens
cacaggtggcttctttcatctt

SEQ ID NO: 7117762 - DNA, 21 bp, Homo sapiens
cacaggtgggtcagtgaggcc

SEQ ID NO: 7117763 - DNA, 21 bp, Homo sapiens
cacaggtgggtcagtgaggcc

SEQ ID NO: 7117764 - DNA, 22 bp, Homo sapiens
cacaggtgtatgaatatgtcca

SEQ ID NO: 7117765 - DNA, 22 bp, Homo sapiens
cacaggtgtccaatacctgctt

SEQ ID NO: 7117766 - DNA, 22 bp, Homo sapiens
cacaggtgtccaatacctgctt

SEQ ID NO: 7117767 - DNA, 22 bp, Homo sapiens
cacaggtgtctctagtagcgtt

SEQ ID NO: 7117768 - DNA, 22 bp, Homo sapiens
cacaggtgtatgaatatgtcca

SEQ ID NO: 7117769 - DNA, 22 bp, Homo sapiens
cacaggtgtctctagtagcgtt

SEQ ID NO: 7117770 - DNA, 17 bp, Homo sapiens
cacaggtgtggtttgag

SEQ ID NO: 7117771 - DNA, 22 bp, Homo sapiens
cacaggtgtgtcctggtcttgt

SEQ ID NO: 7117772 - DNA, 22 bp, Homo sapiens
cacaggtgtgtgccttatcaaa

SEQ ID NO: 7117773 - DNA, 22 bp, Homo sapiens
cacaggtgttcttgcagtgaaa

SEQ ID NO: 7117774 - DNA, 22 bp, Homo sapiens
cacaggtgttcttgcagtgaaa

SEQ ID NO: 7117775 - DNA, 22 bp, Homo sapiens
cacaggtgttcttgcagtgaaa

SEQ ID NO: 7117776 - DNA, 22 bp, Homo sapiens
cacaggtgttcttgcagtgaaa

SEQ ID NO: 7117777 - DNA, 22 bp, Homo sapiens
cacaggtgttcttgcagtgaaa

SEQ ID NO: 7117778 - DNA, 23 bp, Homo sapiens
cacaggtgtttcatcttctcagt

SEQ ID NO: 7117779 - DNA, 23 bp, Homo sapiens
cacaggtgtttcatcttctcagt

SEQ ID NO: 7117780 - DNA, 22 bp, Homo sapiens
cacaggtgtttgttatactcag

SEQ ID NO: 7117781 - DNA, 23 bp, Homo sapiens
cacaggtgtttcatcttctcagt

SEQ ID NO: 7117782 - DNA, 22 bp, Homo sapiens
cacaggtgtttgttatactcag

SEQ ID NO: 7117783 - DNA, 22 bp, Homo sapiens
cacaggttagcagcttgaaact

SEQ ID NO: 7117784 - DNA, 22 bp, Homo sapiens
cacagtaaggtatcccagtgaa

SEQ ID NO: 7117785 - DNA, 22 bp, Homo sapiens
cacagtacccagcactactgag

SEQ ID NO: 7117786 - DNA, 22 bp, Homo sapiens
cacagtcctgccagagggcctt

SEQ ID NO: 7117787 - DNA, 22 bp, Homo sapiens
cacagtctcctctcttagcctg

SEQ ID NO: 7117788 - DNA, 22 bp, Homo sapiens
cacagtcttatcccaaccacca

SEQ ID NO: 7117789 - DNA, 22 bp, Homo sapiens
cacagtgaacattctgtcaggg

SEQ ID NO: 7117790 - DNA, 22 bp, Homo sapiens
cacagtgaagcatgcagacatc

SEQ ID NO: 7117791 - DNA, 22 bp, Homo sapiens
cacaggttgggggagttgataa

SEQ ID NO: 7117792 - DNA, 22 bp, Homo sapiens
cacaggtttgacaaggataaaa

SEQ ID NO: 7117793 - DNA, 22 bp, Homo sapiens
cacagtaaccccaggactggga

SEQ ID NO: 7117794 - DNA, 22 bp, Homo sapiens
cacagtaaccccaggactggga

SEQ ID NO: 7117795 - DNA, 22 bp, Homo sapiens
cacagtaactcctgacccctcg

SEQ ID NO: 7117796 - DNA, 22 bp, Homo sapiens
cacagtaactggcgtgtagtaa

SEQ ID NO: 7117797 - DNA, 22 bp, Homo sapiens
cacagtaagaaatgaagaggta

SEQ ID NO: 7117798 - DNA, 22 bp, Homo sapiens
cacagtaaggtatcccagtgaa

SEQ ID NO: 7117799 - DNA, 22 bp, Homo sapiens
cacaggtgctcctcggggagct

SEQ ID NO: 7117800 - DNA, 22 bp, Homo sapiens
cacaggtgccatctcttcatgg

SEQ ID NO: 7117801 - DNA, 22 bp, Homo sapiens
cacaggtggctccaagttagag

SEQ ID NO: 7117802 - DNA, 22 bp, Homo sapiens
cacaggtggctccaagttagag

SEQ ID NO: 7117803 - DNA, 22 bp, Homo sapiens
cacaggtgcaagaagttgcagt

SEQ ID NO: 7117804 - DNA, 22 bp, Homo sapiens
cacaggtgcaagaagttgcagt

SEQ ID NO: 7117805 - DNA, 22 bp, Homo sapiens
cacaggtgccatctcttcatgg

SEQ ID NO: 7117806 - DNA, 22 bp, Homo sapiens
cacaggtatatgtgtatatact

SEQ ID NO: 7117807 - DNA, 22 bp, Homo sapiens
cacaggtattatcggtgctgca

SEQ ID NO: 7117808 - DNA, 22 bp, Homo sapiens
cacaggtacatccttatcccca

SEQ ID NO: 7117809 - DNA, 22 bp, Homo sapiens
cacaggtagaattttagggaaa

SEQ ID NO: 7117810 - DNA, 22 bp, Homo sapiens
cacaggtagatgccatgcagca

SEQ ID NO: 7117811 - DNA, 22 bp, Homo sapiens
cacaggtagatgccatgcagca

SEQ ID NO: 7117812 - DNA, 22 bp, Homo sapiens
cacaggtatatgtgtatatact

SEQ ID NO: 7117813 - DNA, 22 bp, Homo sapiens
cacagggttgttctgaggattc

SEQ ID NO: 7117814 - DNA, 22 bp, Homo sapiens
cacaggtaatagcctaggctat

SEQ ID NO: 7117815 - DNA, 22 bp, Homo sapiens
cacaggtaatagcctaggctat

SEQ ID NO: 7117816 - DNA, 22 bp, Homo sapiens
cacaggggcaaactgtagggga

SEQ ID NO: 7117817 - DNA, 22 bp, Homo sapiens
cacagggcaggtactctcagag

SEQ ID NO: 7117818 - DNA, 22 bp, Homo sapiens
cacagggctttgatggctgagt

SEQ ID NO: 7117819 - DNA, 22 bp, Homo sapiens
cacaggggcaaactgtagggga

SEQ ID NO: 7117820 - DNA, 18 bp, Homo sapiens
cacaggcaggtgataggt

SEQ ID NO: 7117821 - DNA, 22 bp, Homo sapiens
cacaggccaataccctctctct

SEQ ID NO: 7117822 - DNA, 22 bp, Homo sapiens
cacaggccaataccctctctct

SEQ ID NO: 7117823 - DNA, 22 bp, Homo sapiens
cacaggccagtaagactgtgtt

SEQ ID NO: 7117824 - DNA, 22 bp, Homo sapiens
cacaggccagtaagactgtgtt

SEQ ID NO: 7117825 - DNA, 22 bp, Homo sapiens
cacaggccagtaagactgtgtt

SEQ ID NO: 7117826 - DNA, 22 bp, Homo sapiens
cacaggccagtaagactgtgtt

SEQ ID NO: 7117827 - DNA, 20 bp, Homo sapiens
cacaggccccaagacctgta

SEQ ID NO: 7117828 - DNA, 20 bp, Homo sapiens
cacaggccccaagacctgta

SEQ ID NO: 7117829 - DNA, 20 bp, Homo sapiens
cacaggccttgtgagcagac

SEQ ID NO: 7117830 - DNA, 20 bp, Homo sapiens
cacaggccttgtgagcagac

SEQ ID NO: 7117831 - DNA, 22 bp, Homo sapiens
cacaggcctggggttgagcggg

SEQ ID NO: 7117832 - DNA, 22 bp, Homo sapiens
cacaggcctggggttgagcggg

SEQ ID NO: 7117833 - DNA, 22 bp, Homo sapiens
cacaggcctgtctctttctaac

SEQ ID NO: 7117834 - DNA, 22 bp, Homo sapiens
cacagggcaggtactctcagag

SEQ ID NO: 7117835 - DNA, 22 bp, Homo sapiens
cacagggcaggtactctcagag

SEQ ID NO: 7117836 - DNA, 22 bp, Homo sapiens
cacagggcaggtactctcagag

SEQ ID NO: 7117837 - DNA, 20 bp, Homo sapiens
cacaggccttgtgagcagac

SEQ ID NO: 7117838 - DNA, 20 bp, Homo sapiens
cacaggccttgtgagcagac

SEQ ID NO: 7117839 - DNA, 18 bp, Homo sapiens
cacaggcaggtgataggt

SEQ ID NO: 7117840 - DNA, 18 bp, Homo sapiens
cacaggcaggtgataggt

SEQ ID NO: 7117841 - DNA, 18 bp, Homo sapiens
cacaggcaggtgataggt

SEQ ID NO: 7117842 - DNA, 18 bp, Homo sapiens
cacaggcaggtgataggt

SEQ ID NO: 7117843 - DNA, 18 bp, Homo sapiens
cacaggcaggtgataggt

SEQ ID NO: 7117844 - DNA, 22 bp, Homo sapiens
cacaggcaggaggttctccagt

SEQ ID NO: 7117845 - DNA, 22 bp, Homo sapiens
cacaggcaggaggttctccagt

SEQ ID NO: 7117846 - DNA, 22 bp, Homo sapiens
cacaggcagccttgtagaagaa

SEQ ID NO: 7117847 - DNA, 22 bp, Homo sapiens
cacaggcagccttgtagaagaa

SEQ ID NO: 7117848 - DNA, 22 bp, Homo sapiens
cacaggcaggaggttctccagt

SEQ ID NO: 7117849 - DNA, 23 bp, Homo sapiens
cacaggcagaaatcaagacggta

SEQ ID NO: 7117850 - DNA, 22 bp, Homo sapiens
cacaggcagccttgtagaagaa

SEQ ID NO: 7117851 - DNA, 22 bp, Homo sapiens
cacaggcagccttgtagaagaa

SEQ ID NO: 7117852 - DNA, 23 bp, Homo sapiens
cacaggcagaaatcaagacggta

SEQ ID NO: 7117853 - DNA, 23 bp, Homo sapiens
cacaggcagaaatcaagacggta

SEQ ID NO: 7117854 - DNA, 23 bp, Homo sapiens
cacaggcagaaatcaagacggta

SEQ ID NO: 7117855 - DNA, 23 bp, Homo sapiens
cacaggcagaaatcaagacggta

SEQ ID NO: 7117856 - DNA, 22 bp, Homo sapiens
cacaggcacgcctctggccagg

SEQ ID NO: 7117857 - DNA, 22 bp, Homo sapiens
cacaggcacgcctctggccagg

SEQ ID NO: 7117858 - DNA, 22 bp, Homo sapiens
cacaggcacgcctctggccagg

SEQ ID NO: 7117859 - DNA, 22 bp, Homo sapiens
cacaggcacgcctctggccagg

SEQ ID NO: 7117860 - DNA, 22 bp, Homo sapiens
cacaggcacccctgactgctca

SEQ ID NO: 7117861 - DNA, 22 bp, Homo sapiens
ggagagcctccacggcttctgt

SEQ ID NO: 7117862 - DNA, 22 bp, Homo sapiens
ggagagctagtgcctgccagta

SEQ ID NO: 7117863 - DNA, 22 bp, Homo sapiens
ggagagctagtgcctgccagta

SEQ ID NO: 7117864 - DNA, 20 bp, Homo sapiens
ggagagccacatagtctccc

SEQ ID NO: 7117865 - DNA, 22 bp, Homo sapiens
ggagagcctccacggcttctgt

SEQ ID NO: 7117866 - DNA, 22 bp, Homo sapiens
ggagagcctccacggcttctgt

SEQ ID NO: 7117867 - DNA, 22 bp, Homo sapiens
ggagagctagtgcctgccagta

SEQ ID NO: 7117868 - DNA, 23 bp, Homo sapiens
ggagagctcctcgtgactcactg

SEQ ID NO: 7117869 - DNA, 22 bp, Homo sapiens
ggagagctagtgcctgccagta

SEQ ID NO: 7117870 - DNA, 22 bp, Homo sapiens
ggagagctgaagcatggacagg

SEQ ID NO: 7117871 - DNA, 22 bp, Homo sapiens
ggagagctgaagcatggacagg

SEQ ID NO: 7117872 - DNA, 22 bp, Homo sapiens
cacaggagattgatctattggt

SEQ ID NO: 7117873 - DNA, 22 bp, Homo sapiens
cacaggagtgctgctattgttg

SEQ ID NO: 7117874 - DNA, 22 bp, Homo sapiens
cacaggaggttaggaagtggtc

SEQ ID NO: 7117875 - DNA, 22 bp, Homo sapiens
cacaggagttaacataattaag

SEQ ID NO: 7117876 - DNA, 22 bp, Homo sapiens
cacaggagtgctgctattgttg

SEQ ID NO: 7117877 - DNA, 22 bp, Homo sapiens
cacaggagttaacataattaag

SEQ ID NO: 7117878 - DNA, 22 bp, Homo sapiens
cacaggaggttaggaagtggtc

SEQ ID NO: 7117879 - DNA, 22 bp, Homo sapiens
cacaggaggttaggaagtggtc

SEQ ID NO: 7117880 - DNA, 22 bp, Homo sapiens
cacaggaggttaggaagtggtc

SEQ ID NO: 7117881 - DNA, 18 bp, Homo sapiens
cacaggagccacactcac

SEQ ID NO: 7117882 - DNA, 22 bp, Homo sapiens
cacaggaggttaggaagtggtc

SEQ ID NO: 7117883 - DNA, 22 bp, Homo sapiens
cacaggaggttaggaagtggtc

SEQ ID NO: 7117884 - DNA, 22 bp, Homo sapiens
cacatgaagagagtctagtaat

SEQ ID NO: 7117885 - DNA, 22 bp, Homo sapiens
ggcacaaaggaataaagagaac

SEQ ID NO: 7117886 - DNA, 22 bp, Homo sapiens
cacatatatgggcccctgaggg

SEQ ID NO: 7117887 - DNA, 22 bp, Homo sapiens
cacatatatgggcccctgaggg

SEQ ID NO: 7117888 - DNA, 16 bp, Homo sapiens
cacatatatttatatg

SEQ ID NO: 7117889 - DNA, 16 bp, Homo sapiens
cacatatatttatatg

SEQ ID NO: 7117890 - DNA, 22 bp, Homo sapiens
ggcaatgtttcgatgggagctg

SEQ ID NO: 7117891 - DNA, 22 bp, Homo sapiens
ggcaattacgtattagtcatgt

SEQ ID NO: 7117892 - DNA, 22 bp, Homo sapiens
ggcaattacgtattagtcatgt

SEQ ID NO: 7117893 - DNA, 21 bp, Homo sapiens
ggcaattaggcttctgagtat

SEQ ID NO: 7117894 - DNA, 22 bp, Homo sapiens
ggcaataaatgacttctgcatt

SEQ ID NO: 7117895 - DNA, 22 bp, Homo sapiens
ggcaatagttgtgggttcttta

SEQ ID NO: 7117896 - DNA, 22 bp, Homo sapiens
ggcaatatggaagctacagaga

SEQ ID NO: 7117897 - DNA, 22 bp, Homo sapiens
ggcaatatggaagctacagaga

SEQ ID NO: 7117898 - DNA, 22 bp, Homo sapiens
ggcaatatggtgaaaccccatc

SEQ ID NO: 7117899 - DNA, 22 bp, Homo sapiens
ggcaatatttatataggcaagg

SEQ ID NO: 7117900 - DNA, 22 bp, Homo sapiens
ggcaatatggtgaaaccccatc

SEQ ID NO: 7117901 - DNA, 22 bp, Homo sapiens
ggcaatgtagattctgtagatt

SEQ ID NO: 7117902 - DNA, 22 bp, Homo sapiens
ggcaatgtccatggaacaggac

SEQ ID NO: 7117903 - DNA, 22 bp, Homo sapiens
ggcaatgtctcttgcttccagg

SEQ ID NO: 7117904 - DNA, 22 bp, Homo sapiens
cacatgaaggctggggtcgtga

SEQ ID NO: 7117905 - DNA, 22 bp, Homo sapiens
cacatgaaggctggggtcgtga

SEQ ID NO: 7117906 - DNA, 22 bp, Homo sapiens
cacatgaaggctggggtcgtga

SEQ ID NO: 7117907 - DNA, 22 bp, Homo sapiens
cacatgaaggctggggtcgtga

SEQ ID NO: 7117908 - DNA, 22 bp, Homo sapiens
cacatgaataaggctttattgt

SEQ ID NO: 7117909 - DNA, 22 bp, Homo sapiens
cacatgaattgatgccaagtgc

SEQ ID NO: 7117910 - DNA, 22 bp, Homo sapiens
cacatgacactattttgttcta

SEQ ID NO: 7117911 - DNA, 22 bp, Homo sapiens
cacatgacactattttgttcta

SEQ ID NO: 7117912 - DNA, 22 bp, Homo sapiens
cacatgaccactctttacttct

SEQ ID NO: 7117913 - DNA, 23 bp, Homo sapiens
cacatgacctgacctaggctagg

SEQ ID NO: 7117914 - DNA, 23 bp, Homo sapiens
cacatgacctgacctaggctagg

SEQ ID NO: 7117915 - DNA, 22 bp, Homo sapiens
cacatgaccactctttacttct

SEQ ID NO: 7117916 - DNA, 22 bp, Homo sapiens
cacatgactctggctacccaga

SEQ ID NO: 7117917 - DNA, 22 bp, Homo sapiens
cacatgaccactctttacttct

SEQ ID NO: 7117918 - DNA, 22 bp, Homo sapiens
cacatgactctggctacccaga

SEQ ID NO: 7117919 - DNA, 22 bp, Homo sapiens
cacatgagacaattaaagactt

SEQ ID NO: 7117920 - DNA, 22 bp, Homo sapiens
cacatgagacaattaaagactt

SEQ ID NO: 7117921 - DNA, 22 bp, Homo sapiens
cacatgagagcccccaagagca

SEQ ID NO: 7117922 - DNA, 19 bp, Homo sapiens
cacatgagggctgagggac

SEQ ID NO: 7117923 - DNA, 22 bp, Homo sapiens
cacatgaggtgacttccaagct

SEQ ID NO: 7117924 - DNA, 22 bp, Homo sapiens
cacatgaggtggagatgaatga

SEQ ID NO: 7117925 - DNA, 22 bp, Homo sapiens
cacatgagtcctgccaggtatg

SEQ ID NO: 7117926 - DNA, 22 bp, Homo sapiens
ggcagagttggtggagtcagtt

SEQ ID NO: 7117927 - DNA, 22 bp, Homo sapiens
ggcagagttggtggagtcagtt

SEQ ID NO: 7117928 - DNA, 22 bp, Homo sapiens
ggcagagttggtggagtcagtt

SEQ ID NO: 7117929 - DNA, 22 bp, Homo sapiens
ggcagatatattcgtgaaatag

SEQ ID NO: 7117930 - DNA, 22 bp, Homo sapiens
ggcagatgacagaccagtatgt

SEQ ID NO: 7117931 - DNA, 22 bp, Homo sapiens
ggcagagtgctctgggcagggg

SEQ ID NO: 7117932 - DNA, 22 bp, Homo sapiens
ggcagagtgctctgggcagggg

SEQ ID NO: 7117933 - DNA, 22 bp, Homo sapiens
ggcagagtgctctgggcagggg

SEQ ID NO: 7117934 - DNA, 22 bp, Homo sapiens
ggcagagtgctctgggcagggg

SEQ ID NO: 7117935 - DNA, 22 bp, Homo sapiens
ggcagagtggagtgcggcctcc

SEQ ID NO: 7117936 - DNA, 22 bp, Homo sapiens
ggcagagtggagtgcggcctcc

SEQ ID NO: 7117937 - DNA, 22 bp, Homo sapiens
ggcagagttggtggagtcagtt

SEQ ID NO: 7117938 - DNA, 22 bp, Homo sapiens
ggcagagttggtggagtcagtt

SEQ ID NO: 7117939 - DNA, 18 bp, Homo sapiens
ggcagatgacaggagaga

SEQ ID NO: 7117940 - DNA, 18 bp, Homo sapiens
ggcagatgacaggagaga

SEQ ID NO: 7117941 - DNA, 22 bp, Homo sapiens
ggcagatggaagaggctgggtc

SEQ ID NO: 7117942 - DNA, 22 bp, Homo sapiens
ggcagatggaagaggctgggtc

SEQ ID NO: 7117943 - DNA, 22 bp, Homo sapiens
ggcagatggaagaggctgggtc

SEQ ID NO: 7117944 - DNA, 22 bp, Homo sapiens
cacatgctccatacagaatggg

SEQ ID NO: 7117945 - DNA, 20 bp, Homo sapiens
cacatgctgtgtgtttctct

SEQ ID NO: 7117946 - DNA, 20 bp, Homo sapiens
cacatgctgtgtgtttctct

SEQ ID NO: 7117947 - DNA, 20 bp, Homo sapiens
cacatgctgtgtgtttctct

SEQ ID NO: 7117948 - DNA, 20 bp, Homo sapiens
cacatgctgtgtgtttctct

SEQ ID NO: 7117949 - DNA, 22 bp, Homo sapiens
ggcagaggtgacagtgtctttt

SEQ ID NO: 7117950 - DNA, 22 bp, Homo sapiens
cacatgcaggagccaatgtaca

SEQ ID NO: 7117951 - DNA, 22 bp, Homo sapiens
cacatgcaggagccaatgtaca

SEQ ID NO: 7117952 - DNA, 22 bp, Homo sapiens
cacatgcaggagccaatgtaca

SEQ ID NO: 7117953 - DNA, 22 bp, Homo sapiens
cacatgcaggagccaatgtaca

SEQ ID NO: 7117954 - DNA, 22 bp, Homo sapiens
cacatgcaggagccaatgtaca

SEQ ID NO: 7117955 - DNA, 22 bp, Homo sapiens
ggcagaggtgacagtgtctttt

SEQ ID NO: 7117956 - DNA, 22 bp, Homo sapiens
ggcagaggtgacagtgtctttt

SEQ ID NO: 7117957 - DNA, 22 bp, Homo sapiens
ggcagagtcagaggtggttctg

SEQ ID NO: 7117958 - DNA, 22 bp, Homo sapiens
ggcagagtgctctgggcagggg

SEQ ID NO: 7117959 - DNA, 22 bp, Homo sapiens
ggcagagtgctctgggcagggg

SEQ ID NO: 7117960 - DNA, 22 bp, Homo sapiens
cacatgagtgagaacatgcagt

SEQ ID NO: 7117961 - DNA, 22 bp, Homo sapiens
cacatgagtgtaggaagaggga

SEQ ID NO: 7117962 - DNA, 22 bp, Homo sapiens
cacatgcaagtcctcagttcta

SEQ ID NO: 7117963 - DNA, 22 bp, Homo sapiens
cacatgcaagtcctcagttcta

SEQ ID NO: 7117964 - DNA, 22 bp, Homo sapiens
cacatgcaccagaaatcaacat

SEQ ID NO: 7117965 - DNA, 22 bp, Homo sapiens
cacatgcaccagaaatcaacat

SEQ ID NO: 7117966 - DNA, 22 bp, Homo sapiens
cacatgcaccagaaatcaacat

SEQ ID NO: 7117967 - DNA, 22 bp, Homo sapiens
cacatgcaccagaaatcaacat

SEQ ID NO: 7117968 - DNA, 22 bp, Homo sapiens
cacatgtttcaggccatatttg

SEQ ID NO: 7117969 - DNA, 22 bp, Homo sapiens
cacatgtttgctacatttttct

SEQ ID NO: 7117970 - DNA, 22 bp, Homo sapiens
cacatgtgtgctgaggactgtg

SEQ ID NO: 7117971 - DNA, 22 bp, Homo sapiens
cacatgttaacttcctacagtg

SEQ ID NO: 7117972 - DNA, 22 bp, Homo sapiens
cacatgttcttaacttctgttt

SEQ ID NO: 7117973 - DNA, 22 bp, Homo sapiens
cacatgcttagatttcagtgga

SEQ ID NO: 7117974 - DNA, 22 bp, Homo sapiens
cacatgtgcaaatactgaggct

SEQ ID NO: 7117975 - DNA, 22 bp, Homo sapiens
cacatgtgcagttacatgaatt

SEQ ID NO: 7117976 - DNA, 22 bp, Homo sapiens
cacatgtgggaaatggtgctta

SEQ ID NO: 7117977 - DNA, 22 bp, Homo sapiens
cacatgtgtatatgtgaggggg

SEQ ID NO: 7117978 - DNA, 22 bp, Homo sapiens
cacattcaattacacagatagg

SEQ ID NO: 7117979 - DNA, 22 bp, Homo sapiens
cacattcaattacacagatagg

SEQ ID NO: 7117980 - DNA, 22 bp, Homo sapiens
cacattcacatttttccctcta

SEQ ID NO: 7117981 - DNA, 22 bp, Homo sapiens
cacattcacttctctgtccacc

SEQ ID NO: 7117982 - DNA, 22 bp, Homo sapiens
cacattcacttctctgtccacc

SEQ ID NO: 7117983 - DNA, 22 bp, Homo sapiens
cacattcagctcattaatggtc

SEQ ID NO: 7117984 - DNA, 22 bp, Homo sapiens
cacattcaggattttccatgtc

SEQ ID NO: 7117985 - DNA, 22 bp, Homo sapiens
cacattcagggaacattggagg

SEQ ID NO: 7117986 - DNA, 22 bp, Homo sapiens
cacattaaaatcctaacttcca

SEQ ID NO: 7117987 - DNA, 22 bp, Homo sapiens
cacatgtttggcatgtcaccaa

SEQ ID NO: 7117988 - DNA, 22 bp, Homo sapiens
cacatgtttttggccatcatgg

SEQ ID NO: 7117989 - DNA, 22 bp, Homo sapiens
cacattaaatagtagggatgct

SEQ ID NO: 7117990 - DNA, 22 bp, Homo sapiens
cacattaagaataatgagacta

SEQ ID NO: 7117991 - DNA, 22 bp, Homo sapiens
caccagctctccaccaggtttc

SEQ ID NO: 7117992 - DNA, 22 bp, Homo sapiens
caccagctctccaccaggtttc

SEQ ID NO: 7117993 - DNA, 22 bp, Homo sapiens
caccagctctccaccaggtttc

SEQ ID NO: 7117994 - DNA, 22 bp, Homo sapiens
caccagctgcaacaccatctcc

SEQ ID NO: 7117995 - DNA, 22 bp, Homo sapiens
caccagctgcaacaccatctcc

SEQ ID NO: 7117996 - DNA, 22 bp, Homo sapiens
caccagctctccaccaggtttc

SEQ ID NO: 7117997 - DNA, 22 bp, Homo sapiens
caccagcttacagtctcacccc

SEQ ID NO: 7117998 - DNA, 22 bp, Homo sapiens
caccagcttacagtctcacccc

SEQ ID NO: 7117999 - DNA, 22 bp, Homo sapiens
caccagcttacagtctcacccc

SEQ ID NO: 7118000 - DNA, 22 bp, Homo sapiens
caccagcttcccatcgcgggtc

SEQ ID NO: 7118001 - DNA, 22 bp, Homo sapiens
caccagcttcccatcgcgggtc

SEQ ID NO: 7118002 - DNA, 22 bp, Homo sapiens
caccagcttctcattgcgggtc

SEQ ID NO: 7118003 - DNA, 22 bp, Homo sapiens
caccagcttctcattgcgggtc

SEQ ID NO: 7118004 - DNA, 22 bp, Homo sapiens
caccagcttgcagtcttaaccc

SEQ ID NO: 7118005 - DNA, 22 bp, Homo sapiens
caccagcttgcagtcttaaccc

SEQ ID NO: 7118006 - DNA, 22 bp, Homo sapiens
caccagcttgggctgtggaaat

SEQ ID NO: 7118007 - DNA, 22 bp, Homo sapiens
caccagcttgggctgtggaaat

SEQ ID NO: 7118008 - DNA, 22 bp, Homo sapiens
caccagctttgcccactgccca

SEQ ID NO: 7118009 - DNA, 22 bp, Homo sapiens
caccagctttgcccactgccca

SEQ ID NO: 7118010 - DNA, 22 bp, Homo sapiens
caccagctttgcccactgccca

SEQ ID NO: 7118011 - DNA, 22 bp, Homo sapiens
caccaggagcatctaggaggcg

SEQ ID NO: 7118012 - DNA, 22 bp, Homo sapiens
caccaggagccatcaggagtcc

SEQ ID NO: 7118013 - DNA, 22 bp, Homo sapiens
caccactggaggtcttggcttt

SEQ ID NO: 7118014 - DNA, 22 bp, Homo sapiens
caccagctactccagggccgtg

SEQ ID NO: 7118015 - DNA, 22 bp, Homo sapiens
caccagctactccagggccgtg

SEQ ID NO: 7118016 - DNA, 22 bp, Homo sapiens
caccagctactcgggtttcctg

SEQ ID NO: 7118017 - DNA, 22 bp, Homo sapiens
caccagctactcgggtttcctg

SEQ ID NO: 7118018 - DNA, 22 bp, Homo sapiens
caccagctccaccagggcaggt

SEQ ID NO: 7118019 - DNA, 22 bp, Homo sapiens
caccagctccaccagggcaggt

SEQ ID NO: 7118020 - DNA, 22 bp, Homo sapiens
cacattccttacattcatagag

SEQ ID NO: 7118021 - DNA, 22 bp, Homo sapiens
cacattcctgagcttcgacctg

SEQ ID NO: 7118022 - DNA, 22 bp, Homo sapiens
cacattcctggtgctcagcagc

SEQ ID NO: 7118023 - DNA, 22 bp, Homo sapiens
cacattcctggtgctcagcagc

SEQ ID NO: 7118024 - DNA, 22 bp, Homo sapiens
cacattccccagagctggggct

SEQ ID NO: 7118025 - DNA, 21 bp, Homo sapiens
cacattccatgggtctattta

SEQ ID NO: 7118026 - DNA, 21 bp, Homo sapiens
cacattccatgggtctattta

SEQ ID NO: 7118027 - DNA, 22 bp, Homo sapiens
cacattccccagagctggggct

SEQ ID NO: 7118028 - DNA, 22 bp, Homo sapiens
cacattcatcagtgttgtactg

SEQ ID NO: 7118029 - DNA, 22 bp, Homo sapiens
cacattcatggagtttgcctgt

SEQ ID NO: 7118030 - DNA, 22 bp, Homo sapiens
cacattcatggagtttgcctgt

SEQ ID NO: 7118031 - DNA, 22 bp, Homo sapiens
cacattcagggaacattggagg

SEQ ID NO: 7118032 - DNA, 22 bp, Homo sapiens
cacattcaggtggcatgttaga

SEQ ID NO: 7118033 - DNA, 22 bp, Homo sapiens
cacattcaggtggcatgttaga

SEQ ID NO: 7118034 - DNA, 19 bp, Homo sapiens
atttattgtatgattccat

SEQ ID NO: 7118035 - DNA, 19 bp, Homo sapiens
atttattgtatgattccat

SEQ ID NO: 7118036 - DNA, 19 bp, Homo sapiens
atttattgtatgattccat

SEQ ID NO: 7118037 - DNA, 22 bp, Homo sapiens
atttattggtttgcatggtgaa

SEQ ID NO: 7118038 - DNA, 19 bp, Homo sapiens
atttattgtatgattccat

SEQ ID NO: 7118039 - DNA, 19 bp, Homo sapiens
atttattgtatgattccat

SEQ ID NO: 7118040 - DNA, 19 bp, Homo sapiens
atttattgtatgattccat

SEQ ID NO: 7118041 - DNA, 19 bp, Homo sapiens
atttattgtatgattccat

SEQ ID NO: 7118042 - DNA, 19 bp, Homo sapiens
atttattgtatgattccat

SEQ ID NO: 7118043 - DNA, 23 bp, Homo sapiens
gccatggctgccccacaggcctc

SEQ ID NO: 7118044 - DNA, 22 bp, Homo sapiens
gccatggcccataccaggtgca

SEQ ID NO: 7118045 - DNA, 22 bp, Homo sapiens
gccatggcccataccaggtgca

SEQ ID NO: 7118046 - DNA, 22 bp, Homo sapiens
gccatggacttctgcggacaca

SEQ ID NO: 7118047 - DNA, 22 bp, Homo sapiens
atttattggtttgcatggtgaa

SEQ ID NO: 7118048 - DNA, 22 bp, Homo sapiens
gccatgcctgtgtctccaggcc

SEQ ID NO: 7118049 - DNA, 22 bp, Homo sapiens
gccatgcctgtgtctccaggcc

SEQ ID NO: 7118050 - DNA, 22 bp, Homo sapiens
gccatgcctgtgtctccaggcc

SEQ ID NO: 7118051 - DNA, 22 bp, Homo sapiens
gccatgcaatggaataaaatca

SEQ ID NO: 7118052 - DNA, 22 bp, Homo sapiens
gccatgcatccttggacttggc

SEQ ID NO: 7118053 - DNA, 22 bp, Homo sapiens
gccatgcatttcgctgggaggg

SEQ ID NO: 7118054 - DNA, 22 bp, Homo sapiens
gccatgcctgtgtctccaggcc

SEQ ID NO: 7118055 - DNA, 22 bp, Homo sapiens
gccatgcctgtgtctccaggcc

SEQ ID NO: 7118056 - DNA, 20 bp, Homo sapiens
gccatgaggggaggtgactg

SEQ ID NO: 7118057 - DNA, 22 bp, Homo sapiens
gccatgagtaaactggaaagcc

SEQ ID NO: 7118058 - DNA, 23 bp, Homo sapiens
gccatgagttccctttcacttgt

SEQ ID NO: 7118059 - DNA, 22 bp, Homo sapiens
gccatgagaagaaatgaagggc

SEQ ID NO: 7118060 - DNA, 22 bp, Homo sapiens
gccatgagatgttttatttgca

SEQ ID NO: 7118061 - DNA, 22 bp, Homo sapiens
gccatgaggaactgtaagacaa

SEQ ID NO: 7118062 - DNA, 22 bp, Homo sapiens
gccatgaggctccgagaagtca

SEQ ID NO: 7118063 - DNA, 22 bp, Homo sapiens
gccatgaggctccgagaagtca

SEQ ID NO: 7118064 - DNA, 23 bp, Homo sapiens
gccatctggtatttcctgacttc

SEQ ID NO: 7118065 - DNA, 23 bp, Homo sapiens
gccatctggtatttcctgacttc

SEQ ID NO: 7118066 - DNA, 22 bp, Homo sapiens
gccatcttgagccaggaagtga

SEQ ID NO: 7118067 - DNA, 22 bp, Homo sapiens
gccatcttgagccaggaagtga

SEQ ID NO: 7118068 - DNA, 21 bp, Homo sapiens
gccatcttgcaagatgagaaa

SEQ ID NO: 7118069 - DNA, 22 bp, Homo sapiens
gccatgaaaccagaggatggct

SEQ ID NO: 7118070 - DNA, 22 bp, Homo sapiens
gccatgaactcgggcatggaga

SEQ ID NO: 7118071 - DNA, 22 bp, Homo sapiens
gccatgactctccataccaaag

SEQ ID NO: 7118072 - DNA, 22 bp, Homo sapiens
gccatcctgatgacaggccact

SEQ ID NO: 7118073 - DNA, 23 bp, Homo sapiens
gccatcctaaaacccctgtctgt

SEQ ID NO: 7118074 - DNA, 22 bp, Homo sapiens
gccatcctctgagcactaggca

SEQ ID NO: 7118075 - DNA, 22 bp, Homo sapiens
gccatctgcgcggtgtccagct

SEQ ID NO: 7118076 - DNA, 22 bp, Homo sapiens
gccatctgcgcggtgtccagct

SEQ ID NO: 7118077 - DNA, 22 bp, Homo sapiens
gccatctgctgctctccagtgt

SEQ ID NO: 7118078 - DNA, 22 bp, Homo sapiens
gccatctggcattgcagcacct

SEQ ID NO: 7118079 - DNA, 22 bp, Homo sapiens
gcccagtagttcaaggttgcag

SEQ ID NO: 7118080 - DNA, 22 bp, Homo sapiens
gcccagtagttcaaggttgcag

SEQ ID NO: 7118081 - DNA, 22 bp, Homo sapiens
gcccagtgccctagaatgcact

SEQ ID NO: 7118082 - DNA, 22 bp, Homo sapiens
gcccagtgccctagaatgcact

SEQ ID NO: 7118083 - DNA, 22 bp, Homo sapiens
gcccagtctcttctggccctgt

SEQ ID NO: 7118084 - DNA, 22 bp, Homo sapiens
gcccagtctccaggagactctc

SEQ ID NO: 7118085 - DNA, 22 bp, Homo sapiens
gcccagtctcttctggccctgt

SEQ ID NO: 7118086 - DNA, 22 bp, Homo sapiens
gcccaggtttcatctgctccgt

SEQ ID NO: 7118087 - DNA, 22 bp, Homo sapiens
gcccaggtgccctctgccttac

SEQ ID NO: 7118088 - DNA, 22 bp, Homo sapiens
gcccaggtgccctctgccttac

SEQ ID NO: 7118089 - DNA, 22 bp, Homo sapiens
gcccaggtgccctctgccttac

SEQ ID NO: 7118090 - DNA, 22 bp, Homo sapiens
gcccaggttggagagcagtggc

SEQ ID NO: 7118091 - DNA, 22 bp, Homo sapiens
gcccaggttggagagcagtggc

SEQ ID NO: 7118092 - DNA, 22 bp, Homo sapiens
gcccaggttggagagcagtggc

SEQ ID NO: 7118093 - DNA, 22 bp, Homo sapiens
gcccaggttggagagcagtggc

SEQ ID NO: 7118094 - DNA, 22 bp, Homo sapiens
gcccagggtgcttagaacccat

SEQ ID NO: 7118095 - DNA, 22 bp, Homo sapiens
gcccagggtgaagtgcagttgt

SEQ ID NO: 7118096 - DNA, 22 bp, Homo sapiens
gcccagggtctacaaaaatatt

SEQ ID NO: 7118097 - DNA, 22 bp, Homo sapiens
gcccaggagttgaatgcagcag

SEQ ID NO: 7118098 - DNA, 22 bp, Homo sapiens
gcccaggagttgaatgcagcag

SEQ ID NO: 7118099 - DNA, 22 bp, Homo sapiens
gcccaggagttgaatgcagcag

SEQ ID NO: 7118100 - DNA, 19 bp, Homo sapiens
gcccaggggcccgatgctg

SEQ ID NO: 7118101 - DNA, 22 bp, Homo sapiens
atttcaagtccaagtcttgggt

SEQ ID NO: 7118102 - DNA, 22 bp, Homo sapiens
atttcaagtgttgagctcataa

SEQ ID NO: 7118103 - DNA, 22 bp, Homo sapiens
gcccaggagttgaatgcagcag

SEQ ID NO: 7118104 - DNA, 19 bp, Homo sapiens
atttcaagaggtttattgg

SEQ ID NO: 7118105 - DNA, 22 bp, Homo sapiens
atttcaaggactacttttcaat

SEQ ID NO: 7118106 - DNA, 22 bp, Homo sapiens
atttcccatgtgaatcaattgg

SEQ ID NO: 7118107 - DNA, 22 bp, Homo sapiens
atttcccagggccctcatagtt

SEQ ID NO: 7118108 - DNA, 22 bp, Homo sapiens
atttcccagggccctcatagtt

SEQ ID NO: 7118109 - DNA, 22 bp, Homo sapiens
atttcccagataaacagctgga

SEQ ID NO: 7118110 - DNA, 22 bp, Homo sapiens
atttcccactctactacatgct

SEQ ID NO: 7118111 - DNA, 22 bp, Homo sapiens
atttcccactctactacatgct

SEQ ID NO: 7118112 - DNA, 22 bp, Homo sapiens
gcccagtggtaaaagcaggcct

SEQ ID NO: 7118113 - DNA, 23 bp, Homo sapiens
atttcctactataaaagaggtaa

SEQ ID NO: 7118114 - DNA, 22 bp, Homo sapiens
atttcctaatttatgcaggagt

SEQ ID NO: 7118115 - DNA, 22 bp, Homo sapiens
atttcctaatttatgcaggagt

SEQ ID NO: 7118116 - DNA, 22 bp, Homo sapiens
atttcctaatttagggatagac

SEQ ID NO: 7118117 - DNA, 22 bp, Homo sapiens
atttcctaacagaggcaacagt

SEQ ID NO: 7118118 - DNA, 23 bp, Homo sapiens
atttcctaaaagataatcattac

SEQ ID NO: 7118119 - DNA, 23 bp, Homo sapiens
atttcctaaaagataatcattac

SEQ ID NO: 7118120 - DNA, 22 bp, Homo sapiens
gccctgggctccctgctccaca

SEQ ID NO: 7118121 - DNA, 22 bp, Homo sapiens
gccctgcctgccggtgtgggtc

SEQ ID NO: 7118122 - DNA, 22 bp, Homo sapiens
gccctgggctccctgctccaca

SEQ ID NO: 7118123 - DNA, 22 bp, Homo sapiens
gccctggggaaggtgtctccaa

SEQ ID NO: 7118124 - DNA, 22 bp, Homo sapiens
gccctgggctccctgctccaca

SEQ ID NO: 7118125 - DNA, 22 bp, Homo sapiens
gccctggggaaggtgtctccaa

SEQ ID NO: 7118126 - DNA, 22 bp, Homo sapiens
gccctgtatccaagtcccatct

SEQ ID NO: 7118127 - DNA, 22 bp, Homo sapiens
gccctgtcctcctgactgagtg

SEQ ID NO: 7118128 - DNA, 22 bp, Homo sapiens
gccctgtgagattagaacagca

SEQ ID NO: 7118129 - DNA, 22 bp, Homo sapiens
gccctgtcctcctgactgagtg

SEQ ID NO: 7118130 - DNA, 22 bp, Homo sapiens
gccctggggaaggtgtctccaa

SEQ ID NO: 7118131 - DNA, 22 bp, Homo sapiens
gccctggtgtgcccagcatggg

SEQ ID NO: 7118132 - DNA, 22 bp, Homo sapiens
gccctggttttagaggagcagg

SEQ ID NO: 7118133 - DNA, 22 bp, Homo sapiens
gccctgtgagtcatgcggcaga

SEQ ID NO: 7118134 - DNA, 22 bp, Homo sapiens
gccctgtgatggagactagagg

SEQ ID NO: 7118135 - DNA, 22 bp, Homo sapiens
gccctgtgatggagactagagg

SEQ ID NO: 7118136 - DNA, 22 bp, Homo sapiens
gccctgtgccagtcacgctgtg

SEQ ID NO: 7118137 - DNA, 22 bp, Homo sapiens
gccctgtgccagtcacgctgtg

SEQ ID NO: 7118138 - DNA, 22 bp, Homo sapiens
atttcttcaggtcagaaataga

SEQ ID NO: 7118139 - DNA, 22 bp, Homo sapiens
atttcttcaggttcttctagga

SEQ ID NO: 7118140 - DNA, 22 bp, Homo sapiens
atttcttcaggttcttctagga

SEQ ID NO: 7118141 - DNA, 22 bp, Homo sapiens
atttcttccattgcctcttcaa

SEQ ID NO: 7118142 - DNA, 22 bp, Homo sapiens
atttctgtttgctactataagt

SEQ ID NO: 7118143 - DNA, 22 bp, Homo sapiens
atttcttacataacaaattgtt

SEQ ID NO: 7118144 - DNA, 22 bp, Homo sapiens
atttcttatctgaggtctacat

SEQ ID NO: 7118145 - DNA, 22 bp, Homo sapiens
gccagctgctggaacagcgcga

SEQ ID NO: 7118146 - DNA, 22 bp, Homo sapiens
gccagctgctcgcgtagggtag

SEQ ID NO: 7118147 - DNA, 22 bp, Homo sapiens
gccagctgctggaacagcgcga

SEQ ID NO: 7118148 - DNA, 22 bp, Homo sapiens
gccagctgcatctcctgggctg

SEQ ID NO: 7118149 - DNA, 22 bp, Homo sapiens
gccagctgccctctgctggtcc

SEQ ID NO: 7118150 - DNA, 22 bp, Homo sapiens
gccagccagtttgctgatggct

SEQ ID NO: 7118151 - DNA, 22 bp, Homo sapiens
gccagccataggccagcactgg

SEQ ID NO: 7118152 - DNA, 22 bp, Homo sapiens
gccagccataggccagcactgg

SEQ ID NO: 7118153 - DNA, 22 bp, Homo sapiens
gccagccataggccagcactgg

SEQ ID NO: 7118154 - DNA, 21 bp, Homo sapiens
gccagctgcagggcttccttg

SEQ ID NO: 7118155 - DNA, 21 bp, Homo sapiens
gccagctgcagggcttccttg

SEQ ID NO: 7118156 - DNA, 21 bp, Homo sapiens
gccagctgcagggcttccttg

SEQ ID NO: 7118157 - DNA, 22 bp, Homo sapiens
gccagctgcatctcctgggctg

SEQ ID NO: 7118158 - DNA, 22 bp, Homo sapiens
gccagctgcatctcctgggctg

SEQ ID NO: 7118159 - DNA, 22 bp, Homo sapiens
gccagctgcatctcctgggctg

SEQ ID NO: 7118160 - DNA, 22 bp, Homo sapiens
gccagccacttcagctatggct

SEQ ID NO: 7118161 - DNA, 22 bp, Homo sapiens
gccagccacttcagctatggct

SEQ ID NO: 7118162 - DNA, 22 bp, Homo sapiens
gccagccacttcccagactggc

SEQ ID NO: 7118163 - DNA, 22 bp, Homo sapiens
gccagccacttcccagactggc

SEQ ID NO: 7118164 - DNA, 22 bp, Homo sapiens
gccagccacttcccagactggc

SEQ ID NO: 7118165 - DNA, 22 bp, Homo sapiens
gccagccacttcccagactggc

SEQ ID NO: 7118166 - DNA, 22 bp, Homo sapiens
gccagccacttcccagactggc

SEQ ID NO: 7118167 - DNA, 22 bp, Homo sapiens
gccagccagaaacgtcacactg

SEQ ID NO: 7118168 - DNA, 23 bp, Homo sapiens
gccagccagaatttctccactgt

SEQ ID NO: 7118169 - DNA, 23 bp, Homo sapiens
gccagccagaatttctccactgt

SEQ ID NO: 7118170 - DNA, 22 bp, Homo sapiens
gccagccagagaggcatggtta

SEQ ID NO: 7118171 - DNA, 22 bp, Homo sapiens
gccagccagagaggcatggtta

SEQ ID NO: 7118172 - DNA, 22 bp, Homo sapiens
gccagccagagaggcatggtta

SEQ ID NO: 7118173 - DNA, 22 bp, Homo sapiens
gccagccagagaggcatggtta

SEQ ID NO: 7118174 - DNA, 22 bp, Homo sapiens
gccagccagagtccatctgaga

SEQ ID NO: 7118175 - DNA, 22 bp, Homo sapiens
gccagccagagtggctgtgtgt

SEQ ID NO: 7118176 - DNA, 22 bp, Homo sapiens
gccagccagagtggctgtgtgt

SEQ ID NO: 7118177 - DNA, 22 bp, Homo sapiens
gccagccagggaagggagagac

SEQ ID NO: 7118178 - DNA, 22 bp, Homo sapiens
gccagccagtttgctgatggct

SEQ ID NO: 7118179 - DNA, 22 bp, Homo sapiens
gccagccagtttgctgatggct

SEQ ID NO: 7118180 - DNA, 22 bp, Homo sapiens
attgtacatatgatgtatgtaa

SEQ ID NO: 7118181 - DNA, 22 bp, Homo sapiens
attgtacatgcagtgagtcatc

SEQ ID NO: 7118182 - DNA, 22 bp, Homo sapiens
attgtacataaaatgtatgtct

SEQ ID NO: 7118183 - DNA, 22 bp, Homo sapiens
attgtacagatgaggtaagtga

SEQ ID NO: 7118184 - DNA, 22 bp, Homo sapiens
attgtacaggttggaggaagtg

SEQ ID NO: 7118185 - DNA, 22 bp, Homo sapiens
attgtacaggttggaggaagtg

SEQ ID NO: 7118186 - DNA, 22 bp, Homo sapiens
gcatggcatttgaaggtagaag

SEQ ID NO: 7118187 - DNA, 22 bp, Homo sapiens
gcatggcatttgaaggtagaag

SEQ ID NO: 7118188 - DNA, 22 bp, Homo sapiens
attgtacagatgaggtaagtga

SEQ ID NO: 7118189 - DNA, 22 bp, Homo sapiens
gcatggcattaacaagatggaa

SEQ ID NO: 7118190 - DNA, 22 bp, Homo sapiens
gcatggcattaacaagatggaa

SEQ ID NO: 7118191 - DNA, 22 bp, Homo sapiens
gcatggcatttgaaggtagaag

SEQ ID NO: 7118192 - DNA, 22 bp, Homo sapiens
gcatggcatttgaaggtagaag

SEQ ID NO: 7118193 - DNA, 22 bp, Homo sapiens
gcatggcatttgaaggtagaag

SEQ ID NO: 7118194 - DNA, 22 bp, Homo sapiens
gcatggcattaacaagatggaa

SEQ ID NO: 7118195 - DNA, 22 bp, Homo sapiens
gcatggcagtgaggatggtgct

SEQ ID NO: 7118196 - DNA, 20 bp, Homo sapiens
gcatggcatgtagtgaagtg

SEQ ID NO: 7118197 - DNA, 20 bp, Homo sapiens
gcatggcatgtagtgaagtg

SEQ ID NO: 7118198 - DNA, 22 bp, Homo sapiens
attgtacatgcagtgagtcatc

SEQ ID NO: 7118199 - DNA, 22 bp, Homo sapiens
attgtactacaccatagtactg

SEQ ID NO: 7118200 - DNA, 22 bp, Homo sapiens
attgtactcacaaaacatgagt

SEQ ID NO: 7118201 - DNA, 22 bp, Homo sapiens
attgtactcacaaaacatgagt

SEQ ID NO: 7118202 - DNA, 22 bp, Homo sapiens
attgtactccctctcctgcccg

SEQ ID NO: 7118203 - DNA, 22 bp, Homo sapiens
attgtacttttattacatgtag

SEQ ID NO: 7118204 - DNA, 22 bp, Homo sapiens
gccagaggttcaacaactgtct

SEQ ID NO: 7118205 - DNA, 22 bp, Homo sapiens
attgtacttttattacatgtag

SEQ ID NO: 7118206 - DNA, 22 bp, Homo sapiens
gccagagtgccatcagtgccat

SEQ ID NO: 7118207 - DNA, 22 bp, Homo sapiens
gccagccaagattgagaaggta

SEQ ID NO: 7118208 - DNA, 22 bp, Homo sapiens
gccagccacaagggaggcttgt

SEQ ID NO: 7118209 - DNA, 22 bp, Homo sapiens
gccagccacaagggaggcttgt

SEQ ID NO: 7118210 - DNA, 22 bp, Homo sapiens
gccagccacaagggaggcttgt

SEQ ID NO: 7118211 - DNA, 22 bp, Homo sapiens
gccagccacgttagactggccc

SEQ ID NO: 7118212 - DNA, 22 bp, Homo sapiens
gccagccacgttagactggccc

SEQ ID NO: 7118213 - DNA, 22 bp, Homo sapiens
atttagaagttggagggcaaga

SEQ ID NO: 7118214 - DNA, 22 bp, Homo sapiens
atttagtttaggaaaagtaggt

SEQ ID NO: 7118215 - DNA, 22 bp, Homo sapiens
atttataacgtgcagccagggt

SEQ ID NO: 7118216 - DNA, 22 bp, Homo sapiens
atttataacgtgcagccagggt

SEQ ID NO: 7118217 - DNA, 21 bp, Homo sapiens
atttagaaggaaattttgcaa

SEQ ID NO: 7118218 - DNA, 22 bp, Homo sapiens
atttagaagttggagggcaaga

SEQ ID NO: 7118219 - DNA, 22 bp, Homo sapiens
gccagctggagtgagagtgggc

SEQ ID NO: 7118220 - DNA, 22 bp, Homo sapiens
gccagctggagactggcagggg

SEQ ID NO: 7118221 - DNA, 22 bp, Homo sapiens
gccagctggagactggcagggg

SEQ ID NO: 7118222 - DNA, 22 bp, Homo sapiens
gccagctggagactggcagggg

SEQ ID NO: 7118223 - DNA, 22 bp, Homo sapiens
gccagctggagactggcagggg

SEQ ID NO: 7118224 - DNA, 22 bp, Homo sapiens
gccagctgcttctccagaattt

SEQ ID NO: 7118225 - DNA, 22 bp, Homo sapiens
gccagctggaaatctgcttgaa

SEQ ID NO: 7118226 - DNA, 22 bp, Homo sapiens
gccagctggaaatctgcttgaa

SEQ ID NO: 7118227 - DNA, 22 bp, Homo sapiens
atttatgacgtgttcggtcaat

SEQ ID NO: 7118228 - DNA, 22 bp, Homo sapiens
atttatgacgtgttcggtcaat

SEQ ID NO: 7118229 - DNA, 22 bp, Homo sapiens
atttatgactggtgaatagaac

SEQ ID NO: 7118230 - DNA, 22 bp, Homo sapiens
atttatgactggtgaatagaac

SEQ ID NO: 7118231 - DNA, 22 bp, Homo sapiens
atttatgactggtgaatagaac

SEQ ID NO: 7118232 - DNA, 22 bp, Homo sapiens
atttatgacagaagatatgctg

SEQ ID NO: 7118233 - DNA, 22 bp, Homo sapiens
atttatgacagaagatatgctg

SEQ ID NO: 7118234 - DNA, 22 bp, Homo sapiens
atttatgacagaagatatgctg

SEQ ID NO: 7118235 - DNA, 22 bp, Homo sapiens
atttatgacagaagatatgctg

SEQ ID NO: 7118236 - DNA, 22 bp, Homo sapiens
atttatgacagaagatatgctg

SEQ ID NO: 7118237 - DNA, 22 bp, Homo sapiens
atttatgacaaccaaagagtga

SEQ ID NO: 7118238 - DNA, 22 bp, Homo sapiens
atttatgacaaccaaagagtga

SEQ ID NO: 7118239 - DNA, 22 bp, Homo sapiens
atttatctctggaaactaagca

SEQ ID NO: 7118240 - DNA, 22 bp, Homo sapiens
atttatattttgggagctcctg

SEQ ID NO: 7118241 - DNA, 22 bp, Homo sapiens
atttatattttgggagctcctg

SEQ ID NO: 7118242 - DNA, 22 bp, Homo sapiens
atttatagggcattgaaaactg

SEQ ID NO: 7118243 - DNA, 22 bp, Homo sapiens
atttatagggcattgaaaactg

SEQ ID NO: 7118244 - DNA, 22 bp, Homo sapiens
atttatcaacatgtaccattgg

SEQ ID NO: 7118245 - DNA, 22 bp, Homo sapiens
atttatcatcagaccttttaaa

SEQ ID NO: 7118246 - DNA, 22 bp, Homo sapiens
atttatcatcagaccttttaaa

SEQ ID NO: 7118247 - DNA, 22 bp, Homo sapiens
atttattatgggatttggcaca

SEQ ID NO: 7118248 - DNA, 22 bp, Homo sapiens
atttattatgggatttggcaca

SEQ ID NO: 7118249 - DNA, 22 bp, Homo sapiens
atttattatgggatttggcaca

SEQ ID NO: 7118250 - DNA, 22 bp, Homo sapiens
atttattacctcggagtttctg

SEQ ID NO: 7118251 - DNA, 22 bp, Homo sapiens
atttattacctcggagtttctg

SEQ ID NO: 7118252 - DNA, 22 bp, Homo sapiens
atttattacctcggagtttctg

SEQ ID NO: 7118253 - DNA, 22 bp, Homo sapiens
atttattacctcggagtttctg

SEQ ID NO: 7118254 - DNA, 22 bp, Homo sapiens
atttattacctcggagtttctg

SEQ ID NO: 7118255 - DNA, 22 bp, Homo sapiens
atttattacctcggagtttctg

SEQ ID NO: 7118256 - DNA, 22 bp, Homo sapiens
atttattatgggatttggcaca

SEQ ID NO: 7118257 - DNA, 22 bp, Homo sapiens
atttattatgggatttggcaca

SEQ ID NO: 7118258 - DNA, 22 bp, Homo sapiens
gccaggtggctgagcagctgca

SEQ ID NO: 7118259 - DNA, 22 bp, Homo sapiens
atttatgattagcctattgttg

SEQ ID NO: 7118260 - DNA, 20 bp, Homo sapiens
atttatgtatagcttgttgt

SEQ ID NO: 7118261 - DNA, 22 bp, Homo sapiens
atttatgatagctgcattaaag

SEQ ID NO: 7118262 - DNA, 22 bp, Homo sapiens
atttatgattagcctattgttg

SEQ ID NO: 7118263 - DNA, 22 bp, Homo sapiens
atttatgagctgaaccatgaaa

SEQ ID NO: 7118264 - DNA, 22 bp, Homo sapiens
atttatgatagctgcattaaag

SEQ ID NO: 7118265 - DNA, 22 bp, Homo sapiens
atttatgatagctgcattaaag

SEQ ID NO: 7118266 - DNA, 22 bp, Homo sapiens
atttatgatagctgcattaaag

SEQ ID NO: 7118267 - DNA, 22 bp, Homo sapiens
atttatgatagctgcattaaag

SEQ ID NO: 7118268 - DNA, 22 bp, Homo sapiens
atttatgactggtgaatagaac

SEQ ID NO: 7118269 - DNA, 22 bp, Homo sapiens
atttatgagctgaaccatgaaa

SEQ ID NO: 7118270 - DNA, 22 bp, Homo sapiens
atttatgagctgaaccatgaaa

SEQ ID NO: 7118271 - DNA, 22 bp, Homo sapiens
atttatgtatctgtgtagatca

SEQ ID NO: 7118272 - DNA, 22 bp, Homo sapiens
atttatgtatctgtgtagatca

SEQ ID NO: 7118273 - DNA, 21 bp, Homo sapiens
atttatgtttggggtggaatg

SEQ ID NO: 7118274 - DNA, 22 bp, Homo sapiens
atttattaagcatctgctatgt

SEQ ID NO: 7118275 - DNA, 22 bp, Homo sapiens
atttattaagcatctgctatgt

SEQ ID NO: 7118276 - DNA, 22 bp, Homo sapiens
atttattaagcatctgctatgt

SEQ ID NO: 7118277 - DNA, 22 bp, Homo sapiens
atttattaagcatctgctatgt

SEQ ID NO: 7118278 - DNA, 22 bp, Homo sapiens
caaagaccatgtggcctgaaaa

SEQ ID NO: 7118279 - DNA, 22 bp, Homo sapiens
caaagactgcataacacatgaa

SEQ ID NO: 7118280 - DNA, 20 bp, Homo sapiens
caaagacatgctaggggtgg

SEQ ID NO: 7118281 - DNA, 20 bp, Homo sapiens
caaagacatgctaggggtgg

SEQ ID NO: 7118282 - DNA, 20 bp, Homo sapiens
caaagacatgctaggggtgg

SEQ ID NO: 7118283 - DNA, 20 bp, Homo sapiens
caaagacatgctaggggtgg

SEQ ID NO: 7118284 - DNA, 22 bp, Homo sapiens
caaagacacgggaaacaacgtt

SEQ ID NO: 7118285 - DNA, 22 bp, Homo sapiens
caaagactgcataacacatgaa

SEQ ID NO: 7118286 - DNA, 22 bp, Homo sapiens
caaagagctgttcagtgtcgct

SEQ ID NO: 7118287 - DNA, 22 bp, Homo sapiens
caaagaggtgagaggagccttt

SEQ ID NO: 7118288 - DNA, 22 bp, Homo sapiens
caaagaggtgagaggagccttt

SEQ ID NO: 7118289 - DNA, 22 bp, Homo sapiens
caaagaggttttgagggcagct

SEQ ID NO: 7118290 - DNA, 22 bp, Homo sapiens
gctctgagagtgggtgattctg

SEQ ID NO: 7118291 - DNA, 22 bp, Homo sapiens
caaagaggttttgagggcagct

SEQ ID NO: 7118292 - DNA, 22 bp, Homo sapiens
gctctgagataaacgttgccct

SEQ ID NO: 7118293 - DNA, 22 bp, Homo sapiens
gctctgctgtcttcttgcaggc

SEQ ID NO: 7118294 - DNA, 22 bp, Homo sapiens
gctctgctgtggaatcctctcc

SEQ ID NO: 7118295 - DNA, 22 bp, Homo sapiens
caaagaatcactcatctttagc

SEQ ID NO: 7118296 - DNA, 22 bp, Homo sapiens
caaagaaggaactataatccca

SEQ ID NO: 7118297 - DNA, 22 bp, Homo sapiens
caaagaatagcatggcatttgt

SEQ ID NO: 7118298 - DNA, 22 bp, Homo sapiens
caaagaatagtgagaagatgta

SEQ ID NO: 7118299 - DNA, 22 bp, Homo sapiens
gctccccaggctggtcccctcg

SEQ ID NO: 7118300 - DNA, 22 bp, Homo sapiens
caaagaagagatttacagagct

SEQ ID NO: 7118301 - DNA, 22 bp, Homo sapiens
caaagaagagatttacagagct

SEQ ID NO: 7118302 - DNA, 22 bp, Homo sapiens
caaagaaggaactataatccca

SEQ ID NO: 7118303 - DNA, 22 bp, Homo sapiens
caaagaatgagtgagtacataa

SEQ ID NO: 7118304 - DNA, 22 bp, Homo sapiens
caaagaatgagtgagtacataa

SEQ ID NO: 7118305 - DNA, 22 bp, Homo sapiens
caaagaatcactcatctttagc

SEQ ID NO: 7118306 - DNA, 22 bp, Homo sapiens
caaagaatcactcatctttagc

SEQ ID NO: 7118307 - DNA, 22 bp, Homo sapiens
caaagaatgagtgagtacataa

SEQ ID NO: 7118308 - DNA, 22 bp, Homo sapiens
caaagaatgagtgagtacataa

SEQ ID NO: 7118309 - DNA, 22 bp, Homo sapiens
caaagaatgagtgagtacataa

SEQ ID NO: 7118310 - DNA, 22 bp, Homo sapiens
caaagaatgagtgagtacataa

SEQ ID NO: 7118311 - DNA, 22 bp, Homo sapiens
caaagaatgagtgagtacataa

SEQ ID NO: 7118312 - DNA, 22 bp, Homo sapiens
caaagaatgagtgagtacataa

SEQ ID NO: 7118313 - DNA, 22 bp, Homo sapiens
caaagacacgggaaacaacgtt

SEQ ID NO: 7118314 - DNA, 22 bp, Homo sapiens
caaagacacgggaaacaacgtt

SEQ ID NO: 7118315 - DNA, 22 bp, Homo sapiens
gctcccagggacactggccact

SEQ ID NO: 7118316 - DNA, 22 bp, Homo sapiens
gctcccagggacactggccact

SEQ ID NO: 7118317 - DNA, 22 bp, Homo sapiens
gctcccagggacactggccact

SEQ ID NO: 7118318 - DNA, 22 bp, Homo sapiens
gctcccagggacactggccact

SEQ ID NO: 7118319 - DNA, 22 bp, Homo sapiens
gctcccaggcatggaggtaatt

SEQ ID NO: 7118320 - DNA, 22 bp, Homo sapiens
gctcccaggcatggaggtaatt

SEQ ID NO: 7118321 - DNA, 22 bp, Homo sapiens
gctcccagggacactggccact

SEQ ID NO: 7118322 - DNA, 22 bp, Homo sapiens
gctcccagggacactggccact

SEQ ID NO: 7118323 - DNA, 22 bp, Homo sapiens
gctcccagggaccgcagggcag

SEQ ID NO: 7118324 - DNA, 22 bp, Homo sapiens
gctcccagggaccgcagggcag

SEQ ID NO: 7118325 - DNA, 22 bp, Homo sapiens
gctcccaggcatggaggtaatt

SEQ ID NO: 7118326 - DNA, 22 bp, Homo sapiens
gctcccaggcatggaggtaatt

SEQ ID NO: 7118327 - DNA, 22 bp, Homo sapiens
gctccagggacccaagagaaaa

SEQ ID NO: 7118328 - DNA, 22 bp, Homo sapiens
gctcccaggatgaggagccagg

SEQ ID NO: 7118329 - DNA, 22 bp, Homo sapiens
gctccagggaacagaatgtact

SEQ ID NO: 7118330 - DNA, 22 bp, Homo sapiens
caaaagcagcaagtttatatgt

SEQ ID NO: 7118331 - DNA, 22 bp, Homo sapiens
caaaagcagttctatctgagtt

SEQ ID NO: 7118332 - DNA, 22 bp, Homo sapiens
gctccagggaacagaatgtact

SEQ ID NO: 7118333 - DNA, 22 bp, Homo sapiens
gctcccagttcccaaagtgacc

SEQ ID NO: 7118334 - DNA, 22 bp, Homo sapiens
gctcccagtctgatggaggaga

SEQ ID NO: 7118335 - DNA, 22 bp, Homo sapiens
gctccccagcttagccctggct

SEQ ID NO: 7118336 - DNA, 22 bp, Homo sapiens
gctccccagcttagccctggct

SEQ ID NO: 7118337 - DNA, 22 bp, Homo sapiens
gctcccaggttcttgggccttg

SEQ ID NO: 7118338 - DNA, 22 bp, Homo sapiens
gctcccaggttcttgggccttg

SEQ ID NO: 7118339 - DNA, 22 bp, Homo sapiens
gctcccaggttcttgggccttg

SEQ ID NO: 7118340 - DNA, 22 bp, Homo sapiens
gctcccaggttcttgggccttg

SEQ ID NO: 7118341 - DNA, 22 bp, Homo sapiens
gctcccagggcagcgcagaaga

SEQ ID NO: 7118342 - DNA, 22 bp, Homo sapiens
gctcccagggcagcgcagaaga

SEQ ID NO: 7118343 - DNA, 22 bp, Homo sapiens
gctcccagggcagcgcagaaga

SEQ ID NO: 7118344 - DNA, 22 bp, Homo sapiens
gctcccagggcagcgcagaaga

SEQ ID NO: 7118345 - DNA, 22 bp, Homo sapiens
gctcccagggaccgcagggcag

SEQ ID NO: 7118346 - DNA, 22 bp, Homo sapiens
gctcccagggaccgcagggcag

SEQ ID NO: 7118347 - DNA, 22 bp, Homo sapiens
attttgataatcatgttagaga

SEQ ID NO: 7118348 - DNA, 22 bp, Homo sapiens
attttgataatcatgttagaga

SEQ ID NO: 7118349 - DNA, 22 bp, Homo sapiens
attttgataatcatgttagaga

SEQ ID NO: 7118350 - DNA, 22 bp, Homo sapiens
attttgatgctatctaatgaat

SEQ ID NO: 7118351 - DNA, 22 bp, Homo sapiens
attttgataatcatgttagaga

SEQ ID NO: 7118352 - DNA, 22 bp, Homo sapiens
attttgataatcatgttagaga

SEQ ID NO: 7118353 - DNA, 22 bp, Homo sapiens
attttgactgcattacagaaca

SEQ ID NO: 7118354 - DNA, 22 bp, Homo sapiens
attttgactgcattacagaaca

SEQ ID NO: 7118355 - DNA, 17 bp, Homo sapiens
gccttctctgccctcac

SEQ ID NO: 7118356 - DNA, 22 bp, Homo sapiens
attttgaatcaccttggaagaa

SEQ ID NO: 7118357 - DNA, 22 bp, Homo sapiens
attttgaatcaccttggaagaa

SEQ ID NO: 7118358 - DNA, 22 bp, Homo sapiens
attttgaatcaccttggaagaa

SEQ ID NO: 7118359 - DNA, 22 bp, Homo sapiens
gccttccttttaccaccagcca

SEQ ID NO: 7118360 - DNA, 22 bp, Homo sapiens
gccttctccctaaccaaatcct

SEQ ID NO: 7118361 - DNA, 17 bp, Homo sapiens
gccttccttcctccaca

SEQ ID NO: 7118362 - DNA, 17 bp, Homo sapiens
gccttccttcctccaca

SEQ ID NO: 7118363 - DNA, 17 bp, Homo sapiens
gccttccttcctccaca

SEQ ID NO: 7118364 - DNA, 22 bp, Homo sapiens
gccttccttttaccaccagcca

SEQ ID NO: 7118365 - DNA, 22 bp, Homo sapiens
gccttccttttaccaccagcca

SEQ ID NO: 7118366 - DNA, 22 bp, Homo sapiens
attttgctggtctgaattactt

SEQ ID NO: 7118367 - DNA, 22 bp, Homo sapiens
attttgcacactatgcagcttt

SEQ ID NO: 7118368 - DNA, 23 bp, Homo sapiens
attttgcctcttggctgcttagg

SEQ ID NO: 7118369 - DNA, 22 bp, Homo sapiens
attttgctacagttggtggaaa

SEQ ID NO: 7118370 - DNA, 22 bp, Homo sapiens
attttgctgctatgccttgcaa

SEQ ID NO: 7118371 - DNA, 22 bp, Homo sapiens
attttgctggtctgaattactt

SEQ ID NO: 7118372 - DNA, 22 bp, Homo sapiens
attttgatgctatctaatgaat

SEQ ID NO: 7118373 - DNA, 22 bp, Homo sapiens
attttgcacactatgcagcttt

SEQ ID NO: 7118374 - DNA, 22 bp, Homo sapiens
attttgcacactatgcagcttt

SEQ ID NO: 7118375 - DNA, 22 bp, Homo sapiens
gctcagagaaagattagtccct

SEQ ID NO: 7118376 - DNA, 22 bp, Homo sapiens
gctcagagaaaactggggcttg

SEQ ID NO: 7118377 - DNA, 22 bp, Homo sapiens
gctcagagaaaactggggcttg

SEQ ID NO: 7118378 - DNA, 22 bp, Homo sapiens
gctcagagaaaactggggcttg

SEQ ID NO: 7118379 - DNA, 22 bp, Homo sapiens
gctcagactgcacaccctggtc

SEQ ID NO: 7118380 - DNA, 22 bp, Homo sapiens
gctcaaatcccagcgggctcct

SEQ ID NO: 7118381 - DNA, 22 bp, Homo sapiens
gctcaaatgtcatggggagcct

SEQ ID NO: 7118382 - DNA, 19 bp, Homo sapiens
gctcagagacacctgttgc

SEQ ID NO: 7118383 - DNA, 19 bp, Homo sapiens
gctcagagacacctgttgc

SEQ ID NO: 7118384 - DNA, 22 bp, Homo sapiens
caaaagaagctcttggggctag

SEQ ID NO: 7118385 - DNA, 22 bp, Homo sapiens
gctcagagaatttactgctgcc

SEQ ID NO: 7118386 - DNA, 22 bp, Homo sapiens
gctcagagaatttactgctgcc

SEQ ID NO: 7118387 - DNA, 22 bp, Homo sapiens
gctcagagaatttactgctgcc

SEQ ID NO: 7118388 - DNA, 22 bp, Homo sapiens
gctcagagaatttactgctgcc

SEQ ID NO: 7118389 - DNA, 22 bp, Homo sapiens
gctcagagaagttgtgcctggc

SEQ ID NO: 7118390 - DNA, 22 bp, Homo sapiens
gctcagagaatcagcagacacc

SEQ ID NO: 7118391 - DNA, 22 bp, Homo sapiens
gctcagagaatcagcagacacc

SEQ ID NO: 7118392 - DNA, 22 bp, Homo sapiens
caaaagaagctcttggggctag

SEQ ID NO: 7118393 - DNA, 22 bp, Homo sapiens
caaaagaagctcttggggctag

SEQ ID NO: 7118394 - DNA, 21 bp, Homo sapiens
caaaagagactgattcttgga

SEQ ID NO: 7118395 - DNA, 22 bp, Homo sapiens
caaaagatacttgcatctaact

SEQ ID NO: 7118396 - DNA, 22 bp, Homo sapiens
caaaagatacttgcatctaact

SEQ ID NO: 7118397 - DNA, 22 bp, Homo sapiens
caaaagatacttgcatctaact

SEQ ID NO: 7118398 - DNA, 22 bp, Homo sapiens
caaaagatacttgcatctaact

SEQ ID NO: 7118399 - DNA, 22 bp, Homo sapiens
caaaagcaaagtccctgaatgt

SEQ ID NO: 7118400 - DNA, 22 bp, Homo sapiens
caaaagcagcaagtttatatgt

SEQ ID NO: 7118401 - DNA, 22 bp, Homo sapiens
caaaagcagcaagtttatatgt

SEQ ID NO: 7118402 - DNA, 20 bp, Homo sapiens
caaaagcaatgaagttatga

SEQ ID NO: 7118403 - DNA, 20 bp, Homo sapiens
caaaagcaatgaagttatga

SEQ ID NO: 7118404 - DNA, 20 bp, Homo sapiens
caaaagcaatgaagttatga

SEQ ID NO: 7118405 - DNA, 22 bp, Homo sapiens
caaaagcaaagtccctgaatgt

SEQ ID NO: 7118406 - DNA, 22 bp, Homo sapiens
attttcatcatgggtttaacat

SEQ ID NO: 7118407 - DNA, 22 bp, Homo sapiens
attttcatcgctaggttggcct

SEQ ID NO: 7118408 - DNA, 22 bp, Homo sapiens
attttcatcgctaggttggcct

SEQ ID NO: 7118409 - DNA, 22 bp, Homo sapiens
attttcagttgaaaaagttggt

SEQ ID NO: 7118410 - DNA, 22 bp, Homo sapiens
attttcagtgtaaatgttttat

SEQ ID NO: 7118411 - DNA, 22 bp, Homo sapiens
attttcagttgaaaaagttggt

SEQ ID NO: 7118412 - DNA, 22 bp, Homo sapiens
attttcagttgaaaaagttggt

SEQ ID NO: 7118413 - DNA, 22 bp, Homo sapiens
attttcatcatgggtttaacat

SEQ ID NO: 7118414 - DNA, 22 bp, Homo sapiens
attttcatcatgggtttaacat

SEQ ID NO: 7118415 - DNA, 22 bp, Homo sapiens
attttcatggcttctgctcagt

SEQ ID NO: 7118416 - DNA, 22 bp, Homo sapiens
attttcatggcttctgctcagt

SEQ ID NO: 7118417 - DNA, 22 bp, Homo sapiens
attttcatggcttctgctcagt

SEQ ID NO: 7118418 - DNA, 22 bp, Homo sapiens
attttcatggcttctgctcagt

SEQ ID NO: 7118419 - DNA, 21 bp, Homo sapiens
attttcattaattcagtgtgg

SEQ ID NO: 7118420 - DNA, 22 bp, Homo sapiens
attttcatgactaccttaaata

SEQ ID NO: 7118421 - DNA, 22 bp, Homo sapiens
attttcatggcttctgctcagt

SEQ ID NO: 7118422 - DNA, 22 bp, Homo sapiens
attttcatgactaccttaaata

SEQ ID NO: 7118423 - DNA, 22 bp, Homo sapiens
attttcatgactaccttaaata

SEQ ID NO: 7118424 - DNA, 22 bp, Homo sapiens
attttcatgactaccttaaata

SEQ ID NO: 7118425 - DNA, 22 bp, Homo sapiens
attttcatcgctaggttggcct

SEQ ID NO: 7118426 - DNA, 22 bp, Homo sapiens
attttcattttgcagggtgaga

SEQ ID NO: 7118427 - DNA, 21 bp, Homo sapiens
attttcatttccaggggagga

SEQ ID NO: 7118428 - DNA, 21 bp, Homo sapiens
attttcatttccaggggagga

SEQ ID NO: 7118429 - DNA, 22 bp, Homo sapiens
attttcattttgcagggtgaga

SEQ ID NO: 7118430 - DNA, 21 bp, Homo sapiens
attttcattaattcagtgtgg

SEQ ID NO: 7118431 - DNA, 21 bp, Homo sapiens
attttcatttccaggggagga

SEQ ID NO: 7118432 - DNA, 21 bp, Homo sapiens
attttcatttccaggggagga

SEQ ID NO: 7118433 - DNA, 21 bp, Homo sapiens
attttcattaattcagtgtgg

SEQ ID NO: 7118434 - DNA, 21 bp, Homo sapiens
attttcattaattcagtgtgg

SEQ ID NO: 7118435 - DNA, 22 bp, Homo sapiens
attttccatctccacaccaggg

SEQ ID NO: 7118436 - DNA, 22 bp, Homo sapiens
attttccagcctttctagaact

SEQ ID NO: 7118437 - DNA, 22 bp, Homo sapiens
attttccagcctttctagaact

SEQ ID NO: 7118438 - DNA, 22 bp, Homo sapiens
attttccagcctttctagaact

SEQ ID NO: 7118439 - DNA, 22 bp, Homo sapiens
attttccaaaataattgttact

SEQ ID NO: 7118440 - DNA, 22 bp, Homo sapiens
attttcattttgcagggtgaga

SEQ ID NO: 7118441 - DNA, 22 bp, Homo sapiens
attttcattttgcagggtgaga

SEQ ID NO: 7118442 - DNA, 22 bp, Homo sapiens
attttccaaaataattgttact

SEQ ID NO: 7118443 - DNA, 22 bp, Homo sapiens
attttcctcaagcctctggaag

SEQ ID NO: 7118444 - DNA, 22 bp, Homo sapiens
attttcctcaagcctctggaag

SEQ ID NO: 7118445 - DNA, 22 bp, Homo sapiens
attttcctagtcatgtgcttct

SEQ ID NO: 7118446 - DNA, 22 bp, Homo sapiens
attttctaagcctgtcagactt

SEQ ID NO: 7118447 - DNA, 22 bp, Homo sapiens
attttctagatagatgatgcat

SEQ ID NO: 7118448 - DNA, 22 bp, Homo sapiens
gcctgtgcttaactgacgtgag

SEQ ID NO: 7118449 - DNA, 22 bp, Homo sapiens
gccttcccaccctgcgaggctg

SEQ ID NO: 7118450 - DNA, 22 bp, Homo sapiens
gccttcccaccctgcgaggctg

SEQ ID NO: 7118451 - DNA, 22 bp, Homo sapiens
gccttccctctcatcctgctgg

SEQ ID NO: 7118452 - DNA, 19 bp, Homo sapiens
gccttcccaccacccgtcc

SEQ ID NO: 7118453 - DNA, 19 bp, Homo sapiens
gccttcccaccacccgtcc

SEQ ID NO: 7118454 - DNA, 19 bp, Homo sapiens
gccttcccaccacccgtcc

SEQ ID NO: 7118455 - DNA, 22 bp, Homo sapiens
gccttccaggcagggggagcag

SEQ ID NO: 7118456 - DNA, 22 bp, Homo sapiens
gccttccaggcagggggagcag

SEQ ID NO: 7118457 - DNA, 20 bp, Homo sapiens
gccttccagttcagtggcac

SEQ ID NO: 7118458 - DNA, 20 bp, Homo sapiens
gccttccagttcagtggcac

SEQ ID NO: 7118459 - DNA, 22 bp, Homo sapiens
gccttcccaagacgcctgagtt

SEQ ID NO: 7118460 - DNA, 22 bp, Homo sapiens
gccttcccaagacgcctgagtt

SEQ ID NO: 7118461 - DNA, 22 bp, Homo sapiens
gccttcctgcagctctgagcgt

SEQ ID NO: 7118462 - DNA, 22 bp, Homo sapiens
gccttcctgcagctctgagcgt

SEQ ID NO: 7118463 - DNA, 22 bp, Homo sapiens
gccttccctctcatcctgctgg

SEQ ID NO: 7118464 - DNA, 22 bp, Homo sapiens
gccttccctggctaggcaagca

SEQ ID NO: 7118465 - DNA, 22 bp, Homo sapiens
gccttccttacacctgctcagc

SEQ ID NO: 7118466 - DNA, 22 bp, Homo sapiens
gccttccttacacctgctcagc

SEQ ID NO: 7118467 - DNA, 17 bp, Homo sapiens
gccttccttcctccaca

SEQ ID NO: 7118468 - DNA, 22 bp, Homo sapiens
gccttcctgcagctctgagcgt

SEQ ID NO: 7118469 - DNA, 22 bp, Homo sapiens
gccttccttacacctgctcagc

SEQ ID NO: 7118470 - DNA, 22 bp, Homo sapiens
atttgtaagctagagccatgat

SEQ ID NO: 7118471 - DNA, 22 bp, Homo sapiens
atttgtaaagtgcttaaaagta

SEQ ID NO: 7118472 - DNA, 22 bp, Homo sapiens
atttgtaacacgtgacaggttg

SEQ ID NO: 7118473 - DNA, 17 bp, Homo sapiens
atttgtaactagctctt

SEQ ID NO: 7118474 - DNA, 17 bp, Homo sapiens
atttgtaactagctctt

SEQ ID NO: 7118475 - DNA, 22 bp, Homo sapiens
atttgtaatttcttatctgtgt

SEQ ID NO: 7118476 - DNA, 22 bp, Homo sapiens
atttgtaagctagagccatgat

SEQ ID NO: 7118477 - DNA, 22 bp, Homo sapiens
atttgtaagctagagccatgat

SEQ ID NO: 7118478 - DNA, 22 bp, Homo sapiens
atttgtaatttcttatctgtgt

SEQ ID NO: 7118479 - DNA, 22 bp, Homo sapiens
atttgtaatttcttatctgtgt

SEQ ID NO: 7118480 - DNA, 22 bp, Homo sapiens
atttgtacaaatttatgttagt

SEQ ID NO: 7118481 - DNA, 22 bp, Homo sapiens
atttggtgaggtagccattgtt

SEQ ID NO: 7118482 - DNA, 22 bp, Homo sapiens
atttggtgcctgggaaatctct

SEQ ID NO: 7118483 - DNA, 22 bp, Homo sapiens
atttggtggttccttttccgaa

SEQ ID NO: 7118484 - DNA, 22 bp, Homo sapiens
atttggtgttcatcttttagtg

SEQ ID NO: 7118485 - DNA, 23 bp, Homo sapiens
atttggtgttggttctgccaccc

SEQ ID NO: 7118486 - DNA, 22 bp, Homo sapiens
atttggtgttgtttggagccta

SEQ ID NO: 7118487 - DNA, 22 bp, Homo sapiens
atttggttcccaagctacgtgt

SEQ ID NO: 7118488 - DNA, 22 bp, Homo sapiens
atttggtttcaggattctcagg

SEQ ID NO: 7118489 - DNA, 22 bp, Homo sapiens
atttgtaaagtgcttaaaagta

SEQ ID NO: 7118490 - DNA, 22 bp, Homo sapiens
atttggaattctatttcagtag

SEQ ID NO: 7118491 - DNA, 22 bp, Homo sapiens
atttgggaatgtgcattatact

SEQ ID NO: 7118492 - DNA, 22 bp, Homo sapiens
atttggaattcgagtaattcca

SEQ ID NO: 7118493 - DNA, 22 bp, Homo sapiens
atttcttcctctgtcagtaact

SEQ ID NO: 7118494 - DNA, 22 bp, Homo sapiens
atttcttcctctgtcagtaact

SEQ ID NO: 7118495 - DNA, 22 bp, Homo sapiens
atttgggaatgtgcattatact

SEQ ID NO: 7118496 - DNA, 22 bp, Homo sapiens
atttgggaattatttgcctaat

SEQ ID NO: 7118497 - DNA, 22 bp, Homo sapiens
atttgggaattatttgcctaat

SEQ ID NO: 7118498 - DNA, 22 bp, Homo sapiens
atttgggaattatttgcctaat

SEQ ID NO: 7118499 - DNA, 20 bp, Homo sapiens
atttgggacgattggccacc

SEQ ID NO: 7118500 - DNA, 20 bp, Homo sapiens
atttgggacgattggccacc

SEQ ID NO: 7118501 - DNA, 22 bp, Homo sapiens
atttgggagttgctagtgagtt

SEQ ID NO: 7118502 - DNA, 22 bp, Homo sapiens
atttgggagttgctagtgagtt

SEQ ID NO: 7118503 - DNA, 20 bp, Homo sapiens
atttgggacgattggccacc

SEQ ID NO: 7118504 - DNA, 22 bp, Homo sapiens
atttgggcagtccatgaaataa

SEQ ID NO: 7118505 - DNA, 22 bp, Homo sapiens
atttggtagaggctcggtgtta

SEQ ID NO: 7118506 - DNA, 22 bp, Homo sapiens
atttggtagtcctgataagatt

SEQ ID NO: 7118507 - DNA, 22 bp, Homo sapiens
atttggtagtcctgataagatt

SEQ ID NO: 7118508 - DNA, 22 bp, Homo sapiens
atttggtagtgattgaaattat

SEQ ID NO: 7118509 - DNA, 22 bp, Homo sapiens
atttggtagtgattgaaattat

SEQ ID NO: 7118510 - DNA, 22 bp, Homo sapiens
atttggtagtgattgaaattat

SEQ ID NO: 7118511 - DNA, 22 bp, Homo sapiens
atttgtatcaatctcaatatat

SEQ ID NO: 7118512 - DNA, 22 bp, Homo sapiens
atttgtatcaatctcaatatat

SEQ ID NO: 7118513 - DNA, 22 bp, Homo sapiens
atttgtatcaatctcaatatat

SEQ ID NO: 7118514 - DNA, 22 bp, Homo sapiens
atttgtaccatactgtttatta

SEQ ID NO: 7118515 - DNA, 22 bp, Homo sapiens
atttgtactcaggaattctgct

SEQ ID NO: 7118516 - DNA, 22 bp, Homo sapiens
atttgtagtgaagtgaaaataa

SEQ ID NO: 7118517 - DNA, 22 bp, Homo sapiens
atttgtagtgaagtgaaaataa

SEQ ID NO: 7118518 - DNA, 22 bp, Homo sapiens
atttgtatcttctaatattatc

SEQ ID NO: 7118519 - DNA, 22 bp, Homo sapiens
atttgtatcttctaatattatc

SEQ ID NO: 7118520 - DNA, 22 bp, Homo sapiens
atttgtcaaaacacagagaaca

SEQ ID NO: 7118521 - DNA, 22 bp, Homo sapiens
atttgtatcttctaatattatc

SEQ ID NO: 7118522 - DNA, 22 bp, Homo sapiens
atttgtatcttctaatattatc

SEQ ID NO: 7118523 - DNA, 22 bp, Homo sapiens
atttgtatcttctaatattatc

SEQ ID NO: 7118524 - DNA, 22 bp, Homo sapiens
atttgtcaacaggcatttaggt

SEQ ID NO: 7118525 - DNA, 22 bp, Homo sapiens
atttgtcaaaacacagagaaca

SEQ ID NO: 7118526 - DNA, 22 bp, Homo sapiens
atttgtcaacaggcatttaggt

SEQ ID NO: 7118527 - DNA, 22 bp, Homo sapiens
atttgtcagtggaagtgattca

SEQ ID NO: 7118528 - DNA, 22 bp, Homo sapiens
atttgtcatatataatactctt

SEQ ID NO: 7118529 - DNA, 22 bp, Homo sapiens
atttgtctaatgagtgtgtact

SEQ ID NO: 7118530 - DNA, 22 bp, Homo sapiens
atttgtctaatgagtgtgtact

SEQ ID NO: 7118531 - DNA, 22 bp, Homo sapiens
atttgtctagtggtattcacgt

SEQ ID NO: 7118532 - DNA, 22 bp, Homo sapiens
atttgtcagtggaagtgattca

SEQ ID NO: 7118533 - DNA, 22 bp, Homo sapiens
atttgtcagtggaagtgattca

SEQ ID NO: 7118534 - DNA, 22 bp, Homo sapiens
atttgtcacacatagtttatcc

SEQ ID NO: 7118535 - DNA, 22 bp, Homo sapiens
atttgtcactgagagagttaga

SEQ ID NO: 7118536 - DNA, 22 bp, Homo sapiens
atttgtcactgagagagttaga

SEQ ID NO: 7118537 - DNA, 22 bp, Homo sapiens
atttgtctctgcactttactca

SEQ ID NO: 7118538 - DNA, 22 bp, Homo sapiens
attttagagctccaagtacagc

SEQ ID NO: 7118539 - DNA, 22 bp, Homo sapiens
attttagatttaagaataaggt

SEQ ID NO: 7118540 - DNA, 22 bp, Homo sapiens
attttagatttaagaataaggt

SEQ ID NO: 7118541 - DNA, 22 bp, Homo sapiens
attttagatttaagaataaggt

SEQ ID NO: 7118542 - DNA, 22 bp, Homo sapiens
attttagatttaagaataaggt

SEQ ID NO: 7118543 - DNA, 22 bp, Homo sapiens
attttcagcccccactcgtggc

SEQ ID NO: 7118544 - DNA, 22 bp, Homo sapiens
attttcaggttttgccattgta

SEQ ID NO: 7118545 - DNA, 22 bp, Homo sapiens
attttcagtgatcatagcacac

SEQ ID NO: 7118546 - DNA, 22 bp, Homo sapiens
gcaggattgggctgaaggagtg

SEQ ID NO: 7118547 - DNA, 22 bp, Homo sapiens
gcaggcaaggaacagagactgt

SEQ ID NO: 7118548 - DNA, 22 bp, Homo sapiens
gcaggcaattttggaaggtcag

SEQ ID NO: 7118549 - DNA, 19 bp, Homo sapiens
gcaggcagctggggtatcc

SEQ ID NO: 7118550 - DNA, 22 bp, Homo sapiens
gcagcttcctgagtgtggacag

SEQ ID NO: 7118551 - DNA, 22 bp, Homo sapiens
gcagcttcagtaggtgaagaca

SEQ ID NO: 7118552 - DNA, 22 bp, Homo sapiens
gcagcttcctgagtgtggacag

SEQ ID NO: 7118553 - DNA, 18 bp, Homo sapiens
gcagcttaaactaacaga

SEQ ID NO: 7118554 - DNA, 22 bp, Homo sapiens
gcagcttagaaaaatgaaattg

SEQ ID NO: 7118555 - DNA, 22 bp, Homo sapiens
gcagcttcaagatactttttct

SEQ ID NO: 7118556 - DNA, 22 bp, Homo sapiens
gcagcttcagccagagggccag

SEQ ID NO: 7118557 - DNA, 22 bp, Homo sapiens
gcagcttcagccagagggccag

SEQ ID NO: 7118558 - DNA, 22 bp, Homo sapiens
gcaggcaggcttccttgaactg

SEQ ID NO: 7118559 - DNA, 22 bp, Homo sapiens
gcaggcaggcttccttgaactg

SEQ ID NO: 7118560 - DNA, 22 bp, Homo sapiens
gcaggcaggcttccttgaactg

SEQ ID NO: 7118561 - DNA, 22 bp, Homo sapiens
gcaggcaggcttccttgaactg

SEQ ID NO: 7118562 - DNA, 22 bp, Homo sapiens
gcaggcaggcttccttgaactg

SEQ ID NO: 7118563 - DNA, 22 bp, Homo sapiens
gcaggcaggcttccttgaactg

SEQ ID NO: 7118564 - DNA, 20 bp, Homo sapiens
gcaggcagggaatgggggtg

SEQ ID NO: 7118565 - DNA, 20 bp, Homo sapiens
gcaggcagggaatgggggtg

SEQ ID NO: 7118566 - DNA, 19 bp, Homo sapiens
gcaggcagctggggtatcc

SEQ ID NO: 7118567 - DNA, 22 bp, Homo sapiens
gcaggcaggaaggactaagtaa

SEQ ID NO: 7118568 - DNA, 22 bp, Homo sapiens
gcaggcaggaaggactaagtaa

SEQ ID NO: 7118569 - DNA, 22 bp, Homo sapiens
gcaggcaggaaggactaagtaa

SEQ ID NO: 7118570 - DNA, 22 bp, Homo sapiens
gcaggcaggaaggactaagtaa

SEQ ID NO: 7118571 - DNA, 22 bp, Homo sapiens
gcaggcaggagcccaactgcct

SEQ ID NO: 7118572 - DNA, 22 bp, Homo sapiens
gcaggcaggagcccaactgcct

SEQ ID NO: 7118573 - DNA, 22 bp, Homo sapiens
gcaggcaggagcccaactgcct

SEQ ID NO: 7118574 - DNA, 22 bp, Homo sapiens
gcaggcaggagcccaactgcct

SEQ ID NO: 7118575 - DNA, 22 bp, Homo sapiens
gcaggcaggagcccaactgcct

SEQ ID NO: 7118576 - DNA, 22 bp, Homo sapiens
gcaggcaggagcccaactgcct

SEQ ID NO: 7118577 - DNA, 22 bp, Homo sapiens
gcaggcaggagcccaactgcct

SEQ ID NO: 7118578 - DNA, 22 bp, Homo sapiens
attctctttgtataacatcttg

SEQ ID NO: 7118579 - DNA, 22 bp, Homo sapiens
attctgaagttgcaggagaagc

SEQ ID NO: 7118580 - DNA, 22 bp, Homo sapiens
attctgaggacagagtctagca

SEQ ID NO: 7118581 - DNA, 22 bp, Homo sapiens
attctgaggacagagtctagca

SEQ ID NO: 7118582 - DNA, 22 bp, Homo sapiens
attctgagtacaacaagatgtt

SEQ ID NO: 7118583 - DNA, 22 bp, Homo sapiens
attctctttgtataacatcttg

SEQ ID NO: 7118584 - DNA, 22 bp, Homo sapiens
attctctttgtataacatcttg

SEQ ID NO: 7118585 - DNA, 22 bp, Homo sapiens
attctctttgtataacatcttg

SEQ ID NO: 7118586 - DNA, 22 bp, Homo sapiens
attctcatttttatagatgaga

SEQ ID NO: 7118587 - DNA, 22 bp, Homo sapiens
attctccacacatccagacctt

SEQ ID NO: 7118588 - DNA, 22 bp, Homo sapiens
attctccacacatccagacctt

SEQ ID NO: 7118589 - DNA, 22 bp, Homo sapiens
attctcatttgctggctatatg

SEQ ID NO: 7118590 - DNA, 22 bp, Homo sapiens
attctcatttttatagatgaga

SEQ ID NO: 7118591 - DNA, 22 bp, Homo sapiens
attccacttccactagtttctc

SEQ ID NO: 7118592 - DNA, 22 bp, Homo sapiens
attccacttgattttaggggaa

SEQ ID NO: 7118593 - DNA, 20 bp, Homo sapiens
attccacttgtttgaggtac

SEQ ID NO: 7118594 - DNA, 17 bp, Homo sapiens
attctcagtgtacagtg

SEQ ID NO: 7118595 - DNA, 21 bp, Homo sapiens
attctgagttgtcagtcttca

SEQ ID NO: 7118596 - DNA, 22 bp, Homo sapiens
attctgagtttatttgggaggt

SEQ ID NO: 7118597 - DNA, 22 bp, Homo sapiens
attctgatatcttattctagct

SEQ ID NO: 7118598 - DNA, 22 bp, Homo sapiens
attctgatatcttattctagct

SEQ ID NO: 7118599 - DNA, 22 bp, Homo sapiens
attctgagtccatgggggcagg

SEQ ID NO: 7118600 - DNA, 23 bp, Homo sapiens
attctgagtcagaaagtttgggg

SEQ ID NO: 7118601 - DNA, 22 bp, Homo sapiens
attctgatcattcaagatgtca

SEQ ID NO: 7118602 - DNA, 22 bp, Homo sapiens
attctgatcattcaagatgtca

SEQ ID NO: 7118603 - DNA, 22 bp, Homo sapiens
gcagctgtgggcctcggagagc

SEQ ID NO: 7118604 - DNA, 22 bp, Homo sapiens
gcagctgtgggcctcggagagc

SEQ ID NO: 7118605 - DNA, 22 bp, Homo sapiens
gcagctgtggtgctgagatagg

SEQ ID NO: 7118606 - DNA, 22 bp, Homo sapiens
gcagctgtgtaatgagcccaca

SEQ ID NO: 7118607 - DNA, 20 bp, Homo sapiens
attcacaaagccagtgttgc

SEQ ID NO: 7118608 - DNA, 22 bp, Homo sapiens
attcacaaagaagggaagtaca

SEQ ID NO: 7118609 - DNA, 22 bp, Homo sapiens
attcaatgggggtttctagttg

SEQ ID NO: 7118610 - DNA, 22 bp, Homo sapiens
attcacaaaatgatatagatac

SEQ ID NO: 7118611 - DNA, 22 bp, Homo sapiens
attcacaaaatgatatagatac

SEQ ID NO: 7118612 - DNA, 22 bp, Homo sapiens
attcacaaaatgatatagatac

SEQ ID NO: 7118613 - DNA, 22 bp, Homo sapiens
attcacaaagtcacccttacac

SEQ ID NO: 7118614 - DNA, 22 bp, Homo sapiens
attcacaaataacaggtgcaga

SEQ ID NO: 7118615 - DNA, 22 bp, Homo sapiens
attcacaaatgctgccccattc

SEQ ID NO: 7118616 - DNA, 22 bp, Homo sapiens
attcacaaatgctgccccattc

SEQ ID NO: 7118617 - DNA, 22 bp, Homo sapiens
attcacaaatgctgccccattc

SEQ ID NO: 7118618 - DNA, 22 bp, Homo sapiens
attccaaactctttccctgtcg

SEQ ID NO: 7118619 - DNA, 22 bp, Homo sapiens
attccaaacagtgctgcagact

SEQ ID NO: 7118620 - DNA, 22 bp, Homo sapiens
attccaaacagtgctgcagact

SEQ ID NO: 7118621 - DNA, 22 bp, Homo sapiens
attcacaagttgatggatattt

SEQ ID NO: 7118622 - DNA, 22 bp, Homo sapiens
attcacaagttgatggatattt

SEQ ID NO: 7118623 - DNA, 22 bp, Homo sapiens
attcatctgtacttcaatatct

SEQ ID NO: 7118624 - DNA, 22 bp, Homo sapiens
attcatgaaatgattgagaagt

SEQ ID NO: 7118625 - DNA, 22 bp, Homo sapiens
attcatgaatctacattgtggt

SEQ ID NO: 7118626 - DNA, 19 bp, Homo sapiens
attcatttttgccttctaa

SEQ ID NO: 7118627 - DNA, 19 bp, Homo sapiens
attcatttttgccttctaa

SEQ ID NO: 7118628 - DNA, 22 bp, Homo sapiens
attccaaaaggatgttagaatg

SEQ ID NO: 7118629 - DNA, 22 bp, Homo sapiens
attccaattgtacttgctttta

SEQ ID NO: 7118630 - DNA, 22 bp, Homo sapiens
attccacacagtaatactcaat

SEQ ID NO: 7118631 - DNA, 22 bp, Homo sapiens
attccacacagtaatactcaat

SEQ ID NO: 7118632 - DNA, 22 bp, Homo sapiens
attccacacagtaatactcaat

SEQ ID NO: 7118633 - DNA, 22 bp, Homo sapiens
attccaaagcctgaataatgga

SEQ ID NO: 7118634 - DNA, 22 bp, Homo sapiens
attccacagctcagcctctctt

SEQ ID NO: 7118635 - DNA, 22 bp, Homo sapiens
attccacagccgataccatgac

SEQ ID NO: 7118636 - DNA, 22 bp, Homo sapiens
attccacagctacatcaatcta

SEQ ID NO: 7118637 - DNA, 22 bp, Homo sapiens
attccacagctacatcaatcta

SEQ ID NO: 7118638 - DNA, 22 bp, Homo sapiens
attccacagtgtgtggtgagga

SEQ ID NO: 7118639 - DNA, 22 bp, Homo sapiens
attccacataggccttcatgac

SEQ ID NO: 7118640 - DNA, 22 bp, Homo sapiens
attccaccttctacctgggaga

SEQ ID NO: 7118641 - DNA, 22 bp, Homo sapiens
attccactccaataagtgtcaa

SEQ ID NO: 7118642 - DNA, 22 bp, Homo sapiens
attccactgccgaatgatacat

SEQ ID NO: 7118643 - DNA, 22 bp, Homo sapiens
attccactgccgaatgatacat

SEQ ID NO: 7118644 - DNA, 22 bp, Homo sapiens
attccactgttataaaatgtcc

SEQ ID NO: 7118645 - DNA, 22 bp, Homo sapiens
attccacttagtgactcatttg

SEQ ID NO: 7118646 - DNA, 22 bp, Homo sapiens
attccacttatatgaagtaacg

SEQ ID NO: 7118647 - DNA, 22 bp, Homo sapiens
attccacttatatgaagtaacg

SEQ ID NO: 7118648 - DNA, 20 bp, Homo sapiens
attccacttatatgaggtcc

SEQ ID NO: 7118649 - DNA, 22 bp, Homo sapiens
attgcaaatgagtcttaatata

SEQ ID NO: 7118650 - DNA, 22 bp, Homo sapiens
attgcaaataactgtactgaat

SEQ ID NO: 7118651 - DNA, 22 bp, Homo sapiens
attgcaaaggtcccattcaaga

SEQ ID NO: 7118652 - DNA, 22 bp, Homo sapiens
attgcaaaggtcccattcaaga

SEQ ID NO: 7118653 - DNA, 22 bp, Homo sapiens
gcagtaaaaaaggatatgtgca

SEQ ID NO: 7118654 - DNA, 16 bp, Homo sapiens
gcagtaaaatggttag

SEQ ID NO: 7118655 - DNA, 22 bp, Homo sapiens
gcagtaaagcctgagatatatg

SEQ ID NO: 7118656 - DNA, 22 bp, Homo sapiens
gcagtaaagcctgagatatatg

SEQ ID NO: 7118657 - DNA, 22 bp, Homo sapiens
gcagtaaagcctgagatatatg

SEQ ID NO: 7118658 - DNA, 22 bp, Homo sapiens
gcagtaaaggtgacaatatagg

SEQ ID NO: 7118659 - DNA, 22 bp, Homo sapiens
gcagtaaaggtgacaatatagg

SEQ ID NO: 7118660 - DNA, 22 bp, Homo sapiens
gcagtaaaggtgacaatatagg

SEQ ID NO: 7118661 - DNA, 22 bp, Homo sapiens
gcagtaaataattttgtgtata

SEQ ID NO: 7118662 - DNA, 22 bp, Homo sapiens
gcagtaaataattttgtgtata

SEQ ID NO: 7118663 - DNA, 22 bp, Homo sapiens
gcagtaaattgagagtcatgtt

SEQ ID NO: 7118664 - DNA, 22 bp, Homo sapiens
gcagtaaaaaaggatatgtgca

SEQ ID NO: 7118665 - DNA, 22 bp, Homo sapiens
gcaggtgttttaagacattgaa

SEQ ID NO: 7118666 - DNA, 22 bp, Homo sapiens
gcaggtgttctcagaggaggct

SEQ ID NO: 7118667 - DNA, 22 bp, Homo sapiens
gcaggtgttttaagacattgaa

SEQ ID NO: 7118668 - DNA, 22 bp, Homo sapiens
gcaggtgttttaagacattgaa

SEQ ID NO: 7118669 - DNA, 22 bp, Homo sapiens
gcaggtgtggatttgcatccag

SEQ ID NO: 7118670 - DNA, 22 bp, Homo sapiens
gcaggtgtggatttgcatccag

SEQ ID NO: 7118671 - DNA, 22 bp, Homo sapiens
gcaggtgtgggtggctgccagg

SEQ ID NO: 7118672 - DNA, 22 bp, Homo sapiens
gcaggtgtgggtggctgccagg

SEQ ID NO: 7118673 - DNA, 22 bp, Homo sapiens
gcaggtgtgggtggctgccagg

SEQ ID NO: 7118674 - DNA, 21 bp, Homo sapiens
gcaggtgtggtatcagcttcc

SEQ ID NO: 7118675 - DNA, 22 bp, Homo sapiens
gcaggtgtgggtggctgccagg

SEQ ID NO: 7118676 - DNA, 21 bp, Homo sapiens
gcaggtgtggtatcagcttcc

SEQ ID NO: 7118677 - DNA, 22 bp, Homo sapiens
gcaggtgttctcagaggaggct

SEQ ID NO: 7118678 - DNA, 22 bp, Homo sapiens
attgaaaaatgactattgctta

SEQ ID NO: 7118679 - DNA, 22 bp, Homo sapiens
attgaaaaatgactattgctta

SEQ ID NO: 7118680 - DNA, 19 bp, Homo sapiens
gcaggtggatgtggtcagc

SEQ ID NO: 7118681 - DNA, 19 bp, Homo sapiens
gcaggtggatgtggtcagc

SEQ ID NO: 7118682 - DNA, 19 bp, Homo sapiens
gcaggtggatgtggtcagc

SEQ ID NO: 7118683 - DNA, 19 bp, Homo sapiens
gcaggtggatgtggtcagc

SEQ ID NO: 7118684 - DNA, 19 bp, Homo sapiens
gcaggtggatgtggtcagc

SEQ ID NO: 7118685 - DNA, 22 bp, Homo sapiens
gcaggtgtgctgaattacgtga

SEQ ID NO: 7118686 - DNA, 18 bp, Homo sapiens
gcaggtgtggagaagggg

SEQ ID NO: 7118687 - DNA, 18 bp, Homo sapiens
gcaggtgtggagaagggg

SEQ ID NO: 7118688 - DNA, 18 bp, Homo sapiens
gcaggtgtggagaagggg

SEQ ID NO: 7118689 - DNA, 22 bp, Homo sapiens
gcaggtgtggagagtggtcggg

SEQ ID NO: 7118690 - DNA, 22 bp, Homo sapiens
gcaggtgtggagagtggtcggg

SEQ ID NO: 7118691 - DNA, 22 bp, Homo sapiens
gcaggtgtggagtggggtgagc

SEQ ID NO: 7118692 - DNA, 22 bp, Homo sapiens
gcaggtgtggagtggggtgagc

SEQ ID NO: 7118693 - DNA, 22 bp, Homo sapiens
gcatggcaaatatcgagggcag

SEQ ID NO: 7118694 - DNA, 22 bp, Homo sapiens
gcatggcaaatatcgagggcag

SEQ ID NO: 7118695 - DNA, 22 bp, Homo sapiens
gcatggcaaatatcgagggcag

SEQ ID NO: 7118696 - DNA, 22 bp, Homo sapiens
gcatggcaagaccctgtctcta

SEQ ID NO: 7118697 - DNA, 22 bp, Homo sapiens
gcatggcaagatcaggagacca

SEQ ID NO: 7118698 - DNA, 22 bp, Homo sapiens
gcatggcaagatcaggagacca

SEQ ID NO: 7118699 - DNA, 22 bp, Homo sapiens
gcatggaattcccttatgggcc

SEQ ID NO: 7118700 - DNA, 22 bp, Homo sapiens
gcatggagaagtgggaacaggt

SEQ ID NO: 7118701 - DNA, 22 bp, Homo sapiens
gcatggaattcccttatgggcc

SEQ ID NO: 7118702 - DNA, 22 bp, Homo sapiens
gcatggagaagtgggaacaggt

SEQ ID NO: 7118703 - DNA, 22 bp, Homo sapiens
gcatggagaagtgggaacaggt

SEQ ID NO: 7118704 - DNA, 22 bp, Homo sapiens
gcatggagaagtgggaacaggt

SEQ ID NO: 7118705 - DNA, 22 bp, Homo sapiens
gcatggatctaagaggtcaagg

SEQ ID NO: 7118706 - DNA, 22 bp, Homo sapiens
gcatggatgggagtggacagat

SEQ ID NO: 7118707 - DNA, 22 bp, Homo sapiens
gcatggcaagatcaggagacca

SEQ ID NO: 7118708 - DNA, 22 bp, Homo sapiens
gcatggcaagatcaggagacca

SEQ ID NO: 7118709 - DNA, 22 bp, Homo sapiens
gcatggcaagatcaggagacca

SEQ ID NO: 7118710 - DNA, 22 bp, Homo sapiens
gcatggcaagatcaggagacca

SEQ ID NO: 7118711 - DNA, 22 bp, Homo sapiens
gcatggcaagatcaggagacca

SEQ ID NO: 7118712 - DNA, 22 bp, Homo sapiens
gcatggcaagatcaggagacca

SEQ ID NO: 7118713 - DNA, 22 bp, Homo sapiens
gcatggcagaacacctcgcccg

SEQ ID NO: 7118714 - DNA, 22 bp, Homo sapiens
gcatggcagccagtacatggtg

SEQ ID NO: 7118715 - DNA, 22 bp, Homo sapiens
gcatggcagccagtacatggtg

SEQ ID NO: 7118716 - DNA, 22 bp, Homo sapiens
gcatggcagccagtacatggtg

SEQ ID NO: 7118717 - DNA, 22 bp, Homo sapiens
gcatggcagggattagtagtag

SEQ ID NO: 7118718 - DNA, 21 bp, Homo sapiens
gcatggcaggtcactggggca

SEQ ID NO: 7118719 - DNA, 21 bp, Homo sapiens
gcatggcaggtcactggggca

SEQ ID NO: 7118720 - DNA, 21 bp, Homo sapiens
gcatggcaggtcactggggca

SEQ ID NO: 7118721 - DNA, 22 bp, Homo sapiens
gcatggcagtgaggatggtgct

SEQ ID NO: 7118722 - DNA, 22 bp, Homo sapiens
gcatggcagtgaggatggtgct

SEQ ID NO: 7118723 - DNA, 22 bp, Homo sapiens
gcatggcagtgaggatggtgct

SEQ ID NO: 7118724 - DNA, 21 bp, Homo sapiens
gcatggcaggtcactggggca

SEQ ID NO: 7118725 - DNA, 22 bp, Homo sapiens
attgcaatctggtgaaaacagt

SEQ ID NO: 7118726 - DNA, 22 bp, Homo sapiens
attgcacaaagagggaaactga

SEQ ID NO: 7118727 - DNA, 22 bp, Homo sapiens
attgcacaaagagggaaactga

SEQ ID NO: 7118728 - DNA, 18 bp, Homo sapiens
attgcacaccagcctggg

SEQ ID NO: 7118729 - DNA, 22 bp, Homo sapiens
attgcacagctgaatattttgg

SEQ ID NO: 7118730 - DNA, 22 bp, Homo sapiens
attgcaccttgggttttgaaag

SEQ ID NO: 7118731 - DNA, 22 bp, Homo sapiens
attgcactccagccctgctgac

SEQ ID NO: 7118732 - DNA, 22 bp, Homo sapiens
gcatcagtagctatagttacaa

SEQ ID NO: 7118733 - DNA, 22 bp, Homo sapiens
gcatcattctggctctttccat

SEQ ID NO: 7118734 - DNA, 19 bp, Homo sapiens
gcatcatttgtctcttctt

SEQ ID NO: 7118735 - DNA, 19 bp, Homo sapiens
gcatcatttgtctcttctt

SEQ ID NO: 7118736 - DNA, 22 bp, Homo sapiens
gcatccaaaccattcatcagcc

SEQ ID NO: 7118737 - DNA, 22 bp, Homo sapiens
gcatcattttcttcttcctgca

SEQ ID NO: 7118738 - DNA, 22 bp, Homo sapiens
gcagggcagtgtgtctgtgggg

SEQ ID NO: 7118739 - DNA, 22 bp, Homo sapiens
gcagggcagtaagagctagagt

SEQ ID NO: 7118740 - DNA, 22 bp, Homo sapiens
gcagggcagtgtgtctgtgggg

SEQ ID NO: 7118741 - DNA, 22 bp, Homo sapiens
gcagggcagtgtgtctgtgggg

SEQ ID NO: 7118742 - DNA, 22 bp, Homo sapiens
gcagggcagtgtgtctgtgggg

SEQ ID NO: 7118743 - DNA, 22 bp, Homo sapiens
gcagggcagtgtgtctgtgggg

SEQ ID NO: 7118744 - DNA, 22 bp, Homo sapiens
gcagggcaaacccaggtgttca

SEQ ID NO: 7118745 - DNA, 22 bp, Homo sapiens
gcagggcaaacccaggtgttca

SEQ ID NO: 7118746 - DNA, 22 bp, Homo sapiens
gcagggcaaacccaggtgttca

SEQ ID NO: 7118747 - DNA, 22 bp, Homo sapiens
gcagggcagtaagagctagagt

SEQ ID NO: 7118748 - DNA, 22 bp, Homo sapiens
attctggaaagctattctctct

SEQ ID NO: 7118749 - DNA, 22 bp, Homo sapiens
attctggaaagctattctctct

SEQ ID NO: 7118750 - DNA, 20 bp, Homo sapiens
attctgctttgaaaataagg

SEQ ID NO: 7118751 - DNA, 20 bp, Homo sapiens
attctgctttctgatagagc

SEQ ID NO: 7118752 - DNA, 22 bp, Homo sapiens
attctgcattgctcacaaagat

SEQ ID NO: 7118753 - DNA, 22 bp, Homo sapiens
attctgccgctgccacttacta

SEQ ID NO: 7118754 - DNA, 22 bp, Homo sapiens
gcaggcaggtggcatcttgtga

SEQ ID NO: 7118755 - DNA, 20 bp, Homo sapiens
gcaggcagggaatgggggtg

SEQ ID NO: 7118756 - DNA, 20 bp, Homo sapiens
gcaggcagggaatgggggtg

SEQ ID NO: 7118757 - DNA, 15 bp, Homo sapiens
gcaggcaggtcacct

SEQ ID NO: 7118758 - DNA, 22 bp, Homo sapiens
gcaggcaggtggcatcttgtga

SEQ ID NO: 7118759 - DNA, 22 bp, Homo sapiens
gcagggcatccctgagcgggtg

SEQ ID NO: 7118760 - DNA, 22 bp, Homo sapiens
gcagggcatccctgagcgggtg

SEQ ID NO: 7118761 - DNA, 22 bp, Homo sapiens
gcagggcatccctgagcgggtg

SEQ ID NO: 7118762 - DNA, 22 bp, Homo sapiens
gcagggcatagaggcacggagg

SEQ ID NO: 7118763 - DNA, 22 bp, Homo sapiens
gcagggcatccctgagcgggtg

SEQ ID NO: 7118764 - DNA, 22 bp, Homo sapiens
gcagggcatagaggcacggagg

SEQ ID NO: 7118765 - DNA, 22 bp, Homo sapiens
gcagggcatagaggcacggagg

SEQ ID NO: 7118766 - DNA, 22 bp, Homo sapiens
gcagggcatagaggcacggagg

SEQ ID NO: 7118767 - DNA, 22 bp, Homo sapiens
gcagggcagtgtgtctgtgggg

SEQ ID NO: 7118768 - DNA, 22 bp, Homo sapiens
gcagggcagtgtgtctgtgggg

SEQ ID NO: 7118769 - DNA, 22 bp, Homo sapiens
gcagggcatagaggcacggagg

SEQ ID NO: 7118770 - DNA, 22 bp, Homo sapiens
gcagggcatagaggcacggagg

SEQ ID NO: 7118771 - DNA, 22 bp, Homo sapiens
attctttccagacactgattgc

SEQ ID NO: 7118772 - DNA, 22 bp, Homo sapiens
attctttccagacactgattgc

SEQ ID NO: 7118773 - DNA, 22 bp, Homo sapiens
attctttccagacactgattgc

SEQ ID NO: 7118774 - DNA, 22 bp, Homo sapiens
gcagggcatgggccctgtctgc

SEQ ID NO: 7118775 - DNA, 22 bp, Homo sapiens
gcagggcatccctgagcgggtg

SEQ ID NO: 7118776 - DNA, 22 bp, Homo sapiens
gcagggcatccctgagcgggtg

SEQ ID NO: 7118777 - DNA, 22 bp, Homo sapiens
gcagggcatccctgagcgggtg

SEQ ID NO: 7118778 - DNA, 20 bp, Homo sapiens
gcagggcatcttggccccca

SEQ ID NO: 7118779 - DNA, 20 bp, Homo sapiens
gcagggcatcttggccccca

SEQ ID NO: 7118780 - DNA, 22 bp, Homo sapiens
attcttttttaaggaatagaac

SEQ ID NO: 7118781 - DNA, 22 bp, Homo sapiens
attcttttgtcctagcttgata

SEQ ID NO: 7118782 - DNA, 22 bp, Homo sapiens
attcttttgtcctagcttgata

SEQ ID NO: 7118783 - DNA, 22 bp, Homo sapiens
attcttttcccaactgctttaa

SEQ ID NO: 7118784 - DNA, 22 bp, Homo sapiens
attcttttcccaactgctttaa

SEQ ID NO: 7118785 - DNA, 22 bp, Homo sapiens
attcttttaagccccagggatt

SEQ ID NO: 7118786 - DNA, 22 bp, Homo sapiens
attcttttcccaactgctttaa

SEQ ID NO: 7118787 - DNA, 22 bp, Homo sapiens
attcttttaagccccagggatt

SEQ ID NO: 7118788 - DNA, 22 bp, Homo sapiens
attcttttaaatggcagtagta

SEQ ID NO: 7118789 - DNA, 19 bp, Homo sapiens
attctttggtgtccatttc

SEQ ID NO: 7118790 - DNA, 21 bp, Homo sapiens
gcagagaatgaactttggctt

SEQ ID NO: 7118791 - DNA, 21 bp, Homo sapiens
gcagagaatgaactttggctt

SEQ ID NO: 7118792 - DNA, 22 bp, Homo sapiens
gcagagacagactaatgaaaag

SEQ ID NO: 7118793 - DNA, 22 bp, Homo sapiens
gcagagacagactaatgaaaag

SEQ ID NO: 7118794 - DNA, 22 bp, Homo sapiens
gcagagacagactaatgaaaag

SEQ ID NO: 7118795 - DNA, 22 bp, Homo sapiens
gcagagaccccgcagtgaggcc

SEQ ID NO: 7118796 - DNA, 22 bp, Homo sapiens
gcagagactagtagtgcagact

SEQ ID NO: 7118797 - DNA, 22 bp, Homo sapiens
gcagagaggatattattgtcca

SEQ ID NO: 7118798 - DNA, 22 bp, Homo sapiens
gcagagagttgggctgcgccag

SEQ ID NO: 7118799 - DNA, 22 bp, Homo sapiens
gcagagactagtagtgcagact

SEQ ID NO: 7118800 - DNA, 22 bp, Homo sapiens
gcagagaggaatgaagccatcc

SEQ ID NO: 7118801 - DNA, 22 bp, Homo sapiens
gcagagaggaatgaagccatcc

SEQ ID NO: 7118802 - DNA, 22 bp, Homo sapiens
gcagagaggatattattgtcca

SEQ ID NO: 7118803 - DNA, 22 bp, Homo sapiens
attcaagttcttctgtctttgc

SEQ ID NO: 7118804 - DNA, 22 bp, Homo sapiens
attcaagtggctgctatgttaa

SEQ ID NO: 7118805 - DNA, 22 bp, Homo sapiens
attcaagtccagcttctctaca

SEQ ID NO: 7118806 - DNA, 22 bp, Homo sapiens
gcagagattggtgcactgatga

SEQ ID NO: 7118807 - DNA, 22 bp, Homo sapiens
gcagagattggtgcactgatga

SEQ ID NO: 7118808 - DNA, 22 bp, Homo sapiens
gcagagattatgccatggaaag

SEQ ID NO: 7118809 - DNA, 22 bp, Homo sapiens
gcagagattggaagatgaattt

SEQ ID NO: 7118810 - DNA, 22 bp, Homo sapiens
gcagagatggctgcctctgagt

SEQ ID NO: 7118811 - DNA, 22 bp, Homo sapiens
gcagagatgatgataagcctgc

SEQ ID NO: 7118812 - DNA, 22 bp, Homo sapiens
gcagagatgagctatcaggaca

SEQ ID NO: 7118813 - DNA, 22 bp, Homo sapiens
gcagagatgagctatcaggaca

SEQ ID NO: 7118814 - DNA, 22 bp, Homo sapiens
gcagagatgaggcactcatccc

SEQ ID NO: 7118815 - DNA, 22 bp, Homo sapiens
gcagagatggctgcctctgagt

SEQ ID NO: 7118816 - DNA, 22 bp, Homo sapiens
gcagagatgggccagtgacgca

SEQ ID NO: 7118817 - DNA, 19 bp, Homo sapiens
gcagagatgtggtagcttg

SEQ ID NO: 7118818 - DNA, 22 bp, Homo sapiens
gcagagatccttgctggatgac

SEQ ID NO: 7118819 - DNA, 22 bp, Homo sapiens
gcagagatccttgctggatgac

SEQ ID NO: 7118820 - DNA, 22 bp, Homo sapiens
gcagagatcggacactcagtaa

SEQ ID NO: 7118821 - DNA, 22 bp, Homo sapiens
gcagagatctgagaaggctgcc

SEQ ID NO: 7118822 - DNA, 22 bp, Homo sapiens
gcagagataagtagacaggatg

SEQ ID NO: 7118823 - DNA, 22 bp, Homo sapiens
gcagagataagtagacaggatg

SEQ ID NO: 7118824 - DNA, 22 bp, Homo sapiens
gcagagatattgatatagattt

SEQ ID NO: 7118825 - DNA, 22 bp, Homo sapiens
attatgaagttgagggaccctg

SEQ ID NO: 7118826 - DNA, 22 bp, Homo sapiens
attatcttgataaaatggcagt

SEQ ID NO: 7118827 - DNA, 22 bp, Homo sapiens
attatctatgtagaatgatttt

SEQ ID NO: 7118828 - DNA, 22 bp, Homo sapiens
attatgaagttgagggaccctg

SEQ ID NO: 7118829 - DNA, 22 bp, Homo sapiens
attatgagaggagaaaagtcag

SEQ ID NO: 7118830 - DNA, 22 bp, Homo sapiens
attatgcatttgttagtattaa

SEQ ID NO: 7118831 - DNA, 22 bp, Homo sapiens
gcacccagaataaggacaggac

SEQ ID NO: 7118832 - DNA, 22 bp, Homo sapiens
gcacccacttaggccagtcaat

SEQ ID NO: 7118833 - DNA, 22 bp, Homo sapiens
gcacccagaataaggacaggac

SEQ ID NO: 7118834 - DNA, 22 bp, Homo sapiens
gcacccagaataaggacaggac

SEQ ID NO: 7118835 - DNA, 22 bp, Homo sapiens
gcacccagaataaggacaggac

SEQ ID NO: 7118836 - DNA, 22 bp, Homo sapiens
gcaccatgacagtgaggagaac

SEQ ID NO: 7118837 - DNA, 22 bp, Homo sapiens
gcacccagaataaggacaggac

SEQ ID NO: 7118838 - DNA, 22 bp, Homo sapiens
gcacccagaataaggacaggac

SEQ ID NO: 7118839 - DNA, 22 bp, Homo sapiens
gcacccagagggcagggtctcc

SEQ ID NO: 7118840 - DNA, 22 bp, Homo sapiens
attatctaggaattgacagaag

SEQ ID NO: 7118841 - DNA, 22 bp, Homo sapiens
attatctaggaattgacagaag

SEQ ID NO: 7118842 - DNA, 22 bp, Homo sapiens
attatctatgtagaatgatttt

SEQ ID NO: 7118843 - DNA, 22 bp, Homo sapiens
attatctatgtagaatgatttt

SEQ ID NO: 7118844 - DNA, 22 bp, Homo sapiens
gcagagaaggattgaaaccaga

SEQ ID NO: 7118845 - DNA, 22 bp, Homo sapiens
gcagagaaggattgaaaccaga

SEQ ID NO: 7118846 - DNA, 22 bp, Homo sapiens
gcagagaaggattgaaaccaga

SEQ ID NO: 7118847 - DNA, 22 bp, Homo sapiens
gcagacaatttattagcagatt

SEQ ID NO: 7118848 - DNA, 22 bp, Homo sapiens
gcagaattttctgttttctaga

SEQ ID NO: 7118849 - DNA, 22 bp, Homo sapiens
gcagaattttctgttttctaga

SEQ ID NO: 7118850 - DNA, 22 bp, Homo sapiens
attatgtatttggtatagtttg

SEQ ID NO: 7118851 - DNA, 22 bp, Homo sapiens
attatgtgtaacgagtttattg

SEQ ID NO: 7118852 - DNA, 22 bp, Homo sapiens
attattaaaatgtgtttctctt

SEQ ID NO: 7118853 - DNA, 22 bp, Homo sapiens
attatggacatcaaataactct

SEQ ID NO: 7118854 - DNA, 22 bp, Homo sapiens
attatggacgttaattttggaa

SEQ ID NO: 7118855 - DNA, 22 bp, Homo sapiens
attatggagaaatatgtacagg

SEQ ID NO: 7118856 - DNA, 22 bp, Homo sapiens
attatggatggaggcattagtc

SEQ ID NO: 7118857 - DNA, 22 bp, Homo sapiens
attatggctttcatgggcaata

SEQ ID NO: 7118858 - DNA, 22 bp, Homo sapiens
attatgggtataacacagttat

SEQ ID NO: 7118859 - DNA, 22 bp, Homo sapiens
attatgtagctaaaaattgtgt

SEQ ID NO: 7118860 - DNA, 22 bp, Homo sapiens
attatgtatttggtatagtttg

SEQ ID NO: 7118861 - DNA, 22 bp, Homo sapiens
attatgtatttggtatagtttg

SEQ ID NO: 7118862 - DNA, 22 bp, Homo sapiens
gcaccaggcagctgagcaggcc

SEQ ID NO: 7118863 - DNA, 22 bp, Homo sapiens
gcaccaggcagctgagcaggcc

SEQ ID NO: 7118864 - DNA, 22 bp, Homo sapiens
gcaccaggcagctgagcaggcc

SEQ ID NO: 7118865 - DNA, 22 bp, Homo sapiens
gcaccaggcagctgagcaggcc

SEQ ID NO: 7118866 - DNA, 22 bp, Homo sapiens
gcaccaggcagctgagcaggcc

SEQ ID NO: 7118867 - DNA, 22 bp, Homo sapiens
gcaccaggcagctgagcaggcc

SEQ ID NO: 7118868 - DNA, 22 bp, Homo sapiens
gcacagggctgccaggcggctt

SEQ ID NO: 7118869 - DNA, 22 bp, Homo sapiens
gcacacagctagattaccattc

SEQ ID NO: 7118870 - DNA, 22 bp, Homo sapiens
gcaccaggcttagagccccagg

SEQ ID NO: 7118871 - DNA, 22 bp, Homo sapiens
gcaccaggcttagagccccagg

SEQ ID NO: 7118872 - DNA, 22 bp, Homo sapiens
gcaccagggagggtgtgcttca

SEQ ID NO: 7118873 - DNA, 22 bp, Homo sapiens
gcaccagggagggtgtgcttca

SEQ ID NO: 7118874 - DNA, 22 bp, Homo sapiens
gcaccagggtgctgtgttctgg

SEQ ID NO: 7118875 - DNA, 22 bp, Homo sapiens
gcaccaggtgcagccgggcccc

SEQ ID NO: 7118876 - DNA, 22 bp, Homo sapiens
gcaccaggtgcagccgggcccc

SEQ ID NO: 7118877 - DNA, 22 bp, Homo sapiens
gcacacaggcagtttccagcca

SEQ ID NO: 7118878 - DNA, 22 bp, Homo sapiens
gcacacaggcagtttccagcca

SEQ ID NO: 7118879 - DNA, 22 bp, Homo sapiens
gcacacaggcagtttccagcca

SEQ ID NO: 7118880 - DNA, 22 bp, Homo sapiens
gcacacagctagattaccattc

SEQ ID NO: 7118881 - DNA, 22 bp, Homo sapiens
gcacacagctagattaccattc

SEQ ID NO: 7118882 - DNA, 22 bp, Homo sapiens
gcacacagctagattaccattc

SEQ ID NO: 7118883 - DNA, 22 bp, Homo sapiens
gcacacagccagctgagggcta

SEQ ID NO: 7118884 - DNA, 22 bp, Homo sapiens
gcacacagccagctgagggcta

SEQ ID NO: 7118885 - DNA, 22 bp, Homo sapiens
gcacacagccagctgagggcta

SEQ ID NO: 7118886 - DNA, 22 bp, Homo sapiens
gcacacagaattgattcactgt

SEQ ID NO: 7118887 - DNA, 22 bp, Homo sapiens
gcacacagaattgattcactgt

SEQ ID NO: 7118888 - DNA, 22 bp, Homo sapiens
gcacacagagaggtggtatgtc

SEQ ID NO: 7118889 - DNA, 22 bp, Homo sapiens
gcacacagagaggtggtatgtc

SEQ ID NO: 7118890 - DNA, 22 bp, Homo sapiens
gcacacagattaggaaacagaa

SEQ ID NO: 7118891 - DNA, 22 bp, Homo sapiens
gcacacagattaggaaacagaa

SEQ ID NO: 7118892 - DNA, 22 bp, Homo sapiens
gcacacagattaggaaacagaa

SEQ ID NO: 7118893 - DNA, 22 bp, Homo sapiens
attatataaaattctggaagct

SEQ ID NO: 7118894 - DNA, 22 bp, Homo sapiens
attatataaaattctggaagct

SEQ ID NO: 7118895 - DNA, 22 bp, Homo sapiens
attataggcttgagccaccgtg

SEQ ID NO: 7118896 - DNA, 22 bp, Homo sapiens
attataggcttgagccaccgtg

SEQ ID NO: 7118897 - DNA, 22 bp, Homo sapiens
attataggcttgagccaccgtg

SEQ ID NO: 7118898 - DNA, 22 bp, Homo sapiens
attataggcttgagccaccgtg

SEQ ID NO: 7118899 - DNA, 22 bp, Homo sapiens
attagtttggtgcaaaagtaat

SEQ ID NO: 7118900 - DNA, 22 bp, Homo sapiens
attagtttggtgcaaaagtaat

SEQ ID NO: 7118901 - DNA, 22 bp, Homo sapiens
attagttggggtggagaaggat

SEQ ID NO: 7118902 - DNA, 22 bp, Homo sapiens
attagttgtacagttcattttg

SEQ ID NO: 7118903 - DNA, 22 bp, Homo sapiens
attagttgtgtggttctcaatt

SEQ ID NO: 7118904 - DNA, 22 bp, Homo sapiens
attagtttggtgcaaaagtaat

SEQ ID NO: 7118905 - DNA, 22 bp, Homo sapiens
attaagagcctactatgtgccg

SEQ ID NO: 7118906 - DNA, 22 bp, Homo sapiens
attaagagttacaaatagagta

SEQ ID NO: 7118907 - DNA, 22 bp, Homo sapiens
attaagatcattgtagaagatt

SEQ ID NO: 7118908 - DNA, 22 bp, Homo sapiens
attaacttttgatcagtgtggt

SEQ ID NO: 7118909 - DNA, 22 bp, Homo sapiens
gcacacagaattgattcactgt

SEQ ID NO: 7118910 - DNA, 22 bp, Homo sapiens
gcacacagaattgattcactgt

SEQ ID NO: 7118911 - DNA, 22 bp, Homo sapiens
gcacacagaattgattcactgt

SEQ ID NO: 7118912 - DNA, 22 bp, Homo sapiens
attatccaacacccagttacat

SEQ ID NO: 7118913 - DNA, 22 bp, Homo sapiens
attatccaacacccagttacat

SEQ ID NO: 7118914 - DNA, 22 bp, Homo sapiens
attatcacaggtgagtctcact

SEQ ID NO: 7118915 - DNA, 22 bp, Homo sapiens
attatattgagtataaccagag

SEQ ID NO: 7118916 - DNA, 22 bp, Homo sapiens
attatatttgaaaggttggaag

SEQ ID NO: 7118917 - DNA, 22 bp, Homo sapiens
attatatttgaaaggttggaag

SEQ ID NO: 7118918 - DNA, 22 bp, Homo sapiens
attatattgagtataaccagag

SEQ ID NO: 7118919 - DNA, 22 bp, Homo sapiens
attatattgagtataaccagag

SEQ ID NO: 7118920 - DNA, 22 bp, Homo sapiens
attatattgagtataaccagag

SEQ ID NO: 7118921 - DNA, 22 bp, Homo sapiens
attatatgtgggatagaattta

SEQ ID NO: 7118922 - DNA, 22 bp, Homo sapiens
attatatgtgggatagaattta

SEQ ID NO: 7118923 - DNA, 22 bp, Homo sapiens
attatataggacttgcccttcc

SEQ ID NO: 7118924 - DNA, 22 bp, Homo sapiens
gatggcagtcaaccaggtgagg

SEQ ID NO: 7118925 - DNA, 22 bp, Homo sapiens
gatggcagtcaaccaggtgagg

SEQ ID NO: 7118926 - DNA, 22 bp, Homo sapiens
gatggcagtgggcctcgagtcc

SEQ ID NO: 7118927 - DNA, 22 bp, Homo sapiens
gatggcaggtgatagccgagtc

SEQ ID NO: 7118928 - DNA, 22 bp, Homo sapiens
gatggcagtcaaccaggtgagg

SEQ ID NO: 7118929 - DNA, 22 bp, Homo sapiens
gatggcaggcaggtgagtagag

SEQ ID NO: 7118930 - DNA, 22 bp, Homo sapiens
gatggcaggcaggtgagtagag

SEQ ID NO: 7118931 - DNA, 22 bp, Homo sapiens
gatggcagcatattgacagcat

SEQ ID NO: 7118932 - DNA, 22 bp, Homo sapiens
gatggcagcatattgacagcat

SEQ ID NO: 7118933 - DNA, 22 bp, Homo sapiens
gatggcagcagcagccagggat

SEQ ID NO: 7118934 - DNA, 22 bp, Homo sapiens
gatggcagcagcagccagggat

SEQ ID NO: 7118935 - DNA, 22 bp, Homo sapiens
gatggcagcagcagccagggat

SEQ ID NO: 7118936 - DNA, 22 bp, Homo sapiens
gatggcacacagacatccccgc

SEQ ID NO: 7118937 - DNA, 22 bp, Homo sapiens
gatggagtgccagggtggaact

SEQ ID NO: 7118938 - DNA, 22 bp, Homo sapiens
gatggcacacagacatccccgc

SEQ ID NO: 7118939 - DNA, 22 bp, Homo sapiens
gatggcaccttgaacgctgcgt

SEQ ID NO: 7118940 - DNA, 22 bp, Homo sapiens
gatggagtctgaagctgggaac

SEQ ID NO: 7118941 - DNA, 22 bp, Homo sapiens
gatggaggagatggcagggtgc

SEQ ID NO: 7118942 - DNA, 22 bp, Homo sapiens
gatggagtctgaagctgggaac

SEQ ID NO: 7118943 - DNA, 22 bp, Homo sapiens
gatggaggagatggcagggtgc

SEQ ID NO: 7118944 - DNA, 22 bp, Homo sapiens
atgttatttcaaaattcccttg

SEQ ID NO: 7118945 - DNA, 22 bp, Homo sapiens
atgttatttctgaaagatcatt

SEQ ID NO: 7118946 - DNA, 22 bp, Homo sapiens
atgttatttctgaaagatcatt

SEQ ID NO: 7118947 - DNA, 22 bp, Homo sapiens
atgttatttctgaaagatcatt

SEQ ID NO: 7118948 - DNA, 22 bp, Homo sapiens
atgttatttctgaaagatcatt

SEQ ID NO: 7118949 - DNA, 22 bp, Homo sapiens
atgttatttattatcctcggtt

SEQ ID NO: 7118950 - DNA, 22 bp, Homo sapiens
atgttatttattgaaacacttt

SEQ ID NO: 7118951 - DNA, 22 bp, Homo sapiens
atgttatttattgaaacacttt

SEQ ID NO: 7118952 - DNA, 22 bp, Homo sapiens
atgttatttattatcctcggtt

SEQ ID NO: 7118953 - DNA, 22 bp, Homo sapiens
atgttatttcaaaattcccttg

SEQ ID NO: 7118954 - DNA, 22 bp, Homo sapiens
gagtggggcccactgctgggtg

SEQ ID NO: 7118955 - DNA, 22 bp, Homo sapiens
gagtggggcccactgctgggtg

SEQ ID NO: 7118956 - DNA, 22 bp, Homo sapiens
gagtggggcccactgctgggtg

SEQ ID NO: 7118957 - DNA, 22 bp, Homo sapiens
gagtggggcccactgctgggtg

SEQ ID NO: 7118958 - DNA, 22 bp, Homo sapiens
gagtggggcccactgctgggtg

SEQ ID NO: 7118959 - DNA, 23 bp, Homo sapiens
gagtggggagaaattggttaaac

SEQ ID NO: 7118960 - DNA, 22 bp, Homo sapiens
gagtggggaaagccaggacaga

SEQ ID NO: 7118961 - DNA, 22 bp, Homo sapiens
gagtggggaaagccaggacaga

SEQ ID NO: 7118962 - DNA, 22 bp, Homo sapiens
gagtggggaaagccaggacaga

SEQ ID NO: 7118963 - DNA, 22 bp, Homo sapiens
gagtggggaaagccaggacaga

SEQ ID NO: 7118964 - DNA, 22 bp, Homo sapiens
gagtgggcttggggagagtttg

SEQ ID NO: 7118965 - DNA, 21 bp, Homo sapiens
gagtgggctgagatggggctg

SEQ ID NO: 7118966 - DNA, 22 bp, Homo sapiens
gagtgggcttggggagagtttg

SEQ ID NO: 7118967 - DNA, 22 bp, Homo sapiens
gagtggggaaagccaggacaga

SEQ ID NO: 7118968 - DNA, 22 bp, Homo sapiens
gagtgggcaccgtgggcacact

SEQ ID NO: 7118969 - DNA, 20 bp, Homo sapiens
gagtgggccatggagtgaga

SEQ ID NO: 7118970 - DNA, 20 bp, Homo sapiens
gagtgggccatggagtgaga

SEQ ID NO: 7118971 - DNA, 20 bp, Homo sapiens
gagtgggccatggagtgaga

SEQ ID NO: 7118972 - DNA, 21 bp, Homo sapiens
gagtgggctgagatggggctg

SEQ ID NO: 7118973 - DNA, 21 bp, Homo sapiens
gagtgggctgagatggggctg

SEQ ID NO: 7118974 - DNA, 22 bp, Homo sapiens
atgttatgtctgggaaggggta

SEQ ID NO: 7118975 - DNA, 22 bp, Homo sapiens
atgttatgtctgggaaggggta

SEQ ID NO: 7118976 - DNA, 22 bp, Homo sapiens
atgttatgtctgggaaggggta

SEQ ID NO: 7118977 - DNA, 22 bp, Homo sapiens
atgttatgtgcaagatacataa

SEQ ID NO: 7118978 - DNA, 22 bp, Homo sapiens
gagtggggcgtggatccagcgt

SEQ ID NO: 7118979 - DNA, 22 bp, Homo sapiens
gagtggggcgtggatccagcgt

SEQ ID NO: 7118980 - DNA, 22 bp, Homo sapiens
gagtggggcgaagtcggcgagt

SEQ ID NO: 7118981 - DNA, 22 bp, Homo sapiens
gagtggggcccactgctgggtg

SEQ ID NO: 7118982 - DNA, 22 bp, Homo sapiens
gagtggggcgaagtcggcgagt

SEQ ID NO: 7118983 - DNA, 22 bp, Homo sapiens
gagtggggcgtggatccagcgt

SEQ ID NO: 7118984 - DNA, 22 bp, Homo sapiens
gagtggggcgtggatccagcgt

SEQ ID NO: 7118985 - DNA, 22 bp, Homo sapiens
gagtggggcgtggatccagcgt

SEQ ID NO: 7118986 - DNA, 22 bp, Homo sapiens
atgttattaaagtacagattct

SEQ ID NO: 7118987 - DNA, 23 bp, Homo sapiens
atgttattattagcagtcttgcc

SEQ ID NO: 7118988 - DNA, 22 bp, Homo sapiens
atgttatgtgcaagatacataa

SEQ ID NO: 7118989 - DNA, 22 bp, Homo sapiens
atgttattaaagtacagattct

SEQ ID NO: 7118990 - DNA, 23 bp, Homo sapiens
atgttattattagcagtcttgcc

SEQ ID NO: 7118991 - DNA, 22 bp, Homo sapiens
atgttattcaatttgaatccaa

SEQ ID NO: 7118992 - DNA, 22 bp, Homo sapiens
atgttattcaatttgaatccaa

SEQ ID NO: 7118993 - DNA, 21 bp, Homo sapiens
atgttattctgttcctccagc

SEQ ID NO: 7118994 - DNA, 22 bp, Homo sapiens
atgttattgatgcctgaggctt

SEQ ID NO: 7118995 - DNA, 22 bp, Homo sapiens
gatgtgaggactcatgtggagg

SEQ ID NO: 7118996 - DNA, 22 bp, Homo sapiens
gatgtgaggtggtaaacaggga

SEQ ID NO: 7118997 - DNA, 22 bp, Homo sapiens
gatgtgacaaaccaagaggact

SEQ ID NO: 7118998 - DNA, 22 bp, Homo sapiens
gatgtgaggactcatgtggagg

SEQ ID NO: 7118999 - DNA, 22 bp, Homo sapiens
gatgtctttctgtgtgcctaga

SEQ ID NO: 7119000 - DNA, 22 bp, Homo sapiens
gatgtctttgccatgcatgtgt

SEQ ID NO: 7119001 - DNA, 22 bp, Homo sapiens
gatgtctttgaggctcactgct

SEQ ID NO: 7119002 - DNA, 22 bp, Homo sapiens
gatgtctttttccaggctcttt

SEQ ID NO: 7119003 - DNA, 22 bp, Homo sapiens
gatggccacatacatggctggg

SEQ ID NO: 7119004 - DNA, 22 bp, Homo sapiens
gatgtcttcccatgttcatgtg

SEQ ID NO: 7119005 - DNA, 22 bp, Homo sapiens
gatgtcttcccatgttcatgtg

SEQ ID NO: 7119006 - DNA, 22 bp, Homo sapiens
gatgtcttctcaactgtagacc

SEQ ID NO: 7119007 - DNA, 22 bp, Homo sapiens
gatgtcttctcaactgtagacc

SEQ ID NO: 7119008 - DNA, 22 bp, Homo sapiens
gatgtcttctcaactgtagacc

SEQ ID NO: 7119009 - DNA, 22 bp, Homo sapiens
gatgtcttggcttgctctctgt

SEQ ID NO: 7119010 - DNA, 22 bp, Homo sapiens
gatgtcttggtcaacttgggct

SEQ ID NO: 7119011 - DNA, 20 bp, Homo sapiens
gatgtcttggtcacagtggc

SEQ ID NO: 7119012 - DNA, 20 bp, Homo sapiens
gatgtcttggtcacagtggc

SEQ ID NO: 7119013 - DNA, 20 bp, Homo sapiens
gatgtcttggtcacagtggc

SEQ ID NO: 7119014 - DNA, 22 bp, Homo sapiens
gatgtctttagggcaaaatatt

SEQ ID NO: 7119015 - DNA, 22 bp, Homo sapiens
gattcagtgagggtgagaagaa

SEQ ID NO: 7119016 - DNA, 22 bp, Homo sapiens
gattcattctcagtttctagag

SEQ ID NO: 7119017 - DNA, 22 bp, Homo sapiens
gattccaaatggagatgtccac

SEQ ID NO: 7119018 - DNA, 22 bp, Homo sapiens
gattccaaatggagatgtccac

SEQ ID NO: 7119019 - DNA, 22 bp, Homo sapiens
gattccacagcttcgaggtctt

SEQ ID NO: 7119020 - DNA, 22 bp, Homo sapiens
gattccacagcttcgaggtctt

SEQ ID NO: 7119021 - DNA, 22 bp, Homo sapiens
gattcactcatattttacgttt

SEQ ID NO: 7119022 - DNA, 22 bp, Homo sapiens
gattcagcctctgcttccctga

SEQ ID NO: 7119023 - DNA, 22 bp, Homo sapiens
gatgtgtcatttggtcatctgc

SEQ ID NO: 7119024 - DNA, 22 bp, Homo sapiens
gatgtgtcatttggtcatctgc

SEQ ID NO: 7119025 - DNA, 22 bp, Homo sapiens
gatgtgcttagtacagatgtgt

SEQ ID NO: 7119026 - DNA, 22 bp, Homo sapiens
gatgtggcatagaatgatggtt

SEQ ID NO: 7119027 - DNA, 22 bp, Homo sapiens
gatgtggctgccatggagcctg

SEQ ID NO: 7119028 - DNA, 18 bp, Homo sapiens
gatgtgggccctggatat

SEQ ID NO: 7119029 - DNA, 18 bp, Homo sapiens
gatgtgggccctggatat

SEQ ID NO: 7119030 - DNA, 18 bp, Homo sapiens
gatgtgggccctggatat

SEQ ID NO: 7119031 - DNA, 22 bp, Homo sapiens
gatgtggggataatactggtac

SEQ ID NO: 7119032 - DNA, 22 bp, Homo sapiens
gatgtggggataatactggtac

SEQ ID NO: 7119033 - DNA, 22 bp, Homo sapiens
gatgtggggttgagggaccagc

SEQ ID NO: 7119034 - DNA, 22 bp, Homo sapiens
gatgtggggttgagggaccagc

SEQ ID NO: 7119035 - DNA, 22 bp, Homo sapiens
gatgtggggttgagggaccagc

SEQ ID NO: 7119036 - DNA, 22 bp, Homo sapiens
gatgtgggtgtcttcagctggt

SEQ ID NO: 7119037 - DNA, 22 bp, Homo sapiens
gatgtgggtgtcttcagctggt

SEQ ID NO: 7119038 - DNA, 22 bp, Homo sapiens
gatgtgggtgtcttcagctggt

SEQ ID NO: 7119039 - DNA, 22 bp, Homo sapiens
gattctgcgatgaggacgagct

SEQ ID NO: 7119040 - DNA, 18 bp, Homo sapiens
gattctgattctggaggc

SEQ ID NO: 7119041 - DNA, 22 bp, Homo sapiens
gattctctgctatctatcacct

SEQ ID NO: 7119042 - DNA, 22 bp, Homo sapiens
gattctcttggatgtaggcata

SEQ ID NO: 7119043 - DNA, 22 bp, Homo sapiens
gattcctagcaaactcttggag

SEQ ID NO: 7119044 - DNA, 20 bp, Homo sapiens
gattcctctgagaactggag

SEQ ID NO: 7119045 - DNA, 22 bp, Homo sapiens
gattcctttcgcctgccgagct

SEQ ID NO: 7119046 - DNA, 22 bp, Homo sapiens
gattctctctggatcccatgga

SEQ ID NO: 7119047 - DNA, 22 bp, Homo sapiens
gattctctctggatcccatgga

SEQ ID NO: 7119048 - DNA, 22 bp, Homo sapiens
attaaattggatctgcatagtt

SEQ ID NO: 7119049 - DNA, 22 bp, Homo sapiens
attaaattggatctgcatagtt

SEQ ID NO: 7119050 - DNA, 22 bp, Homo sapiens
attaaattggatctgcatagtt

SEQ ID NO: 7119051 - DNA, 22 bp, Homo sapiens
attaacagaattttacatgctt

SEQ ID NO: 7119052 - DNA, 19 bp, Homo sapiens
attaacatcagtgttggcc

SEQ ID NO: 7119053 - DNA, 22 bp, Homo sapiens
attaacatgagttggagatagg

SEQ ID NO: 7119054 - DNA, 22 bp, Homo sapiens
attaacatgcagccagacacac

SEQ ID NO: 7119055 - DNA, 22 bp, Homo sapiens
ctttattcctacaagattttct

SEQ ID NO: 7119056 - DNA, 22 bp, Homo sapiens
ctttattctgcaaattgccttg

SEQ ID NO: 7119057 - DNA, 22 bp, Homo sapiens
ctttattagatgtagactttct

SEQ ID NO: 7119058 - DNA, 22 bp, Homo sapiens
ctttattagatgtagactttct

SEQ ID NO: 7119059 - DNA, 22 bp, Homo sapiens
ctttattagatgtagactttct

SEQ ID NO: 7119060 - DNA, 22 bp, Homo sapiens
ctttattagatgtagactttct

SEQ ID NO: 7119061 - DNA, 22 bp, Homo sapiens
ctttattcctacaagattttct

SEQ ID NO: 7119062 - DNA, 22 bp, Homo sapiens
ctttattgtccttcttaggtgg

SEQ ID NO: 7119063 - DNA, 22 bp, Homo sapiens
ctttattgtccttcttaggtgg

SEQ ID NO: 7119064 - DNA, 22 bp, Homo sapiens
ctttattgtccttcttaggtgg

SEQ ID NO: 7119065 - DNA, 22 bp, Homo sapiens
ctttattgtccttcttaggtgg

SEQ ID NO: 7119066 - DNA, 22 bp, Homo sapiens
ctttattgtccttcttaggtgg

SEQ ID NO: 7119067 - DNA, 22 bp, Homo sapiens
ctttattgtccttcttaggtgg

SEQ ID NO: 7119068 - DNA, 22 bp, Homo sapiens
ctttattgtccttcttaggtgg

SEQ ID NO: 7119069 - DNA, 22 bp, Homo sapiens
ctttattgtccttcttaggtgg

SEQ ID NO: 7119070 - DNA, 22 bp, Homo sapiens
ctttcaaaacgctctgtatgca

SEQ ID NO: 7119071 - DNA, 22 bp, Homo sapiens
ctttatgttggggtgtcttagt

SEQ ID NO: 7119072 - DNA, 22 bp, Homo sapiens
ctttatgttggggtgtcttagt

SEQ ID NO: 7119073 - DNA, 22 bp, Homo sapiens
ctttatgttcagtacaatgctt

SEQ ID NO: 7119074 - DNA, 22 bp, Homo sapiens
ctttattagatgtagactttct

SEQ ID NO: 7119075 - DNA, 22 bp, Homo sapiens
ctttattagatgtagactttct

SEQ ID NO: 7119076 - DNA, 22 bp, Homo sapiens
ctttattagatgtagactttct

SEQ ID NO: 7119077 - DNA, 22 bp, Homo sapiens
ctttagaaatctggatgtattt

SEQ ID NO: 7119078 - DNA, 22 bp, Homo sapiens
ctttatgtgtactttccatttt

SEQ ID NO: 7119079 - DNA, 22 bp, Homo sapiens
ctttacttgctttgttacaaaa

SEQ ID NO: 7119080 - DNA, 22 bp, Homo sapiens
ctttacttctcaaaataaagca

SEQ ID NO: 7119081 - DNA, 22 bp, Homo sapiens
ctttacttctcaaaataaagca

SEQ ID NO: 7119082 - DNA, 22 bp, Homo sapiens
ctttactgccatgcatttataa

SEQ ID NO: 7119083 - DNA, 22 bp, Homo sapiens
ctttactgttcttctgtgggaa

SEQ ID NO: 7119084 - DNA, 22 bp, Homo sapiens
ctttaccacaaggacagaactt

SEQ ID NO: 7119085 - DNA, 22 bp, Homo sapiens
ctttacatcctgtttcccgttt

SEQ ID NO: 7119086 - DNA, 22 bp, Homo sapiens
ctttacagtgctgctaatggct

SEQ ID NO: 7119087 - DNA, 22 bp, Homo sapiens
ctttacagataggaactactca

SEQ ID NO: 7119088 - DNA, 22 bp, Homo sapiens
ctttacagcctccagaaggaac

SEQ ID NO: 7119089 - DNA, 22 bp, Homo sapiens
ctttacagcctccagaaggaac

SEQ ID NO: 7119090 - DNA, 22 bp, Homo sapiens
ctttacagcttagtggtatgga

SEQ ID NO: 7119091 - DNA, 17 bp, Homo sapiens
cttgttttccactggga

SEQ ID NO: 7119092 - DNA, 17 bp, Homo sapiens
cttgttttccactggga

SEQ ID NO: 7119093 - DNA, 17 bp, Homo sapiens
cttgttttccactggga

SEQ ID NO: 7119094 - DNA, 22 bp, Homo sapiens
ctttacacaatgattttcttta

SEQ ID NO: 7119095 - DNA, 22 bp, Homo sapiens
atctttgggatcctgatttact

SEQ ID NO: 7119096 - DNA, 22 bp, Homo sapiens
cttgttttaaactgttgtggct

SEQ ID NO: 7119097 - DNA, 22 bp, Homo sapiens
cttgttttaaactgttgtggct

SEQ ID NO: 7119098 - DNA, 22 bp, Homo sapiens
atctggagaataaatgtccaag

SEQ ID NO: 7119099 - DNA, 22 bp, Homo sapiens
atctggagaaaccgccaaggga

SEQ ID NO: 7119100 - DNA, 22 bp, Homo sapiens
cttctccagccacgcccactcc

SEQ ID NO: 7119101 - DNA, 19 bp, Homo sapiens
cttctccagcttctagaag

SEQ ID NO: 7119102 - DNA, 22 bp, Homo sapiens
atctggaattaagagaaagtga

SEQ ID NO: 7119103 - DNA, 22 bp, Homo sapiens
atctggaattaagagaaagtga

SEQ ID NO: 7119104 - DNA, 22 bp, Homo sapiens
atctggaattgaagaggtttga

SEQ ID NO: 7119105 - DNA, 22 bp, Homo sapiens
atctggactagagcagaatggg

SEQ ID NO: 7119106 - DNA, 22 bp, Homo sapiens
atctggaatgtctcattgggaa

SEQ ID NO: 7119107 - DNA, 22 bp, Homo sapiens
atctggaatcttgctgaccctg

SEQ ID NO: 7119108 - DNA, 22 bp, Homo sapiens
atctggaatgtctcattgggaa

SEQ ID NO: 7119109 - DNA, 22 bp, Homo sapiens
atctggaatccttgtggacaat

SEQ ID NO: 7119110 - DNA, 22 bp, Homo sapiens
atctggaatccttgtggacaat

SEQ ID NO: 7119111 - DNA, 22 bp, Homo sapiens
atctggaatagcatggggttga

SEQ ID NO: 7119112 - DNA, 22 bp, Homo sapiens
atctggaatagcatggggttga

SEQ ID NO: 7119113 - DNA, 22 bp, Homo sapiens
atctggaatccttgtggacaat

SEQ ID NO: 7119114 - DNA, 17 bp, Homo sapiens
atctggaagctagctga

SEQ ID NO: 7119115 - DNA, 17 bp, Homo sapiens
atctggaagctagctga

SEQ ID NO: 7119116 - DNA, 22 bp, Homo sapiens
atctggaagtaggagagtgggc

SEQ ID NO: 7119117 - DNA, 22 bp, Homo sapiens
atctggaagtaggagagtgggc

SEQ ID NO: 7119118 - DNA, 22 bp, Homo sapiens
atctggaagtcagaggtttgca

SEQ ID NO: 7119119 - DNA, 22 bp, Homo sapiens
atctggaagtcagaggtttgca

SEQ ID NO: 7119120 - DNA, 22 bp, Homo sapiens
atctggaagtctccgaaggcag

SEQ ID NO: 7119121 - DNA, 22 bp, Homo sapiens
atctggaagtctccgaaggcag

SEQ ID NO: 7119122 - DNA, 22 bp, Homo sapiens
atctggaagttaagcttggtgc

SEQ ID NO: 7119123 - DNA, 22 bp, Homo sapiens
atctggaagttaagcttggtgc

SEQ ID NO: 7119124 - DNA, 22 bp, Homo sapiens
atctggaagttaagcttggtgc

SEQ ID NO: 7119125 - DNA, 22 bp, Homo sapiens
cttctccctggcttctgcacac

SEQ ID NO: 7119126 - DNA, 22 bp, Homo sapiens
cttctcccaagtatgcagtttg

SEQ ID NO: 7119127 - DNA, 18 bp, Homo sapiens
cttctcccatcttggcca

SEQ ID NO: 7119128 - DNA, 18 bp, Homo sapiens
cttctcccatcttggcca

SEQ ID NO: 7119129 - DNA, 22 bp, Homo sapiens
cttctccccagaaaagatttct

SEQ ID NO: 7119130 - DNA, 22 bp, Homo sapiens
cttctcctctgagtcctgggag

SEQ ID NO: 7119131 - DNA, 22 bp, Homo sapiens
cttctcctctgagtcctgggag

SEQ ID NO: 7119132 - DNA, 22 bp, Homo sapiens
cttctcctctgagtcctgggag

SEQ ID NO: 7119133 - DNA, 22 bp, Homo sapiens
cttctccctggcttctgcacac

SEQ ID NO: 7119134 - DNA, 22 bp, Homo sapiens
cttctcctaaggtcagaattgc

SEQ ID NO: 7119135 - DNA, 22 bp, Homo sapiens
atctttcagtttcataccaatt

SEQ ID NO: 7119136 - DNA, 22 bp, Homo sapiens
atctttcagggccatttgtatt

SEQ ID NO: 7119137 - DNA, 22 bp, Homo sapiens
atctttcaatcaggaaaaatct

SEQ ID NO: 7119138 - DNA, 22 bp, Homo sapiens
atctttcaatcaggaaaaatct

SEQ ID NO: 7119139 - DNA, 22 bp, Homo sapiens
cttctcctgtaagaagatcaaa

SEQ ID NO: 7119140 - DNA, 22 bp, Homo sapiens
cttctcctgtaagaagatcaaa

SEQ ID NO: 7119141 - DNA, 19 bp, Homo sapiens
atcttgggaaatggtaact

SEQ ID NO: 7119142 - DNA, 22 bp, Homo sapiens
atcttgggaattttccaggagt

SEQ ID NO: 7119143 - DNA, 20 bp, Homo sapiens
atcttgggacagggcacatg

SEQ ID NO: 7119144 - DNA, 22 bp, Homo sapiens
atcttgggacatgtgctctggg

SEQ ID NO: 7119145 - DNA, 21 bp, Homo sapiens
atctttattacgcagagaaga

SEQ ID NO: 7119146 - DNA, 22 bp, Homo sapiens
atctttcctgttttcagacagc

SEQ ID NO: 7119147 - DNA, 22 bp, Homo sapiens
atctttctatggtactttctcc

SEQ ID NO: 7119148 - DNA, 22 bp, Homo sapiens
atctttctatggtactttctcc

SEQ ID NO: 7119149 - DNA, 22 bp, Homo sapiens
atctttctatggtactttctcc

SEQ ID NO: 7119150 - DNA, 22 bp, Homo sapiens
atctttctatttctaaaaacta

SEQ ID NO: 7119151 - DNA, 22 bp, Homo sapiens
atctttctatttctaaaaacta

SEQ ID NO: 7119152 - DNA, 22 bp, Homo sapiens
atctttctatttctaaaaacta

SEQ ID NO: 7119153 - DNA, 22 bp, Homo sapiens
atctttctctgcactatacaat

SEQ ID NO: 7119154 - DNA, 22 bp, Homo sapiens
atctttctccatatacatcttt

SEQ ID NO: 7119155 - DNA, 22 bp, Homo sapiens
atctttctccatatacatcttt

SEQ ID NO: 7119156 - DNA, 22 bp, Homo sapiens
atctttctccatatacatcttt

SEQ ID NO: 7119157 - DNA, 22 bp, Homo sapiens
atctttctctgcactatacaat

SEQ ID NO: 7119158 - DNA, 22 bp, Homo sapiens
atctttctctgcactatacaat

SEQ ID NO: 7119159 - DNA, 22 bp, Homo sapiens
atctttctctgcactatacaat

SEQ ID NO: 7119160 - DNA, 22 bp, Homo sapiens
atctttcttatttgaagaaaga

SEQ ID NO: 7119161 - DNA, 22 bp, Homo sapiens
atctttcttatttgaagaaaga

SEQ ID NO: 7119162 - DNA, 19 bp, Homo sapiens
ctttttcaccttctagaag

SEQ ID NO: 7119163 - DNA, 22 bp, Homo sapiens
ctttttatagctatgtcctatg

SEQ ID NO: 7119164 - DNA, 22 bp, Homo sapiens
ctttttatctcttaatgatgtt

SEQ ID NO: 7119165 - DNA, 22 bp, Homo sapiens
ctttttatctcttaatgatgtt

SEQ ID NO: 7119166 - DNA, 22 bp, Homo sapiens
ctttttatctcttaatgatgtt

SEQ ID NO: 7119167 - DNA, 22 bp, Homo sapiens
ctttttcattggctttaggaca

SEQ ID NO: 7119168 - DNA, 19 bp, Homo sapiens
ctttttcaccttctagaag

SEQ ID NO: 7119169 - DNA, 22 bp, Homo sapiens
ctttttccagcttcagggtggg

SEQ ID NO: 7119170 - DNA, 22 bp, Homo sapiens
atgacatgattgccatttgata

SEQ ID NO: 7119171 - DNA, 22 bp, Homo sapiens
atgacatgcgaatgtactggag

SEQ ID NO: 7119172 - DNA, 22 bp, Homo sapiens
atgacatggtgcagacagtgtc

SEQ ID NO: 7119173 - DNA, 22 bp, Homo sapiens
atgacatggtgcagacagtgtc

SEQ ID NO: 7119174 - DNA, 22 bp, Homo sapiens
atgacatgtactgctctctcat

SEQ ID NO: 7119175 - DNA, 22 bp, Homo sapiens
atgacatgtcctagttggtcta

SEQ ID NO: 7119176 - DNA, 22 bp, Homo sapiens
atgacatgttccctttttctca

SEQ ID NO: 7119177 - DNA, 22 bp, Homo sapiens
atgacatgttgggaaccctgct

SEQ ID NO: 7119178 - DNA, 22 bp, Homo sapiens
atgacagatagtcttcatttgc

SEQ ID NO: 7119179 - DNA, 22 bp, Homo sapiens
atgacagatagtcttcatttgc

SEQ ID NO: 7119180 - DNA, 19 bp, Homo sapiens
atgacagagttgataagtg

SEQ ID NO: 7119181 - DNA, 19 bp, Homo sapiens
atgacagagttgataagtg

SEQ ID NO: 7119182 - DNA, 22 bp, Homo sapiens
atgacagatagtcttcatttgc

SEQ ID NO: 7119183 - DNA, 22 bp, Homo sapiens
atgacagaggattgtaaagagg

SEQ ID NO: 7119184 - DNA, 22 bp, Homo sapiens
atgacagaggattgtaaagagg

SEQ ID NO: 7119185 - DNA, 22 bp, Homo sapiens
atgacagaggattgtaaagagg

SEQ ID NO: 7119186 - DNA, 19 bp, Homo sapiens
atgacagagttgataagtg

SEQ ID NO: 7119187 - DNA, 22 bp, Homo sapiens
atgacagaccctctaaagacaa

SEQ ID NO: 7119188 - DNA, 22 bp, Homo sapiens
atgacagaccctctaaagacaa

SEQ ID NO: 7119189 - DNA, 22 bp, Homo sapiens
atgacagaggagtgcaggtgat

SEQ ID NO: 7119190 - DNA, 22 bp, Homo sapiens
atgacagaggagtgcaggtgat

SEQ ID NO: 7119191 - DNA, 22 bp, Homo sapiens
atgacagaggattgtaaagagg

SEQ ID NO: 7119192 - DNA, 22 bp, Homo sapiens
atgacagaggattgtaaagagg

SEQ ID NO: 7119193 - DNA, 22 bp, Homo sapiens
cttttgttgcccttgtcgcagg

SEQ ID NO: 7119194 - DNA, 18 bp, Homo sapiens
cttttgttttccctcctc

SEQ ID NO: 7119195 - DNA, 21 bp, Homo sapiens
ctttttactcgttcatatgca

SEQ ID NO: 7119196 - DNA, 22 bp, Homo sapiens
ctttttactctgttgtctcagc

SEQ ID NO: 7119197 - DNA, 22 bp, Homo sapiens
ctttttatagctatgtcctatg

SEQ ID NO: 7119198 - DNA, 22 bp, Homo sapiens
ctttttatagctatgtcctatg

SEQ ID NO: 7119199 - DNA, 22 bp, Homo sapiens
ctttttataccgtgccagttga

SEQ ID NO: 7119200 - DNA, 22 bp, Homo sapiens
ctttttataccgtgccagttga

SEQ ID NO: 7119201 - DNA, 22 bp, Homo sapiens
atgagaataaaggtgatttcga

SEQ ID NO: 7119202 - DNA, 22 bp, Homo sapiens
atgagaatgcattcatgttttg

SEQ ID NO: 7119203 - DNA, 22 bp, Homo sapiens
atgagaatggtgattctgcaga

SEQ ID NO: 7119204 - DNA, 22 bp, Homo sapiens
atgagacaagagtctaaattca

SEQ ID NO: 7119205 - DNA, 22 bp, Homo sapiens
atgagacacatgtgacttcttt

SEQ ID NO: 7119206 - DNA, 22 bp, Homo sapiens
atgagacattgcaagtccagaa

SEQ ID NO: 7119207 - DNA, 22 bp, Homo sapiens
atgagagacaggaacgagctgg

SEQ ID NO: 7119208 - DNA, 22 bp, Homo sapiens
atgagagacaggaacgagctgg

SEQ ID NO: 7119209 - DNA, 22 bp, Homo sapiens
atgagagacaggaacgagctgg

SEQ ID NO: 7119210 - DNA, 22 bp, Homo sapiens
atgagagactgtgtgttgggag

SEQ ID NO: 7119211 - DNA, 22 bp, Homo sapiens
atgagagactgtgtgttgggag

SEQ ID NO: 7119212 - DNA, 22 bp, Homo sapiens
atgagaaagttaatcatcatga

SEQ ID NO: 7119213 - DNA, 22 bp, Homo sapiens
atgagaaatttattacaagcta

SEQ ID NO: 7119214 - DNA, 22 bp, Homo sapiens
atgagaaatttattacaagcta

SEQ ID NO: 7119215 - DNA, 22 bp, Homo sapiens
atgacattgaatatgttaacta

SEQ ID NO: 7119216 - DNA, 22 bp, Homo sapiens
atgagaaagttaatcatcatga

SEQ ID NO: 7119217 - DNA, 22 bp, Homo sapiens
atgagaaagttaatcatcatga

SEQ ID NO: 7119218 - DNA, 22 bp, Homo sapiens
atgagattttaaaacttcactt

SEQ ID NO: 7119219 - DNA, 22 bp, Homo sapiens
atgagcaaccttctcctccagc

SEQ ID NO: 7119220 - DNA, 22 bp, Homo sapiens
atgagcaaccttctcctccagc

SEQ ID NO: 7119221 - DNA, 22 bp, Homo sapiens
atgagcaagagctatgtacaga

SEQ ID NO: 7119222 - DNA, 22 bp, Homo sapiens
atgagcaagagctatgtacaga

SEQ ID NO: 7119223 - DNA, 22 bp, Homo sapiens
atgagcaagagctatgtacaga

SEQ ID NO: 7119224 - DNA, 22 bp, Homo sapiens
atgagcaagagctatgtacaga

SEQ ID NO: 7119225 - DNA, 22 bp, Homo sapiens
atgagcaagccagttccagagt

SEQ ID NO: 7119226 - DNA, 22 bp, Homo sapiens
atgagcaaggctttgtgatagt

SEQ ID NO: 7119227 - DNA, 19 bp, Homo sapiens
atgagcaatagttttaatc

SEQ ID NO: 7119228 - DNA, 22 bp, Homo sapiens
atgagcaattaaattgcaccag

SEQ ID NO: 7119229 - DNA, 22 bp, Homo sapiens
atgagcaattaggaagaaaaca

SEQ ID NO: 7119230 - DNA, 22 bp, Homo sapiens
atgagcacactgataagcccct

SEQ ID NO: 7119231 - DNA, 22 bp, Homo sapiens
atgagcacactgataagcccct

SEQ ID NO: 7119232 - DNA, 23 bp, Homo sapiens
atgagcacaaacagcaaaaggga

SEQ ID NO: 7119233 - DNA, 23 bp, Homo sapiens
atgagcacccactatggaattgc

SEQ ID NO: 7119234 - DNA, 22 bp, Homo sapiens
atgagagctctatgatctgttt

SEQ ID NO: 7119235 - DNA, 18 bp, Homo sapiens
atgagaggtgtcagaaga

SEQ ID NO: 7119236 - DNA, 22 bp, Homo sapiens
atgagaggtttcgtcagaggaa

SEQ ID NO: 7119237 - DNA, 22 bp, Homo sapiens
atgagaggtttcgtcagaggaa

SEQ ID NO: 7119238 - DNA, 22 bp, Homo sapiens
atgagagtactagaaacttcct

SEQ ID NO: 7119239 - DNA, 21 bp, Homo sapiens
atgagagtaatgctataaatt

SEQ ID NO: 7119240 - DNA, 21 bp, Homo sapiens
atgagagtaatgctataaatt

SEQ ID NO: 7119241 - DNA, 22 bp, Homo sapiens
atgagagtctcagagtctcttc

SEQ ID NO: 7119242 - DNA, 22 bp, Homo sapiens
atgagatgtgtctaatggaacc

SEQ ID NO: 7119243 - DNA, 22 bp, Homo sapiens
atgagataggaacaaacttaca

SEQ ID NO: 7119244 - DNA, 22 bp, Homo sapiens
ctttgccaaaagctgcaggtgg

SEQ ID NO: 7119245 - DNA, 22 bp, Homo sapiens
ctttgccatgttgcctgcagaa

SEQ ID NO: 7119246 - DNA, 22 bp, Homo sapiens
ctttgccatgttgcctgcagaa

SEQ ID NO: 7119247 - DNA, 22 bp, Homo sapiens
ctttctttgcagtgagccagag

SEQ ID NO: 7119248 - DNA, 22 bp, Homo sapiens
ctttctttgcagtgagccagag

SEQ ID NO: 7119249 - DNA, 22 bp, Homo sapiens
ctttcaaaacgctctgtatgca

SEQ ID NO: 7119250 - DNA, 22 bp, Homo sapiens
ctttcaaaacgctctgtatgca

SEQ ID NO: 7119251 - DNA, 22 bp, Homo sapiens
ctttcaaaacgctctgtatgca

SEQ ID NO: 7119252 - DNA, 22 bp, Homo sapiens
ctttctttcgaagacgtgatta

SEQ ID NO: 7119253 - DNA, 22 bp, Homo sapiens
ctttgcctcctagagcacgttc

SEQ ID NO: 7119254 - DNA, 22 bp, Homo sapiens
ctttgcgcaacaccttcgccat

SEQ ID NO: 7119255 - DNA, 22 bp, Homo sapiens
ctttgctagtgtttcagtagac

SEQ ID NO: 7119256 - DNA, 22 bp, Homo sapiens
ctttgcttctccaacctgctca

SEQ ID NO: 7119257 - DNA, 22 bp, Homo sapiens
ctttgcttctccaacctgctca

SEQ ID NO: 7119258 - DNA, 22 bp, Homo sapiens
ctttggaaaagcataccaagga

SEQ ID NO: 7119259 - DNA, 22 bp, Homo sapiens
ctttggaaaaatacctggcata

SEQ ID NO: 7119260 - DNA, 22 bp, Homo sapiens
ctttggaaaaagtgactggctc

SEQ ID NO: 7119261 - DNA, 22 bp, Homo sapiens
ctttggaaagtaagcagctaga

SEQ ID NO: 7119262 - DNA, 22 bp, Homo sapiens
ctttggaacaagaagaaatggc

SEQ ID NO: 7119263 - DNA, 22 bp, Homo sapiens
ctttggcattagcctgtataga

SEQ ID NO: 7119264 - DNA, 22 bp, Homo sapiens
ctttggctgacaggtttctggt

SEQ ID NO: 7119265 - DNA, 22 bp, Homo sapiens
atgacaaaagaagacatgaggt

SEQ ID NO: 7119266 - DNA, 22 bp, Homo sapiens
atgacaaaagaagacatgaggt

SEQ ID NO: 7119267 - DNA, 22 bp, Homo sapiens
atgacaaaagaagacatgaggt

SEQ ID NO: 7119268 - DNA, 22 bp, Homo sapiens
atgacaatggacatagttaaaa

SEQ ID NO: 7119269 - DNA, 22 bp, Homo sapiens
atgacaaaagaagacatgaggt

SEQ ID NO: 7119270 - DNA, 22 bp, Homo sapiens
atgacaaaagaagacatgaggt

SEQ ID NO: 7119271 - DNA, 22 bp, Homo sapiens
atgacacaagagcagaagccat

SEQ ID NO: 7119272 - DNA, 22 bp, Homo sapiens
atgacacaagagcagaagccat

SEQ ID NO: 7119273 - DNA, 22 bp, Homo sapiens
atgacacaattttagagctgaa

SEQ ID NO: 7119274 - DNA, 22 bp, Homo sapiens
atgacacaattttagagctgaa

SEQ ID NO: 7119275 - DNA, 22 bp, Homo sapiens
atgacacaattttagagctgaa

SEQ ID NO: 7119276 - DNA, 22 bp, Homo sapiens
atgacacataaaacaaggactg

SEQ ID NO: 7119277 - DNA, 22 bp, Homo sapiens
atgacacataaaacaaggactg

SEQ ID NO: 7119278 - DNA, 22 bp, Homo sapiens
atgacacatttgtgctgttgaa

SEQ ID NO: 7119279 - DNA, 22 bp, Homo sapiens
atgacaccatattagcctagag

SEQ ID NO: 7119280 - DNA, 22 bp, Homo sapiens
atgacagaaggcctccctgaca

SEQ ID NO: 7119281 - DNA, 22 bp, Homo sapiens
atgacagacagaagggattttt

SEQ ID NO: 7119282 - DNA, 22 bp, Homo sapiens
atgacagacagaagggattttt

SEQ ID NO: 7119283 - DNA, 22 bp, Homo sapiens
atgacagaccctctaaagacaa

SEQ ID NO: 7119284 - DNA, 22 bp, Homo sapiens
atgacacccccacagcattgtt

SEQ ID NO: 7119285 - DNA, 23 bp, Homo sapiens
atgacactcctgtgcgcaccctg

SEQ ID NO: 7119286 - DNA, 23 bp, Homo sapiens
atgacactcctgtgcgcaccctg

SEQ ID NO: 7119287 - DNA, 23 bp, Homo sapiens
atgacactcctgtgcgcaccctg

SEQ ID NO: 7119288 - DNA, 22 bp, Homo sapiens
atgacactgtcctagtaaggaa

SEQ ID NO: 7119289 - DNA, 22 bp, Homo sapiens
ctttgggcactgaagtatgggt

SEQ ID NO: 7119290 - DNA, 22 bp, Homo sapiens
ctttgggcaaagggccaattcg

SEQ ID NO: 7119291 - DNA, 20 bp, Homo sapiens
ctttgggtttctcatgtaca

SEQ ID NO: 7119292 - DNA, 22 bp, Homo sapiens
ctttggtaaatgtcaaaaagtt

SEQ ID NO: 7119293 - DNA, 22 bp, Homo sapiens
ctttggtaccaccccagagtgg

SEQ ID NO: 7119294 - DNA, 22 bp, Homo sapiens
ctttggtaccaccccagagtgg

SEQ ID NO: 7119295 - DNA, 22 bp, Homo sapiens
ctttggtacgctttacatgttt

SEQ ID NO: 7119296 - DNA, 22 bp, Homo sapiens
ctttggtacgctttacatgttt

SEQ ID NO: 7119297 - DNA, 22 bp, Homo sapiens
ctttgggatttcatgagagcta

SEQ ID NO: 7119298 - DNA, 22 bp, Homo sapiens
ctttggtatcttactagtattt

SEQ ID NO: 7119299 - DNA, 21 bp, Homo sapiens
ctttggtatttcactcacata

SEQ ID NO: 7119300 - DNA, 21 bp, Homo sapiens
ctttggtatttcactcacata

SEQ ID NO: 7119301 - DNA, 22 bp, Homo sapiens
atgaatttttctaagcttttgt

SEQ ID NO: 7119302 - DNA, 22 bp, Homo sapiens
atgaatttttctaagcttttgt

SEQ ID NO: 7119303 - DNA, 22 bp, Homo sapiens
ctttggctgggcaaagggaggt

SEQ ID NO: 7119304 - DNA, 22 bp, Homo sapiens
ctttggcttgcactattacact

SEQ ID NO: 7119305 - DNA, 22 bp, Homo sapiens
ctttggcttgccctggcagtac

SEQ ID NO: 7119306 - DNA, 22 bp, Homo sapiens
ctttggcttgccctggcagtac

SEQ ID NO: 7119307 - DNA, 22 bp, Homo sapiens
gaaggagggagcggcgcggatt

SEQ ID NO: 7119308 - DNA, 22 bp, Homo sapiens
gaaggagggagcggcgcggatt

SEQ ID NO: 7119309 - DNA, 22 bp, Homo sapiens
gaaggagggtgcggatctgagc

SEQ ID NO: 7119310 - DNA, 22 bp, Homo sapiens
gaaggcaacaccaggatgcact

SEQ ID NO: 7119311 - DNA, 22 bp, Homo sapiens
gaaggatttgagattatcctag

SEQ ID NO: 7119312 - DNA, 22 bp, Homo sapiens
atgcaggagagcatgtttaaga

SEQ ID NO: 7119313 - DNA, 22 bp, Homo sapiens
atgcaggaggactaaagggatg

SEQ ID NO: 7119314 - DNA, 22 bp, Homo sapiens
gaaggatttgagattatcctag

SEQ ID NO: 7119315 - DNA, 22 bp, Homo sapiens
gaaggaggtctgcattctacag

SEQ ID NO: 7119316 - DNA, 22 bp, Homo sapiens
atgcagtgtttggaagcttaag

SEQ ID NO: 7119317 - DNA, 22 bp, Homo sapiens
atgcagtgtttggaagcttaag

SEQ ID NO: 7119318 - DNA, 22 bp, Homo sapiens
atgcagttagcactacagaaga

SEQ ID NO: 7119319 - DNA, 22 bp, Homo sapiens
atgcagttagcactacagaaga

SEQ ID NO: 7119320 - DNA, 22 bp, Homo sapiens
atgcagttagcactacagaaga

SEQ ID NO: 7119321 - DNA, 22 bp, Homo sapiens
atgcagttagcagtagctcccc

SEQ ID NO: 7119322 - DNA, 22 bp, Homo sapiens
atgcagttaggtaatagtctca

SEQ ID NO: 7119323 - DNA, 22 bp, Homo sapiens
atgcagttaggtaatagtctca

SEQ ID NO: 7119324 - DNA, 22 bp, Homo sapiens
atgcagttagtatacttccagt

SEQ ID NO: 7119325 - DNA, 22 bp, Homo sapiens
atgcagttatgtgagggcatga

SEQ ID NO: 7119326 - DNA, 22 bp, Homo sapiens
atgcagttccacaggcgcatgg

SEQ ID NO: 7119327 - DNA, 22 bp, Homo sapiens
atgcagtctaagcatgtaaggg

SEQ ID NO: 7119328 - DNA, 22 bp, Homo sapiens
atgcagtccacaggccacagtg

SEQ ID NO: 7119329 - DNA, 22 bp, Homo sapiens
atgcagtctaagcatgtaaggg

SEQ ID NO: 7119330 - DNA, 20 bp, Homo sapiens
atgcagtcttgtggcaacta

SEQ ID NO: 7119331 - DNA, 20 bp, Homo sapiens
atgcagtcttgtggcaacta

SEQ ID NO: 7119332 - DNA, 22 bp, Homo sapiens
atgcagtggcagctcctggtgt

SEQ ID NO: 7119333 - DNA, 22 bp, Homo sapiens
atgcagtggcagctcctggtgt

SEQ ID NO: 7119334 - DNA, 22 bp, Homo sapiens
atgcagtggcagctcctggtgt

SEQ ID NO: 7119335 - DNA, 22 bp, Homo sapiens
atgcagtggcagctcctggtgt

SEQ ID NO: 7119336 - DNA, 20 bp, Homo sapiens
atgcagtcttgtggcaacta

SEQ ID NO: 7119337 - DNA, 22 bp, Homo sapiens
atgcagtggcttcagtgtcagt

SEQ ID NO: 7119338 - DNA, 22 bp, Homo sapiens
atgcagtcatggaatgctctca

SEQ ID NO: 7119339 - DNA, 22 bp, Homo sapiens
atgcagtcatggaatgctctca

SEQ ID NO: 7119340 - DNA, 22 bp, Homo sapiens
atgcagtccaagctctagagtt

SEQ ID NO: 7119341 - DNA, 22 bp, Homo sapiens
atgcagtccacaggccacagtg

SEQ ID NO: 7119342 - DNA, 22 bp, Homo sapiens
atgcagtccacaggccacagtg

SEQ ID NO: 7119343 - DNA, 22 bp, Homo sapiens
atgcagtacagataattctaca

SEQ ID NO: 7119344 - DNA, 22 bp, Homo sapiens
atgcagtactgatacatgccac

SEQ ID NO: 7119345 - DNA, 22 bp, Homo sapiens
atgcagtacagataattctaca

SEQ ID NO: 7119346 - DNA, 22 bp, Homo sapiens
gaagctctcaaactctcccctt

SEQ ID NO: 7119347 - DNA, 22 bp, Homo sapiens
gaagctctcaacaatggggagt

SEQ ID NO: 7119348 - DNA, 22 bp, Homo sapiens
gaagctacagttgtcaaaggta

SEQ ID NO: 7119349 - DNA, 22 bp, Homo sapiens
gaagctgagctgaggcatgttg

SEQ ID NO: 7119350 - DNA, 22 bp, Homo sapiens
gaagctgagtggactctggcca

SEQ ID NO: 7119351 - DNA, 22 bp, Homo sapiens
gaaggaggcgttagccctagga

SEQ ID NO: 7119352 - DNA, 22 bp, Homo sapiens
gaaggaggcgttagccctagga

SEQ ID NO: 7119353 - DNA, 22 bp, Homo sapiens
gaaggaggcgttagccctagga

SEQ ID NO: 7119354 - DNA, 22 bp, Homo sapiens
gaaggagctactaataagaggg

SEQ ID NO: 7119355 - DNA, 22 bp, Homo sapiens
gaaggagctactaataagaggg

SEQ ID NO: 7119356 - DNA, 22 bp, Homo sapiens
gaagcctggagaccagatgttg

SEQ ID NO: 7119357 - DNA, 22 bp, Homo sapiens
gaagcagcagctggggacagtt

SEQ ID NO: 7119358 - DNA, 22 bp, Homo sapiens
gaagcagcaaatctgcagtatc

SEQ ID NO: 7119359 - DNA, 22 bp, Homo sapiens
gaagcagcaagtataggacagg

SEQ ID NO: 7119360 - DNA, 22 bp, Homo sapiens
gaagcagcaagtataggacagg

SEQ ID NO: 7119361 - DNA, 22 bp, Homo sapiens
gaagcctggtccagagctccca

SEQ ID NO: 7119362 - DNA, 22 bp, Homo sapiens
gaagcctggtccagagctccca

SEQ ID NO: 7119363 - DNA, 22 bp, Homo sapiens
gaagcggcatcaggaggctgcc

SEQ ID NO: 7119364 - DNA, 22 bp, Homo sapiens
gaagccttgaactgcaaacccc

SEQ ID NO: 7119365 - DNA, 22 bp, Homo sapiens
gaagccttgaactgcaaacccc

SEQ ID NO: 7119366 - DNA, 22 bp, Homo sapiens
atgatggatgtcacagtctgta

SEQ ID NO: 7119367 - DNA, 22 bp, Homo sapiens
gaagagctaaaggcacaggctt

SEQ ID NO: 7119368 - DNA, 22 bp, Homo sapiens
atgatggctaggctggttttga

SEQ ID NO: 7119369 - DNA, 22 bp, Homo sapiens
atgatggctaggctggttttga

SEQ ID NO: 7119370 - DNA, 22 bp, Homo sapiens
gaagagcatttgcccaggctgt

SEQ ID NO: 7119371 - DNA, 22 bp, Homo sapiens
gaagagcatttgcccaggctgt

SEQ ID NO: 7119372 - DNA, 22 bp, Homo sapiens
gaagagcatttgcccaggctgt

SEQ ID NO: 7119373 - DNA, 22 bp, Homo sapiens
gaagagcatttgcccaggctgt

SEQ ID NO: 7119374 - DNA, 22 bp, Homo sapiens
gaagagcatatgaagagcatat

SEQ ID NO: 7119375 - DNA, 22 bp, Homo sapiens
gaagagcatatgaagagcatat

SEQ ID NO: 7119376 - DNA, 22 bp, Homo sapiens
gaagagatgacaaaggagcatg

SEQ ID NO: 7119377 - DNA, 22 bp, Homo sapiens
gaagagatgacaaaggagcatg

SEQ ID NO: 7119378 - DNA, 21 bp, Homo sapiens
gaagagagtcctcatcctgag

SEQ ID NO: 7119379 - DNA, 22 bp, Homo sapiens
atgatgttggtttaatttgagt

SEQ ID NO: 7119380 - DNA, 23 bp, Homo sapiens
atgatgtttttggtagtcaaatg

SEQ ID NO: 7119381 - DNA, 22 bp, Homo sapiens
atgattactcccatttgataga

SEQ ID NO: 7119382 - DNA, 22 bp, Homo sapiens
atgatgttgataaattacttta

SEQ ID NO: 7119383 - DNA, 22 bp, Homo sapiens
atgatgttgataaattacttta

SEQ ID NO: 7119384 - DNA, 22 bp, Homo sapiens
atgatgtcatagtgtcagcagt

SEQ ID NO: 7119385 - DNA, 22 bp, Homo sapiens
atgatgtccacaggggtgttca

SEQ ID NO: 7119386 - DNA, 22 bp, Homo sapiens
atgatgttaccagtacttagag

SEQ ID NO: 7119387 - DNA, 22 bp, Homo sapiens
atgatgtactagttaaatatta

SEQ ID NO: 7119388 - DNA, 22 bp, Homo sapiens
gaagagagccgcgggacatcag

SEQ ID NO: 7119389 - DNA, 22 bp, Homo sapiens
gaagagagccgcgggacatcag

SEQ ID NO: 7119390 - DNA, 22 bp, Homo sapiens
gaagagagccgcgggacatcag

SEQ ID NO: 7119391 - DNA, 22 bp, Homo sapiens
gaagagagccgcgggacatcag

SEQ ID NO: 7119392 - DNA, 21 bp, Homo sapiens
gaagagagtcctcatcctgag

SEQ ID NO: 7119393 - DNA, 22 bp, Homo sapiens
gaagagagagtggggttctgcg

SEQ ID NO: 7119394 - DNA, 22 bp, Homo sapiens
gaagagagagtggggttctgcg

SEQ ID NO: 7119395 - DNA, 22 bp, Homo sapiens
gaagagagagtggggttctgcg

SEQ ID NO: 7119396 - DNA, 22 bp, Homo sapiens
gaagagagcagcaaactggagt

SEQ ID NO: 7119397 - DNA, 22 bp, Homo sapiens
gaagagagcagcaaactggagt

SEQ ID NO: 7119398 - DNA, 22 bp, Homo sapiens
gaagagagcagcaaactggagt

SEQ ID NO: 7119399 - DNA, 22 bp, Homo sapiens
gaagagagcagcaaactggagt

SEQ ID NO: 7119400 - DNA, 22 bp, Homo sapiens
gaagagagagccctggggtccg

SEQ ID NO: 7119401 - DNA, 22 bp, Homo sapiens
gaagagagagccctggggtccg

SEQ ID NO: 7119402 - DNA, 22 bp, Homo sapiens
gaagagagagccctggggtccg

SEQ ID NO: 7119403 - DNA, 22 bp, Homo sapiens
gaagagagagccctggggtccg

SEQ ID NO: 7119404 - DNA, 22 bp, Homo sapiens
gaagaaagggaattaacttgag

SEQ ID NO: 7119405 - DNA, 22 bp, Homo sapiens
gaagaaagggaattaacttgag

SEQ ID NO: 7119406 - DNA, 22 bp, Homo sapiens
gaagaaatgtgttcaaggtagg

SEQ ID NO: 7119407 - DNA, 22 bp, Homo sapiens
gaagaaatgtgttcaaggtagg

SEQ ID NO: 7119408 - DNA, 22 bp, Homo sapiens
gaagagagaacattacataaac

SEQ ID NO: 7119409 - DNA, 22 bp, Homo sapiens
atgagcatctgacatttaaaac

SEQ ID NO: 7119410 - DNA, 22 bp, Homo sapiens
atgagcatctgagccagtgact

SEQ ID NO: 7119411 - DNA, 22 bp, Homo sapiens
atgagcatctgagccagtgact

SEQ ID NO: 7119412 - DNA, 22 bp, Homo sapiens
atgagcatgtgactcaaaccaa

SEQ ID NO: 7119413 - DNA, 23 bp, Homo sapiens
atgagcatttttaatttctgtgg

SEQ ID NO: 7119414 - DNA, 23 bp, Homo sapiens
atgagcatttttaatttctgtgg

SEQ ID NO: 7119415 - DNA, 22 bp, Homo sapiens
atgagcagtttttaagtagcaa

SEQ ID NO: 7119416 - DNA, 22 bp, Homo sapiens
atgagcatatgggaggagtact

SEQ ID NO: 7119417 - DNA, 22 bp, Homo sapiens
atgagcatccagaacagtgcct

SEQ ID NO: 7119418 - DNA, 22 bp, Homo sapiens
atgagcaggaagagcacaaaga

SEQ ID NO: 7119419 - DNA, 22 bp, Homo sapiens
atgagcaggtttaagagaggcc

SEQ ID NO: 7119420 - DNA, 22 bp, Homo sapiens
atgagcaggtttaagagaggcc

SEQ ID NO: 7119421 - DNA, 22 bp, Homo sapiens
atgagcagtaggttcatggctg

SEQ ID NO: 7119422 - DNA, 22 bp, Homo sapiens
atgagcagtttttaagtagcaa

SEQ ID NO: 7119423 - DNA, 19 bp, Homo sapiens
atgagctggcatttcaggt

SEQ ID NO: 7119424 - DNA, 22 bp, Homo sapiens
atgagctagaaaaccatgtgga

SEQ ID NO: 7119425 - DNA, 22 bp, Homo sapiens
atgagcccagggaattcctttc

SEQ ID NO: 7119426 - DNA, 22 bp, Homo sapiens
atgagccctggaggcatttttt

SEQ ID NO: 7119427 - DNA, 22 bp, Homo sapiens
atgcctggactgtatcccagat

SEQ ID NO: 7119428 - DNA, 22 bp, Homo sapiens
gaatttcctctaaacccctgag

SEQ ID NO: 7119429 - DNA, 22 bp, Homo sapiens
gaatttctggaccctttgagaa

SEQ ID NO: 7119430 - DNA, 17 bp, Homo sapiens
gaatttcttggtcaaaa

SEQ ID NO: 7119431 - DNA, 17 bp, Homo sapiens
gaatttcttggtcaaaa

SEQ ID NO: 7119432 - DNA, 22 bp, Homo sapiens
atgctaaggcccaggagaaaat

SEQ ID NO: 7119433 - DNA, 22 bp, Homo sapiens
atgctaaggcccaggagaaaat

SEQ ID NO: 7119434 - DNA, 22 bp, Homo sapiens
atgctaaggcccaggagaaaat

SEQ ID NO: 7119435 - DNA, 22 bp, Homo sapiens
atgctaaatgttaatgttacct

SEQ ID NO: 7119436 - DNA, 22 bp, Homo sapiens
atgctaaattcagacagggtta

SEQ ID NO: 7119437 - DNA, 22 bp, Homo sapiens
atgctaaattcagacagggtta

SEQ ID NO: 7119438 - DNA, 22 bp, Homo sapiens
atgctacaacattatctggggt

SEQ ID NO: 7119439 - DNA, 22 bp, Homo sapiens
atgctacaacattatctggggt

SEQ ID NO: 7119440 - DNA, 23 bp, Homo sapiens
atgctacaccaacacaggggaat

SEQ ID NO: 7119441 - DNA, 22 bp, Homo sapiens
atgctacactatttgctgagca

SEQ ID NO: 7119442 - DNA, 22 bp, Homo sapiens
atgctacactatttgctgagca

SEQ ID NO: 7119443 - DNA, 22 bp, Homo sapiens
atgctacactccgcgaaaatgt

SEQ ID NO: 7119444 - DNA, 22 bp, Homo sapiens
atgctacactccgcgaaaatgt

SEQ ID NO: 7119445 - DNA, 22 bp, Homo sapiens
atgctacagagataggttgggt

SEQ ID NO: 7119446 - DNA, 22 bp, Homo sapiens
atgctacagagataggttgggt

SEQ ID NO: 7119447 - DNA, 22 bp, Homo sapiens
atgctacagagtttgaatatgt

SEQ ID NO: 7119448 - DNA, 22 bp, Homo sapiens
atgctacagagtttgaatatgt

SEQ ID NO: 7119449 - DNA, 22 bp, Homo sapiens
atgctacagagtttgaatatgt

SEQ ID NO: 7119450 - DNA, 22 bp, Homo sapiens
atgctacagcatctctcatcag

SEQ ID NO: 7119451 - DNA, 22 bp, Homo sapiens
atgcctggatttgggactcaaa

SEQ ID NO: 7119452 - DNA, 22 bp, Homo sapiens
atgcctggtatgaagcaaggaa

SEQ ID NO: 7119453 - DNA, 22 bp, Homo sapiens
atgctaaactatgatcattttc

SEQ ID NO: 7119454 - DNA, 22 bp, Homo sapiens
atgctaaagctttgctttcatt

SEQ ID NO: 7119455 - DNA, 22 bp, Homo sapiens
atgctaaaggggtaggcctcct

SEQ ID NO: 7119456 - DNA, 22 bp, Homo sapiens
atgctaaataactggtttgact

SEQ ID NO: 7119457 - DNA, 22 bp, Homo sapiens
atgctaaataactggtttgact

SEQ ID NO: 7119458 - DNA, 22 bp, Homo sapiens
atgctaaatccagaagcagtca

SEQ ID NO: 7119459 - DNA, 22 bp, Homo sapiens
atgctaaatccagaagcagtca

SEQ ID NO: 7119460 - DNA, 22 bp, Homo sapiens
atgctaaatgctgggggtacat

SEQ ID NO: 7119461 - DNA, 22 bp, Homo sapiens
atgctaaatgctgggggtacat

SEQ ID NO: 7119462 - DNA, 22 bp, Homo sapiens
atgctaaatggccagtaccaaa

SEQ ID NO: 7119463 - DNA, 16 bp, Homo sapiens
atgctgctattagagg

SEQ ID NO: 7119464 - DNA, 16 bp, Homo sapiens
atgctgctattagagg

SEQ ID NO: 7119465 - DNA, 22 bp, Homo sapiens
atgctctgggcttttgaagtgg

SEQ ID NO: 7119466 - DNA, 23 bp, Homo sapiens
atgctctgggctgtgggacctgc

SEQ ID NO: 7119467 - DNA, 20 bp, Homo sapiens
gacagcttggggtgtcacct

SEQ ID NO: 7119468 - DNA, 22 bp, Homo sapiens
gacaggaaacaagaaggcagga

SEQ ID NO: 7119469 - DNA, 22 bp, Homo sapiens
gacaggaaacaagaaggcagga

SEQ ID NO: 7119470 - DNA, 22 bp, Homo sapiens
gacagcttgcctggtactgcaa

SEQ ID NO: 7119471 - DNA, 22 bp, Homo sapiens
gacagcttcttgggccgggcct

SEQ ID NO: 7119472 - DNA, 22 bp, Homo sapiens
gacagcttctatgtgacgagca

SEQ ID NO: 7119473 - DNA, 22 bp, Homo sapiens
gacagcttctagaggaattggt

SEQ ID NO: 7119474 - DNA, 22 bp, Homo sapiens
gacagcttctagaaatggtcac

SEQ ID NO: 7119475 - DNA, 22 bp, Homo sapiens
gacagcttcgaggaggtgagct

SEQ ID NO: 7119476 - DNA, 22 bp, Homo sapiens
gacagcttagtgaaaatgtaaa

SEQ ID NO: 7119477 - DNA, 22 bp, Homo sapiens
atgctatagaaatatttaaatt

SEQ ID NO: 7119478 - DNA, 22 bp, Homo sapiens
atgctatagaaatatttaaatt

SEQ ID NO: 7119479 - DNA, 22 bp, Homo sapiens
atgctacagcatctctcatcag

SEQ ID NO: 7119480 - DNA, 22 bp, Homo sapiens
atgctacagcatctctcatcag

SEQ ID NO: 7119481 - DNA, 22 bp, Homo sapiens
atgctacagccctctttgcata

SEQ ID NO: 7119482 - DNA, 22 bp, Homo sapiens
atgctacagccctctttgcata

SEQ ID NO: 7119483 - DNA, 22 bp, Homo sapiens
atgctacaggaagacgtcaggc

SEQ ID NO: 7119484 - DNA, 22 bp, Homo sapiens
atgctacaggaagacgtcaggc

SEQ ID NO: 7119485 - DNA, 22 bp, Homo sapiens
atgctacaggagccccacttag

SEQ ID NO: 7119486 - DNA, 22 bp, Homo sapiens
atgctacaggagccccacttag

SEQ ID NO: 7119487 - DNA, 22 bp, Homo sapiens
atgctacaggattctccttatc

SEQ ID NO: 7119488 - DNA, 22 bp, Homo sapiens
atgctacaggattctccttatc

SEQ ID NO: 7119489 - DNA, 18 bp, Homo sapiens
atgctacaggcaggtgtc

SEQ ID NO: 7119490 - DNA, 22 bp, Homo sapiens
atgctacatagatacaaaaatg

SEQ ID NO: 7119491 - DNA, 22 bp, Homo sapiens
atgctacatagatacaaaaatg

SEQ ID NO: 7119492 - DNA, 22 bp, Homo sapiens
atgctacattttggtttataaa

SEQ ID NO: 7119493 - DNA, 22 bp, Homo sapiens
atgctactcattaagtttgtca

SEQ ID NO: 7119494 - DNA, 22 bp, Homo sapiens
atgctataaactctaggtcatt

SEQ ID NO: 7119495 - DNA, 22 bp, Homo sapiens
atgccactgcacttcagcctgg

SEQ ID NO: 7119496 - DNA, 22 bp, Homo sapiens
atgccactgcacttcagcctgg

SEQ ID NO: 7119497 - DNA, 22 bp, Homo sapiens
atgccactgcactccagcctgg

SEQ ID NO: 7119498 - DNA, 22 bp, Homo sapiens
atgccactgcacttcagcctgg

SEQ ID NO: 7119499 - DNA, 22 bp, Homo sapiens
atgccactgcacttcagcttgg

SEQ ID NO: 7119500 - DNA, 22 bp, Homo sapiens
atgccactgcacttcagcttgg

SEQ ID NO: 7119501 - DNA, 22 bp, Homo sapiens
atgccactgcacttcagcttgg

SEQ ID NO: 7119502 - DNA, 19 bp, Homo sapiens
gaatttatctcttcagtcc

SEQ ID NO: 7119503 - DNA, 22 bp, Homo sapiens
gaatttcaaagaggttaagagg

SEQ ID NO: 7119504 - DNA, 22 bp, Homo sapiens
gaatttcagaggtaacatcatc

SEQ ID NO: 7119505 - DNA, 22 bp, Homo sapiens
atgccactgcactccagcctgg

SEQ ID NO: 7119506 - DNA, 22 bp, Homo sapiens
atgccactgcactccagcctgg

SEQ ID NO: 7119507 - DNA, 22 bp, Homo sapiens
atgccactgcactccagcctgg

SEQ ID NO: 7119508 - DNA, 22 bp, Homo sapiens
atgccactgcactccagcctgg

SEQ ID NO: 7119509 - DNA, 22 bp, Homo sapiens
atgccactgcactccagcctgg

SEQ ID NO: 7119510 - DNA, 22 bp, Homo sapiens
atgccactgcactccagcctgg

SEQ ID NO: 7119511 - DNA, 22 bp, Homo sapiens
atgccactgcactccagcctgg

SEQ ID NO: 7119512 - DNA, 22 bp, Homo sapiens
atgccactgcactccagcctgg

SEQ ID NO: 7119513 - DNA, 22 bp, Homo sapiens
atgccactgcactccagcctgg

SEQ ID NO: 7119514 - DNA, 22 bp, Homo sapiens
atgccactgcactccagcctgg

SEQ ID NO: 7119515 - DNA, 22 bp, Homo sapiens
atgcatttgtaaaatataatcg

SEQ ID NO: 7119516 - DNA, 22 bp, Homo sapiens
atgccactgcactccagcctag

SEQ ID NO: 7119517 - DNA, 22 bp, Homo sapiens
atgccactgcactccagcctag

SEQ ID NO: 7119518 - DNA, 22 bp, Homo sapiens
atgccactgcactccagcctag

SEQ ID NO: 7119519 - DNA, 22 bp, Homo sapiens
atgccactgcactccagcctag

SEQ ID NO: 7119520 - DNA, 22 bp, Homo sapiens
atgccactgcactccagcctag

SEQ ID NO: 7119521 - DNA, 22 bp, Homo sapiens
atgccactgcactccagcctag

SEQ ID NO: 7119522 - DNA, 22 bp, Homo sapiens
atgccactgcactccagcctag

SEQ ID NO: 7119523 - DNA, 22 bp, Homo sapiens
atgcataaagaaagctatctgg

SEQ ID NO: 7119524 - DNA, 21 bp, Homo sapiens
gaagtacaccaggaaggccac

SEQ ID NO: 7119525 - DNA, 22 bp, Homo sapiens
atgcataaagaaagctatctgg

SEQ ID NO: 7119526 - DNA, 22 bp, Homo sapiens
atgcagtttgcttcgcagcagt

SEQ ID NO: 7119527 - DNA, 22 bp, Homo sapiens
atgcagttttaaatcatttcag

SEQ ID NO: 7119528 - DNA, 22 bp, Homo sapiens
atgcagttttaggggaagggtt

SEQ ID NO: 7119529 - DNA, 22 bp, Homo sapiens
atgcagttttcaaagactattc

SEQ ID NO: 7119530 - DNA, 22 bp, Homo sapiens
atgcagttgcaatggaggactc

SEQ ID NO: 7119531 - DNA, 18 bp, Homo sapiens
atgcagttggtactctca

SEQ ID NO: 7119532 - DNA, 22 bp, Homo sapiens
atgcagtttaaggcacaattag

SEQ ID NO: 7119533 - DNA, 22 bp, Homo sapiens
atgcagtttaaggcacaattag

SEQ ID NO: 7119534 - DNA, 22 bp, Homo sapiens
atgcagtttatctccaaatcat

SEQ ID NO: 7119535 - DNA, 22 bp, Homo sapiens
gaagtacagttttatctagcca

SEQ ID NO: 7119536 - DNA, 22 bp, Homo sapiens
gaagtacattctgatagggaag

SEQ ID NO: 7119537 - DNA, 22 bp, Homo sapiens
gaagtacattctgatagggaag

SEQ ID NO: 7119538 - DNA, 22 bp, Homo sapiens
gaagtattactctgaatgtatt

SEQ ID NO: 7119539 - DNA, 22 bp, Homo sapiens
gaagtctctctggagagtagaa

SEQ ID NO: 7119540 - DNA, 22 bp, Homo sapiens
gaagtctctctgggctcagttc

SEQ ID NO: 7119541 - DNA, 22 bp, Homo sapiens
gaagtctcacagacagatcaga

SEQ ID NO: 7119542 - DNA, 22 bp, Homo sapiens
gaagtctcatagttaaaattct

SEQ ID NO: 7119543 - DNA, 22 bp, Homo sapiens
gaagtctcatttggtgtcagtt

SEQ ID NO: 7119544 - DNA, 22 bp, Homo sapiens
gaagtctgctgctcaggagttt

SEQ ID NO: 7119545 - DNA, 22 bp, Homo sapiens
gaagtctgacaggtctgaatca

SEQ ID NO: 7119546 - DNA, 22 bp, Homo sapiens
atgcatttgacgggatatattt

SEQ ID NO: 7119547 - DNA, 22 bp, Homo sapiens
gaagtcagctccccaggtcccc

SEQ ID NO: 7119548 - DNA, 22 bp, Homo sapiens
gaagtcagtcatctcctgtctc

SEQ ID NO: 7119549 - DNA, 22 bp, Homo sapiens
gaagtcagtcatctcctgtctc

SEQ ID NO: 7119550 - DNA, 22 bp, Homo sapiens
gaagtcatgctcccatcttgct

SEQ ID NO: 7119551 - DNA, 22 bp, Homo sapiens
gaagtccaagatcaaggcccca

SEQ ID NO: 7119552 - DNA, 22 bp, Homo sapiens
gaagtccagaatactgctctga

SEQ ID NO: 7119553 - DNA, 22 bp, Homo sapiens
gaagtccagaatactgctctga

SEQ ID NO: 7119554 - DNA, 22 bp, Homo sapiens
gaagtccagatcaagtcaccag

SEQ ID NO: 7119555 - DNA, 23 bp, Homo sapiens
gaggagggtcgtgctgtgttcct

SEQ ID NO: 7119556 - DNA, 22 bp, Homo sapiens
gaggcacaatacatgtctcaag

SEQ ID NO: 7119557 - DNA, 22 bp, Homo sapiens
gaggaggggcacttgtctccta

SEQ ID NO: 7119558 - DNA, 22 bp, Homo sapiens
gaggaggggcacttgtctccta

SEQ ID NO: 7119559 - DNA, 23 bp, Homo sapiens
gaggagggtcgtgctgtgttcct

SEQ ID NO: 7119560 - DNA, 23 bp, Homo sapiens
gaggagggtcgtgctgtgttcct

SEQ ID NO: 7119561 - DNA, 22 bp, Homo sapiens
gaggaggggacagtacttgtgc

SEQ ID NO: 7119562 - DNA, 22 bp, Homo sapiens
gaggaggggcacttgtctccta

SEQ ID NO: 7119563 - DNA, 22 bp, Homo sapiens
gaggaggggcacttgtctccta

SEQ ID NO: 7119564 - DNA, 22 bp, Homo sapiens
gaggcacagagtaggtgcacac

SEQ ID NO: 7119565 - DNA, 22 bp, Homo sapiens
gaggcacagagtaggtgcacac

SEQ ID NO: 7119566 - DNA, 22 bp, Homo sapiens
gaggcacagagccctaggagct

SEQ ID NO: 7119567 - DNA, 22 bp, Homo sapiens
gaggcacagagccctaggagct

SEQ ID NO: 7119568 - DNA, 22 bp, Homo sapiens
gaggcacaccagggagtcttgt

SEQ ID NO: 7119569 - DNA, 22 bp, Homo sapiens
gaggcacaatacatgtctcaag

SEQ ID NO: 7119570 - DNA, 22 bp, Homo sapiens
gaggcacaccagggagtcttgt

SEQ ID NO: 7119571 - DNA, 22 bp, Homo sapiens
gaggcacagagccctaggagct

SEQ ID NO: 7119572 - DNA, 22 bp, Homo sapiens
gaggcacagtcccgaggcaagg

SEQ ID NO: 7119573 - DNA, 22 bp, Homo sapiens
gaggcacagtcccgaggcaagg

SEQ ID NO: 7119574 - DNA, 22 bp, Homo sapiens
gaggcacagtgtttggtcagtg

SEQ ID NO: 7119575 - DNA, 22 bp, Homo sapiens
gaggcacagtgtttggtcagtg

SEQ ID NO: 7119576 - DNA, 22 bp, Homo sapiens
gaggcacagtcccgaggcaagg

SEQ ID NO: 7119577 - DNA, 18 bp, Homo sapiens
gaggcacatagttggggc

SEQ ID NO: 7119578 - DNA, 22 bp, Homo sapiens
gaggcacagttcttcctccaga

SEQ ID NO: 7119579 - DNA, 18 bp, Homo sapiens
gaggcacatagttggggc

SEQ ID NO: 7119580 - DNA, 22 bp, Homo sapiens
gaggcacagtgtttggtcagtg

SEQ ID NO: 7119581 - DNA, 22 bp, Homo sapiens
atgtatcaacaaattgtacagt

SEQ ID NO: 7119582 - DNA, 22 bp, Homo sapiens
atgtagcttcctaggagtgatt

SEQ ID NO: 7119583 - DNA, 22 bp, Homo sapiens
atgtagcttgtcccacatcata

SEQ ID NO: 7119584 - DNA, 22 bp, Homo sapiens
atgtatcaacaaattgtacagt

SEQ ID NO: 7119585 - DNA, 22 bp, Homo sapiens
atgtatcaactgcaggcaagtt

SEQ ID NO: 7119586 - DNA, 22 bp, Homo sapiens
atgtatcaattatctgtctgca

SEQ ID NO: 7119587 - DNA, 22 bp, Homo sapiens
atgtatcaagggaaagagagta

SEQ ID NO: 7119588 - DNA, 22 bp, Homo sapiens
gaggcacatatatacagagccc

SEQ ID NO: 7119589 - DNA, 22 bp, Homo sapiens
atgtagctgcagatgataatgc

SEQ ID NO: 7119590 - DNA, 22 bp, Homo sapiens
atgtagctggggaggttgagtc

SEQ ID NO: 7119591 - DNA, 21 bp, Homo sapiens
atgtagcttacaagataaagg

SEQ ID NO: 7119592 - DNA, 22 bp, Homo sapiens
gaggcacatatatacagagccc

SEQ ID NO: 7119593 - DNA, 22 bp, Homo sapiens
gaggcacatatatacagagccc

SEQ ID NO: 7119594 - DNA, 22 bp, Homo sapiens
gaggcacatatatacagagccc

SEQ ID NO: 7119595 - DNA, 22 bp, Homo sapiens
gaggagggctttgttgatgtta

SEQ ID NO: 7119596 - DNA, 22 bp, Homo sapiens
gaggagggctttgttgatgtta

SEQ ID NO: 7119597 - DNA, 22 bp, Homo sapiens
gaggaggggacagtacttgtgc

SEQ ID NO: 7119598 - DNA, 22 bp, Homo sapiens
gaggaggggacagtacttgtgc

SEQ ID NO: 7119599 - DNA, 22 bp, Homo sapiens
gaggagggctttgttgatgtta

SEQ ID NO: 7119600 - DNA, 22 bp, Homo sapiens
gaggagggctttgttgatgtta

SEQ ID NO: 7119601 - DNA, 22 bp, Homo sapiens
gaggagggcagttcctctttta

SEQ ID NO: 7119602 - DNA, 22 bp, Homo sapiens
gaggagggcctggtgtcccttc

SEQ ID NO: 7119603 - DNA, 22 bp, Homo sapiens
gaggagggcctggtgtcccttc

SEQ ID NO: 7119604 - DNA, 22 bp, Homo sapiens
gaggagggcctggtgtcccttc

SEQ ID NO: 7119605 - DNA, 22 bp, Homo sapiens
gaggagggcctggtgtcccttc

SEQ ID NO: 7119606 - DNA, 22 bp, Homo sapiens
gaggagggcagttcctctttta

SEQ ID NO: 7119607 - DNA, 22 bp, Homo sapiens
gaggagggcagttcctctttta

SEQ ID NO: 7119608 - DNA, 22 bp, Homo sapiens
gaggagggcagttcctctttta

SEQ ID NO: 7119609 - DNA, 22 bp, Homo sapiens
gaggagggagctggaagctctt

SEQ ID NO: 7119610 - DNA, 22 bp, Homo sapiens
gaggagggagctggaagctctt

SEQ ID NO: 7119611 - DNA, 22 bp, Homo sapiens
gaggagggagctggaagctctt

SEQ ID NO: 7119612 - DNA, 22 bp, Homo sapiens
gaggagggagctggaagctctt

SEQ ID NO: 7119613 - DNA, 22 bp, Homo sapiens
gaggagggagctggaagctctt

SEQ ID NO: 7119614 - DNA, 22 bp, Homo sapiens
gaggagggagctggaagctctt

SEQ ID NO: 7119615 - DNA, 22 bp, Homo sapiens
gaggagggagctggaagctctt

SEQ ID NO: 7119616 - DNA, 22 bp, Homo sapiens
gaggagggagctggaagctctt

SEQ ID NO: 7119617 - DNA, 22 bp, Homo sapiens
gaggagggagctggaagctctt

SEQ ID NO: 7119618 - DNA, 22 bp, Homo sapiens
gaggagggagctggaagctctt

SEQ ID NO: 7119619 - DNA, 22 bp, Homo sapiens
atgggcagctgcagcagtggtg

SEQ ID NO: 7119620 - DNA, 22 bp, Homo sapiens
atgggcagcagctgtcattttc

SEQ ID NO: 7119621 - DNA, 22 bp, Homo sapiens
atgggcagcagctgtcattttc

SEQ ID NO: 7119622 - DNA, 22 bp, Homo sapiens
atgggcagcagctgtcattttc

SEQ ID NO: 7119623 - DNA, 22 bp, Homo sapiens
atgggcagctgcagcagtggtg

SEQ ID NO: 7119624 - DNA, 22 bp, Homo sapiens
atgggcagctgcagcagtggtg

SEQ ID NO: 7119625 - DNA, 22 bp, Homo sapiens
atgggcagagtggggacaggaa

SEQ ID NO: 7119626 - DNA, 22 bp, Homo sapiens
atgggcagagtggggacaggaa

SEQ ID NO: 7119627 - DNA, 22 bp, Homo sapiens
gagctgccggcccacagtacta

SEQ ID NO: 7119628 - DNA, 22 bp, Homo sapiens
atgggcagagtggggacaggaa

SEQ ID NO: 7119629 - DNA, 22 bp, Homo sapiens
atgggcagagtggggacaggaa

SEQ ID NO: 7119630 - DNA, 22 bp, Homo sapiens
atgggcagcagctgccattcat

SEQ ID NO: 7119631 - DNA, 22 bp, Homo sapiens
atgggcagcagctgccattcat

SEQ ID NO: 7119632 - DNA, 22 bp, Homo sapiens
atgggcagcagctgccattcat

SEQ ID NO: 7119633 - DNA, 22 bp, Homo sapiens
atgggcaggcactggctctcag

SEQ ID NO: 7119634 - DNA, 22 bp, Homo sapiens
atgggcaggcactggctctcag

SEQ ID NO: 7119635 - DNA, 22 bp, Homo sapiens
gaggagctgggtcagggagaca

SEQ ID NO: 7119636 - DNA, 22 bp, Homo sapiens
gaggagctgggtcagggagaca

SEQ ID NO: 7119637 - DNA, 22 bp, Homo sapiens
atgggcagctgcagcagtggtg

SEQ ID NO: 7119638 - DNA, 22 bp, Homo sapiens
atgggcagctgcagcagtggtg

SEQ ID NO: 7119639 - DNA, 22 bp, Homo sapiens
atgggcagctgcagcagtggtg

SEQ ID NO: 7119640 - DNA, 22 bp, Homo sapiens
atgggcaggcaaggtggcgagt

SEQ ID NO: 7119641 - DNA, 22 bp, Homo sapiens
atgggcaggcaaggtggcgagt

SEQ ID NO: 7119642 - DNA, 22 bp, Homo sapiens
atgtatttctatgtagtgaaga

SEQ ID NO: 7119643 - DNA, 22 bp, Homo sapiens
gaggcctgggttggaggtgcat

SEQ ID NO: 7119644 - DNA, 22 bp, Homo sapiens
gaggcctgggttggaggtgcat

SEQ ID NO: 7119645 - DNA, 22 bp, Homo sapiens
gaggcctgggttggaggtgcat

SEQ ID NO: 7119646 - DNA, 22 bp, Homo sapiens
gaggcctgggttggaggtgcat

SEQ ID NO: 7119647 - DNA, 23 bp, Homo sapiens
atgtatttaaatttcagtgatga

SEQ ID NO: 7119648 - DNA, 22 bp, Homo sapiens
atgtatttactgagaaggaaac

SEQ ID NO: 7119649 - DNA, 22 bp, Homo sapiens
atgtatttactgagaaggaaac

SEQ ID NO: 7119650 - DNA, 22 bp, Homo sapiens
atgtatttctatgtagtgaaga

SEQ ID NO: 7119651 - DNA, 22 bp, Homo sapiens
atgtattgtctcttttccttaa

SEQ ID NO: 7119652 - DNA, 23 bp, Homo sapiens
atgtatttaaatttcagtgatga

SEQ ID NO: 7119653 - DNA, 23 bp, Homo sapiens
atgtatttaaatttcagtgatga

SEQ ID NO: 7119654 - DNA, 22 bp, Homo sapiens
gaggctctggagtaggtacaca

SEQ ID NO: 7119655 - DNA, 22 bp, Homo sapiens
gaggctcttcaataggtcaatg

SEQ ID NO: 7119656 - DNA, 22 bp, Homo sapiens
gaggctcttcaataggtcaatg

SEQ ID NO: 7119657 - DNA, 22 bp, Homo sapiens
gaggctccggtagtagccttga

SEQ ID NO: 7119658 - DNA, 22 bp, Homo sapiens
gaggctccccatgaggccccag

SEQ ID NO: 7119659 - DNA, 22 bp, Homo sapiens
gaggctccctcaactctgggtg

SEQ ID NO: 7119660 - DNA, 22 bp, Homo sapiens
atgtattcaagccacatacatt

SEQ ID NO: 7119661 - DNA, 22 bp, Homo sapiens
atgtattcaagccacatacatt

SEQ ID NO: 7119662 - DNA, 22 bp, Homo sapiens
atgtattcaagccacatacatt

SEQ ID NO: 7119663 - DNA, 22 bp, Homo sapiens
atgtatgttcaagcaatgatta

SEQ ID NO: 7119664 - DNA, 22 bp, Homo sapiens
atgtatgtttctatatatgaca

SEQ ID NO: 7119665 - DNA, 22 bp, Homo sapiens
atgtatgtgagctttgagatca

SEQ ID NO: 7119666 - DNA, 23 bp, Homo sapiens
atgtatctcatccaaggaagctc

SEQ ID NO: 7119667 - DNA, 22 bp, Homo sapiens
atgtatccttttaagaagaaaa

SEQ ID NO: 7119668 - DNA, 23 bp, Homo sapiens
atgtatctcatccaaggaagctc

SEQ ID NO: 7119669 - DNA, 22 bp, Homo sapiens
atgtatcatgcagggtccatga

SEQ ID NO: 7119670 - DNA, 22 bp, Homo sapiens
atgtatcacagcaatgtagtca

SEQ ID NO: 7119671 - DNA, 22 bp, Homo sapiens
atgtatcacagcaatgtagtca

SEQ ID NO: 7119672 - DNA, 22 bp, Homo sapiens
atgtatcagaaatagcattggc

SEQ ID NO: 7119673 - DNA, 22 bp, Homo sapiens
atgtatcagataaagcatgtgg

SEQ ID NO: 7119674 - DNA, 22 bp, Homo sapiens
atgtatgtagtgtacatataca

SEQ ID NO: 7119675 - DNA, 22 bp, Homo sapiens
atgtatggggtgtatgggatca

SEQ ID NO: 7119676 - DNA, 22 bp, Homo sapiens
atgtgccacatgatattgtctc

SEQ ID NO: 7119677 - DNA, 22 bp, Homo sapiens
atgtgccatctactgtcccaag

SEQ ID NO: 7119678 - DNA, 22 bp, Homo sapiens
atgtgaggttaacctactgtta

SEQ ID NO: 7119679 - DNA, 22 bp, Homo sapiens
atgtgcccctgttttgaattgt

SEQ ID NO: 7119680 - DNA, 22 bp, Homo sapiens
atgtgcctgtgtttggagttaa

SEQ ID NO: 7119681 - DNA, 22 bp, Homo sapiens
atgtgccttcatcctccctgtc

SEQ ID NO: 7119682 - DNA, 22 bp, Homo sapiens
atgtgcgaggtgcttgtcagca

SEQ ID NO: 7119683 - DNA, 22 bp, Homo sapiens
atgtgcgtgtgtacatatatat

SEQ ID NO: 7119684 - DNA, 22 bp, Homo sapiens
atgtgaggtagataggatgcag

SEQ ID NO: 7119685 - DNA, 22 bp, Homo sapiens
atgtcatctcttaaaaattgca

SEQ ID NO: 7119686 - DNA, 22 bp, Homo sapiens
atgtgaggtagataggatgcag

SEQ ID NO: 7119687 - DNA, 22 bp, Homo sapiens
atgtcataaatatactgttcct

SEQ ID NO: 7119688 - DNA, 22 bp, Homo sapiens
atgtcaggaccctactgcattg

SEQ ID NO: 7119689 - DNA, 22 bp, Homo sapiens
atgtcaggaccctactgcattg

SEQ ID NO: 7119690 - DNA, 21 bp, Homo sapiens
atgtcaggcacttatgaggaa

SEQ ID NO: 7119691 - DNA, 22 bp, Homo sapiens
atgtcacttttgagactaggtt

SEQ ID NO: 7119692 - DNA, 22 bp, Homo sapiens
atgtcacttttctccctgctgg

SEQ ID NO: 7119693 - DNA, 22 bp, Homo sapiens
gaggctgaacaggttctcatga

SEQ ID NO: 7119694 - DNA, 22 bp, Homo sapiens
gaggctgaacaggttctcatga

SEQ ID NO: 7119695 - DNA, 22 bp, Homo sapiens
atgtcagaagaacaatgagata

SEQ ID NO: 7119696 - DNA, 22 bp, Homo sapiens
atgtcagaagctggatgacagc

SEQ ID NO: 7119697 - DNA, 22 bp, Homo sapiens
atgtcagaagctggatgacagc

SEQ ID NO: 7119698 - DNA, 22 bp, Homo sapiens
atgtcagaatctacattctact

SEQ ID NO: 7119699 - DNA, 22 bp, Homo sapiens
atgtcagaatctacattctact

SEQ ID NO: 7119700 - DNA, 22 bp, Homo sapiens
atgtcagaatctacattctact

SEQ ID NO: 7119701 - DNA, 22 bp, Homo sapiens
atgtcagagcttccacaatagt

SEQ ID NO: 7119702 - DNA, 22 bp, Homo sapiens
atgtcagagcttccacaatagt

SEQ ID NO: 7119703 - DNA, 22 bp, Homo sapiens
atgtcagatcctcagaaagtct

SEQ ID NO: 7119704 - DNA, 22 bp, Homo sapiens
atgtcagatgtttatctgattt

SEQ ID NO: 7119705 - DNA, 22 bp, Homo sapiens
atgtcagatgtttatctgattt

SEQ ID NO: 7119706 - DNA, 22 bp, Homo sapiens
atgtcagattcctaaatatctt

SEQ ID NO: 7119707 - DNA, 22 bp, Homo sapiens
atgtggcctagtatagaaatga

SEQ ID NO: 7119708 - DNA, 22 bp, Homo sapiens
atgtggcctagtatagaaatga

SEQ ID NO: 7119709 - DNA, 22 bp, Homo sapiens
atgtggcctagtatagaaatga

SEQ ID NO: 7119710 - DNA, 22 bp, Homo sapiens
atgtggccttaatgacagcagc

SEQ ID NO: 7119711 - DNA, 22 bp, Homo sapiens
atgtggcccagcggtcaggctg

SEQ ID NO: 7119712 - DNA, 22 bp, Homo sapiens
atgtggcccagcggtcaggctg

SEQ ID NO: 7119713 - DNA, 22 bp, Homo sapiens
atgtggccagtcatgtagtaac

SEQ ID NO: 7119714 - DNA, 22 bp, Homo sapiens
atgtggccagtcatgtagtaac

SEQ ID NO: 7119715 - DNA, 21 bp, Homo sapiens
atgtggccattgtagtccacg

SEQ ID NO: 7119716 - DNA, 21 bp, Homo sapiens
atgtggccattgtagtccacg

SEQ ID NO: 7119717 - DNA, 22 bp, Homo sapiens
atgtggaatgaacaaaggaggc

SEQ ID NO: 7119718 - DNA, 22 bp, Homo sapiens
atgtggaatgaacaaaggaggc

SEQ ID NO: 7119719 - DNA, 22 bp, Homo sapiens
atgtgctttgctggaaatgtca

SEQ ID NO: 7119720 - DNA, 22 bp, Homo sapiens
atgtgctttccaatgctgtagg

SEQ ID NO: 7119721 - DNA, 22 bp, Homo sapiens
atgtgctttctttccaaggggc

SEQ ID NO: 7119722 - DNA, 22 bp, Homo sapiens
atgtgctggctaactggatggg

SEQ ID NO: 7119723 - DNA, 22 bp, Homo sapiens
atgtgcttcattctacatgaca

SEQ ID NO: 7119724 - DNA, 22 bp, Homo sapiens
atgtgcttcgccagggcgttgc

SEQ ID NO: 7119725 - DNA, 22 bp, Homo sapiens
atgtgcttgaagcctcagagaa

SEQ ID NO: 7119726 - DNA, 22 bp, Homo sapiens
atgtgcttgactactctctatt

SEQ ID NO: 7119727 - DNA, 22 bp, Homo sapiens
atgtgcttgagggaaatcagtt

SEQ ID NO: 7119728 - DNA, 22 bp, Homo sapiens
atgtgcttggaaaagcagtggt

SEQ ID NO: 7119729 - DNA, 22 bp, Homo sapiens
atgtgctttattaagtaaaaat

SEQ ID NO: 7119730 - DNA, 22 bp, Homo sapiens
gaggttggcgccctgcctggcc

SEQ ID NO: 7119731 - DNA, 22 bp, Homo sapiens
gaggttggcgccctgcctggcc

SEQ ID NO: 7119732 - DNA, 22 bp, Homo sapiens
gaggttggagggctggcctgca

SEQ ID NO: 7119733 - DNA, 22 bp, Homo sapiens
gaggttggcgccctgcctggcc

SEQ ID NO: 7119734 - DNA, 22 bp, Homo sapiens
gaggttgggaagtccaagctgg

SEQ ID NO: 7119735 - DNA, 22 bp, Homo sapiens
gaggttgggaagtccaagctgg

SEQ ID NO: 7119736 - DNA, 22 bp, Homo sapiens
gaggttgggaagtccaagctgg

SEQ ID NO: 7119737 - DNA, 22 bp, Homo sapiens
gagtgcagtatgagaggctgct

SEQ ID NO: 7119738 - DNA, 22 bp, Homo sapiens
gagtgggcaccgtgggcacact

SEQ ID NO: 7119739 - DNA, 22 bp, Homo sapiens
gagtgggcaccgtgggcacact

SEQ ID NO: 7119740 - DNA, 22 bp, Homo sapiens
gagtgcagtatcttctgtgtcc

SEQ ID NO: 7119741 - DNA, 22 bp, Homo sapiens
gagtgcagtatcttctgtgtcc

SEQ ID NO: 7119742 - DNA, 22 bp, Homo sapiens
gaggttgggatgagggatacag

SEQ ID NO: 7119743 - DNA, 22 bp, Homo sapiens
gaggttgggatgagggatacag

SEQ ID NO: 7119744 - DNA, 22 bp, Homo sapiens
gaggttcagtaaggaatactga

SEQ ID NO: 7119745 - DNA, 22 bp, Homo sapiens
gaggttccccattgtactggct

SEQ ID NO: 7119746 - DNA, 22 bp, Homo sapiens
atgttatggctcaaacatttgg

SEQ ID NO: 7119747 - DNA, 22 bp, Homo sapiens
atgttatcttcggaagcaagtg

SEQ ID NO: 7119748 - DNA, 22 bp, Homo sapiens
atgttatgacaagcatgacaga

SEQ ID NO: 7119749 - DNA, 22 bp, Homo sapiens
atgttatgtccctcttactcag

SEQ ID NO: 7119750 - DNA, 22 bp, Homo sapiens
atgttatgtaacacttgtttct

SEQ ID NO: 7119751 - DNA, 22 bp, Homo sapiens
atgttatgtctgggaaggggta

SEQ ID NO: 7119752 - DNA, 22 bp, Homo sapiens
atgttatgtctgggaaggggta

SEQ ID NO: 7119753 - DNA, 23 bp, Homo sapiens
gaggtgtgaattctgggtgctgc

SEQ ID NO: 7119754 - DNA, 22 bp, Homo sapiens
atgttataaatagagacactgg

SEQ ID NO: 7119755 - DNA, 22 bp, Homo sapiens
atgttagttgaattgaggagtg

SEQ ID NO: 7119756 - DNA, 22 bp, Homo sapiens
atgttagtgtcactttgtacaa

SEQ ID NO: 7119757 - DNA, 22 bp, Homo sapiens
atgttagttttggtgagagtac

SEQ ID NO: 7119758 - DNA, 22 bp, Homo sapiens
atgttatagttataaaatgagg

SEQ ID NO: 7119759 - DNA, 22 bp, Homo sapiens
atgttatagttataaaatgagg

SEQ ID NO: 7119760 - DNA, 22 bp, Homo sapiens
atgttatagttataaaatgagg

SEQ ID NO: 7119761 - DNA, 22 bp, Homo sapiens
gaggtgtgatgcagagtggtgg

SEQ ID NO: 7119762 - DNA, 22 bp, Homo sapiens
gaggtgtgatgcagagtggtgg

SEQ ID NO: 7119763 - DNA, 22 bp, Homo sapiens
gaggtgtgatgcagagtggtgg

SEQ ID NO: 7119764 - DNA, 22 bp, Homo sapiens
gaggtgtgcacagcgtgctgac

SEQ ID NO: 7119765 - DNA, 22 bp, Homo sapiens
gaggtgtgcacagcgtgctgac

SEQ ID NO: 7119766 - DNA, 22 bp, Homo sapiens
gaggtgtgctgcggcccggtgc

SEQ ID NO: 7119767 - DNA, 22 bp, Homo sapiens
gaggtgtggtcctcagccccca

SEQ ID NO: 7119768 - DNA, 22 bp, Homo sapiens
gaggttagtgatttgtcattga

SEQ ID NO: 7119769 - DNA, 22 bp, Homo sapiens
gaggttagaggtcagtgcagtc

SEQ ID NO: 7119770 - DNA, 22 bp, Homo sapiens
gaggttagcagtatcttctagt

SEQ ID NO: 7119771 - DNA, 22 bp, Homo sapiens
gaggttaggtgacttgttcaga

SEQ ID NO: 7119772 - DNA, 22 bp, Homo sapiens
gaggtgtgttacagattgtcat

SEQ ID NO: 7119773 - DNA, 22 bp, Homo sapiens
gaggtgtgttacagattgtcat

SEQ ID NO: 7119774 - DNA, 22 bp, Homo sapiens
gaggttaaaccttaaagcttca

SEQ ID NO: 7119775 - DNA, 22 bp, Homo sapiens
atgtggccttaggttctagtgg

SEQ ID NO: 7119776 - DNA, 17 bp, Homo sapiens
atgtggctaagctgctg

SEQ ID NO: 7119777 - DNA, 22 bp, Homo sapiens
atgtggccttaatgacagcagc

SEQ ID NO: 7119778 - DNA, 23 bp, Homo sapiens
atgtggctagtgagaccaagaaa

SEQ ID NO: 7119779 - DNA, 18 bp, Homo sapiens
atgtggctagtgctactg

SEQ ID NO: 7119780 - DNA, 22 bp, Homo sapiens
atgtggctgatcgcagagctct

SEQ ID NO: 7119781 - DNA, 22 bp, Homo sapiens
atgtggctgatcgcagagctct

SEQ ID NO: 7119782 - DNA, 23 bp, Homo sapiens
atgttaaacataactgaagagcc

SEQ ID NO: 7119783 - DNA, 22 bp, Homo sapiens
atgttaaaagtgaggatggcca

SEQ ID NO: 7119784 - DNA, 23 bp, Homo sapiens
atgttaaacataactgaagagcc

SEQ ID NO: 7119785 - DNA, 23 bp, Homo sapiens
atgttaaacataactgaagagcc

SEQ ID NO: 7119786 - DNA, 22 bp, Homo sapiens
atgttaaaagtctgagtgggag

SEQ ID NO: 7119787 - DNA, 22 bp, Homo sapiens
atgttaaaagtgaggatggcca

SEQ ID NO: 7119788 - DNA, 22 bp, Homo sapiens
atgttagaatctctgaatgtgg

SEQ ID NO: 7119789 - DNA, 22 bp, Homo sapiens
atgttagcattgagcacttact

SEQ ID NO: 7119790 - DNA, 22 bp, Homo sapiens
atgttaggcaatctttcttgtt

SEQ ID NO: 7119791 - DNA, 22 bp, Homo sapiens
atgttagaaggaatgttaaaag

SEQ ID NO: 7119792 - DNA, 22 bp, Homo sapiens
atgttagaaggaatgttaaaag

SEQ ID NO: 7119793 - DNA, 22 bp, Homo sapiens
atgttacttagaataattctgg

SEQ ID NO: 7119794 - DNA, 22 bp, Homo sapiens
atgttagaaggaatgttaaaag

SEQ ID NO: 7119795 - DNA, 22 bp, Homo sapiens
atgttactgtgatcatgatact

SEQ ID NO: 7119796 - DNA, 22 bp, Homo sapiens
atgttactgtgatcatgatact

SEQ ID NO: 7119797 - DNA, 23 bp, Homo sapiens
atgttacttaacctctctgtgcc

SEQ ID NO: 7119798 - DNA, 22 bp, Homo sapiens
atgttacctgttaggtacctgt

SEQ ID NO: 7119799 - DNA, 22 bp, Homo sapiens
atgttacggaatgtcaaggact

SEQ ID NO: 7119800 - DNA, 22 bp, Homo sapiens
atgttactgtgatcatgatact

SEQ ID NO: 7119801 - DNA, 22 bp, Homo sapiens
atgttacagagaaagtggaagc

SEQ ID NO: 7119802 - DNA, 22 bp, Homo sapiens
atgttacagagaaagtggaagc

SEQ ID NO: 7119803 - DNA, 22 bp, Homo sapiens
atgttacagttgagtaaattaa

SEQ ID NO: 7119804 - DNA, 16 bp, Homo sapiens
atgttacagaagtaat

SEQ ID NO: 7119805 - DNA, 22 bp, Homo sapiens
atgttacagttgagtaaattaa

SEQ ID NO: 7119806 - DNA, 22 bp, Homo sapiens
atgttacagttgagtaaattaa

SEQ ID NO: 7119807 - DNA, 22 bp, Homo sapiens
atggagggtgtcagagagcgaa

SEQ ID NO: 7119808 - DNA, 22 bp, Homo sapiens
gagacagtgaggaaggctaggt

SEQ ID NO: 7119809 - DNA, 22 bp, Homo sapiens
atggagggtgtcagagagcgaa

SEQ ID NO: 7119810 - DNA, 22 bp, Homo sapiens
atggaggtctgtgactcccaaa

SEQ ID NO: 7119811 - DNA, 22 bp, Homo sapiens
atggataatgtctctgtttccc

SEQ ID NO: 7119812 - DNA, 22 bp, Homo sapiens
atggataatgtctctgtttccc

SEQ ID NO: 7119813 - DNA, 22 bp, Homo sapiens
atggatattggccaaactcatt

SEQ ID NO: 7119814 - DNA, 22 bp, Homo sapiens
atggatcacagtgccgtgggtg

SEQ ID NO: 7119815 - DNA, 22 bp, Homo sapiens
atggatcagaatcccgggaggg

SEQ ID NO: 7119816 - DNA, 22 bp, Homo sapiens
gagacaggcagctagtgggtca

SEQ ID NO: 7119817 - DNA, 22 bp, Homo sapiens
gagacaggatttaaccaaagct

SEQ ID NO: 7119818 - DNA, 22 bp, Homo sapiens
gagacaggcagctagtgggtca

SEQ ID NO: 7119819 - DNA, 22 bp, Homo sapiens
gagacaggcagctagtgggtca

SEQ ID NO: 7119820 - DNA, 22 bp, Homo sapiens
gagacaggcagctagtgggtca

SEQ ID NO: 7119821 - DNA, 22 bp, Homo sapiens
gagacaggcagctagtgggtca

SEQ ID NO: 7119822 - DNA, 22 bp, Homo sapiens
gagacaggcagctagtgggtca

SEQ ID NO: 7119823 - DNA, 22 bp, Homo sapiens
gagacaggcagctagtgggtca

SEQ ID NO: 7119824 - DNA, 22 bp, Homo sapiens
gagacaggccaggtggtactta

SEQ ID NO: 7119825 - DNA, 22 bp, Homo sapiens
gagacaggccaggtggtactta

SEQ ID NO: 7119826 - DNA, 22 bp, Homo sapiens
gagacaggccaggtggtactta

SEQ ID NO: 7119827 - DNA, 22 bp, Homo sapiens
gagacaggccaggtggtactta

SEQ ID NO: 7119828 - DNA, 22 bp, Homo sapiens
gagacaggcagctagtgggtca

SEQ ID NO: 7119829 - DNA, 22 bp, Homo sapiens
gagacaggcagctagtgggtca

SEQ ID NO: 7119830 - DNA, 22 bp, Homo sapiens
gagacaggcagctagtgggtca

SEQ ID NO: 7119831 - DNA, 21 bp, Homo sapiens
gagaatcaggaaggattgatg

SEQ ID NO: 7119832 - DNA, 21 bp, Homo sapiens
gagaatcaggaaggattgatg

SEQ ID NO: 7119833 - DNA, 22 bp, Homo sapiens
gagaatattagagttagtttat

SEQ ID NO: 7119834 - DNA, 22 bp, Homo sapiens
gagaatattagagttagtttat

SEQ ID NO: 7119835 - DNA, 21 bp, Homo sapiens
gagaatagaggggaagctgaa

SEQ ID NO: 7119836 - DNA, 21 bp, Homo sapiens
gagaatagaggggaagctgaa

SEQ ID NO: 7119837 - DNA, 22 bp, Homo sapiens
gagaatatattgaagtagttcc

SEQ ID NO: 7119838 - DNA, 22 bp, Homo sapiens
gagaatatttttagctttcctc

SEQ ID NO: 7119839 - DNA, 22 bp, Homo sapiens
gagaatcatttacagaatgatt

SEQ ID NO: 7119840 - DNA, 22 bp, Homo sapiens
gagaatcatttacagaatgatt

SEQ ID NO: 7119841 - DNA, 22 bp, Homo sapiens
gagaatcatttacagaatgatt

SEQ ID NO: 7119842 - DNA, 22 bp, Homo sapiens
gagacagcacaggccactggga

SEQ ID NO: 7119843 - DNA, 22 bp, Homo sapiens
gagacagcacaggccactggga

SEQ ID NO: 7119844 - DNA, 22 bp, Homo sapiens
gagacaggatttaaccaaagct

SEQ ID NO: 7119845 - DNA, 22 bp, Homo sapiens
gagacaggatttaaccaaagct

SEQ ID NO: 7119846 - DNA, 22 bp, Homo sapiens
gagacaggatttaaccaaagct

SEQ ID NO: 7119847 - DNA, 22 bp, Homo sapiens
gagacaggatttaaccaaagct

SEQ ID NO: 7119848 - DNA, 22 bp, Homo sapiens
gagacaggatttaaccaaagct

SEQ ID NO: 7119849 - DNA, 22 bp, Homo sapiens
gagacagcctactccagtctca

SEQ ID NO: 7119850 - DNA, 17 bp, Homo sapiens
gagacagcaggagcccc

SEQ ID NO: 7119851 - DNA, 22 bp, Homo sapiens
gagacagcagggccagggcctg

SEQ ID NO: 7119852 - DNA, 21 bp, Homo sapiens
gagacagcccagtgccagggc

SEQ ID NO: 7119853 - DNA, 21 bp, Homo sapiens
gagacagcccagtgccagggc

SEQ ID NO: 7119854 - DNA, 22 bp, Homo sapiens
atggcacaggagaggagggctg

SEQ ID NO: 7119855 - DNA, 22 bp, Homo sapiens
atggcacaggagaggagggctg

SEQ ID NO: 7119856 - DNA, 18 bp, Homo sapiens
atggcacagtctttccct

SEQ ID NO: 7119857 - DNA, 22 bp, Homo sapiens
atggcacagtgggaaatgacct

SEQ ID NO: 7119858 - DNA, 22 bp, Homo sapiens
atggcacagtgggaaatgacct

SEQ ID NO: 7119859 - DNA, 22 bp, Homo sapiens
atggcacagatgttctgattat

SEQ ID NO: 7119860 - DNA, 22 bp, Homo sapiens
atggcacagtgggaaatgacct

SEQ ID NO: 7119861 - DNA, 22 bp, Homo sapiens
atggcacacaggtctgcaaggg

SEQ ID NO: 7119862 - DNA, 22 bp, Homo sapiens
atggcacacaggtctgcaaggg

SEQ ID NO: 7119863 - DNA, 22 bp, Homo sapiens
atggcacagatgttctgattat

SEQ ID NO: 7119864 - DNA, 22 bp, Homo sapiens
atggcacagattagggtcacag

SEQ ID NO: 7119865 - DNA, 22 bp, Homo sapiens
atggcaagcaagctgaagagat

SEQ ID NO: 7119866 - DNA, 22 bp, Homo sapiens
atggcaaaaactgcagttacct

SEQ ID NO: 7119867 - DNA, 22 bp, Homo sapiens
atggcaaaaactgcagttacct

SEQ ID NO: 7119868 - DNA, 22 bp, Homo sapiens
atggcaaaaattaacagatcaa

SEQ ID NO: 7119869 - DNA, 22 bp, Homo sapiens
atggatgggatattgcttgcca

SEQ ID NO: 7119870 - DNA, 22 bp, Homo sapiens
atggatggcctgagcacagctg

SEQ ID NO: 7119871 - DNA, 22 bp, Homo sapiens
atggatgagtccttgagacaca

SEQ ID NO: 7119872 - DNA, 22 bp, Homo sapiens
atggcactgacctcccttgtaa

SEQ ID NO: 7119873 - DNA, 22 bp, Homo sapiens
atggcaccttccccagagctca

SEQ ID NO: 7119874 - DNA, 23 bp, Homo sapiens
atggcacatgggacagtaagtag

SEQ ID NO: 7119875 - DNA, 22 bp, Homo sapiens
atggcacatgaccttgatggat

SEQ ID NO: 7119876 - DNA, 22 bp, Homo sapiens
atggcacatgttgccttcgaat

SEQ ID NO: 7119877 - DNA, 22 bp, Homo sapiens
atggcaccaaatatgtctcatt

SEQ ID NO: 7119878 - DNA, 22 bp, Homo sapiens
atggcaccaaatatgtctcatt

SEQ ID NO: 7119879 - DNA, 22 bp, Homo sapiens
atggcaccttccccagagctca

SEQ ID NO: 7119880 - DNA, 22 bp, Homo sapiens
atggcagaaagaatagaggcta

SEQ ID NO: 7119881 - DNA, 22 bp, Homo sapiens
atggcagaaaggcatgtgggcc

SEQ ID NO: 7119882 - DNA, 22 bp, Homo sapiens
atggcagaaaggcatgtgggcc

SEQ ID NO: 7119883 - DNA, 22 bp, Homo sapiens
atggcagaatatctgcatcgca

SEQ ID NO: 7119884 - DNA, 22 bp, Homo sapiens
atggcagaatatctgcatcgca

SEQ ID NO: 7119885 - DNA, 22 bp, Homo sapiens
atggcagaattaggatttcaag

SEQ ID NO: 7119886 - DNA, 22 bp, Homo sapiens
atggcagacacaggcaggcaga

SEQ ID NO: 7119887 - DNA, 22 bp, Homo sapiens
atggcagacctcctggccacaa

SEQ ID NO: 7119888 - DNA, 22 bp, Homo sapiens
atggcagacctcctggccacaa

SEQ ID NO: 7119889 - DNA, 22 bp, Homo sapiens
atggcagacctgggctggagaa

SEQ ID NO: 7119890 - DNA, 22 bp, Homo sapiens
gagaaggggtgatgtgggtaat

SEQ ID NO: 7119891 - DNA, 22 bp, Homo sapiens
gagaaggtggacctgaaggagc

SEQ ID NO: 7119892 - DNA, 22 bp, Homo sapiens
gagaaggggtgatgtgggtaat

SEQ ID NO: 7119893 - DNA, 22 bp, Homo sapiens
gagaaggggtgatgtgggtaat

SEQ ID NO: 7119894 - DNA, 22 bp, Homo sapiens
gagaaggggtgatgtgggtaat

SEQ ID NO: 7119895 - DNA, 22 bp, Homo sapiens
gagaacaggctctggagtcaga

SEQ ID NO: 7119896 - DNA, 22 bp, Homo sapiens
gagaaggtggacctgaaggagc

SEQ ID NO: 7119897 - DNA, 22 bp, Homo sapiens
gagaagtgcagagtggttaagc

SEQ ID NO: 7119898 - DNA, 22 bp, Homo sapiens
gagaagtttggagtgaaggttt

SEQ ID NO: 7119899 - DNA, 22 bp, Homo sapiens
gagaagtttctggtttgcatag

SEQ ID NO: 7119900 - DNA, 22 bp, Homo sapiens
gagaagttgtaggagaattttg

SEQ ID NO: 7119901 - DNA, 22 bp, Homo sapiens
atgctgtgtttgagaacctagg

SEQ ID NO: 7119902 - DNA, 22 bp, Homo sapiens
atgctgtgttttaaatggaaat

SEQ ID NO: 7119903 - DNA, 22 bp, Homo sapiens
atgctgtgtggtcaagttaatt

SEQ ID NO: 7119904 - DNA, 22 bp, Homo sapiens
atgctgtgtggccacctccatg

SEQ ID NO: 7119905 - DNA, 22 bp, Homo sapiens
atgctgtgtctagcaggaacac

SEQ ID NO: 7119906 - DNA, 22 bp, Homo sapiens
atgctgtgtcaggaatttgata

SEQ ID NO: 7119907 - DNA, 22 bp, Homo sapiens
atgctgtgtcctagtgaaagaa

SEQ ID NO: 7119908 - DNA, 22 bp, Homo sapiens
atgctgtttgcttttagtctgc

SEQ ID NO: 7119909 - DNA, 22 bp, Homo sapiens
atgcttaaccttggtgtacaat

SEQ ID NO: 7119910 - DNA, 22 bp, Homo sapiens
atgcttaactctgtacatagtt

SEQ ID NO: 7119911 - DNA, 22 bp, Homo sapiens
atgcttaactctgtacatagtt

SEQ ID NO: 7119912 - DNA, 23 bp, Homo sapiens
gagaacagccacagagagctgtg

SEQ ID NO: 7119913 - DNA, 23 bp, Homo sapiens
gagaacagccacagagagctgtg

SEQ ID NO: 7119914 - DNA, 22 bp, Homo sapiens
atgctggggcctcagaccagaa

SEQ ID NO: 7119915 - DNA, 22 bp, Homo sapiens
atgctgtccactcttggtgttt

SEQ ID NO: 7119916 - DNA, 22 bp, Homo sapiens
atgctgtatacatatgaaatta

SEQ ID NO: 7119917 - DNA, 22 bp, Homo sapiens
atgctgtcagtattatgtgcag

SEQ ID NO: 7119918 - DNA, 22 bp, Homo sapiens
atgctgtccctgcccttcaccc

SEQ ID NO: 7119919 - DNA, 22 bp, Homo sapiens
atgctgtctctgctatccaaag

SEQ ID NO: 7119920 - DNA, 22 bp, Homo sapiens
atgctgggaagacaaggtggag

SEQ ID NO: 7119921 - DNA, 22 bp, Homo sapiens
atgctgggaagacaaggtggag

SEQ ID NO: 7119922 - DNA, 22 bp, Homo sapiens
atgctgggaagacaaggtggag

SEQ ID NO: 7119923 - DNA, 22 bp, Homo sapiens
atgctgggaaactgaaaggaat

SEQ ID NO: 7119924 - DNA, 22 bp, Homo sapiens
atgctgggaaactgaaaggaat

SEQ ID NO: 7119925 - DNA, 22 bp, Homo sapiens
atgctggcagccgagtgctcca

SEQ ID NO: 7119926 - DNA, 22 bp, Homo sapiens
atgctggcagccgagtgctcca

SEQ ID NO: 7119927 - DNA, 22 bp, Homo sapiens
atgctgtggaagttcctgaagc

SEQ ID NO: 7119928 - DNA, 22 bp, Homo sapiens
atgctgtgccttctctgtgcca

SEQ ID NO: 7119929 - DNA, 22 bp, Homo sapiens
atgctgtgctggctaaccatgg

SEQ ID NO: 7119930 - DNA, 22 bp, Homo sapiens
atgctgtgcctggaaagcggct

SEQ ID NO: 7119931 - DNA, 22 bp, Homo sapiens
atgctgtgccttctctgtgcca

SEQ ID NO: 7119932 - DNA, 22 bp, Homo sapiens
atgctgtgagtgtgccgcagag

SEQ ID NO: 7119933 - DNA, 22 bp, Homo sapiens
atgctgtgattgtagaaatatt

SEQ ID NO: 7119934 - DNA, 22 bp, Homo sapiens
atgctgtgaaaaagaaggctga

SEQ ID NO: 7119935 - DNA, 22 bp, Homo sapiens
atgctgtgagtgtgccgcagag

SEQ ID NO: 7119936 - DNA, 22 bp, Homo sapiens
atgctgtgaaaaagaaggctga

SEQ ID NO: 7119937 - DNA, 22 bp, Homo sapiens
atgctgtgtcaccttaggattt

SEQ ID NO: 7119938 - DNA, 22 bp, Homo sapiens
atgctgtgtattttactctttc

SEQ ID NO: 7119939 - DNA, 22 bp, Homo sapiens
atgctgtgtattttactctttc

SEQ ID NO: 7119940 - DNA, 22 bp, Homo sapiens
atgctgtggtagacagcattcc

SEQ ID NO: 7119941 - DNA, 22 bp, Homo sapiens
atgctgtggaagttcctgaagc

SEQ ID NO: 7119942 - DNA, 22 bp, Homo sapiens
atgctgtggatgccttgcccca

SEQ ID NO: 7119943 - DNA, 22 bp, Homo sapiens
atgctgtggggagtgagggtag

SEQ ID NO: 7119944 - DNA, 22 bp, Homo sapiens
atgctgtggccagagttcaact

SEQ ID NO: 7119945 - DNA, 22 bp, Homo sapiens
gagcacaggctttggtggacac

SEQ ID NO: 7119946 - DNA, 22 bp, Homo sapiens
gagcacaggctttggtggacac

SEQ ID NO: 7119947 - DNA, 22 bp, Homo sapiens
gagcacaggctttggtggacac

SEQ ID NO: 7119948 - DNA, 22 bp, Homo sapiens
gagcacaggctgctgtgaactg

SEQ ID NO: 7119949 - DNA, 22 bp, Homo sapiens
gagcacagctgtcttgcaagct

SEQ ID NO: 7119950 - DNA, 22 bp, Homo sapiens
gagcacaggctgctgtgaactg

SEQ ID NO: 7119951 - DNA, 22 bp, Homo sapiens
gagcacaggctgctgtgaactg

SEQ ID NO: 7119952 - DNA, 22 bp, Homo sapiens
gagcacaggctgctgtgaactg

SEQ ID NO: 7119953 - DNA, 22 bp, Homo sapiens
gagcacagctggaggtagcatt

SEQ ID NO: 7119954 - DNA, 22 bp, Homo sapiens
gagcacagctgtcttgcaagct

SEQ ID NO: 7119955 - DNA, 22 bp, Homo sapiens
gagcacagctgtcttgcaagct

SEQ ID NO: 7119956 - DNA, 22 bp, Homo sapiens
gagcacagctggaggtagcatt

SEQ ID NO: 7119957 - DNA, 22 bp, Homo sapiens
gagcacagattgatttaaaata

SEQ ID NO: 7119958 - DNA, 22 bp, Homo sapiens
gagcacagcagggctctgggtg

SEQ ID NO: 7119959 - DNA, 22 bp, Homo sapiens
gagcacagcagggctctgggtg

SEQ ID NO: 7119960 - DNA, 22 bp, Homo sapiens
gagcacagccaaagtaagaagg

SEQ ID NO: 7119961 - DNA, 22 bp, Homo sapiens
gagcacagccaaagtaagaagg

SEQ ID NO: 7119962 - DNA, 22 bp, Homo sapiens
gagcacagccaaagtaagaagg

SEQ ID NO: 7119963 - DNA, 22 bp, Homo sapiens
gagcacagcgcagtttgtaatt

SEQ ID NO: 7119964 - DNA, 22 bp, Homo sapiens
gagcacagcgcagtttgtaatt

SEQ ID NO: 7119965 - DNA, 22 bp, Homo sapiens
gagcacagcgcagtttgtaatt

SEQ ID NO: 7119966 - DNA, 22 bp, Homo sapiens
gagcacagcgcagtttgtaatt

SEQ ID NO: 7119967 - DNA, 19 bp, Homo sapiens
gagcacagcggcatttggt

SEQ ID NO: 7119968 - DNA, 19 bp, Homo sapiens
gagcacagcggcatttggt

SEQ ID NO: 7119969 - DNA, 19 bp, Homo sapiens
gagcacagcggcatttggt

SEQ ID NO: 7119970 - DNA, 19 bp, Homo sapiens
gagcacagcggcatttggt

SEQ ID NO: 7119971 - DNA, 19 bp, Homo sapiens
gagcacagcggcatttggt

SEQ ID NO: 7119972 - DNA, 22 bp, Homo sapiens
gagcacagctggaggtagcatt

SEQ ID NO: 7119973 - DNA, 22 bp, Homo sapiens
gagcacagctggaggtagcatt

SEQ ID NO: 7119974 - DNA, 22 bp, Homo sapiens
gagcacagggaatagacagata

SEQ ID NO: 7119975 - DNA, 22 bp, Homo sapiens
gagcacagggaatagacagata

SEQ ID NO: 7119976 - DNA, 22 bp, Homo sapiens
atgggagagggtaggaattact

SEQ ID NO: 7119977 - DNA, 22 bp, Homo sapiens
atgggaggaagagaagatgtct

SEQ ID NO: 7119978 - DNA, 22 bp, Homo sapiens
atgggaggaagagaagatgtct

SEQ ID NO: 7119979 - DNA, 22 bp, Homo sapiens
atgggaggaagagaagatgtct

SEQ ID NO: 7119980 - DNA, 22 bp, Homo sapiens
gagcacaggctttggtggacac

SEQ ID NO: 7119981 - DNA, 22 bp, Homo sapiens
gagcacaggctttggtggacac

SEQ ID NO: 7119982 - DNA, 22 bp, Homo sapiens
gagcacagggaatagacagata

SEQ ID NO: 7119983 - DNA, 22 bp, Homo sapiens
gagcacagggaatagacagata

SEQ ID NO: 7119984 - DNA, 22 bp, Homo sapiens
atgggagggtggaaaggctctg

SEQ ID NO: 7119985 - DNA, 22 bp, Homo sapiens
atgggagggtggaaaggctctg

SEQ ID NO: 7119986 - DNA, 22 bp, Homo sapiens
atgggagggtggaaaggctctg

SEQ ID NO: 7119987 - DNA, 22 bp, Homo sapiens
atgggagtgtgcttgaggagtt

SEQ ID NO: 7119988 - DNA, 22 bp, Homo sapiens
atgggagtccaacatcaaggac

SEQ ID NO: 7119989 - DNA, 22 bp, Homo sapiens
atgggagtgacagggccactgg

SEQ ID NO: 7119990 - DNA, 22 bp, Homo sapiens
atgggagtggaggaaaaaagtt

SEQ ID NO: 7119991 - DNA, 20 bp, Homo sapiens
atggctctgattctgagccc

SEQ ID NO: 7119992 - DNA, 19 bp, Homo sapiens
atggctctgggatcactgc

SEQ ID NO: 7119993 - DNA, 20 bp, Homo sapiens
atggctctgtttggcagtga

SEQ ID NO: 7119994 - DNA, 22 bp, Homo sapiens
atggctgagatgggctccaggc

SEQ ID NO: 7119995 - DNA, 22 bp, Homo sapiens
atggctgaggctggaggtggca

SEQ ID NO: 7119996 - DNA, 21 bp, Homo sapiens
atggctgatgatattgaacat

SEQ ID NO: 7119997 - DNA, 22 bp, Homo sapiens
atggctctttattctgctgcat

SEQ ID NO: 7119998 - DNA, 22 bp, Homo sapiens
atggctgcagccggccctgcgc

SEQ ID NO: 7119999 - DNA, 22 bp, Homo sapiens
atggctgcagtccgtgccctgg

SEQ ID NO: 7120000 - DNA, 22 bp, Homo sapiens
atggctgcatcatcctggttga

SEQ ID NO: 7120001 - DNA, 22 bp, Homo sapiens
gagcacagattgatttaaaata

SEQ ID NO: 7120002 - DNA, 22 bp, Homo sapiens
gagcacagattgatttaaaata

SEQ ID NO: 7120003 - DNA, 22 bp, Homo sapiens
atggcagagaaagcgagccaca

SEQ ID NO: 7120004 - DNA, 22 bp, Homo sapiens
atggccctgtttatggtaaggc

SEQ ID NO: 7120005 - DNA, 22 bp, Homo sapiens
atggcagagggattgaacagct

SEQ ID NO: 7120006 - DNA, 22 bp, Homo sapiens
atggccctttattccttcttcc

SEQ ID NO: 7120007 - DNA, 22 bp, Homo sapiens
atggcagacctgggctggagaa

SEQ ID NO: 7120008 - DNA, 21 bp, Homo sapiens
atggctcaggccatcaatgga

SEQ ID NO: 7120009 - DNA, 21 bp, Homo sapiens
atggctcaggccatcaatgga

SEQ ID NO: 7120010 - DNA, 22 bp, Homo sapiens
atggctcatttatcttgcagcc

SEQ ID NO: 7120011 - DNA, 22 bp, Homo sapiens
atggctcatttatcttgcagcc

SEQ ID NO: 7120012 - DNA, 22 bp, Homo sapiens
atggctcatttatcttgcagcc

SEQ ID NO: 7120013 - DNA, 22 bp, Homo sapiens
atggctccaagatggagagcca

SEQ ID NO: 7120014 - DNA, 22 bp, Homo sapiens
atggctccagcttggcttcacc

SEQ ID NO: 7120015 - DNA, 22 bp, Homo sapiens
atggctccagcttggcttcacc

SEQ ID NO: 7120016 - DNA, 22 bp, Homo sapiens
atggctctaggttgggcagttt

SEQ ID NO: 7120017 - DNA, 22 bp, Homo sapiens
atggctctaggttgggcagttt

SEQ ID NO: 7120018 - DNA, 17 bp, Homo sapiens
gagcccgttatcgggga

SEQ ID NO: 7120019 - DNA, 22 bp, Homo sapiens
gagccctcaatgaatctgcatt

SEQ ID NO: 7120020 - DNA, 17 bp, Homo sapiens
gagcccctttccaagtt

SEQ ID NO: 7120021 - DNA, 22 bp, Homo sapiens
gagccccttctgcagtcaggtt

SEQ ID NO: 7120022 - DNA, 22 bp, Homo sapiens
gagccccaggacagctctagtt

SEQ ID NO: 7120023 - DNA, 22 bp, Homo sapiens
gagccccaggacagctctagtt

SEQ ID NO: 7120024 - DNA, 22 bp, Homo sapiens
gagccccaccctagacattctg

SEQ ID NO: 7120025 - DNA, 22 bp, Homo sapiens
gagccccaccctagacattctg

SEQ ID NO: 7120026 - DNA, 22 bp, Homo sapiens
gagccccagccctgcttctata

SEQ ID NO: 7120027 - DNA, 22 bp, Homo sapiens
gagccccagccctgcttctata

SEQ ID NO: 7120028 - DNA, 22 bp, Homo sapiens
gagccccagccctgcttctata

SEQ ID NO: 7120029 - DNA, 22 bp, Homo sapiens
gagccccaggacagctctagtt

SEQ ID NO: 7120030 - DNA, 22 bp, Homo sapiens
gagccctcattgaatctgcatt

SEQ ID NO: 7120031 - DNA, 22 bp, Homo sapiens
gagccctccatggagccaggca

SEQ ID NO: 7120032 - DNA, 22 bp, Homo sapiens
gagccctccatggagccaggca

SEQ ID NO: 7120033 - DNA, 19 bp, Homo sapiens
gagccctctccatggccac

SEQ ID NO: 7120034 - DNA, 19 bp, Homo sapiens
gagccctctccatggccac

SEQ ID NO: 7120035 - DNA, 22 bp, Homo sapiens
atgggatgaacttgatctgctt

SEQ ID NO: 7120036 - DNA, 22 bp, Homo sapiens
atgggataacaagaaggctgag

SEQ ID NO: 7120037 - DNA, 22 bp, Homo sapiens
atgggatgatcacctgagctca

SEQ ID NO: 7120038 - DNA, 22 bp, Homo sapiens
atgggatcttgccctgagggct

SEQ ID NO: 7120039 - DNA, 22 bp, Homo sapiens
atgggatgaacttgatctgctt

SEQ ID NO: 7120040 - DNA, 22 bp, Homo sapiens
atgggcagacagggagctcacg

SEQ ID NO: 7120041 - DNA, 22 bp, Homo sapiens
atgggatgcatggctgtggcca

SEQ ID NO: 7120042 - DNA, 22 bp, Homo sapiens
atgggcaacagcagtcacaatg

SEQ ID NO: 7120043 - DNA, 22 bp, Homo sapiens
atgggcagacagggagctcacg

SEQ ID NO: 7120044 - DNA, 22 bp, Homo sapiens
atgggcagacagggagctcacg

SEQ ID NO: 7120045 - DNA, 21 bp, Homo sapiens
atgggcagaggcagagaggct

SEQ ID NO: 7120046 - DNA, 22 bp, Homo sapiens
atgggcagagctggtgggaggc

SEQ ID NO: 7120047 - DNA, 22 bp, Homo sapiens
atgggcagacagggagctcacg

SEQ ID NO: 7120048 - DNA, 22 bp, Homo sapiens
atgggcagagctggtgggaggc

SEQ ID NO: 7120049 - DNA, 22 bp, Homo sapiens
atgggcagagctggtgggaggc

SEQ ID NO: 7120050 - DNA, 21 bp, Homo sapiens
atgggcagaggcagagaggct

SEQ ID NO: 7120051 - DNA, 22 bp, Homo sapiens
gagcccatcctcgaggggctgc

SEQ ID NO: 7120052 - DNA, 22 bp, Homo sapiens
gagccccaccctagacattctg

SEQ ID NO: 7120053 - DNA, 22 bp, Homo sapiens
gagccccaccctagacattctg

SEQ ID NO: 7120054 - DNA, 20 bp, Homo sapiens
gagccctctgcactagcgcc

SEQ ID NO: 7120055 - DNA, 17 bp, Homo sapiens
gagctctgtggcacaag

SEQ ID NO: 7120056 - DNA, 17 bp, Homo sapiens
gagctctgtggcacaag

SEQ ID NO: 7120057 - DNA, 22 bp, Homo sapiens
gagctctgtgtagcctgagggt

SEQ ID NO: 7120058 - DNA, 22 bp, Homo sapiens
gagctctgtgtagcctgagggt

SEQ ID NO: 7120059 - DNA, 22 bp, Homo sapiens
gagctctgtgtagcctgagggt

SEQ ID NO: 7120060 - DNA, 22 bp, Homo sapiens
gagctgcacatctgaggctaat

SEQ ID NO: 7120061 - DNA, 22 bp, Homo sapiens
gagctgcacatctgaggctaat

SEQ ID NO: 7120062 - DNA, 21 bp, Homo sapiens
gagctgcaccttgacctgttt

SEQ ID NO: 7120063 - DNA, 22 bp, Homo sapiens
gagctgcactgggggtggaatg

SEQ ID NO: 7120064 - DNA, 22 bp, Homo sapiens
gagctgcactgggggtggaatg

SEQ ID NO: 7120065 - DNA, 22 bp, Homo sapiens
gagctgccagacatgggaatga

SEQ ID NO: 7120066 - DNA, 22 bp, Homo sapiens
gagctgccagacatgggaatga

SEQ ID NO: 7120067 - DNA, 22 bp, Homo sapiens
gagctgcatgcggaaacctgtt

SEQ ID NO: 7120068 - DNA, 22 bp, Homo sapiens
gagctgccaagattacaatcag

SEQ ID NO: 7120069 - DNA, 22 bp, Homo sapiens
gagctgcagcggctgacgcaac

SEQ ID NO: 7120070 - DNA, 22 bp, Homo sapiens
gagctgcagcggctgacgcaac

SEQ ID NO: 7120071 - DNA, 22 bp, Homo sapiens
gagctgcagcggctgacgcaac

SEQ ID NO: 7120072 - DNA, 22 bp, Homo sapiens
gagctgccggcccacagtacta

SEQ ID NO: 7120073 - DNA, 22 bp, Homo sapiens
gagctgccctgagctttgcatg

SEQ ID NO: 7120074 - DNA, 22 bp, Homo sapiens
gagctgccctgagctttgcatg

SEQ ID NO: 7120075 - DNA, 22 bp, Homo sapiens
gagctgccctgagctttgcatg

SEQ ID NO: 7120076 - DNA, 22 bp, Homo sapiens
atgggcagagtggggacaggaa

SEQ ID NO: 7120077 - DNA, 21 bp, Homo sapiens
atgggcagaggcagagaggct

SEQ ID NO: 7120078 - DNA, 21 bp, Homo sapiens
atgggcagaggcagagaggct

SEQ ID NO: 7120079 - DNA, 22 bp, Homo sapiens
atgggcagagtggggacaggaa

SEQ ID NO: 7120080 - DNA, 21 bp, Homo sapiens
atgggcagaggcagagaggct

SEQ ID NO: 7120081 - DNA, 21 bp, Homo sapiens
atgggcagaggcagagaggct

SEQ ID NO: 7120082 - DNA, 22 bp, Homo sapiens
ataggccatttgagggccaggt

SEQ ID NO: 7120083 - DNA, 22 bp, Homo sapiens
ataggctgatctagcagcacag

SEQ ID NO: 7120084 - DNA, 22 bp, Homo sapiens
ataggctggagtgcagtggcat

SEQ ID NO: 7120085 - DNA, 22 bp, Homo sapiens
ataggctgtaataattcacatt

SEQ ID NO: 7120086 - DNA, 22 bp, Homo sapiens
ataggcaagggatacaatatac

SEQ ID NO: 7120087 - DNA, 22 bp, Homo sapiens
ataggcatgacatgcagggatt

SEQ ID NO: 7120088 - DNA, 22 bp, Homo sapiens
ataggctgtaataattcacatt

SEQ ID NO: 7120089 - DNA, 22 bp, Homo sapiens
atagggaggaactgagtcagga

SEQ ID NO: 7120090 - DNA, 22 bp, Homo sapiens
atagggaggaactgagtcagga

SEQ ID NO: 7120091 - DNA, 22 bp, Homo sapiens
atagggcagtcaggccgccact

SEQ ID NO: 7120092 - DNA, 22 bp, Homo sapiens
atagacattttgcattcaagca

SEQ ID NO: 7120093 - DNA, 23 bp, Homo sapiens
atagactgatttggatgtgaaag

SEQ ID NO: 7120094 - DNA, 22 bp, Homo sapiens
atagcagtgacattttaatgtg

SEQ ID NO: 7120095 - DNA, 22 bp, Homo sapiens
atagcatataagttataaaact

SEQ ID NO: 7120096 - DNA, 22 bp, Homo sapiens
ataggcacaaccattaaaataa

SEQ ID NO: 7120097 - DNA, 22 bp, Homo sapiens
ataggcacatagtgtccggaac

SEQ ID NO: 7120098 - DNA, 22 bp, Homo sapiens
ataggcacattaggaacttttg

SEQ ID NO: 7120099 - DNA, 22 bp, Homo sapiens
ataggcacattaggaacttttg

SEQ ID NO: 7120100 - DNA, 22 bp, Homo sapiens
ataggcagaaatgctccctatt

SEQ ID NO: 7120101 - DNA, 22 bp, Homo sapiens
atagcatagtcagcttcgctga

SEQ ID NO: 7120102 - DNA, 22 bp, Homo sapiens
atagcatataagttataaaact

SEQ ID NO: 7120103 - DNA, 22 bp, Homo sapiens
atagggctgttgtgaggattaa

SEQ ID NO: 7120104 - DNA, 22 bp, Homo sapiens
ataggggcagatgaggaatggg

SEQ ID NO: 7120105 - DNA, 22 bp, Homo sapiens
atagggcctaaaaagtattgct

SEQ ID NO: 7120106 - DNA, 22 bp, Homo sapiens
ataggtacagcagatattctta

SEQ ID NO: 7120107 - DNA, 22 bp, Homo sapiens
atagggtgagtgggtgctggct

SEQ ID NO: 7120108 - DNA, 21 bp, Homo sapiens
ataggtaacccagcagacttg

SEQ ID NO: 7120109 - DNA, 22 bp, Homo sapiens
ataggtgtgtggttcatggccc

SEQ ID NO: 7120110 - DNA, 22 bp, Homo sapiens
atagtaaattatcgtggagaga

SEQ ID NO: 7120111 - DNA, 22 bp, Homo sapiens
atagtacaatcagttaattagt

SEQ ID NO: 7120112 - DNA, 22 bp, Homo sapiens
atagtacaagggaagagtgaag

SEQ ID NO: 7120113 - DNA, 20 bp, Homo sapiens
atagtaatgaagtcttgttc

SEQ ID NO: 7120114 - DNA, 22 bp, Homo sapiens
atagtacaagggaagagtgaag

SEQ ID NO: 7120115 - DNA, 22 bp, Homo sapiens
atagtacaatcagttaattagt

SEQ ID NO: 7120116 - DNA, 22 bp, Homo sapiens
atagtacacatcctacaatgtt

SEQ ID NO: 7120117 - DNA, 22 bp, Homo sapiens
atagtacacatcctacaatgtt

SEQ ID NO: 7120118 - DNA, 22 bp, Homo sapiens
atagtacacatcctacaatgtt

SEQ ID NO: 7120119 - DNA, 22 bp, Homo sapiens
atagtacagagggctactggtt

SEQ ID NO: 7120120 - DNA, 22 bp, Homo sapiens
atagtacagagggctactggtt

SEQ ID NO: 7120121 - DNA, 22 bp, Homo sapiens
atagtacagatccattaattat

SEQ ID NO: 7120122 - DNA, 22 bp, Homo sapiens
atagtacagatccattaattat

SEQ ID NO: 7120123 - DNA, 22 bp, Homo sapiens
atagacatttactgagcacgta

SEQ ID NO: 7120124 - DNA, 22 bp, Homo sapiens
atagacattataacacagagct

SEQ ID NO: 7120125 - DNA, 22 bp, Homo sapiens
atagacattataacacagagct

SEQ ID NO: 7120126 - DNA, 22 bp, Homo sapiens
atagacatggtcttttgtcatt

SEQ ID NO: 7120127 - DNA, 22 bp, Homo sapiens
atagacatggtcttttgtcatt

SEQ ID NO: 7120128 - DNA, 22 bp, Homo sapiens
atagacatgcaacactttttac

SEQ ID NO: 7120129 - DNA, 22 bp, Homo sapiens
atagacatggtcttttgtcatt

SEQ ID NO: 7120130 - DNA, 22 bp, Homo sapiens
atagacagctacatagaatata

SEQ ID NO: 7120131 - DNA, 18 bp, Homo sapiens
atagacaggaaaaatgga

SEQ ID NO: 7120132 - DNA, 18 bp, Homo sapiens
atagacaggaaaaatgga

SEQ ID NO: 7120133 - DNA, 22 bp, Homo sapiens
atagacatagccgtaatttatt

SEQ ID NO: 7120134 - DNA, 22 bp, Homo sapiens
atagacatatggctttgtttct

SEQ ID NO: 7120135 - DNA, 22 bp, Homo sapiens
atagacatatggctttgtttct

SEQ ID NO: 7120136 - DNA, 22 bp, Homo sapiens
atagacaacacttattattcct

SEQ ID NO: 7120137 - DNA, 22 bp, Homo sapiens
atagacaatcccccatcctacc

SEQ ID NO: 7120138 - DNA, 22 bp, Homo sapiens
atagacaatcccccatcctacc

SEQ ID NO: 7120139 - DNA, 22 bp, Homo sapiens
atagacaatggtttgccaagaa

SEQ ID NO: 7120140 - DNA, 22 bp, Homo sapiens
atagacacagctatgatttgag

SEQ ID NO: 7120141 - DNA, 22 bp, Homo sapiens
atagacactgaaatccctgcca

SEQ ID NO: 7120142 - DNA, 22 bp, Homo sapiens
atagacagaaagataatagaat

SEQ ID NO: 7120143 - DNA, 22 bp, Homo sapiens
atagacagaaagataatagaat

SEQ ID NO: 7120144 - DNA, 22 bp, Homo sapiens
atagacagatgatagataaatc

SEQ ID NO: 7120145 - DNA, 22 bp, Homo sapiens
atagaatttgcactaaatctgc

SEQ ID NO: 7120146 - DNA, 22 bp, Homo sapiens
atagacaaacacgaagatgaca

SEQ ID NO: 7120147 - DNA, 22 bp, Homo sapiens
atagacaaacacgaagatgaca

SEQ ID NO: 7120148 - DNA, 22 bp, Homo sapiens
atagacaaacacgaagatgaca

SEQ ID NO: 7120149 - DNA, 20 bp, Homo sapiens
atagacaaagacatgccaga

SEQ ID NO: 7120150 - DNA, 20 bp, Homo sapiens
atagacaaagacatgccaga

SEQ ID NO: 7120151 - DNA, 20 bp, Homo sapiens
atagacaaagacatgccaga

SEQ ID NO: 7120152 - DNA, 22 bp, Homo sapiens
atagaattcgtgtttgtaattc

SEQ ID NO: 7120153 - DNA, 22 bp, Homo sapiens
atagaattctttgaaatttatg

SEQ ID NO: 7120154 - DNA, 22 bp, Homo sapiens
atagaattctttgaaatttatg

SEQ ID NO: 7120155 - DNA, 22 bp, Homo sapiens
atagaattctttgaaatttatg

SEQ ID NO: 7120156 - DNA, 22 bp, Homo sapiens
atagaattcgtgtttgtaattc

SEQ ID NO: 7120157 - DNA, 22 bp, Homo sapiens
atagaatcatctgtgcactagt

SEQ ID NO: 7120158 - DNA, 22 bp, Homo sapiens
atagaatcctgcagcaagcctt

SEQ ID NO: 7120159 - DNA, 22 bp, Homo sapiens
atagaatctttgtaaaacactt

SEQ ID NO: 7120160 - DNA, 22 bp, Homo sapiens
atagaatgtattatagtacaga

SEQ ID NO: 7120161 - DNA, 22 bp, Homo sapiens
atagaatgtattatagtacaga

SEQ ID NO: 7120162 - DNA, 22 bp, Homo sapiens
ctggccaggttttgaacagttg

SEQ ID NO: 7120163 - DNA, 22 bp, Homo sapiens
ctggccagggtgcgatcgtggt

SEQ ID NO: 7120164 - DNA, 22 bp, Homo sapiens
ctggccaggttttgaacagttg

SEQ ID NO: 7120165 - DNA, 22 bp, Homo sapiens
ctggccagggtgcgatcgtggt

SEQ ID NO: 7120166 - DNA, 22 bp, Homo sapiens
ctggccaggcttgggacagaca

SEQ ID NO: 7120167 - DNA, 22 bp, Homo sapiens
ctggccaggcttgggacagaca

SEQ ID NO: 7120168 - DNA, 22 bp, Homo sapiens
ctggccaggcttgggacagaca

SEQ ID NO: 7120169 - DNA, 22 bp, Homo sapiens
ctggccaggcttgggacagaca

SEQ ID NO: 7120170 - DNA, 22 bp, Homo sapiens
ctggccagggtgcgatcgtggt

SEQ ID NO: 7120171 - DNA, 22 bp, Homo sapiens
ctggccagggtgcgatcgtggt

SEQ ID NO: 7120172 - DNA, 22 bp, Homo sapiens
ctggccaggttttgaacagttg

SEQ ID NO: 7120173 - DNA, 22 bp, Homo sapiens
ctggccaggttttgaacagttg

SEQ ID NO: 7120174 - DNA, 22 bp, Homo sapiens
ctggccaggttttgaacagttg

SEQ ID NO: 7120175 - DNA, 22 bp, Homo sapiens
ctggccagtgactgctcacccg

SEQ ID NO: 7120176 - DNA, 22 bp, Homo sapiens
ctggccagtgactgctcacccg

SEQ ID NO: 7120177 - DNA, 22 bp, Homo sapiens
ctggccagtgactgctcacccg

SEQ ID NO: 7120178 - DNA, 22 bp, Homo sapiens
ctggccagtgactgctcacccg

SEQ ID NO: 7120179 - DNA, 22 bp, Homo sapiens
ctggccagtgactgctcacccg

SEQ ID NO: 7120180 - DNA, 22 bp, Homo sapiens
ctggccagtgcctgtgggcccc

SEQ ID NO: 7120181 - DNA, 22 bp, Homo sapiens
ctggccagtgcctgtgggcccc

SEQ ID NO: 7120182 - DNA, 22 bp, Homo sapiens
ctggaggaaaacaactgcagac

SEQ ID NO: 7120183 - DNA, 22 bp, Homo sapiens
ctggaggaaaacaactgcagac

SEQ ID NO: 7120184 - DNA, 21 bp, Homo sapiens
ctggagcttggtgagaagtgt

SEQ ID NO: 7120185 - DNA, 21 bp, Homo sapiens
ctggagcttggtgagaagtgt

SEQ ID NO: 7120186 - DNA, 22 bp, Homo sapiens
ctggagcttattgggagcagaa

SEQ ID NO: 7120187 - DNA, 22 bp, Homo sapiens
ctggagcttattgggagcagaa

SEQ ID NO: 7120188 - DNA, 22 bp, Homo sapiens
ctggccagaggttcctctgccc

SEQ ID NO: 7120189 - DNA, 22 bp, Homo sapiens
ctggccagaggttcctctgccc

SEQ ID NO: 7120190 - DNA, 22 bp, Homo sapiens
ctggccaggctctcacgtggtc

SEQ ID NO: 7120191 - DNA, 22 bp, Homo sapiens
ctggccaggctctcacgtggtc

SEQ ID NO: 7120192 - DNA, 22 bp, Homo sapiens
ctggccaggctctcacgtggtc

SEQ ID NO: 7120193 - DNA, 22 bp, Homo sapiens
ctggccaggcttgggacagaca

SEQ ID NO: 7120194 - DNA, 22 bp, Homo sapiens
ctggccaggcttgggacagaca

SEQ ID NO: 7120195 - DNA, 22 bp, Homo sapiens
ctggccaggcttgggacagaca

SEQ ID NO: 7120196 - DNA, 22 bp, Homo sapiens
atagaaaacagatgtccttaaa

SEQ ID NO: 7120197 - DNA, 22 bp, Homo sapiens
atagaaaacagatgtccttaaa

SEQ ID NO: 7120198 - DNA, 22 bp, Homo sapiens
atagaaacagggaagcaaagca

SEQ ID NO: 7120199 - DNA, 22 bp, Homo sapiens
atagaaacagggaagcaaagca

SEQ ID NO: 7120200 - DNA, 22 bp, Homo sapiens
atagaaacagggaagcaaagca

SEQ ID NO: 7120201 - DNA, 22 bp, Homo sapiens
atagaaacagggaagcaaagca

SEQ ID NO: 7120202 - DNA, 22 bp, Homo sapiens
atactttggtcactattattgg

SEQ ID NO: 7120203 - DNA, 22 bp, Homo sapiens
atactttggtcactattattgg

SEQ ID NO: 7120204 - DNA, 22 bp, Homo sapiens
atacttttaattccttctgagt

SEQ ID NO: 7120205 - DNA, 22 bp, Homo sapiens
atagaaaacagatgtccttaaa

SEQ ID NO: 7120206 - DNA, 22 bp, Homo sapiens
atagaaaacagatgtccttaaa

SEQ ID NO: 7120207 - DNA, 22 bp, Homo sapiens
atagaaaacagatgtccttaaa

SEQ ID NO: 7120208 - DNA, 22 bp, Homo sapiens
atagaaaacagatgtccttaaa

SEQ ID NO: 7120209 - DNA, 21 bp, Homo sapiens
atactttgaattacagccttg

SEQ ID NO: 7120210 - DNA, 21 bp, Homo sapiens
atactttgaattacagccttg

SEQ ID NO: 7120211 - DNA, 22 bp, Homo sapiens
atactttgctacattgtacatt

SEQ ID NO: 7120212 - DNA, 22 bp, Homo sapiens
atactttgctagtatcagtgtg

SEQ ID NO: 7120213 - DNA, 22 bp, Homo sapiens
atactttgctagtatcagtgtg

SEQ ID NO: 7120214 - DNA, 22 bp, Homo sapiens
atactttgctagtatcagtgtg

SEQ ID NO: 7120215 - DNA, 22 bp, Homo sapiens
atactttgggggttagtgtaga

SEQ ID NO: 7120216 - DNA, 22 bp, Homo sapiens
atagaaaggtctttggcagaca

SEQ ID NO: 7120217 - DNA, 22 bp, Homo sapiens
atagaaatggcagctggtgcta

SEQ ID NO: 7120218 - DNA, 19 bp, Homo sapiens
atagaaagggttaaagaca

SEQ ID NO: 7120219 - DNA, 22 bp, Homo sapiens
atagaatagcatagaaaattga

SEQ ID NO: 7120220 - DNA, 22 bp, Homo sapiens
atagaatatgacttttagatcc

SEQ ID NO: 7120221 - DNA, 22 bp, Homo sapiens
atagaatagcatagaaaattga

SEQ ID NO: 7120222 - DNA, 22 bp, Homo sapiens
atagaatagcatagaaaattga

SEQ ID NO: 7120223 - DNA, 22 bp, Homo sapiens
atagaatatgacttttagatcc

SEQ ID NO: 7120224 - DNA, 22 bp, Homo sapiens
atagaatatgacttttagatcc

SEQ ID NO: 7120225 - DNA, 20 bp, Homo sapiens
atagaatcacaagtcctgaa

SEQ ID NO: 7120226 - DNA, 22 bp, Homo sapiens
atagaatatgacttttagatcc

SEQ ID NO: 7120227 - DNA, 22 bp, Homo sapiens
atagaatatgacttttagatcc

SEQ ID NO: 7120228 - DNA, 22 bp, Homo sapiens
atacatatatggtacttcctgg

SEQ ID NO: 7120229 - DNA, 22 bp, Homo sapiens
ctggaagactcaatggcctgcc

SEQ ID NO: 7120230 - DNA, 22 bp, Homo sapiens
ctggaagactcaatggcctgcc

SEQ ID NO: 7120231 - DNA, 22 bp, Homo sapiens
ctggaagacgtttgaagccatg

SEQ ID NO: 7120232 - DNA, 22 bp, Homo sapiens
ctggaagactcaatggcctgcc

SEQ ID NO: 7120233 - DNA, 22 bp, Homo sapiens
atacatctcatgtaagagataa

SEQ ID NO: 7120234 - DNA, 22 bp, Homo sapiens
atacatctcatgtaagagataa

SEQ ID NO: 7120235 - DNA, 22 bp, Homo sapiens
ctggaagacgtttgaagccatg

SEQ ID NO: 7120236 - DNA, 22 bp, Homo sapiens
ctggaagacgtttgaagccatg

SEQ ID NO: 7120237 - DNA, 22 bp, Homo sapiens
ctggaagaccccccaggactca

SEQ ID NO: 7120238 - DNA, 21 bp, Homo sapiens
ctggaagaagcagcaggattc

SEQ ID NO: 7120239 - DNA, 21 bp, Homo sapiens
ctggaagaagcagcaggattc

SEQ ID NO: 7120240 - DNA, 21 bp, Homo sapiens
ctggaagaagcagcaggattc

SEQ ID NO: 7120241 - DNA, 22 bp, Homo sapiens
ctggaagaactccagttctgtg

SEQ ID NO: 7120242 - DNA, 22 bp, Homo sapiens
ctggaactcctggggagctggt

SEQ ID NO: 7120243 - DNA, 22 bp, Homo sapiens
ctggaagaactccagttctgtg

SEQ ID NO: 7120244 - DNA, 22 bp, Homo sapiens
ctggaagaactccagttctgtg

SEQ ID NO: 7120245 - DNA, 23 bp, Homo sapiens
ctggaacatagtagatggtcaga

SEQ ID NO: 7120246 - DNA, 22 bp, Homo sapiens
ctggaacccaggcctggaagcc

SEQ ID NO: 7120247 - DNA, 22 bp, Homo sapiens
ctggaacccaggcctggaagcc

SEQ ID NO: 7120248 - DNA, 22 bp, Homo sapiens
ctggaacagaagcactggagag

SEQ ID NO: 7120249 - DNA, 22 bp, Homo sapiens
ctggaacagtgttggagcttga

SEQ ID NO: 7120250 - DNA, 23 bp, Homo sapiens
ctggaacatagtagatggtcaga

SEQ ID NO: 7120251 - DNA, 22 bp, Homo sapiens
ctggaaattggagatgatgttt

SEQ ID NO: 7120252 - DNA, 22 bp, Homo sapiens
ctggaaatcactactagtcaat

SEQ ID NO: 7120253 - DNA, 22 bp, Homo sapiens
ctggaaatcactactagtcaat

SEQ ID NO: 7120254 - DNA, 22 bp, Homo sapiens
ctggaaatcactactagtcaat

SEQ ID NO: 7120255 - DNA, 22 bp, Homo sapiens
ctggaacaagtggccttgcaag

SEQ ID NO: 7120256 - DNA, 22 bp, Homo sapiens
atacagaagttttccacttatt

SEQ ID NO: 7120257 - DNA, 22 bp, Homo sapiens
atacagaagttttccacttatt

SEQ ID NO: 7120258 - DNA, 21 bp, Homo sapiens
atacagaaggtggcaaagtac

SEQ ID NO: 7120259 - DNA, 19 bp, Homo sapiens
ctggaaagttggcagtgag

SEQ ID NO: 7120260 - DNA, 19 bp, Homo sapiens
ctggaaagttggcagtgag

SEQ ID NO: 7120261 - DNA, 22 bp, Homo sapiens
ctggaaatcactactagtcaat

SEQ ID NO: 7120262 - DNA, 21 bp, Homo sapiens
atacagaaggtggcaaagtac

SEQ ID NO: 7120263 - DNA, 21 bp, Homo sapiens
atacagaaggtggcaaagtac

SEQ ID NO: 7120264 - DNA, 21 bp, Homo sapiens
atacagaaggtggcaaagtac

SEQ ID NO: 7120265 - DNA, 21 bp, Homo sapiens
atacagaaggtggcaaagtac

SEQ ID NO: 7120266 - DNA, 22 bp, Homo sapiens
atacagaagcctgtatttctgg

SEQ ID NO: 7120267 - DNA, 21 bp, Homo sapiens
atacagaaggcagactctctc

SEQ ID NO: 7120268 - DNA, 22 bp, Homo sapiens
atacagaagacccctccgtcat

SEQ ID NO: 7120269 - DNA, 22 bp, Homo sapiens
atacagaagcctgtatttctgg

SEQ ID NO: 7120270 - DNA, 22 bp, Homo sapiens
atacagaagcctgtatttctgg

SEQ ID NO: 7120271 - DNA, 22 bp, Homo sapiens
atacagaagcctgtatttctgg

SEQ ID NO: 7120272 - DNA, 22 bp, Homo sapiens
atacatgactcacacattctgc

SEQ ID NO: 7120273 - DNA, 22 bp, Homo sapiens
atacatgacagcatagcatcct

SEQ ID NO: 7120274 - DNA, 22 bp, Homo sapiens
atacatgacagcatagcatcct

SEQ ID NO: 7120275 - DNA, 22 bp, Homo sapiens
atacatgactcacacattctgc

SEQ ID NO: 7120276 - DNA, 22 bp, Homo sapiens
atacatgactcacacattctgc

SEQ ID NO: 7120277 - DNA, 22 bp, Homo sapiens
atacatcttccttttaaaatgc

SEQ ID NO: 7120278 - DNA, 22 bp, Homo sapiens
atacatcttccttttaaaatgc

SEQ ID NO: 7120279 - DNA, 22 bp, Homo sapiens
atacatctcatgtaagagataa

SEQ ID NO: 7120280 - DNA, 22 bp, Homo sapiens
atacatctcatgtaagagataa

SEQ ID NO: 7120281 - DNA, 22 bp, Homo sapiens
atacatctctttgaagtgcttt

SEQ ID NO: 7120282 - DNA, 22 bp, Homo sapiens
ctggagctgtcttcacaggcct

SEQ ID NO: 7120283 - DNA, 22 bp, Homo sapiens
ctggagctgtcttcacaggcct

SEQ ID NO: 7120284 - DNA, 22 bp, Homo sapiens
ctggagctgggctagggtagga

SEQ ID NO: 7120285 - DNA, 22 bp, Homo sapiens
ctggagctggtatagggacaaa

SEQ ID NO: 7120286 - DNA, 22 bp, Homo sapiens
ctggagctggtatagggacaaa

SEQ ID NO: 7120287 - DNA, 22 bp, Homo sapiens
ctggagctgccagggctgccgc

SEQ ID NO: 7120288 - DNA, 22 bp, Homo sapiens
ctggagctgccagggctgccgc

SEQ ID NO: 7120289 - DNA, 22 bp, Homo sapiens
ctggagctggcccaggctggcc

SEQ ID NO: 7120290 - DNA, 22 bp, Homo sapiens
ctggagctggcccaggctggcc

SEQ ID NO: 7120291 - DNA, 22 bp, Homo sapiens
atacatgatacttagtacgtag

SEQ ID NO: 7120292 - DNA, 22 bp, Homo sapiens
atacatgatacttagtacgtag

SEQ ID NO: 7120293 - DNA, 22 bp, Homo sapiens
atacatgatcactgtattataa

SEQ ID NO: 7120294 - DNA, 21 bp, Homo sapiens
ataatgtacaaaaactgtctt

SEQ ID NO: 7120295 - DNA, 22 bp, Homo sapiens
ataatgtaaggctccctacagt

SEQ ID NO: 7120296 - DNA, 22 bp, Homo sapiens
ataatgtacaactgcttttaat

SEQ ID NO: 7120297 - DNA, 22 bp, Homo sapiens
ataatgtaggtatgtgtattta

SEQ ID NO: 7120298 - DNA, 22 bp, Homo sapiens
ataatcattcacataaggtgct

SEQ ID NO: 7120299 - DNA, 22 bp, Homo sapiens
ctgcctggaaggagcaagggga

SEQ ID NO: 7120300 - DNA, 22 bp, Homo sapiens
ataatcattcacataaggtgct

SEQ ID NO: 7120301 - DNA, 22 bp, Homo sapiens
ataatggtagatgtccacgcag

SEQ ID NO: 7120302 - DNA, 22 bp, Homo sapiens
ataatgtaggctcctgggagaa

SEQ ID NO: 7120303 - DNA, 22 bp, Homo sapiens
ataatgtgatatttcatttaca

SEQ ID NO: 7120304 - DNA, 22 bp, Homo sapiens
ataatgtgttcatcttacaatt

SEQ ID NO: 7120305 - DNA, 22 bp, Homo sapiens
ataatgtttcagtactgtctgt

SEQ ID NO: 7120306 - DNA, 22 bp, Homo sapiens
ataatgtttcagtactgtctgt

SEQ ID NO: 7120307 - DNA, 22 bp, Homo sapiens
ataatgtttcagtactgtctgt

SEQ ID NO: 7120308 - DNA, 22 bp, Homo sapiens
ataattatctcagacacttgtt

SEQ ID NO: 7120309 - DNA, 22 bp, Homo sapiens
ataattatctcagacacttgtt

SEQ ID NO: 7120310 - DNA, 22 bp, Homo sapiens
ataattatctcagacacttgtt

SEQ ID NO: 7120311 - DNA, 22 bp, Homo sapiens
ataattatctcagacacttgtt

SEQ ID NO: 7120312 - DNA, 22 bp, Homo sapiens
ataattatctcagacacttgtt

SEQ ID NO: 7120313 - DNA, 16 bp, Homo sapiens
ataattactgctactt

SEQ ID NO: 7120314 - DNA, 22 bp, Homo sapiens
ataatgtttttgtataagcatg

SEQ ID NO: 7120315 - DNA, 22 bp, Homo sapiens
ataattaatttcagtaatctcc

SEQ ID NO: 7120316 - DNA, 22 bp, Homo sapiens
ataattaatttcagtaatctcc

SEQ ID NO: 7120317 - DNA, 22 bp, Homo sapiens
ataattaatttcagtaatctcc

SEQ ID NO: 7120318 - DNA, 22 bp, Homo sapiens
ataattaatttcagtaatctcc

SEQ ID NO: 7120319 - DNA, 20 bp, Homo sapiens
ataattacatagagattgcc

SEQ ID NO: 7120320 - DNA, 22 bp, Homo sapiens
ataattacattatactgttaga

SEQ ID NO: 7120321 - DNA, 22 bp, Homo sapiens
ataattacattatactgttaga

SEQ ID NO: 7120322 - DNA, 20 bp, Homo sapiens
ataattatttacttttgtgc

SEQ ID NO: 7120323 - DNA, 20 bp, Homo sapiens
ataattatttacttttgtgc

SEQ ID NO: 7120324 - DNA, 22 bp, Homo sapiens
ataatttaaattagtatgtgat

SEQ ID NO: 7120325 - DNA, 22 bp, Homo sapiens
ataatttaaattagtatgtgat

SEQ ID NO: 7120326 - DNA, 22 bp, Homo sapiens
ataatttaaattagtatgtgat

SEQ ID NO: 7120327 - DNA, 22 bp, Homo sapiens
ataatttaaattagtatgtgat

SEQ ID NO: 7120328 - DNA, 22 bp, Homo sapiens
ataattctccaatttttgttgt

SEQ ID NO: 7120329 - DNA, 22 bp, Homo sapiens
ataattctccaatttttgttgt

SEQ ID NO: 7120330 - DNA, 22 bp, Homo sapiens
ataatttaattttcacagtggt

SEQ ID NO: 7120331 - DNA, 22 bp, Homo sapiens
ataatttaattttcacagtggt

SEQ ID NO: 7120332 - DNA, 22 bp, Homo sapiens
ataatttacaactgcttttaat

SEQ ID NO: 7120333 - DNA, 22 bp, Homo sapiens
ataatttacaactgcttttaat

SEQ ID NO: 7120334 - DNA, 22 bp, Homo sapiens
ataatttacaactgcttttaat

SEQ ID NO: 7120335 - DNA, 22 bp, Homo sapiens
ataatttacaactgcttttaat

SEQ ID NO: 7120336 - DNA, 22 bp, Homo sapiens
ataatttacaactgcttttaat

SEQ ID NO: 7120337 - DNA, 22 bp, Homo sapiens
ataatttacaactgcttttaat

SEQ ID NO: 7120338 - DNA, 22 bp, Homo sapiens
ataatttaaattagtatgtgat

SEQ ID NO: 7120339 - DNA, 22 bp, Homo sapiens
ataatttaaattagtatgtgat

SEQ ID NO: 7120340 - DNA, 22 bp, Homo sapiens
ataatttaattttcacagtggt

SEQ ID NO: 7120341 - DNA, 22 bp, Homo sapiens
ataatttaattttcacagtggt

SEQ ID NO: 7120342 - DNA, 22 bp, Homo sapiens
ataatttaattttcacagtggt

SEQ ID NO: 7120343 - DNA, 20 bp, Homo sapiens
ataatttaccctgcaccact

SEQ ID NO: 7120344 - DNA, 22 bp, Homo sapiens
ataatttacaactgcttttaat

SEQ ID NO: 7120345 - DNA, 22 bp, Homo sapiens
ataatttacaactgcttttaat

SEQ ID NO: 7120346 - DNA, 22 bp, Homo sapiens
ataatttacaactgcttttaat

SEQ ID NO: 7120347 - DNA, 20 bp, Homo sapiens
ataatttaccctgcaccact

SEQ ID NO: 7120348 - DNA, 20 bp, Homo sapiens
atacacattcatagaaaaat

SEQ ID NO: 7120349 - DNA, 20 bp, Homo sapiens
ataatttaccctgcaccact

SEQ ID NO: 7120350 - DNA, 20 bp, Homo sapiens
ataatttaccctgcaccact

SEQ ID NO: 7120351 - DNA, 22 bp, Homo sapiens
atacagaagaactatagccact

SEQ ID NO: 7120352 - DNA, 22 bp, Homo sapiens
atacagaagaactatagccact

SEQ ID NO: 7120353 - DNA, 22 bp, Homo sapiens
atacagaactctcagttgtata

SEQ ID NO: 7120354 - DNA, 22 bp, Homo sapiens
atacagaactctcagttgtata

SEQ ID NO: 7120355 - DNA, 21 bp, Homo sapiens
atacagaacattgatccaaga

SEQ ID NO: 7120356 - DNA, 21 bp, Homo sapiens
atacagaacattgatccaaga

SEQ ID NO: 7120357 - DNA, 22 bp, Homo sapiens
atacagaactctcagttgtata

SEQ ID NO: 7120358 - DNA, 22 bp, Homo sapiens
atacagaactctcagttgtata

SEQ ID NO: 7120359 - DNA, 22 bp, Homo sapiens
atacagaactctcagttgtata

SEQ ID NO: 7120360 - DNA, 22 bp, Homo sapiens
atacagaacaagcctcacctcc

SEQ ID NO: 7120361 - DNA, 22 bp, Homo sapiens
atacagaacaagcctcacctcc

SEQ ID NO: 7120362 - DNA, 21 bp, Homo sapiens
atacagaacattgatccaaga

SEQ ID NO: 7120363 - DNA, 21 bp, Homo sapiens
atacagaacattgatccaaga

SEQ ID NO: 7120364 - DNA, 21 bp, Homo sapiens
atacagaacattgatccaaga

SEQ ID NO: 7120365 - DNA, 22 bp, Homo sapiens
atacagaaaatgatgcagagtt

SEQ ID NO: 7120366 - DNA, 22 bp, Homo sapiens
atacagaaaatgatgcagagtt

SEQ ID NO: 7120367 - DNA, 22 bp, Homo sapiens
atacagaaaatgatgcagagtt

SEQ ID NO: 7120368 - DNA, 22 bp, Homo sapiens
atacagaaaatgatgcagagtt

SEQ ID NO: 7120369 - DNA, 22 bp, Homo sapiens
atacagaaaatgatgcagagtt

SEQ ID NO: 7120370 - DNA, 22 bp, Homo sapiens
atacagaaaatgatgcagagtt

SEQ ID NO: 7120371 - DNA, 22 bp, Homo sapiens
atacactttagaaaaacgctgc

SEQ ID NO: 7120372 - DNA, 22 bp, Homo sapiens
atacactttagaaaaacgctgc

SEQ ID NO: 7120373 - DNA, 22 bp, Homo sapiens
atacagaaaagtggatagccag

SEQ ID NO: 7120374 - DNA, 19 bp, Homo sapiens
agtttattataggtgattc

SEQ ID NO: 7120375 - DNA, 19 bp, Homo sapiens
agtttattataggtgattc

SEQ ID NO: 7120376 - DNA, 20 bp, Homo sapiens
agtttattccaggagaactg

SEQ ID NO: 7120377 - DNA, 19 bp, Homo sapiens
agtttattataggtgattc

SEQ ID NO: 7120378 - DNA, 19 bp, Homo sapiens
agtttattataggtgattc

SEQ ID NO: 7120379 - DNA, 19 bp, Homo sapiens
agtttattataggtgattc

SEQ ID NO: 7120380 - DNA, 19 bp, Homo sapiens
agtttattataggtgattc

SEQ ID NO: 7120381 - DNA, 19 bp, Homo sapiens
agtttattataggtgattc

SEQ ID NO: 7120382 - DNA, 19 bp, Homo sapiens
agtttattataggtgattc

SEQ ID NO: 7120383 - DNA, 22 bp, Homo sapiens
agtttatgttgtttataagcca

SEQ ID NO: 7120384 - DNA, 22 bp, Homo sapiens
agtttatgttgtttataagcca

SEQ ID NO: 7120385 - DNA, 21 bp, Homo sapiens
agtttacaactgtccagcccc

SEQ ID NO: 7120386 - DNA, 22 bp, Homo sapiens
agtgttctaacaactgctttca

SEQ ID NO: 7120387 - DNA, 22 bp, Homo sapiens
agtgttctcagctactagagag

SEQ ID NO: 7120388 - DNA, 18 bp, Homo sapiens
agtgttctcgttttataa

SEQ ID NO: 7120389 - DNA, 22 bp, Homo sapiens
agtttacaacagtagctatgga

SEQ ID NO: 7120390 - DNA, 22 bp, Homo sapiens
agtgttccacacatctggggaa

SEQ ID NO: 7120391 - DNA, 20 bp, Homo sapiens
agtgttccggaagactggca

SEQ ID NO: 7120392 - DNA, 22 bp, Homo sapiens
agtgttaatggtgtatattagg

SEQ ID NO: 7120393 - DNA, 23 bp, Homo sapiens
agtgttagtagttgtcttatgct

SEQ ID NO: 7120394 - DNA, 22 bp, Homo sapiens
agtgttagtgaaaggtgtttat

SEQ ID NO: 7120395 - DNA, 22 bp, Homo sapiens
agtgttagtgaaaggtgtttat

SEQ ID NO: 7120396 - DNA, 22 bp, Homo sapiens
agtgttagtggctgcagctggt

SEQ ID NO: 7120397 - DNA, 22 bp, Homo sapiens
agtgttagtggctgcagctggt

SEQ ID NO: 7120398 - DNA, 21 bp, Homo sapiens
agtgttataggagcagggaaa

SEQ ID NO: 7120399 - DNA, 22 bp, Homo sapiens
agtgttatttattgtttcataa

SEQ ID NO: 7120400 - DNA, 22 bp, Homo sapiens
agtttcacagaatatgaaggtt

SEQ ID NO: 7120401 - DNA, 22 bp, Homo sapiens
agtttatttttgataagtcttg

SEQ ID NO: 7120402 - DNA, 22 bp, Homo sapiens
agtttatttttgataagtcttg

SEQ ID NO: 7120403 - DNA, 22 bp, Homo sapiens
agtttatttttgataagtcttg

SEQ ID NO: 7120404 - DNA, 22 bp, Homo sapiens
agtttatttttgataagtcttg

SEQ ID NO: 7120405 - DNA, 22 bp, Homo sapiens
agtttatttttgataagtcttg

SEQ ID NO: 7120406 - DNA, 22 bp, Homo sapiens
agtttatttttgataagtcttg

SEQ ID NO: 7120407 - DNA, 17 bp, Homo sapiens
agtttatttagccttct

SEQ ID NO: 7120408 - DNA, 17 bp, Homo sapiens
agtttatttagccttct

SEQ ID NO: 7120409 - DNA, 17 bp, Homo sapiens
agtttatttagccttct

SEQ ID NO: 7120410 - DNA, 17 bp, Homo sapiens
agtttatttagccttct

SEQ ID NO: 7120411 - DNA, 17 bp, Homo sapiens
agtttatttagccttct

SEQ ID NO: 7120412 - DNA, 17 bp, Homo sapiens
agtttatttagccttct

SEQ ID NO: 7120413 - DNA, 22 bp, Homo sapiens
agtttatttctccatttaccta

SEQ ID NO: 7120414 - DNA, 22 bp, Homo sapiens
agtttatttctccatttaccta

SEQ ID NO: 7120415 - DNA, 22 bp, Homo sapiens
agtttatttctccatttaccta

SEQ ID NO: 7120416 - DNA, 22 bp, Homo sapiens
agtttatttctccatttaccta

SEQ ID NO: 7120417 - DNA, 22 bp, Homo sapiens
agtttatttctccatttaccta

SEQ ID NO: 7120418 - DNA, 22 bp, Homo sapiens
agtttatttctccatttaccta

SEQ ID NO: 7120419 - DNA, 22 bp, Homo sapiens
agtttatttttgataagtcttg

SEQ ID NO: 7120420 - DNA, 22 bp, Homo sapiens
agtttattgtatatggtagttt

SEQ ID NO: 7120421 - DNA, 22 bp, Homo sapiens
agtttattgtatatggtagttt

SEQ ID NO: 7120422 - DNA, 22 bp, Homo sapiens
agtttattctgcttggccctcc

SEQ ID NO: 7120423 - DNA, 22 bp, Homo sapiens
agtttattctgcttggccctcc

SEQ ID NO: 7120424 - DNA, 22 bp, Homo sapiens
agtttattctgcttggccctcc

SEQ ID NO: 7120425 - DNA, 22 bp, Homo sapiens
agtttattctgcttggccctcc

SEQ ID NO: 7120426 - DNA, 22 bp, Homo sapiens
agtttattctgcttggccctcc

SEQ ID NO: 7120427 - DNA, 22 bp, Homo sapiens
agtttattgtatatggtagttt

SEQ ID NO: 7120428 - DNA, 22 bp, Homo sapiens
agtttattgtatatggtagttt

SEQ ID NO: 7120429 - DNA, 22 bp, Homo sapiens
agtttattgtatatggtagttt

SEQ ID NO: 7120430 - DNA, 22 bp, Homo sapiens
agtttattgtatatggtagttt

SEQ ID NO: 7120431 - DNA, 22 bp, Homo sapiens
agtttattgtatatggtagttt

SEQ ID NO: 7120432 - DNA, 17 bp, Homo sapiens
agtttatttagccttct

SEQ ID NO: 7120433 - DNA, 20 bp, Homo sapiens
agtttattccaggagaactg

SEQ ID NO: 7120434 - DNA, 20 bp, Homo sapiens
agtttattccaggagaactg

SEQ ID NO: 7120435 - DNA, 20 bp, Homo sapiens
agtttattccaggagaactg

SEQ ID NO: 7120436 - DNA, 20 bp, Homo sapiens
agtttattccaggagaactg

SEQ ID NO: 7120437 - DNA, 20 bp, Homo sapiens
agtttattccaggagaactg

SEQ ID NO: 7120438 - DNA, 20 bp, Homo sapiens
agtttattccaggagaactg

SEQ ID NO: 7120439 - DNA, 22 bp, Homo sapiens
agtttattctctggtcttagta

SEQ ID NO: 7120440 - DNA, 22 bp, Homo sapiens
agtttattctctggtcttagta

SEQ ID NO: 7120441 - DNA, 22 bp, Homo sapiens
agtttattctctggtcttagta

SEQ ID NO: 7120442 - DNA, 22 bp, Homo sapiens
agtttattctctggtcttagta

SEQ ID NO: 7120443 - DNA, 22 bp, Homo sapiens
agtttattctctggtcttagta

SEQ ID NO: 7120444 - DNA, 22 bp, Homo sapiens
agtttattctctggtcttagta

SEQ ID NO: 7120445 - DNA, 22 bp, Homo sapiens
agtttattctctggtcttagta

SEQ ID NO: 7120446 - DNA, 22 bp, Homo sapiens
agtttattctctggtcttagta

SEQ ID NO: 7120447 - DNA, 22 bp, Homo sapiens
agtttattctgcttggccctcc

SEQ ID NO: 7120448 - DNA, 22 bp, Homo sapiens
ctgagtggaacataggatgata

SEQ ID NO: 7120449 - DNA, 22 bp, Homo sapiens
ctgagtgggtttctgcttgtca

SEQ ID NO: 7120450 - DNA, 22 bp, Homo sapiens
ctgagtgaggggagcttgatgg

SEQ ID NO: 7120451 - DNA, 22 bp, Homo sapiens
ctgagttctgcccaaggtctgg

SEQ ID NO: 7120452 - DNA, 22 bp, Homo sapiens
ctgagttctaggctgccacctt

SEQ ID NO: 7120453 - DNA, 22 bp, Homo sapiens
ctgataatacagcagtttgtct

SEQ ID NO: 7120454 - DNA, 21 bp, Homo sapiens
ctgataattgttaaattattt

SEQ ID NO: 7120455 - DNA, 22 bp, Homo sapiens
ctgatacaatgctaataaattt

SEQ ID NO: 7120456 - DNA, 22 bp, Homo sapiens
ctgatacactccctaaaatata

SEQ ID NO: 7120457 - DNA, 22 bp, Homo sapiens
ctgatacactccctaaaatata

SEQ ID NO: 7120458 - DNA, 21 bp, Homo sapiens
ctgataattgttaaattattt

SEQ ID NO: 7120459 - DNA, 21 bp, Homo sapiens
ctgataattgttaaattattt

SEQ ID NO: 7120460 - DNA, 22 bp, Homo sapiens
ctgataatttcaaaaatcttca

SEQ ID NO: 7120461 - DNA, 22 bp, Homo sapiens
ctgatacaatgctaataaattt

SEQ ID NO: 7120462 - DNA, 22 bp, Homo sapiens
ctgatacatagtagcatgtcat

SEQ ID NO: 7120463 - DNA, 22 bp, Homo sapiens
ctgatagacaatcaccatggga

SEQ ID NO: 7120464 - DNA, 22 bp, Homo sapiens
ctgatatgatgggtgattttca

SEQ ID NO: 7120465 - DNA, 22 bp, Homo sapiens
agttttattccaatgtgcagca

SEQ ID NO: 7120466 - DNA, 22 bp, Homo sapiens
agttttattaaatccacagaag

SEQ ID NO: 7120467 - DNA, 22 bp, Homo sapiens
agttttattccaatgtgcagca

SEQ ID NO: 7120468 - DNA, 22 bp, Homo sapiens
agttttattccaatgtgcagca

SEQ ID NO: 7120469 - DNA, 22 bp, Homo sapiens
agttttattaaatccacagaag

SEQ ID NO: 7120470 - DNA, 22 bp, Homo sapiens
agttttattaaatccacagaag

SEQ ID NO: 7120471 - DNA, 22 bp, Homo sapiens
agttttattgtcccagaggtga

SEQ ID NO: 7120472 - DNA, 22 bp, Homo sapiens
agttttattccaatgtgcagca

SEQ ID NO: 7120473 - DNA, 22 bp, Homo sapiens
agttttattgtcccagaggtga

SEQ ID NO: 7120474 - DNA, 23 bp, Homo sapiens
agttttcaagttggtggctggca

SEQ ID NO: 7120475 - DNA, 22 bp, Homo sapiens
agttttcaatatatgatagtga

SEQ ID NO: 7120476 - DNA, 22 bp, Homo sapiens
agttttcaatatatgatagtga

SEQ ID NO: 7120477 - DNA, 22 bp, Homo sapiens
agttttattaaatccacagaag

SEQ ID NO: 7120478 - DNA, 22 bp, Homo sapiens
agttttatgttcacagaaggat

SEQ ID NO: 7120479 - DNA, 22 bp, Homo sapiens
ctgatattaacaggcaagtgag

SEQ ID NO: 7120480 - DNA, 22 bp, Homo sapiens
ctgatattattgaagctggagt

SEQ ID NO: 7120481 - DNA, 22 bp, Homo sapiens
ctgatattattgaagctggagt

SEQ ID NO: 7120482 - DNA, 22 bp, Homo sapiens
ctgatattcattatggagctcc

SEQ ID NO: 7120483 - DNA, 22 bp, Homo sapiens
ctgatattcattatggagctcc

SEQ ID NO: 7120484 - DNA, 22 bp, Homo sapiens
ctgatattctattttgcttgct

SEQ ID NO: 7120485 - DNA, 22 bp, Homo sapiens
ctgatattctattttgcttgct

SEQ ID NO: 7120486 - DNA, 22 bp, Homo sapiens
ctgatattcttgaaatcatggt

SEQ ID NO: 7120487 - DNA, 22 bp, Homo sapiens
ctgatattcttgaaatcatggt

SEQ ID NO: 7120488 - DNA, 22 bp, Homo sapiens
ctgatattctttgagctgctaa

SEQ ID NO: 7120489 - DNA, 22 bp, Homo sapiens
ctgatattctttgagctgctaa

SEQ ID NO: 7120490 - DNA, 22 bp, Homo sapiens
ctgatatttctcttaacactag

SEQ ID NO: 7120491 - DNA, 22 bp, Homo sapiens
agtttcacatgcatggatgtgt

SEQ ID NO: 7120492 - DNA, 22 bp, Homo sapiens
agtttcagaatttatgcagaca

SEQ ID NO: 7120493 - DNA, 22 bp, Homo sapiens
agtttcagtgttgacagatggt

SEQ ID NO: 7120494 - DNA, 18 bp, Homo sapiens
agtttcagggcaggaaac

SEQ ID NO: 7120495 - DNA, 22 bp, Homo sapiens
agtttcatattaccatgtcacc

SEQ ID NO: 7120496 - DNA, 22 bp, Homo sapiens
agtttcatgagacagattttca

SEQ ID NO: 7120497 - DNA, 22 bp, Homo sapiens
agtttcatgagacagattttca

SEQ ID NO: 7120498 - DNA, 22 bp, Homo sapiens
agtttcatgagacagattttca

SEQ ID NO: 7120499 - DNA, 22 bp, Homo sapiens
agtttcatgtagccatatttac

SEQ ID NO: 7120500 - DNA, 22 bp, Homo sapiens
agtttctcttaatctagtatct

SEQ ID NO: 7120501 - DNA, 22 bp, Homo sapiens
agtttctctcagtatagaatag

SEQ ID NO: 7120502 - DNA, 22 bp, Homo sapiens
agtttctctagagtctttgaaa

SEQ ID NO: 7120503 - DNA, 22 bp, Homo sapiens
agtttctctttgacaccaaaat

SEQ ID NO: 7120504 - DNA, 22 bp, Homo sapiens
agtttcttcatccaaaaaatgg

SEQ ID NO: 7120505 - DNA, 22 bp, Homo sapiens
agtttcttcatccaaaaaatgg

SEQ ID NO: 7120506 - DNA, 22 bp, Homo sapiens
agtttcttattcttagttatgt

SEQ ID NO: 7120507 - DNA, 23 bp, Homo sapiens
agtttctttgagacttgccctgt

SEQ ID NO: 7120508 - DNA, 22 bp, Homo sapiens
agtttcttgaagactgatgttt

SEQ ID NO: 7120509 - DNA, 22 bp, Homo sapiens
agtttcttgccgtgctttccat

SEQ ID NO: 7120510 - DNA, 22 bp, Homo sapiens
agtttcttggtcacagttttca

SEQ ID NO: 7120511 - DNA, 22 bp, Homo sapiens
ctgccctggtcccatggctgat

SEQ ID NO: 7120512 - DNA, 22 bp, Homo sapiens
ctgccctgacctgcctcagagt

SEQ ID NO: 7120513 - DNA, 22 bp, Homo sapiens
ctgccctgacctgcctcagagt

SEQ ID NO: 7120514 - DNA, 22 bp, Homo sapiens
ctgccctgacctgcctcagagt

SEQ ID NO: 7120515 - DNA, 22 bp, Homo sapiens
ctgccctgacctgcctcagagt

SEQ ID NO: 7120516 - DNA, 22 bp, Homo sapiens
ctgccctgacctgcctcagagt

SEQ ID NO: 7120517 - DNA, 22 bp, Homo sapiens
ctgccctgacctgcctcagagt

SEQ ID NO: 7120518 - DNA, 22 bp, Homo sapiens
ctgccctctagggatgcactgg

SEQ ID NO: 7120519 - DNA, 22 bp, Homo sapiens
ctgccctctagaggaggactga

SEQ ID NO: 7120520 - DNA, 22 bp, Homo sapiens
ctgccctctagggatgcactgg

SEQ ID NO: 7120521 - DNA, 22 bp, Homo sapiens
ctgccctctagaggaggactga

SEQ ID NO: 7120522 - DNA, 22 bp, Homo sapiens
ctgccctcgggccctcccatag

SEQ ID NO: 7120523 - DNA, 22 bp, Homo sapiens
ctgccctcgggccctcccatag

SEQ ID NO: 7120524 - DNA, 18 bp, Homo sapiens
ctgccccttctctgagat

SEQ ID NO: 7120525 - DNA, 22 bp, Homo sapiens
ctgcccgtccctttgctctcgc

SEQ ID NO: 7120526 - DNA, 21 bp, Homo sapiens
ctgccctagatggctctggaa

SEQ ID NO: 7120527 - DNA, 18 bp, Homo sapiens
ctgcccagagcatttcat

SEQ ID NO: 7120528 - DNA, 18 bp, Homo sapiens
ctgcccagagcatttcat

SEQ ID NO: 7120529 - DNA, 22 bp, Homo sapiens
agttttgactaagatggcttgg

SEQ ID NO: 7120530 - DNA, 17 bp, Homo sapiens
agttttgatataatggc

SEQ ID NO: 7120531 - DNA, 22 bp, Homo sapiens
ctgcccagattttaccacctgc

SEQ ID NO: 7120532 - DNA, 18 bp, Homo sapiens
ctgccccttctctgagat

SEQ ID NO: 7120533 - DNA, 20 bp, Homo sapiens
agttttcagcagaacaccca

SEQ ID NO: 7120534 - DNA, 22 bp, Homo sapiens
agttttcaggaaagagttggtg

SEQ ID NO: 7120535 - DNA, 20 bp, Homo sapiens
agttttcagcagaacaccca

SEQ ID NO: 7120536 - DNA, 22 bp, Homo sapiens
agttttcagaaattgcgaccca

SEQ ID NO: 7120537 - DNA, 22 bp, Homo sapiens
agttttcacactcaccaaaagg

SEQ ID NO: 7120538 - DNA, 22 bp, Homo sapiens
agttttcacactcaccaaaagg

SEQ ID NO: 7120539 - DNA, 22 bp, Homo sapiens
agttttcattaccatgctgcaa

SEQ ID NO: 7120540 - DNA, 22 bp, Homo sapiens
agttttcctctcatttatcaat

SEQ ID NO: 7120541 - DNA, 22 bp, Homo sapiens
agttttcagggtttctgtcctc

SEQ ID NO: 7120542 - DNA, 22 bp, Homo sapiens
agttttcagtaaatattagtga

SEQ ID NO: 7120543 - DNA, 22 bp, Homo sapiens
agttttctgacccctgctctat

SEQ ID NO: 7120544 - DNA, 22 bp, Homo sapiens
agttttctctgtgttctgctta

SEQ ID NO: 7120545 - DNA, 22 bp, Homo sapiens
agttttcattaccatgctgcaa

SEQ ID NO: 7120546 - DNA, 22 bp, Homo sapiens
agttttcctctcatttatcaat

SEQ ID NO: 7120547 - DNA, 22 bp, Homo sapiens
agttttcctttattgagtacca

SEQ ID NO: 7120548 - DNA, 22 bp, Homo sapiens
agttttctcacatcaaaaatga

SEQ ID NO: 7120549 - DNA, 22 bp, Homo sapiens
agttttctcacatcaaaaatga

SEQ ID NO: 7120550 - DNA, 22 bp, Homo sapiens
agttttctttcgcaaaggtaca

SEQ ID NO: 7120551 - DNA, 22 bp, Homo sapiens
agttttctttcgcaaaggtaca

SEQ ID NO: 7120552 - DNA, 22 bp, Homo sapiens
ctgccctgtctgcagcctggct

SEQ ID NO: 7120553 - DNA, 22 bp, Homo sapiens
ctgccctgtctgcagcctggct

SEQ ID NO: 7120554 - DNA, 22 bp, Homo sapiens
ctgccctgtctgcagcctggct

SEQ ID NO: 7120555 - DNA, 22 bp, Homo sapiens
ctgccctgtgagggtccttggg

SEQ ID NO: 7120556 - DNA, 22 bp, Homo sapiens
ctgccctgtgagggtccttggg

SEQ ID NO: 7120557 - DNA, 22 bp, Homo sapiens
ctgccctgtgagggtccttggg

SEQ ID NO: 7120558 - DNA, 22 bp, Homo sapiens
ctgccctgtgcacaggaaactg

SEQ ID NO: 7120559 - DNA, 22 bp, Homo sapiens
ctgccctgtggctctgagtcat

SEQ ID NO: 7120560 - DNA, 22 bp, Homo sapiens
ctgccctgtggctctgagtcat

SEQ ID NO: 7120561 - DNA, 22 bp, Homo sapiens
ataataaaccaggatgggtctg

SEQ ID NO: 7120562 - DNA, 22 bp, Homo sapiens
ataataaaccaggatgggtctg

SEQ ID NO: 7120563 - DNA, 22 bp, Homo sapiens
ataataaaccaggatgggtctg

SEQ ID NO: 7120564 - DNA, 22 bp, Homo sapiens
ataagtttgtctttgtaaagat

SEQ ID NO: 7120565 - DNA, 21 bp, Homo sapiens
ataagttgtgcaactgtttga

SEQ ID NO: 7120566 - DNA, 22 bp, Homo sapiens
ataagtttgtctttgtaaagat

SEQ ID NO: 7120567 - DNA, 19 bp, Homo sapiens
ataagttcaactggaccca

SEQ ID NO: 7120568 - DNA, 22 bp, Homo sapiens
ataagttggtggtctttaatta

SEQ ID NO: 7120569 - DNA, 22 bp, Homo sapiens
ataagttggtggtctttaatta

SEQ ID NO: 7120570 - DNA, 21 bp, Homo sapiens
ataagttgtgcaactgtttga

SEQ ID NO: 7120571 - DNA, 21 bp, Homo sapiens
ataagttgtgcaactgtttga

SEQ ID NO: 7120572 - DNA, 22 bp, Homo sapiens
ctgccctgtggctctgagtcat

SEQ ID NO: 7120573 - DNA, 22 bp, Homo sapiens
ctgccctgtggctctgagtcat

SEQ ID NO: 7120574 - DNA, 22 bp, Homo sapiens
ctgccctgtttggacagcccgg

SEQ ID NO: 7120575 - DNA, 22 bp, Homo sapiens
ataagcctgattcacttgtcat

SEQ ID NO: 7120576 - DNA, 22 bp, Homo sapiens
ataagctctggacagccacatt

SEQ ID NO: 7120577 - DNA, 22 bp, Homo sapiens
ataagtgactgcagggaattca

SEQ ID NO: 7120578 - DNA, 22 bp, Homo sapiens
ataagtgatatttagctataga

SEQ ID NO: 7120579 - DNA, 22 bp, Homo sapiens
ctgcctgcttttctgggagccg

SEQ ID NO: 7120580 - DNA, 22 bp, Homo sapiens
ctgcctgcttttctgggagccg

SEQ ID NO: 7120581 - DNA, 22 bp, Homo sapiens
ctgcctgcttctgagccagagg

SEQ ID NO: 7120582 - DNA, 22 bp, Homo sapiens
ctgcctgcttctgagccagagg

SEQ ID NO: 7120583 - DNA, 22 bp, Homo sapiens
ctgcctgcttaccatgcatcag

SEQ ID NO: 7120584 - DNA, 22 bp, Homo sapiens
ctgcctgcttaccatgcatcag

SEQ ID NO: 7120585 - DNA, 22 bp, Homo sapiens
ctgcctgcttctgagccagagg

SEQ ID NO: 7120586 - DNA, 22 bp, Homo sapiens
ctgcctgcttctgagccagagg

SEQ ID NO: 7120587 - DNA, 23 bp, Homo sapiens
ctgcctgctggggagacagatct

SEQ ID NO: 7120588 - DNA, 23 bp, Homo sapiens
ctgcctgctggggagacagatct

SEQ ID NO: 7120589 - DNA, 23 bp, Homo sapiens
ctgcctgctggggagacagatct

SEQ ID NO: 7120590 - DNA, 22 bp, Homo sapiens
ctgcctgctgcctgtggagggt

SEQ ID NO: 7120591 - DNA, 22 bp, Homo sapiens
ctgcctgctgccctccagagcc

SEQ ID NO: 7120592 - DNA, 22 bp, Homo sapiens
ctgcctgctgccctccagagcc

SEQ ID NO: 7120593 - DNA, 22 bp, Homo sapiens
ctgcctgctgccctccagagcc

SEQ ID NO: 7120594 - DNA, 22 bp, Homo sapiens
ctgcctgctgccctccagagcc

SEQ ID NO: 7120595 - DNA, 22 bp, Homo sapiens
ctgcctgctgccctccagagcc

SEQ ID NO: 7120596 - DNA, 18 bp, Homo sapiens
ctgcctgctctccagctt

SEQ ID NO: 7120597 - DNA, 23 bp, Homo sapiens
ataataattatggcagcaaagtg

SEQ ID NO: 7120598 - DNA, 22 bp, Homo sapiens
ataataatgaaagccactgtgt

SEQ ID NO: 7120599 - DNA, 23 bp, Homo sapiens
ataataattatggcagcaaagtg

SEQ ID NO: 7120600 - DNA, 22 bp, Homo sapiens
ataatacatggttaacctcttt

SEQ ID NO: 7120601 - DNA, 18 bp, Homo sapiens
ctgcctgctctccagctt

SEQ ID NO: 7120602 - DNA, 18 bp, Homo sapiens
ctgcctgctctccagctt

SEQ ID NO: 7120603 - DNA, 18 bp, Homo sapiens
ctgcctgctctccagctt

SEQ ID NO: 7120604 - DNA, 18 bp, Homo sapiens
ctgcctgctctccagctt

SEQ ID NO: 7120605 - DNA, 18 bp, Homo sapiens
ctgcctgctctccagctt

SEQ ID NO: 7120606 - DNA, 22 bp, Homo sapiens
ataataaaccaggatgggtctg

SEQ ID NO: 7120607 - DNA, 22 bp, Homo sapiens
ataataacacctgaataggaaa

SEQ ID NO: 7120608 - DNA, 23 bp, Homo sapiens
ataataacgtctgtcttgtctct

SEQ ID NO: 7120609 - DNA, 22 bp, Homo sapiens
ataataatactgtgcaatggat

SEQ ID NO: 7120610 - DNA, 22 bp, Homo sapiens
ataataatgaaagccactgtgt

SEQ ID NO: 7120611 - DNA, 22 bp, Homo sapiens
ctgttattcaagacaaaggcag

SEQ ID NO: 7120612 - DNA, 23 bp, Homo sapiens
ctgttattccaggctgatgggtg

SEQ ID NO: 7120613 - DNA, 22 bp, Homo sapiens
ctgttattccccttgctgtggt

SEQ ID NO: 7120614 - DNA, 19 bp, Homo sapiens
ctgttattgtcagagctcc

SEQ ID NO: 7120615 - DNA, 22 bp, Homo sapiens
ctgttatttagaacatggaatc

SEQ ID NO: 7120616 - DNA, 22 bp, Homo sapiens
ctgttatttagaacatggaatc

SEQ ID NO: 7120617 - DNA, 22 bp, Homo sapiens
ctgttatttagaacatggaatc

SEQ ID NO: 7120618 - DNA, 22 bp, Homo sapiens
ctgttatttctgaatgccatcc

SEQ ID NO: 7120619 - DNA, 22 bp, Homo sapiens
ctgttatttctgccaggtgagt

SEQ ID NO: 7120620 - DNA, 22 bp, Homo sapiens
ctgttatttgagagtgttgaat

SEQ ID NO: 7120621 - DNA, 22 bp, Homo sapiens
ctgttactcctttggcagatta

SEQ ID NO: 7120622 - DNA, 22 bp, Homo sapiens
ctgttaggttaaggaatggcaa

SEQ ID NO: 7120623 - DNA, 22 bp, Homo sapiens
ctgttatctgttattgccagtt

SEQ ID NO: 7120624 - DNA, 22 bp, Homo sapiens
ctgttatgcatggtcattgcct

SEQ ID NO: 7120625 - DNA, 23 bp, Homo sapiens
ctgttatgtaaatatgtttagtg

SEQ ID NO: 7120626 - DNA, 22 bp, Homo sapiens
ctgttattaaaaagctcaggct

SEQ ID NO: 7120627 - DNA, 22 bp, Homo sapiens
ctgttattcaagacaaaggcag

SEQ ID NO: 7120628 - DNA, 22 bp, Homo sapiens
ctgtttatctctaacctgttta

SEQ ID NO: 7120629 - DNA, 22 bp, Homo sapiens
ctgttatttgctggaagagttt

SEQ ID NO: 7120630 - DNA, 22 bp, Homo sapiens
ctgttatttgctggaagagttt

SEQ ID NO: 7120631 - DNA, 22 bp, Homo sapiens
ctgttattttataattcaagaa

SEQ ID NO: 7120632 - DNA, 22 bp, Homo sapiens
ctgtttcaaaactagtacaaca

SEQ ID NO: 7120633 - DNA, 22 bp, Homo sapiens
ctgtttattgagcaatctgcca

SEQ ID NO: 7120634 - DNA, 22 bp, Homo sapiens
ctgtttattacgtaattaatat

SEQ ID NO: 7120635 - DNA, 22 bp, Homo sapiens
atcattccacatgtaccactag

SEQ ID NO: 7120636 - DNA, 22 bp, Homo sapiens
atcattcagtctctgggacagt

SEQ ID NO: 7120637 - DNA, 22 bp, Homo sapiens
atcattcagtgaccacttccca

SEQ ID NO: 7120638 - DNA, 22 bp, Homo sapiens
atcattcagtgaccacttccca

SEQ ID NO: 7120639 - DNA, 22 bp, Homo sapiens
atcattcagtgaccacttccca

SEQ ID NO: 7120640 - DNA, 22 bp, Homo sapiens
atcattcatcttattgccagtc

SEQ ID NO: 7120641 - DNA, 22 bp, Homo sapiens
atcattctagctgttgtgttga

SEQ ID NO: 7120642 - DNA, 22 bp, Homo sapiens
ctgtgtgtcctcggacgagttt

SEQ ID NO: 7120643 - DNA, 22 bp, Homo sapiens
ctgtgtgtgaacacagcccagc

SEQ ID NO: 7120644 - DNA, 22 bp, Homo sapiens
ctgtgtgtgaacacagcccagc

SEQ ID NO: 7120645 - DNA, 22 bp, Homo sapiens
ctgtgtgtgaacacagcccagc

SEQ ID NO: 7120646 - DNA, 22 bp, Homo sapiens
ctgtgtgtgaacacagcccagc

SEQ ID NO: 7120647 - DNA, 22 bp, Homo sapiens
atcattcagcctaagcaagtac

SEQ ID NO: 7120648 - DNA, 22 bp, Homo sapiens
atcattcagcctaagcaagtac

SEQ ID NO: 7120649 - DNA, 22 bp, Homo sapiens
atcattcagtctctgggacagt

SEQ ID NO: 7120650 - DNA, 22 bp, Homo sapiens
atcattagcaattttcaataag

SEQ ID NO: 7120651 - DNA, 22 bp, Homo sapiens
atcattagcaattttcaataag

SEQ ID NO: 7120652 - DNA, 22 bp, Homo sapiens
atcattataatggtatagttgt

SEQ ID NO: 7120653 - DNA, 22 bp, Homo sapiens
atcattatcctcctatttgcct

SEQ ID NO: 7120654 - DNA, 22 bp, Homo sapiens
atcattcaagtgctctaaaatg

SEQ ID NO: 7120655 - DNA, 22 bp, Homo sapiens
atcattactcctgtaaaattgt

SEQ ID NO: 7120656 - DNA, 22 bp, Homo sapiens
atcattagaccaaactagagct

SEQ ID NO: 7120657 - DNA, 22 bp, Homo sapiens
ctgtgtcctccccatcacttct

SEQ ID NO: 7120658 - DNA, 22 bp, Homo sapiens
atcattaaatataagcttcaca

SEQ ID NO: 7120659 - DNA, 22 bp, Homo sapiens
atcattaaatataagcttcaca

SEQ ID NO: 7120660 - DNA, 22 bp, Homo sapiens
ctgtgtcccttgtcccagagcc

SEQ ID NO: 7120661 - DNA, 22 bp, Homo sapiens
atcattaaatataagcttcaca

SEQ ID NO: 7120662 - DNA, 22 bp, Homo sapiens
atcattaaatataagcttcaca

SEQ ID NO: 7120663 - DNA, 22 bp, Homo sapiens
ctgtgtcccagccaggataatg

SEQ ID NO: 7120664 - DNA, 22 bp, Homo sapiens
ctgtgtcccagtaccttgggta

SEQ ID NO: 7120665 - DNA, 22 bp, Homo sapiens
ctgtgtcccagtaccttgggta

SEQ ID NO: 7120666 - DNA, 22 bp, Homo sapiens
ctgtgtccccctcagccaggtg

SEQ ID NO: 7120667 - DNA, 22 bp, Homo sapiens
ctgtgtccccctcagccaggtg

SEQ ID NO: 7120668 - DNA, 22 bp, Homo sapiens
ctgtgtcccttgtcccagagcc

SEQ ID NO: 7120669 - DNA, 22 bp, Homo sapiens
atcaggaatgaatacttttgga

SEQ ID NO: 7120670 - DNA, 22 bp, Homo sapiens
atcaggaatgaatacttttgga

SEQ ID NO: 7120671 - DNA, 22 bp, Homo sapiens
atcaggaatgaatacttttgga

SEQ ID NO: 7120672 - DNA, 22 bp, Homo sapiens
atcaggaagccagtctaatgga

SEQ ID NO: 7120673 - DNA, 22 bp, Homo sapiens
atcaggaagatctagcgaatgt

SEQ ID NO: 7120674 - DNA, 22 bp, Homo sapiens
atcaggaagccagtctaatgga

SEQ ID NO: 7120675 - DNA, 22 bp, Homo sapiens
atcaggaagatctagcgaatgt

SEQ ID NO: 7120676 - DNA, 22 bp, Homo sapiens
atcaggaagatctagcgaatgt

SEQ ID NO: 7120677 - DNA, 22 bp, Homo sapiens
atcaggaagccagtctaatgga

SEQ ID NO: 7120678 - DNA, 22 bp, Homo sapiens
atcaggaagcgtctggtatttt

SEQ ID NO: 7120679 - DNA, 22 bp, Homo sapiens
atcaggaagaagaatgtgttgg

SEQ ID NO: 7120680 - DNA, 22 bp, Homo sapiens
atcaggaagaagaatgtgttgg

SEQ ID NO: 7120681 - DNA, 22 bp, Homo sapiens
atcaggaagaagaatgtgttgg

SEQ ID NO: 7120682 - DNA, 22 bp, Homo sapiens
atcaggaacgttcatggactgt

SEQ ID NO: 7120683 - DNA, 22 bp, Homo sapiens
atcaggaagaattggatgctac

SEQ ID NO: 7120684 - DNA, 20 bp, Homo sapiens
atcaggaagagagactgacc

SEQ ID NO: 7120685 - DNA, 22 bp, Homo sapiens
atcaggaaatacttatttataa

SEQ ID NO: 7120686 - DNA, 22 bp, Homo sapiens
atcaggaaatacttatttataa

SEQ ID NO: 7120687 - DNA, 20 bp, Homo sapiens
ctgtgctccgggttcctgga

SEQ ID NO: 7120688 - DNA, 17 bp, Homo sapiens
ctgtgctcgagtgatgg

SEQ ID NO: 7120689 - DNA, 22 bp, Homo sapiens
atcaggaacgttcatggactgt

SEQ ID NO: 7120690 - DNA, 22 bp, Homo sapiens
atcaggccagcaatccctgggc

SEQ ID NO: 7120691 - DNA, 22 bp, Homo sapiens
atcaggccagcaatccctgggc

SEQ ID NO: 7120692 - DNA, 22 bp, Homo sapiens
ctgtgggagcacatgacagata

SEQ ID NO: 7120693 - DNA, 22 bp, Homo sapiens
ctgtgggagcacatgacagata

SEQ ID NO: 7120694 - DNA, 22 bp, Homo sapiens
ctgtgggagcacatgacagata

SEQ ID NO: 7120695 - DNA, 22 bp, Homo sapiens
ctgtgggagcactggggaccga

SEQ ID NO: 7120696 - DNA, 19 bp, Homo sapiens
ctgtgtcacatttatgaaa

SEQ ID NO: 7120697 - DNA, 19 bp, Homo sapiens
ctgtgtcacatttatgaaa

SEQ ID NO: 7120698 - DNA, 19 bp, Homo sapiens
ctgtgtcacatttatgaaa

SEQ ID NO: 7120699 - DNA, 22 bp, Homo sapiens
ctgtgtccaatggccttagcag

SEQ ID NO: 7120700 - DNA, 22 bp, Homo sapiens
ctgtgtcactcactgcgttatg

SEQ ID NO: 7120701 - DNA, 22 bp, Homo sapiens
ctgtgtccaatggccttagcag

SEQ ID NO: 7120702 - DNA, 22 bp, Homo sapiens
ctgtgtccatgttctaatttgg

SEQ ID NO: 7120703 - DNA, 22 bp, Homo sapiens
ctgtgtccatttatcattgtca

SEQ ID NO: 7120704 - DNA, 22 bp, Homo sapiens
ctgtgtcccacacgaggtgtat

SEQ ID NO: 7120705 - DNA, 22 bp, Homo sapiens
ctgtgcgtaagtagccaaaata

SEQ ID NO: 7120706 - DNA, 22 bp, Homo sapiens
ctgtgcgttgtgaaatgtttag

SEQ ID NO: 7120707 - DNA, 22 bp, Homo sapiens
ctgtgcctttgtagctgtgcct

SEQ ID NO: 7120708 - DNA, 22 bp, Homo sapiens
ctgtgccttctgcctggaacat

SEQ ID NO: 7120709 - DNA, 22 bp, Homo sapiens
ctgtgccttctacttcactcta

SEQ ID NO: 7120710 - DNA, 22 bp, Homo sapiens
ctgtgcctgccttgttcactga

SEQ ID NO: 7120711 - DNA, 22 bp, Homo sapiens
ctgtgcctgcaggccacatcaa

SEQ ID NO: 7120712 - DNA, 20 bp, Homo sapiens
ctgtgcctcctgctagtcct

SEQ ID NO: 7120713 - DNA, 22 bp, Homo sapiens
ctgtgcctccctttactttgag

SEQ ID NO: 7120714 - DNA, 22 bp, Homo sapiens
ctgtgcctccagtctcgcttct

SEQ ID NO: 7120715 - DNA, 22 bp, Homo sapiens
ctgtgcctgccttgttcactga

SEQ ID NO: 7120716 - DNA, 22 bp, Homo sapiens
ctgtgcctggggggcagagctg

SEQ ID NO: 7120717 - DNA, 22 bp, Homo sapiens
ctgtgccttagtattctcattt

SEQ ID NO: 7120718 - DNA, 22 bp, Homo sapiens
ctgtgcctccaagtggtctctg

SEQ ID NO: 7120719 - DNA, 22 bp, Homo sapiens
ctgtgcctaagatgcatgtctc

SEQ ID NO: 7120720 - DNA, 22 bp, Homo sapiens
ctgtgcagtaggtcagggctgg

SEQ ID NO: 7120721 - DNA, 22 bp, Homo sapiens
ctgtgcagtaggtcagggctgg

SEQ ID NO: 7120722 - DNA, 22 bp, Homo sapiens
ctgtgccctttcgctgcactgt

SEQ ID NO: 7120723 - DNA, 22 bp, Homo sapiens
ctgtgccctttgtcctcgtctc

SEQ ID NO: 7120724 - DNA, 20 bp, Homo sapiens
ctgtgcctaaacctccgggt

SEQ ID NO: 7120725 - DNA, 22 bp, Homo sapiens
ctgtgcagtaggtcagggctgg

SEQ ID NO: 7120726 - DNA, 21 bp, Homo sapiens
ctgtccagtaattcctggcac

SEQ ID NO: 7120727 - DNA, 22 bp, Homo sapiens
ctgtccagggtgtgcaggggct

SEQ ID NO: 7120728 - DNA, 22 bp, Homo sapiens
cttcagaggggactcaaagtca

SEQ ID NO: 7120729 - DNA, 22 bp, Homo sapiens
cttcagaggggactcaaagtca

SEQ ID NO: 7120730 - DNA, 22 bp, Homo sapiens
cttcagagcttgttaaaactgt

SEQ ID NO: 7120731 - DNA, 22 bp, Homo sapiens
cttcagaggggactcaaagtca

SEQ ID NO: 7120732 - DNA, 22 bp, Homo sapiens
cttcagagtgactcagcatctt

SEQ ID NO: 7120733 - DNA, 22 bp, Homo sapiens
cttcagagtgcagaagattggg

SEQ ID NO: 7120734 - DNA, 22 bp, Homo sapiens
cttcagagtgcagaagattggg

SEQ ID NO: 7120735 - DNA, 21 bp, Homo sapiens
cttcagcaaatacttggcagg

SEQ ID NO: 7120736 - DNA, 22 bp, Homo sapiens
cttcagaattcctcagcctcag

SEQ ID NO: 7120737 - DNA, 22 bp, Homo sapiens
cttcagaattcctcagcctcag

SEQ ID NO: 7120738 - DNA, 22 bp, Homo sapiens
cttcagaattcctcagcctcag

SEQ ID NO: 7120739 - DNA, 22 bp, Homo sapiens
cttcacagaataaactcattat

SEQ ID NO: 7120740 - DNA, 22 bp, Homo sapiens
cttcacacccactaggatggct

SEQ ID NO: 7120741 - DNA, 22 bp, Homo sapiens
cttcagaatgggactgtgtttg

SEQ ID NO: 7120742 - DNA, 22 bp, Homo sapiens
ctgtttcaagtgaagtcagaca

SEQ ID NO: 7120743 - DNA, 22 bp, Homo sapiens
ctgtttcagaacttcttaaaaa

SEQ ID NO: 7120744 - DNA, 22 bp, Homo sapiens
ctgtttccaccttcatggctaa

SEQ ID NO: 7120745 - DNA, 22 bp, Homo sapiens
cttcacacccactaaaatgatg

SEQ ID NO: 7120746 - DNA, 22 bp, Homo sapiens
ctgtttctaaagggagcagatt

SEQ ID NO: 7120747 - DNA, 22 bp, Homo sapiens
ctgtttctaaagggagcagatt

SEQ ID NO: 7120748 - DNA, 22 bp, Homo sapiens
ctgtttcctaccgtttttcatt

SEQ ID NO: 7120749 - DNA, 22 bp, Homo sapiens
ctgtttcctgtcttctcactat

SEQ ID NO: 7120750 - DNA, 22 bp, Homo sapiens
atccttcagctgccctgttacc

SEQ ID NO: 7120751 - DNA, 22 bp, Homo sapiens
atccttcaaggggctgacagct

SEQ ID NO: 7120752 - DNA, 22 bp, Homo sapiens
cttcagcagcctcttgcataaa

SEQ ID NO: 7120753 - DNA, 22 bp, Homo sapiens
cttcagcagcctcttgcataaa

SEQ ID NO: 7120754 - DNA, 19 bp, Homo sapiens
cttcagcatctccggagct

SEQ ID NO: 7120755 - DNA, 19 bp, Homo sapiens
cttcagcatctccggagct

SEQ ID NO: 7120756 - DNA, 22 bp, Homo sapiens
cttcagcatctttttcttgggg

SEQ ID NO: 7120757 - DNA, 22 bp, Homo sapiens
cttcagcatctttttcttgggg

SEQ ID NO: 7120758 - DNA, 22 bp, Homo sapiens
cttcagcatctttttcttgggg

SEQ ID NO: 7120759 - DNA, 22 bp, Homo sapiens
atccttaatttacttgcatctt

SEQ ID NO: 7120760 - DNA, 21 bp, Homo sapiens
cttcagcaaatacttggcagg

SEQ ID NO: 7120761 - DNA, 22 bp, Homo sapiens
cttcagcaactttggaatgttt

SEQ ID NO: 7120762 - DNA, 22 bp, Homo sapiens
cttcagcaactttggaatgttt

SEQ ID NO: 7120763 - DNA, 22 bp, Homo sapiens
cttcagcaccatagctccttct

SEQ ID NO: 7120764 - DNA, 22 bp, Homo sapiens
cttcagcaccatagctccttct

SEQ ID NO: 7120765 - DNA, 22 bp, Homo sapiens
cttcagcacctcagctggagag

SEQ ID NO: 7120766 - DNA, 22 bp, Homo sapiens
cttcagcacctcagctggagag

SEQ ID NO: 7120767 - DNA, 23 bp, Homo sapiens
cttcagcagaaacataaattctc

SEQ ID NO: 7120768 - DNA, 23 bp, Homo sapiens
cttcagcagaaacataaattctc

SEQ ID NO: 7120769 - DNA, 23 bp, Homo sapiens
cttcagcagaaacataaattctc

SEQ ID NO: 7120770 - DNA, 22 bp, Homo sapiens
cttcagcagatgcaaaacccct

SEQ ID NO: 7120771 - DNA, 22 bp, Homo sapiens
cttcagcagatgcaaaacccct

SEQ ID NO: 7120772 - DNA, 22 bp, Homo sapiens
cttcagcagatgtgctagagat

SEQ ID NO: 7120773 - DNA, 22 bp, Homo sapiens
cttcagcagatgtgctagagat

SEQ ID NO: 7120774 - DNA, 22 bp, Homo sapiens
cttcagcagatgtgctagagat

SEQ ID NO: 7120775 - DNA, 22 bp, Homo sapiens
cttcagcagcctcttgcataaa

SEQ ID NO: 7120776 - DNA, 22 bp, Homo sapiens
atccttccagagttattctcaa

SEQ ID NO: 7120777 - DNA, 22 bp, Homo sapiens
atccttccttcatttgacaggt

SEQ ID NO: 7120778 - DNA, 22 bp, Homo sapiens
atccttgaatgactctgccctc

SEQ ID NO: 7120779 - DNA, 22 bp, Homo sapiens
atccttgacacactccagtact

SEQ ID NO: 7120780 - DNA, 18 bp, Homo sapiens
atccttggggctgctgct

SEQ ID NO: 7120781 - DNA, 22 bp, Homo sapiens
atccttgggtctctggaaattg

SEQ ID NO: 7120782 - DNA, 22 bp, Homo sapiens
atccttgaatgactctgccctc

SEQ ID NO: 7120783 - DNA, 22 bp, Homo sapiens
atccttgagccttatcttttgt

SEQ ID NO: 7120784 - DNA, 22 bp, Homo sapiens
atccttgagccttatcttttgt

SEQ ID NO: 7120785 - DNA, 22 bp, Homo sapiens
atccttggatgtgtctttttgt

SEQ ID NO: 7120786 - DNA, 22 bp, Homo sapiens
atccttggcacagtggaattca

SEQ ID NO: 7120787 - DNA, 22 bp, Homo sapiens
atccttggcagctcagacctac

SEQ ID NO: 7120788 - DNA, 22 bp, Homo sapiens
atctccagttagcagtactgat

SEQ ID NO: 7120789 - DNA, 22 bp, Homo sapiens
atctccagttagcagtactgat

SEQ ID NO: 7120790 - DNA, 22 bp, Homo sapiens
atctcccaaactcatttcttca

SEQ ID NO: 7120791 - DNA, 22 bp, Homo sapiens
atctccagtgaggcagattctg

SEQ ID NO: 7120792 - DNA, 22 bp, Homo sapiens
atctccaggcatttcaagagac

SEQ ID NO: 7120793 - DNA, 22 bp, Homo sapiens
atctccagggtgcccttgttct

SEQ ID NO: 7120794 - DNA, 18 bp, Homo sapiens
atctcccattggccaagg

SEQ ID NO: 7120795 - DNA, 22 bp, Homo sapiens
atctcccaaattagcctcttga

SEQ ID NO: 7120796 - DNA, 22 bp, Homo sapiens
atctcccaaattagcctcttga

SEQ ID NO: 7120797 - DNA, 22 bp, Homo sapiens
atctcccaaattagcctcttga

SEQ ID NO: 7120798 - DNA, 22 bp, Homo sapiens
atctcccaaattagcctcttga

SEQ ID NO: 7120799 - DNA, 22 bp, Homo sapiens
atctcccaattccctgataaat

SEQ ID NO: 7120800 - DNA, 22 bp, Homo sapiens
atctcccaattccctgataaat

SEQ ID NO: 7120801 - DNA, 22 bp, Homo sapiens
atctcccaattccctgataaat

SEQ ID NO: 7120802 - DNA, 22 bp, Homo sapiens
atctcccacaggctgctacttc

SEQ ID NO: 7120803 - DNA, 22 bp, Homo sapiens
atctcccagccacagcattctt

SEQ ID NO: 7120804 - DNA, 22 bp, Homo sapiens
atctcccagccacagcattctt

SEQ ID NO: 7120805 - DNA, 22 bp, Homo sapiens
atctcattctcccgtgccatgg

SEQ ID NO: 7120806 - DNA, 22 bp, Homo sapiens
atctcattctcccgtgccatgg

SEQ ID NO: 7120807 - DNA, 22 bp, Homo sapiens
atctcattttggtttctactta

SEQ ID NO: 7120808 - DNA, 22 bp, Homo sapiens
atctcattttggtttctactta

SEQ ID NO: 7120809 - DNA, 22 bp, Homo sapiens
atctcattttggtttctactta

SEQ ID NO: 7120810 - DNA, 22 bp, Homo sapiens
atctcatcagatctgtataagc

SEQ ID NO: 7120811 - DNA, 22 bp, Homo sapiens
atctatttctgctaataacaat

SEQ ID NO: 7120812 - DNA, 22 bp, Homo sapiens
atctatttctgctaataacaat

SEQ ID NO: 7120813 - DNA, 22 bp, Homo sapiens
atctatttctgctaataacaat

SEQ ID NO: 7120814 - DNA, 22 bp, Homo sapiens
atctccagaatggcttgttaat

SEQ ID NO: 7120815 - DNA, 22 bp, Homo sapiens
atctccagaggagtcatggtct

SEQ ID NO: 7120816 - DNA, 22 bp, Homo sapiens
atctccagaggagtcatggtct

SEQ ID NO: 7120817 - DNA, 22 bp, Homo sapiens
atctccagcaatggggagctct

SEQ ID NO: 7120818 - DNA, 22 bp, Homo sapiens
atctccagctcgcagagctcct

SEQ ID NO: 7120819 - DNA, 22 bp, Homo sapiens
atctccagctggctgtgataaa

SEQ ID NO: 7120820 - DNA, 17 bp, Homo sapiens
atctggaagctagctga

SEQ ID NO: 7120821 - DNA, 22 bp, Homo sapiens
atctggaagccagatactcagt

SEQ ID NO: 7120822 - DNA, 22 bp, Homo sapiens
atctggaagattgaaggggagt

SEQ ID NO: 7120823 - DNA, 22 bp, Homo sapiens
atctggaagattgaaggggagt

SEQ ID NO: 7120824 - DNA, 21 bp, Homo sapiens
atctggaagaactggtaagtg

SEQ ID NO: 7120825 - DNA, 21 bp, Homo sapiens
atctggaagaactggtaagtg

SEQ ID NO: 7120826 - DNA, 22 bp, Homo sapiens
atctggaagattgaaggggagt

SEQ ID NO: 7120827 - DNA, 22 bp, Homo sapiens
atctggaagattgaaggggagt

SEQ ID NO: 7120828 - DNA, 21 bp, Homo sapiens
atctggaagaactggtaagtg

SEQ ID NO: 7120829 - DNA, 19 bp, Homo sapiens
atctggaactcgtttgttt

SEQ ID NO: 7120830 - DNA, 19 bp, Homo sapiens
atctggaactcgtttgttt

SEQ ID NO: 7120831 - DNA, 21 bp, Homo sapiens
atctggaaattctgccagaga

SEQ ID NO: 7120832 - DNA, 22 bp, Homo sapiens
atctggaacaaagcttaggaat

SEQ ID NO: 7120833 - DNA, 22 bp, Homo sapiens
atctggaacaaagcttaggaat

SEQ ID NO: 7120834 - DNA, 22 bp, Homo sapiens
atctggaacaaagcttaggaat

SEQ ID NO: 7120835 - DNA, 22 bp, Homo sapiens
atctggaacaaagcttaggaat

SEQ ID NO: 7120836 - DNA, 21 bp, Homo sapiens
atctggaaattctgccagaga

SEQ ID NO: 7120837 - DNA, 22 bp, Homo sapiens
atctggaaataaatacgagttc

SEQ ID NO: 7120838 - DNA, 22 bp, Homo sapiens
atctggaaataaatacgagttc

SEQ ID NO: 7120839 - DNA, 21 bp, Homo sapiens
atctggaaattctgccagaga

SEQ ID NO: 7120840 - DNA, 22 bp, Homo sapiens
atctggaaaacacagtgtagac

SEQ ID NO: 7120841 - DNA, 22 bp, Homo sapiens
atctggaaaacacagtgtagac

SEQ ID NO: 7120842 - DNA, 22 bp, Homo sapiens
cttcattaaccaaaatgcaata

SEQ ID NO: 7120843 - DNA, 22 bp, Homo sapiens
cttcattaaccaaaatgcaata

SEQ ID NO: 7120844 - DNA, 22 bp, Homo sapiens
cttcatacaattttttgacata

SEQ ID NO: 7120845 - DNA, 22 bp, Homo sapiens
cttcataatctgaaatttgtaa

SEQ ID NO: 7120846 - DNA, 22 bp, Homo sapiens
cttcataaactcagaaggcagc

SEQ ID NO: 7120847 - DNA, 21 bp, Homo sapiens
cttcatcccggagattctggt

SEQ ID NO: 7120848 - DNA, 21 bp, Homo sapiens
cttcatcccggagattctggt

SEQ ID NO: 7120849 - DNA, 22 bp, Homo sapiens
cttcatctttctgagcctcagt

SEQ ID NO: 7120850 - DNA, 22 bp, Homo sapiens
cttcatgagggtaatctacaaa

SEQ ID NO: 7120851 - DNA, 22 bp, Homo sapiens
cttcatgagtgtacaacctgtg

SEQ ID NO: 7120852 - DNA, 22 bp, Homo sapiens
cttcatgatcctaccacattga

SEQ ID NO: 7120853 - DNA, 22 bp, Homo sapiens
ctggtggcatcttgagatggtt

SEQ ID NO: 7120854 - DNA, 22 bp, Homo sapiens
ctggtggcatcttgagatggtt

SEQ ID NO: 7120855 - DNA, 22 bp, Homo sapiens
ctggtgggaagatggaaaacat

SEQ ID NO: 7120856 - DNA, 22 bp, Homo sapiens
ctggtgggagataattgaatca

SEQ ID NO: 7120857 - DNA, 22 bp, Homo sapiens
ctggtgggagcagcaggcagct

SEQ ID NO: 7120858 - DNA, 22 bp, Homo sapiens
ctggtgggagcagcaggcagct

SEQ ID NO: 7120859 - DNA, 22 bp, Homo sapiens
ctggtggcatcttgagacggtt

SEQ ID NO: 7120860 - DNA, 22 bp, Homo sapiens
ctggtggcaatgaggcgtcact

SEQ ID NO: 7120861 - DNA, 22 bp, Homo sapiens
ctggtggcaatgaggcgtcact

SEQ ID NO: 7120862 - DNA, 22 bp, Homo sapiens
ctggtggagagtgggctctgga

SEQ ID NO: 7120863 - DNA, 22 bp, Homo sapiens
ctggtggagggacaggcttagc

SEQ ID NO: 7120864 - DNA, 22 bp, Homo sapiens
ctggtggagatgcctggcccct

SEQ ID NO: 7120865 - DNA, 22 bp, Homo sapiens
ctggtgggagcagcaggcagct

SEQ ID NO: 7120866 - DNA, 22 bp, Homo sapiens
ctggtgggagcagcaggcagct

SEQ ID NO: 7120867 - DNA, 22 bp, Homo sapiens
ctggtgggagcagcaggcagct

SEQ ID NO: 7120868 - DNA, 22 bp, Homo sapiens
ctggtgggagcagcaggcagct

SEQ ID NO: 7120869 - DNA, 22 bp, Homo sapiens
ctggtgggagcagcaggcagct

SEQ ID NO: 7120870 - DNA, 22 bp, Homo sapiens
ctggtgggaggcaaggtggaag

SEQ ID NO: 7120871 - DNA, 22 bp, Homo sapiens
ctggtgggaggcaaggtggaag

SEQ ID NO: 7120872 - DNA, 22 bp, Homo sapiens
ctggtgggaggcaaggtggaag

SEQ ID NO: 7120873 - DNA, 22 bp, Homo sapiens
ctggtgggaggcaaggtggaag

SEQ ID NO: 7120874 - DNA, 22 bp, Homo sapiens
ctggtgggaggcaaggtggaag

SEQ ID NO: 7120875 - DNA, 22 bp, Homo sapiens
ctggtggggagtcctggtctcc

SEQ ID NO: 7120876 - DNA, 22 bp, Homo sapiens
ctggtggagagtgggctctgga

SEQ ID NO: 7120877 - DNA, 19 bp, Homo sapiens
ctggtgcttgagtgagtca

SEQ ID NO: 7120878 - DNA, 22 bp, Homo sapiens
ctggtggaagcctgggctcaga

SEQ ID NO: 7120879 - DNA, 22 bp, Homo sapiens
ctggtggaagcctgggctcaga

SEQ ID NO: 7120880 - DNA, 22 bp, Homo sapiens
ctggtggaagcctgggctcaga

SEQ ID NO: 7120881 - DNA, 22 bp, Homo sapiens
ctggtggaatggcagagggaac

SEQ ID NO: 7120882 - DNA, 22 bp, Homo sapiens
ctggtgctggcaacagagtagg

SEQ ID NO: 7120883 - DNA, 22 bp, Homo sapiens
ctggtgctggcaacagagtagg

SEQ ID NO: 7120884 - DNA, 22 bp, Homo sapiens
ctggtgctgggcagggctcagg

SEQ ID NO: 7120885 - DNA, 22 bp, Homo sapiens
ctggtgctgggcagggctcagg

SEQ ID NO: 7120886 - DNA, 22 bp, Homo sapiens
ctggtgctgtagcctgattgag

SEQ ID NO: 7120887 - DNA, 17 bp, Homo sapiens
ctggggatgtgggactc

SEQ ID NO: 7120888 - DNA, 22 bp, Homo sapiens
ctggggatgggacctggcataa

SEQ ID NO: 7120889 - DNA, 17 bp, Homo sapiens
ctggggatgtgggactc

SEQ ID NO: 7120890 - DNA, 22 bp, Homo sapiens
ctggggcagagcccagcaattt

SEQ ID NO: 7120891 - DNA, 22 bp, Homo sapiens
ctggggcagagcccagcaattt

SEQ ID NO: 7120892 - DNA, 22 bp, Homo sapiens
ctggggcagagcccagcaattt

SEQ ID NO: 7120893 - DNA, 22 bp, Homo sapiens
ctggggcagagcctttagcaaa

SEQ ID NO: 7120894 - DNA, 22 bp, Homo sapiens
ctgggctgtcccagggcggcag

SEQ ID NO: 7120895 - DNA, 22 bp, Homo sapiens
ctgggctgtcccagggcggcag

SEQ ID NO: 7120896 - DNA, 22 bp, Homo sapiens
ctgggctgtcccagggcggcag

SEQ ID NO: 7120897 - DNA, 22 bp, Homo sapiens
ctgggctgtcccagggcggcag

SEQ ID NO: 7120898 - DNA, 22 bp, Homo sapiens
ctgggctgtcagttttgtttta

SEQ ID NO: 7120899 - DNA, 22 bp, Homo sapiens
ctgggctgtcccaaccccatcc

SEQ ID NO: 7120900 - DNA, 22 bp, Homo sapiens
ctgggctgtcccaaccccatcc

SEQ ID NO: 7120901 - DNA, 22 bp, Homo sapiens
ctgggctgtcccaaccccatcc

SEQ ID NO: 7120902 - DNA, 22 bp, Homo sapiens
ctgggctgtcagttttgtttta

SEQ ID NO: 7120903 - DNA, 23 bp, Homo sapiens
ctgggctgtcctgaggtcacctc

SEQ ID NO: 7120904 - DNA, 23 bp, Homo sapiens
ctgggctgtcctgaggtcacctc

SEQ ID NO: 7120905 - DNA, 23 bp, Homo sapiens
ctgggctgtcctgaggtcacctc

SEQ ID NO: 7120906 - DNA, 23 bp, Homo sapiens
ctgggctgtcctgaggtcacctc

SEQ ID NO: 7120907 - DNA, 22 bp, Homo sapiens
ctgggctgtggtgtggcccaaa

SEQ ID NO: 7120908 - DNA, 22 bp, Homo sapiens
ctgggctgtggtgtggcccaaa

SEQ ID NO: 7120909 - DNA, 22 bp, Homo sapiens
ctgggctgtggtgtggcccaaa

SEQ ID NO: 7120910 - DNA, 22 bp, Homo sapiens
ctgggctgtggtgtggcccaaa

SEQ ID NO: 7120911 - DNA, 22 bp, Homo sapiens
ctgggctgttctgcccctgggt

SEQ ID NO: 7120912 - DNA, 22 bp, Homo sapiens
ctgggctgttctgcccctgggt

SEQ ID NO: 7120913 - DNA, 22 bp, Homo sapiens
ctggggaggatgctacgacctg

SEQ ID NO: 7120914 - DNA, 22 bp, Homo sapiens
ctggggaggatgctacgacctg

SEQ ID NO: 7120915 - DNA, 22 bp, Homo sapiens
ctggggaggatgctacgacctg

SEQ ID NO: 7120916 - DNA, 22 bp, Homo sapiens
ctggggaggatgctacgacctg

SEQ ID NO: 7120917 - DNA, 22 bp, Homo sapiens
ctggggaggatgctacgacctg

SEQ ID NO: 7120918 - DNA, 22 bp, Homo sapiens
ctggggaggatgctacgacctg

SEQ ID NO: 7120919 - DNA, 22 bp, Homo sapiens
ctggggaggcagggctgcccct

SEQ ID NO: 7120920 - DNA, 22 bp, Homo sapiens
ctggggaggcagggctgcccct

SEQ ID NO: 7120921 - DNA, 22 bp, Homo sapiens
ctggggaggcagggctgcccct

SEQ ID NO: 7120922 - DNA, 22 bp, Homo sapiens
ctggggaggcagggctgcccct

SEQ ID NO: 7120923 - DNA, 22 bp, Homo sapiens
ctggggaggcagggctgcccct

SEQ ID NO: 7120924 - DNA, 22 bp, Homo sapiens
ctggggaggcagggctgcccct

SEQ ID NO: 7120925 - DNA, 22 bp, Homo sapiens
ctggggaggcagggctgcccct

SEQ ID NO: 7120926 - DNA, 22 bp, Homo sapiens
ctggggaggcagggctgcccct

SEQ ID NO: 7120927 - DNA, 22 bp, Homo sapiens
ctggggagtgaaattcttaaat

SEQ ID NO: 7120928 - DNA, 22 bp, Homo sapiens
ctggggagtgaaattcttaaat

SEQ ID NO: 7120929 - DNA, 22 bp, Homo sapiens
ctggggagtgaaattcttaaat

SEQ ID NO: 7120930 - DNA, 22 bp, Homo sapiens
ctggggagtgaaattcttaaat

SEQ ID NO: 7120931 - DNA, 22 bp, Homo sapiens
ctggggagtgaaggtaattaca

SEQ ID NO: 7120932 - DNA, 22 bp, Homo sapiens
ctggggagtgaaggtaattaca

SEQ ID NO: 7120933 - DNA, 22 bp, Homo sapiens
ctggggatgggacctggcataa

SEQ ID NO: 7120934 - DNA, 22 bp, Homo sapiens
atatttgttagagtctatgtgt

SEQ ID NO: 7120935 - DNA, 22 bp, Homo sapiens
atatttgttgagttcttatgat

SEQ ID NO: 7120936 - DNA, 22 bp, Homo sapiens
atatttgttgagttcttatgat

SEQ ID NO: 7120937 - DNA, 22 bp, Homo sapiens
atatttgtttggcagagttcag

SEQ ID NO: 7120938 - DNA, 22 bp, Homo sapiens
atattttcacagaacttgcaaa

SEQ ID NO: 7120939 - DNA, 22 bp, Homo sapiens
atattttcacagaacttgcaaa

SEQ ID NO: 7120940 - DNA, 22 bp, Homo sapiens
atattttcactgaaccaaagta

SEQ ID NO: 7120941 - DNA, 22 bp, Homo sapiens
atattttcactgaaccaaagta

SEQ ID NO: 7120942 - DNA, 22 bp, Homo sapiens
atattttccgaacttgaggtag

SEQ ID NO: 7120943 - DNA, 22 bp, Homo sapiens
atattttgaagttaataatgtg

SEQ ID NO: 7120944 - DNA, 22 bp, Homo sapiens
atattttgaagttaataatgtg

SEQ ID NO: 7120945 - DNA, 22 bp, Homo sapiens
ctgtatgattccatttctataa

SEQ ID NO: 7120946 - DNA, 22 bp, Homo sapiens
ctgtatctgtgttggatgagtt

SEQ ID NO: 7120947 - DNA, 22 bp, Homo sapiens
ctgtatgaaattgtcattttta

SEQ ID NO: 7120948 - DNA, 22 bp, Homo sapiens
ctgtatcaccccagggttcttt

SEQ ID NO: 7120949 - DNA, 22 bp, Homo sapiens
ctgtatcagactctgcttgagg

SEQ ID NO: 7120950 - DNA, 20 bp, Homo sapiens
ctgtatcaggttacaaagta

SEQ ID NO: 7120951 - DNA, 20 bp, Homo sapiens
ctgtatcaggttacaaagta

SEQ ID NO: 7120952 - DNA, 22 bp, Homo sapiens
ctgtatcagttcagaggtgcag

SEQ ID NO: 7120953 - DNA, 22 bp, Homo sapiens
ctgtatctgtgttggatgagtt

SEQ ID NO: 7120954 - DNA, 22 bp, Homo sapiens
ctgtatctgtgttggatgagtt

SEQ ID NO: 7120955 - DNA, 22 bp, Homo sapiens
ctgtatctgtgttggatgagtt

SEQ ID NO: 7120956 - DNA, 22 bp, Homo sapiens
atattttggcaaatgtctagat

SEQ ID NO: 7120957 - DNA, 22 bp, Homo sapiens
ctgtaatcccagctactcggga

SEQ ID NO: 7120958 - DNA, 22 bp, Homo sapiens
ctgtaatcccagctactcggga

SEQ ID NO: 7120959 - DNA, 22 bp, Homo sapiens
ctgtaatcccagctactcggga

SEQ ID NO: 7120960 - DNA, 22 bp, Homo sapiens
ctgtaatgaactctttgtcagt

SEQ ID NO: 7120961 - DNA, 22 bp, Homo sapiens
ctgtaattcactagggtcagcg

SEQ ID NO: 7120962 - DNA, 22 bp, Homo sapiens
ctgtatttcttggacagttgct

SEQ ID NO: 7120963 - DNA, 22 bp, Homo sapiens
ctgtatttcccacattctctat

SEQ ID NO: 7120964 - DNA, 22 bp, Homo sapiens
ctgtatttcttggacagttgct

SEQ ID NO: 7120965 - DNA, 22 bp, Homo sapiens
ctgtattgaagtgttggctgag

SEQ ID NO: 7120966 - DNA, 22 bp, Homo sapiens
ctgtattctgggcagggaagga

SEQ ID NO: 7120967 - DNA, 22 bp, Homo sapiens
ctgtatttagttaaaatgctaa

SEQ ID NO: 7120968 - DNA, 22 bp, Homo sapiens
ctgtatttagttaaaatgctaa

SEQ ID NO: 7120969 - DNA, 22 bp, Homo sapiens
ctgtatttcccacattctctat

SEQ ID NO: 7120970 - DNA, 22 bp, Homo sapiens
ctgtattcaaagtgaggatgta

SEQ ID NO: 7120971 - DNA, 22 bp, Homo sapiens
ctgtatgtttctatgaatgtga

SEQ ID NO: 7120972 - DNA, 22 bp, Homo sapiens
ctgtattaaaggcagtgatctt

SEQ ID NO: 7120973 - DNA, 22 bp, Homo sapiens
ctgtattagccaggtgcacaag

SEQ ID NO: 7120974 - DNA, 22 bp, Homo sapiens
ctgtatgtagaatagctgacaa

SEQ ID NO: 7120975 - DNA, 22 bp, Homo sapiens
ctgtatgttccgttttgtcact

SEQ ID NO: 7120976 - DNA, 22 bp, Homo sapiens
ctgtccacctttgataggctct

SEQ ID NO: 7120977 - DNA, 22 bp, Homo sapiens
ctgtccacctactgactagttg

SEQ ID NO: 7120978 - DNA, 21 bp, Homo sapiens
ctgtccacatcacagagcctc

SEQ ID NO: 7120979 - DNA, 22 bp, Homo sapiens
ctgtccacatggagaacctggt

SEQ ID NO: 7120980 - DNA, 22 bp, Homo sapiens
ctgtccacatggagaacctggt

SEQ ID NO: 7120981 - DNA, 21 bp, Homo sapiens
ctgtccaaatttcataacttt

SEQ ID NO: 7120982 - DNA, 19 bp, Homo sapiens
ctgtccacacactcgcttc

SEQ ID NO: 7120983 - DNA, 21 bp, Homo sapiens
ctgtccacatcacagagcctc

SEQ ID NO: 7120984 - DNA, 21 bp, Homo sapiens
ctgtccacatcacagagcctc

SEQ ID NO: 7120985 - DNA, 19 bp, Homo sapiens
ctgtccacacactcgcttc

SEQ ID NO: 7120986 - DNA, 21 bp, Homo sapiens
ctgtccacatcacagagcctc

SEQ ID NO: 7120987 - DNA, 22 bp, Homo sapiens
ctgtcatttctttagcaatggg

SEQ ID NO: 7120988 - DNA, 22 bp, Homo sapiens
ctgtcatttttttagaacacct

SEQ ID NO: 7120989 - DNA, 21 bp, Homo sapiens
ctgtccaaatttcataacttt

SEQ ID NO: 7120990 - DNA, 22 bp, Homo sapiens
ctgtccagaaagggggcaacaa

SEQ ID NO: 7120991 - DNA, 22 bp, Homo sapiens
ctgtccagcacatgtctgcccc

SEQ ID NO: 7120992 - DNA, 22 bp, Homo sapiens
ctgtccagcgactaggggatgg

SEQ ID NO: 7120993 - DNA, 22 bp, Homo sapiens
ctgtccagctgaccagagcagc

SEQ ID NO: 7120994 - DNA, 22 bp, Homo sapiens
ctgtccagctgaccagagcagc

SEQ ID NO: 7120995 - DNA, 22 bp, Homo sapiens
ctgtccagctgaccagagcagc

SEQ ID NO: 7120996 - DNA, 22 bp, Homo sapiens
ctgtccagcttggctcctgggg

SEQ ID NO: 7120997 - DNA, 22 bp, Homo sapiens
ctgtccagcttggctcctgggg

SEQ ID NO: 7120998 - DNA, 22 bp, Homo sapiens
ctgggcctggggctgttgagag

SEQ ID NO: 7120999 - DNA, 22 bp, Homo sapiens
ctgggcctgggaggccaggtct

SEQ ID NO: 7121000 - DNA, 22 bp, Homo sapiens
ctgggctgatttagtcacgttt

SEQ ID NO: 7121001 - DNA, 22 bp, Homo sapiens
ctgggctgcagcgggagcgacg

SEQ ID NO: 7121002 - DNA, 22 bp, Homo sapiens
ctgggctgcagcgggagcgacg

SEQ ID NO: 7121003 - DNA, 22 bp, Homo sapiens
ctgggctgcagcgggagcgacg

SEQ ID NO: 7121004 - DNA, 22 bp, Homo sapiens
ctgggctgcagcgggagcgacg

SEQ ID NO: 7121005 - DNA, 20 bp, Homo sapiens
ctgggctgggctacagggtc

SEQ ID NO: 7121006 - DNA, 20 bp, Homo sapiens
ctgggctgggctacagggtc

SEQ ID NO: 7121007 - DNA, 20 bp, Homo sapiens
ctgggctgggctacagggtc

SEQ ID NO: 7121008 - DNA, 22 bp, Homo sapiens
ctgggctgtcaatggccctctg

SEQ ID NO: 7121009 - DNA, 22 bp, Homo sapiens
ctgggctgtcaatggccctctg

SEQ ID NO: 7121010 - DNA, 22 bp, Homo sapiens
ctgggctgggtttaccctcttc

SEQ ID NO: 7121011 - DNA, 20 bp, Homo sapiens
ctgggctgggctacagggtc

SEQ ID NO: 7121012 - DNA, 22 bp, Homo sapiens
ctgggctgtaatgtggcactga

SEQ ID NO: 7121013 - DNA, 22 bp, Homo sapiens
ctgggctgtaatgtggcactga

SEQ ID NO: 7121014 - DNA, 22 bp, Homo sapiens
ctgggctgggtttaccctcttc

SEQ ID NO: 7121015 - DNA, 22 bp, Homo sapiens
ctgggcctggcgttccaggctg

SEQ ID NO: 7121016 - DNA, 22 bp, Homo sapiens
ctgggcctggagcccacgagcc

SEQ ID NO: 7121017 - DNA, 22 bp, Homo sapiens
ctgggcctggagcccacgagcc

SEQ ID NO: 7121018 - DNA, 22 bp, Homo sapiens
ctgggcctggagcccacgagcc

SEQ ID NO: 7121019 - DNA, 22 bp, Homo sapiens
ctgggcctggcgttccaggctg

SEQ ID NO: 7121020 - DNA, 22 bp, Homo sapiens
ctgggcctgggaggccaggtct

SEQ ID NO: 7121021 - DNA, 22 bp, Homo sapiens
ctgggcctgggaggccaggtct

SEQ ID NO: 7121022 - DNA, 22 bp, Homo sapiens
ctgggcctggacgggcagatct

SEQ ID NO: 7121023 - DNA, 22 bp, Homo sapiens
ctgggcctggacgggcagatct

SEQ ID NO: 7121024 - DNA, 22 bp, Homo sapiens
ctgggcctgagctctgaagagt

SEQ ID NO: 7121025 - DNA, 19 bp, Homo sapiens
ctgggcctgcatggttgtt

SEQ ID NO: 7121026 - DNA, 17 bp, Homo sapiens
ctgggcctctgcccttt

SEQ ID NO: 7121027 - DNA, 17 bp, Homo sapiens
ctgggcctctgcccttt

SEQ ID NO: 7121028 - DNA, 22 bp, Homo sapiens
ctgggcctgagctctgaagagt

SEQ ID NO: 7121029 - DNA, 22 bp, Homo sapiens
ctgggccatgggccagcgaggc

SEQ ID NO: 7121030 - DNA, 22 bp, Homo sapiens
ctgggccatgggccagcgaggc

SEQ ID NO: 7121031 - DNA, 17 bp, Homo sapiens
ctgggcctctgcccttt

SEQ ID NO: 7121032 - DNA, 17 bp, Homo sapiens
ctgggcctctgcccttt

SEQ ID NO: 7121033 - DNA, 22 bp, Homo sapiens
ctgggcccacaagtggaatcgt

SEQ ID NO: 7121034 - DNA, 22 bp, Homo sapiens
ctgggcccacaagtggaatcgt

SEQ ID NO: 7121035 - DNA, 22 bp, Homo sapiens
ctgggcccacaagtggaatcgt

SEQ ID NO: 7121036 - DNA, 22 bp, Homo sapiens
ctgggccatgggccagcgaggc

SEQ ID NO: 7121037 - DNA, 22 bp, Homo sapiens
atatcattctgatgtatatctt

SEQ ID NO: 7121038 - DNA, 22 bp, Homo sapiens
ctgggcagtttacattcctacc

SEQ ID NO: 7121039 - DNA, 22 bp, Homo sapiens
ctgggcagttcgctttcgtttt

SEQ ID NO: 7121040 - DNA, 22 bp, Homo sapiens
ctgggccagggaggtgtctgta

SEQ ID NO: 7121041 - DNA, 22 bp, Homo sapiens
ctgggcagtttattcagttctg

SEQ ID NO: 7121042 - DNA, 22 bp, Homo sapiens
ctgggcagtttacattcctacc

SEQ ID NO: 7121043 - DNA, 22 bp, Homo sapiens
ctgggccagggaggtgtctgta

SEQ ID NO: 7121044 - DNA, 22 bp, Homo sapiens
ctgggccagtctcggccgctct

SEQ ID NO: 7121045 - DNA, 22 bp, Homo sapiens
ctgggccagtctcggccgctct

SEQ ID NO: 7121046 - DNA, 22 bp, Homo sapiens
ctgggccatcagaggggctgga

SEQ ID NO: 7121047 - DNA, 22 bp, Homo sapiens
ctgggccagtctcggccgctct

SEQ ID NO: 7121048 - DNA, 22 bp, Homo sapiens
ctgggccatcagaggggctgga

SEQ ID NO: 7121049 - DNA, 22 bp, Homo sapiens
ctgggccatcagaggggctgga

SEQ ID NO: 7121050 - DNA, 22 bp, Homo sapiens
atagtcttcagcactttgatca

SEQ ID NO: 7121051 - DNA, 22 bp, Homo sapiens
atagtcttcagcactttgatca

SEQ ID NO: 7121052 - DNA, 22 bp, Homo sapiens
atagtcactctgttaggtgttt

SEQ ID NO: 7121053 - DNA, 22 bp, Homo sapiens
atagtcactgccttccatttgt

SEQ ID NO: 7121054 - DNA, 22 bp, Homo sapiens
atagtcagtgtctatatcgttg

SEQ ID NO: 7121055 - DNA, 22 bp, Homo sapiens
atagtcataggcaaatagaaga

SEQ ID NO: 7121056 - DNA, 22 bp, Homo sapiens
atagtacagcatttttcctgag

SEQ ID NO: 7121057 - DNA, 22 bp, Homo sapiens
atagtacatgggtgtcctcaca

SEQ ID NO: 7121058 - DNA, 22 bp, Homo sapiens
atagtagaaggcatatttggaa

SEQ ID NO: 7121059 - DNA, 22 bp, Homo sapiens
atagtatttaatagttagctca

SEQ ID NO: 7121060 - DNA, 22 bp, Homo sapiens
atagtatttccagaaatagtct

SEQ ID NO: 7121061 - DNA, 22 bp, Homo sapiens
atagtatttccagaaatagtct

SEQ ID NO: 7121062 - DNA, 22 bp, Homo sapiens
atatattttttgagacagagtc

SEQ ID NO: 7121063 - DNA, 22 bp, Homo sapiens
atatattttttgagacagagtc

SEQ ID NO: 7121064 - DNA, 22 bp, Homo sapiens
atatattttttgagacagagtc

SEQ ID NO: 7121065 - DNA, 22 bp, Homo sapiens
atatattttttgagacagagtc

SEQ ID NO: 7121066 - DNA, 22 bp, Homo sapiens
atatattttttgagacagagtc

SEQ ID NO: 7121067 - DNA, 22 bp, Homo sapiens
atatattttgcggtcacgtggc

SEQ ID NO: 7121068 - DNA, 22 bp, Homo sapiens
atatattttgcggtcacgtggc

SEQ ID NO: 7121069 - DNA, 22 bp, Homo sapiens
atagtctttactgctgaattga

SEQ ID NO: 7121070 - DNA, 22 bp, Homo sapiens
atagtgaaaatgctgtcagcat

SEQ ID NO: 7121071 - DNA, 19 bp, Homo sapiens
atatatgtatacaatgtgg

SEQ ID NO: 7121072 - DNA, 20 bp, Homo sapiens
atatatgtatgcgtgtggtt

SEQ ID NO: 7121073 - DNA, 22 bp, Homo sapiens
atatatgtatgtggcggagagg

SEQ ID NO: 7121074 - DNA, 22 bp, Homo sapiens
atatatgtgcaggctcacacat

SEQ ID NO: 7121075 - DNA, 22 bp, Homo sapiens
atatattttgcggtcacgtggc

SEQ ID NO: 7121076 - DNA, 22 bp, Homo sapiens
atatattttgcggtcacgtggc

SEQ ID NO: 7121077 - DNA, 22 bp, Homo sapiens
atatcaaaataaacagcatgca

SEQ ID NO: 7121078 - DNA, 22 bp, Homo sapiens
atatcaaaataaacagcatgca

SEQ ID NO: 7121079 - DNA, 22 bp, Homo sapiens
atatcaaacgaagttattttaa

SEQ ID NO: 7121080 - DNA, 22 bp, Homo sapiens
atatcaaaataaacagcatgca

SEQ ID NO: 7121081 - DNA, 22 bp, Homo sapiens
atatcaaacgaagttattttaa

SEQ ID NO: 7121082 - DNA, 22 bp, Homo sapiens
atatcaaagctagtggaaattt

SEQ ID NO: 7121083 - DNA, 22 bp, Homo sapiens
atatcaaacgaagttattttaa

SEQ ID NO: 7121084 - DNA, 22 bp, Homo sapiens
atatcaaagctagtggaaattt

SEQ ID NO: 7121085 - DNA, 22 bp, Homo sapiens
atatcaaagctagtggaaattt

SEQ ID NO: 7121086 - DNA, 22 bp, Homo sapiens
atatcaaagctagtggaaattt

SEQ ID NO: 7121087 - DNA, 22 bp, Homo sapiens
atatcacaaacaagtctgtact

SEQ ID NO: 7121088 - DNA, 22 bp, Homo sapiens
atatcacaaacaagtctgtact

SEQ ID NO: 7121089 - DNA, 21 bp, Homo sapiens
atatcacaaacatatggtctg

SEQ ID NO: 7121090 - DNA, 23 bp, Homo sapiens
atatcacacccagtacagtctcc

SEQ ID NO: 7121091 - DNA, 22 bp, Homo sapiens
atatcattatgttatgagcaca

SEQ ID NO: 7121092 - DNA, 22 bp, Homo sapiens
atatcattatgttatgagcaca

SEQ ID NO: 7121093 - DNA, 22 bp, Homo sapiens
atatcattatgttatgagcaca

SEQ ID NO: 7121094 - DNA, 22 bp, Homo sapiens
atatcattatgttatgagcaca

SEQ ID NO: 7121095 - DNA, 22 bp, Homo sapiens
atatcattatgttatgagcaca

SEQ ID NO: 7121096 - DNA, 22 bp, Homo sapiens
atatcataaatcggtgcatgaa

SEQ ID NO: 7121097 - DNA, 22 bp, Homo sapiens
atatcattatgttatgagcaca

SEQ ID NO: 7121098 - DNA, 22 bp, Homo sapiens
atatcataaatcggtgcatgaa

SEQ ID NO: 7121099 - DNA, 22 bp, Homo sapiens
atatcagaaatagtaagcagag

SEQ ID NO: 7121100 - DNA, 22 bp, Homo sapiens
atatcagacagaaagcattgac

SEQ ID NO: 7121101 - DNA, 18 bp, Homo sapiens
atatcagctacttcatgg

SEQ ID NO: 7121102 - DNA, 22 bp, Homo sapiens
atatcacagtagttgtttagtt

SEQ ID NO: 7121103 - DNA, 22 bp, Homo sapiens
atatcacaggtgtttacctgat

SEQ ID NO: 7121104 - DNA, 22 bp, Homo sapiens
atatcacagctctttcattgct

SEQ ID NO: 7121105 - DNA, 22 bp, Homo sapiens
atatcacaggaaaggaagatac

SEQ ID NO: 7121106 - DNA, 22 bp, Homo sapiens
atatcacagctctttcattgct

SEQ ID NO: 7121107 - DNA, 22 bp, Homo sapiens
atatcacagatgcagaaagaga

SEQ ID NO: 7121108 - DNA, 22 bp, Homo sapiens
atatcacagatgcagaaagaga

SEQ ID NO: 7121109 - DNA, 21 bp, Homo sapiens
aggtgcagagccagggaccag

SEQ ID NO: 7121110 - DNA, 21 bp, Homo sapiens
aggtgcagagccagggaccag

SEQ ID NO: 7121111 - DNA, 22 bp, Homo sapiens
aggtgaggtttgggaggtgtca

SEQ ID NO: 7121112 - DNA, 22 bp, Homo sapiens
cctgggcagggagaccaggctc

SEQ ID NO: 7121113 - DNA, 22 bp, Homo sapiens
cctgggcaggccggacgctggg

SEQ ID NO: 7121114 - DNA, 22 bp, Homo sapiens
cctgggcagtgctggagttgaa

SEQ ID NO: 7121115 - DNA, 22 bp, Homo sapiens
aggtgctgtttgtcagcagttt

SEQ ID NO: 7121116 - DNA, 22 bp, Homo sapiens
cctgggcagggctggactctca

SEQ ID NO: 7121117 - DNA, 22 bp, Homo sapiens
cctgggcaggtgtggcttcccc

SEQ ID NO: 7121118 - DNA, 22 bp, Homo sapiens
cctgggcaggtgtggcttcccc

SEQ ID NO: 7121119 - DNA, 22 bp, Homo sapiens
cctgggttagtatctgtttcca

SEQ ID NO: 7121120 - DNA, 22 bp, Homo sapiens
cctgggtgtcatgggcagctgg

SEQ ID NO: 7121121 - DNA, 22 bp, Homo sapiens
cctgggtgtcatgggcagctgg

SEQ ID NO: 7121122 - DNA, 22 bp, Homo sapiens
aggtggagttggctgtagttca

SEQ ID NO: 7121123 - DNA, 22 bp, Homo sapiens
aggtggagttggctgtagttca

SEQ ID NO: 7121124 - DNA, 22 bp, Homo sapiens
aggtggagttaagtgtgaactg

SEQ ID NO: 7121125 - DNA, 22 bp, Homo sapiens
aggtggagttggctgtagttca

SEQ ID NO: 7121126 - DNA, 22 bp, Homo sapiens
aggtggagttggctgtagttca

SEQ ID NO: 7121127 - DNA, 22 bp, Homo sapiens
aggtggagttaagtgtgaactg

SEQ ID NO: 7121128 - DNA, 22 bp, Homo sapiens
aggtggagttaagtgtgaactg

SEQ ID NO: 7121129 - DNA, 22 bp, Homo sapiens
aggtggagttaagtgtgaactg

SEQ ID NO: 7121130 - DNA, 22 bp, Homo sapiens
aggtggagtgtgcagggagagc

SEQ ID NO: 7121131 - DNA, 22 bp, Homo sapiens
aggtggagttaagtgtgaactg

SEQ ID NO: 7121132 - DNA, 23 bp, Homo sapiens
cctgggtttcagagctgcttttc

SEQ ID NO: 7121133 - DNA, 22 bp, Homo sapiens
cctggtcacccctctctctgca

SEQ ID NO: 7121134 - DNA, 22 bp, Homo sapiens
cctggtcagagcagtcaggatc

SEQ ID NO: 7121135 - DNA, 22 bp, Homo sapiens
cctggtcagagcagtcaggatc

SEQ ID NO: 7121136 - DNA, 22 bp, Homo sapiens
cctggtcagagcagtcaggatc

SEQ ID NO: 7121137 - DNA, 22 bp, Homo sapiens
cctggtcaggtaactgggctga

SEQ ID NO: 7121138 - DNA, 22 bp, Homo sapiens
cctggtcaggtaactgggctga

SEQ ID NO: 7121139 - DNA, 22 bp, Homo sapiens
aggtggagtgaaggaaaggcag

SEQ ID NO: 7121140 - DNA, 22 bp, Homo sapiens
aggtggagtgaaggaaaggcag

SEQ ID NO: 7121141 - DNA, 22 bp, Homo sapiens
aggtggagtgaaggaaaggcag

SEQ ID NO: 7121142 - DNA, 23 bp, Homo sapiens
aggtggagctgtgcagccggggc

SEQ ID NO: 7121143 - DNA, 22 bp, Homo sapiens
aggtggagtgaaggaaaggcag

SEQ ID NO: 7121144 - DNA, 22 bp, Homo sapiens
aggtggagatcagggactaagg

SEQ ID NO: 7121145 - DNA, 23 bp, Homo sapiens
aggtggagctgtgcagccggggc

SEQ ID NO: 7121146 - DNA, 22 bp, Homo sapiens
aggtgcttggctcgtgcacaca

SEQ ID NO: 7121147 - DNA, 22 bp, Homo sapiens
aggtgcttggctcgtgcacaca

SEQ ID NO: 7121148 - DNA, 22 bp, Homo sapiens
aggtgcttggctcgtgcacaca

SEQ ID NO: 7121149 - DNA, 22 bp, Homo sapiens
aggtggagtgtgcagggagagc

SEQ ID NO: 7121150 - DNA, 21 bp, Homo sapiens
aggtggagtgcttagcatcca

SEQ ID NO: 7121151 - DNA, 21 bp, Homo sapiens
aggtggagtgcttagcatcca

SEQ ID NO: 7121152 - DNA, 22 bp, Homo sapiens
aggtggagtgaaggaaaggcag

SEQ ID NO: 7121153 - DNA, 21 bp, Homo sapiens
aggtggagtgcttagcatcca

SEQ ID NO: 7121154 - DNA, 22 bp, Homo sapiens
aggtggagtgtgcagggagagc

SEQ ID NO: 7121155 - DNA, 22 bp, Homo sapiens
aggtggagtgtgcagggagagc

SEQ ID NO: 7121156 - DNA, 22 bp, Homo sapiens
aggtggagtgtgcagggagagc

SEQ ID NO: 7121157 - DNA, 22 bp, Homo sapiens
aggtggagtgtgcagggagagc

SEQ ID NO: 7121158 - DNA, 22 bp, Homo sapiens
aggtggagtgtgcagggagagc

SEQ ID NO: 7121159 - DNA, 22 bp, Homo sapiens
aggtggagtgtgcagggagagc

SEQ ID NO: 7121160 - DNA, 22 bp, Homo sapiens
aggtggagtgtgcagggagagc

SEQ ID NO: 7121161 - DNA, 19 bp, Homo sapiens
aggtctgcagctgcagttt

SEQ ID NO: 7121162 - DNA, 22 bp, Homo sapiens
aggtctgcctcactcacttctg

SEQ ID NO: 7121163 - DNA, 22 bp, Homo sapiens
aggtctgctatgtgagcaatac

SEQ ID NO: 7121164 - DNA, 22 bp, Homo sapiens
aggtctggaaacagcagggaga

SEQ ID NO: 7121165 - DNA, 22 bp, Homo sapiens
aggtctggaaacagcagggaga

SEQ ID NO: 7121166 - DNA, 19 bp, Homo sapiens
aggtctgcagctgcagttt

SEQ ID NO: 7121167 - DNA, 22 bp, Homo sapiens
aggtctggaaacagcagggaga

SEQ ID NO: 7121168 - DNA, 18 bp, Homo sapiens
aggtctgaggaagagcct

SEQ ID NO: 7121169 - DNA, 22 bp, Homo sapiens
aggtctgagtatggcctgagaa

SEQ ID NO: 7121170 - DNA, 22 bp, Homo sapiens
aggtctgagcaggggagaacag

SEQ ID NO: 7121171 - DNA, 22 bp, Homo sapiens
aggtctgagcaggggagaacag

SEQ ID NO: 7121172 - DNA, 17 bp, Homo sapiens
aggtctgagagtatctg

SEQ ID NO: 7121173 - DNA, 22 bp, Homo sapiens
aggtcctgtctatcaccctcgc

SEQ ID NO: 7121174 - DNA, 22 bp, Homo sapiens
aggtctcttgctgtctctgggc

SEQ ID NO: 7121175 - DNA, 22 bp, Homo sapiens
aggtctcttgctgtctctgggc

SEQ ID NO: 7121176 - DNA, 22 bp, Homo sapiens
aggtatgccaattaggtcaagt

SEQ ID NO: 7121177 - DNA, 22 bp, Homo sapiens
aggtatgcatttttactttagg

SEQ ID NO: 7121178 - DNA, 22 bp, Homo sapiens
aggtatggcataaatcacaggg

SEQ ID NO: 7121179 - DNA, 22 bp, Homo sapiens
aggtatgtatgtgtgtatattt

SEQ ID NO: 7121180 - DNA, 22 bp, Homo sapiens
aggtatgtgctattgttatatt

SEQ ID NO: 7121181 - DNA, 22 bp, Homo sapiens
aggtatgtggttccatgatgag

SEQ ID NO: 7121182 - DNA, 21 bp, Homo sapiens
aggtatgttgagaactgagga

SEQ ID NO: 7121183 - DNA, 22 bp, Homo sapiens
aggtattattagcatctctatt

SEQ ID NO: 7121184 - DNA, 22 bp, Homo sapiens
aggtattattagcatctctatt

SEQ ID NO: 7121185 - DNA, 22 bp, Homo sapiens
aggtattcagagagatgctttt

SEQ ID NO: 7121186 - DNA, 22 bp, Homo sapiens
aggtcctgtccttggtctctga

SEQ ID NO: 7121187 - DNA, 22 bp, Homo sapiens
aggtgagggtgccagtgcatgg

SEQ ID NO: 7121188 - DNA, 22 bp, Homo sapiens
aggtgagggtgccagtgcatgg

SEQ ID NO: 7121189 - DNA, 22 bp, Homo sapiens
aggtgagggtgccagtgcatgg

SEQ ID NO: 7121190 - DNA, 22 bp, Homo sapiens
aggtgaggtttgggaggtgtca

SEQ ID NO: 7121191 - DNA, 22 bp, Homo sapiens
aggtgaggtttgggaggtgtca

SEQ ID NO: 7121192 - DNA, 22 bp, Homo sapiens
aggtgaggtttgggaggtgtca

SEQ ID NO: 7121193 - DNA, 19 bp, Homo sapiens
aggtgaggggcaccatgtc

SEQ ID NO: 7121194 - DNA, 19 bp, Homo sapiens
aggtgaggggcaccatgtc

SEQ ID NO: 7121195 - DNA, 19 bp, Homo sapiens
aggtgaggggcaccatgtc

SEQ ID NO: 7121196 - DNA, 19 bp, Homo sapiens
aggtgaggggcaccatgtc

SEQ ID NO: 7121197 - DNA, 22 bp, Homo sapiens
aggtgagggtgccagtgcatgg

SEQ ID NO: 7121198 - DNA, 19 bp, Homo sapiens
aggtgaggggcaccatgtc

SEQ ID NO: 7121199 - DNA, 22 bp, Homo sapiens
aggtctggtgagagcaggtgct

SEQ ID NO: 7121200 - DNA, 22 bp, Homo sapiens
aggtctggtgagagcaggtgct

SEQ ID NO: 7121201 - DNA, 22 bp, Homo sapiens
aggtctggtgagagcaggtgct

SEQ ID NO: 7121202 - DNA, 22 bp, Homo sapiens
aggtctggtgagagcaggtgct

SEQ ID NO: 7121203 - DNA, 22 bp, Homo sapiens
aggtctgggagttcattccctg

SEQ ID NO: 7121204 - DNA, 22 bp, Homo sapiens
aggtctgggattgaagacatca

SEQ ID NO: 7121205 - DNA, 22 bp, Homo sapiens
aggtctgggattgaagacatca

SEQ ID NO: 7121206 - DNA, 22 bp, Homo sapiens
aggtctgggcaccactggctgc

SEQ ID NO: 7121207 - DNA, 22 bp, Homo sapiens
aggtctggaggcggagtcagga

SEQ ID NO: 7121208 - DNA, 23 bp, Homo sapiens
aggtctggacccttggcccctgc

SEQ ID NO: 7121209 - DNA, 22 bp, Homo sapiens
aggtctggaggcggagtcagga

SEQ ID NO: 7121210 - DNA, 22 bp, Homo sapiens
aggtctggaggcggagtcagga

SEQ ID NO: 7121211 - DNA, 22 bp, Homo sapiens
aggtctggaggcggagtcagga

SEQ ID NO: 7121212 - DNA, 22 bp, Homo sapiens
aggtctggaggcggagtcagga

SEQ ID NO: 7121213 - DNA, 22 bp, Homo sapiens
aggtctggctcttctccacaga

SEQ ID NO: 7121214 - DNA, 22 bp, Homo sapiens
aggtctggctcttctccacaga

SEQ ID NO: 7121215 - DNA, 22 bp, Homo sapiens
aggtctgggagttcattccctg

SEQ ID NO: 7121216 - DNA, 22 bp, Homo sapiens
aggtctgggagttcattccctg

SEQ ID NO: 7121217 - DNA, 22 bp, Homo sapiens
aggtatctggtaagaggcagac

SEQ ID NO: 7121218 - DNA, 22 bp, Homo sapiens
aggtatcaacagcagagtctga

SEQ ID NO: 7121219 - DNA, 22 bp, Homo sapiens
aggtatattttgtatatactct

SEQ ID NO: 7121220 - DNA, 18 bp, Homo sapiens
aggtatatgaatctcttt

SEQ ID NO: 7121221 - DNA, 22 bp, Homo sapiens
aggtatatgctattacttctgc

SEQ ID NO: 7121222 - DNA, 22 bp, Homo sapiens
aggtatatgctattacttctgc

SEQ ID NO: 7121223 - DNA, 22 bp, Homo sapiens
aggtatatgttcatgtatgtgt

SEQ ID NO: 7121224 - DNA, 22 bp, Homo sapiens
aggtatattttgtatatactct

SEQ ID NO: 7121225 - DNA, 22 bp, Homo sapiens
aggtatattttgtatatactct

SEQ ID NO: 7121226 - DNA, 18 bp, Homo sapiens
aggtataagtgatctgct

SEQ ID NO: 7121227 - DNA, 22 bp, Homo sapiens
aggtataagtctcatttctgtt

SEQ ID NO: 7121228 - DNA, 22 bp, Homo sapiens
aggtatatgaagatgaaataac

SEQ ID NO: 7121229 - DNA, 22 bp, Homo sapiens
aggtatatgaagatgaaataac

SEQ ID NO: 7121230 - DNA, 17 bp, Homo sapiens
aggtataaaatggtagc

SEQ ID NO: 7121231 - DNA, 17 bp, Homo sapiens
aggtataaaatggtagc

SEQ ID NO: 7121232 - DNA, 20 bp, Homo sapiens
aggtataagaaatgtgattt

SEQ ID NO: 7121233 - DNA, 22 bp, Homo sapiens
aggtataagaagattatttata

SEQ ID NO: 7121234 - DNA, 22 bp, Homo sapiens
cctggctcattatgtgccccca

SEQ ID NO: 7121235 - DNA, 22 bp, Homo sapiens
cctggctccaaagctgtgactc

SEQ ID NO: 7121236 - DNA, 22 bp, Homo sapiens
cctggctcaggcacgcatggct

SEQ ID NO: 7121237 - DNA, 22 bp, Homo sapiens
cctggctcaggcacgcatggct

SEQ ID NO: 7121238 - DNA, 22 bp, Homo sapiens
cctggctcaggcacgcatggct

SEQ ID NO: 7121239 - DNA, 22 bp, Homo sapiens
cctggctcagtgttgaaggggt

SEQ ID NO: 7121240 - DNA, 22 bp, Homo sapiens
cctggctcagtgttgaaggggt

SEQ ID NO: 7121241 - DNA, 22 bp, Homo sapiens
cctggccttaagggcagggagc

SEQ ID NO: 7121242 - DNA, 22 bp, Homo sapiens
cctggcctttgaacgctagact

SEQ ID NO: 7121243 - DNA, 22 bp, Homo sapiens
cctggctaggagagctgggctc

SEQ ID NO: 7121244 - DNA, 22 bp, Homo sapiens
cctggctcaaggcgaggactcc

SEQ ID NO: 7121245 - DNA, 22 bp, Homo sapiens
cctggctcaaggcgaggactcc

SEQ ID NO: 7121246 - DNA, 22 bp, Homo sapiens
cctggctcaaggcgaggactcc

SEQ ID NO: 7121247 - DNA, 23 bp, Homo sapiens
cctggctcaccccttatgtccag

SEQ ID NO: 7121248 - DNA, 22 bp, Homo sapiens
cctggctcagaccccagttctg

SEQ ID NO: 7121249 - DNA, 22 bp, Homo sapiens
cctggctcagaccccagttctg

SEQ ID NO: 7121250 - DNA, 22 bp, Homo sapiens
cctggctcagaccccagttctg

SEQ ID NO: 7121251 - DNA, 22 bp, Homo sapiens
cctggctcagaccccagttctg

SEQ ID NO: 7121252 - DNA, 22 bp, Homo sapiens
cctggctcagagtatgtcatcg

SEQ ID NO: 7121253 - DNA, 22 bp, Homo sapiens
cctggctcagcagctctttctc

SEQ ID NO: 7121254 - DNA, 22 bp, Homo sapiens
cctggctcagcagctctttctc

SEQ ID NO: 7121255 - DNA, 22 bp, Homo sapiens
cctggctcaggcacgcatggct

SEQ ID NO: 7121256 - DNA, 22 bp, Homo sapiens
cctggctcaggcacgcatggct

SEQ ID NO: 7121257 - DNA, 22 bp, Homo sapiens
agggtggctggaggaatcagaa

SEQ ID NO: 7121258 - DNA, 22 bp, Homo sapiens
agggtggctggaggaatcagaa

SEQ ID NO: 7121259 - DNA, 22 bp, Homo sapiens
agggtggctggaggaatcagaa

SEQ ID NO: 7121260 - DNA, 22 bp, Homo sapiens
agggtggctgagtagatggaag

SEQ ID NO: 7121261 - DNA, 22 bp, Homo sapiens
agggtggctggaggaatcagaa

SEQ ID NO: 7121262 - DNA, 22 bp, Homo sapiens
agggtggctgtgaagtgcttgg

SEQ ID NO: 7121263 - DNA, 21 bp, Homo sapiens
agggtggctctgggtcagaac

SEQ ID NO: 7121264 - DNA, 21 bp, Homo sapiens
agggtggctctgggtcagaac

SEQ ID NO: 7121265 - DNA, 21 bp, Homo sapiens
agggtggctctgggtcagaac

SEQ ID NO: 7121266 - DNA, 21 bp, Homo sapiens
agggtggctctgggtcagaac

SEQ ID NO: 7121267 - DNA, 22 bp, Homo sapiens
agggtggctgagtagatggaag

SEQ ID NO: 7121268 - DNA, 22 bp, Homo sapiens
agggtggctgagtagatggaag

SEQ ID NO: 7121269 - DNA, 22 bp, Homo sapiens
agggtggctgagtagatggaag

SEQ ID NO: 7121270 - DNA, 22 bp, Homo sapiens
agggtggctgtgaagtgcttgg

SEQ ID NO: 7121271 - DNA, 22 bp, Homo sapiens
agggtggctgtgaagtgcttgg

SEQ ID NO: 7121272 - DNA, 22 bp, Homo sapiens
agggtggcttaattccaaaggg

SEQ ID NO: 7121273 - DNA, 23 bp, Homo sapiens
agggtggcttgctttgcttcctt

SEQ ID NO: 7121274 - DNA, 23 bp, Homo sapiens
agggtggcttgctttgcttcctt

SEQ ID NO: 7121275 - DNA, 22 bp, Homo sapiens
cctggccagcagccccttcctc

SEQ ID NO: 7121276 - DNA, 22 bp, Homo sapiens
cctggccagccagggctggggt

SEQ ID NO: 7121277 - DNA, 22 bp, Homo sapiens
cctggccagccagggctggggt

SEQ ID NO: 7121278 - DNA, 22 bp, Homo sapiens
agggtggcagttactggagcaa

SEQ ID NO: 7121279 - DNA, 22 bp, Homo sapiens
agggtggcagttactggagcaa

SEQ ID NO: 7121280 - DNA, 22 bp, Homo sapiens
agggtggccaccaagtatgtca

SEQ ID NO: 7121281 - DNA, 22 bp, Homo sapiens
agggtggccaccaagtatgtca

SEQ ID NO: 7121282 - DNA, 22 bp, Homo sapiens
agggtggccaccaagtatgtca

SEQ ID NO: 7121283 - DNA, 22 bp, Homo sapiens
cctggagctcactgggagccgg

SEQ ID NO: 7121284 - DNA, 22 bp, Homo sapiens
cctggagctcactgggagccgg

SEQ ID NO: 7121285 - DNA, 22 bp, Homo sapiens
agggtggccatgagggagagat

SEQ ID NO: 7121286 - DNA, 22 bp, Homo sapiens
agggtggccatgagggagagat

SEQ ID NO: 7121287 - DNA, 22 bp, Homo sapiens
agggtggccatgagggagagat

SEQ ID NO: 7121288 - DNA, 22 bp, Homo sapiens
agggtggccatgagggagagat

SEQ ID NO: 7121289 - DNA, 22 bp, Homo sapiens
agggtggccatgagggagagat

SEQ ID NO: 7121290 - DNA, 22 bp, Homo sapiens
agggtggccatgagggagagat

SEQ ID NO: 7121291 - DNA, 22 bp, Homo sapiens
agggtggccccactttggttgg

SEQ ID NO: 7121292 - DNA, 22 bp, Homo sapiens
cctggagcccctctggccagcc

SEQ ID NO: 7121293 - DNA, 22 bp, Homo sapiens
cctggagcccctctggccagcc

SEQ ID NO: 7121294 - DNA, 22 bp, Homo sapiens
cctggagcccctctggccagcc

SEQ ID NO: 7121295 - DNA, 22 bp, Homo sapiens
cctggagcccctctggccagcc

SEQ ID NO: 7121296 - DNA, 22 bp, Homo sapiens
cctggagcccctctggccagcc

SEQ ID NO: 7121297 - DNA, 22 bp, Homo sapiens
cctggagcccctctggccagcc

SEQ ID NO: 7121298 - DNA, 22 bp, Homo sapiens
cctggagcccctctggccagcc

SEQ ID NO: 7121299 - DNA, 20 bp, Homo sapiens
cctggagcctggaaggagtc

SEQ ID NO: 7121300 - DNA, 20 bp, Homo sapiens
cctggagcctggaaggagtc

SEQ ID NO: 7121301 - DNA, 22 bp, Homo sapiens
cctggagcgcgggtcaagctgg

SEQ ID NO: 7121302 - DNA, 22 bp, Homo sapiens
agggtggcagttactggagcaa

SEQ ID NO: 7121303 - DNA, 22 bp, Homo sapiens
agggtggcagttactggagcaa

SEQ ID NO: 7121304 - DNA, 22 bp, Homo sapiens
cctgcctgcgtcctctgagggc

SEQ ID NO: 7121305 - DNA, 22 bp, Homo sapiens
cctgcctgcgtcctctgagggc

SEQ ID NO: 7121306 - DNA, 22 bp, Homo sapiens
agggtggcagttactggagcaa

SEQ ID NO: 7121307 - DNA, 22 bp, Homo sapiens
agggtggcagttactggagcaa

SEQ ID NO: 7121308 - DNA, 22 bp, Homo sapiens
agggtggcagttactggagcaa

SEQ ID NO: 7121309 - DNA, 22 bp, Homo sapiens
agggtggcactggtggctctat

SEQ ID NO: 7121310 - DNA, 22 bp, Homo sapiens
agggtggcactggtggctctat

SEQ ID NO: 7121311 - DNA, 22 bp, Homo sapiens
agggtggcactggtggctctat

SEQ ID NO: 7121312 - DNA, 22 bp, Homo sapiens
agggtggcacctggaagggatg

SEQ ID NO: 7121313 - DNA, 22 bp, Homo sapiens
agggtggcacctggaagggatg

SEQ ID NO: 7121314 - DNA, 22 bp, Homo sapiens
agggtggcacctggaagggatg

SEQ ID NO: 7121315 - DNA, 22 bp, Homo sapiens
agggtggcactggtggctctat

SEQ ID NO: 7121316 - DNA, 22 bp, Homo sapiens
agggtggcaccacatatcatag

SEQ ID NO: 7121317 - DNA, 22 bp, Homo sapiens
agggtggcacctggaagggatg

SEQ ID NO: 7121318 - DNA, 22 bp, Homo sapiens
agggtggcacctggaagggatg

SEQ ID NO: 7121319 - DNA, 20 bp, Homo sapiens
agggtggcaagttagtgaca

SEQ ID NO: 7121320 - DNA, 20 bp, Homo sapiens
agggtggcaagttagtgaca

SEQ ID NO: 7121321 - DNA, 19 bp, Homo sapiens
agggtggcaaaggagggtg

SEQ ID NO: 7121322 - DNA, 19 bp, Homo sapiens
agggtggcaaaggagggtg

SEQ ID NO: 7121323 - DNA, 19 bp, Homo sapiens
agggtggcaaaggagggtg

SEQ ID NO: 7121324 - DNA, 19 bp, Homo sapiens
agggtggcaaaggagggtg

SEQ ID NO: 7121325 - DNA, 19 bp, Homo sapiens
agggtggcaaaggagggtg

SEQ ID NO: 7121326 - DNA, 22 bp, Homo sapiens
agggtggaagatggcactatct

SEQ ID NO: 7121327 - DNA, 22 bp, Homo sapiens
agggtggagggagtccctgagc

SEQ ID NO: 7121328 - DNA, 19 bp, Homo sapiens
agggtggcaaaggagggtg

SEQ ID NO: 7121329 - DNA, 19 bp, Homo sapiens
agggtggcaaaggagggtg

SEQ ID NO: 7121330 - DNA, 22 bp, Homo sapiens
agggtggaagatggcactatct

SEQ ID NO: 7121331 - DNA, 22 bp, Homo sapiens
agggtggaagatggcactatct

SEQ ID NO: 7121332 - DNA, 22 bp, Homo sapiens
agggtggagggagtccctgagc

SEQ ID NO: 7121333 - DNA, 22 bp, Homo sapiens
agggtgctgccggacaggtggg

SEQ ID NO: 7121334 - DNA, 22 bp, Homo sapiens
agggtgctgccggacaggtggg

SEQ ID NO: 7121335 - DNA, 23 bp, Homo sapiens
agggtgagcaagctatggagacc

SEQ ID NO: 7121336 - DNA, 23 bp, Homo sapiens
agggtgagcaagctatggagacc

SEQ ID NO: 7121337 - DNA, 22 bp, Homo sapiens
aggggctgtggaaaccaactct

SEQ ID NO: 7121338 - DNA, 22 bp, Homo sapiens
aggggcttatgtttctccaggc

SEQ ID NO: 7121339 - DNA, 22 bp, Homo sapiens
aggggcttgtggagttgctggt

SEQ ID NO: 7121340 - DNA, 22 bp, Homo sapiens
aggggctgtggaaaccaactct

SEQ ID NO: 7121341 - DNA, 22 bp, Homo sapiens
aggggctgtggaaaccaactct

SEQ ID NO: 7121342 - DNA, 22 bp, Homo sapiens
aggggcttgtggagttgctggt

SEQ ID NO: 7121343 - DNA, 22 bp, Homo sapiens
aggggctttggtgctggtcctg

SEQ ID NO: 7121344 - DNA, 22 bp, Homo sapiens
aggggctttggtgctggtcctg

SEQ ID NO: 7121345 - DNA, 23 bp, Homo sapiens
agggtgagcaagctatggagacc

SEQ ID NO: 7121346 - DNA, 22 bp, Homo sapiens
cctgcctggcccaccttgccac

SEQ ID NO: 7121347 - DNA, 22 bp, Homo sapiens
cctgcctggctgtcagcagagc

SEQ ID NO: 7121348 - DNA, 22 bp, Homo sapiens
cctgcctggcacatagtactct

SEQ ID NO: 7121349 - DNA, 20 bp, Homo sapiens
cctgcctggccattccttgg

SEQ ID NO: 7121350 - DNA, 22 bp, Homo sapiens
cctgcctggatcagccatcctg

SEQ ID NO: 7121351 - DNA, 22 bp, Homo sapiens
cctgcctgctttctgctttgca

SEQ ID NO: 7121352 - DNA, 22 bp, Homo sapiens
cctgcctggagctgagtgtgga

SEQ ID NO: 7121353 - DNA, 22 bp, Homo sapiens
cctggagcccaaggcagtgaga

SEQ ID NO: 7121354 - DNA, 22 bp, Homo sapiens
cctggagcccaaggcagtgaga

SEQ ID NO: 7121355 - DNA, 22 bp, Homo sapiens
cctggagcatcaggaggaaggg

SEQ ID NO: 7121356 - DNA, 22 bp, Homo sapiens
cctggagcccaaggcagtgaga

SEQ ID NO: 7121357 - DNA, 22 bp, Homo sapiens
cctggagcccaaggcagtgaga

SEQ ID NO: 7121358 - DNA, 22 bp, Homo sapiens
cctggagcccaaggcagtgaga

SEQ ID NO: 7121359 - DNA, 22 bp, Homo sapiens
cctggagcatcaggaggaaggg

SEQ ID NO: 7121360 - DNA, 22 bp, Homo sapiens
cctggagcatcaggaggaaggg

SEQ ID NO: 7121361 - DNA, 22 bp, Homo sapiens
cctggagcatcaggaggaaggg

SEQ ID NO: 7121362 - DNA, 22 bp, Homo sapiens
cctgcctggcttccagaagaga

SEQ ID NO: 7121363 - DNA, 18 bp, Homo sapiens
cctggacctgtctccttt

SEQ ID NO: 7121364 - DNA, 21 bp, Homo sapiens
cctggactaaaaccaggccac

SEQ ID NO: 7121365 - DNA, 22 bp, Homo sapiens
cctggagcactctccctggctg

SEQ ID NO: 7121366 - DNA, 22 bp, Homo sapiens
cctggagcactctccctggctg

SEQ ID NO: 7121367 - DNA, 22 bp, Homo sapiens
cctggagcaggagctgcagagg

SEQ ID NO: 7121368 - DNA, 22 bp, Homo sapiens
cctggagcaggagctgcagagg

SEQ ID NO: 7121369 - DNA, 22 bp, Homo sapiens
cctggagcaggagctgcagagg

SEQ ID NO: 7121370 - DNA, 22 bp, Homo sapiens
cgtggcctctatggctcccgcc

SEQ ID NO: 7121371 - DNA, 22 bp, Homo sapiens
cgtggcctttgagtgagctccc

SEQ ID NO: 7121372 - DNA, 22 bp, Homo sapiens
cgtggccagccatttcctggaa

SEQ ID NO: 7121373 - DNA, 22 bp, Homo sapiens
cgtggccagtttcaagctacca

SEQ ID NO: 7121374 - DNA, 22 bp, Homo sapiens
cgtggccacccagtggtgcgtg

SEQ ID NO: 7121375 - DNA, 22 bp, Homo sapiens
cgtggccagcacaaggcagtga

SEQ ID NO: 7121376 - DNA, 20 bp, Homo sapiens
cgtgctgtgaccttgagcat

SEQ ID NO: 7121377 - DNA, 19 bp, Homo sapiens
cgtggagctggcaggcagg

SEQ ID NO: 7121378 - DNA, 22 bp, Homo sapiens
cgtggcagtggaaggctgggtg

SEQ ID NO: 7121379 - DNA, 22 bp, Homo sapiens
cgtggctcttttctgcatcagg

SEQ ID NO: 7121380 - DNA, 22 bp, Homo sapiens
ctaaaattatcaagataattcc

SEQ ID NO: 7121381 - DNA, 22 bp, Homo sapiens
ctaaacaagatactaatgaggt

SEQ ID NO: 7121382 - DNA, 22 bp, Homo sapiens
ctaaactagcagttctgcaaca

SEQ ID NO: 7121383 - DNA, 18 bp, Homo sapiens
ctaaactgcacctaatga

SEQ ID NO: 7121384 - DNA, 22 bp, Homo sapiens
ctaaacatgttggtgctttaaa

SEQ ID NO: 7121385 - DNA, 22 bp, Homo sapiens
ctaaacatgttggtgctttaaa

SEQ ID NO: 7121386 - DNA, 22 bp, Homo sapiens
ctaaacatgttggtgctttaaa

SEQ ID NO: 7121387 - DNA, 22 bp, Homo sapiens
ctaaacatgtagcttttgtggt

SEQ ID NO: 7121388 - DNA, 22 bp, Homo sapiens
ctaaacatgtagcttttgtggt

SEQ ID NO: 7121389 - DNA, 22 bp, Homo sapiens
ctaaacatggcttagaacactc

SEQ ID NO: 7121390 - DNA, 22 bp, Homo sapiens
ctaaacatgcaagagcttctgg

SEQ ID NO: 7121391 - DNA, 22 bp, Homo sapiens
ctaaacatgcaagagcttctgg

SEQ ID NO: 7121392 - DNA, 22 bp, Homo sapiens
ctaaacatgaactacatttagg

SEQ ID NO: 7121393 - DNA, 22 bp, Homo sapiens
ctaaacatgaactacatttagg

SEQ ID NO: 7121394 - DNA, 22 bp, Homo sapiens
ctaaacatgcaagagcttctgg

SEQ ID NO: 7121395 - DNA, 22 bp, Homo sapiens
ctaaacatcttgcaatgcacag

SEQ ID NO: 7121396 - DNA, 22 bp, Homo sapiens
ctaaacactatgtaagcaagaa

SEQ ID NO: 7121397 - DNA, 22 bp, Homo sapiens
ctaaacagtgcatatgggtgtt

SEQ ID NO: 7121398 - DNA, 22 bp, Homo sapiens
ctaaacaatgaacaaagcactg

SEQ ID NO: 7121399 - DNA, 22 bp, Homo sapiens
ctaaacaagggattataattga

SEQ ID NO: 7121400 - DNA, 22 bp, Homo sapiens
ctaaacaagggattataattga

SEQ ID NO: 7121401 - DNA, 17 bp, Homo sapiens
cgtgagcagcaggtgcc

SEQ ID NO: 7121402 - DNA, 22 bp, Homo sapiens
cgtgaggggggtaaggcgtccg

SEQ ID NO: 7121403 - DNA, 22 bp, Homo sapiens
cgtgatatttgtggtggatgaa

SEQ ID NO: 7121404 - DNA, 22 bp, Homo sapiens
cggtcaggtgcagcgttggcac

SEQ ID NO: 7121405 - DNA, 22 bp, Homo sapiens
cgcggtggcggcctccagcgcc

SEQ ID NO: 7121406 - DNA, 22 bp, Homo sapiens
cggtcaggtgcagcgttggcac

SEQ ID NO: 7121407 - DNA, 22 bp, Homo sapiens
cggtcaggtgcagcgttggcac

SEQ ID NO: 7121408 - DNA, 22 bp, Homo sapiens
cgtgattggcttctgcattgga

SEQ ID NO: 7121409 - DNA, 22 bp, Homo sapiens
cgtgcaaatatatgtgtgatga

SEQ ID NO: 7121410 - DNA, 22 bp, Homo sapiens
cgtgcatgatatatgagttgtt

SEQ ID NO: 7121411 - DNA, 22 bp, Homo sapiens
cgtgccactgcactctagcctg

SEQ ID NO: 7121412 - DNA, 22 bp, Homo sapiens
cgtgccccggtgaggagttcag

SEQ ID NO: 7121413 - DNA, 22 bp, Homo sapiens
cgtgccccggtgaggagttcag

SEQ ID NO: 7121414 - DNA, 22 bp, Homo sapiens
cgtgccttggtcccaaccccca

SEQ ID NO: 7121415 - DNA, 22 bp, Homo sapiens
cgtgctaacgtttaaggttatg

SEQ ID NO: 7121416 - DNA, 22 bp, Homo sapiens
cgcgctgcagacagcggaggcc

SEQ ID NO: 7121417 - DNA, 22 bp, Homo sapiens
cgcggaggaggtcaggaggtga

SEQ ID NO: 7121418 - DNA, 22 bp, Homo sapiens
cgcggaggaggtcaggaggtga

SEQ ID NO: 7121419 - DNA, 22 bp, Homo sapiens
cgcggctctgcgggccgctgag

SEQ ID NO: 7121420 - DNA, 22 bp, Homo sapiens
cgcgggcccctgcgctccgggc

SEQ ID NO: 7121421 - DNA, 22 bp, Homo sapiens
cgcgggcctccagacccagtat

SEQ ID NO: 7121422 - DNA, 22 bp, Homo sapiens
cgcggggctggaaaggaacttc

SEQ ID NO: 7121423 - DNA, 22 bp, Homo sapiens
cgcgggggtcctcaggcaggcg

SEQ ID NO: 7121424 - DNA, 22 bp, Homo sapiens
cgcggtggcggcctccagcgcc

SEQ ID NO: 7121425 - DNA, 22 bp, Homo sapiens
cgcctggatgttcacgggcagc

SEQ ID NO: 7121426 - DNA, 19 bp, Homo sapiens
cgcctggcaggccctgcgc

SEQ ID NO: 7121427 - DNA, 22 bp, Homo sapiens
cgcctgggagtccacacctgct

SEQ ID NO: 7121428 - DNA, 22 bp, Homo sapiens
cgccttcacaaggacagtatat

SEQ ID NO: 7121429 - DNA, 22 bp, Homo sapiens
cgccttcaggccctttttgttg

SEQ ID NO: 7121430 - DNA, 22 bp, Homo sapiens
cgccttcaggccctttttgttg

SEQ ID NO: 7121431 - DNA, 22 bp, Homo sapiens
cgcgctcatttccgcctccttc

SEQ ID NO: 7121432 - DNA, 22 bp, Homo sapiens
cgcgctctccttctggcaccca

SEQ ID NO: 7121433 - DNA, 22 bp, Homo sapiens
cgcgctctccttctggcaccca

SEQ ID NO: 7121434 - DNA, 23 bp, Homo sapiens
ctacaagagcaagcatggacaag

SEQ ID NO: 7121435 - DNA, 22 bp, Homo sapiens
ctacaagaggaatggaggtctg

SEQ ID NO: 7121436 - DNA, 22 bp, Homo sapiens
ctacaagcatctatgtttcaag

SEQ ID NO: 7121437 - DNA, 22 bp, Homo sapiens
ctacaagtcattccaggtactt

SEQ ID NO: 7121438 - DNA, 22 bp, Homo sapiens
ctacacagagcctacttctgca

SEQ ID NO: 7121439 - DNA, 22 bp, Homo sapiens
agtcagagttcttggggagaca

SEQ ID NO: 7121440 - DNA, 22 bp, Homo sapiens
agtcagagtctattgctgtggt

SEQ ID NO: 7121441 - DNA, 22 bp, Homo sapiens
agtcagagtgtgcaggccggct

SEQ ID NO: 7121442 - DNA, 22 bp, Homo sapiens
agtcagagtctattgctgtggt

SEQ ID NO: 7121443 - DNA, 22 bp, Homo sapiens
agtcagagtcgccgacagtcaa

SEQ ID NO: 7121444 - DNA, 17 bp, Homo sapiens
agtcagaggagtatctg

SEQ ID NO: 7121445 - DNA, 17 bp, Homo sapiens
agtcagaggagtatctg

SEQ ID NO: 7121446 - DNA, 22 bp, Homo sapiens
agtcagaggaatgggccaggct

SEQ ID NO: 7121447 - DNA, 23 bp, Homo sapiens
agtcagagcagaagggctgcttg

SEQ ID NO: 7121448 - DNA, 22 bp, Homo sapiens
agtcagagcaaactggacagac

SEQ ID NO: 7121449 - DNA, 23 bp, Homo sapiens
agtcagagagtgtgagacaactg

SEQ ID NO: 7121450 - DNA, 22 bp, Homo sapiens
agtcagagagctctcagcatag

SEQ ID NO: 7121451 - DNA, 22 bp, Homo sapiens
agtcagagaaaacagccctgtg

SEQ ID NO: 7121452 - DNA, 22 bp, Homo sapiens
agtcagagaataaagaatgcat

SEQ ID NO: 7121453 - DNA, 22 bp, Homo sapiens
agtcagactatcttggttgaga

SEQ ID NO: 7121454 - DNA, 22 bp, Homo sapiens
agtcaccaacatggttcccagg

SEQ ID NO: 7121455 - DNA, 22 bp, Homo sapiens
agtcaccaacatggttcccagg

SEQ ID NO: 7121456 - DNA, 22 bp, Homo sapiens
agtcactttatgagagaaccat

SEQ ID NO: 7121457 - DNA, 22 bp, Homo sapiens
agtcactttgctactctgcctt

SEQ ID NO: 7121458 - DNA, 22 bp, Homo sapiens
agtcagaagggcccttccttcc

SEQ ID NO: 7121459 - DNA, 22 bp, Homo sapiens
agtcataattataaacatcagt

SEQ ID NO: 7121460 - DNA, 22 bp, Homo sapiens
agtcataattataaacatcagt

SEQ ID NO: 7121461 - DNA, 22 bp, Homo sapiens
agtcagtttccctggaaagcag

SEQ ID NO: 7121462 - DNA, 22 bp, Homo sapiens
agtcagttttaccaatctcagt

SEQ ID NO: 7121463 - DNA, 22 bp, Homo sapiens
agtcagttttctccagggggct

SEQ ID NO: 7121464 - DNA, 22 bp, Homo sapiens
agtcagttttcttaaagggaag

SEQ ID NO: 7121465 - DNA, 22 bp, Homo sapiens
agtcagttgtggagatttaact

SEQ ID NO: 7121466 - DNA, 22 bp, Homo sapiens
agtcagttgtggagatttaact

SEQ ID NO: 7121467 - DNA, 22 bp, Homo sapiens
agtcagttgcagtttatggatg

SEQ ID NO: 7121468 - DNA, 22 bp, Homo sapiens
agtcagttgcaaacatcaggca

SEQ ID NO: 7121469 - DNA, 19 bp, Homo sapiens
agtcagttctgaggaggaa

SEQ ID NO: 7121470 - DNA, 22 bp, Homo sapiens
agtcagttcatggctctgtcct

SEQ ID NO: 7121471 - DNA, 22 bp, Homo sapiens
agtcagttaacctcacagcatc

SEQ ID NO: 7121472 - DNA, 19 bp, Homo sapiens
agtcagttctgaggaggaa

SEQ ID NO: 7121473 - DNA, 18 bp, Homo sapiens
agtcagttgatggggacc

SEQ ID NO: 7121474 - DNA, 22 bp, Homo sapiens
agtcagttaaactttgtaaagt

SEQ ID NO: 7121475 - DNA, 22 bp, Homo sapiens
agtcagttaaactttgtaaagt

SEQ ID NO: 7121476 - DNA, 22 bp, Homo sapiens
agtcagggcctggcctgctgaa

SEQ ID NO: 7121477 - DNA, 21 bp, Homo sapiens
ctacagaatcgagcattctgg

SEQ ID NO: 7121478 - DNA, 22 bp, Homo sapiens
agtcaggctgacaggctaggag

SEQ ID NO: 7121479 - DNA, 22 bp, Homo sapiens
agtcaggctgacaggctaggag

SEQ ID NO: 7121480 - DNA, 21 bp, Homo sapiens
ctacacagctttctataggaa

SEQ ID NO: 7121481 - DNA, 22 bp, Homo sapiens
ctacacagagcctacttctgca

SEQ ID NO: 7121482 - DNA, 21 bp, Homo sapiens
ctacacagctttctataggaa

SEQ ID NO: 7121483 - DNA, 20 bp, Homo sapiens
ctacacagggttcgctgggc

SEQ ID NO: 7121484 - DNA, 22 bp, Homo sapiens
ctacacagttctgcctaatggc

SEQ ID NO: 7121485 - DNA, 21 bp, Homo sapiens
ctacactgtgttagaaaatgg

SEQ ID NO: 7121486 - DNA, 22 bp, Homo sapiens
ctacacttgcatgagtcttgaa

SEQ ID NO: 7121487 - DNA, 20 bp, Homo sapiens
ctacacttggcacctggcat

SEQ ID NO: 7121488 - DNA, 22 bp, Homo sapiens
ctacacttgttcgactgcagga

SEQ ID NO: 7121489 - DNA, 22 bp, Homo sapiens
ctacagaaaatcagccacaggc

SEQ ID NO: 7121490 - DNA, 22 bp, Homo sapiens
ctacacttgatggagtttcctt

SEQ ID NO: 7121491 - DNA, 22 bp, Homo sapiens
ctacacttgttcgactgcagga

SEQ ID NO: 7121492 - DNA, 22 bp, Homo sapiens
ctacactttggttgactttgtg

SEQ ID NO: 7121493 - DNA, 22 bp, Homo sapiens
ctacagaaacactggacatgtg

SEQ ID NO: 7121494 - DNA, 22 bp, Homo sapiens
ctacagaaacctttttcataca

SEQ ID NO: 7121495 - DNA, 22 bp, Homo sapiens
ctacagaagaaactatcactat

SEQ ID NO: 7121496 - DNA, 22 bp, Homo sapiens
ctacagaagaaactatcactat

SEQ ID NO: 7121497 - DNA, 22 bp, Homo sapiens
ctacagaagaaactatcactat

SEQ ID NO: 7121498 - DNA, 22 bp, Homo sapiens
ctacagaagccgtggtcaggaa

SEQ ID NO: 7121499 - DNA, 21 bp, Homo sapiens
ctacagaagctctcctatcca

SEQ ID NO: 7121500 - DNA, 22 bp, Homo sapiens
ctacagaaggagaaatgggtaa

SEQ ID NO: 7121501 - DNA, 22 bp, Homo sapiens
ctacagaagtttcccttgctta

SEQ ID NO: 7121502 - DNA, 21 bp, Homo sapiens
ctacagaatcgagcattctgg

SEQ ID NO: 7121503 - DNA, 21 bp, Homo sapiens
ctacagaatcgagcattctgg

SEQ ID NO: 7121504 - DNA, 20 bp, Homo sapiens
cctttattatttgtatgatg

SEQ ID NO: 7121505 - DNA, 20 bp, Homo sapiens
cctttattatttgtatgatg

SEQ ID NO: 7121506 - DNA, 20 bp, Homo sapiens
cctttattatttgtatgatg

SEQ ID NO: 7121507 - DNA, 20 bp, Homo sapiens
cctttattatttgtatgatg

SEQ ID NO: 7121508 - DNA, 20 bp, Homo sapiens
cctttattatttgtatgatg

SEQ ID NO: 7121509 - DNA, 22 bp, Homo sapiens
cctttattcaattagtcctaat

SEQ ID NO: 7121510 - DNA, 22 bp, Homo sapiens
cctttattcaattagtcctaat

SEQ ID NO: 7121511 - DNA, 22 bp, Homo sapiens
cctttattcaattagtcctaat

SEQ ID NO: 7121512 - DNA, 22 bp, Homo sapiens
cctttattcaattagtcctaat

SEQ ID NO: 7121513 - DNA, 21 bp, Homo sapiens
cctttagatttctatgcagtt

SEQ ID NO: 7121514 - DNA, 22 bp, Homo sapiens
cctttagaattctgcccctcct

SEQ ID NO: 7121515 - DNA, 22 bp, Homo sapiens
cctttagagcaaacgccaccta

SEQ ID NO: 7121516 - DNA, 22 bp, Homo sapiens
cctttagatgatctcttggaca

SEQ ID NO: 7121517 - DNA, 21 bp, Homo sapiens
cctttatgcaaggactggcat

SEQ ID NO: 7121518 - DNA, 19 bp, Homo sapiens
cctttagttgctcagagaa

SEQ ID NO: 7121519 - DNA, 22 bp, Homo sapiens
cctttagaatacagactttcta

SEQ ID NO: 7121520 - DNA, 22 bp, Homo sapiens
cctttagaaagtcagtagttgc

SEQ ID NO: 7121521 - DNA, 21 bp, Homo sapiens
aggtttctcttttatggaggg

SEQ ID NO: 7121522 - DNA, 21 bp, Homo sapiens
aggtttctcttttatggaggg

SEQ ID NO: 7121523 - DNA, 19 bp, Homo sapiens
aggtttctaactattcaag

SEQ ID NO: 7121524 - DNA, 19 bp, Homo sapiens
aggtttctaactattcaag

SEQ ID NO: 7121525 - DNA, 22 bp, Homo sapiens
aggtttctatgctgtttatctt

SEQ ID NO: 7121526 - DNA, 21 bp, Homo sapiens
aggtttatttcaacttcagga

SEQ ID NO: 7121527 - DNA, 21 bp, Homo sapiens
aggtttatttcaacttcagga

SEQ ID NO: 7121528 - DNA, 22 bp, Homo sapiens
aggtttcatgggagacaactca

SEQ ID NO: 7121529 - DNA, 22 bp, Homo sapiens
aggtttattatgtagcattatt

SEQ ID NO: 7121530 - DNA, 22 bp, Homo sapiens
aggtttatgattctgcacgtgg

SEQ ID NO: 7121531 - DNA, 22 bp, Homo sapiens
aggtttatgattctgcacgtgg

SEQ ID NO: 7121532 - DNA, 17 bp, Homo sapiens
aggtttatggtatttga

SEQ ID NO: 7121533 - DNA, 22 bp, Homo sapiens
cgcctgctctgtttccatgtgg

SEQ ID NO: 7121534 - DNA, 22 bp, Homo sapiens
agtacaaattatagcgcttgga

SEQ ID NO: 7121535 - DNA, 22 bp, Homo sapiens
cgcctgctctcactggacagct

SEQ ID NO: 7121536 - DNA, 22 bp, Homo sapiens
cgcctgcttaacgaattgtgtt

SEQ ID NO: 7121537 - DNA, 22 bp, Homo sapiens
cgcctggaacctctaggaccag

SEQ ID NO: 7121538 - DNA, 22 bp, Homo sapiens
cgcctggaacctctaggaccag

SEQ ID NO: 7121539 - DNA, 22 bp, Homo sapiens
cgcctggagaggaggcgacgcg

SEQ ID NO: 7121540 - DNA, 22 bp, Homo sapiens
agtacaaagtgctcctggttct

SEQ ID NO: 7121541 - DNA, 22 bp, Homo sapiens
agtacaaatgcagccagagtag

SEQ ID NO: 7121542 - DNA, 22 bp, Homo sapiens
agtacaaatgcagccagagtag

SEQ ID NO: 7121543 - DNA, 22 bp, Homo sapiens
agtacaaatgcagccagagtag

SEQ ID NO: 7121544 - DNA, 22 bp, Homo sapiens
agtacaaattatagcgcttgga

SEQ ID NO: 7121545 - DNA, 22 bp, Homo sapiens
agtacaaattatagcgcttgga

SEQ ID NO: 7121546 - DNA, 22 bp, Homo sapiens
agtacaaaatgcagcatcatca

SEQ ID NO: 7121547 - DNA, 22 bp, Homo sapiens
agtacaaaatgcagcatcatca

SEQ ID NO: 7121548 - DNA, 22 bp, Homo sapiens
agtacaaaatgcagcatcatca

SEQ ID NO: 7121549 - DNA, 22 bp, Homo sapiens
agtacaaactgtttcaaagtag

SEQ ID NO: 7121550 - DNA, 22 bp, Homo sapiens
agtacaaactgtttcaaagtag

SEQ ID NO: 7121551 - DNA, 22 bp, Homo sapiens
agtacaaactgtttcaaagtag

SEQ ID NO: 7121552 - DNA, 22 bp, Homo sapiens
agtacaaaggcccttgattact

SEQ ID NO: 7121553 - DNA, 22 bp, Homo sapiens
agtacaaaggcccttgattact

SEQ ID NO: 7121554 - DNA, 22 bp, Homo sapiens
agtacaaaggcccttgattact

SEQ ID NO: 7121555 - DNA, 22 bp, Homo sapiens
agtaatagagattttaatgtcc

SEQ ID NO: 7121556 - DNA, 22 bp, Homo sapiens
agtaatcgtgatcgagagatca

SEQ ID NO: 7121557 - DNA, 22 bp, Homo sapiens
agtaacaggatccaaagaatgt

SEQ ID NO: 7121558 - DNA, 22 bp, Homo sapiens
agtaacaggtgtacagactatc

SEQ ID NO: 7121559 - DNA, 22 bp, Homo sapiens
agtaacaggtgtacagactatc

SEQ ID NO: 7121560 - DNA, 22 bp, Homo sapiens
agtaataatttatattagggag

SEQ ID NO: 7121561 - DNA, 22 bp, Homo sapiens
agtaatctgattttatagctat

SEQ ID NO: 7121562 - DNA, 22 bp, Homo sapiens
agtaatgacaatttttatctgt

SEQ ID NO: 7121563 - DNA, 22 bp, Homo sapiens
agtaatgccctctgctttggag

SEQ ID NO: 7121564 - DNA, 22 bp, Homo sapiens
agtaatgcggtggggaaaacaa

SEQ ID NO: 7121565 - DNA, 22 bp, Homo sapiens
agtaatgcttctagaactattt

SEQ ID NO: 7121566 - DNA, 22 bp, Homo sapiens
agtaatgtgcctgaaatacttg

SEQ ID NO: 7121567 - DNA, 21 bp, Homo sapiens
agtaattgcggtgattagtga

SEQ ID NO: 7121568 - DNA, 22 bp, Homo sapiens
agtaattggctacagtgtaatt

SEQ ID NO: 7121569 - DNA, 22 bp, Homo sapiens
agtaattggctacagtgtaatt

SEQ ID NO: 7121570 - DNA, 22 bp, Homo sapiens
agtaatttgttataaagcaata

SEQ ID NO: 7121571 - DNA, 22 bp, Homo sapiens
agtaatttgttataaagcaata

SEQ ID NO: 7121572 - DNA, 21 bp, Homo sapiens
agtacaaaaattcctttctca

SEQ ID NO: 7121573 - DNA, 21 bp, Homo sapiens
agtacaaaaattcctttctca

SEQ ID NO: 7121574 - DNA, 22 bp, Homo sapiens
cctggtgcaccaagtaagggtg

SEQ ID NO: 7121575 - DNA, 22 bp, Homo sapiens
cctggtgcaccaagtaagggtg

SEQ ID NO: 7121576 - DNA, 22 bp, Homo sapiens
cctggtccccatcggcccagcg

SEQ ID NO: 7121577 - DNA, 22 bp, Homo sapiens
cctggtgcaggtgtgttgccag

SEQ ID NO: 7121578 - DNA, 22 bp, Homo sapiens
cctggtgccactagagaatgtc

SEQ ID NO: 7121579 - DNA, 22 bp, Homo sapiens
cctggtgcccccaagccagctg

SEQ ID NO: 7121580 - DNA, 22 bp, Homo sapiens
aggtgtctttgcggcccgccgc

SEQ ID NO: 7121581 - DNA, 22 bp, Homo sapiens
aggtgtcttcagggtgagacag

SEQ ID NO: 7121582 - DNA, 22 bp, Homo sapiens
aggtgtgaagagttgacacatt

SEQ ID NO: 7121583 - DNA, 22 bp, Homo sapiens
aggtgtcttcagggtgagacag

SEQ ID NO: 7121584 - DNA, 22 bp, Homo sapiens
aggtgtcttcagggtgagacag

SEQ ID NO: 7121585 - DNA, 22 bp, Homo sapiens
aggtgtctttcagtcatggctt

SEQ ID NO: 7121586 - DNA, 22 bp, Homo sapiens
aggtgtcttcagggtgagacag

SEQ ID NO: 7121587 - DNA, 22 bp, Homo sapiens
aggtgtctgtgatgggagcgat

SEQ ID NO: 7121588 - DNA, 22 bp, Homo sapiens
aggtgtctgggctttggagtca

SEQ ID NO: 7121589 - DNA, 22 bp, Homo sapiens
aggtggggttcagtctcagccg

SEQ ID NO: 7121590 - DNA, 22 bp, Homo sapiens
aggtgtctggatgggtgtcctt

SEQ ID NO: 7121591 - DNA, 22 bp, Homo sapiens
aggtggggttcagtctcagccg

SEQ ID NO: 7121592 - DNA, 22 bp, Homo sapiens
aggtgtctggatgggtgtcctt

SEQ ID NO: 7121593 - DNA, 22 bp, Homo sapiens
aggtggggttcagtctcagccg

SEQ ID NO: 7121594 - DNA, 22 bp, Homo sapiens
aggtgtgcaggatgaacccctc

SEQ ID NO: 7121595 - DNA, 23 bp, Homo sapiens
aggtgtgcttctgggcacctggg

SEQ ID NO: 7121596 - DNA, 23 bp, Homo sapiens
aggtgtgcttctgggcacctggg

SEQ ID NO: 7121597 - DNA, 22 bp, Homo sapiens
aggtgtggctatgctgtgttcc

SEQ ID NO: 7121598 - DNA, 22 bp, Homo sapiens
aggtgtggctggggcagaggcc

SEQ ID NO: 7121599 - DNA, 22 bp, Homo sapiens
aggtgtggctggggcagaggcc

SEQ ID NO: 7121600 - DNA, 22 bp, Homo sapiens
aggtgtggctggggcagaggcc

SEQ ID NO: 7121601 - DNA, 22 bp, Homo sapiens
aggtgtggctggggcagaggcc

SEQ ID NO: 7121602 - DNA, 22 bp, Homo sapiens
aggtgtggctggggcagaggcc

SEQ ID NO: 7121603 - DNA, 22 bp, Homo sapiens
aggtgtggctggggcagaggcc

SEQ ID NO: 7121604 - DNA, 22 bp, Homo sapiens
aggtgtggctggggcagaggcc

SEQ ID NO: 7121605 - DNA, 22 bp, Homo sapiens
aggtgtggctggggcagaggcc

SEQ ID NO: 7121606 - DNA, 22 bp, Homo sapiens
aggtgtggcttgaagtctctat

SEQ ID NO: 7121607 - DNA, 22 bp, Homo sapiens
aggtgtggcttgaagtctctat

SEQ ID NO: 7121608 - DNA, 22 bp, Homo sapiens
aggtgtggcttgaagtctctat

SEQ ID NO: 7121609 - DNA, 22 bp, Homo sapiens
aggtgtgggaaacgggtgacct

SEQ ID NO: 7121610 - DNA, 22 bp, Homo sapiens
aggtgtgggaaacgggtgacct

SEQ ID NO: 7121611 - DNA, 22 bp, Homo sapiens
aggtgtgggaaacgggtgacct

SEQ ID NO: 7121612 - DNA, 22 bp, Homo sapiens
aggtgtgggaaacgggtgacct

SEQ ID NO: 7121613 - DNA, 19 bp, Homo sapiens
aggtgtgggggctgcagac

SEQ ID NO: 7121614 - DNA, 19 bp, Homo sapiens
aggtgtgggggctgcagac

SEQ ID NO: 7121615 - DNA, 19 bp, Homo sapiens
aggtgtgggggctgcagac

SEQ ID NO: 7121616 - DNA, 19 bp, Homo sapiens
aggtgtgggggctgcagac

SEQ ID NO: 7121617 - DNA, 19 bp, Homo sapiens
aggtgtgggggctgcagac

SEQ ID NO: 7121618 - DNA, 19 bp, Homo sapiens
aggtgtgggggctgcagac

SEQ ID NO: 7121619 - DNA, 19 bp, Homo sapiens
aggtgtgggggctgcagac

SEQ ID NO: 7121620 - DNA, 19 bp, Homo sapiens
aggtgtgggggctgcagac

SEQ ID NO: 7121621 - DNA, 17 bp, Homo sapiens
aggtgtggtcaagggag

SEQ ID NO: 7121622 - DNA, 17 bp, Homo sapiens
aggtgtggtcaagggag

SEQ ID NO: 7121623 - DNA, 17 bp, Homo sapiens
aggtgtggtcaagggag

SEQ ID NO: 7121624 - DNA, 22 bp, Homo sapiens
aggttatcatcagttgagcact

SEQ ID NO: 7121625 - DNA, 22 bp, Homo sapiens
aggttagtgctgaaatgacatg

SEQ ID NO: 7121626 - DNA, 22 bp, Homo sapiens
aggttatatgtcatactgaagt

SEQ ID NO: 7121627 - DNA, 22 bp, Homo sapiens
aggttatttgcagatggaattc

SEQ ID NO: 7121628 - DNA, 22 bp, Homo sapiens
aggttattaaagtgtatttttg

SEQ ID NO: 7121629 - DNA, 18 bp, Homo sapiens
aggtgtgtttctaggagc

SEQ ID NO: 7121630 - DNA, 22 bp, Homo sapiens
aggttaaaaaggattcagttaa

SEQ ID NO: 7121631 - DNA, 19 bp, Homo sapiens
aggttacaggtgtcacaga

SEQ ID NO: 7121632 - DNA, 22 bp, Homo sapiens
aggttacagtcatctcagaatc

SEQ ID NO: 7121633 - DNA, 22 bp, Homo sapiens
aggttacagtcatctcagaatc

SEQ ID NO: 7121634 - DNA, 22 bp, Homo sapiens
aggttacagtgattataggttt

SEQ ID NO: 7121635 - DNA, 23 bp, Homo sapiens
aggttacagttgttaagttgcaa

SEQ ID NO: 7121636 - DNA, 22 bp, Homo sapiens
aggttacataggctttaaaagt

SEQ ID NO: 7121637 - DNA, 22 bp, Homo sapiens
aggtttataggaaatttgttcc

SEQ ID NO: 7121638 - DNA, 22 bp, Homo sapiens
aggtttactgagggtgctggtt

SEQ ID NO: 7121639 - DNA, 22 bp, Homo sapiens
aggttgggatgagtgggtgagc

SEQ ID NO: 7121640 - DNA, 22 bp, Homo sapiens
aggttggcctcagggaggctct

SEQ ID NO: 7121641 - DNA, 22 bp, Homo sapiens
aggttggctgctcttttcctaa

SEQ ID NO: 7121642 - DNA, 22 bp, Homo sapiens
aggttattttgctcagggaact

SEQ ID NO: 7121643 - DNA, 22 bp, Homo sapiens
aggttcagacgcataataggca

SEQ ID NO: 7121644 - DNA, 22 bp, Homo sapiens
aggttcagagttgttgatgttt

SEQ ID NO: 7121645 - DNA, 22 bp, Homo sapiens
aggttcagatgacttttatgct

SEQ ID NO: 7121646 - DNA, 23 bp, Homo sapiens
aggttcagctttcttactctggg

SEQ ID NO: 7121647 - DNA, 23 bp, Homo sapiens
aggttcaggagatggaggaacaa

SEQ ID NO: 7121648 - DNA, 22 bp, Homo sapiens
aggttcaggcacttgcccaaca

SEQ ID NO: 7121649 - DNA, 22 bp, Homo sapiens
aggttcaggctgcacacctgag

SEQ ID NO: 7121650 - DNA, 17 bp, Homo sapiens
aggttcaggttacattc

SEQ ID NO: 7121651 - DNA, 22 bp, Homo sapiens
aggttcagtaaatgttagttga

SEQ ID NO: 7121652 - DNA, 22 bp, Homo sapiens
aggttcagtctttggacccctc

SEQ ID NO: 7121653 - DNA, 22 bp, Homo sapiens
aggttcagtgcctggaacaggg

SEQ ID NO: 7121654 - DNA, 22 bp, Homo sapiens
aggttcatccagctcattaaaa

SEQ ID NO: 7121655 - DNA, 22 bp, Homo sapiens
agtggggaggtccaggccaccc

SEQ ID NO: 7121656 - DNA, 20 bp, Homo sapiens
agtggggagtcaggagtgcc

SEQ ID NO: 7121657 - DNA, 20 bp, Homo sapiens
agtggggagtcaggagtgcc

SEQ ID NO: 7121658 - DNA, 20 bp, Homo sapiens
agtggggagtcaggagtgcc

SEQ ID NO: 7121659 - DNA, 20 bp, Homo sapiens
agtggggagtcaggagtgcc

SEQ ID NO: 7121660 - DNA, 22 bp, Homo sapiens
agtggggacttatgccagcatt

SEQ ID NO: 7121661 - DNA, 22 bp, Homo sapiens
agtggggacttatgccagcatt

SEQ ID NO: 7121662 - DNA, 22 bp, Homo sapiens
agtggggacttatgccagcatt

SEQ ID NO: 7121663 - DNA, 20 bp, Homo sapiens
agtggggagtcaggagtgcc

SEQ ID NO: 7121664 - DNA, 23 bp, Homo sapiens
agtggggaatcaacagattcttt

SEQ ID NO: 7121665 - DNA, 22 bp, Homo sapiens
agtggggaagagcatgggccct

SEQ ID NO: 7121666 - DNA, 22 bp, Homo sapiens
agtggggacaatgagagcaggt

SEQ ID NO: 7121667 - DNA, 22 bp, Homo sapiens
agtggggacaatgagagcaggt

SEQ ID NO: 7121668 - DNA, 22 bp, Homo sapiens
agtgtctgatgcacagttgtcc

SEQ ID NO: 7121669 - DNA, 22 bp, Homo sapiens
agtgtctgcaaaatgaaagagc

SEQ ID NO: 7121670 - DNA, 22 bp, Homo sapiens
agtgtctgcaaaatgaaagagc

SEQ ID NO: 7121671 - DNA, 22 bp, Homo sapiens
agtgtctgatcagttgactaga

SEQ ID NO: 7121672 - DNA, 22 bp, Homo sapiens
agtgtctgatcagttgactaga

SEQ ID NO: 7121673 - DNA, 22 bp, Homo sapiens
agtgtctgatcagttgactaga

SEQ ID NO: 7121674 - DNA, 22 bp, Homo sapiens
agtgtctgagtaaatttctcat

SEQ ID NO: 7121675 - DNA, 23 bp, Homo sapiens
agtgtctgagtgcaggctgtgca

SEQ ID NO: 7121676 - DNA, 23 bp, Homo sapiens
agtgtctgagtgcaggctgtgca

SEQ ID NO: 7121677 - DNA, 22 bp, Homo sapiens
agtgtctgagctatcattaggg

SEQ ID NO: 7121678 - DNA, 22 bp, Homo sapiens
agtgtctgagccagaattagaa

SEQ ID NO: 7121679 - DNA, 21 bp, Homo sapiens
agtgtctgagcgctgcttctg

SEQ ID NO: 7121680 - DNA, 22 bp, Homo sapiens
agtgtctgaaggatttggcttc

SEQ ID NO: 7121681 - DNA, 22 bp, Homo sapiens
agtgtctgaaggatttggcttc

SEQ ID NO: 7121682 - DNA, 22 bp, Homo sapiens
agtgtctgaagcctcagcccga

SEQ ID NO: 7121683 - DNA, 22 bp, Homo sapiens
agtgtctgaactgggtgctgac

SEQ ID NO: 7121684 - DNA, 22 bp, Homo sapiens
agtgtctgaactgggtgctgac

SEQ ID NO: 7121685 - DNA, 22 bp, Homo sapiens
agtgtcctctattatgacttta

SEQ ID NO: 7121686 - DNA, 22 bp, Homo sapiens
agtgtcctggcaagggtttcag

SEQ ID NO: 7121687 - DNA, 22 bp, Homo sapiens
agtgtctgcctatttttcaagc

SEQ ID NO: 7121688 - DNA, 22 bp, Homo sapiens
agtgtctgccagctgccaggtg

SEQ ID NO: 7121689 - DNA, 22 bp, Homo sapiens
agtgtctgccagctgccaggtg

SEQ ID NO: 7121690 - DNA, 22 bp, Homo sapiens
agtgtctgccaactgcatggtc

SEQ ID NO: 7121691 - DNA, 22 bp, Homo sapiens
agtgtctgccaactgcatggtc

SEQ ID NO: 7121692 - DNA, 22 bp, Homo sapiens
agtgtctgccaactgcatggtc

SEQ ID NO: 7121693 - DNA, 22 bp, Homo sapiens
agtgtctgcagtgatgtctctt

SEQ ID NO: 7121694 - DNA, 22 bp, Homo sapiens
agtgtctgcagtgatgtctctt

SEQ ID NO: 7121695 - DNA, 22 bp, Homo sapiens
agtgtctgcagtgatgtctctt

SEQ ID NO: 7121696 - DNA, 22 bp, Homo sapiens
agtgtctgcctgggaggagcat

SEQ ID NO: 7121697 - DNA, 22 bp, Homo sapiens
agtgtctgcctgggaggagcat

SEQ ID NO: 7121698 - DNA, 21 bp, Homo sapiens
ctctgtttgcctgctgccatc

SEQ ID NO: 7121699 - DNA, 21 bp, Homo sapiens
ctctgtttgcctgctgccatc

SEQ ID NO: 7121700 - DNA, 22 bp, Homo sapiens
ctctgtttttcaatagttcttg

SEQ ID NO: 7121701 - DNA, 22 bp, Homo sapiens
ctctgtttggcgctgctccttc

SEQ ID NO: 7121702 - DNA, 22 bp, Homo sapiens
ctcttaaataacatcattgctt

SEQ ID NO: 7121703 - DNA, 22 bp, Homo sapiens
ctcttaatgaccttaattcaag

SEQ ID NO: 7121704 - DNA, 22 bp, Homo sapiens
ctcttaatgttttatagattga

SEQ ID NO: 7121705 - DNA, 22 bp, Homo sapiens
ctcttaatgaccttaattcaag

SEQ ID NO: 7121706 - DNA, 20 bp, Homo sapiens
ctcttaaatgtaaagtaggc

SEQ ID NO: 7121707 - DNA, 22 bp, Homo sapiens
ctcttaatgttttatagattga

SEQ ID NO: 7121708 - DNA, 22 bp, Homo sapiens
ctcttaattaagctgagatctg

SEQ ID NO: 7121709 - DNA, 22 bp, Homo sapiens
ctcttaattaagctgagatctg

SEQ ID NO: 7121710 - DNA, 20 bp, Homo sapiens
ctcttaattgctcacattag

SEQ ID NO: 7121711 - DNA, 22 bp, Homo sapiens
ctgaagcagatgtggctgagat

SEQ ID NO: 7121712 - DNA, 22 bp, Homo sapiens
ctgaagcagatgtggctgagat

SEQ ID NO: 7121713 - DNA, 22 bp, Homo sapiens
ctgaagcagatgtggctgagat

SEQ ID NO: 7121714 - DNA, 22 bp, Homo sapiens
ctgaagcaggaacagcgagatt

SEQ ID NO: 7121715 - DNA, 22 bp, Homo sapiens
ctgaagcaggaacagcgagatt

SEQ ID NO: 7121716 - DNA, 22 bp, Homo sapiens
ctgaagcaattgagagatgttt

SEQ ID NO: 7121717 - DNA, 22 bp, Homo sapiens
ctgaagcacagcatataaataa

SEQ ID NO: 7121718 - DNA, 19 bp, Homo sapiens
agtgttaacccagtgttgg

SEQ ID NO: 7121719 - DNA, 22 bp, Homo sapiens
agtgttaagagaaaattctgct

SEQ ID NO: 7121720 - DNA, 22 bp, Homo sapiens
ctgaagcaaatgaaacagctct

SEQ ID NO: 7121721 - DNA, 23 bp, Homo sapiens
ctgaagcaatatcccctcacttc

SEQ ID NO: 7121722 - DNA, 22 bp, Homo sapiens
agtgtgtgtttgggcggtttat

SEQ ID NO: 7121723 - DNA, 20 bp, Homo sapiens
agtgtgttcctcttactgtg

SEQ ID NO: 7121724 - DNA, 20 bp, Homo sapiens
agtgtgttcctcttactgtg

SEQ ID NO: 7121725 - DNA, 21 bp, Homo sapiens
agtgtgtgtggaatgagaata

SEQ ID NO: 7121726 - DNA, 22 bp, Homo sapiens
agtgtgtgtttgggcggtttat

SEQ ID NO: 7121727 - DNA, 22 bp, Homo sapiens
agtgtgtgtttgggcggtttat

SEQ ID NO: 7121728 - DNA, 22 bp, Homo sapiens
agtgtgtgtttgggcggtttat

SEQ ID NO: 7121729 - DNA, 22 bp, Homo sapiens
agtgtgttctcaatgaaaagaa

SEQ ID NO: 7121730 - DNA, 22 bp, Homo sapiens
agtgtgttctcaatgaaaagaa

SEQ ID NO: 7121731 - DNA, 22 bp, Homo sapiens
agtgtgttctggtctaccttgg

SEQ ID NO: 7121732 - DNA, 22 bp, Homo sapiens
agtgtgttctggtctaccttgg

SEQ ID NO: 7121733 - DNA, 21 bp, Homo sapiens
agtgtgttcttggcattacct

SEQ ID NO: 7121734 - DNA, 22 bp, Homo sapiens
agtgtgttgtaggctcaaatgg

SEQ ID NO: 7121735 - DNA, 22 bp, Homo sapiens
agtgtgtttaggctgcgggttg

SEQ ID NO: 7121736 - DNA, 22 bp, Homo sapiens
agtgtgtttggagcgagggagg

SEQ ID NO: 7121737 - DNA, 23 bp, Homo sapiens
agtgttaaatttcgcacctaaat

SEQ ID NO: 7121738 - DNA, 22 bp, Homo sapiens
agtgtgtgcctttggatacctg

SEQ ID NO: 7121739 - DNA, 22 bp, Homo sapiens
agtgtgtgctgttccccggagg

SEQ ID NO: 7121740 - DNA, 22 bp, Homo sapiens
agtgtgtgctgttccccggagg

SEQ ID NO: 7121741 - DNA, 22 bp, Homo sapiens
agtgtgtgctgttccccggagg

SEQ ID NO: 7121742 - DNA, 22 bp, Homo sapiens
agtgtgtgcctttggatacctg

SEQ ID NO: 7121743 - DNA, 18 bp, Homo sapiens
agtgtgtgccctttcagg

SEQ ID NO: 7121744 - DNA, 18 bp, Homo sapiens
agtgtgtgccctttcagg

SEQ ID NO: 7121745 - DNA, 22 bp, Homo sapiens
agtgtgtgcctttggatacctg

SEQ ID NO: 7121746 - DNA, 22 bp, Homo sapiens
agtgtgtgcctttggatacctg

SEQ ID NO: 7121747 - DNA, 21 bp, Homo sapiens
agtgtgtgtggaatgagaata

SEQ ID NO: 7121748 - DNA, 21 bp, Homo sapiens
agtgtgtgtggaatgagaata

SEQ ID NO: 7121749 - DNA, 21 bp, Homo sapiens
agtgtgtgtggaatgagaata

SEQ ID NO: 7121750 - DNA, 21 bp, Homo sapiens
agtgtgtgtggaatgagaata

SEQ ID NO: 7121751 - DNA, 21 bp, Homo sapiens
agtgtgtgtggaatgagaata

SEQ ID NO: 7121752 - DNA, 22 bp, Homo sapiens
agtgtgtgcatgcattcgtgca

SEQ ID NO: 7121753 - DNA, 18 bp, Homo sapiens
agtgtgtgccctttcagg

SEQ ID NO: 7121754 - DNA, 22 bp, Homo sapiens
agtgtgtgcatgcattcgtgca

SEQ ID NO: 7121755 - DNA, 22 bp, Homo sapiens
agtgtgtgcatgcattcgtgca

SEQ ID NO: 7121756 - DNA, 22 bp, Homo sapiens
agtgtgtgcatgcattcgtgca

SEQ ID NO: 7121757 - DNA, 22 bp, Homo sapiens
agtgtgtgcatgcattcgtgca

SEQ ID NO: 7121758 - DNA, 21 bp, Homo sapiens
agtgtgtgataggcaggaaga

SEQ ID NO: 7121759 - DNA, 21 bp, Homo sapiens
agtgtgtgataggcaggaaga

SEQ ID NO: 7121760 - DNA, 22 bp, Homo sapiens
agtgtggggtcaccggcccagg

SEQ ID NO: 7121761 - DNA, 22 bp, Homo sapiens
agtgtgggggctttggtgtcac

SEQ ID NO: 7121762 - DNA, 22 bp, Homo sapiens
agtgtgggggctttggtgtcac

SEQ ID NO: 7121763 - DNA, 22 bp, Homo sapiens
ctgagaggcggagcttgcagtg

SEQ ID NO: 7121764 - DNA, 22 bp, Homo sapiens
ctgagaggcggaggttgcagtg

SEQ ID NO: 7121765 - DNA, 22 bp, Homo sapiens
ctgagaggcggagcttgcagtg

SEQ ID NO: 7121766 - DNA, 22 bp, Homo sapiens
ctgagaggcagccagagaaaat

SEQ ID NO: 7121767 - DNA, 22 bp, Homo sapiens
ctgagaggcagccagagaaaat

SEQ ID NO: 7121768 - DNA, 22 bp, Homo sapiens
ctgagagcatcgctggagatag

SEQ ID NO: 7121769 - DNA, 22 bp, Homo sapiens
ctgagaggaacatcttatgctt

SEQ ID NO: 7121770 - DNA, 22 bp, Homo sapiens
ctgagaggatgctgcagtggag

SEQ ID NO: 7121771 - DNA, 22 bp, Homo sapiens
ctgagaggatgctgcagtggag

SEQ ID NO: 7121772 - DNA, 22 bp, Homo sapiens
ctgagaggatgctgcagtggag

SEQ ID NO: 7121773 - DNA, 22 bp, Homo sapiens
ctgagaaagtgagggttaaaca

SEQ ID NO: 7121774 - DNA, 22 bp, Homo sapiens
ctgagaaagtgagggttaaaca

SEQ ID NO: 7121775 - DNA, 22 bp, Homo sapiens
ctgaagctgggcacttcctttt

SEQ ID NO: 7121776 - DNA, 22 bp, Homo sapiens
ctgaagctgaaaacttccagca

SEQ ID NO: 7121777 - DNA, 22 bp, Homo sapiens
ctgaagctgcataccaaagact

SEQ ID NO: 7121778 - DNA, 22 bp, Homo sapiens
ctgaagctgggcacttcctttt

SEQ ID NO: 7121779 - DNA, 22 bp, Homo sapiens
ctgaagcaggaggggaggcgct

SEQ ID NO: 7121780 - DNA, 22 bp, Homo sapiens
ctgaagcaggcctacttcattg

SEQ ID NO: 7121781 - DNA, 22 bp, Homo sapiens
ctgaagcaggcctacttcattg

SEQ ID NO: 7121782 - DNA, 22 bp, Homo sapiens
ctgaagcaggcctacttcattg

SEQ ID NO: 7121783 - DNA, 22 bp, Homo sapiens
ctgaagcagggagtgatgaagt

SEQ ID NO: 7121784 - DNA, 22 bp, Homo sapiens
ctgaagcagggagtgatgaagt

SEQ ID NO: 7121785 - DNA, 23 bp, Homo sapiens
ctgaagcagttccctctctgccc

SEQ ID NO: 7121786 - DNA, 22 bp, Homo sapiens
ctgaagcatatcatgccaagtt

SEQ ID NO: 7121787 - DNA, 22 bp, Homo sapiens
ctgaagcatgcgtttgtaaact

SEQ ID NO: 7121788 - DNA, 22 bp, Homo sapiens
ctgaagccagtttgctgccctt

SEQ ID NO: 7121789 - DNA, 22 bp, Homo sapiens
agtgggagggccatatggtgaa

SEQ ID NO: 7121790 - DNA, 22 bp, Homo sapiens
agtgggatgcaataaagatata

SEQ ID NO: 7121791 - DNA, 22 bp, Homo sapiens
agtgggcaaaacagctcagagc

SEQ ID NO: 7121792 - DNA, 22 bp, Homo sapiens
agtgggagggccatatggtgaa

SEQ ID NO: 7121793 - DNA, 22 bp, Homo sapiens
agtgggagggccatatggtgaa

SEQ ID NO: 7121794 - DNA, 20 bp, Homo sapiens
agtgggagagggcagactgc

SEQ ID NO: 7121795 - DNA, 22 bp, Homo sapiens
agtgggagggccatatggtgaa

SEQ ID NO: 7121796 - DNA, 22 bp, Homo sapiens
agtgggagagaagcaagtagta

SEQ ID NO: 7121797 - DNA, 22 bp, Homo sapiens
ctctgagcagaggccgtggcta

SEQ ID NO: 7121798 - DNA, 22 bp, Homo sapiens
ctctgagatgataccttctgga

SEQ ID NO: 7121799 - DNA, 22 bp, Homo sapiens
ctctgagatgataccttctgga

SEQ ID NO: 7121800 - DNA, 22 bp, Homo sapiens
ctctgagatgcttgaagaggat

SEQ ID NO: 7121801 - DNA, 22 bp, Homo sapiens
ctctgagatgcttgaagaggat

SEQ ID NO: 7121802 - DNA, 22 bp, Homo sapiens
agtgggcaggcagggtgcgcag

SEQ ID NO: 7121803 - DNA, 22 bp, Homo sapiens
agtgggcaggcagggtgcgcag

SEQ ID NO: 7121804 - DNA, 22 bp, Homo sapiens
agtgggcagcccaggaggtctt

SEQ ID NO: 7121805 - DNA, 22 bp, Homo sapiens
agtgggcagcccaggaggtctt

SEQ ID NO: 7121806 - DNA, 22 bp, Homo sapiens
agtgggcaggcagggtgcgcag

SEQ ID NO: 7121807 - DNA, 22 bp, Homo sapiens
agtgggcagtgcgctcggatgc

SEQ ID NO: 7121808 - DNA, 22 bp, Homo sapiens
agtgggcatatgaagtctcaag

SEQ ID NO: 7121809 - DNA, 19 bp, Homo sapiens
agtgggcaaggaagatgac

SEQ ID NO: 7121810 - DNA, 18 bp, Homo sapiens
agtgggcacacagagaac

SEQ ID NO: 7121811 - DNA, 22 bp, Homo sapiens
agtgggcagcccaggaggtctt

SEQ ID NO: 7121812 - DNA, 22 bp, Homo sapiens
agtgggcaaaacagctcagagc

SEQ ID NO: 7121813 - DNA, 22 bp, Homo sapiens
agtgggcaaaacagctcagagc

SEQ ID NO: 7121814 - DNA, 19 bp, Homo sapiens
agtgggcaaggaagatgac

SEQ ID NO: 7121815 - DNA, 22 bp, Homo sapiens
agtgggctggtggcagggagaa

SEQ ID NO: 7121816 - DNA, 22 bp, Homo sapiens
agtgggctggtggcagggagaa

SEQ ID NO: 7121817 - DNA, 22 bp, Homo sapiens
agtgggctggtggcagggagaa

SEQ ID NO: 7121818 - DNA, 22 bp, Homo sapiens
agtgggctggtggcagggagaa

SEQ ID NO: 7121819 - DNA, 22 bp, Homo sapiens
agtgggctggtggcagggagaa

SEQ ID NO: 7121820 - DNA, 22 bp, Homo sapiens
agtgggctggtggcagggagaa

SEQ ID NO: 7121821 - DNA, 22 bp, Homo sapiens
agtgggcttactgagggagtgt

SEQ ID NO: 7121822 - DNA, 22 bp, Homo sapiens
agtgggcttactgagggagtgt

SEQ ID NO: 7121823 - DNA, 22 bp, Homo sapiens
agtgggcttactgagggagtgt

SEQ ID NO: 7121824 - DNA, 22 bp, Homo sapiens
agtgggcttactgagggagtgt

SEQ ID NO: 7121825 - DNA, 22 bp, Homo sapiens
agtgggcttactgagggagtgt

SEQ ID NO: 7121826 - DNA, 22 bp, Homo sapiens
agtgggcttactgagggagtgt

SEQ ID NO: 7121827 - DNA, 22 bp, Homo sapiens
agtgggcttttttccgttccat

SEQ ID NO: 7121828 - DNA, 22 bp, Homo sapiens
agtgggcatgatctggtgtctg

SEQ ID NO: 7121829 - DNA, 22 bp, Homo sapiens
agtgggcatgatctggtgtctg

SEQ ID NO: 7121830 - DNA, 22 bp, Homo sapiens
agtgggccaaatggaggcaagt

SEQ ID NO: 7121831 - DNA, 22 bp, Homo sapiens
agtgggccaaatggaggcaagt

SEQ ID NO: 7121832 - DNA, 22 bp, Homo sapiens
agtgggcccgagccagtggtct

SEQ ID NO: 7121833 - DNA, 22 bp, Homo sapiens
agtgggcccttgtcacactgat

SEQ ID NO: 7121834 - DNA, 22 bp, Homo sapiens
ctctgagaagccttgatgggga

SEQ ID NO: 7121835 - DNA, 22 bp, Homo sapiens
ctctgagaagccttgatgggga

SEQ ID NO: 7121836 - DNA, 22 bp, Homo sapiens
ctctgagaatataagactattt

SEQ ID NO: 7121837 - DNA, 22 bp, Homo sapiens
ctctgagaatataagactattt

SEQ ID NO: 7121838 - DNA, 22 bp, Homo sapiens
ctctgagaagagttcaagtaaa

SEQ ID NO: 7121839 - DNA, 22 bp, Homo sapiens
ctctgagactcaagtgagtggg

SEQ ID NO: 7121840 - DNA, 22 bp, Homo sapiens
ctctgagactcaagtgagtggg

SEQ ID NO: 7121841 - DNA, 22 bp, Homo sapiens
ctctgagaatatgagctctttg

SEQ ID NO: 7121842 - DNA, 22 bp, Homo sapiens
ctctgagacttagcatctacat

SEQ ID NO: 7121843 - DNA, 22 bp, Homo sapiens
ctctgagagagctggtgagcac

SEQ ID NO: 7121844 - DNA, 22 bp, Homo sapiens
ctctgagaggatcctgcccggg

SEQ ID NO: 7121845 - DNA, 22 bp, Homo sapiens
ctctgagaggctgccctgccat

SEQ ID NO: 7121846 - DNA, 22 bp, Homo sapiens
ctctgagaggctgccctgccat

SEQ ID NO: 7121847 - DNA, 22 bp, Homo sapiens
ctctgagaggtgagaagcagca

SEQ ID NO: 7121848 - DNA, 22 bp, Homo sapiens
ctctgagaggtgagaagcagca

SEQ ID NO: 7121849 - DNA, 22 bp, Homo sapiens
ctctgagaggtgagaagcagca

SEQ ID NO: 7121850 - DNA, 22 bp, Homo sapiens
ctctgagagtgctcagagggta

SEQ ID NO: 7121851 - DNA, 22 bp, Homo sapiens
ctctgagagtgctcagagggta

SEQ ID NO: 7121852 - DNA, 22 bp, Homo sapiens
ctctgagagtgctcagagggta

SEQ ID NO: 7121853 - DNA, 22 bp, Homo sapiens
ctctgagatagtttctatcaat

SEQ ID NO: 7121854 - DNA, 22 bp, Homo sapiens
ctctgacctctagccagctctg

SEQ ID NO: 7121855 - DNA, 22 bp, Homo sapiens
ctctgactgacctggaatgaat

SEQ ID NO: 7121856 - DNA, 22 bp, Homo sapiens
ctctgactttaaatacaggatg

SEQ ID NO: 7121857 - DNA, 22 bp, Homo sapiens
ctctgagaaagctgtgagctaa

SEQ ID NO: 7121858 - DNA, 22 bp, Homo sapiens
agtggctgtcctggctctaact

SEQ ID NO: 7121859 - DNA, 22 bp, Homo sapiens
ctctgacattctgtgactctga

SEQ ID NO: 7121860 - DNA, 22 bp, Homo sapiens
agtggctgtatcagtcaaccct

SEQ ID NO: 7121861 - DNA, 22 bp, Homo sapiens
agtggctggtagttactgagca

SEQ ID NO: 7121862 - DNA, 22 bp, Homo sapiens
agtggctggtagttactgagca

SEQ ID NO: 7121863 - DNA, 22 bp, Homo sapiens
agtggctggtctaaggtcacag

SEQ ID NO: 7121864 - DNA, 22 bp, Homo sapiens
agtggctggtctaaggtcacag

SEQ ID NO: 7121865 - DNA, 22 bp, Homo sapiens
ctctctccttagctgcagacca

SEQ ID NO: 7121866 - DNA, 22 bp, Homo sapiens
ctctctccttagctgcagacca

SEQ ID NO: 7121867 - DNA, 22 bp, Homo sapiens
agtgcaggctcgcttgtgaggc

SEQ ID NO: 7121868 - DNA, 19 bp, Homo sapiens
agtgcagggagcaccctca

SEQ ID NO: 7121869 - DNA, 19 bp, Homo sapiens
agtgcagggagcaccctca

SEQ ID NO: 7121870 - DNA, 19 bp, Homo sapiens
agtgcagggagcaccctca

SEQ ID NO: 7121871 - DNA, 23 bp, Homo sapiens
ctctctctaccatgtgaggacac

SEQ ID NO: 7121872 - DNA, 23 bp, Homo sapiens
ctctctctaccatgtgaggacac

SEQ ID NO: 7121873 - DNA, 22 bp, Homo sapiens
agtgcaggccccaggccaggcc

SEQ ID NO: 7121874 - DNA, 22 bp, Homo sapiens
agtgcaggccccaggccaggcc

SEQ ID NO: 7121875 - DNA, 22 bp, Homo sapiens
agtgcaggctcgcttgtgaggc

SEQ ID NO: 7121876 - DNA, 22 bp, Homo sapiens
agtgcaggctcgcttgtgaggc

SEQ ID NO: 7121877 - DNA, 22 bp, Homo sapiens
agtgcaggccccaggccaggcc

SEQ ID NO: 7121878 - DNA, 22 bp, Homo sapiens
agtgcaggccccaggccaggcc

SEQ ID NO: 7121879 - DNA, 22 bp, Homo sapiens
agtgcaggccccaggccaggcc

SEQ ID NO: 7121880 - DNA, 22 bp, Homo sapiens
agtgcaggccccaggccaggcc

SEQ ID NO: 7121881 - DNA, 22 bp, Homo sapiens
agtgcaggagcctggccagagc

SEQ ID NO: 7121882 - DNA, 22 bp, Homo sapiens
agtgcaggccccaggccaggcc

SEQ ID NO: 7121883 - DNA, 22 bp, Homo sapiens
agtgcaggccccaggccaggcc

SEQ ID NO: 7121884 - DNA, 22 bp, Homo sapiens
ctctctggggttccagacgtgg

SEQ ID NO: 7121885 - DNA, 22 bp, Homo sapiens
ctctctgggggccatgccaaga

SEQ ID NO: 7121886 - DNA, 22 bp, Homo sapiens
ctctctggggttccagacgtgg

SEQ ID NO: 7121887 - DNA, 22 bp, Homo sapiens
ctctctgggcccagttggcacc

SEQ ID NO: 7121888 - DNA, 22 bp, Homo sapiens
ctctctgggcccagttggcacc

SEQ ID NO: 7121889 - DNA, 22 bp, Homo sapiens
ctctctgggcccagttggcacc

SEQ ID NO: 7121890 - DNA, 22 bp, Homo sapiens
ctctctgggggccatgccaaga

SEQ ID NO: 7121891 - DNA, 22 bp, Homo sapiens
ctctctgggcccagttggcacc

SEQ ID NO: 7121892 - DNA, 22 bp, Homo sapiens
ctctctgggcccagttggcacc

SEQ ID NO: 7121893 - DNA, 22 bp, Homo sapiens
ctctctgggaatattttattct

SEQ ID NO: 7121894 - DNA, 22 bp, Homo sapiens
ctctctgggcccagttggcacc

SEQ ID NO: 7121895 - DNA, 22 bp, Homo sapiens
ctctctggcttggcacggagat

SEQ ID NO: 7121896 - DNA, 18 bp, Homo sapiens
ctctctgggtgaggacaa

SEQ ID NO: 7121897 - DNA, 18 bp, Homo sapiens
ctctctgggtgaggacaa

SEQ ID NO: 7121898 - DNA, 18 bp, Homo sapiens
ctctctgggtgaggacaa

SEQ ID NO: 7121899 - DNA, 18 bp, Homo sapiens
ctctctgggtgaggacaa

SEQ ID NO: 7121900 - DNA, 17 bp, Homo sapiens
agtggcaggcagatggg

SEQ ID NO: 7121901 - DNA, 17 bp, Homo sapiens
agtggcaggcagatggg

SEQ ID NO: 7121902 - DNA, 17 bp, Homo sapiens
agtggcaggcagatggg

SEQ ID NO: 7121903 - DNA, 17 bp, Homo sapiens
agtggcaggcagatggg

SEQ ID NO: 7121904 - DNA, 22 bp, Homo sapiens
agtggcaggaaagtggaagaga

SEQ ID NO: 7121905 - DNA, 22 bp, Homo sapiens
agtggcagctgtcatgccctag

SEQ ID NO: 7121906 - DNA, 22 bp, Homo sapiens
agtggcaggcagaagcttctca

SEQ ID NO: 7121907 - DNA, 22 bp, Homo sapiens
agtggcaggcagaagcttctca

SEQ ID NO: 7121908 - DNA, 22 bp, Homo sapiens
ctctctggtacatagagtttgg

SEQ ID NO: 7121909 - DNA, 22 bp, Homo sapiens
ctctctggtcccagattccaga

SEQ ID NO: 7121910 - DNA, 22 bp, Homo sapiens
agtggcagccgagcaggagatg

SEQ ID NO: 7121911 - DNA, 22 bp, Homo sapiens
agtggcagccgagcaggagatg

SEQ ID NO: 7121912 - DNA, 22 bp, Homo sapiens
agtggcagccgagcaggagatg

SEQ ID NO: 7121913 - DNA, 22 bp, Homo sapiens
agtggcagccgagcaggagatg

SEQ ID NO: 7121914 - DNA, 22 bp, Homo sapiens
agtggcagccttgttcattatg

SEQ ID NO: 7121915 - DNA, 22 bp, Homo sapiens
agtggcagctgtcatgccctag

SEQ ID NO: 7121916 - DNA, 22 bp, Homo sapiens
agtggcagctgtcatgccctag

SEQ ID NO: 7121917 - DNA, 22 bp, Homo sapiens
agtggcaggcggagatgtagga

SEQ ID NO: 7121918 - DNA, 17 bp, Homo sapiens
agtggcaggcagatggg

SEQ ID NO: 7121919 - DNA, 22 bp, Homo sapiens
agtggcaggcggagatgtagga

SEQ ID NO: 7121920 - DNA, 22 bp, Homo sapiens
agtggcaggcggagatgtagga

SEQ ID NO: 7121921 - DNA, 22 bp, Homo sapiens
agtggctggacgacaagggtga

SEQ ID NO: 7121922 - DNA, 19 bp, Homo sapiens
agtggctgggcagaagcaa

SEQ ID NO: 7121923 - DNA, 19 bp, Homo sapiens
agtggctgggcagaagcaa

SEQ ID NO: 7121924 - DNA, 22 bp, Homo sapiens
agtggctggcataggaacagac

SEQ ID NO: 7121925 - DNA, 22 bp, Homo sapiens
agtggctggcataggaacagac

SEQ ID NO: 7121926 - DNA, 22 bp, Homo sapiens
ctcctcccacggtctcaggaag

SEQ ID NO: 7121927 - DNA, 22 bp, Homo sapiens
ctcctcccacggtctcaggaag

SEQ ID NO: 7121928 - DNA, 22 bp, Homo sapiens
ctcctcccacggtctcaggaag

SEQ ID NO: 7121929 - DNA, 22 bp, Homo sapiens
ctcctcagctgggaggagtccc

SEQ ID NO: 7121930 - DNA, 22 bp, Homo sapiens
ctcctcagctgggaggagtccc

SEQ ID NO: 7121931 - DNA, 22 bp, Homo sapiens
ctcctcagctgggaggagtccc

SEQ ID NO: 7121932 - DNA, 22 bp, Homo sapiens
ctcccaggttacatctgagcct

SEQ ID NO: 7121933 - DNA, 22 bp, Homo sapiens
ctcccaggttccgacgcctctt

SEQ ID NO: 7121934 - DNA, 22 bp, Homo sapiens
ctcccaggttccgacgcctctt

SEQ ID NO: 7121935 - DNA, 22 bp, Homo sapiens
ctcccaggttccgacgcctctt

SEQ ID NO: 7121936 - DNA, 22 bp, Homo sapiens
ctcccaggttccgacgcctctt

SEQ ID NO: 7121937 - DNA, 22 bp, Homo sapiens
ctcccaggttacatctgagcct

SEQ ID NO: 7121938 - DNA, 22 bp, Homo sapiens
ctcccaggtgtcccttctgcca

SEQ ID NO: 7121939 - DNA, 22 bp, Homo sapiens
ctcccaggttacatctgagcct

SEQ ID NO: 7121940 - DNA, 22 bp, Homo sapiens
ctcccaggttacatctgagcct

SEQ ID NO: 7121941 - DNA, 21 bp, Homo sapiens
ctcccagggtgactgttcaac

SEQ ID NO: 7121942 - DNA, 21 bp, Homo sapiens
ctcccagggtgactgttcaac

SEQ ID NO: 7121943 - DNA, 21 bp, Homo sapiens
ctcccagggtgactgttcaac

SEQ ID NO: 7121944 - DNA, 21 bp, Homo sapiens
ctcccagggtgactgttcaac

SEQ ID NO: 7121945 - DNA, 22 bp, Homo sapiens
ctcccaggtgtcccttctgcca

SEQ ID NO: 7121946 - DNA, 22 bp, Homo sapiens
ctcccaggtgtcccttctgcca

SEQ ID NO: 7121947 - DNA, 22 bp, Homo sapiens
ctcccaggtgtcccttctgcca

SEQ ID NO: 7121948 - DNA, 22 bp, Homo sapiens
ctcccagggtctaggctgctgg

SEQ ID NO: 7121949 - DNA, 22 bp, Homo sapiens
ctcccagggtctaggctgctgg

SEQ ID NO: 7121950 - DNA, 22 bp, Homo sapiens
ctcccagggtagggagagacta

SEQ ID NO: 7121951 - DNA, 22 bp, Homo sapiens
ctcccagggtctaggctgctgg

SEQ ID NO: 7121952 - DNA, 22 bp, Homo sapiens
ctcccagggtctaggctgctgg

SEQ ID NO: 7121953 - DNA, 22 bp, Homo sapiens
ctcccagggtagggagagacta

SEQ ID NO: 7121954 - DNA, 22 bp, Homo sapiens
ctcccaggggagtcatctgctt

SEQ ID NO: 7121955 - DNA, 22 bp, Homo sapiens
ctcccaggggagtcatctgctt

SEQ ID NO: 7121956 - DNA, 22 bp, Homo sapiens
ctcccagggtagggagagacta

SEQ ID NO: 7121957 - DNA, 22 bp, Homo sapiens
ctcccaggggagtcatctgctt

SEQ ID NO: 7121958 - DNA, 22 bp, Homo sapiens
ctcccaggggagtcatctgctt

SEQ ID NO: 7121959 - DNA, 22 bp, Homo sapiens
ctcccaggggaactatcaagta

SEQ ID NO: 7121960 - DNA, 22 bp, Homo sapiens
agtgcagccgagatcaggtgct

SEQ ID NO: 7121961 - DNA, 22 bp, Homo sapiens
agtgcagcaccatgttacagag

SEQ ID NO: 7121962 - DNA, 22 bp, Homo sapiens
agtgcagcatgaagcacatgtg

SEQ ID NO: 7121963 - DNA, 22 bp, Homo sapiens
agtgcagcatgaagcacatgtg

SEQ ID NO: 7121964 - DNA, 22 bp, Homo sapiens
agtgcagcatgctggggaggct

SEQ ID NO: 7121965 - DNA, 22 bp, Homo sapiens
ctcctccctctttgccacacat

SEQ ID NO: 7121966 - DNA, 22 bp, Homo sapiens
ctcctccctctttgccacacat

SEQ ID NO: 7121967 - DNA, 22 bp, Homo sapiens
ctcctccctctttgccacacat

SEQ ID NO: 7121968 - DNA, 22 bp, Homo sapiens
ctcctcccacggtctcaggaag

SEQ ID NO: 7121969 - DNA, 22 bp, Homo sapiens
ctcctccctctttgccacacat

SEQ ID NO: 7121970 - DNA, 22 bp, Homo sapiens
ctcctccctgcgattgctctgc

SEQ ID NO: 7121971 - DNA, 22 bp, Homo sapiens
ctcctccctgcgattgctctgc

SEQ ID NO: 7121972 - DNA, 22 bp, Homo sapiens
ctcctccctgggaggctggcat

SEQ ID NO: 7121973 - DNA, 22 bp, Homo sapiens
ctcctccctgggaggctggcat

SEQ ID NO: 7121974 - DNA, 22 bp, Homo sapiens
ctcctcctaaatgattcttcct

SEQ ID NO: 7121975 - DNA, 22 bp, Homo sapiens
ctcctcctggacacaggctgtg

SEQ ID NO: 7121976 - DNA, 22 bp, Homo sapiens
ctcctcctggacacaggctgtg

SEQ ID NO: 7121977 - DNA, 22 bp, Homo sapiens
agtgcaggagcctggccagagc

SEQ ID NO: 7121978 - DNA, 22 bp, Homo sapiens
agtgcaggagcctggccagagc

SEQ ID NO: 7121979 - DNA, 22 bp, Homo sapiens
agtgcaggagcctggccagagc

SEQ ID NO: 7121980 - DNA, 22 bp, Homo sapiens
agtgcaggagcctggccagagc

SEQ ID NO: 7121981 - DNA, 22 bp, Homo sapiens
agtgcaggagcctggccagagc

SEQ ID NO: 7121982 - DNA, 22 bp, Homo sapiens
agtgcagctaagtggctctgtg

SEQ ID NO: 7121983 - DNA, 22 bp, Homo sapiens
agtgcagctgggactgtagggt

SEQ ID NO: 7121984 - DNA, 22 bp, Homo sapiens
agtgcagctgggactgtagggt

SEQ ID NO: 7121985 - DNA, 22 bp, Homo sapiens
ctcctctcaaaagtaggttgac

SEQ ID NO: 7121986 - DNA, 22 bp, Homo sapiens
ctcctctcaggctggatggcgc

SEQ ID NO: 7121987 - DNA, 22 bp, Homo sapiens
ctcctctccatcagcgccaccc

SEQ ID NO: 7121988 - DNA, 22 bp, Homo sapiens
ctcctctcaaaagtaggttgac

SEQ ID NO: 7121989 - DNA, 22 bp, Homo sapiens
ctcctctagaagctgacctgga

SEQ ID NO: 7121990 - DNA, 22 bp, Homo sapiens
ctcctctcaaaagtaggttgac

SEQ ID NO: 7121991 - DNA, 22 bp, Homo sapiens
ctcctccttcctgtgttgtgca

SEQ ID NO: 7121992 - DNA, 22 bp, Homo sapiens
ctccagttggccccagttggtt

SEQ ID NO: 7121993 - DNA, 22 bp, Homo sapiens
ctccagttggccccagttggtt

SEQ ID NO: 7121994 - DNA, 20 bp, Homo sapiens
ctccagtgttcaggggagtg

SEQ ID NO: 7121995 - DNA, 22 bp, Homo sapiens
ctccagtgtctcagagcagatg

SEQ ID NO: 7121996 - DNA, 22 bp, Homo sapiens
ctccagtgtctcagagcagatg

SEQ ID NO: 7121997 - DNA, 22 bp, Homo sapiens
ctccagtgggggtgagcctaga

SEQ ID NO: 7121998 - DNA, 22 bp, Homo sapiens
ctccagtgggggtgagcctaga

SEQ ID NO: 7121999 - DNA, 22 bp, Homo sapiens
ctccagtgggggtgagcctaga

SEQ ID NO: 7122000 - DNA, 22 bp, Homo sapiens
ctccagggagctgcgggagcca

SEQ ID NO: 7122001 - DNA, 22 bp, Homo sapiens
ctcaggcagttgtttgcatagt

SEQ ID NO: 7122002 - DNA, 21 bp, Homo sapiens
ctcaggcatttgaggagagtc

SEQ ID NO: 7122003 - DNA, 21 bp, Homo sapiens
ctcaggcatttgaggagagtc

SEQ ID NO: 7122004 - DNA, 22 bp, Homo sapiens
ctccagttggccccagttggtt

SEQ ID NO: 7122005 - DNA, 22 bp, Homo sapiens
ctccatcagctgttggttgagg

SEQ ID NO: 7122006 - DNA, 22 bp, Homo sapiens
ctccatcagctgttggttgagg

SEQ ID NO: 7122007 - DNA, 22 bp, Homo sapiens
ctccatcatgtttgatcctgag

SEQ ID NO: 7122008 - DNA, 22 bp, Homo sapiens
ctccatggaaaaggctgttgtt

SEQ ID NO: 7122009 - DNA, 22 bp, Homo sapiens
agtgacaggggaggcaggtgtg

SEQ ID NO: 7122010 - DNA, 22 bp, Homo sapiens
agtgacagtctcagagatcagg

SEQ ID NO: 7122011 - DNA, 22 bp, Homo sapiens
agtgacagtctgatttctcaaa

SEQ ID NO: 7122012 - DNA, 22 bp, Homo sapiens
agtgacatcatgtcagcaaagt

SEQ ID NO: 7122013 - DNA, 22 bp, Homo sapiens
agtgacatgaccacaaagcagc

SEQ ID NO: 7122014 - DNA, 22 bp, Homo sapiens
agtgacatgaccacaaagcagc

SEQ ID NO: 7122015 - DNA, 22 bp, Homo sapiens
agtgacatgagttctcggtaaa

SEQ ID NO: 7122016 - DNA, 22 bp, Homo sapiens
agtgacattaaggattcttcaa

SEQ ID NO: 7122017 - DNA, 22 bp, Homo sapiens
agtgacattattttgtgtacta

SEQ ID NO: 7122018 - DNA, 22 bp, Homo sapiens
agtgacatttaaaaccacagct

SEQ ID NO: 7122019 - DNA, 22 bp, Homo sapiens
agtgacatttaaagacccaccc

SEQ ID NO: 7122020 - DNA, 22 bp, Homo sapiens
agtgacatttgcaccagctgct

SEQ ID NO: 7122021 - DNA, 22 bp, Homo sapiens
agtgactgggcagggcagggcc

SEQ ID NO: 7122022 - DNA, 22 bp, Homo sapiens
agtgactgggcagggcagggcc

SEQ ID NO: 7122023 - DNA, 22 bp, Homo sapiens
agtgactggtgtgaagttaaat

SEQ ID NO: 7122024 - DNA, 22 bp, Homo sapiens
agtgactggtgtgaagttaaat

SEQ ID NO: 7122025 - DNA, 22 bp, Homo sapiens
agtgactggtgtgaagttaaat

SEQ ID NO: 7122026 - DNA, 21 bp, Homo sapiens
agtgactatgacattattacc

SEQ ID NO: 7122027 - DNA, 22 bp, Homo sapiens
agtgactcacacaaacatgtgt

SEQ ID NO: 7122028 - DNA, 22 bp, Homo sapiens
agtgactcactagctctcagtg

SEQ ID NO: 7122029 - DNA, 22 bp, Homo sapiens
agtgactggtgtgaagttaaat

SEQ ID NO: 7122030 - DNA, 22 bp, Homo sapiens
agtgactggttttgacaggaat

SEQ ID NO: 7122031 - DNA, 22 bp, Homo sapiens
agtgatttgactcttttattgt

SEQ ID NO: 7122032 - DNA, 22 bp, Homo sapiens
agtgacatttgcaccagctgct

SEQ ID NO: 7122033 - DNA, 22 bp, Homo sapiens
agtgacattttccccgctatgt

SEQ ID NO: 7122034 - DNA, 22 bp, Homo sapiens
agtgactaaaggttttaatggc

SEQ ID NO: 7122035 - DNA, 22 bp, Homo sapiens
agtgcagagtacatttgtggca

SEQ ID NO: 7122036 - DNA, 22 bp, Homo sapiens
agtgcagagtacatttgtggca

SEQ ID NO: 7122037 - DNA, 22 bp, Homo sapiens
agtgcagatttttagtcagctt

SEQ ID NO: 7122038 - DNA, 22 bp, Homo sapiens
agtgcagatttttagtcagctt

SEQ ID NO: 7122039 - DNA, 22 bp, Homo sapiens
agtgcagatttttagtcagctt

SEQ ID NO: 7122040 - DNA, 22 bp, Homo sapiens
agtgcagatttttagtcagctt

SEQ ID NO: 7122041 - DNA, 22 bp, Homo sapiens
agtgcagagagcaatactctac

SEQ ID NO: 7122042 - DNA, 22 bp, Homo sapiens
agtgcagagagcaatactctac

SEQ ID NO: 7122043 - DNA, 22 bp, Homo sapiens
agtgcagaggctgggaaatgct

SEQ ID NO: 7122044 - DNA, 22 bp, Homo sapiens
agtgcagaggctgggaaatgct

SEQ ID NO: 7122045 - DNA, 22 bp, Homo sapiens
agtgcagagacctggtcaggca

SEQ ID NO: 7122046 - DNA, 22 bp, Homo sapiens
agtgcagactgaaatgaccttc

SEQ ID NO: 7122047 - DNA, 22 bp, Homo sapiens
agtgcagagacctggtcaggca

SEQ ID NO: 7122048 - DNA, 22 bp, Homo sapiens
agtgcagagacctggtcaggca

SEQ ID NO: 7122049 - DNA, 22 bp, Homo sapiens
agtgcacagcctgctgcagaat

SEQ ID NO: 7122050 - DNA, 22 bp, Homo sapiens
agtgatttgcagtatttactaa

SEQ ID NO: 7122051 - DNA, 22 bp, Homo sapiens
agtgcactggcaccatctcagc

SEQ ID NO: 7122052 - DNA, 22 bp, Homo sapiens
ctcaggagttggaggctacagt

SEQ ID NO: 7122053 - DNA, 22 bp, Homo sapiens
ctcaggagttggaggctacagt

SEQ ID NO: 7122054 - DNA, 23 bp, Homo sapiens
agtcttaatacagctcttttcta

SEQ ID NO: 7122055 - DNA, 22 bp, Homo sapiens
agtcttaatagagaaaaactgt

SEQ ID NO: 7122056 - DNA, 22 bp, Homo sapiens
ctcaggagttggaggctacagt

SEQ ID NO: 7122057 - DNA, 22 bp, Homo sapiens
agtctgtgtgaatgtgggcttt

SEQ ID NO: 7122058 - DNA, 22 bp, Homo sapiens
agtctgtgtgaatgtgggcttt

SEQ ID NO: 7122059 - DNA, 22 bp, Homo sapiens
agtctgtgtgaatgtgggcttt

SEQ ID NO: 7122060 - DNA, 19 bp, Homo sapiens
agtctgtggatttgtgggt

SEQ ID NO: 7122061 - DNA, 22 bp, Homo sapiens
agtctgtggggtccctggggca

SEQ ID NO: 7122062 - DNA, 22 bp, Homo sapiens
agtctgtgtacctttggccttc

SEQ ID NO: 7122063 - DNA, 22 bp, Homo sapiens
agtctgtgtacctttggccttc

SEQ ID NO: 7122064 - DNA, 22 bp, Homo sapiens
agtctgtgtactgggtttctgt

SEQ ID NO: 7122065 - DNA, 22 bp, Homo sapiens
agtctgtgtactgggtttctgt

SEQ ID NO: 7122066 - DNA, 22 bp, Homo sapiens
agtctgtgtatattcactgccc

SEQ ID NO: 7122067 - DNA, 22 bp, Homo sapiens
agtctgtgtatattcactgccc

SEQ ID NO: 7122068 - DNA, 22 bp, Homo sapiens
ctcaggatgcaggtcacaggac

SEQ ID NO: 7122069 - DNA, 22 bp, Homo sapiens
ctcaggatggaagcctacagga

SEQ ID NO: 7122070 - DNA, 22 bp, Homo sapiens
ctcaggatggaagcctacagga

SEQ ID NO: 7122071 - DNA, 22 bp, Homo sapiens
ctcaggattgtgcctagggaga

SEQ ID NO: 7122072 - DNA, 22 bp, Homo sapiens
ctcaggcaaggcccgcattctc

SEQ ID NO: 7122073 - DNA, 22 bp, Homo sapiens
ctcaggcaaggcccgcattctc

SEQ ID NO: 7122074 - DNA, 22 bp, Homo sapiens
ctcaggcaaggcccgcattctc

SEQ ID NO: 7122075 - DNA, 22 bp, Homo sapiens
ctcaggcacgggtcagtgagcg

SEQ ID NO: 7122076 - DNA, 22 bp, Homo sapiens
ctcaggcacgggtcagtgagcg

SEQ ID NO: 7122077 - DNA, 22 bp, Homo sapiens
ctcaggcacgggtcagtgagcg

SEQ ID NO: 7122078 - DNA, 22 bp, Homo sapiens
ctcaggcacgggtcagtgagcg

SEQ ID NO: 7122079 - DNA, 22 bp, Homo sapiens
ctcaggcacttttgtcacagac

SEQ ID NO: 7122080 - DNA, 22 bp, Homo sapiens
ctcaggcacttttgtcacagac

SEQ ID NO: 7122081 - DNA, 18 bp, Homo sapiens
ctcaggcagagaagcttt

SEQ ID NO: 7122082 - DNA, 18 bp, Homo sapiens
ctcaggcagagaagcttt

SEQ ID NO: 7122083 - DNA, 18 bp, Homo sapiens
ctcaggcagagaagcttt

SEQ ID NO: 7122084 - DNA, 22 bp, Homo sapiens
ctcaggcagttctgtagcctcc

SEQ ID NO: 7122085 - DNA, 22 bp, Homo sapiens
agtctgtctttggcttcaccac

SEQ ID NO: 7122086 - DNA, 22 bp, Homo sapiens
agtctgtgaaaagataggaagt

SEQ ID NO: 7122087 - DNA, 22 bp, Homo sapiens
agtctgtgaaaagataggaagt

SEQ ID NO: 7122088 - DNA, 19 bp, Homo sapiens
agtctgtctgctttccctc

SEQ ID NO: 7122089 - DNA, 19 bp, Homo sapiens
agtctgtctgctttccctc

SEQ ID NO: 7122090 - DNA, 22 bp, Homo sapiens
agtctggattagttgggggcaa

SEQ ID NO: 7122091 - DNA, 22 bp, Homo sapiens
agtctggagtgttttgtagcaa

SEQ ID NO: 7122092 - DNA, 22 bp, Homo sapiens
agtctggagtttgctactggac

SEQ ID NO: 7122093 - DNA, 22 bp, Homo sapiens
agtctggagtttgctactggac

SEQ ID NO: 7122094 - DNA, 22 bp, Homo sapiens
agtctggattagttgggggcaa

SEQ ID NO: 7122095 - DNA, 22 bp, Homo sapiens
agtctgtctttggcttcaccac

SEQ ID NO: 7122096 - DNA, 22 bp, Homo sapiens
agtctgtgaacttggcagggaa

SEQ ID NO: 7122097 - DNA, 22 bp, Homo sapiens
agtctgtgaacttggcagggaa

SEQ ID NO: 7122098 - DNA, 22 bp, Homo sapiens
agtctgtgaacttggcagggaa

SEQ ID NO: 7122099 - DNA, 22 bp, Homo sapiens
agtctgtgactcattggatctc

SEQ ID NO: 7122100 - DNA, 22 bp, Homo sapiens
agtctgtgaacttggcagggaa

SEQ ID NO: 7122101 - DNA, 22 bp, Homo sapiens
agtctgtgagtgatgtacctgc

SEQ ID NO: 7122102 - DNA, 22 bp, Homo sapiens
agtctgtgagtgatgtacctgc

SEQ ID NO: 7122103 - DNA, 23 bp, Homo sapiens
agtctgtgctgaagaagttacaa

SEQ ID NO: 7122104 - DNA, 22 bp, Homo sapiens
agtctgtgctgttggtgaggat

SEQ ID NO: 7122105 - DNA, 22 bp, Homo sapiens
agtctgtgctgttggtgaggat

SEQ ID NO: 7122106 - DNA, 22 bp, Homo sapiens
agtctgtgctgttggtgaggat

SEQ ID NO: 7122107 - DNA, 23 bp, Homo sapiens
agtctgtgcttggtgggagggcc

SEQ ID NO: 7122108 - DNA, 23 bp, Homo sapiens
agtctgtgcttggtgggagggcc

SEQ ID NO: 7122109 - DNA, 23 bp, Homo sapiens
agtctgtgcttggtgggagggcc

SEQ ID NO: 7122110 - DNA, 22 bp, Homo sapiens
agtctgtggatggactggcaga

SEQ ID NO: 7122111 - DNA, 22 bp, Homo sapiens
agtctgtggatggactggcaga

SEQ ID NO: 7122112 - DNA, 22 bp, Homo sapiens
agtctgcttcctggagaactca

SEQ ID NO: 7122113 - DNA, 22 bp, Homo sapiens
agtctgcttttgtgaagagctg

SEQ ID NO: 7122114 - DNA, 21 bp, Homo sapiens
agtctggaaaacacattcatg

SEQ ID NO: 7122115 - DNA, 22 bp, Homo sapiens
agtctggaaaatgcatgtttca

SEQ ID NO: 7122116 - DNA, 23 bp, Homo sapiens
agtctggaagtgcagtggctgga

SEQ ID NO: 7122117 - DNA, 22 bp, Homo sapiens
agtctggaataaaactacttac

SEQ ID NO: 7122118 - DNA, 22 bp, Homo sapiens
agtctggaatttggcctgagca

SEQ ID NO: 7122119 - DNA, 22 bp, Homo sapiens
agtctggacatgctgaacttgg

SEQ ID NO: 7122120 - DNA, 22 bp, Homo sapiens
agtctggacctgctgggtctcc

SEQ ID NO: 7122121 - DNA, 22 bp, Homo sapiens
agtctggagcagcagtattggt

SEQ ID NO: 7122122 - DNA, 22 bp, Homo sapiens
agtctggagcagcagtattggt

SEQ ID NO: 7122123 - DNA, 22 bp, Homo sapiens
agtctggagctcagacttggga

SEQ ID NO: 7122124 - DNA, 22 bp, Homo sapiens
agtctggaggtggcaggtgtgt

SEQ ID NO: 7122125 - DNA, 22 bp, Homo sapiens
agtctggaggtggcaggtgtgt

SEQ ID NO: 7122126 - DNA, 19 bp, Homo sapiens
agtctggagtaaaaggaat

SEQ ID NO: 7122127 - DNA, 19 bp, Homo sapiens
agtctggagtaaaaggaat

SEQ ID NO: 7122128 - DNA, 22 bp, Homo sapiens
agtctggagtagagcctagaaa

SEQ ID NO: 7122129 - DNA, 22 bp, Homo sapiens
agtctggagtagagcctagaaa

SEQ ID NO: 7122130 - DNA, 22 bp, Homo sapiens
agtctggagtgattatgtggga

SEQ ID NO: 7122131 - DNA, 22 bp, Homo sapiens
agtctggagtgcggcggcagga

SEQ ID NO: 7122132 - DNA, 22 bp, Homo sapiens
agtctggagtgcggcggcagga

SEQ ID NO: 7122133 - DNA, 22 bp, Homo sapiens
agtccaagatcaaggtgtcagg

SEQ ID NO: 7122134 - DNA, 22 bp, Homo sapiens
agtccaagattagggtgacagc

SEQ ID NO: 7122135 - DNA, 22 bp, Homo sapiens
agtccaagatcaaggtgtcaac

SEQ ID NO: 7122136 - DNA, 22 bp, Homo sapiens
agtccaagatcaaggtgtcagg

SEQ ID NO: 7122137 - DNA, 22 bp, Homo sapiens
agtccaagaccaaggtgtcacc

SEQ ID NO: 7122138 - DNA, 22 bp, Homo sapiens
agtccaagatcaaggtgtcaac

SEQ ID NO: 7122139 - DNA, 22 bp, Homo sapiens
agtccaaagcagatgagggcca

SEQ ID NO: 7122140 - DNA, 20 bp, Homo sapiens
agtccaaagcctgtttactt

SEQ ID NO: 7122141 - DNA, 22 bp, Homo sapiens
agtccaagaccaaggtgtcacc

SEQ ID NO: 7122142 - DNA, 22 bp, Homo sapiens
agtcattttgccagtcttcagg

SEQ ID NO: 7122143 - DNA, 22 bp, Homo sapiens
agtcattttgccagtcttcagg

SEQ ID NO: 7122144 - DNA, 22 bp, Homo sapiens
agtcattttgctaaatgagggt

SEQ ID NO: 7122145 - DNA, 22 bp, Homo sapiens
agtccaaagcagatgagggcca

SEQ ID NO: 7122146 - DNA, 22 bp, Homo sapiens
agtccaaagcagatgagggcca

SEQ ID NO: 7122147 - DNA, 22 bp, Homo sapiens
agtcattttctgcctgtaatct

SEQ ID NO: 7122148 - DNA, 22 bp, Homo sapiens
agtcattttctgcctgtaatct

SEQ ID NO: 7122149 - DNA, 22 bp, Homo sapiens
agtcattttctgcctgtaatct

SEQ ID NO: 7122150 - DNA, 22 bp, Homo sapiens
agtcatttggagcaccttatta

SEQ ID NO: 7122151 - DNA, 22 bp, Homo sapiens
agtcatttctgtagtcatgttt

SEQ ID NO: 7122152 - DNA, 22 bp, Homo sapiens
agtcatttctgtagtcatgttt

SEQ ID NO: 7122153 - DNA, 18 bp, Homo sapiens
agtcatttacttttgtga

SEQ ID NO: 7122154 - DNA, 18 bp, Homo sapiens
agtcatttacttttgtga

SEQ ID NO: 7122155 - DNA, 18 bp, Homo sapiens
agtcatttacttttgtga

SEQ ID NO: 7122156 - DNA, 22 bp, Homo sapiens
agtcatttatcttagccattat

SEQ ID NO: 7122157 - DNA, 22 bp, Homo sapiens
agtcatttcccattcttcatat

SEQ ID NO: 7122158 - DNA, 22 bp, Homo sapiens
agtcatttctgcttccatggct

SEQ ID NO: 7122159 - DNA, 22 bp, Homo sapiens
agtcatgctacttcatcttctg

SEQ ID NO: 7122160 - DNA, 22 bp, Homo sapiens
agtcatctcttctacaatatgg

SEQ ID NO: 7122161 - DNA, 22 bp, Homo sapiens
agtcattacagcaggcagaagg

SEQ ID NO: 7122162 - DNA, 22 bp, Homo sapiens
agtcattattatttgtcaaagg

SEQ ID NO: 7122163 - DNA, 20 bp, Homo sapiens
agtcattgggtgtccttcgg

SEQ ID NO: 7122164 - DNA, 22 bp, Homo sapiens
agtcatatctgaggaggaatcc

SEQ ID NO: 7122165 - DNA, 22 bp, Homo sapiens
agtcatatgacccttcacaaac

SEQ ID NO: 7122166 - DNA, 22 bp, Homo sapiens
agtcatatgacccttcacaaac

SEQ ID NO: 7122167 - DNA, 22 bp, Homo sapiens
agtcatatggctatttagtggg

SEQ ID NO: 7122168 - DNA, 22 bp, Homo sapiens
agtcatatgtggcattttctaa

SEQ ID NO: 7122169 - DNA, 22 bp, Homo sapiens
agtcatatgtggcattttctaa

SEQ ID NO: 7122170 - DNA, 22 bp, Homo sapiens
agtcatatgtggcattttctaa

SEQ ID NO: 7122171 - DNA, 19 bp, Homo sapiens
agtcatattgttcatcttg

SEQ ID NO: 7122172 - DNA, 22 bp, Homo sapiens
agtcatatttatataatttccc

SEQ ID NO: 7122173 - DNA, 22 bp, Homo sapiens
agtcatcatttatatcaagtct

SEQ ID NO: 7122174 - DNA, 21 bp, Homo sapiens
agtctctctaataaatgcttg

SEQ ID NO: 7122175 - DNA, 22 bp, Homo sapiens
agtctctctcctcgtggtaacc

SEQ ID NO: 7122176 - DNA, 20 bp, Homo sapiens
agtctctcccagaatgagca

SEQ ID NO: 7122177 - DNA, 22 bp, Homo sapiens
agtctctttaatcacagtgtct

SEQ ID NO: 7122178 - DNA, 22 bp, Homo sapiens
agtctctttaatcacagtgtct

SEQ ID NO: 7122179 - DNA, 22 bp, Homo sapiens
agtctctccacattgttataaa

SEQ ID NO: 7122180 - DNA, 22 bp, Homo sapiens
agtctctcacagaggattctcc

SEQ ID NO: 7122181 - DNA, 22 bp, Homo sapiens
agtccaaggccatacagttgtg

SEQ ID NO: 7122182 - DNA, 22 bp, Homo sapiens
agtccaagattagggtgacagc

SEQ ID NO: 7122183 - DNA, 22 bp, Homo sapiens
agtccaaggagagacagcattt

SEQ ID NO: 7122184 - DNA, 22 bp, Homo sapiens
agtccaaggccatacagttgtg

SEQ ID NO: 7122185 - DNA, 22 bp, Homo sapiens
agtccaaggccatacagttgtg

SEQ ID NO: 7122186 - DNA, 22 bp, Homo sapiens
agtctcttttgcgaagagtgtt

SEQ ID NO: 7122187 - DNA, 22 bp, Homo sapiens
agtctgaagactcatgtctgaa

SEQ ID NO: 7122188 - DNA, 21 bp, Homo sapiens
agtctgaggtggggcctagga

SEQ ID NO: 7122189 - DNA, 22 bp, Homo sapiens
agtctgaggcaccctgaatatt

SEQ ID NO: 7122190 - DNA, 22 bp, Homo sapiens
agtctgaagatattcttgcagg

SEQ ID NO: 7122191 - DNA, 22 bp, Homo sapiens
agtctgaaggcaatctgctgac

SEQ ID NO: 7122192 - DNA, 22 bp, Homo sapiens
agtctgagtatctctgagccag

SEQ ID NO: 7122193 - DNA, 22 bp, Homo sapiens
agtctgagttagtggaaatgta

SEQ ID NO: 7122194 - DNA, 22 bp, Homo sapiens
agtctgcaaatatgttcatgtg

SEQ ID NO: 7122195 - DNA, 20 bp, Homo sapiens
agtctgcctgctccttctcc

SEQ ID NO: 7122196 - DNA, 19 bp, Homo sapiens
agtctgcatttctagcaag

SEQ ID NO: 7122197 - DNA, 20 bp, Homo sapiens
agtctgcagctgcatgaccc

SEQ ID NO: 7122198 - DNA, 22 bp, Homo sapiens
ccgcccacactaaatatgagcg

SEQ ID NO: 7122199 - DNA, 22 bp, Homo sapiens
ccgcccacactaaatatgagcg

SEQ ID NO: 7122200 - DNA, 22 bp, Homo sapiens
agggccctaaggaaggcacaca

SEQ ID NO: 7122201 - DNA, 22 bp, Homo sapiens
agggccctaaggaaggcacaca

SEQ ID NO: 7122202 - DNA, 22 bp, Homo sapiens
agggccctaaggaaggcacaca

SEQ ID NO: 7122203 - DNA, 22 bp, Homo sapiens
ccgccgtgcaggccgcgacgtg

SEQ ID NO: 7122204 - DNA, 22 bp, Homo sapiens
agggccccatagtcactgcccg

SEQ ID NO: 7122205 - DNA, 22 bp, Homo sapiens
cccttttttatgtcaagcattg

SEQ ID NO: 7122206 - DNA, 22 bp, Homo sapiens
ccgagagcaggtggccgctggt

SEQ ID NO: 7122207 - DNA, 22 bp, Homo sapiens
ccgagcccggagaggagctctt

SEQ ID NO: 7122208 - DNA, 22 bp, Homo sapiens
ccgaggtcctggacttggccct

SEQ ID NO: 7122209 - DNA, 22 bp, Homo sapiens
ccgcaaggcagaggttgcagtg

SEQ ID NO: 7122210 - DNA, 22 bp, Homo sapiens
ccgcaaggcagaggttgcagtg

SEQ ID NO: 7122211 - DNA, 22 bp, Homo sapiens
ccgaggtcctggacttggccct

SEQ ID NO: 7122212 - DNA, 22 bp, Homo sapiens
ccgaggctggagtgcagtggcg

SEQ ID NO: 7122213 - DNA, 22 bp, Homo sapiens
ccgaggctggcctcagggctgt

SEQ ID NO: 7122214 - DNA, 22 bp, Homo sapiens
ccctttcctgaagaatattttt

SEQ ID NO: 7122215 - DNA, 22 bp, Homo sapiens
ccctttcctgaagaatattttt

SEQ ID NO: 7122216 - DNA, 22 bp, Homo sapiens
ccctttctccagaactgtctga

SEQ ID NO: 7122217 - DNA, 22 bp, Homo sapiens
ccctttcccttctggctcaggg

SEQ ID NO: 7122218 - DNA, 22 bp, Homo sapiens
cccttcccttctgggagatcca

SEQ ID NO: 7122219 - DNA, 22 bp, Homo sapiens
cccttcagtgcgtgagaatgag

SEQ ID NO: 7122220 - DNA, 22 bp, Homo sapiens
cccttcagtgctaggctgcctg

SEQ ID NO: 7122221 - DNA, 21 bp, Homo sapiens
ccctttctccatacttcatcc

SEQ ID NO: 7122222 - DNA, 22 bp, Homo sapiens
ccctttctccagaactgtctga

SEQ ID NO: 7122223 - DNA, 22 bp, Homo sapiens
ccctttctgggacccctgtctc

SEQ ID NO: 7122224 - DNA, 22 bp, Homo sapiens
ccctttctgggacccctgtctc

SEQ ID NO: 7122225 - DNA, 22 bp, Homo sapiens
ccctttctgggacccctgtctc

SEQ ID NO: 7122226 - DNA, 22 bp, Homo sapiens
ccctttcttccgtgacttctgc

SEQ ID NO: 7122227 - DNA, 22 bp, Homo sapiens
ccctttttcactctaccaaggt

SEQ ID NO: 7122228 - DNA, 22 bp, Homo sapiens
ccctttcttccgtgacttctgc

SEQ ID NO: 7122229 - DNA, 22 bp, Homo sapiens
agggccagagtacatcagggct

SEQ ID NO: 7122230 - DNA, 22 bp, Homo sapiens
agggccagagtacatcagggct

SEQ ID NO: 7122231 - DNA, 22 bp, Homo sapiens
agggccagagtacatcagggct

SEQ ID NO: 7122232 - DNA, 22 bp, Homo sapiens
agggccagagtacatcagggct

SEQ ID NO: 7122233 - DNA, 22 bp, Homo sapiens
agggccagagtacatcagggct

SEQ ID NO: 7122234 - DNA, 22 bp, Homo sapiens
agggccagagtctgtgtagata

SEQ ID NO: 7122235 - DNA, 22 bp, Homo sapiens
agggccagagtacatcagggct

SEQ ID NO: 7122236 - DNA, 22 bp, Homo sapiens
agggccagagtacatcagggct

SEQ ID NO: 7122237 - DNA, 22 bp, Homo sapiens
agggccagagtacatcagggct

SEQ ID NO: 7122238 - DNA, 22 bp, Homo sapiens
agggccagagtctgtgtagata

SEQ ID NO: 7122239 - DNA, 22 bp, Homo sapiens
agggccagagtctgtgtagata

SEQ ID NO: 7122240 - DNA, 22 bp, Homo sapiens
agggccagaatccctcagtcta

SEQ ID NO: 7122241 - DNA, 22 bp, Homo sapiens
agggccagaggcaccttgcagc

SEQ ID NO: 7122242 - DNA, 22 bp, Homo sapiens
agggccagaatccctcagtcta

SEQ ID NO: 7122243 - DNA, 22 bp, Homo sapiens
agggccagaatccctcagtcta

SEQ ID NO: 7122244 - DNA, 22 bp, Homo sapiens
agggccagaatccctcagtcta

SEQ ID NO: 7122245 - DNA, 22 bp, Homo sapiens
agggccagaggcaccttgcagc

SEQ ID NO: 7122246 - DNA, 22 bp, Homo sapiens
ccctggaggcggatgttgcagt

SEQ ID NO: 7122247 - DNA, 22 bp, Homo sapiens
ccctggaggcggatgttgcagt

SEQ ID NO: 7122248 - DNA, 22 bp, Homo sapiens
ccctggaggcggagcttgcagt

SEQ ID NO: 7122249 - DNA, 22 bp, Homo sapiens
ccctggaggcggagcttgcagt

SEQ ID NO: 7122250 - DNA, 22 bp, Homo sapiens
ccctggaggcggagcttgcagt

SEQ ID NO: 7122251 - DNA, 22 bp, Homo sapiens
ccctggaggcggagcttgcagt

SEQ ID NO: 7122252 - DNA, 22 bp, Homo sapiens
ccctggaggcaaaggttgcagt

SEQ ID NO: 7122253 - DNA, 22 bp, Homo sapiens
ccctggaggcaaaggttgcagt

SEQ ID NO: 7122254 - DNA, 22 bp, Homo sapiens
ccctggaggcaaaggttgcagt

SEQ ID NO: 7122255 - DNA, 22 bp, Homo sapiens
ccctggaggctggaggcagtag

SEQ ID NO: 7122256 - DNA, 22 bp, Homo sapiens
ccctggaggctggaggcagtag

SEQ ID NO: 7122257 - DNA, 22 bp, Homo sapiens
ccctggaggctggaggcagtag

SEQ ID NO: 7122258 - DNA, 22 bp, Homo sapiens
agggccacttgtagactggtga

SEQ ID NO: 7122259 - DNA, 16 bp, Homo sapiens
agggccagaagcatca

SEQ ID NO: 7122260 - DNA, 16 bp, Homo sapiens
agggccagaagcatca

SEQ ID NO: 7122261 - DNA, 23 bp, Homo sapiens
agggccactgggaaggattactg

SEQ ID NO: 7122262 - DNA, 23 bp, Homo sapiens
agggccactgggaaggattactg

SEQ ID NO: 7122263 - DNA, 22 bp, Homo sapiens
ccctggagggacagctgctcta

SEQ ID NO: 7122264 - DNA, 22 bp, Homo sapiens
ccctggagggacagctgctcta

SEQ ID NO: 7122265 - DNA, 22 bp, Homo sapiens
ccctggagggacagctgctcta

SEQ ID NO: 7122266 - DNA, 22 bp, Homo sapiens
agggccctctggcaggccaggc

SEQ ID NO: 7122267 - DNA, 22 bp, Homo sapiens
agggccctctggcaggccaggc

SEQ ID NO: 7122268 - DNA, 22 bp, Homo sapiens
agggccctctggcaggccaggc

SEQ ID NO: 7122269 - DNA, 22 bp, Homo sapiens
agggccctagggaatgagacat

SEQ ID NO: 7122270 - DNA, 22 bp, Homo sapiens
agggccctagggaatgagacat

SEQ ID NO: 7122271 - DNA, 22 bp, Homo sapiens
agggccctagggaatgagacat

SEQ ID NO: 7122272 - DNA, 22 bp, Homo sapiens
agggccctccccgctcagggca

SEQ ID NO: 7122273 - DNA, 22 bp, Homo sapiens
agggccctccccgctcagggca

SEQ ID NO: 7122274 - DNA, 22 bp, Homo sapiens
agggccctccccgctcagggca

SEQ ID NO: 7122275 - DNA, 22 bp, Homo sapiens
agggccctctggcaggccaggc

SEQ ID NO: 7122276 - DNA, 22 bp, Homo sapiens
agggccctctggcaggccaggc

SEQ ID NO: 7122277 - DNA, 22 bp, Homo sapiens
agggccctctgggcactgtggc

SEQ ID NO: 7122278 - DNA, 22 bp, Homo sapiens
agggccctgagttgcagccctg

SEQ ID NO: 7122279 - DNA, 22 bp, Homo sapiens
agggccctgagttgcagccctg

SEQ ID NO: 7122280 - DNA, 22 bp, Homo sapiens
agggcccttacgcaggcccttc

SEQ ID NO: 7122281 - DNA, 22 bp, Homo sapiens
agggccctggggtgcactgaca

SEQ ID NO: 7122282 - DNA, 22 bp, Homo sapiens
agggcccttacgcaggcccttc

SEQ ID NO: 7122283 - DNA, 22 bp, Homo sapiens
agggcccttacgcaggcccttc

SEQ ID NO: 7122284 - DNA, 22 bp, Homo sapiens
agggccctggggtgcactgaca

SEQ ID NO: 7122285 - DNA, 18 bp, Homo sapiens
agggccctggtggccatt

SEQ ID NO: 7122286 - DNA, 18 bp, Homo sapiens
agggccctggtggccatt

SEQ ID NO: 7122287 - DNA, 22 bp, Homo sapiens
agggcccttacgcaggcccttc

SEQ ID NO: 7122288 - DNA, 23 bp, Homo sapiens
agggcctcaggagggctgcatgg

SEQ ID NO: 7122289 - DNA, 23 bp, Homo sapiens
agggcctcaggagggctgcatgg

SEQ ID NO: 7122290 - DNA, 22 bp, Homo sapiens
agggctccaaggaagtgtagct

SEQ ID NO: 7122291 - DNA, 22 bp, Homo sapiens
agggctccaggggctgggtgac

SEQ ID NO: 7122292 - DNA, 22 bp, Homo sapiens
agggctccaggggctgggtgac

SEQ ID NO: 7122293 - DNA, 22 bp, Homo sapiens
agggctcccgtgaggtgactgc

SEQ ID NO: 7122294 - DNA, 22 bp, Homo sapiens
agggctcccgtgaggtgactgc

SEQ ID NO: 7122295 - DNA, 22 bp, Homo sapiens
agggctcataattcctgacttc

SEQ ID NO: 7122296 - DNA, 21 bp, Homo sapiens
agggctcaaatgtgcttgctg

SEQ ID NO: 7122297 - DNA, 22 bp, Homo sapiens
agggctcataattcctgacttc

SEQ ID NO: 7122298 - DNA, 22 bp, Homo sapiens
agggctcattgacatggaaaag

SEQ ID NO: 7122299 - DNA, 22 bp, Homo sapiens
agggctcattgacatggaaaag

SEQ ID NO: 7122300 - DNA, 22 bp, Homo sapiens
agggctcatctgagactgacat

SEQ ID NO: 7122301 - DNA, 22 bp, Homo sapiens
agggctccaaggaagtgtagct

SEQ ID NO: 7122302 - DNA, 22 bp, Homo sapiens
agggctctgttggggtcagcac

SEQ ID NO: 7122303 - DNA, 22 bp, Homo sapiens
agggctctgttggggtcagcac

SEQ ID NO: 7122304 - DNA, 22 bp, Homo sapiens
agggctcttcctttgcctctca

SEQ ID NO: 7122305 - DNA, 22 bp, Homo sapiens
agggctcttcctttgcctctca

SEQ ID NO: 7122306 - DNA, 22 bp, Homo sapiens
agggctcttcctttgcctctca

SEQ ID NO: 7122307 - DNA, 22 bp, Homo sapiens
cctccccacgggcagccggcgc

SEQ ID NO: 7122308 - DNA, 22 bp, Homo sapiens
cctccccacgggcagccggcgc

SEQ ID NO: 7122309 - DNA, 22 bp, Homo sapiens
cctccccacgggcagccggcgc

SEQ ID NO: 7122310 - DNA, 22 bp, Homo sapiens
cctccccacgggcagccggcgc

SEQ ID NO: 7122311 - DNA, 22 bp, Homo sapiens
cctccccatgacccggtgctgg

SEQ ID NO: 7122312 - DNA, 22 bp, Homo sapiens
cctcctctgtgcagctgtgggt

SEQ ID NO: 7122313 - DNA, 22 bp, Homo sapiens
agggctctgtccccagaggccc

SEQ ID NO: 7122314 - DNA, 22 bp, Homo sapiens
agggctctggggtggcagagat

SEQ ID NO: 7122315 - DNA, 22 bp, Homo sapiens
agggctctggggtggcagagat

SEQ ID NO: 7122316 - DNA, 20 bp, Homo sapiens
agggctctgccttgctgatg

SEQ ID NO: 7122317 - DNA, 22 bp, Homo sapiens
agggctctgagtgggaaagagg

SEQ ID NO: 7122318 - DNA, 22 bp, Homo sapiens
agggctcctgaggcccttctgg

SEQ ID NO: 7122319 - DNA, 22 bp, Homo sapiens
agggctcctccccggcctccac

SEQ ID NO: 7122320 - DNA, 22 bp, Homo sapiens
agggctcctccccggcctccac

SEQ ID NO: 7122321 - DNA, 22 bp, Homo sapiens
agggctcctgaggcccttctgg

SEQ ID NO: 7122322 - DNA, 22 bp, Homo sapiens
agggctcctgaggcccttctgg

SEQ ID NO: 7122323 - DNA, 22 bp, Homo sapiens
agggctctcttggacaactgct

SEQ ID NO: 7122324 - DNA, 22 bp, Homo sapiens
agggctctgagctggaccacct

SEQ ID NO: 7122325 - DNA, 18 bp, Homo sapiens
agggctctctgctgggtt

SEQ ID NO: 7122326 - DNA, 22 bp, Homo sapiens
agggctctcttcttggtttgca

SEQ ID NO: 7122327 - DNA, 22 bp, Homo sapiens
agggctccgggcaggcgatgga

SEQ ID NO: 7122328 - DNA, 22 bp, Homo sapiens
agggctccgggccaccggcctg

SEQ ID NO: 7122329 - DNA, 22 bp, Homo sapiens
agggctcctatgatgctctgcc

SEQ ID NO: 7122330 - DNA, 22 bp, Homo sapiens
agggctcctatgatgctctgcc

SEQ ID NO: 7122331 - DNA, 22 bp, Homo sapiens
agggctcctatgatgctctgcc

SEQ ID NO: 7122332 - DNA, 22 bp, Homo sapiens
agggctcctatgccccatggac

SEQ ID NO: 7122333 - DNA, 22 bp, Homo sapiens
agggctcctatgccccatggac

SEQ ID NO: 7122334 - DNA, 22 bp, Homo sapiens
agggctcctccccggcctccac

SEQ ID NO: 7122335 - DNA, 22 bp, Homo sapiens
agggctcctccccggcctccac

SEQ ID NO: 7122336 - DNA, 22 bp, Homo sapiens
aggggctgggacagagccaagc

SEQ ID NO: 7122337 - DNA, 22 bp, Homo sapiens
aggggctgggacagagccaagc

SEQ ID NO: 7122338 - DNA, 22 bp, Homo sapiens
aggggctgggacagagccaagc

SEQ ID NO: 7122339 - DNA, 22 bp, Homo sapiens
aggggctgggacagagccaagc

SEQ ID NO: 7122340 - DNA, 22 bp, Homo sapiens
aggggctggcttatctgagagt

SEQ ID NO: 7122341 - DNA, 22 bp, Homo sapiens
aggggctggcttatctgagagt

SEQ ID NO: 7122342 - DNA, 22 bp, Homo sapiens
aggggctggcttatctgagagt

SEQ ID NO: 7122343 - DNA, 22 bp, Homo sapiens
aggggctggcttatctgagagt

SEQ ID NO: 7122344 - DNA, 22 bp, Homo sapiens
aggggctggagttcgaggttac

SEQ ID NO: 7122345 - DNA, 22 bp, Homo sapiens
aggggctggagttcgaggttac

SEQ ID NO: 7122346 - DNA, 22 bp, Homo sapiens
aggggctggcttatctgagagt

SEQ ID NO: 7122347 - DNA, 22 bp, Homo sapiens
aggggctggcttatctgagagt

SEQ ID NO: 7122348 - DNA, 22 bp, Homo sapiens
aggggctgctgggtccgcccct

SEQ ID NO: 7122349 - DNA, 22 bp, Homo sapiens
aggggctggagttcgaggttac

SEQ ID NO: 7122350 - DNA, 22 bp, Homo sapiens
aggggctgctgggtccgcccct

SEQ ID NO: 7122351 - DNA, 22 bp, Homo sapiens
aggggctgcctggcttggcact

SEQ ID NO: 7122352 - DNA, 22 bp, Homo sapiens
aggggctgcctggcttggcact

SEQ ID NO: 7122353 - DNA, 22 bp, Homo sapiens
cctgaggattgttggtgcttcc

SEQ ID NO: 7122354 - DNA, 22 bp, Homo sapiens
cctgaggattgttggtgcttcc

SEQ ID NO: 7122355 - DNA, 22 bp, Homo sapiens
cctgaggatgccagcatgggtg

SEQ ID NO: 7122356 - DNA, 22 bp, Homo sapiens
cctgaggatgccagcatgggtg

SEQ ID NO: 7122357 - DNA, 22 bp, Homo sapiens
cctgaggatgccagcatgggtg

SEQ ID NO: 7122358 - DNA, 22 bp, Homo sapiens
cctgaggatgccagcatgggtg

SEQ ID NO: 7122359 - DNA, 22 bp, Homo sapiens
cctgaggagattgtggctgggg

SEQ ID NO: 7122360 - DNA, 22 bp, Homo sapiens
cctgaggagattgtggctgggg

SEQ ID NO: 7122361 - DNA, 22 bp, Homo sapiens
cctgaggagattgtggctgggg

SEQ ID NO: 7122362 - DNA, 22 bp, Homo sapiens
cctgaggatattcaccagcatg

SEQ ID NO: 7122363 - DNA, 22 bp, Homo sapiens
cctgaggcaaggacttggtggc

SEQ ID NO: 7122364 - DNA, 22 bp, Homo sapiens
cctgaggcaaggacttggtggc

SEQ ID NO: 7122365 - DNA, 22 bp, Homo sapiens
cctgaggcaaggacttggtggc

SEQ ID NO: 7122366 - DNA, 22 bp, Homo sapiens
cctgaggcccctgaggatagca

SEQ ID NO: 7122367 - DNA, 22 bp, Homo sapiens
cctgaggcccctgaggatagca

SEQ ID NO: 7122368 - DNA, 22 bp, Homo sapiens
cctgaggccctggctgtgctga

SEQ ID NO: 7122369 - DNA, 22 bp, Homo sapiens
cctgaggccctggctgtgctga

SEQ ID NO: 7122370 - DNA, 17 bp, Homo sapiens
aggggagagtgggaaga

SEQ ID NO: 7122371 - DNA, 17 bp, Homo sapiens
aggggagagtgggaaga

SEQ ID NO: 7122372 - DNA, 17 bp, Homo sapiens
aggggagagtgggaaga

SEQ ID NO: 7122373 - DNA, 17 bp, Homo sapiens
aggggagagtgggaaga

SEQ ID NO: 7122374 - DNA, 17 bp, Homo sapiens
aggggagagtgggaaga

SEQ ID NO: 7122375 - DNA, 17 bp, Homo sapiens
aggggagagtgggaaga

SEQ ID NO: 7122376 - DNA, 17 bp, Homo sapiens
aggggagagtgggaaga

SEQ ID NO: 7122377 - DNA, 22 bp, Homo sapiens
cctgagagtggtgtacaggaga

SEQ ID NO: 7122378 - DNA, 22 bp, Homo sapiens
cctgagagtggtgtacaggaga

SEQ ID NO: 7122379 - DNA, 22 bp, Homo sapiens
cctgagagtggtgtacaggaga

SEQ ID NO: 7122380 - DNA, 22 bp, Homo sapiens
cctgagagtggtgtacaggaga

SEQ ID NO: 7122381 - DNA, 22 bp, Homo sapiens
aggggagagttaatgtgaatgt

SEQ ID NO: 7122382 - DNA, 22 bp, Homo sapiens
aggggagagttaatgtgaatgt

SEQ ID NO: 7122383 - DNA, 22 bp, Homo sapiens
cctgagagtgcgtgcctcctta

SEQ ID NO: 7122384 - DNA, 22 bp, Homo sapiens
cctgaggaccagcacccatctg

SEQ ID NO: 7122385 - DNA, 22 bp, Homo sapiens
cctgaggacagtgtgaccatgg

SEQ ID NO: 7122386 - DNA, 22 bp, Homo sapiens
cctgaggacacacgctgcagga

SEQ ID NO: 7122387 - DNA, 22 bp, Homo sapiens
cctgaggacacacgctgcagga

SEQ ID NO: 7122388 - DNA, 22 bp, Homo sapiens
cctgaggacacacgctgcagga

SEQ ID NO: 7122389 - DNA, 22 bp, Homo sapiens
cctgaggacacacgctgcagga

SEQ ID NO: 7122390 - DNA, 22 bp, Homo sapiens
cctgaggacacacgctgcagga

SEQ ID NO: 7122391 - DNA, 22 bp, Homo sapiens
cctgaggacacacgctgcagga

SEQ ID NO: 7122392 - DNA, 22 bp, Homo sapiens
cctgaggacacacgctgcagga

SEQ ID NO: 7122393 - DNA, 22 bp, Homo sapiens
cctgaggacacacgctgcagga

SEQ ID NO: 7122394 - DNA, 19 bp, Homo sapiens
cctgaggaaaagatgattg

SEQ ID NO: 7122395 - DNA, 21 bp, Homo sapiens
aggggacagagtagctccagg

SEQ ID NO: 7122396 - DNA, 21 bp, Homo sapiens
aggggacagagtagctccagg

SEQ ID NO: 7122397 - DNA, 22 bp, Homo sapiens
aggggacacggcttctccaggg

SEQ ID NO: 7122398 - DNA, 21 bp, Homo sapiens
aggggacagagtagctccagg

SEQ ID NO: 7122399 - DNA, 22 bp, Homo sapiens
cctctgggctgcctgcacgggt

SEQ ID NO: 7122400 - DNA, 22 bp, Homo sapiens
cctctgggctgcctgcacgggt

SEQ ID NO: 7122401 - DNA, 22 bp, Homo sapiens
aggggacacggcttctccaggg

SEQ ID NO: 7122402 - DNA, 22 bp, Homo sapiens
aggggacacggcttctccaggg

SEQ ID NO: 7122403 - DNA, 22 bp, Homo sapiens
aggggacacggcttctccaggg

SEQ ID NO: 7122404 - DNA, 21 bp, Homo sapiens
aggggacagagtagctccagg

SEQ ID NO: 7122405 - DNA, 22 bp, Homo sapiens
aggggacatttagcaatgacta

SEQ ID NO: 7122406 - DNA, 22 bp, Homo sapiens
aggggagaaaaatgccttctgt

SEQ ID NO: 7122407 - DNA, 22 bp, Homo sapiens
aggggagaaaaatgccttctgt

SEQ ID NO: 7122408 - DNA, 22 bp, Homo sapiens
aggggagaaaaatgccttctgt

SEQ ID NO: 7122409 - DNA, 22 bp, Homo sapiens
aggggagaaaaatgccttctgt

SEQ ID NO: 7122410 - DNA, 22 bp, Homo sapiens
aggggagaatttcaactcaggt

SEQ ID NO: 7122411 - DNA, 22 bp, Homo sapiens
aggggagaatttcaactcaggt

SEQ ID NO: 7122412 - DNA, 22 bp, Homo sapiens
aggggagaatttcaactcaggt

SEQ ID NO: 7122413 - DNA, 22 bp, Homo sapiens
aggggagaatttcaactcaggt

SEQ ID NO: 7122414 - DNA, 22 bp, Homo sapiens
aggggagaatttcaactcaggt

SEQ ID NO: 7122415 - DNA, 22 bp, Homo sapiens
aggggagactggaatctaacat

SEQ ID NO: 7122416 - DNA, 22 bp, Homo sapiens
aggggagactggaatctaacat

SEQ ID NO: 7122417 - DNA, 22 bp, Homo sapiens
aggggagactggaatctaacat

SEQ ID NO: 7122418 - DNA, 22 bp, Homo sapiens
aggggagagaacataaggaagt

SEQ ID NO: 7122419 - DNA, 22 bp, Homo sapiens
aggggagagaacataaggaagt

SEQ ID NO: 7122420 - DNA, 22 bp, Homo sapiens
aggggagagaacataaggaagt

SEQ ID NO: 7122421 - DNA, 22 bp, Homo sapiens
aggggagagaacataaggaagt

SEQ ID NO: 7122422 - DNA, 22 bp, Homo sapiens
aggggagagaacataaggaagt

SEQ ID NO: 7122423 - DNA, 22 bp, Homo sapiens
aggggagaggtgagcaacttct

SEQ ID NO: 7122424 - DNA, 22 bp, Homo sapiens
aggggagaggtgagcaacttct

SEQ ID NO: 7122425 - DNA, 23 bp, Homo sapiens
agggctgatgccattgcagctct

SEQ ID NO: 7122426 - DNA, 23 bp, Homo sapiens
agggctgatgccattgcagctct

SEQ ID NO: 7122427 - DNA, 22 bp, Homo sapiens
agggctgcaatgggagataact

SEQ ID NO: 7122428 - DNA, 22 bp, Homo sapiens
agggctgatgcaccatgtagcc

SEQ ID NO: 7122429 - DNA, 22 bp, Homo sapiens
agggctgagtggtgcagtcaaa

SEQ ID NO: 7122430 - DNA, 22 bp, Homo sapiens
agggctgagtggtgcagtcaaa

SEQ ID NO: 7122431 - DNA, 22 bp, Homo sapiens
agggctgagtggtgcagtcaaa

SEQ ID NO: 7122432 - DNA, 22 bp, Homo sapiens
agggctgagtgggagagagttg

SEQ ID NO: 7122433 - DNA, 22 bp, Homo sapiens
cctcctggccctgggcctggaa

SEQ ID NO: 7122434 - DNA, 22 bp, Homo sapiens
cctcctggccctgggcctggaa

SEQ ID NO: 7122435 - DNA, 22 bp, Homo sapiens
cctcctggatggatttggtgga

SEQ ID NO: 7122436 - DNA, 22 bp, Homo sapiens
cctcctggatggatttggtgga

SEQ ID NO: 7122437 - DNA, 22 bp, Homo sapiens
cctcctggaggctctagggaaa

SEQ ID NO: 7122438 - DNA, 22 bp, Homo sapiens
cctcctggaggctctagggaaa

SEQ ID NO: 7122439 - DNA, 21 bp, Homo sapiens
cctcctgcccgcaagctaggg

SEQ ID NO: 7122440 - DNA, 22 bp, Homo sapiens
cctcctgcggcgtccgcgctct

SEQ ID NO: 7122441 - DNA, 22 bp, Homo sapiens
cctcctgcggcgtccgcgctct

SEQ ID NO: 7122442 - DNA, 22 bp, Homo sapiens
cctcctgcggcgtccgcgctct

SEQ ID NO: 7122443 - DNA, 22 bp, Homo sapiens
cctcctgcggcgtccgcgctct

SEQ ID NO: 7122444 - DNA, 19 bp, Homo sapiens
cctcctgctagatatgcaa

SEQ ID NO: 7122445 - DNA, 22 bp, Homo sapiens
cctcctggaaaaattccctggc

SEQ ID NO: 7122446 - DNA, 22 bp, Homo sapiens
cctcctggaaaaattccctggc

SEQ ID NO: 7122447 - DNA, 22 bp, Homo sapiens
cctcctgcacttgctttccttc

SEQ ID NO: 7122448 - DNA, 22 bp, Homo sapiens
cctcctgcacttgctttccttc

SEQ ID NO: 7122449 - DNA, 22 bp, Homo sapiens
cctcctgcacctccaggaactc

SEQ ID NO: 7122450 - DNA, 22 bp, Homo sapiens
cctcctgcacctccaggaactc

SEQ ID NO: 7122451 - DNA, 22 bp, Homo sapiens
cctcctgcactgcaagcttgag

SEQ ID NO: 7122452 - DNA, 22 bp, Homo sapiens
cctcctggaggctctaagggag

SEQ ID NO: 7122453 - DNA, 22 bp, Homo sapiens
cctcctggagcattggtgagga

SEQ ID NO: 7122454 - DNA, 22 bp, Homo sapiens
cctcctggaaaaattccctggc

SEQ ID NO: 7122455 - DNA, 22 bp, Homo sapiens
cctcctggaaaaattccctggc

SEQ ID NO: 7122456 - DNA, 22 bp, Homo sapiens
cctcctggagcattggtgagga

SEQ ID NO: 7122457 - DNA, 22 bp, Homo sapiens
cctcctggagcattggtgagga

SEQ ID NO: 7122458 - DNA, 21 bp, Homo sapiens
cctctggcttgtgctgtgccc

SEQ ID NO: 7122459 - DNA, 22 bp, Homo sapiens
cctctgggaagccagtcctgct

SEQ ID NO: 7122460 - DNA, 22 bp, Homo sapiens
cctctgggaagccagtcctgct

SEQ ID NO: 7122461 - DNA, 22 bp, Homo sapiens
cctctggcttactgttgggttt

SEQ ID NO: 7122462 - DNA, 21 bp, Homo sapiens
cctctggcttgtgctgtgccc

SEQ ID NO: 7122463 - DNA, 22 bp, Homo sapiens
cctctgggaagccagtcctgct

SEQ ID NO: 7122464 - DNA, 22 bp, Homo sapiens
cctctgggagactgctactgag

SEQ ID NO: 7122465 - DNA, 22 bp, Homo sapiens
cctctgggagactgctactgag

SEQ ID NO: 7122466 - DNA, 22 bp, Homo sapiens
agggctgcaatgggagataact

SEQ ID NO: 7122467 - DNA, 22 bp, Homo sapiens
agggctgcaccggggcttcgcg

SEQ ID NO: 7122468 - DNA, 22 bp, Homo sapiens
agggctgcaggcaagatatggc

SEQ ID NO: 7122469 - DNA, 22 bp, Homo sapiens
agggctgcaggcaagatatggc

SEQ ID NO: 7122470 - DNA, 19 bp, Homo sapiens
cctctgccagcccgcctct

SEQ ID NO: 7122471 - DNA, 19 bp, Homo sapiens
cctctgccagcccgcctct

SEQ ID NO: 7122472 - DNA, 19 bp, Homo sapiens
cctctgccagcccgcctct

SEQ ID NO: 7122473 - DNA, 19 bp, Homo sapiens
cctctgccagcccgcctct

SEQ ID NO: 7122474 - DNA, 18 bp, Homo sapiens
cctctgccatagccagca

SEQ ID NO: 7122475 - DNA, 18 bp, Homo sapiens
cctctgccatagccagca

SEQ ID NO: 7122476 - DNA, 22 bp, Homo sapiens
cctctggcttactgttgggttt

SEQ ID NO: 7122477 - DNA, 22 bp, Homo sapiens
cctctgggcaggtagcagcagc

SEQ ID NO: 7122478 - DNA, 22 bp, Homo sapiens
cctctgggcaggtagcagcagc

SEQ ID NO: 7122479 - DNA, 22 bp, Homo sapiens
cctctgggccagcctggaccct

SEQ ID NO: 7122480 - DNA, 22 bp, Homo sapiens
cctctgggcaggtagcagcagc

SEQ ID NO: 7122481 - DNA, 22 bp, Homo sapiens
cctctgggcaggtagcagcagc

SEQ ID NO: 7122482 - DNA, 16 bp, Homo sapiens
cctctgggatgtttgc

SEQ ID NO: 7122483 - DNA, 16 bp, Homo sapiens
cctctgggcctgcaag

SEQ ID NO: 7122484 - DNA, 22 bp, Homo sapiens
cctctgggcctggaagggcagt

SEQ ID NO: 7122485 - DNA, 22 bp, Homo sapiens
cctctgggcctggaagggcagt

SEQ ID NO: 7122486 - DNA, 22 bp, Homo sapiens
cctctgggcctggaagggcagt

SEQ ID NO: 7122487 - DNA, 22 bp, Homo sapiens
cctctgggccagcctggaccct

SEQ ID NO: 7122488 - DNA, 16 bp, Homo sapiens
cctctgggcctgcaag

SEQ ID NO: 7122489 - DNA, 16 bp, Homo sapiens
cctctgggcctgcaag

SEQ ID NO: 7122490 - DNA, 22 bp, Homo sapiens
cctctgggcggagatctgctgc

SEQ ID NO: 7122491 - DNA, 22 bp, Homo sapiens
ccctccccacaaagcttcacac

SEQ ID NO: 7122492 - DNA, 22 bp, Homo sapiens
ccctccccacaaagcttcacac

SEQ ID NO: 7122493 - DNA, 22 bp, Homo sapiens
ccctctctcggttgctgtggtt

SEQ ID NO: 7122494 - DNA, 22 bp, Homo sapiens
agggatgggtctaacccagaac

SEQ ID NO: 7122495 - DNA, 22 bp, Homo sapiens
agggatgggaactcctccagca

SEQ ID NO: 7122496 - DNA, 22 bp, Homo sapiens
agggatgggaactcctccagca

SEQ ID NO: 7122497 - DNA, 22 bp, Homo sapiens
agggatggcaagttaacctgag

SEQ ID NO: 7122498 - DNA, 22 bp, Homo sapiens
agggatggatcttggccctgga

SEQ ID NO: 7122499 - DNA, 22 bp, Homo sapiens
agggatgggaactcctccagca

SEQ ID NO: 7122500 - DNA, 22 bp, Homo sapiens
ccctctcttagaagaaacacag

SEQ ID NO: 7122501 - DNA, 22 bp, Homo sapiens
ccctctcttagaagaaacacag

SEQ ID NO: 7122502 - DNA, 22 bp, Homo sapiens
ccctctgactgggccagttctg

SEQ ID NO: 7122503 - DNA, 20 bp, Homo sapiens
ccctctgcacatggctgtgg

SEQ ID NO: 7122504 - DNA, 22 bp, Homo sapiens
ccctctctgacttctgaacttg

SEQ ID NO: 7122505 - DNA, 22 bp, Homo sapiens
ccctctctgacttctgaacttg

SEQ ID NO: 7122506 - DNA, 22 bp, Homo sapiens
ccctctctgacttctgaacttg

SEQ ID NO: 7122507 - DNA, 22 bp, Homo sapiens
ccctctctcggttgctgtggtt

SEQ ID NO: 7122508 - DNA, 22 bp, Homo sapiens
ccctctggtttgcccttgggtg

SEQ ID NO: 7122509 - DNA, 18 bp, Homo sapiens
ccctcttgcacaaagcaa

SEQ ID NO: 7122510 - DNA, 18 bp, Homo sapiens
ccctcttgcacaaagcaa

SEQ ID NO: 7122511 - DNA, 18 bp, Homo sapiens
ccctcttgcacaaagcaa

SEQ ID NO: 7122512 - DNA, 17 bp, Homo sapiens
ccctctggggagggagg

SEQ ID NO: 7122513 - DNA, 17 bp, Homo sapiens
ccctctggggagggagg

SEQ ID NO: 7122514 - DNA, 22 bp, Homo sapiens
ccctctgctcaggtgcataggc

SEQ ID NO: 7122515 - DNA, 22 bp, Homo sapiens
ccctctgctgcctggctgggtc

SEQ ID NO: 7122516 - DNA, 22 bp, Homo sapiens
ccctctggctcttctcaggccg

SEQ ID NO: 7122517 - DNA, 22 bp, Homo sapiens
ccctctggctcttctcaggccg

SEQ ID NO: 7122518 - DNA, 22 bp, Homo sapiens
ccctctggctcttctcaggccg

SEQ ID NO: 7122519 - DNA, 22 bp, Homo sapiens
ccctctggctcttctcaggccg

SEQ ID NO: 7122520 - DNA, 20 bp, Homo sapiens
ccctctgctacactgggagc

SEQ ID NO: 7122521 - DNA, 20 bp, Homo sapiens
ccctctgctacactgggagc

SEQ ID NO: 7122522 - DNA, 22 bp, Homo sapiens
ccctctgctcaggtgcataggc

SEQ ID NO: 7122523 - DNA, 22 bp, Homo sapiens
ccctctgcaggctggacctgcc

SEQ ID NO: 7122524 - DNA, 22 bp, Homo sapiens
ccctctgcaggctggacctgcc

SEQ ID NO: 7122525 - DNA, 22 bp, Homo sapiens
ccctctgcctctgagtaggaca

SEQ ID NO: 7122526 - DNA, 22 bp, Homo sapiens
ccctggaggagcttagagcttg

SEQ ID NO: 7122527 - DNA, 22 bp, Homo sapiens
ccctggaggagcttagagcttg

SEQ ID NO: 7122528 - DNA, 19 bp, Homo sapiens
ccctggaggagtgttggct

SEQ ID NO: 7122529 - DNA, 19 bp, Homo sapiens
ccctggaggagtgttggct

SEQ ID NO: 7122530 - DNA, 22 bp, Homo sapiens
ccctggaggaccccaatgtggc

SEQ ID NO: 7122531 - DNA, 22 bp, Homo sapiens
agggcagagcactgaattggga

SEQ ID NO: 7122532 - DNA, 22 bp, Homo sapiens
agggcagagctgtctaaatggc

SEQ ID NO: 7122533 - DNA, 22 bp, Homo sapiens
agggcagaggcggacacggaag

SEQ ID NO: 7122534 - DNA, 22 bp, Homo sapiens
agggcagaggcggacacggaag

SEQ ID NO: 7122535 - DNA, 22 bp, Homo sapiens
agggcagaggcggacacggaag

SEQ ID NO: 7122536 - DNA, 20 bp, Homo sapiens
agggcagagggattacaggc

SEQ ID NO: 7122537 - DNA, 20 bp, Homo sapiens
agggcagagggattacaggc

SEQ ID NO: 7122538 - DNA, 20 bp, Homo sapiens
agggcagagggattacaggc

SEQ ID NO: 7122539 - DNA, 20 bp, Homo sapiens
agggcagagggattacaggc

SEQ ID NO: 7122540 - DNA, 22 bp, Homo sapiens
ccctggaaggagatgggacatg

SEQ ID NO: 7122541 - DNA, 21 bp, Homo sapiens
ccctggaatcctgagtgccag

SEQ ID NO: 7122542 - DNA, 21 bp, Homo sapiens
ccctggaatcctgagtgccag

SEQ ID NO: 7122543 - DNA, 22 bp, Homo sapiens
agggcagagaaatgtagttgag

SEQ ID NO: 7122544 - DNA, 22 bp, Homo sapiens
agggcagagaaatgtagttgag

SEQ ID NO: 7122545 - DNA, 22 bp, Homo sapiens
agggcagagacatgcttcctga

SEQ ID NO: 7122546 - DNA, 22 bp, Homo sapiens
agggcagagacatgcttcctga

SEQ ID NO: 7122547 - DNA, 22 bp, Homo sapiens
agggcagagagatgaatgggat

SEQ ID NO: 7122548 - DNA, 22 bp, Homo sapiens
agggcagagagatgaatgggat

SEQ ID NO: 7122549 - DNA, 22 bp, Homo sapiens
agggcagagagatgaatgggat

SEQ ID NO: 7122550 - DNA, 22 bp, Homo sapiens
agggcagagagatgaatgggat

SEQ ID NO: 7122551 - DNA, 22 bp, Homo sapiens
agggcagagatctgagtgggca

SEQ ID NO: 7122552 - DNA, 22 bp, Homo sapiens
agggcagagatctgagtgggca

SEQ ID NO: 7122553 - DNA, 22 bp, Homo sapiens
agggcagagatctgagtgggca

SEQ ID NO: 7122554 - DNA, 22 bp, Homo sapiens
agggcagagatctgagtgggca

SEQ ID NO: 7122555 - DNA, 22 bp, Homo sapiens
agggcagagatctgagtgggca

SEQ ID NO: 7122556 - DNA, 22 bp, Homo sapiens
agggcagagatctgagtgggca

SEQ ID NO: 7122557 - DNA, 22 bp, Homo sapiens
agggcagagatctgagtgggca

SEQ ID NO: 7122558 - DNA, 22 bp, Homo sapiens
agggcagagatctgagtgggca

SEQ ID NO: 7122559 - DNA, 22 bp, Homo sapiens
agggcagagattaattaagaca

SEQ ID NO: 7122560 - DNA, 22 bp, Homo sapiens
agggcagagattaattaagaca

SEQ ID NO: 7122561 - DNA, 22 bp, Homo sapiens
agggcagagcactgaattggga

SEQ ID NO: 7122562 - DNA, 22 bp, Homo sapiens
agggcagagcactgaattggga

SEQ ID NO: 7122563 - DNA, 22 bp, Homo sapiens
agggcagagcactgaattggga

SEQ ID NO: 7122564 - DNA, 22 bp, Homo sapiens
agggatgatcagggtagaggct

SEQ ID NO: 7122565 - DNA, 22 bp, Homo sapiens
agggatgatcagggtagaggct

SEQ ID NO: 7122566 - DNA, 22 bp, Homo sapiens
agggatgatcagggtagaggct

SEQ ID NO: 7122567 - DNA, 22 bp, Homo sapiens
agggatgactcttggctgattc

SEQ ID NO: 7122568 - DNA, 22 bp, Homo sapiens
agggatcagtagggacggcagc

SEQ ID NO: 7122569 - DNA, 22 bp, Homo sapiens
agggatcagaatttcctccttt

SEQ ID NO: 7122570 - DNA, 22 bp, Homo sapiens
agggatcagcagagggtgtggt

SEQ ID NO: 7122571 - DNA, 18 bp, Homo sapiens
agggatcatcactgcagc

SEQ ID NO: 7122572 - DNA, 18 bp, Homo sapiens
agggatcatcactgcagc

SEQ ID NO: 7122573 - DNA, 22 bp, Homo sapiens
agggatcatcctgcaagtgcct

SEQ ID NO: 7122574 - DNA, 18 bp, Homo sapiens
agggatctagatggagtc

SEQ ID NO: 7122575 - DNA, 18 bp, Homo sapiens
agggatctagatggagtc

SEQ ID NO: 7122576 - DNA, 22 bp, Homo sapiens
agggagtgtaaatggtgctcag

SEQ ID NO: 7122577 - DNA, 22 bp, Homo sapiens
agggagtgtaaatggtgctcag

SEQ ID NO: 7122578 - DNA, 22 bp, Homo sapiens
agggagtgtaaatggtgctcag

SEQ ID NO: 7122579 - DNA, 22 bp, Homo sapiens
agggagtgttacataatgggtt

SEQ ID NO: 7122580 - DNA, 22 bp, Homo sapiens
agggagtgttacataatgggtt

SEQ ID NO: 7122581 - DNA, 22 bp, Homo sapiens
agggagtgttatattccatcag

SEQ ID NO: 7122582 - DNA, 22 bp, Homo sapiens
agggagttagaaatccaggata

SEQ ID NO: 7122583 - DNA, 22 bp, Homo sapiens
agggagttccgatctgtgcacc

SEQ ID NO: 7122584 - DNA, 22 bp, Homo sapiens
agggatcaaaaaatgtacatgc

SEQ ID NO: 7122585 - DNA, 22 bp, Homo sapiens
agggatcaaaaaatgtacatgc

SEQ ID NO: 7122586 - DNA, 22 bp, Homo sapiens
agggatcacggtggacttggat

SEQ ID NO: 7122587 - DNA, 22 bp, Homo sapiens
agggatggatcttggccctgga

SEQ ID NO: 7122588 - DNA, 22 bp, Homo sapiens
agggatggatcttggccctgga

SEQ ID NO: 7122589 - DNA, 22 bp, Homo sapiens
agggatggatcttggccctgga

SEQ ID NO: 7122590 - DNA, 22 bp, Homo sapiens
agggatggagtgcggcccggac

SEQ ID NO: 7122591 - DNA, 22 bp, Homo sapiens
agggatggagtgcggcccggac

SEQ ID NO: 7122592 - DNA, 22 bp, Homo sapiens
agggatggaagctcgtctgcaa

SEQ ID NO: 7122593 - DNA, 22 bp, Homo sapiens
agggatggagtgcggcccggac

SEQ ID NO: 7122594 - DNA, 22 bp, Homo sapiens
agggatgatggaaagaagcagg

SEQ ID NO: 7122595 - DNA, 22 bp, Homo sapiens
agggatgatttcagtgtctgcc

SEQ ID NO: 7122596 - DNA, 22 bp, Homo sapiens
agggatgcagtaaaaactgtag

SEQ ID NO: 7122597 - DNA, 22 bp, Homo sapiens
agggatgctaataaatcaaaga

SEQ ID NO: 7122598 - DNA, 22 bp, Homo sapiens
agggatggaagacttgaagacc

SEQ ID NO: 7122599 - DNA, 22 bp, Homo sapiens
agggatggaagacttgaagacc

SEQ ID NO: 7122600 - DNA, 22 bp, Homo sapiens
cccaggggttcaaggctgcagt

SEQ ID NO: 7122601 - DNA, 22 bp, Homo sapiens
agggactcctctgctcggctgc

SEQ ID NO: 7122602 - DNA, 22 bp, Homo sapiens
agggactcctctgctcggctgc

SEQ ID NO: 7122603 - DNA, 22 bp, Homo sapiens
agggactcggttgagtgcccct

SEQ ID NO: 7122604 - DNA, 22 bp, Homo sapiens
agggactcggttgagtgcccct

SEQ ID NO: 7122605 - DNA, 22 bp, Homo sapiens
agggactcggttgagtgcccct

SEQ ID NO: 7122606 - DNA, 22 bp, Homo sapiens
agggactcggttgagtgcccct

SEQ ID NO: 7122607 - DNA, 22 bp, Homo sapiens
agggactggctctctgagcagg

SEQ ID NO: 7122608 - DNA, 22 bp, Homo sapiens
agggactggctctctgagcagg

SEQ ID NO: 7122609 - DNA, 22 bp, Homo sapiens
agggactggctctctgagcagg

SEQ ID NO: 7122610 - DNA, 22 bp, Homo sapiens
agggagaaaattggatgcacaa

SEQ ID NO: 7122611 - DNA, 22 bp, Homo sapiens
agggactggctctctgagcagg

SEQ ID NO: 7122612 - DNA, 22 bp, Homo sapiens
agggacttggcagcaatatgga

SEQ ID NO: 7122613 - DNA, 22 bp, Homo sapiens
agggagaaaattggatgcacaa

SEQ ID NO: 7122614 - DNA, 22 bp, Homo sapiens
agggagaaaattggatgcacaa

SEQ ID NO: 7122615 - DNA, 22 bp, Homo sapiens
agggagaaaattggatgcacaa

SEQ ID NO: 7122616 - DNA, 22 bp, Homo sapiens
agggagaaaattggatgcacaa

SEQ ID NO: 7122617 - DNA, 22 bp, Homo sapiens
agggagaaaattggatgcacaa

SEQ ID NO: 7122618 - DNA, 22 bp, Homo sapiens
agggagaaaattggatgcacaa

SEQ ID NO: 7122619 - DNA, 22 bp, Homo sapiens
agggagaacagttgcagcagac

SEQ ID NO: 7122620 - DNA, 22 bp, Homo sapiens
agggagaacagttgcagcagac

SEQ ID NO: 7122621 - DNA, 22 bp, Homo sapiens
agggagaacagttgcagcagac

SEQ ID NO: 7122622 - DNA, 22 bp, Homo sapiens
agggagaacagttgcagcagac

SEQ ID NO: 7122623 - DNA, 22 bp, Homo sapiens
agggagaacagttgcagcagac

SEQ ID NO: 7122624 - DNA, 22 bp, Homo sapiens
agggagaacagttgcagcagac

SEQ ID NO: 7122625 - DNA, 22 bp, Homo sapiens
agggagaagagaacaaagccct

SEQ ID NO: 7122626 - DNA, 22 bp, Homo sapiens
agggagaagagaacaaagccct

SEQ ID NO: 7122627 - DNA, 22 bp, Homo sapiens
agggagtggttaagaaggtgca

SEQ ID NO: 7122628 - DNA, 22 bp, Homo sapiens
agggagtggttaagaaggtgca

SEQ ID NO: 7122629 - DNA, 22 bp, Homo sapiens
agggagtggttaagaaggtgca

SEQ ID NO: 7122630 - DNA, 22 bp, Homo sapiens
agggagtgtaaatggtgctcag

SEQ ID NO: 7122631 - DNA, 22 bp, Homo sapiens
agggagtgtaaatggtgctcag

SEQ ID NO: 7122632 - DNA, 22 bp, Homo sapiens
agggagtctggcagtctaagag

SEQ ID NO: 7122633 - DNA, 22 bp, Homo sapiens
agggagtctggtagtctaagtg

SEQ ID NO: 7122634 - DNA, 22 bp, Homo sapiens
agggagtggttaagaaggtgca

SEQ ID NO: 7122635 - DNA, 22 bp, Homo sapiens
agggagtggttaagaaggtgca

SEQ ID NO: 7122636 - DNA, 17 bp, Homo sapiens
agggagtcagtaggagc

SEQ ID NO: 7122637 - DNA, 22 bp, Homo sapiens
agggagtccattttagaggtgg

SEQ ID NO: 7122638 - DNA, 22 bp, Homo sapiens
agggagtctagttgatgtggaa

SEQ ID NO: 7122639 - DNA, 21 bp, Homo sapiens
agggagtctggaggaagcgtt

SEQ ID NO: 7122640 - DNA, 22 bp, Homo sapiens
agggagaaggtttagctgtgag

SEQ ID NO: 7122641 - DNA, 22 bp, Homo sapiens
agggagaaggtttagctgtgag

SEQ ID NO: 7122642 - DNA, 22 bp, Homo sapiens
agggagaaggtccatgcctgtc

SEQ ID NO: 7122643 - DNA, 22 bp, Homo sapiens
agggagaaggtccatgcctgtc

SEQ ID NO: 7122644 - DNA, 22 bp, Homo sapiens
agggagaaggtttagctgtgag

SEQ ID NO: 7122645 - DNA, 22 bp, Homo sapiens
agggaggagtcctcaaagtcat

SEQ ID NO: 7122646 - DNA, 22 bp, Homo sapiens
agggaggagtcctcaaagtcat

SEQ ID NO: 7122647 - DNA, 22 bp, Homo sapiens
agggaggagtcctcaaagtcat

SEQ ID NO: 7122648 - DNA, 20 bp, Homo sapiens
agggaacaatggacgctgtc

SEQ ID NO: 7122649 - DNA, 22 bp, Homo sapiens
agggaaattaatgtgagcaatg

SEQ ID NO: 7122650 - DNA, 22 bp, Homo sapiens
agggaacagtgaaaggcatcag

SEQ ID NO: 7122651 - DNA, 22 bp, Homo sapiens
agggaacagtgaaaggcatcag

SEQ ID NO: 7122652 - DNA, 22 bp, Homo sapiens
agggaacccaactgactgacag

SEQ ID NO: 7122653 - DNA, 22 bp, Homo sapiens
agggaacccaactgactgacag

SEQ ID NO: 7122654 - DNA, 22 bp, Homo sapiens
agggaactccatgaggccagag

SEQ ID NO: 7122655 - DNA, 22 bp, Homo sapiens
agggaacagtgaaaggcatcag

SEQ ID NO: 7122656 - DNA, 22 bp, Homo sapiens
agggaacagtgaaaggcatcag

SEQ ID NO: 7122657 - DNA, 22 bp, Homo sapiens
agggaaatggagagtgtagttt

SEQ ID NO: 7122658 - DNA, 22 bp, Homo sapiens
agggaaatctttcaacacttca

SEQ ID NO: 7122659 - DNA, 22 bp, Homo sapiens
cccaggatggggctgcagttat

SEQ ID NO: 7122660 - DNA, 22 bp, Homo sapiens
agggaaataatctattctgagg

SEQ ID NO: 7122661 - DNA, 23 bp, Homo sapiens
agggaaatactgcaatttttgga

SEQ ID NO: 7122662 - DNA, 21 bp, Homo sapiens
agggaaatccagtcacttttc

SEQ ID NO: 7122663 - DNA, 21 bp, Homo sapiens
agggaaatccagtcacttttc

SEQ ID NO: 7122664 - DNA, 22 bp, Homo sapiens
agggaaatctcagctctaaaat

SEQ ID NO: 7122665 - DNA, 23 bp, Homo sapiens
cccaggagtttcactgcaaaggt

SEQ ID NO: 7122666 - DNA, 23 bp, Homo sapiens
cccaggagtttcactgcaaaggt

SEQ ID NO: 7122667 - DNA, 22 bp, Homo sapiens
cccaggagtttgagttcagcat

SEQ ID NO: 7122668 - DNA, 23 bp, Homo sapiens
cccaggagtttcactgcaaaggt

SEQ ID NO: 7122669 - DNA, 22 bp, Homo sapiens
cccaggagtttgagttcagcat

SEQ ID NO: 7122670 - DNA, 20 bp, Homo sapiens
cccaggagtttgctcttact

SEQ ID NO: 7122671 - DNA, 22 bp, Homo sapiens
cccaggatcacctggtcaaggg

SEQ ID NO: 7122672 - DNA, 22 bp, Homo sapiens
cccaggatgatcgagagtggga

SEQ ID NO: 7122673 - DNA, 23 bp, Homo sapiens
cccaggagtttcactgcaaaggt

SEQ ID NO: 7122674 - DNA, 23 bp, Homo sapiens
cccaggagtttcactgcaaaggt

SEQ ID NO: 7122675 - DNA, 22 bp, Homo sapiens
cccaggagttggaggctgcagt

SEQ ID NO: 7122676 - DNA, 22 bp, Homo sapiens
cccaggagttggaggctgcagt

SEQ ID NO: 7122677 - DNA, 23 bp, Homo sapiens
cccaggagtttcactgcaaaggt

SEQ ID NO: 7122678 - DNA, 22 bp, Homo sapiens
cccaggagttggaggctgcagt

SEQ ID NO: 7122679 - DNA, 22 bp, Homo sapiens
cccaggagttggaggctgcagt

SEQ ID NO: 7122680 - DNA, 22 bp, Homo sapiens
cccaggagttggaggctgcagt

SEQ ID NO: 7122681 - DNA, 22 bp, Homo sapiens
cccaggagttggaggctgcagt

SEQ ID NO: 7122682 - DNA, 22 bp, Homo sapiens
cccaggagttggaggctgcagt

SEQ ID NO: 7122683 - DNA, 22 bp, Homo sapiens
cccagggctgcagatggaggct

SEQ ID NO: 7122684 - DNA, 22 bp, Homo sapiens
cccagggctgcagatggaggct

SEQ ID NO: 7122685 - DNA, 22 bp, Homo sapiens
cccagggctgcagatggaggct

SEQ ID NO: 7122686 - DNA, 21 bp, Homo sapiens
cccagggaagccgcagtcacc

SEQ ID NO: 7122687 - DNA, 22 bp, Homo sapiens
cccagggccctggacagctaca

SEQ ID NO: 7122688 - DNA, 21 bp, Homo sapiens
cccagggaagccgcagtcacc

SEQ ID NO: 7122689 - DNA, 23 bp, Homo sapiens
agggaagaaacatgaagggctgt

SEQ ID NO: 7122690 - DNA, 23 bp, Homo sapiens
agggaagaaacatgaagggctgt

SEQ ID NO: 7122691 - DNA, 22 bp, Homo sapiens
agggaagaagctggtagtaggt

SEQ ID NO: 7122692 - DNA, 22 bp, Homo sapiens
agggaagaaaatccatcgctgc

SEQ ID NO: 7122693 - DNA, 22 bp, Homo sapiens
agggaagaaaatccatcgctgc

SEQ ID NO: 7122694 - DNA, 23 bp, Homo sapiens
agggaagaaacatgaagggctgt

SEQ ID NO: 7122695 - DNA, 23 bp, Homo sapiens
agggaagaaacatgaagggctgt

SEQ ID NO: 7122696 - DNA, 23 bp, Homo sapiens
agggaagaaacatgaagggctgt

SEQ ID NO: 7122697 - DNA, 22 bp, Homo sapiens
cccagggcttttctcactagac

SEQ ID NO: 7122698 - DNA, 22 bp, Homo sapiens
cccagggcttttctcactagac

SEQ ID NO: 7122699 - DNA, 22 bp, Homo sapiens
cccagggctgtagaatgtccaa

SEQ ID NO: 7122700 - DNA, 22 bp, Homo sapiens
cccagggctgtagaatgtccaa

SEQ ID NO: 7122701 - DNA, 22 bp, Homo sapiens
cccagggcttgagtcatccatg

SEQ ID NO: 7122702 - DNA, 22 bp, Homo sapiens
cccagggcttgagtcatccatg

SEQ ID NO: 7122703 - DNA, 22 bp, Homo sapiens
cccaggggaggtcctcagggaa

SEQ ID NO: 7122704 - DNA, 22 bp, Homo sapiens
cccaggggtaaggcgcagcgtg

SEQ ID NO: 7122705 - DNA, 22 bp, Homo sapiens
aggcttctggaatccagtttct

SEQ ID NO: 7122706 - DNA, 22 bp, Homo sapiens
aggcttctctgcaagatgttaa

SEQ ID NO: 7122707 - DNA, 22 bp, Homo sapiens
aggcttctgctgatatttcatt

SEQ ID NO: 7122708 - DNA, 19 bp, Homo sapiens
aggcttctaccctgtccag

SEQ ID NO: 7122709 - DNA, 22 bp, Homo sapiens
aggcttctagggttggcagcgg

SEQ ID NO: 7122710 - DNA, 22 bp, Homo sapiens
aggcttctccacataaagttac

SEQ ID NO: 7122711 - DNA, 22 bp, Homo sapiens
aggctggctgagctgcagcctg

SEQ ID NO: 7122712 - DNA, 22 bp, Homo sapiens
aggctggctgagctgcagcctg

SEQ ID NO: 7122713 - DNA, 22 bp, Homo sapiens
aggctggctgagctgcagcctg

SEQ ID NO: 7122714 - DNA, 22 bp, Homo sapiens
aggctggctggcaggggacaca

SEQ ID NO: 7122715 - DNA, 22 bp, Homo sapiens
aggctggctggcaggggacaca

SEQ ID NO: 7122716 - DNA, 22 bp, Homo sapiens
aggctggctggcaggggacaca

SEQ ID NO: 7122717 - DNA, 22 bp, Homo sapiens
aggctggctgacttctgaagca

SEQ ID NO: 7122718 - DNA, 22 bp, Homo sapiens
aggctggctgagctgcagcctg

SEQ ID NO: 7122719 - DNA, 22 bp, Homo sapiens
aggcttcactcgacatgccaat

SEQ ID NO: 7122720 - DNA, 22 bp, Homo sapiens
aggcttcctggaggaagaggta

SEQ ID NO: 7122721 - DNA, 22 bp, Homo sapiens
aggcttcctggaggaagaggta

SEQ ID NO: 7122722 - DNA, 22 bp, Homo sapiens
aggcttcttgggcttcattctg

SEQ ID NO: 7122723 - DNA, 22 bp, Homo sapiens
aggcttgcaatggacacatgtg

SEQ ID NO: 7122724 - DNA, 19 bp, Homo sapiens
aggcttggaacagccttat

SEQ ID NO: 7122725 - DNA, 22 bp, Homo sapiens
aggcttcttgataaaatgcaga

SEQ ID NO: 7122726 - DNA, 22 bp, Homo sapiens
aggcttcttctgcctgtctttg

SEQ ID NO: 7122727 - DNA, 22 bp, Homo sapiens
aggcttcttcttcctatttagt

SEQ ID NO: 7122728 - DNA, 21 bp, Homo sapiens
aggcttggatctagacaggcc

SEQ ID NO: 7122729 - DNA, 21 bp, Homo sapiens
aggcttggatagatattcata

SEQ ID NO: 7122730 - DNA, 21 bp, Homo sapiens
aggcttggatctagacaggcc

SEQ ID NO: 7122731 - DNA, 21 bp, Homo sapiens
aggcttggatctagacaggcc

SEQ ID NO: 7122732 - DNA, 21 bp, Homo sapiens
aggcttggatctagacaggcc

SEQ ID NO: 7122733 - DNA, 21 bp, Homo sapiens
aggcttggatctagacaggcc

SEQ ID NO: 7122734 - DNA, 22 bp, Homo sapiens
cccaggaggtggagcttgcagt

SEQ ID NO: 7122735 - DNA, 22 bp, Homo sapiens
cccaggaggtggagcttgcagt

SEQ ID NO: 7122736 - DNA, 22 bp, Homo sapiens
cccaggaggtggagcttgcagt

SEQ ID NO: 7122737 - DNA, 22 bp, Homo sapiens
cccaggagttggaggctacggt

SEQ ID NO: 7122738 - DNA, 22 bp, Homo sapiens
cccaggagttggaggctgcagt

SEQ ID NO: 7122739 - DNA, 22 bp, Homo sapiens
cccaggagttggaggctacggt

SEQ ID NO: 7122740 - DNA, 22 bp, Homo sapiens
cccaggagttggaggctacggt

SEQ ID NO: 7122741 - DNA, 22 bp, Homo sapiens
cccaggagttggaggctacggt

SEQ ID NO: 7122742 - DNA, 22 bp, Homo sapiens
aggcaggggagctggaagggta

SEQ ID NO: 7122743 - DNA, 22 bp, Homo sapiens
aggcaggggagctggaagggta

SEQ ID NO: 7122744 - DNA, 22 bp, Homo sapiens
aggcaggggagctggaagggta

SEQ ID NO: 7122745 - DNA, 22 bp, Homo sapiens
aggcaggggagctggaagggta

SEQ ID NO: 7122746 - DNA, 22 bp, Homo sapiens
aggcaggggagctggaagggta

SEQ ID NO: 7122747 - DNA, 22 bp, Homo sapiens
aggcaggggagctggaagggta

SEQ ID NO: 7122748 - DNA, 22 bp, Homo sapiens
aggcaggggagctggaagggta

SEQ ID NO: 7122749 - DNA, 22 bp, Homo sapiens
aggcaggggagctggaagggta

SEQ ID NO: 7122750 - DNA, 22 bp, Homo sapiens
aggcaggggagctggaagggta

SEQ ID NO: 7122751 - DNA, 22 bp, Homo sapiens
aggcagggtcttgctatgttgc

SEQ ID NO: 7122752 - DNA, 22 bp, Homo sapiens
aggcagggtcttgctatgttgc

SEQ ID NO: 7122753 - DNA, 22 bp, Homo sapiens
aggcaggggagctggaagggta

SEQ ID NO: 7122754 - DNA, 22 bp, Homo sapiens
aggcagggtcttgctatgttgc

SEQ ID NO: 7122755 - DNA, 22 bp, Homo sapiens
aggcaggggagctggaagggta

SEQ ID NO: 7122756 - DNA, 22 bp, Homo sapiens
aggcaggggagctggaagggta

SEQ ID NO: 7122757 - DNA, 22 bp, Homo sapiens
aggcaggggagctggaagggta

SEQ ID NO: 7122758 - DNA, 22 bp, Homo sapiens
aggcagggtcttgctatgttgc

SEQ ID NO: 7122759 - DNA, 22 bp, Homo sapiens
aggcagggtgatgataatgatt

SEQ ID NO: 7122760 - DNA, 22 bp, Homo sapiens
aggcagggtgatgataatgatt

SEQ ID NO: 7122761 - DNA, 22 bp, Homo sapiens
aggcagggtgatgataatgatt

SEQ ID NO: 7122762 - DNA, 22 bp, Homo sapiens
aggcagggtgatgataatgatt

SEQ ID NO: 7122763 - DNA, 22 bp, Homo sapiens
aggcagggtgatgataatgatt

SEQ ID NO: 7122764 - DNA, 17 bp, Homo sapiens
aggcaggtaagagttat

SEQ ID NO: 7122765 - DNA, 22 bp, Homo sapiens
aggcagggtgatgataatgatt

SEQ ID NO: 7122766 - DNA, 22 bp, Homo sapiens
aggcagggtgatgataatgatt

SEQ ID NO: 7122767 - DNA, 22 bp, Homo sapiens
aggcagggtgatgataatgatt

SEQ ID NO: 7122768 - DNA, 17 bp, Homo sapiens
aggcaggtaagagttat

SEQ ID NO: 7122769 - DNA, 22 bp, Homo sapiens
ccacagctgaccgcaggtgagc

SEQ ID NO: 7122770 - DNA, 22 bp, Homo sapiens
ccacagctgaccgcaggtgagc

SEQ ID NO: 7122771 - DNA, 22 bp, Homo sapiens
ccacagctgaccgcaggtgagc

SEQ ID NO: 7122772 - DNA, 22 bp, Homo sapiens
ccacagctgaccgcaggtgagc

SEQ ID NO: 7122773 - DNA, 17 bp, Homo sapiens
ccacagctgggtgcctt

SEQ ID NO: 7122774 - DNA, 17 bp, Homo sapiens
ccacagctgggtgcctt

SEQ ID NO: 7122775 - DNA, 21 bp, Homo sapiens
ccacagctggtctctgagccc

SEQ ID NO: 7122776 - DNA, 21 bp, Homo sapiens
ccacagctggtctctgagccc

SEQ ID NO: 7122777 - DNA, 22 bp, Homo sapiens
ccacaggacagttaatgtgcag

SEQ ID NO: 7122778 - DNA, 22 bp, Homo sapiens
ccacaggacagttaatgtgcag

SEQ ID NO: 7122779 - DNA, 22 bp, Homo sapiens
ccagagagtatcatggagagta

SEQ ID NO: 7122780 - DNA, 22 bp, Homo sapiens
ccagagagtatcatggagagta

SEQ ID NO: 7122781 - DNA, 17 bp, Homo sapiens
ccagagagtagttagga

SEQ ID NO: 7122782 - DNA, 22 bp, Homo sapiens
ccagagagtatcatggagagta

SEQ ID NO: 7122783 - DNA, 22 bp, Homo sapiens
ccagagagtatcatggagagta

SEQ ID NO: 7122784 - DNA, 22 bp, Homo sapiens
ccagagagtcgatgggggacac

SEQ ID NO: 7122785 - DNA, 22 bp, Homo sapiens
ccagagagtatcatggagagta

SEQ ID NO: 7122786 - DNA, 22 bp, Homo sapiens
ccagagagtatcatggagagta

SEQ ID NO: 7122787 - DNA, 22 bp, Homo sapiens
ccagagagtcgatgggggacac

SEQ ID NO: 7122788 - DNA, 22 bp, Homo sapiens
ccagagagtcgatgggggacac

SEQ ID NO: 7122789 - DNA, 22 bp, Homo sapiens
ccagagaggggaagggcttgcc

SEQ ID NO: 7122790 - DNA, 22 bp, Homo sapiens
ccagagaggtagcttaccctct

SEQ ID NO: 7122791 - DNA, 22 bp, Homo sapiens
ccagagaggtagcttaccctct

SEQ ID NO: 7122792 - DNA, 20 bp, Homo sapiens
ccagagagtaggttagtgat

SEQ ID NO: 7122793 - DNA, 22 bp, Homo sapiens
ccagagagtaaacattttccgg

SEQ ID NO: 7122794 - DNA, 22 bp, Homo sapiens
ccagagagtaaacattttccgg

SEQ ID NO: 7122795 - DNA, 22 bp, Homo sapiens
ccagagagtaggaggcattatt

SEQ ID NO: 7122796 - DNA, 22 bp, Homo sapiens
ccagagagtaggaggcattatt

SEQ ID NO: 7122797 - DNA, 23 bp, Homo sapiens
ccacaggagggttcatttattca

SEQ ID NO: 7122798 - DNA, 20 bp, Homo sapiens
ccacaggagtccagtcgacc

SEQ ID NO: 7122799 - DNA, 22 bp, Homo sapiens
ccacaggaggaacaattagatg

SEQ ID NO: 7122800 - DNA, 22 bp, Homo sapiens
ccacaggaggaacaattagatg

SEQ ID NO: 7122801 - DNA, 22 bp, Homo sapiens
ccacaggaggaacaattagatg

SEQ ID NO: 7122802 - DNA, 22 bp, Homo sapiens
ccacaggaggaacaattagatg

SEQ ID NO: 7122803 - DNA, 22 bp, Homo sapiens
ccacaggaggatgttcagacaa

SEQ ID NO: 7122804 - DNA, 22 bp, Homo sapiens
ccacaggacggaggtctggccg

SEQ ID NO: 7122805 - DNA, 22 bp, Homo sapiens
ccacaggaccagaggagatcac

SEQ ID NO: 7122806 - DNA, 22 bp, Homo sapiens
ccacaggacggaggtctggccg

SEQ ID NO: 7122807 - DNA, 20 bp, Homo sapiens
ccacaggagtccagtcgacc

SEQ ID NO: 7122808 - DNA, 22 bp, Homo sapiens
ccacaggatccaagggaaggca

SEQ ID NO: 7122809 - DNA, 22 bp, Homo sapiens
ccacaggatccaagggaaggca

SEQ ID NO: 7122810 - DNA, 23 bp, Homo sapiens
ccacaggcacagaggcttgcatc

SEQ ID NO: 7122811 - DNA, 22 bp, Homo sapiens
ccagagagggcgccacctggag

SEQ ID NO: 7122812 - DNA, 22 bp, Homo sapiens
ccagagagggcgccacctggag

SEQ ID NO: 7122813 - DNA, 22 bp, Homo sapiens
aggcatgcgccaatttattaga

SEQ ID NO: 7122814 - DNA, 21 bp, Homo sapiens
aggcatggaaatggcacactg

SEQ ID NO: 7122815 - DNA, 20 bp, Homo sapiens
ccagagcagccactgaagtt

SEQ ID NO: 7122816 - DNA, 20 bp, Homo sapiens
ccagagcagccactgaagtt

SEQ ID NO: 7122817 - DNA, 21 bp, Homo sapiens
aggcatggaaatggcacactg

SEQ ID NO: 7122818 - DNA, 21 bp, Homo sapiens
aggcatggaaatggcacactg

SEQ ID NO: 7122819 - DNA, 22 bp, Homo sapiens
aggcatggatggatccagggct

SEQ ID NO: 7122820 - DNA, 22 bp, Homo sapiens
aggcatggatggatccagggct

SEQ ID NO: 7122821 - DNA, 22 bp, Homo sapiens
aggcatggatggatccagggct

SEQ ID NO: 7122822 - DNA, 22 bp, Homo sapiens
aggcatggacatttcggcagct

SEQ ID NO: 7122823 - DNA, 22 bp, Homo sapiens
aggcatggacatttcggcagct

SEQ ID NO: 7122824 - DNA, 22 bp, Homo sapiens
aggcatggacatttcggcagct

SEQ ID NO: 7122825 - DNA, 22 bp, Homo sapiens
ccagagatgctcagggtttgca

SEQ ID NO: 7122826 - DNA, 22 bp, Homo sapiens
ccagagatggacagggaatttg

SEQ ID NO: 7122827 - DNA, 22 bp, Homo sapiens
ccagagatgttcacattctaat

SEQ ID NO: 7122828 - DNA, 23 bp, Homo sapiens
ccagagattgttacacagtaggc

SEQ ID NO: 7122829 - DNA, 22 bp, Homo sapiens
ccagagcaattctcacagaact

SEQ ID NO: 7122830 - DNA, 22 bp, Homo sapiens
ccagagcagaaccggaacacca

SEQ ID NO: 7122831 - DNA, 22 bp, Homo sapiens
ccagagcaattctcacagaact

SEQ ID NO: 7122832 - DNA, 22 bp, Homo sapiens
ccagagcagatgtggccttggt

SEQ ID NO: 7122833 - DNA, 22 bp, Homo sapiens
aggcatggatgtagcagtgacc

SEQ ID NO: 7122834 - DNA, 22 bp, Homo sapiens
aggcatggatgtagcagtgacc

SEQ ID NO: 7122835 - DNA, 22 bp, Homo sapiens
aggcatggatgtagcagtgacc

SEQ ID NO: 7122836 - DNA, 22 bp, Homo sapiens
aggcatggatgtagcagtgacc

SEQ ID NO: 7122837 - DNA, 22 bp, Homo sapiens
aggcatggatgtagcagtgacc

SEQ ID NO: 7122838 - DNA, 22 bp, Homo sapiens
aggcatggatgtagcagtgacc

SEQ ID NO: 7122839 - DNA, 22 bp, Homo sapiens
aggcatggcactgagcagcttc

SEQ ID NO: 7122840 - DNA, 22 bp, Homo sapiens
aggcatggcactgagcagcttc

SEQ ID NO: 7122841 - DNA, 22 bp, Homo sapiens
aggcatggcactgagcagcttc

SEQ ID NO: 7122842 - DNA, 22 bp, Homo sapiens
aggcatggcactgagcagcttc

SEQ ID NO: 7122843 - DNA, 22 bp, Homo sapiens
aggcatggcactgagcagcttc

SEQ ID NO: 7122844 - DNA, 22 bp, Homo sapiens
aggcatggcactgagcagcttc

SEQ ID NO: 7122845 - DNA, 22 bp, Homo sapiens
aggcatggcactgagcagcttc

SEQ ID NO: 7122846 - DNA, 23 bp, Homo sapiens
aggcatggcatggatggtggctc

SEQ ID NO: 7122847 - DNA, 22 bp, Homo sapiens
ccagagtctttatattcctgaa

SEQ ID NO: 7122848 - DNA, 23 bp, Homo sapiens
aggcatggcatggatggtggctc

SEQ ID NO: 7122849 - DNA, 22 bp, Homo sapiens
aggcatggcatggggcagatgt

SEQ ID NO: 7122850 - DNA, 22 bp, Homo sapiens
aggcatggcatggggcagatgt

SEQ ID NO: 7122851 - DNA, 22 bp, Homo sapiens
ccagcagacacacaggcgtggg

SEQ ID NO: 7122852 - DNA, 22 bp, Homo sapiens
ccagcagaagctcccgctgggt

SEQ ID NO: 7122853 - DNA, 22 bp, Homo sapiens
ccagcagaagctcccgctgggt

SEQ ID NO: 7122854 - DNA, 19 bp, Homo sapiens
ccagcagaagccactcctg

SEQ ID NO: 7122855 - DNA, 22 bp, Homo sapiens
ccagcactgttctaaggaaaca

SEQ ID NO: 7122856 - DNA, 19 bp, Homo sapiens
ccagcagaagccactcctg

SEQ ID NO: 7122857 - DNA, 19 bp, Homo sapiens
ccagagttcttgccattct

SEQ ID NO: 7122858 - DNA, 22 bp, Homo sapiens
ccagagtgacgtgaagtgtgaa

SEQ ID NO: 7122859 - DNA, 22 bp, Homo sapiens
ccagcactgctctcagactgag

SEQ ID NO: 7122860 - DNA, 22 bp, Homo sapiens
ccagcactgttctaaggaaaca

SEQ ID NO: 7122861 - DNA, 22 bp, Homo sapiens
ccagcactgttctaaggaaaca

SEQ ID NO: 7122862 - DNA, 22 bp, Homo sapiens
ccagcagagcatggggaggaag

SEQ ID NO: 7122863 - DNA, 22 bp, Homo sapiens
ccagcagagctcaaacttcctg

SEQ ID NO: 7122864 - DNA, 22 bp, Homo sapiens
ccagcagagcatggggaggaag

SEQ ID NO: 7122865 - DNA, 19 bp, Homo sapiens
ccagcagacacagctgccc

SEQ ID NO: 7122866 - DNA, 19 bp, Homo sapiens
ccagcagacacagctgccc

SEQ ID NO: 7122867 - DNA, 22 bp, Homo sapiens
ccagcagagctggaagtgtgct

SEQ ID NO: 7122868 - DNA, 22 bp, Homo sapiens
ccagcagagggcgcttcacacc

SEQ ID NO: 7122869 - DNA, 22 bp, Homo sapiens
ccagcagagggcgcttcacacc

SEQ ID NO: 7122870 - DNA, 22 bp, Homo sapiens
ccagcagagggcgcttcacacc

SEQ ID NO: 7122871 - DNA, 22 bp, Homo sapiens
ccagcagaggggcggagtgcag

SEQ ID NO: 7122872 - DNA, 22 bp, Homo sapiens
ccagcagaggggcggagtgcag

SEQ ID NO: 7122873 - DNA, 22 bp, Homo sapiens
aggccagaaatgtcagggagtg

SEQ ID NO: 7122874 - DNA, 22 bp, Homo sapiens
aggccagaaatttggagtatgt

SEQ ID NO: 7122875 - DNA, 22 bp, Homo sapiens
aggccagaaatttggagtatgt

SEQ ID NO: 7122876 - DNA, 22 bp, Homo sapiens
aggccagaacagctctgcacca

SEQ ID NO: 7122877 - DNA, 22 bp, Homo sapiens
aggccagacagctagaaacagg

SEQ ID NO: 7122878 - DNA, 22 bp, Homo sapiens
aggccagacagctagaaacagg

SEQ ID NO: 7122879 - DNA, 22 bp, Homo sapiens
aggccagacagctagaaacagg

SEQ ID NO: 7122880 - DNA, 22 bp, Homo sapiens
aggccagactttggccaaatcc

SEQ ID NO: 7122881 - DNA, 22 bp, Homo sapiens
ccagcctcatcgcctgcctgtc

SEQ ID NO: 7122882 - DNA, 22 bp, Homo sapiens
ccagcctcatcatattcctgct

SEQ ID NO: 7122883 - DNA, 22 bp, Homo sapiens
ccagcctcatcgcctgcctgtc

SEQ ID NO: 7122884 - DNA, 22 bp, Homo sapiens
ccagcctcatcgcctgcctgtc

SEQ ID NO: 7122885 - DNA, 22 bp, Homo sapiens
aggccagatgtcgggctagaag

SEQ ID NO: 7122886 - DNA, 22 bp, Homo sapiens
aggccagatgtcgggctagaag

SEQ ID NO: 7122887 - DNA, 22 bp, Homo sapiens
aggccagatgtcgggctagaag

SEQ ID NO: 7122888 - DNA, 22 bp, Homo sapiens
ccagccctgccagagagagctg

SEQ ID NO: 7122889 - DNA, 22 bp, Homo sapiens
aggccagagaggggaccagcct

SEQ ID NO: 7122890 - DNA, 22 bp, Homo sapiens
aggccagagttaaggagaacag

SEQ ID NO: 7122891 - DNA, 22 bp, Homo sapiens
aggccagagttaaggagaacag

SEQ ID NO: 7122892 - DNA, 22 bp, Homo sapiens
aggccagagttaaggagaacag

SEQ ID NO: 7122893 - DNA, 22 bp, Homo sapiens
aggccagatattgtgctaccca

SEQ ID NO: 7122894 - DNA, 17 bp, Homo sapiens
aggccagatgaggcaag

SEQ ID NO: 7122895 - DNA, 17 bp, Homo sapiens
aggccagatgaggcaag

SEQ ID NO: 7122896 - DNA, 17 bp, Homo sapiens
aggccagatgaggcaag

SEQ ID NO: 7122897 - DNA, 17 bp, Homo sapiens
aggccagatgaggcaag

SEQ ID NO: 7122898 - DNA, 23 bp, Homo sapiens
ccagcctctgggtcttcatccag

SEQ ID NO: 7122899 - DNA, 22 bp, Homo sapiens
ccagcctgaaatgcctcatcct

SEQ ID NO: 7122900 - DNA, 22 bp, Homo sapiens
ccagcctgaaatgcctcatcct

SEQ ID NO: 7122901 - DNA, 22 bp, Homo sapiens
ccagcctgaaatgcctcatcct

SEQ ID NO: 7122902 - DNA, 19 bp, Homo sapiens
ccagcctctcttccacccc

SEQ ID NO: 7122903 - DNA, 19 bp, Homo sapiens
ccagcctctcttccacccc

SEQ ID NO: 7122904 - DNA, 22 bp, Homo sapiens
ccagcctgaaatgcctcatcct

SEQ ID NO: 7122905 - DNA, 22 bp, Homo sapiens
ccagcctgaaatgcctcatcct

SEQ ID NO: 7122906 - DNA, 22 bp, Homo sapiens
ccagcctgaaatgcctcatcct

SEQ ID NO: 7122907 - DNA, 22 bp, Homo sapiens
ccagcctccatgtagatagctg

SEQ ID NO: 7122908 - DNA, 22 bp, Homo sapiens
ccagcctccatgtagatagctg

SEQ ID NO: 7122909 - DNA, 22 bp, Homo sapiens
ccagcctccatgtagatagctg

SEQ ID NO: 7122910 - DNA, 22 bp, Homo sapiens
ccagcctccatgtagatagctg

SEQ ID NO: 7122911 - DNA, 22 bp, Homo sapiens
ccagcctcatcgcctgcctgtc

SEQ ID NO: 7122912 - DNA, 22 bp, Homo sapiens
ccagcctccatgtagatagctg

SEQ ID NO: 7122913 - DNA, 22 bp, Homo sapiens
ccagcctccatgtagatagctg

SEQ ID NO: 7122914 - DNA, 22 bp, Homo sapiens
ccagcctccatgtagatagctg

SEQ ID NO: 7122915 - DNA, 22 bp, Homo sapiens
ccagcctccatgtagatagctg

SEQ ID NO: 7122916 - DNA, 22 bp, Homo sapiens
ccagcctccatgtagatagctg

SEQ ID NO: 7122917 - DNA, 19 bp, Homo sapiens
ccagcctctcttccacccc

SEQ ID NO: 7122918 - DNA, 22 bp, Homo sapiens
ccagctttaggttgcctgccag

SEQ ID NO: 7122919 - DNA, 22 bp, Homo sapiens
ccagctttatagcttcaaagga

SEQ ID NO: 7122920 - DNA, 22 bp, Homo sapiens
ccagctttatagcttcaaagga

SEQ ID NO: 7122921 - DNA, 22 bp, Homo sapiens
ccagcttggagtaacaaatggt

SEQ ID NO: 7122922 - DNA, 22 bp, Homo sapiens
ccagctttatagcttcaaagga

SEQ ID NO: 7122923 - DNA, 22 bp, Homo sapiens
ccagctttatcaagtctgagct

SEQ ID NO: 7122924 - DNA, 22 bp, Homo sapiens
ccagctttcatatcatgaggta

SEQ ID NO: 7122925 - DNA, 22 bp, Homo sapiens
ccagctttcatatcatgaggta

SEQ ID NO: 7122926 - DNA, 22 bp, Homo sapiens
ccagctttcatatcatgaggta

SEQ ID NO: 7122927 - DNA, 22 bp, Homo sapiens
ccagctttccagggttgactgg

SEQ ID NO: 7122928 - DNA, 21 bp, Homo sapiens
ccagctttcccaagtcccttt

SEQ ID NO: 7122929 - DNA, 22 bp, Homo sapiens
aggcccagctggacaaactgct

SEQ ID NO: 7122930 - DNA, 22 bp, Homo sapiens
aggcccagctggacaaactgct

SEQ ID NO: 7122931 - DNA, 19 bp, Homo sapiens
ccagctggcctgggacctc

SEQ ID NO: 7122932 - DNA, 19 bp, Homo sapiens
ccagctggcctgggacctc

SEQ ID NO: 7122933 - DNA, 19 bp, Homo sapiens
ccagctggcctgggacctc

SEQ ID NO: 7122934 - DNA, 19 bp, Homo sapiens
ccagctggcctgggacctc

SEQ ID NO: 7122935 - DNA, 19 bp, Homo sapiens
ccagctggcctgggacctc

SEQ ID NO: 7122936 - DNA, 22 bp, Homo sapiens
ccagcttctctctgatgcagct

SEQ ID NO: 7122937 - DNA, 22 bp, Homo sapiens
ccagcttctctctgatgcagct

SEQ ID NO: 7122938 - DNA, 22 bp, Homo sapiens
ccagcttctctctgatgcagct

SEQ ID NO: 7122939 - DNA, 22 bp, Homo sapiens
ccagcttctctgttccagcccc

SEQ ID NO: 7122940 - DNA, 22 bp, Homo sapiens
ccagcttctctgttccagcccc

SEQ ID NO: 7122941 - DNA, 22 bp, Homo sapiens
ccagcctggactgggtcttgtg

SEQ ID NO: 7122942 - DNA, 22 bp, Homo sapiens
ccagcctggactgggtcttgtg

SEQ ID NO: 7122943 - DNA, 22 bp, Homo sapiens
aggcccagagagccagttagtg

SEQ ID NO: 7122944 - DNA, 22 bp, Homo sapiens
aggcccagagagccagttagtg

SEQ ID NO: 7122945 - DNA, 22 bp, Homo sapiens
aggcccagagcaggaaagggtt

SEQ ID NO: 7122946 - DNA, 22 bp, Homo sapiens
aggcccagagcaggaaagggtt

SEQ ID NO: 7122947 - DNA, 22 bp, Homo sapiens
aggcccagagcaggaaagggtt

SEQ ID NO: 7122948 - DNA, 21 bp, Homo sapiens
aggcccagagtcttgggggga

SEQ ID NO: 7122949 - DNA, 22 bp, Homo sapiens
aggcccagcccgtcctcgtgct

SEQ ID NO: 7122950 - DNA, 22 bp, Homo sapiens
aggcccagcccgtcctcgtgct

SEQ ID NO: 7122951 - DNA, 22 bp, Homo sapiens
aggcccagcccgtcctcgtgct

SEQ ID NO: 7122952 - DNA, 22 bp, Homo sapiens
aggcccagcccgtcctcgtgct

SEQ ID NO: 7122953 - DNA, 19 bp, Homo sapiens
aggcccagcgctgggggct

SEQ ID NO: 7122954 - DNA, 19 bp, Homo sapiens
aggcccagcgctgggggct

SEQ ID NO: 7122955 - DNA, 19 bp, Homo sapiens
aggcccagcgctgggggct

SEQ ID NO: 7122956 - DNA, 19 bp, Homo sapiens
aggcccagcgctgggggct

SEQ ID NO: 7122957 - DNA, 22 bp, Homo sapiens
aggcccagctggacaaactgct

SEQ ID NO: 7122958 - DNA, 22 bp, Homo sapiens
aggcccagctggacaaactgct

SEQ ID NO: 7122959 - DNA, 22 bp, Homo sapiens
aggccctgggcagttctgtagc

SEQ ID NO: 7122960 - DNA, 22 bp, Homo sapiens
aggccctgggcagttctgtagc

SEQ ID NO: 7122961 - DNA, 22 bp, Homo sapiens
aggccctgggttagggcccact

SEQ ID NO: 7122962 - DNA, 22 bp, Homo sapiens
aggccctgggttagggcccact

SEQ ID NO: 7122963 - DNA, 22 bp, Homo sapiens
aggccctggggtctgttaaatt

SEQ ID NO: 7122964 - DNA, 22 bp, Homo sapiens
aggccctggggtctgttaaatt

SEQ ID NO: 7122965 - DNA, 22 bp, Homo sapiens
ccaggacaagtgtggccatggc

SEQ ID NO: 7122966 - DNA, 18 bp, Homo sapiens
aggccctggcctcgaaca

SEQ ID NO: 7122967 - DNA, 18 bp, Homo sapiens
aggccctggcctcgaaca

SEQ ID NO: 7122968 - DNA, 18 bp, Homo sapiens
aggccctggcctcgaaca

SEQ ID NO: 7122969 - DNA, 22 bp, Homo sapiens
aggccctggcctgactcaatgt

SEQ ID NO: 7122970 - DNA, 22 bp, Homo sapiens
aggccctggctgggtttcttta

SEQ ID NO: 7122971 - DNA, 22 bp, Homo sapiens
aggccctgggagcagagatgca

SEQ ID NO: 7122972 - DNA, 22 bp, Homo sapiens
aggccctgggagcagagatgca

SEQ ID NO: 7122973 - DNA, 22 bp, Homo sapiens
aggccctgggagcagagatgca

SEQ ID NO: 7122974 - DNA, 22 bp, Homo sapiens
aggccctgggagcagagatgca

SEQ ID NO: 7122975 - DNA, 22 bp, Homo sapiens
aggccctgggagcagagatgca

SEQ ID NO: 7122976 - DNA, 22 bp, Homo sapiens
aggccctgggcagttctgtagc

SEQ ID NO: 7122977 - DNA, 22 bp, Homo sapiens
aggccctggcccccagagattc

SEQ ID NO: 7122978 - DNA, 22 bp, Homo sapiens
aggccctggcccccagagattc

SEQ ID NO: 7122979 - DNA, 22 bp, Homo sapiens
aggccctggcccccagagattc

SEQ ID NO: 7122980 - DNA, 22 bp, Homo sapiens
aggccctggcccccagagattc

SEQ ID NO: 7122981 - DNA, 22 bp, Homo sapiens
aggccctggcccccagagattc

SEQ ID NO: 7122982 - DNA, 22 bp, Homo sapiens
aggccctggcccccagagattc

SEQ ID NO: 7122983 - DNA, 22 bp, Homo sapiens
aggccctggcccccagagattc

SEQ ID NO: 7122984 - DNA, 22 bp, Homo sapiens
aggccctggcactgcctgggag

SEQ ID NO: 7122985 - DNA, 22 bp, Homo sapiens
aggccctggcactgcctgggag

SEQ ID NO: 7122986 - DNA, 22 bp, Homo sapiens
aggccctggcactgcctgggag

SEQ ID NO: 7122987 - DNA, 22 bp, Homo sapiens
ccagcttttcctctcattgctt

SEQ ID NO: 7122988 - DNA, 22 bp, Homo sapiens
ccagcttttcagaatctgcctg

SEQ ID NO: 7122989 - DNA, 22 bp, Homo sapiens
ccagcttttcttatcattataa

SEQ ID NO: 7122990 - DNA, 22 bp, Homo sapiens
ccagcttttgcactggactggg

SEQ ID NO: 7122991 - DNA, 22 bp, Homo sapiens
ccagcttttggggtgacaattt

SEQ ID NO: 7122992 - DNA, 20 bp, Homo sapiens
ccagctttccctgcagcatc

SEQ ID NO: 7122993 - DNA, 22 bp, Homo sapiens
ccagctttcctgcgagttgatt

SEQ ID NO: 7122994 - DNA, 22 bp, Homo sapiens
ccagctttctcagaggcttcta

SEQ ID NO: 7122995 - DNA, 22 bp, Homo sapiens
ccagctttctgggtggtttctg

SEQ ID NO: 7122996 - DNA, 22 bp, Homo sapiens
ccagctttggagtgttgttgct

SEQ ID NO: 7122997 - DNA, 22 bp, Homo sapiens
ccagcttttagtgggcttatta

SEQ ID NO: 7122998 - DNA, 22 bp, Homo sapiens
ccaggagagcagaagcccaggc

SEQ ID NO: 7122999 - DNA, 22 bp, Homo sapiens
ccaggagagcagaagcccaggc

SEQ ID NO: 7123000 - DNA, 22 bp, Homo sapiens
ccaggagagcagaagcccaggc

SEQ ID NO: 7123001 - DNA, 22 bp, Homo sapiens
ccaggagagcagaagcccaggc

SEQ ID NO: 7123002 - DNA, 22 bp, Homo sapiens
ccaggagagcattgcacagagg

SEQ ID NO: 7123003 - DNA, 22 bp, Homo sapiens
ccaggagagcaggcgtgcagct

SEQ ID NO: 7123004 - DNA, 22 bp, Homo sapiens
ccaggagagcaggcgtgcagct

SEQ ID NO: 7123005 - DNA, 22 bp, Homo sapiens
ccaggagagcaggcgtgcagct

SEQ ID NO: 7123006 - DNA, 22 bp, Homo sapiens
ccaggagagctctaaatggctg

SEQ ID NO: 7123007 - DNA, 22 bp, Homo sapiens
ccaggagagctctcgttcagtg

SEQ ID NO: 7123008 - DNA, 22 bp, Homo sapiens
ccaggagagcgccctcccggcc

SEQ ID NO: 7123009 - DNA, 22 bp, Homo sapiens
ccaggagagcattgcacagagg

SEQ ID NO: 7123010 - DNA, 22 bp, Homo sapiens
ccaggagagcattgcacagagg

SEQ ID NO: 7123011 - DNA, 22 bp, Homo sapiens
ccaggagagcattgcacagagg

SEQ ID NO: 7123012 - DNA, 22 bp, Homo sapiens
ccaggagcgggaaaaggaagaa

SEQ ID NO: 7123013 - DNA, 22 bp, Homo sapiens
ccaggagcaaagatcactggga

SEQ ID NO: 7123014 - DNA, 22 bp, Homo sapiens
ccaggagcaaagatcactggga

SEQ ID NO: 7123015 - DNA, 22 bp, Homo sapiens
ccaggagcaaagatcactggga

SEQ ID NO: 7123016 - DNA, 22 bp, Homo sapiens
ccaggagcaaagatcactggga

SEQ ID NO: 7123017 - DNA, 22 bp, Homo sapiens
ccaggagatttttccatagcac

SEQ ID NO: 7123018 - DNA, 22 bp, Homo sapiens
ccaggagcaaagatcactggga

SEQ ID NO: 7123019 - DNA, 22 bp, Homo sapiens
ccaggagatgggagcatctaaa

SEQ ID NO: 7123020 - DNA, 22 bp, Homo sapiens
ccaggagatgggagcatctaaa

SEQ ID NO: 7123021 - DNA, 22 bp, Homo sapiens
ccaggagatttttccatagcac

SEQ ID NO: 7123022 - DNA, 22 bp, Homo sapiens
ccaggagatgggaaagtagcag

SEQ ID NO: 7123023 - DNA, 22 bp, Homo sapiens
ccaggagatgggaaagtagcag

SEQ ID NO: 7123024 - DNA, 22 bp, Homo sapiens
ccaggagatgatgttggggatt

SEQ ID NO: 7123025 - DNA, 22 bp, Homo sapiens
ccaggagataagctgagtttat

SEQ ID NO: 7123026 - DNA, 19 bp, Homo sapiens
ccaggagagcttggagaag

SEQ ID NO: 7123027 - DNA, 22 bp, Homo sapiens
ccagggtggaggctggatggag

SEQ ID NO: 7123028 - DNA, 22 bp, Homo sapiens
aggctctgtcaggcggagcagc

SEQ ID NO: 7123029 - DNA, 22 bp, Homo sapiens
aggctctgtgacaatcaagctg

SEQ ID NO: 7123030 - DNA, 22 bp, Homo sapiens
aggctctgtgacaatcaagctg

SEQ ID NO: 7123031 - DNA, 22 bp, Homo sapiens
aggctctgtgacaatcaagctg

SEQ ID NO: 7123032 - DNA, 22 bp, Homo sapiens
aggctctgtgacaatcaagctg

SEQ ID NO: 7123033 - DNA, 22 bp, Homo sapiens
aggctctgtgactaaagaggat

SEQ ID NO: 7123034 - DNA, 22 bp, Homo sapiens
aggctctgtgactaaagaggat

SEQ ID NO: 7123035 - DNA, 22 bp, Homo sapiens
aggctctgtgactaaagaggat

SEQ ID NO: 7123036 - DNA, 22 bp, Homo sapiens
aggctctgtgatccacaatgag

SEQ ID NO: 7123037 - DNA, 22 bp, Homo sapiens
aggctctgtgatgtgccaggca

SEQ ID NO: 7123038 - DNA, 22 bp, Homo sapiens
aggctctgtgatgtgccaggca

SEQ ID NO: 7123039 - DNA, 22 bp, Homo sapiens
aggctctgtgactaaagaggat

SEQ ID NO: 7123040 - DNA, 22 bp, Homo sapiens
aggctctgtgatccacaatgag

SEQ ID NO: 7123041 - DNA, 22 bp, Homo sapiens
aggctctgtgactaaagaggat

SEQ ID NO: 7123042 - DNA, 22 bp, Homo sapiens
aggctctgtgatgtgccaggca

SEQ ID NO: 7123043 - DNA, 22 bp, Homo sapiens
aggctctgtgatgtgccaggca

SEQ ID NO: 7123044 - DNA, 22 bp, Homo sapiens
aggctctgtgatgtgccaggca

SEQ ID NO: 7123045 - DNA, 22 bp, Homo sapiens
aggctctgtgcagcctgcatct

SEQ ID NO: 7123046 - DNA, 22 bp, Homo sapiens
aggctgaggggcgagggaccct

SEQ ID NO: 7123047 - DNA, 22 bp, Homo sapiens
aggctgaggggcgagggaccct

SEQ ID NO: 7123048 - DNA, 22 bp, Homo sapiens
aggctgaggcgggtagatcacc

SEQ ID NO: 7123049 - DNA, 22 bp, Homo sapiens
aggctgaggcgggtagatcacc

SEQ ID NO: 7123050 - DNA, 22 bp, Homo sapiens
aggctctgtgcatcctccccaa

SEQ ID NO: 7123051 - DNA, 22 bp, Homo sapiens
aggctctgtgcatcctccccaa

SEQ ID NO: 7123052 - DNA, 22 bp, Homo sapiens
aggctctgtgcagcctgcatct

SEQ ID NO: 7123053 - DNA, 22 bp, Homo sapiens
aggctctgtgcagcctgcatct

SEQ ID NO: 7123054 - DNA, 22 bp, Homo sapiens
aggctctgtgcagcctgcatct

SEQ ID NO: 7123055 - DNA, 22 bp, Homo sapiens
aggctctgtgcatcctccccaa

SEQ ID NO: 7123056 - DNA, 20 bp, Homo sapiens
aggctgagggtgattgtgtc

SEQ ID NO: 7123057 - DNA, 20 bp, Homo sapiens
aggctgagggtgattgtgtc

SEQ ID NO: 7123058 - DNA, 22 bp, Homo sapiens
aggctgaggggcgagggaccct

SEQ ID NO: 7123059 - DNA, 22 bp, Homo sapiens
aggctgaggtaggaggatcgct

SEQ ID NO: 7123060 - DNA, 22 bp, Homo sapiens
aggctgaggtaggaggatcgct

SEQ ID NO: 7123061 - DNA, 22 bp, Homo sapiens
ccatggcttttgagtctcaaga

SEQ ID NO: 7123062 - DNA, 22 bp, Homo sapiens
ccatggcttggaaagggaggtg

SEQ ID NO: 7123063 - DNA, 22 bp, Homo sapiens
ccatggcttggaaagggaggtg

SEQ ID NO: 7123064 - DNA, 22 bp, Homo sapiens
ccatggcttctttctctgccag

SEQ ID NO: 7123065 - DNA, 22 bp, Homo sapiens
ccatggcttctttctctgccag

SEQ ID NO: 7123066 - DNA, 22 bp, Homo sapiens
ccatggctgcaattcttctgga

SEQ ID NO: 7123067 - DNA, 22 bp, Homo sapiens
ccatggcttacagatggagcat

SEQ ID NO: 7123068 - DNA, 22 bp, Homo sapiens
aggctgagtcgggaggatcact

SEQ ID NO: 7123069 - DNA, 19 bp, Homo sapiens
ccatgcagcctgggggcag

SEQ ID NO: 7123070 - DNA, 19 bp, Homo sapiens
ccatgcagcctgggggcag

SEQ ID NO: 7123071 - DNA, 18 bp, Homo sapiens
ccatggctccctcctgcc

SEQ ID NO: 7123072 - DNA, 18 bp, Homo sapiens
ccatggctccctcctgcc

SEQ ID NO: 7123073 - DNA, 22 bp, Homo sapiens
aggctgaggtaggaggatcgct

SEQ ID NO: 7123074 - DNA, 22 bp, Homo sapiens
aggctgaggtaggaggatcgct

SEQ ID NO: 7123075 - DNA, 22 bp, Homo sapiens
aggctgaggtaggaggatcgct

SEQ ID NO: 7123076 - DNA, 22 bp, Homo sapiens
aggctgaggtgtgctgtgatcg

SEQ ID NO: 7123077 - DNA, 22 bp, Homo sapiens
aggctgaggtgtgctgtgatcg

SEQ ID NO: 7123078 - DNA, 22 bp, Homo sapiens
aggctgaggtgtgctgtgatcg

SEQ ID NO: 7123079 - DNA, 22 bp, Homo sapiens
aggctgaggtgtgctgtgatcg

SEQ ID NO: 7123080 - DNA, 22 bp, Homo sapiens
aggctgaggtgtgctgtgatcg

SEQ ID NO: 7123081 - DNA, 22 bp, Homo sapiens
aggctgagtcgggaggatcact

SEQ ID NO: 7123082 - DNA, 22 bp, Homo sapiens
aggctgagtcgggaggatcact

SEQ ID NO: 7123083 - DNA, 22 bp, Homo sapiens
aggctgagtcaagttagggtga

SEQ ID NO: 7123084 - DNA, 22 bp, Homo sapiens
aggctgagtcaagttagggtga

SEQ ID NO: 7123085 - DNA, 22 bp, Homo sapiens
aggctgagtcaagttagggtga

SEQ ID NO: 7123086 - DNA, 22 bp, Homo sapiens
aggctggctgaaaaacaccctt

SEQ ID NO: 7123087 - DNA, 22 bp, Homo sapiens
aggctggctgacttctgaagca

SEQ ID NO: 7123088 - DNA, 22 bp, Homo sapiens
aggctggctgacttctgaagca

SEQ ID NO: 7123089 - DNA, 17 bp, Homo sapiens
aggctggctcacaggga

SEQ ID NO: 7123090 - DNA, 22 bp, Homo sapiens
aggctggcgtcaggggctgtac

SEQ ID NO: 7123091 - DNA, 21 bp, Homo sapiens
cccagagcctagggagggcac

SEQ ID NO: 7123092 - DNA, 21 bp, Homo sapiens
cccagagcctagggagggcac

SEQ ID NO: 7123093 - DNA, 21 bp, Homo sapiens
cccagagcctagggagggcac

SEQ ID NO: 7123094 - DNA, 22 bp, Homo sapiens
cccagagccggtggtgctcaca

SEQ ID NO: 7123095 - DNA, 22 bp, Homo sapiens
cccagagccggtggtgctcaca

SEQ ID NO: 7123096 - DNA, 22 bp, Homo sapiens
cccagagccggtggtgctcaca

SEQ ID NO: 7123097 - DNA, 22 bp, Homo sapiens
cccactgtctgttcccagggcc

SEQ ID NO: 7123098 - DNA, 22 bp, Homo sapiens
cccagagatgtcctgagtgata

SEQ ID NO: 7123099 - DNA, 23 bp, Homo sapiens
cccagagcacagcctccagatgc

SEQ ID NO: 7123100 - DNA, 23 bp, Homo sapiens
cccagagcacagcctccagatgc

SEQ ID NO: 7123101 - DNA, 23 bp, Homo sapiens
cccagagcacagcctccagatgc

SEQ ID NO: 7123102 - DNA, 23 bp, Homo sapiens
cccagagcacagcctccagatgc

SEQ ID NO: 7123103 - DNA, 20 bp, Homo sapiens
cccagagcactttttcatgt

SEQ ID NO: 7123104 - DNA, 22 bp, Homo sapiens
cccagagcataacgtatcttga

SEQ ID NO: 7123105 - DNA, 19 bp, Homo sapiens
cccagagcatcctgaactt

SEQ ID NO: 7123106 - DNA, 19 bp, Homo sapiens
cccagagcatcctgaactt

SEQ ID NO: 7123107 - DNA, 22 bp, Homo sapiens
cccagagcatgtgctgcctttg

SEQ ID NO: 7123108 - DNA, 20 bp, Homo sapiens
cccagagccatagccagaca

SEQ ID NO: 7123109 - DNA, 20 bp, Homo sapiens
cccagagccatagccagaca

SEQ ID NO: 7123110 - DNA, 20 bp, Homo sapiens
cccagagccatagccagaca

SEQ ID NO: 7123111 - DNA, 22 bp, Homo sapiens
cccagagccgctcccctacttc

SEQ ID NO: 7123112 - DNA, 22 bp, Homo sapiens
cccagagccgctcccctacttc

SEQ ID NO: 7123113 - DNA, 22 bp, Homo sapiens
aggctgcgttagcctcactccc

SEQ ID NO: 7123114 - DNA, 22 bp, Homo sapiens
aggctgctataaacattcccgt

SEQ ID NO: 7123115 - DNA, 22 bp, Homo sapiens
aggctgctcacctccctgtctg

SEQ ID NO: 7123116 - DNA, 22 bp, Homo sapiens
aggctgcctggctgtgagtgaa

SEQ ID NO: 7123117 - DNA, 22 bp, Homo sapiens
aggctgctcacctccctgtctg

SEQ ID NO: 7123118 - DNA, 22 bp, Homo sapiens
aggctgctcagtagatggagct

SEQ ID NO: 7123119 - DNA, 22 bp, Homo sapiens
aggctgctcagtagatggagct

SEQ ID NO: 7123120 - DNA, 22 bp, Homo sapiens
aggctgctcacctccctgtctg

SEQ ID NO: 7123121 - DNA, 22 bp, Homo sapiens
cccactgctgctctccatggca

SEQ ID NO: 7123122 - DNA, 22 bp, Homo sapiens
cccactggcaatattatgagac

SEQ ID NO: 7123123 - DNA, 18 bp, Homo sapiens
cccactgtccccacaggc

SEQ ID NO: 7123124 - DNA, 22 bp, Homo sapiens
aggctgcctcgtgagctcgctg

SEQ ID NO: 7123125 - DNA, 22 bp, Homo sapiens
aggctgcctcgtgagctcgctg

SEQ ID NO: 7123126 - DNA, 22 bp, Homo sapiens
aggctgcctcgtgagctcgctg

SEQ ID NO: 7123127 - DNA, 22 bp, Homo sapiens
aggctgcctcgtgagctcgctg

SEQ ID NO: 7123128 - DNA, 22 bp, Homo sapiens
aggctgcctctgcaggatccct

SEQ ID NO: 7123129 - DNA, 22 bp, Homo sapiens
aggctgcctctgcaggatccct

SEQ ID NO: 7123130 - DNA, 22 bp, Homo sapiens
aggctgcctcttttgagagggt

SEQ ID NO: 7123131 - DNA, 22 bp, Homo sapiens
aggctgcctcttttgagagggt

SEQ ID NO: 7123132 - DNA, 22 bp, Homo sapiens
aggctgcctcttttgagagggt

SEQ ID NO: 7123133 - DNA, 22 bp, Homo sapiens
aggctgcctcttttgagagggt

SEQ ID NO: 7123134 - DNA, 22 bp, Homo sapiens
aggctgcctggctgtgagtgaa

SEQ ID NO: 7123135 - DNA, 22 bp, Homo sapiens
aggctgcctggctgtgagtgaa

SEQ ID NO: 7123136 - DNA, 22 bp, Homo sapiens
aggctgcctggctgtgagtgaa

SEQ ID NO: 7123137 - DNA, 22 bp, Homo sapiens
ccatgggagatgatggggagtg

SEQ ID NO: 7123138 - DNA, 22 bp, Homo sapiens
ccatgggagatgatggggagtg

SEQ ID NO: 7123139 - DNA, 22 bp, Homo sapiens
ccatgggaattgggaggtccca

SEQ ID NO: 7123140 - DNA, 22 bp, Homo sapiens
ccatggtctctgtgaagcctgt

SEQ ID NO: 7123141 - DNA, 22 bp, Homo sapiens
ccatgtgcttgctctggcacct

SEQ ID NO: 7123142 - DNA, 20 bp, Homo sapiens
aggctgcctaaggctctgca

SEQ ID NO: 7123143 - DNA, 22 bp, Homo sapiens
aggctgcctaggttcaacacct

SEQ ID NO: 7123144 - DNA, 22 bp, Homo sapiens
aggctgcctaggttcaacacct

SEQ ID NO: 7123145 - DNA, 19 bp, Homo sapiens
aggctgcctcaccctccct

SEQ ID NO: 7123146 - DNA, 19 bp, Homo sapiens
aggctgcctcaccctccct

SEQ ID NO: 7123147 - DNA, 22 bp, Homo sapiens
aggctgcctcgtgagctcgctg

SEQ ID NO: 7123148 - DNA, 19 bp, Homo sapiens
aggctgcctcaccctccct

SEQ ID NO: 7123149 - DNA, 22 bp, Homo sapiens
ccagggaaggctgctggctgtg

SEQ ID NO: 7123150 - DNA, 22 bp, Homo sapiens
ccagggaaggctctgcctgctt

SEQ ID NO: 7123151 - DNA, 22 bp, Homo sapiens
ccaggctgtaaacaccttcaaa

SEQ ID NO: 7123152 - DNA, 22 bp, Homo sapiens
aggctccaccctacagagctcc

SEQ ID NO: 7123153 - DNA, 22 bp, Homo sapiens
aggctccacggcaggatgctgt

SEQ ID NO: 7123154 - DNA, 22 bp, Homo sapiens
ccaggctgtaaacaccttcaaa

SEQ ID NO: 7123155 - DNA, 22 bp, Homo sapiens
aggctccaccagtcaggtgcat

SEQ ID NO: 7123156 - DNA, 22 bp, Homo sapiens
aggctccaccagtcaggtgcat

SEQ ID NO: 7123157 - DNA, 22 bp, Homo sapiens
aggctccaccccgccagacctt

SEQ ID NO: 7123158 - DNA, 22 bp, Homo sapiens
aggctccaccctacagagctcc

SEQ ID NO: 7123159 - DNA, 22 bp, Homo sapiens
aggctccaccctacagagctcc

SEQ ID NO: 7123160 - DNA, 22 bp, Homo sapiens
aggctccaccagtcaggtgcat

SEQ ID NO: 7123161 - DNA, 22 bp, Homo sapiens
aggctccaccagtcaggtgcat

SEQ ID NO: 7123162 - DNA, 23 bp, Homo sapiens
aggctccacatgggcactttgca

SEQ ID NO: 7123163 - DNA, 22 bp, Homo sapiens
aggctccaagaggttaagtcac

SEQ ID NO: 7123164 - DNA, 22 bp, Homo sapiens
aggctcatctgagcagaaacct

SEQ ID NO: 7123165 - DNA, 22 bp, Homo sapiens
aggctcatccccacaaagcaaa

SEQ ID NO: 7123166 - DNA, 22 bp, Homo sapiens
aggctcagttctgtggtgagcc

SEQ ID NO: 7123167 - DNA, 22 bp, Homo sapiens
aggctcagttctgtggtgagcc

SEQ ID NO: 7123168 - DNA, 22 bp, Homo sapiens
aggctcagtttggtttccattg

SEQ ID NO: 7123169 - DNA, 22 bp, Homo sapiens
aggctcagtttggtttccattg

SEQ ID NO: 7123170 - DNA, 22 bp, Homo sapiens
aggctcagtttggtttccattg

SEQ ID NO: 7123171 - DNA, 22 bp, Homo sapiens
aggctcagtttggtttccattg

SEQ ID NO: 7123172 - DNA, 22 bp, Homo sapiens
aggctcagtgcaaatcattctg

SEQ ID NO: 7123173 - DNA, 22 bp, Homo sapiens
aggctcagtgcaaatcattctg

SEQ ID NO: 7123174 - DNA, 22 bp, Homo sapiens
aggctcagtgcaaatcattctg

SEQ ID NO: 7123175 - DNA, 22 bp, Homo sapiens
aggctcagttcacgtcaacttt

SEQ ID NO: 7123176 - DNA, 22 bp, Homo sapiens
aggctcagttcacgtcaacttt

SEQ ID NO: 7123177 - DNA, 22 bp, Homo sapiens
aggctcagttcacgtcaacttt

SEQ ID NO: 7123178 - DNA, 22 bp, Homo sapiens
aggctcagttcacgtcaacttt

SEQ ID NO: 7123179 - DNA, 22 bp, Homo sapiens
aggctcagttcacgtcaacttt

SEQ ID NO: 7123180 - DNA, 22 bp, Homo sapiens
aggctcagttcacgtcaacttt

SEQ ID NO: 7123181 - DNA, 22 bp, Homo sapiens
aggctcagttctgtggtgagcc

SEQ ID NO: 7123182 - DNA, 22 bp, Homo sapiens
aggctcagttctgtggtgagcc

SEQ ID NO: 7123183 - DNA, 22 bp, Homo sapiens
aggctcagttctgtggtgagcc

SEQ ID NO: 7123184 - DNA, 22 bp, Homo sapiens
aggctcagttctgtggtgagcc

SEQ ID NO: 7123185 - DNA, 22 bp, Homo sapiens
aggctcagttctgtggtgagcc

SEQ ID NO: 7123186 - DNA, 22 bp, Homo sapiens
ccaggaggaaagaccagcccat

SEQ ID NO: 7123187 - DNA, 22 bp, Homo sapiens
ccaggaggaaattctaaaggta

SEQ ID NO: 7123188 - DNA, 22 bp, Homo sapiens
ccaggagctggcatgtggagag

SEQ ID NO: 7123189 - DNA, 22 bp, Homo sapiens
ccaggagctggagggtgcagtg

SEQ ID NO: 7123190 - DNA, 22 bp, Homo sapiens
ccaggagctggagggtgcagtg

SEQ ID NO: 7123191 - DNA, 22 bp, Homo sapiens
ccaggagctggcatgtggagag

SEQ ID NO: 7123192 - DNA, 22 bp, Homo sapiens
ccaggagctggcatgtggagag

SEQ ID NO: 7123193 - DNA, 17 bp, Homo sapiens
ccaggagcgtgggtctc

SEQ ID NO: 7123194 - DNA, 17 bp, Homo sapiens
ccaggagcgtgggtctc

SEQ ID NO: 7123195 - DNA, 22 bp, Homo sapiens
ccaggagctatgtacacactat

SEQ ID NO: 7123196 - DNA, 22 bp, Homo sapiens
ccaggagctatgtacacactat

SEQ ID NO: 7123197 - DNA, 22 bp, Homo sapiens
ccaggagctggagggtgcagtg

SEQ ID NO: 7123198 - DNA, 22 bp, Homo sapiens
aggctcagcctgggcctagagc

SEQ ID NO: 7123199 - DNA, 22 bp, Homo sapiens
aggctcagcctgggcctagagc

SEQ ID NO: 7123200 - DNA, 22 bp, Homo sapiens
ccaggaggatcatcctgttttc

SEQ ID NO: 7123201 - DNA, 22 bp, Homo sapiens
aggctcaggtgcctcattcaca

SEQ ID NO: 7123202 - DNA, 20 bp, Homo sapiens
aggctcagctgagctcttgg

SEQ ID NO: 7123203 - DNA, 22 bp, Homo sapiens
aggctcaggtgcctcattcaca

SEQ ID NO: 7123204 - DNA, 22 bp, Homo sapiens
aggctcaggtgcctcattcaca

SEQ ID NO: 7123205 - DNA, 22 bp, Homo sapiens
aggctcaggtgcctcattcaca

SEQ ID NO: 7123206 - DNA, 22 bp, Homo sapiens
aggctcagtatagctggcaagt

SEQ ID NO: 7123207 - DNA, 22 bp, Homo sapiens
aggctcagtatagctggcaagt

SEQ ID NO: 7123208 - DNA, 22 bp, Homo sapiens
aggctcagtatagctggcaagt

SEQ ID NO: 7123209 - DNA, 22 bp, Homo sapiens
aggctcagtatagctggcaagt

SEQ ID NO: 7123210 - DNA, 22 bp, Homo sapiens
aggctcagtatagctggcaagt

SEQ ID NO: 7123211 - DNA, 22 bp, Homo sapiens
aggctcagtatagctggcaagt

SEQ ID NO: 7123212 - DNA, 22 bp, Homo sapiens
aggctcagtatagctggcaagt

SEQ ID NO: 7123213 - DNA, 22 bp, Homo sapiens
aggctcagtcccggcccgcgcc

SEQ ID NO: 7123214 - DNA, 22 bp, Homo sapiens
aggctcagtcccggcccgcgcc

SEQ ID NO: 7123215 - DNA, 22 bp, Homo sapiens
aggctcagtcccggcccgcgcc

SEQ ID NO: 7123216 - DNA, 22 bp, Homo sapiens
aggctcagtcccggcccgcgcc

SEQ ID NO: 7123217 - DNA, 22 bp, Homo sapiens
aggctcagtcccggcccgcgcc

SEQ ID NO: 7123218 - DNA, 22 bp, Homo sapiens
aggctcagtcccggcccgcgcc

SEQ ID NO: 7123219 - DNA, 22 bp, Homo sapiens
aggctcagtctgttcatgcact

SEQ ID NO: 7123220 - DNA, 22 bp, Homo sapiens
aggctcagtctgttcatgcact

SEQ ID NO: 7123221 - DNA, 22 bp, Homo sapiens
aggctcagtctgttcatgcact

SEQ ID NO: 7123222 - DNA, 22 bp, Homo sapiens
aggctcagtctgttcatgcact

SEQ ID NO: 7123223 - DNA, 22 bp, Homo sapiens
aggctcagtctgttcatgcact

SEQ ID NO: 7123224 - DNA, 22 bp, Homo sapiens
aggctcagtctgttcatgcact

SEQ ID NO: 7123225 - DNA, 22 bp, Homo sapiens
aggctcagtgatgtaaaatata

SEQ ID NO: 7123226 - DNA, 22 bp, Homo sapiens
aggctcagtgatgtaaaatata

SEQ ID NO: 7123227 - DNA, 22 bp, Homo sapiens
aggctcagtgatgtaaaatata

SEQ ID NO: 7123228 - DNA, 22 bp, Homo sapiens
aggctcagtgatgtaaaatata

SEQ ID NO: 7123229 - DNA, 22 bp, Homo sapiens
aggctcagtgcaaatcattctg

SEQ ID NO: 7123230 - DNA, 22 bp, Homo sapiens
ccagggtcttggagaggagtgc

SEQ ID NO: 7123231 - DNA, 22 bp, Homo sapiens
ccagggcttcagaggttttggc

SEQ ID NO: 7123232 - DNA, 22 bp, Homo sapiens
aggctccttgctcacaggctca

SEQ ID NO: 7123233 - DNA, 22 bp, Homo sapiens
aggctccttgctcacaggctca

SEQ ID NO: 7123234 - DNA, 22 bp, Homo sapiens
aggctccttcacagcactcgcc

SEQ ID NO: 7123235 - DNA, 20 bp, Homo sapiens
aggctcctgtacctgaggaa

SEQ ID NO: 7123236 - DNA, 22 bp, Homo sapiens
aggctccttcacagcactcgcc

SEQ ID NO: 7123237 - DNA, 22 bp, Homo sapiens
aggctcctgcaggccttgtagg

SEQ ID NO: 7123238 - DNA, 22 bp, Homo sapiens
aggctcctgatcctggggtctg

SEQ ID NO: 7123239 - DNA, 22 bp, Homo sapiens
aggctcctgagaggcagaggct

SEQ ID NO: 7123240 - DNA, 22 bp, Homo sapiens
aggctcctgagaggcagaggct

SEQ ID NO: 7123241 - DNA, 22 bp, Homo sapiens
aggctcctgagaggcagaggct

SEQ ID NO: 7123242 - DNA, 22 bp, Homo sapiens
aggctcctgagaggcagaggct

SEQ ID NO: 7123243 - DNA, 20 bp, Homo sapiens
aggctcctgtacctgaggaa

SEQ ID NO: 7123244 - DNA, 22 bp, Homo sapiens
aggctcctgggtgtggccgcca

SEQ ID NO: 7123245 - DNA, 20 bp, Homo sapiens
aggctcctgtacctgaggaa

SEQ ID NO: 7123246 - DNA, 20 bp, Homo sapiens
aggctcctgtacctgaggaa

SEQ ID NO: 7123247 - DNA, 22 bp, Homo sapiens
ccagggtgctctgtggcgtcgc

SEQ ID NO: 7123248 - DNA, 22 bp, Homo sapiens
ccagggtgagtgtcatgggtta

SEQ ID NO: 7123249 - DNA, 22 bp, Homo sapiens
ccagggtgctctgtggcgtcgc

SEQ ID NO: 7123250 - DNA, 22 bp, Homo sapiens
ccagggtgctctgtggcgtcgc

SEQ ID NO: 7123251 - DNA, 22 bp, Homo sapiens
ccagggtgaggaggctcccacg

SEQ ID NO: 7123252 - DNA, 22 bp, Homo sapiens
ccagggtgaggaggctcccacg

SEQ ID NO: 7123253 - DNA, 22 bp, Homo sapiens
ccagggtgaggaggctcccacg

SEQ ID NO: 7123254 - DNA, 22 bp, Homo sapiens
ccagggtgagtgtcatgggtta

SEQ ID NO: 7123255 - DNA, 22 bp, Homo sapiens
ccagggtgagtgtcatgggtta

SEQ ID NO: 7123256 - DNA, 22 bp, Homo sapiens
ccagggtgagtgtcatgggtta

SEQ ID NO: 7123257 - DNA, 22 bp, Homo sapiens
ccagggtgagaaaaggctggat

SEQ ID NO: 7123258 - DNA, 22 bp, Homo sapiens
ccagggtgagaaaaggctggat

SEQ ID NO: 7123259 - DNA, 22 bp, Homo sapiens
ccagggtgagaaaaggctggat

SEQ ID NO: 7123260 - DNA, 22 bp, Homo sapiens
ccagggtgaccagctggcctag

SEQ ID NO: 7123261 - DNA, 22 bp, Homo sapiens
ccagggtgaccagctggcctag

SEQ ID NO: 7123262 - DNA, 22 bp, Homo sapiens
ccagggtgaccctcccggtggc

SEQ ID NO: 7123263 - DNA, 22 bp, Homo sapiens
ccagggagcctggtgtgtcagc

SEQ ID NO: 7123264 - DNA, 22 bp, Homo sapiens
ccagggagcctggtgtgtcagc

SEQ ID NO: 7123265 - DNA, 22 bp, Homo sapiens
ccagggagcggggctgggtctc

SEQ ID NO: 7123266 - DNA, 22 bp, Homo sapiens
ccagggagcggggctgggtctc

SEQ ID NO: 7123267 - DNA, 22 bp, Homo sapiens
ccagggagcggggctgggtctc

SEQ ID NO: 7123268 - DNA, 22 bp, Homo sapiens
ccagggactttgcattgtttat

SEQ ID NO: 7123269 - DNA, 22 bp, Homo sapiens
ccagggagcccacaggacaatg

SEQ ID NO: 7123270 - DNA, 22 bp, Homo sapiens
ccagggagcccacaggacaatg

SEQ ID NO: 7123271 - DNA, 22 bp, Homo sapiens
ccagggagcccacaggacaatg

SEQ ID NO: 7123272 - DNA, 22 bp, Homo sapiens
ccagggagcccacaggacaatg

SEQ ID NO: 7123273 - DNA, 22 bp, Homo sapiens
ccagggagcccacaggacaatg

SEQ ID NO: 7123274 - DNA, 22 bp, Homo sapiens
ccagggaagtagttgtgagagc

SEQ ID NO: 7123275 - DNA, 22 bp, Homo sapiens
ccagggaagtcacattgtctag

SEQ ID NO: 7123276 - DNA, 22 bp, Homo sapiens
ccagggaagtcacattgtctag

SEQ ID NO: 7123277 - DNA, 22 bp, Homo sapiens
ccagggaagtcacattgtctag

SEQ ID NO: 7123278 - DNA, 22 bp, Homo sapiens
ccagggaatcaggcagaagtca

SEQ ID NO: 7123279 - DNA, 22 bp, Homo sapiens
ccagggaatcaggcagaagtca

SEQ ID NO: 7123280 - DNA, 22 bp, Homo sapiens
ccagggaatctctgagtgtgtt

SEQ ID NO: 7123281 - DNA, 22 bp, Homo sapiens
ccagggaatgatatttttgcct

SEQ ID NO: 7123282 - DNA, 22 bp, Homo sapiens
ccagggaatgtgggatgactct

SEQ ID NO: 7123283 - DNA, 22 bp, Homo sapiens
ccagggaatgtgggatgactct

SEQ ID NO: 7123284 - DNA, 22 bp, Homo sapiens
ccagggaatgtgggatgactct

SEQ ID NO: 7123285 - DNA, 17 bp, Homo sapiens
ccagggaggggccgcgc

SEQ ID NO: 7123286 - DNA, 17 bp, Homo sapiens
ccagggaggggccgcgc

SEQ ID NO: 7123287 - DNA, 17 bp, Homo sapiens
ccagggaggggccgcgc

SEQ ID NO: 7123288 - DNA, 22 bp, Homo sapiens
aggctccctgaatcgcccgttc

SEQ ID NO: 7123289 - DNA, 22 bp, Homo sapiens
ccagggagcggggctgggtctc

SEQ ID NO: 7123290 - DNA, 22 bp, Homo sapiens
aggctcctcggggctgacggcg

SEQ ID NO: 7123291 - DNA, 22 bp, Homo sapiens
aggctcctcggggctgacggcg

SEQ ID NO: 7123292 - DNA, 22 bp, Homo sapiens
aggctcctgagaggcagaggct

SEQ ID NO: 7123293 - DNA, 22 bp, Homo sapiens
aggctcctgagaggcagaggct

SEQ ID NO: 7123294 - DNA, 22 bp, Homo sapiens
aggctcctagcctgtggctggt

SEQ ID NO: 7123295 - DNA, 22 bp, Homo sapiens
aggctcctagcctgtggctggt

SEQ ID NO: 7123296 - DNA, 22 bp, Homo sapiens
cagggtgcagagctagggtagt

SEQ ID NO: 7123297 - DNA, 22 bp, Homo sapiens
cagggtgcatacccatgcatac

SEQ ID NO: 7123298 - DNA, 22 bp, Homo sapiens
cagggtgagcctctggagccct

SEQ ID NO: 7123299 - DNA, 22 bp, Homo sapiens
cagggtgagcctctggagccct

SEQ ID NO: 7123300 - DNA, 22 bp, Homo sapiens
cagggtgactgccctggccact

SEQ ID NO: 7123301 - DNA, 22 bp, Homo sapiens
cagggtgagcctctggagccct

SEQ ID NO: 7123302 - DNA, 22 bp, Homo sapiens
cagggtgagtgggaagcagcgt

SEQ ID NO: 7123303 - DNA, 22 bp, Homo sapiens
cagggtgactgccctggccact

SEQ ID NO: 7123304 - DNA, 22 bp, Homo sapiens
cagggtgactgccctggccact

SEQ ID NO: 7123305 - DNA, 23 bp, Homo sapiens
cagggtgaccaatgtggccatca

SEQ ID NO: 7123306 - DNA, 23 bp, Homo sapiens
cagggtgaccaatgtggccatca

SEQ ID NO: 7123307 - DNA, 22 bp, Homo sapiens
cagggtgacaagtggcaaggag

SEQ ID NO: 7123308 - DNA, 22 bp, Homo sapiens
cagggtcttggcgccatcaccc

SEQ ID NO: 7123309 - DNA, 22 bp, Homo sapiens
caggggctgtttgcctcaggcc

SEQ ID NO: 7123310 - DNA, 22 bp, Homo sapiens
caggggctgtgggcggagcctc

SEQ ID NO: 7123311 - DNA, 22 bp, Homo sapiens
caggggctgtgggcggagcctc

SEQ ID NO: 7123312 - DNA, 22 bp, Homo sapiens
caggggctgtttgcctcaggcc

SEQ ID NO: 7123313 - DNA, 22 bp, Homo sapiens
caggggctgtttgcctcaggcc

SEQ ID NO: 7123314 - DNA, 22 bp, Homo sapiens
caggggctgtttgcctcaggcc

SEQ ID NO: 7123315 - DNA, 22 bp, Homo sapiens
caggggctgtgggcggagcctc

SEQ ID NO: 7123316 - DNA, 22 bp, Homo sapiens
caggggctgtgggcggagcctc

SEQ ID NO: 7123317 - DNA, 22 bp, Homo sapiens
caggggctgtggcacatggtgt

SEQ ID NO: 7123318 - DNA, 22 bp, Homo sapiens
caggggctgtggcacatggtgt

SEQ ID NO: 7123319 - DNA, 22 bp, Homo sapiens
caggggctgagaaggaacgtcc

SEQ ID NO: 7123320 - DNA, 22 bp, Homo sapiens
caggggctgtggcacatggtgt

SEQ ID NO: 7123321 - DNA, 22 bp, Homo sapiens
caggggctgtgggcggagcctc

SEQ ID NO: 7123322 - DNA, 22 bp, Homo sapiens
caggggctgtgggcggagcctc

SEQ ID NO: 7123323 - DNA, 22 bp, Homo sapiens
caggggctgtgggcggagcctc

SEQ ID NO: 7123324 - DNA, 22 bp, Homo sapiens
caggggctgtggcacatggtgt

SEQ ID NO: 7123325 - DNA, 22 bp, Homo sapiens
caggggctgaaatgttggggtt

SEQ ID NO: 7123326 - DNA, 22 bp, Homo sapiens
caggggctgaaatgttggggtt

SEQ ID NO: 7123327 - DNA, 22 bp, Homo sapiens
caggggctgaaatgttggggtt

SEQ ID NO: 7123328 - DNA, 22 bp, Homo sapiens
caggggctgagaaggaacgtcc

SEQ ID NO: 7123329 - DNA, 22 bp, Homo sapiens
caggggctgagaaggaacgtcc

SEQ ID NO: 7123330 - DNA, 22 bp, Homo sapiens
caggggctctgggtgatgtgag

SEQ ID NO: 7123331 - DNA, 22 bp, Homo sapiens
caggggctctgggtgatgtgag

SEQ ID NO: 7123332 - DNA, 22 bp, Homo sapiens
caggggctctgggtgatgtgag

SEQ ID NO: 7123333 - DNA, 22 bp, Homo sapiens
caggggctgaaatgttggggtt

SEQ ID NO: 7123334 - DNA, 22 bp, Homo sapiens
caggggctgaaatgttggggtt

SEQ ID NO: 7123335 - DNA, 22 bp, Homo sapiens
caggggctgaaatgttggggtt

SEQ ID NO: 7123336 - DNA, 22 bp, Homo sapiens
caggggctctgagattgtctaa

SEQ ID NO: 7123337 - DNA, 22 bp, Homo sapiens
caggggctctgagattgtctaa

SEQ ID NO: 7123338 - DNA, 22 bp, Homo sapiens
caggggctctgagattgtctaa

SEQ ID NO: 7123339 - DNA, 22 bp, Homo sapiens
caggggctctaatgcatgatca

SEQ ID NO: 7123340 - DNA, 22 bp, Homo sapiens
caggggctctaatgcatgatca

SEQ ID NO: 7123341 - DNA, 22 bp, Homo sapiens
caggggctccctgggtgccagt

SEQ ID NO: 7123342 - DNA, 22 bp, Homo sapiens
caggggctccctgggtgccagt

SEQ ID NO: 7123343 - DNA, 22 bp, Homo sapiens
caggggctccctgggtgccagt

SEQ ID NO: 7123344 - DNA, 22 bp, Homo sapiens
caggggctccctgggtgccagt

SEQ ID NO: 7123345 - DNA, 22 bp, Homo sapiens
caggggctctaatgcatgatca

SEQ ID NO: 7123346 - DNA, 22 bp, Homo sapiens
caggggctctaatgcatgatca

SEQ ID NO: 7123347 - DNA, 22 bp, Homo sapiens
caggggctctaatgcatgatca

SEQ ID NO: 7123348 - DNA, 22 bp, Homo sapiens
caggtgagtaacaatgggtgat

SEQ ID NO: 7123349 - DNA, 22 bp, Homo sapiens
caggtgagtaacaatgggtgat

SEQ ID NO: 7123350 - DNA, 22 bp, Homo sapiens
caggtgaggctgaacagatgaa

SEQ ID NO: 7123351 - DNA, 22 bp, Homo sapiens
caggtgaggctgaacagatgaa

SEQ ID NO: 7123352 - DNA, 22 bp, Homo sapiens
caggtgaggctgaacagatgaa

SEQ ID NO: 7123353 - DNA, 22 bp, Homo sapiens
caggtgaggctgaacagatgaa

SEQ ID NO: 7123354 - DNA, 22 bp, Homo sapiens
caggtgagtttgctattgtaca

SEQ ID NO: 7123355 - DNA, 22 bp, Homo sapiens
caggtgagtaacaatgggtgat

SEQ ID NO: 7123356 - DNA, 22 bp, Homo sapiens
caggtgagtaacaatgggtgat

SEQ ID NO: 7123357 - DNA, 22 bp, Homo sapiens
caggtgagtttgctattgtaca

SEQ ID NO: 7123358 - DNA, 22 bp, Homo sapiens
caggtgagtttgctattgtaca

SEQ ID NO: 7123359 - DNA, 20 bp, Homo sapiens
caggtgattccctggggaat

SEQ ID NO: 7123360 - DNA, 22 bp, Homo sapiens
caggtgagttttcctccttggt

SEQ ID NO: 7123361 - DNA, 22 bp, Homo sapiens
caggtgagttttcctccttggt

SEQ ID NO: 7123362 - DNA, 22 bp, Homo sapiens
caggtgacttctgaggccttca

SEQ ID NO: 7123363 - DNA, 22 bp, Homo sapiens
caggtgagaggcggtcctgcat

SEQ ID NO: 7123364 - DNA, 22 bp, Homo sapiens
caggtgagaggcggtcctgcat

SEQ ID NO: 7123365 - DNA, 20 bp, Homo sapiens
caggtgagcagatctgggtg

SEQ ID NO: 7123366 - DNA, 20 bp, Homo sapiens
caggtgagcagatctgggtg

SEQ ID NO: 7123367 - DNA, 20 bp, Homo sapiens
caggtgagcagatctgggtg

SEQ ID NO: 7123368 - DNA, 22 bp, Homo sapiens
caggtgagctctatctagggag

SEQ ID NO: 7123369 - DNA, 20 bp, Homo sapiens
caggtgagcagatctgggtg

SEQ ID NO: 7123370 - DNA, 22 bp, Homo sapiens
caggtgagctctatctagggag

SEQ ID NO: 7123371 - DNA, 22 bp, Homo sapiens
caggtgaggctgaacagatgaa

SEQ ID NO: 7123372 - DNA, 22 bp, Homo sapiens
caggtgaggctgaacagatgaa

SEQ ID NO: 7123373 - DNA, 17 bp, Homo sapiens
caggtgacctggtgatg

SEQ ID NO: 7123374 - DNA, 22 bp, Homo sapiens
caggtgacctttgtcctaagtt

SEQ ID NO: 7123375 - DNA, 17 bp, Homo sapiens
caggtgacctggtgatg

SEQ ID NO: 7123376 - DNA, 22 bp, Homo sapiens
caggtgacctatggtcactaca

SEQ ID NO: 7123377 - DNA, 22 bp, Homo sapiens
caggtgacctgggatccgctgc

SEQ ID NO: 7123378 - DNA, 22 bp, Homo sapiens
caggtgaccctctcacctgctt

SEQ ID NO: 7123379 - DNA, 22 bp, Homo sapiens
caggtgaccctcagtgtggact

SEQ ID NO: 7123380 - DNA, 22 bp, Homo sapiens
caggtgaccctctcacctgctt

SEQ ID NO: 7123381 - DNA, 22 bp, Homo sapiens
caggtccttgtttgtaaagcag

SEQ ID NO: 7123382 - DNA, 22 bp, Homo sapiens
caggtcctttagtgtccagaac

SEQ ID NO: 7123383 - DNA, 22 bp, Homo sapiens
caggtgaccctcagtgtggact

SEQ ID NO: 7123384 - DNA, 22 bp, Homo sapiens
cagggtgcgccactcagatgta

SEQ ID NO: 7123385 - DNA, 22 bp, Homo sapiens
cagggtgcgggagatgtgcacc

SEQ ID NO: 7123386 - DNA, 22 bp, Homo sapiens
cagggtgcctctgctcccacca

SEQ ID NO: 7123387 - DNA, 22 bp, Homo sapiens
cagggctccctctggctcccag

SEQ ID NO: 7123388 - DNA, 22 bp, Homo sapiens
cagggctccctgcagcctctgt

SEQ ID NO: 7123389 - DNA, 22 bp, Homo sapiens
cagggctccccgcaccgcagcc

SEQ ID NO: 7123390 - DNA, 22 bp, Homo sapiens
cagggctccccgcaccgcagcc

SEQ ID NO: 7123391 - DNA, 22 bp, Homo sapiens
cagggctccccgcaccgcagcc

SEQ ID NO: 7123392 - DNA, 22 bp, Homo sapiens
cagggctccctctggctcccag

SEQ ID NO: 7123393 - DNA, 22 bp, Homo sapiens
cagggctcccttgcaaggaggg

SEQ ID NO: 7123394 - DNA, 22 bp, Homo sapiens
cagggctccctgcagcctctgt

SEQ ID NO: 7123395 - DNA, 22 bp, Homo sapiens
cagggctccctgcagcctctgt

SEQ ID NO: 7123396 - DNA, 22 bp, Homo sapiens
cagggctccccagagagcctct

SEQ ID NO: 7123397 - DNA, 22 bp, Homo sapiens
cagggctccccagagagcctct

SEQ ID NO: 7123398 - DNA, 22 bp, Homo sapiens
cagggctccccagagagcctct

SEQ ID NO: 7123399 - DNA, 22 bp, Homo sapiens
cagggctccccagagagcctct

SEQ ID NO: 7123400 - DNA, 22 bp, Homo sapiens
cagggctcccaaatatctcttc

SEQ ID NO: 7123401 - DNA, 22 bp, Homo sapiens
cagggctcccaaatatctcttc

SEQ ID NO: 7123402 - DNA, 22 bp, Homo sapiens
cagggcctgcctggttcctgga

SEQ ID NO: 7123403 - DNA, 22 bp, Homo sapiens
cagggcctgcctggttcctgga

SEQ ID NO: 7123404 - DNA, 22 bp, Homo sapiens
cagggctccatgcagggactcc

SEQ ID NO: 7123405 - DNA, 22 bp, Homo sapiens
cagggctcgctcgctcgctcgc

SEQ ID NO: 7123406 - DNA, 22 bp, Homo sapiens
cagggctcgctcgctcgctcgc

SEQ ID NO: 7123407 - DNA, 22 bp, Homo sapiens
cagggctcgctcgctcgctcgc

SEQ ID NO: 7123408 - DNA, 22 bp, Homo sapiens
cagggctcgctcttgcccttcg

SEQ ID NO: 7123409 - DNA, 22 bp, Homo sapiens
cagggctcgctcttgcccttcg

SEQ ID NO: 7123410 - DNA, 22 bp, Homo sapiens
cagggctcgctgccagcttcag

SEQ ID NO: 7123411 - DNA, 22 bp, Homo sapiens
cagggctcgctgccagcttcag

SEQ ID NO: 7123412 - DNA, 22 bp, Homo sapiens
cagggctcgctgccagcttcag

SEQ ID NO: 7123413 - DNA, 22 bp, Homo sapiens
cagggctcgctgccagcttcag

SEQ ID NO: 7123414 - DNA, 22 bp, Homo sapiens
cagggctctgccttgagggatg

SEQ ID NO: 7123415 - DNA, 22 bp, Homo sapiens
cagggctctgccttgagggatg

SEQ ID NO: 7123416 - DNA, 22 bp, Homo sapiens
cagggcttgccttgccccggcg

SEQ ID NO: 7123417 - DNA, 22 bp, Homo sapiens
cagggcttgatctgcatcctgc

SEQ ID NO: 7123418 - DNA, 22 bp, Homo sapiens
cagggcttgatctgcatcctgc

SEQ ID NO: 7123419 - DNA, 22 bp, Homo sapiens
caggggctagcacttaatgttt

SEQ ID NO: 7123420 - DNA, 22 bp, Homo sapiens
caggggctagcacttaatgttt

SEQ ID NO: 7123421 - DNA, 22 bp, Homo sapiens
caggggctccctgggtgccagt

SEQ ID NO: 7123422 - DNA, 22 bp, Homo sapiens
caggggctccctgggtgccagt

SEQ ID NO: 7123423 - DNA, 22 bp, Homo sapiens
caggggctccctgggtgccagt

SEQ ID NO: 7123424 - DNA, 22 bp, Homo sapiens
caggggctccctgggtgccagt

SEQ ID NO: 7123425 - DNA, 22 bp, Homo sapiens
caggggctccctgggtgccagt

SEQ ID NO: 7123426 - DNA, 22 bp, Homo sapiens
cagggcctgagggctgctctgc

SEQ ID NO: 7123427 - DNA, 22 bp, Homo sapiens
cagggcctgcaagagacctggg

SEQ ID NO: 7123428 - DNA, 22 bp, Homo sapiens
cagggcctgcaagagacctggg

SEQ ID NO: 7123429 - DNA, 22 bp, Homo sapiens
cagggcctgcaagagacctggg

SEQ ID NO: 7123430 - DNA, 22 bp, Homo sapiens
cagggcctgcaagagacctggg

SEQ ID NO: 7123431 - DNA, 22 bp, Homo sapiens
cagggcctgcctggttcctgga

SEQ ID NO: 7123432 - DNA, 22 bp, Homo sapiens
cagggcctgcctggttcctgga

SEQ ID NO: 7123433 - DNA, 22 bp, Homo sapiens
cagggcctctgtgggctctctc

SEQ ID NO: 7123434 - DNA, 22 bp, Homo sapiens
cagggcctgagggctgctctgc

SEQ ID NO: 7123435 - DNA, 22 bp, Homo sapiens
cagggcctgagggctgctctgc

SEQ ID NO: 7123436 - DNA, 22 bp, Homo sapiens
cagggcctcctaaggcatctaa

SEQ ID NO: 7123437 - DNA, 22 bp, Homo sapiens
cagggcctcgaagcctctgggc

SEQ ID NO: 7123438 - DNA, 22 bp, Homo sapiens
cagggcctcgaagcctctgggc

SEQ ID NO: 7123439 - DNA, 22 bp, Homo sapiens
cagggcctcgaagcctctgggc

SEQ ID NO: 7123440 - DNA, 22 bp, Homo sapiens
cagggcctctcatcccacgggc

SEQ ID NO: 7123441 - DNA, 22 bp, Homo sapiens
cagggcctctcatcccacgggc

SEQ ID NO: 7123442 - DNA, 22 bp, Homo sapiens
cagggcctctcctccaggaact

SEQ ID NO: 7123443 - DNA, 22 bp, Homo sapiens
cagggcctctcctccaggaact

SEQ ID NO: 7123444 - DNA, 22 bp, Homo sapiens
cagggcctctcctccaggaact

SEQ ID NO: 7123445 - DNA, 22 bp, Homo sapiens
cagggcctctgtgggctctctc

SEQ ID NO: 7123446 - DNA, 22 bp, Homo sapiens
cagggcctctgtgggctctctc

SEQ ID NO: 7123447 - DNA, 22 bp, Homo sapiens
cagggatgtgatgagctgagcc

SEQ ID NO: 7123448 - DNA, 22 bp, Homo sapiens
cagggatgtgatgagctgagcc

SEQ ID NO: 7123449 - DNA, 22 bp, Homo sapiens
cagggatgtctctggaagggag

SEQ ID NO: 7123450 - DNA, 22 bp, Homo sapiens
cagggatgtctctggaagggag

SEQ ID NO: 7123451 - DNA, 22 bp, Homo sapiens
cagggatgtctctggaagggag

SEQ ID NO: 7123452 - DNA, 22 bp, Homo sapiens
cagggatgtctctggaagggag

SEQ ID NO: 7123453 - DNA, 22 bp, Homo sapiens
cagggatgtctctggaagggag

SEQ ID NO: 7123454 - DNA, 22 bp, Homo sapiens
cagggccaggctgatggcctgg

SEQ ID NO: 7123455 - DNA, 23 bp, Homo sapiens
cagggccaggcagcagctgtcac

SEQ ID NO: 7123456 - DNA, 23 bp, Homo sapiens
cagggccaggcagcagctgtcac

SEQ ID NO: 7123457 - DNA, 22 bp, Homo sapiens
cagggcctccccggcagtcttt

SEQ ID NO: 7123458 - DNA, 22 bp, Homo sapiens
cagggcctccccggcagtcttt

SEQ ID NO: 7123459 - DNA, 22 bp, Homo sapiens
cagggcctcctaaggcatctaa

SEQ ID NO: 7123460 - DNA, 22 bp, Homo sapiens
cagggcctcctaaggcatctaa

SEQ ID NO: 7123461 - DNA, 22 bp, Homo sapiens
caggctgcggccgtgtgagcat

SEQ ID NO: 7123462 - DNA, 22 bp, Homo sapiens
caggctgcggccgtgtgagcat

SEQ ID NO: 7123463 - DNA, 22 bp, Homo sapiens
caggctgcggtcggctctggtc

SEQ ID NO: 7123464 - DNA, 22 bp, Homo sapiens
caggctgcggtcggctctggtc

SEQ ID NO: 7123465 - DNA, 22 bp, Homo sapiens
caggctgagctctggcctgggc

SEQ ID NO: 7123466 - DNA, 22 bp, Homo sapiens
caggctgaggcagtagggtttg

SEQ ID NO: 7123467 - DNA, 22 bp, Homo sapiens
caggctgcggccgtgtgagcat

SEQ ID NO: 7123468 - DNA, 22 bp, Homo sapiens
caggctgcggccgtgtgagcat

SEQ ID NO: 7123469 - DNA, 22 bp, Homo sapiens
caggctgcggccgtgtgagcat

SEQ ID NO: 7123470 - DNA, 22 bp, Homo sapiens
caggctgcgtttgtgaaaggta

SEQ ID NO: 7123471 - DNA, 22 bp, Homo sapiens
caggctgctccagggtaggaaa

SEQ ID NO: 7123472 - DNA, 22 bp, Homo sapiens
caggctgctccagggtaggaaa

SEQ ID NO: 7123473 - DNA, 22 bp, Homo sapiens
caggctgcggtcggctctggtc

SEQ ID NO: 7123474 - DNA, 22 bp, Homo sapiens
caggctgcggtcggctctggtc

SEQ ID NO: 7123475 - DNA, 22 bp, Homo sapiens
caggctgcggtcggctctggtc

SEQ ID NO: 7123476 - DNA, 22 bp, Homo sapiens
caggctgcggtcggctctggtc

SEQ ID NO: 7123477 - DNA, 22 bp, Homo sapiens
caggctgcggtcggctctggtc

SEQ ID NO: 7123478 - DNA, 22 bp, Homo sapiens
caggctgcggtcggctctggtc

SEQ ID NO: 7123479 - DNA, 22 bp, Homo sapiens
agctgtggaagactgtcagggt

SEQ ID NO: 7123480 - DNA, 22 bp, Homo sapiens
agctgtggaagactgtcagggt

SEQ ID NO: 7123481 - DNA, 22 bp, Homo sapiens
agctgtgctgccaagttgctga

SEQ ID NO: 7123482 - DNA, 22 bp, Homo sapiens
agctgtggaaatcaggcaatga

SEQ ID NO: 7123483 - DNA, 22 bp, Homo sapiens
agctgtgcacactgtgaagtag

SEQ ID NO: 7123484 - DNA, 22 bp, Homo sapiens
agctgtgattatccactggaat

SEQ ID NO: 7123485 - DNA, 22 bp, Homo sapiens
agctgtgcctattcgtggcaag

SEQ ID NO: 7123486 - DNA, 22 bp, Homo sapiens
agctgtgccttgctgcacggtg

SEQ ID NO: 7123487 - DNA, 22 bp, Homo sapiens
agctgtggaagactgtcagggt

SEQ ID NO: 7123488 - DNA, 22 bp, Homo sapiens
agctgtggagtagggggttgga

SEQ ID NO: 7123489 - DNA, 22 bp, Homo sapiens
agctgtggagtagggggttgga

SEQ ID NO: 7123490 - DNA, 19 bp, Homo sapiens
agctgtggatgtgggattt

SEQ ID NO: 7123491 - DNA, 19 bp, Homo sapiens
agctgtggatgtgggattt

SEQ ID NO: 7123492 - DNA, 19 bp, Homo sapiens
agctgtggatgtgggattt

SEQ ID NO: 7123493 - DNA, 22 bp, Homo sapiens
agctgtggattgggtactttct

SEQ ID NO: 7123494 - DNA, 22 bp, Homo sapiens
agctgtggcaaccttgtcagac

SEQ ID NO: 7123495 - DNA, 22 bp, Homo sapiens
agctgtggcaaccttgtcagac

SEQ ID NO: 7123496 - DNA, 22 bp, Homo sapiens
caggctcactttctcagtcaca

SEQ ID NO: 7123497 - DNA, 22 bp, Homo sapiens
caggctcactttctcagtcaca

SEQ ID NO: 7123498 - DNA, 22 bp, Homo sapiens
caggctcagaagccagtggagc

SEQ ID NO: 7123499 - DNA, 22 bp, Homo sapiens
caggctcagaagccagtggagc

SEQ ID NO: 7123500 - DNA, 22 bp, Homo sapiens
caggctcactgtaaggtcagct

SEQ ID NO: 7123501 - DNA, 22 bp, Homo sapiens
caggctcactgtaaggtcagct

SEQ ID NO: 7123502 - DNA, 22 bp, Homo sapiens
caggctcactttctcagtcaca

SEQ ID NO: 7123503 - DNA, 22 bp, Homo sapiens
caggcctgtctgcacatgaggc

SEQ ID NO: 7123504 - DNA, 22 bp, Homo sapiens
caggctcactgtaaggtcagct

SEQ ID NO: 7123505 - DNA, 22 bp, Homo sapiens
agctggggcatttatccactaa

SEQ ID NO: 7123506 - DNA, 22 bp, Homo sapiens
agctgggcttggccaggtcgct

SEQ ID NO: 7123507 - DNA, 22 bp, Homo sapiens
agctggggcatttatccactaa

SEQ ID NO: 7123508 - DNA, 18 bp, Homo sapiens
agctggggcctctggtcc

SEQ ID NO: 7123509 - DNA, 18 bp, Homo sapiens
agctggggcctctggtcc

SEQ ID NO: 7123510 - DNA, 22 bp, Homo sapiens
agctggggcatttatccactaa

SEQ ID NO: 7123511 - DNA, 18 bp, Homo sapiens
agctggggcctctggtcc

SEQ ID NO: 7123512 - DNA, 18 bp, Homo sapiens
agctggggcctctggtcc

SEQ ID NO: 7123513 - DNA, 22 bp, Homo sapiens
caggctcagcaggagcctgacc

SEQ ID NO: 7123514 - DNA, 22 bp, Homo sapiens
caggctcagatgccctgcgctg

SEQ ID NO: 7123515 - DNA, 22 bp, Homo sapiens
caggctcagatgccctgcgctg

SEQ ID NO: 7123516 - DNA, 22 bp, Homo sapiens
caggctcagaagccagtggagc

SEQ ID NO: 7123517 - DNA, 22 bp, Homo sapiens
caggctcagatgccctgcgctg

SEQ ID NO: 7123518 - DNA, 22 bp, Homo sapiens
caggctcagatgccctgcgctg

SEQ ID NO: 7123519 - DNA, 22 bp, Homo sapiens
caggctcagcaggagcctgacc

SEQ ID NO: 7123520 - DNA, 22 bp, Homo sapiens
caggctcagcaggagcctgacc

SEQ ID NO: 7123521 - DNA, 22 bp, Homo sapiens
caggctcagcaggagcctgacc

SEQ ID NO: 7123522 - DNA, 22 bp, Homo sapiens
caggctcagctctggccagtgc

SEQ ID NO: 7123523 - DNA, 22 bp, Homo sapiens
caggctcagctctggccagtgc

SEQ ID NO: 7123524 - DNA, 22 bp, Homo sapiens
caggctcagctctggccagtgc

SEQ ID NO: 7123525 - DNA, 22 bp, Homo sapiens
caggctccaagccctctgatgt

SEQ ID NO: 7123526 - DNA, 22 bp, Homo sapiens
caggctccacaggggaatccgg

SEQ ID NO: 7123527 - DNA, 22 bp, Homo sapiens
caggctccactgtaggcagctc

SEQ ID NO: 7123528 - DNA, 22 bp, Homo sapiens
caggctccactgtaggcagctc

SEQ ID NO: 7123529 - DNA, 22 bp, Homo sapiens
caggctccactgtaggcagctc

SEQ ID NO: 7123530 - DNA, 22 bp, Homo sapiens
agctgtgaattttatgctagtg

SEQ ID NO: 7123531 - DNA, 22 bp, Homo sapiens
caggctccactgtaggcagctc

SEQ ID NO: 7123532 - DNA, 22 bp, Homo sapiens
agctgtgattatccactggaat

SEQ ID NO: 7123533 - DNA, 22 bp, Homo sapiens
agctgtgattatccactggaat

SEQ ID NO: 7123534 - DNA, 22 bp, Homo sapiens
cagggagctattagggttagtg

SEQ ID NO: 7123535 - DNA, 22 bp, Homo sapiens
caggctggagttacctttaggg

SEQ ID NO: 7123536 - DNA, 22 bp, Homo sapiens
cagggagaaatctccaggaggt

SEQ ID NO: 7123537 - DNA, 22 bp, Homo sapiens
cagggagaaatctccaggaggt

SEQ ID NO: 7123538 - DNA, 22 bp, Homo sapiens
caggctggagttacctttaggg

SEQ ID NO: 7123539 - DNA, 22 bp, Homo sapiens
caggctggagtgcagttgtgca

SEQ ID NO: 7123540 - DNA, 22 bp, Homo sapiens
caggctggagttacctttaggg

SEQ ID NO: 7123541 - DNA, 22 bp, Homo sapiens
caggctggagtgcagttgtgca

SEQ ID NO: 7123542 - DNA, 22 bp, Homo sapiens
caggctggagtgcagttgtgca

SEQ ID NO: 7123543 - DNA, 22 bp, Homo sapiens
caggctggagtgcagtgtcgcc

SEQ ID NO: 7123544 - DNA, 22 bp, Homo sapiens
caggctggagtgcagttgtgca

SEQ ID NO: 7123545 - DNA, 22 bp, Homo sapiens
caggctggagtgcagttgtgca

SEQ ID NO: 7123546 - DNA, 22 bp, Homo sapiens
caggctggagtgcagttgtgca

SEQ ID NO: 7123547 - DNA, 22 bp, Homo sapiens
caggctggagtgcagtgtcgcc

SEQ ID NO: 7123548 - DNA, 22 bp, Homo sapiens
caggctggagtgcagtgtcgcc

SEQ ID NO: 7123549 - DNA, 22 bp, Homo sapiens
caggctggagtgcagtgtcgcc

SEQ ID NO: 7123550 - DNA, 22 bp, Homo sapiens
caggctggagtgcagtggtgcc

SEQ ID NO: 7123551 - DNA, 22 bp, Homo sapiens
caggctggagtgcagtggtgcc

SEQ ID NO: 7123552 - DNA, 22 bp, Homo sapiens
caggctggagtacaattgtgtg

SEQ ID NO: 7123553 - DNA, 22 bp, Homo sapiens
caggctggacattagatacata

SEQ ID NO: 7123554 - DNA, 22 bp, Homo sapiens
caggctggacattagatacata

SEQ ID NO: 7123555 - DNA, 22 bp, Homo sapiens
caggctggacattagatacata

SEQ ID NO: 7123556 - DNA, 22 bp, Homo sapiens
caggctgctgtccacaaagcat

SEQ ID NO: 7123557 - DNA, 22 bp, Homo sapiens
caggctgctgtccacaaagcat

SEQ ID NO: 7123558 - DNA, 22 bp, Homo sapiens
caggctgctgcctagaatgaca

SEQ ID NO: 7123559 - DNA, 22 bp, Homo sapiens
caggctgctgcctagaatgaca

SEQ ID NO: 7123560 - DNA, 22 bp, Homo sapiens
cagggagctgacaaccaaggag

SEQ ID NO: 7123561 - DNA, 22 bp, Homo sapiens
cagggagctctgggccggactc

SEQ ID NO: 7123562 - DNA, 22 bp, Homo sapiens
cagggagctgacaaccaaggag

SEQ ID NO: 7123563 - DNA, 22 bp, Homo sapiens
cagggagctggagttggagtac

SEQ ID NO: 7123564 - DNA, 22 bp, Homo sapiens
cagggagctctgggccggactc

SEQ ID NO: 7123565 - DNA, 22 bp, Homo sapiens
cagggagctggctggctgtgcc

SEQ ID NO: 7123566 - DNA, 22 bp, Homo sapiens
cagggagctggctggcgtgagt

SEQ ID NO: 7123567 - DNA, 22 bp, Homo sapiens
cagggagctggctggcgtgagt

SEQ ID NO: 7123568 - DNA, 22 bp, Homo sapiens
cagggagctggctggctgtgcc

SEQ ID NO: 7123569 - DNA, 22 bp, Homo sapiens
cagggatgggatggagtcagtt

SEQ ID NO: 7123570 - DNA, 22 bp, Homo sapiens
cagggatgggatggagtcagtt

SEQ ID NO: 7123571 - DNA, 19 bp, Homo sapiens
cagggatgggtagggactc

SEQ ID NO: 7123572 - DNA, 19 bp, Homo sapiens
cagggatgggtagggactc

SEQ ID NO: 7123573 - DNA, 22 bp, Homo sapiens
cagggatggttgagaattggta

SEQ ID NO: 7123574 - DNA, 22 bp, Homo sapiens
cagggatgggatggagtcagtt

SEQ ID NO: 7123575 - DNA, 22 bp, Homo sapiens
cagggatgggatggagtcagtt

SEQ ID NO: 7123576 - DNA, 22 bp, Homo sapiens
cagggagctttcccaggaccct

SEQ ID NO: 7123577 - DNA, 22 bp, Homo sapiens
cagggagctttcccaggaccct

SEQ ID NO: 7123578 - DNA, 22 bp, Homo sapiens
cagggagctggtgccagccgac

SEQ ID NO: 7123579 - DNA, 22 bp, Homo sapiens
cagggagctggctggctgtgcc

SEQ ID NO: 7123580 - DNA, 22 bp, Homo sapiens
caggaagggggatccttggaag

SEQ ID NO: 7123581 - DNA, 22 bp, Homo sapiens
agctgcagtcaagctgggccac

SEQ ID NO: 7123582 - DNA, 22 bp, Homo sapiens
agctgcagtgaactgttttgtc

SEQ ID NO: 7123583 - DNA, 20 bp, Homo sapiens
agctgcatatttatgtgtac

SEQ ID NO: 7123584 - DNA, 22 bp, Homo sapiens
agctgcatttcagctgtgacct

SEQ ID NO: 7123585 - DNA, 22 bp, Homo sapiens
agctgccaagttggagtagcaa

SEQ ID NO: 7123586 - DNA, 22 bp, Homo sapiens
agctgccaagtttctcagttta

SEQ ID NO: 7123587 - DNA, 22 bp, Homo sapiens
agctgccacagagcctggccag

SEQ ID NO: 7123588 - DNA, 22 bp, Homo sapiens
agctgccacagagcctggccag

SEQ ID NO: 7123589 - DNA, 22 bp, Homo sapiens
agctgccacagagcctggccag

SEQ ID NO: 7123590 - DNA, 22 bp, Homo sapiens
agctgccacatgcccaagggca

SEQ ID NO: 7123591 - DNA, 22 bp, Homo sapiens
agctgccacatgcccaagggca

SEQ ID NO: 7123592 - DNA, 22 bp, Homo sapiens
agctgccacatggtgtcactgt

SEQ ID NO: 7123593 - DNA, 19 bp, Homo sapiens
caggaaggggcgaatctgg

SEQ ID NO: 7123594 - DNA, 22 bp, Homo sapiens
caggaaggggctcactctggcc

SEQ ID NO: 7123595 - DNA, 22 bp, Homo sapiens
caggaaggggctcactctggcc

SEQ ID NO: 7123596 - DNA, 22 bp, Homo sapiens
caggaaggggctcactctggcc

SEQ ID NO: 7123597 - DNA, 22 bp, Homo sapiens
caggaaggggctcactctggcc

SEQ ID NO: 7123598 - DNA, 22 bp, Homo sapiens
caggaaggcgcggctgtgcctg

SEQ ID NO: 7123599 - DNA, 22 bp, Homo sapiens
caggaaggcgcggctgtgcctg

SEQ ID NO: 7123600 - DNA, 22 bp, Homo sapiens
caggaaggcgcggctgtgcctg

SEQ ID NO: 7123601 - DNA, 22 bp, Homo sapiens
caggaaggcgcggctgtgcctg

SEQ ID NO: 7123602 - DNA, 22 bp, Homo sapiens
caggaaggcgcggctgtgcctg

SEQ ID NO: 7123603 - DNA, 22 bp, Homo sapiens
caggaaggcccacctgtcctgt

SEQ ID NO: 7123604 - DNA, 22 bp, Homo sapiens
caggaaggcccacctgtcctgt

SEQ ID NO: 7123605 - DNA, 22 bp, Homo sapiens
caggaaggcccacctgtcctgt

SEQ ID NO: 7123606 - DNA, 22 bp, Homo sapiens
agctgcagataggatgttattt

SEQ ID NO: 7123607 - DNA, 22 bp, Homo sapiens
agctgcagataggatgttattt

SEQ ID NO: 7123608 - DNA, 22 bp, Homo sapiens
agctgcagagaaaagaggctgg

SEQ ID NO: 7123609 - DNA, 18 bp, Homo sapiens
agctgcagaccaggaggt

SEQ ID NO: 7123610 - DNA, 22 bp, Homo sapiens
agctgcagagaaaagaggctgg

SEQ ID NO: 7123611 - DNA, 22 bp, Homo sapiens
agctgcagagaaaagaggctgg

SEQ ID NO: 7123612 - DNA, 18 bp, Homo sapiens
agctgcagaccaggaggt

SEQ ID NO: 7123613 - DNA, 19 bp, Homo sapiens
agctgcagaccagaagtgc

SEQ ID NO: 7123614 - DNA, 22 bp, Homo sapiens
agctgcagaaaggacaactaat

SEQ ID NO: 7123615 - DNA, 20 bp, Homo sapiens
agctgcagaacccactggac

SEQ ID NO: 7123616 - DNA, 20 bp, Homo sapiens
agctgcagaacccactggac

SEQ ID NO: 7123617 - DNA, 20 bp, Homo sapiens
agctgcagaacccactggac

SEQ ID NO: 7123618 - DNA, 22 bp, Homo sapiens
agctgcagcactccagtagccg

SEQ ID NO: 7123619 - DNA, 22 bp, Homo sapiens
agctgcagattctatctagaag

SEQ ID NO: 7123620 - DNA, 22 bp, Homo sapiens
agctgcagattctatctagaag

SEQ ID NO: 7123621 - DNA, 23 bp, Homo sapiens
agctgcagatgctcagcgggcag

SEQ ID NO: 7123622 - DNA, 22 bp, Homo sapiens
caggaagagaacatggaggctg

SEQ ID NO: 7123623 - DNA, 22 bp, Homo sapiens
caggaagagaacatggaggctg

SEQ ID NO: 7123624 - DNA, 21 bp, Homo sapiens
agctgcagccatgtacatggc

SEQ ID NO: 7123625 - DNA, 22 bp, Homo sapiens
agctgcagcactccagtagccg

SEQ ID NO: 7123626 - DNA, 22 bp, Homo sapiens
caggaaggcccacctgtcctgt

SEQ ID NO: 7123627 - DNA, 22 bp, Homo sapiens
caggaaggcccacctgtcctgt

SEQ ID NO: 7123628 - DNA, 22 bp, Homo sapiens
caggaagagaacatggaggctg

SEQ ID NO: 7123629 - DNA, 22 bp, Homo sapiens
caggaagagaacatggaggctg

SEQ ID NO: 7123630 - DNA, 22 bp, Homo sapiens
caggaaggaccgtccagatcag

SEQ ID NO: 7123631 - DNA, 22 bp, Homo sapiens
caggaaggaccgtccagatcag

SEQ ID NO: 7123632 - DNA, 22 bp, Homo sapiens
cagctctgtaaattccttcatc

SEQ ID NO: 7123633 - DNA, 22 bp, Homo sapiens
cagctctgtaaattccttcatc

SEQ ID NO: 7123634 - DNA, 22 bp, Homo sapiens
cagctctgtaaattccttcatc

SEQ ID NO: 7123635 - DNA, 22 bp, Homo sapiens
cagctctgtaaattccttcatc

SEQ ID NO: 7123636 - DNA, 22 bp, Homo sapiens
cagctctgtaaattccttcatc

SEQ ID NO: 7123637 - DNA, 22 bp, Homo sapiens
cagctctggttcctgggcccag

SEQ ID NO: 7123638 - DNA, 22 bp, Homo sapiens
cagctctggttcctgggcccag

SEQ ID NO: 7123639 - DNA, 22 bp, Homo sapiens
cagctctgtaaattccttcatc

SEQ ID NO: 7123640 - DNA, 22 bp, Homo sapiens
cagctctgtctgtagaaacttc

SEQ ID NO: 7123641 - DNA, 22 bp, Homo sapiens
cagctctgtctgtagaaacttc

SEQ ID NO: 7123642 - DNA, 22 bp, Homo sapiens
cagctgaagcccaggcagaacc

SEQ ID NO: 7123643 - DNA, 22 bp, Homo sapiens
cagctgaagcccaggcagaacc

SEQ ID NO: 7123644 - DNA, 22 bp, Homo sapiens
cagctgaagctcttgtcaaagg

SEQ ID NO: 7123645 - DNA, 22 bp, Homo sapiens
cagctgaagctcttgtcaaagg

SEQ ID NO: 7123646 - DNA, 22 bp, Homo sapiens
cagctgaaggtaggaaccagga

SEQ ID NO: 7123647 - DNA, 22 bp, Homo sapiens
cagctgaatcagtgagtggaaa

SEQ ID NO: 7123648 - DNA, 22 bp, Homo sapiens
cagctgaatggctccctgctaa

SEQ ID NO: 7123649 - DNA, 22 bp, Homo sapiens
cagctgaattcttcagactcca

SEQ ID NO: 7123650 - DNA, 22 bp, Homo sapiens
cagctgaattcttcagactcca

SEQ ID NO: 7123651 - DNA, 22 bp, Homo sapiens
cagctgacaaactctgagctta

SEQ ID NO: 7123652 - DNA, 22 bp, Homo sapiens
cagctgacaagagtccttggag

SEQ ID NO: 7123653 - DNA, 22 bp, Homo sapiens
cagctgacactttgacctagag

SEQ ID NO: 7123654 - DNA, 22 bp, Homo sapiens
cagctgacccagtgaggaggca

SEQ ID NO: 7123655 - DNA, 22 bp, Homo sapiens
cagctgacccgtgggaggcggg

SEQ ID NO: 7123656 - DNA, 22 bp, Homo sapiens
cagctctgggtgacaggagggc

SEQ ID NO: 7123657 - DNA, 22 bp, Homo sapiens
cagctctgggtgacaggagggc

SEQ ID NO: 7123658 - DNA, 22 bp, Homo sapiens
cagctctgggtgacaggagggc

SEQ ID NO: 7123659 - DNA, 22 bp, Homo sapiens
cagctctgggtgacaggagggc

SEQ ID NO: 7123660 - DNA, 22 bp, Homo sapiens
cagctctgggtgacaggagggc

SEQ ID NO: 7123661 - DNA, 22 bp, Homo sapiens
cagctctgggtgacaggagggc

SEQ ID NO: 7123662 - DNA, 22 bp, Homo sapiens
cagctctgggtgacaggagggc

SEQ ID NO: 7123663 - DNA, 22 bp, Homo sapiens
cagctctggtccagggagggca

SEQ ID NO: 7123664 - DNA, 22 bp, Homo sapiens
cagctctggtccagggagggca

SEQ ID NO: 7123665 - DNA, 22 bp, Homo sapiens
cagctctggtccagggagggca

SEQ ID NO: 7123666 - DNA, 22 bp, Homo sapiens
cagctctggtccagggagggca

SEQ ID NO: 7123667 - DNA, 22 bp, Homo sapiens
cagctctggttcctgggcccag

SEQ ID NO: 7123668 - DNA, 22 bp, Homo sapiens
cagctctggttcctgggcccag

SEQ ID NO: 7123669 - DNA, 22 bp, Homo sapiens
cagctctggttcctgggcccag

SEQ ID NO: 7123670 - DNA, 22 bp, Homo sapiens
cagctctggttcctgggcccag

SEQ ID NO: 7123671 - DNA, 20 bp, Homo sapiens
cagctctgggcaggtcgagg

SEQ ID NO: 7123672 - DNA, 22 bp, Homo sapiens
cagctctggggcagagtgacta

SEQ ID NO: 7123673 - DNA, 22 bp, Homo sapiens
cagctctggggcagagtgacta

SEQ ID NO: 7123674 - DNA, 22 bp, Homo sapiens
cagctctggggcagagtgacta

SEQ ID NO: 7123675 - DNA, 22 bp, Homo sapiens
cagctctggggcagagtgacta

SEQ ID NO: 7123676 - DNA, 22 bp, Homo sapiens
cagctctggggcagagtgacta

SEQ ID NO: 7123677 - DNA, 22 bp, Homo sapiens
cagctctggggcagagtgacta

SEQ ID NO: 7123678 - DNA, 22 bp, Homo sapiens
cagctctgggtaggaggaatct

SEQ ID NO: 7123679 - DNA, 22 bp, Homo sapiens
cagctctgggtaggaggaatct

SEQ ID NO: 7123680 - DNA, 22 bp, Homo sapiens
cagctctgggtaggaggaatct

SEQ ID NO: 7123681 - DNA, 22 bp, Homo sapiens
cagctctgggtgacaggagggc

SEQ ID NO: 7123682 - DNA, 22 bp, Homo sapiens
cagctctgggtgacaggagggc

SEQ ID NO: 7123683 - DNA, 22 bp, Homo sapiens
cagctgagaagtgatagctgca

SEQ ID NO: 7123684 - DNA, 22 bp, Homo sapiens
cagctgagaccagaatgcaggt

SEQ ID NO: 7123685 - DNA, 22 bp, Homo sapiens
cagctgagaagtgatagctgca

SEQ ID NO: 7123686 - DNA, 22 bp, Homo sapiens
cagctgagaagtgatagctgca

SEQ ID NO: 7123687 - DNA, 22 bp, Homo sapiens
cagctgagaaggtctgatcagg

SEQ ID NO: 7123688 - DNA, 22 bp, Homo sapiens
cagctgagaaaggcaggctcac

SEQ ID NO: 7123689 - DNA, 23 bp, Homo sapiens
agctgaggctgtgggtgtcagag

SEQ ID NO: 7123690 - DNA, 22 bp, Homo sapiens
cagctgagaccagaatgcaggt

SEQ ID NO: 7123691 - DNA, 22 bp, Homo sapiens
agctgattccactttttcccca

SEQ ID NO: 7123692 - DNA, 22 bp, Homo sapiens
agctgagggcaggatggggtga

SEQ ID NO: 7123693 - DNA, 22 bp, Homo sapiens
agctgattccactttttcccca

SEQ ID NO: 7123694 - DNA, 22 bp, Homo sapiens
agctgatttttaggagacagga

SEQ ID NO: 7123695 - DNA, 23 bp, Homo sapiens
agctgcaagactccctgtctgag

SEQ ID NO: 7123696 - DNA, 23 bp, Homo sapiens
agctgcaagactccctgtctgag

SEQ ID NO: 7123697 - DNA, 22 bp, Homo sapiens
agctgcaactgtccttgccttg

SEQ ID NO: 7123698 - DNA, 22 bp, Homo sapiens
agctgcaagaagaggtccctga

SEQ ID NO: 7123699 - DNA, 22 bp, Homo sapiens
agctgcaacatctgcttgtccc

SEQ ID NO: 7123700 - DNA, 22 bp, Homo sapiens
agctgcaacatctgcttgtccc

SEQ ID NO: 7123701 - DNA, 22 bp, Homo sapiens
agctgcaaccttagctataggc

SEQ ID NO: 7123702 - DNA, 21 bp, Homo sapiens
agctgcaaaaacatacagttc

SEQ ID NO: 7123703 - DNA, 19 bp, Homo sapiens
agctgcaaaaggtggaact

SEQ ID NO: 7123704 - DNA, 22 bp, Homo sapiens
agctgcaaaccaggccggcgcg

SEQ ID NO: 7123705 - DNA, 22 bp, Homo sapiens
agctgcaaagatctgtcagtca

SEQ ID NO: 7123706 - DNA, 22 bp, Homo sapiens
agctgcaaagatgatttgttgt

SEQ ID NO: 7123707 - DNA, 22 bp, Homo sapiens
agctgcaaaggcacacttgggc

SEQ ID NO: 7123708 - DNA, 22 bp, Homo sapiens
agctgcaaaggcacacttgggc

SEQ ID NO: 7123709 - DNA, 20 bp, Homo sapiens
agctgcaacagactgtatgg

SEQ ID NO: 7123710 - DNA, 22 bp, Homo sapiens
agctgcactgtgaagttcatag

SEQ ID NO: 7123711 - DNA, 22 bp, Homo sapiens
agctgcaattctggacatagtc

SEQ ID NO: 7123712 - DNA, 22 bp, Homo sapiens
agctgcactgacctgtatgaag

SEQ ID NO: 7123713 - DNA, 22 bp, Homo sapiens
agctgcaagtgttgcctcctac

SEQ ID NO: 7123714 - DNA, 22 bp, Homo sapiens
agctgcaatacccttcttcctt

SEQ ID NO: 7123715 - DNA, 22 bp, Homo sapiens
agctgcaattaaagactgtgaa

SEQ ID NO: 7123716 - DNA, 21 bp, Homo sapiens
agctgcaagagcaacatcttt

SEQ ID NO: 7123717 - DNA, 22 bp, Homo sapiens
agctgcaagataaaagtgatgt

SEQ ID NO: 7123718 - DNA, 22 bp, Homo sapiens
agctgcaagatttcttttgtat

SEQ ID NO: 7123719 - DNA, 14 bp, Homo sapiens
agctgcaagcatcc

SEQ ID NO: 7123720 - DNA, 22 bp, Homo sapiens
agctgcaagtaagcttgctcct

SEQ ID NO: 7123721 - DNA, 22 bp, Homo sapiens
agctgcaagtccaaaggaatta

SEQ ID NO: 7123722 - DNA, 22 bp, Homo sapiens
agctgcaagtctgtgtggggag

SEQ ID NO: 7123723 - DNA, 22 bp, Homo sapiens
agctgggctgggctgagctgag

SEQ ID NO: 7123724 - DNA, 22 bp, Homo sapiens
agctgggctgggctgagctgag

SEQ ID NO: 7123725 - DNA, 22 bp, Homo sapiens
agctgggctgggctgagctgag

SEQ ID NO: 7123726 - DNA, 22 bp, Homo sapiens
agctgggctggagctccaagcg

SEQ ID NO: 7123727 - DNA, 22 bp, Homo sapiens
agctgggcttggccaggtcgct

SEQ ID NO: 7123728 - DNA, 22 bp, Homo sapiens
agctgggcttggccaggtcgct

SEQ ID NO: 7123729 - DNA, 19 bp, Homo sapiens
agctgggctgtcacagtga

SEQ ID NO: 7123730 - DNA, 22 bp, Homo sapiens
agctgggctgggctgagctgag

SEQ ID NO: 7123731 - DNA, 22 bp, Homo sapiens
agctgggctgggctgagctgag

SEQ ID NO: 7123732 - DNA, 19 bp, Homo sapiens
agctgggctgtcacagtga

SEQ ID NO: 7123733 - DNA, 19 bp, Homo sapiens
agctgggcttactcactcg

SEQ ID NO: 7123734 - DNA, 22 bp, Homo sapiens
caggccagagtccaactccaga

SEQ ID NO: 7123735 - DNA, 22 bp, Homo sapiens
caggccagagtccaactccaga

SEQ ID NO: 7123736 - DNA, 22 bp, Homo sapiens
caggccagagtccaactccaga

SEQ ID NO: 7123737 - DNA, 22 bp, Homo sapiens
caggccagcagggcctccgtgg

SEQ ID NO: 7123738 - DNA, 22 bp, Homo sapiens
caggccagcagggcctccgtgg

SEQ ID NO: 7123739 - DNA, 22 bp, Homo sapiens
caggccagcggcccgcgcgttc

SEQ ID NO: 7123740 - DNA, 22 bp, Homo sapiens
caggccagcggcccgcgcgttc

SEQ ID NO: 7123741 - DNA, 22 bp, Homo sapiens
caggccagcgtccagaacaagc

SEQ ID NO: 7123742 - DNA, 22 bp, Homo sapiens
caggccagcgtccagaacaagc

SEQ ID NO: 7123743 - DNA, 22 bp, Homo sapiens
caggccagcttcctgacatcct

SEQ ID NO: 7123744 - DNA, 22 bp, Homo sapiens
caggccagcttcctgacatcct

SEQ ID NO: 7123745 - DNA, 22 bp, Homo sapiens
caggccaggctgcatttgcccc

SEQ ID NO: 7123746 - DNA, 22 bp, Homo sapiens
caggccaggctgcatttgcccc

SEQ ID NO: 7123747 - DNA, 22 bp, Homo sapiens
caggcacttctgctgcttgtct

SEQ ID NO: 7123748 - DNA, 22 bp, Homo sapiens
caggcactgtgttaggcactgt

SEQ ID NO: 7123749 - DNA, 22 bp, Homo sapiens
caggcacttctgctgcttgtct

SEQ ID NO: 7123750 - DNA, 22 bp, Homo sapiens
caggcactgtgttaggcactgt

SEQ ID NO: 7123751 - DNA, 22 bp, Homo sapiens
caggcactgtgctgagctctgc

SEQ ID NO: 7123752 - DNA, 22 bp, Homo sapiens
caggcactgtgttaggcactgt

SEQ ID NO: 7123753 - DNA, 22 bp, Homo sapiens
caggcactgtgttaggcactgt

SEQ ID NO: 7123754 - DNA, 22 bp, Homo sapiens
caggcactgtgctgagctctgc

SEQ ID NO: 7123755 - DNA, 20 bp, Homo sapiens
agctggcccacaggtgtggg

SEQ ID NO: 7123756 - DNA, 22 bp, Homo sapiens
agctggcccactgtgtggtcca

SEQ ID NO: 7123757 - DNA, 22 bp, Homo sapiens
agctggcccactgtgtggtcca

SEQ ID NO: 7123758 - DNA, 20 bp, Homo sapiens
agctggcccccggtggcctg

SEQ ID NO: 7123759 - DNA, 22 bp, Homo sapiens
agctggccctcgagagccaatt

SEQ ID NO: 7123760 - DNA, 18 bp, Homo sapiens
agctggccctggctgccg

SEQ ID NO: 7123761 - DNA, 18 bp, Homo sapiens
agctggccctggctgccg

SEQ ID NO: 7123762 - DNA, 18 bp, Homo sapiens
agctggccctggctgccg

SEQ ID NO: 7123763 - DNA, 22 bp, Homo sapiens
agctggccggcctccaggtgga

SEQ ID NO: 7123764 - DNA, 22 bp, Homo sapiens
agctggccggcctccaggtgga

SEQ ID NO: 7123765 - DNA, 20 bp, Homo sapiens
caggcagtttgtggttaggg

SEQ ID NO: 7123766 - DNA, 22 bp, Homo sapiens
agctggcctccgggtgcctggg

SEQ ID NO: 7123767 - DNA, 22 bp, Homo sapiens
agctggcctccgggtgcctggg

SEQ ID NO: 7123768 - DNA, 22 bp, Homo sapiens
caggaggaggtgaggtagaact

SEQ ID NO: 7123769 - DNA, 22 bp, Homo sapiens
caggaggagggtacaccatcag

SEQ ID NO: 7123770 - DNA, 22 bp, Homo sapiens
caggaggagggtacaccatcag

SEQ ID NO: 7123771 - DNA, 22 bp, Homo sapiens
caggaggagctggccgcctcat

SEQ ID NO: 7123772 - DNA, 22 bp, Homo sapiens
agctgctgagccatgtcctgct

SEQ ID NO: 7123773 - DNA, 19 bp, Homo sapiens
agctgctgattggtggagg

SEQ ID NO: 7123774 - DNA, 22 bp, Homo sapiens
caggaggattgcttgaggccag

SEQ ID NO: 7123775 - DNA, 22 bp, Homo sapiens
caggaggacatactggctcaca

SEQ ID NO: 7123776 - DNA, 22 bp, Homo sapiens
caggaggacatactggctcaca

SEQ ID NO: 7123777 - DNA, 22 bp, Homo sapiens
caggaggacatactggctcaca

SEQ ID NO: 7123778 - DNA, 22 bp, Homo sapiens
caggaggagcattagcgtctca

SEQ ID NO: 7123779 - DNA, 23 bp, Homo sapiens
caggaggagaaggcttggttggc

SEQ ID NO: 7123780 - DNA, 22 bp, Homo sapiens
caggaggagcattagcgtctca

SEQ ID NO: 7123781 - DNA, 22 bp, Homo sapiens
agctgccacatggtgtcactgt

SEQ ID NO: 7123782 - DNA, 21 bp, Homo sapiens
agctgccaccctagcttctga

SEQ ID NO: 7123783 - DNA, 21 bp, Homo sapiens
agctgccaccctagcttctga

SEQ ID NO: 7123784 - DNA, 22 bp, Homo sapiens
agctgccactgagggtgcacag

SEQ ID NO: 7123785 - DNA, 22 bp, Homo sapiens
agctgccactgagggtgcacag

SEQ ID NO: 7123786 - DNA, 22 bp, Homo sapiens
caggagccccaggctgacaata

SEQ ID NO: 7123787 - DNA, 22 bp, Homo sapiens
caggcactgtgctagatccttg

SEQ ID NO: 7123788 - DNA, 22 bp, Homo sapiens
caggcactgtgctgagctctgc

SEQ ID NO: 7123789 - DNA, 22 bp, Homo sapiens
caggcactggggatgctgggat

SEQ ID NO: 7123790 - DNA, 22 bp, Homo sapiens
caggcactggggatgctgggat

SEQ ID NO: 7123791 - DNA, 22 bp, Homo sapiens
caggcactggggatgctgggat

SEQ ID NO: 7123792 - DNA, 22 bp, Homo sapiens
caggcactggccagtcagcaca

SEQ ID NO: 7123793 - DNA, 22 bp, Homo sapiens
caggcactggccagtcagcaca

SEQ ID NO: 7123794 - DNA, 22 bp, Homo sapiens
caggcactggggatgctgggat

SEQ ID NO: 7123795 - DNA, 22 bp, Homo sapiens
caggcactggggatgctgggat

SEQ ID NO: 7123796 - DNA, 22 bp, Homo sapiens
caggcactgtgcaagggtctcg

SEQ ID NO: 7123797 - DNA, 22 bp, Homo sapiens
caggcactgtgcaagggtctcg

SEQ ID NO: 7123798 - DNA, 22 bp, Homo sapiens
caggcactcattcagagaggtg

SEQ ID NO: 7123799 - DNA, 22 bp, Homo sapiens
caggcactcattcagagaggtg

SEQ ID NO: 7123800 - DNA, 22 bp, Homo sapiens
caggcactcattcagagaggtg

SEQ ID NO: 7123801 - DNA, 22 bp, Homo sapiens
caggcactcattcagagaggtg

SEQ ID NO: 7123802 - DNA, 22 bp, Homo sapiens
caggcacactgtctacactgag

SEQ ID NO: 7123803 - DNA, 22 bp, Homo sapiens
caggcactcattcagagaggtg

SEQ ID NO: 7123804 - DNA, 22 bp, Homo sapiens
caggcactcattcagagaggtg

SEQ ID NO: 7123805 - DNA, 22 bp, Homo sapiens
caggcactgcactaccactttt

SEQ ID NO: 7123806 - DNA, 22 bp, Homo sapiens
caggcactgcactaccactttt

SEQ ID NO: 7123807 - DNA, 22 bp, Homo sapiens
caggcactggccagtcagcaca

SEQ ID NO: 7123808 - DNA, 22 bp, Homo sapiens
caggcactggccagtcagcaca

SEQ ID NO: 7123809 - DNA, 22 bp, Homo sapiens
caggcactggccagtcagcaca

SEQ ID NO: 7123810 - DNA, 22 bp, Homo sapiens
caggcactggccagtcagcaca

SEQ ID NO: 7123811 - DNA, 19 bp, Homo sapiens
agctgctggcccagggacc

SEQ ID NO: 7123812 - DNA, 19 bp, Homo sapiens
agctgctggcccagggacc

SEQ ID NO: 7123813 - DNA, 19 bp, Homo sapiens
agctgctggcccagggacc

SEQ ID NO: 7123814 - DNA, 22 bp, Homo sapiens
agctgctgggaccccagatcca

SEQ ID NO: 7123815 - DNA, 22 bp, Homo sapiens
caggcacactgtctacactgag

SEQ ID NO: 7123816 - DNA, 22 bp, Homo sapiens
caggcacactgtctacactgag

SEQ ID NO: 7123817 - DNA, 22 bp, Homo sapiens
caggcacactgtctacactgag

SEQ ID NO: 7123818 - DNA, 22 bp, Homo sapiens
agctgctgcccataggtgacat

SEQ ID NO: 7123819 - DNA, 22 bp, Homo sapiens
agctgctgcccataggtgacat

SEQ ID NO: 7123820 - DNA, 22 bp, Homo sapiens
agctgctgccggtggccaccct

SEQ ID NO: 7123821 - DNA, 22 bp, Homo sapiens
agctgctgccggtggccaccct

SEQ ID NO: 7123822 - DNA, 22 bp, Homo sapiens
agctgctgcctcactggtctgt

SEQ ID NO: 7123823 - DNA, 22 bp, Homo sapiens
agctgctgcgcctcaccctggc

SEQ ID NO: 7123824 - DNA, 22 bp, Homo sapiens
ccaaggtggctacagccctgca

SEQ ID NO: 7123825 - DNA, 22 bp, Homo sapiens
ccaaggtgggcagatcacgagg

SEQ ID NO: 7123826 - DNA, 22 bp, Homo sapiens
ccaaggtgggcagatcacgagg

SEQ ID NO: 7123827 - DNA, 22 bp, Homo sapiens
ccaaggttagaaaaggtacttt

SEQ ID NO: 7123828 - DNA, 22 bp, Homo sapiens
ccaaggttgagaaactgtagga

SEQ ID NO: 7123829 - DNA, 22 bp, Homo sapiens
ccaagggctgctgaggtgtcca

SEQ ID NO: 7123830 - DNA, 22 bp, Homo sapiens
ccaagggctctggacagagtgg

SEQ ID NO: 7123831 - DNA, 22 bp, Homo sapiens
ccaagggctctggacagagtgg

SEQ ID NO: 7123832 - DNA, 22 bp, Homo sapiens
ccaagggctatttacagaacag

SEQ ID NO: 7123833 - DNA, 22 bp, Homo sapiens
ccaagggctatttacagaacag

SEQ ID NO: 7123834 - DNA, 22 bp, Homo sapiens
ccaaggactggacacacaggtt

SEQ ID NO: 7123835 - DNA, 22 bp, Homo sapiens
ccaagctggacagcagcaagga

SEQ ID NO: 7123836 - DNA, 22 bp, Homo sapiens
ccaagctggatttagctgcaca

SEQ ID NO: 7123837 - DNA, 22 bp, Homo sapiens
ccaatattatgaaagtgtgaca

SEQ ID NO: 7123838 - DNA, 18 bp, Homo sapiens
aggcaggctggagtgact

SEQ ID NO: 7123839 - DNA, 18 bp, Homo sapiens
aggcaggctggagtgact

SEQ ID NO: 7123840 - DNA, 22 bp, Homo sapiens
aggcaggctggtctgaagagtg

SEQ ID NO: 7123841 - DNA, 22 bp, Homo sapiens
ccaatacactttatagaagaaa

SEQ ID NO: 7123842 - DNA, 22 bp, Homo sapiens
ccaatactctttctccctgtgt

SEQ ID NO: 7123843 - DNA, 22 bp, Homo sapiens
ccaatactgaacttaaaagtat

SEQ ID NO: 7123844 - DNA, 22 bp, Homo sapiens
ccaatactgttgattcatagtg

SEQ ID NO: 7123845 - DNA, 22 bp, Homo sapiens
ccaatacttagattaaaatagt

SEQ ID NO: 7123846 - DNA, 22 bp, Homo sapiens
ccaatagagtgctgtaagaatt

SEQ ID NO: 7123847 - DNA, 22 bp, Homo sapiens
ccaagtgatacacccgcctcgg

SEQ ID NO: 7123848 - DNA, 22 bp, Homo sapiens
ccaagttaccagcaatataagt

SEQ ID NO: 7123849 - DNA, 22 bp, Homo sapiens
ccaagtgttttataagggacag

SEQ ID NO: 7123850 - DNA, 22 bp, Homo sapiens
ccaagtcctgctgccactctac

SEQ ID NO: 7123851 - DNA, 20 bp, Homo sapiens
ccaaggttggaggcagggtg

SEQ ID NO: 7123852 - DNA, 19 bp, Homo sapiens
ccaaggttggcagctgggc

SEQ ID NO: 7123853 - DNA, 22 bp, Homo sapiens
ccaaggttttctggcactattt

SEQ ID NO: 7123854 - DNA, 22 bp, Homo sapiens
ccaagtcctctaccattcctgg

SEQ ID NO: 7123855 - DNA, 22 bp, Homo sapiens
ccaagtcctgctgccactctac

SEQ ID NO: 7123856 - DNA, 22 bp, Homo sapiens
ccaagctacttaggagtctgag

SEQ ID NO: 7123857 - DNA, 22 bp, Homo sapiens
ccaagccgcggctcctcctgcg

SEQ ID NO: 7123858 - DNA, 22 bp, Homo sapiens
ccaagcagtctgctaggagttt

SEQ ID NO: 7123859 - DNA, 22 bp, Homo sapiens
ccaagcagtctgctaggagttt

SEQ ID NO: 7123860 - DNA, 22 bp, Homo sapiens
ccaagctacttaggagtctgag

SEQ ID NO: 7123861 - DNA, 22 bp, Homo sapiens
ccaagctacttaggagtctgag

SEQ ID NO: 7123862 - DNA, 22 bp, Homo sapiens
ccaagctgactgtgctgttgtg

SEQ ID NO: 7123863 - DNA, 22 bp, Homo sapiens
ccaagctgagcaccatctgatc

SEQ ID NO: 7123864 - DNA, 22 bp, Homo sapiens
ccaagcagaaccattcaggcac

SEQ ID NO: 7123865 - DNA, 16 bp, Homo sapiens
ccaagcagcagcagct

SEQ ID NO: 7123866 - DNA, 16 bp, Homo sapiens
ccaagcagcagcagct

SEQ ID NO: 7123867 - DNA, 22 bp, Homo sapiens
aggcagcagtcatgaggaaaga

SEQ ID NO: 7123868 - DNA, 22 bp, Homo sapiens
ccaaaggccaagctcaggtaaa

SEQ ID NO: 7123869 - DNA, 22 bp, Homo sapiens
ccaaaggccaggcactgaggtt

SEQ ID NO: 7123870 - DNA, 22 bp, Homo sapiens
ccaaaggccaggcactgaggtt

SEQ ID NO: 7123871 - DNA, 22 bp, Homo sapiens
ccaaaggccaagctcaggtaaa

SEQ ID NO: 7123872 - DNA, 22 bp, Homo sapiens
ccaaaggcggaactgagtctct

SEQ ID NO: 7123873 - DNA, 22 bp, Homo sapiens
ccaaaggcggaactgagtctct

SEQ ID NO: 7123874 - DNA, 21 bp, Homo sapiens
ccaaaggctatgtatcttctg

SEQ ID NO: 7123875 - DNA, 22 bp, Homo sapiens
ccaaaggtgttggccttcagtg

SEQ ID NO: 7123876 - DNA, 23 bp, Homo sapiens
aggcagcaggttgtccagggtga

SEQ ID NO: 7123877 - DNA, 23 bp, Homo sapiens
aggcagcaggttgtccagggtga

SEQ ID NO: 7123878 - DNA, 23 bp, Homo sapiens
aggcagcaggttgtccagggtga

SEQ ID NO: 7123879 - DNA, 23 bp, Homo sapiens
aggcagcaggttgtccagggtga

SEQ ID NO: 7123880 - DNA, 23 bp, Homo sapiens
aggcagcaggttgtccagggtga

SEQ ID NO: 7123881 - DNA, 23 bp, Homo sapiens
aggcagcaggttgtccagggtga

SEQ ID NO: 7123882 - DNA, 19 bp, Homo sapiens
aggcagcaggccagggatg

SEQ ID NO: 7123883 - DNA, 22 bp, Homo sapiens
aggcagcagggccactggctga

SEQ ID NO: 7123884 - DNA, 22 bp, Homo sapiens
aggcagcagggccactggctga

SEQ ID NO: 7123885 - DNA, 22 bp, Homo sapiens
aggcagcagggccactggctga

SEQ ID NO: 7123886 - DNA, 20 bp, Homo sapiens
catttgttagctttctactg

SEQ ID NO: 7123887 - DNA, 22 bp, Homo sapiens
catttgttctgatttcaaaagg

SEQ ID NO: 7123888 - DNA, 22 bp, Homo sapiens
catttgttaatgctgcttttaa

SEQ ID NO: 7123889 - DNA, 22 bp, Homo sapiens
catttgttaattactattatct

SEQ ID NO: 7123890 - DNA, 22 bp, Homo sapiens
catttgaaattcttagaacaaa

SEQ ID NO: 7123891 - DNA, 22 bp, Homo sapiens
catttgaaattcttagaacaaa

SEQ ID NO: 7123892 - DNA, 22 bp, Homo sapiens
catttgttaagaaggaaaaagg

SEQ ID NO: 7123893 - DNA, 22 bp, Homo sapiens
cattaacaatgactgcttgact

SEQ ID NO: 7123894 - DNA, 22 bp, Homo sapiens
cattaacaattgtttatgctgt

SEQ ID NO: 7123895 - DNA, 22 bp, Homo sapiens
catttgaaatagttcattcttg

SEQ ID NO: 7123896 - DNA, 22 bp, Homo sapiens
catttgaaattcttagaacaaa

SEQ ID NO: 7123897 - DNA, 22 bp, Homo sapiens
catttgttgggacaatgaaaag

SEQ ID NO: 7123898 - DNA, 22 bp, Homo sapiens
catttgttgggacaatgaaaag

SEQ ID NO: 7123899 - DNA, 22 bp, Homo sapiens
catttgttggtcagattgtagt

SEQ ID NO: 7123900 - DNA, 22 bp, Homo sapiens
cattttaaatgatttaagccaa

SEQ ID NO: 7123901 - DNA, 22 bp, Homo sapiens
cattttaaatgatttaagccaa

SEQ ID NO: 7123902 - DNA, 19 bp, Homo sapiens
aggcagcaggccagggatg

SEQ ID NO: 7123903 - DNA, 19 bp, Homo sapiens
aggcagcaggccagggatg

SEQ ID NO: 7123904 - DNA, 19 bp, Homo sapiens
aggcagcaggccagggatg

SEQ ID NO: 7123905 - DNA, 19 bp, Homo sapiens
aggcagcaggccagggatg

SEQ ID NO: 7123906 - DNA, 19 bp, Homo sapiens
aggcagcaggccagggatg

SEQ ID NO: 7123907 - DNA, 22 bp, Homo sapiens
cattttaaatgatttaagccaa

SEQ ID NO: 7123908 - DNA, 21 bp, Homo sapiens
aggcagcaggatccagggaca

SEQ ID NO: 7123909 - DNA, 21 bp, Homo sapiens
aggcagcaggatccagggaca

SEQ ID NO: 7123910 - DNA, 21 bp, Homo sapiens
aggcagcaggatccagggaca

SEQ ID NO: 7123911 - DNA, 21 bp, Homo sapiens
aggcagcaggatccagggaca

SEQ ID NO: 7123912 - DNA, 22 bp, Homo sapiens
aggcactgtggaagacatggtt

SEQ ID NO: 7123913 - DNA, 22 bp, Homo sapiens
aggcactgtggaagacatggtt

SEQ ID NO: 7123914 - DNA, 22 bp, Homo sapiens
aggcactgtggaagacatggtt

SEQ ID NO: 7123915 - DNA, 22 bp, Homo sapiens
aggcactgtggaagacatggtt

SEQ ID NO: 7123916 - DNA, 22 bp, Homo sapiens
aggcactgtggaagacatggtt

SEQ ID NO: 7123917 - DNA, 22 bp, Homo sapiens
aggcactgtggaagacatggtt

SEQ ID NO: 7123918 - DNA, 22 bp, Homo sapiens
aggcactgtgcttcttatatgt

SEQ ID NO: 7123919 - DNA, 22 bp, Homo sapiens
aggcactgtgctgatgtcttat

SEQ ID NO: 7123920 - DNA, 22 bp, Homo sapiens
aggcactgtgctgatgtcttat

SEQ ID NO: 7123921 - DNA, 22 bp, Homo sapiens
aggcactgtgctgatgtcttat

SEQ ID NO: 7123922 - DNA, 22 bp, Homo sapiens
aggcactgtactaggtacaggg

SEQ ID NO: 7123923 - DNA, 22 bp, Homo sapiens
aggcactgtgcagtcccaagca

SEQ ID NO: 7123924 - DNA, 22 bp, Homo sapiens
aggcactggtctaccccttagt

SEQ ID NO: 7123925 - DNA, 22 bp, Homo sapiens
aggcactgtactaggtacaggg

SEQ ID NO: 7123926 - DNA, 22 bp, Homo sapiens
aggcactgtactaggtacaggg

SEQ ID NO: 7123927 - DNA, 22 bp, Homo sapiens
cattaaatatcaacctagacta

SEQ ID NO: 7123928 - DNA, 22 bp, Homo sapiens
cattaaatatcaacctagacta

SEQ ID NO: 7123929 - DNA, 22 bp, Homo sapiens
cattaaatcttccagacctcac

SEQ ID NO: 7123930 - DNA, 22 bp, Homo sapiens
cattaaattccttgttctcaaa

SEQ ID NO: 7123931 - DNA, 22 bp, Homo sapiens
cattaacaatgactgcttgact

SEQ ID NO: 7123932 - DNA, 15 bp, Homo sapiens
aggcactgtgggacc

SEQ ID NO: 7123933 - DNA, 22 bp, Homo sapiens
catgttttgtgtacagaatatt

SEQ ID NO: 7123934 - DNA, 22 bp, Homo sapiens
cattaaaatatctcatggtgtt

SEQ ID NO: 7123935 - DNA, 22 bp, Homo sapiens
cattaaaatatctcatggtgtt

SEQ ID NO: 7123936 - DNA, 23 bp, Homo sapiens
catgtttttctatctcagcgtgt

SEQ ID NO: 7123937 - DNA, 23 bp, Homo sapiens
catgtttttctatctcagcgtgt

SEQ ID NO: 7123938 - DNA, 22 bp, Homo sapiens
catgggggctgaggctgctgta

SEQ ID NO: 7123939 - DNA, 22 bp, Homo sapiens
catggggcccatgtgctccaag

SEQ ID NO: 7123940 - DNA, 22 bp, Homo sapiens
catggggcccatgtgctccaag

SEQ ID NO: 7123941 - DNA, 22 bp, Homo sapiens
catgggggctgaggctgctgta

SEQ ID NO: 7123942 - DNA, 23 bp, Homo sapiens
catggggagcagtgctcctgacc

SEQ ID NO: 7123943 - DNA, 23 bp, Homo sapiens
catggggagcagtgctcctgacc

SEQ ID NO: 7123944 - DNA, 23 bp, Homo sapiens
catggggagcagtgctcctgacc

SEQ ID NO: 7123945 - DNA, 23 bp, Homo sapiens
catggggagcagtgctcctgacc

SEQ ID NO: 7123946 - DNA, 22 bp, Homo sapiens
catggggatgaggctgagactt

SEQ ID NO: 7123947 - DNA, 22 bp, Homo sapiens
catggggagacacctagggaaa

SEQ ID NO: 7123948 - DNA, 22 bp, Homo sapiens
catggggagacacctagggaaa

SEQ ID NO: 7123949 - DNA, 22 bp, Homo sapiens
catgggcttgctctctgagctc

SEQ ID NO: 7123950 - DNA, 22 bp, Homo sapiens
catggggagacacctagggaaa

SEQ ID NO: 7123951 - DNA, 22 bp, Homo sapiens
catggggagacacctagggaaa

SEQ ID NO: 7123952 - DNA, 22 bp, Homo sapiens
catgggctgctgacaggggctc

SEQ ID NO: 7123953 - DNA, 22 bp, Homo sapiens
catgggctttggaggctggagg

SEQ ID NO: 7123954 - DNA, 22 bp, Homo sapiens
catgggcttgctctctgagctc

SEQ ID NO: 7123955 - DNA, 22 bp, Homo sapiens
catggctcggggacaggaggta

SEQ ID NO: 7123956 - DNA, 22 bp, Homo sapiens
aggatttgaacctaggcaatca

SEQ ID NO: 7123957 - DNA, 22 bp, Homo sapiens
aggattgttgcagggcttcgtt

SEQ ID NO: 7123958 - DNA, 22 bp, Homo sapiens
catgtatagttggaactacatc

SEQ ID NO: 7123959 - DNA, 22 bp, Homo sapiens
catgtatagttggaactacatc

SEQ ID NO: 7123960 - DNA, 22 bp, Homo sapiens
catgtataggtccatagtgaat

SEQ ID NO: 7123961 - DNA, 22 bp, Homo sapiens
catgtatagacactcatacagt

SEQ ID NO: 7123962 - DNA, 22 bp, Homo sapiens
catgtatagacactcatacagt

SEQ ID NO: 7123963 - DNA, 22 bp, Homo sapiens
catgtatagacactcatacagt

SEQ ID NO: 7123964 - DNA, 22 bp, Homo sapiens
catgtagtcctaatgctggtga

SEQ ID NO: 7123965 - DNA, 22 bp, Homo sapiens
catgtacattctgtagatggag

SEQ ID NO: 7123966 - DNA, 19 bp, Homo sapiens
catggtgaaaccccgtctc

SEQ ID NO: 7123967 - DNA, 19 bp, Homo sapiens
catggtgaaaccccgtctc

SEQ ID NO: 7123968 - DNA, 19 bp, Homo sapiens
catggtgaaaccccgtctc

SEQ ID NO: 7123969 - DNA, 19 bp, Homo sapiens
catggtgaaaccccgtctc

SEQ ID NO: 7123970 - DNA, 22 bp, Homo sapiens
catgtacattctgtagatggag

SEQ ID NO: 7123971 - DNA, 18 bp, Homo sapiens
catgggtgacaggtggat

SEQ ID NO: 7123972 - DNA, 18 bp, Homo sapiens
catgggtgacaggtggat

SEQ ID NO: 7123973 - DNA, 18 bp, Homo sapiens
catgggtgacaggtggat

SEQ ID NO: 7123974 - DNA, 18 bp, Homo sapiens
catgggtgacaggtggat

SEQ ID NO: 7123975 - DNA, 22 bp, Homo sapiens
catggtcatgctgagctacaaa

SEQ ID NO: 7123976 - DNA, 22 bp, Homo sapiens
aggcactgcagattacaggcgc

SEQ ID NO: 7123977 - DNA, 22 bp, Homo sapiens
aggcactgcagattacaggcgc

SEQ ID NO: 7123978 - DNA, 22 bp, Homo sapiens
catgtcaataaatataactgca

SEQ ID NO: 7123979 - DNA, 22 bp, Homo sapiens
catgtcagggaagagagtcagt

SEQ ID NO: 7123980 - DNA, 22 bp, Homo sapiens
catgtcagggaagagagtcagt

SEQ ID NO: 7123981 - DNA, 22 bp, Homo sapiens
catgtcagggcttcctcctctc

SEQ ID NO: 7123982 - DNA, 22 bp, Homo sapiens
catgtccacagttctgagaggc

SEQ ID NO: 7123983 - DNA, 22 bp, Homo sapiens
catgtatagttggaactacatc

SEQ ID NO: 7123984 - DNA, 22 bp, Homo sapiens
catgtatccctaattgtgttaa

SEQ ID NO: 7123985 - DNA, 22 bp, Homo sapiens
catgtatcttaattgctttgga

SEQ ID NO: 7123986 - DNA, 18 bp, Homo sapiens
catgtatgcaaataagca

SEQ ID NO: 7123987 - DNA, 18 bp, Homo sapiens
catgtatgcaaataagca

SEQ ID NO: 7123988 - DNA, 22 bp, Homo sapiens
catgtcaaccagttgtttgaat

SEQ ID NO: 7123989 - DNA, 22 bp, Homo sapiens
catgtcaagactgaagatccag

SEQ ID NO: 7123990 - DNA, 16 bp, Homo sapiens
aggaggggaattagga

SEQ ID NO: 7123991 - DNA, 20 bp, Homo sapiens
aggaggggatagaatcaaag

SEQ ID NO: 7123992 - DNA, 20 bp, Homo sapiens
aggaggggatagaatcaaag

SEQ ID NO: 7123993 - DNA, 16 bp, Homo sapiens
aggaggggaattagga

SEQ ID NO: 7123994 - DNA, 22 bp, Homo sapiens
aggaggggcaatgatagtctgg

SEQ ID NO: 7123995 - DNA, 22 bp, Homo sapiens
aggaggggcaatgatagtctgg

SEQ ID NO: 7123996 - DNA, 22 bp, Homo sapiens
aggaggggcaatgatagtctgg

SEQ ID NO: 7123997 - DNA, 22 bp, Homo sapiens
aggaggggcaatgatagtctgg

SEQ ID NO: 7123998 - DNA, 22 bp, Homo sapiens
aggaggggcaatgatagtctgg

SEQ ID NO: 7123999 - DNA, 20 bp, Homo sapiens
aggaggggatagaatcaaag

SEQ ID NO: 7124000 - DNA, 20 bp, Homo sapiens
aggaggggatagaatcaaag

SEQ ID NO: 7124001 - DNA, 20 bp, Homo sapiens
aggaggggatagaatcaaag

SEQ ID NO: 7124002 - DNA, 22 bp, Homo sapiens
aggaggggcaatgatagtctgg

SEQ ID NO: 7124003 - DNA, 22 bp, Homo sapiens
catgcggctctttccaaaccgg

SEQ ID NO: 7124004 - DNA, 22 bp, Homo sapiens
catgcgggttccaggctgcact

SEQ ID NO: 7124005 - DNA, 22 bp, Homo sapiens
catgctaaaatatctgaagatt

SEQ ID NO: 7124006 - DNA, 22 bp, Homo sapiens
catgctaaaccagaacatagga

SEQ ID NO: 7124007 - DNA, 21 bp, Homo sapiens
aggagggcacaaggccaggaa

SEQ ID NO: 7124008 - DNA, 21 bp, Homo sapiens
aggagggcacaaggccaggaa

SEQ ID NO: 7124009 - DNA, 21 bp, Homo sapiens
aggagggcacaaggccaggaa

SEQ ID NO: 7124010 - DNA, 21 bp, Homo sapiens
aggagggcacaaggccaggaa

SEQ ID NO: 7124011 - DNA, 21 bp, Homo sapiens
aggagggcacaaggccaggaa

SEQ ID NO: 7124012 - DNA, 22 bp, Homo sapiens
aggagggatagaaaaatacttg

SEQ ID NO: 7124013 - DNA, 22 bp, Homo sapiens
aggagggatagaaaaatacttg

SEQ ID NO: 7124014 - DNA, 22 bp, Homo sapiens
aggagggagcttaagccaggca

SEQ ID NO: 7124015 - DNA, 22 bp, Homo sapiens
aggagggcaggctggctgccta

SEQ ID NO: 7124016 - DNA, 22 bp, Homo sapiens
aggagggctaggaaaaccagga

SEQ ID NO: 7124017 - DNA, 22 bp, Homo sapiens
aggagggctaggaaaaccagga

SEQ ID NO: 7124018 - DNA, 22 bp, Homo sapiens
aggagggcaggctggctgccta

SEQ ID NO: 7124019 - DNA, 21 bp, Homo sapiens
aggagggcacaaggccaggaa

SEQ ID NO: 7124020 - DNA, 22 bp, Homo sapiens
aggagggcaggctggctgccta

SEQ ID NO: 7124021 - DNA, 22 bp, Homo sapiens
aggagggcaggctggctgccta

SEQ ID NO: 7124022 - DNA, 21 bp, Homo sapiens
aggagggcacaaggccaggaa

SEQ ID NO: 7124023 - DNA, 22 bp, Homo sapiens
aggagggcaggctggctgccta

SEQ ID NO: 7124024 - DNA, 22 bp, Homo sapiens
aggagggcaggctggctgccta

SEQ ID NO: 7124025 - DNA, 22 bp, Homo sapiens
catggagataaactgaaatatt

SEQ ID NO: 7124026 - DNA, 22 bp, Homo sapiens
catggacaacctccattcgagt

SEQ ID NO: 7124027 - DNA, 22 bp, Homo sapiens
catggacagtgggacagtgtgt

SEQ ID NO: 7124028 - DNA, 22 bp, Homo sapiens
catggacatatgagacctttcc

SEQ ID NO: 7124029 - DNA, 22 bp, Homo sapiens
catggactctggtttggggagc

SEQ ID NO: 7124030 - DNA, 22 bp, Homo sapiens
catgctaaccagagacataaag

SEQ ID NO: 7124031 - DNA, 22 bp, Homo sapiens
catgctaaccagagacataaag

SEQ ID NO: 7124032 - DNA, 22 bp, Homo sapiens
catggaatgtgagttgtttagt

SEQ ID NO: 7124033 - DNA, 22 bp, Homo sapiens
catggaatgtgagttgtttagt

SEQ ID NO: 7124034 - DNA, 22 bp, Homo sapiens
catggacaacctccattcgagt

SEQ ID NO: 7124035 - DNA, 22 bp, Homo sapiens
catggacagtgggacagtgtgt

SEQ ID NO: 7124036 - DNA, 22 bp, Homo sapiens
catggatagatgaatgcttaaa

SEQ ID NO: 7124037 - DNA, 22 bp, Homo sapiens
catggaggaggaagggcgttgt

SEQ ID NO: 7124038 - DNA, 22 bp, Homo sapiens
catggaggaccctcagggagct

SEQ ID NO: 7124039 - DNA, 22 bp, Homo sapiens
catggaggaccctcagggagct

SEQ ID NO: 7124040 - DNA, 22 bp, Homo sapiens
catggatagatgaatgcttaaa

SEQ ID NO: 7124041 - DNA, 22 bp, Homo sapiens
catggatatattgtacagtagc

SEQ ID NO: 7124042 - DNA, 22 bp, Homo sapiens
catggatatattgtacagtagc

SEQ ID NO: 7124043 - DNA, 22 bp, Homo sapiens
catggatatattgtacagtagc

SEQ ID NO: 7124044 - DNA, 22 bp, Homo sapiens
catggatcataaatgtgctaaa

SEQ ID NO: 7124045 - DNA, 22 bp, Homo sapiens
catggcaacaactctttattcc

SEQ ID NO: 7124046 - DNA, 22 bp, Homo sapiens
catggcaacaactctttattcc

SEQ ID NO: 7124047 - DNA, 22 bp, Homo sapiens
catggcaataaacctacacagt

SEQ ID NO: 7124048 - DNA, 23 bp, Homo sapiens
aggattctgcttttcagaaataa

SEQ ID NO: 7124049 - DNA, 21 bp, Homo sapiens
aggattccagcacactgcttc

SEQ ID NO: 7124050 - DNA, 22 bp, Homo sapiens
aggattgtatacctaagtgtta

SEQ ID NO: 7124051 - DNA, 22 bp, Homo sapiens
aggattgtatacctaagtgtta

SEQ ID NO: 7124052 - DNA, 22 bp, Homo sapiens
aggattgtgcctccagtcagaa

SEQ ID NO: 7124053 - DNA, 22 bp, Homo sapiens
aggattaactgacctagtgttt

SEQ ID NO: 7124054 - DNA, 22 bp, Homo sapiens
aggattaaaacagtgggatttg

SEQ ID NO: 7124055 - DNA, 22 bp, Homo sapiens
aggattaaaacagtgggatttg

SEQ ID NO: 7124056 - DNA, 22 bp, Homo sapiens
aggattaaagtatatttttgag

SEQ ID NO: 7124057 - DNA, 22 bp, Homo sapiens
aggattaaagtatatttttgag

SEQ ID NO: 7124058 - DNA, 22 bp, Homo sapiens
aggattaactgacctagtgttt

SEQ ID NO: 7124059 - DNA, 22 bp, Homo sapiens
aggatgtgttcatagctgacgc

SEQ ID NO: 7124060 - DNA, 22 bp, Homo sapiens
aggatgtgttttgagctgacta

SEQ ID NO: 7124061 - DNA, 22 bp, Homo sapiens
aggatgttatctgtgcaggtgg

SEQ ID NO: 7124062 - DNA, 22 bp, Homo sapiens
catggcagagaaggggaactgg

SEQ ID NO: 7124063 - DNA, 22 bp, Homo sapiens
aggatgtggtctgttttctgag

SEQ ID NO: 7124064 - DNA, 22 bp, Homo sapiens
aggatgtgtgtaggctggttaa

SEQ ID NO: 7124065 - DNA, 22 bp, Homo sapiens
catggcagaaacctgagctgct

SEQ ID NO: 7124066 - DNA, 22 bp, Homo sapiens
catggcagaaacctgagctgct

SEQ ID NO: 7124067 - DNA, 22 bp, Homo sapiens
catggcagaaacctgagctgct

SEQ ID NO: 7124068 - DNA, 22 bp, Homo sapiens
catggcagaaacctgagctgct

SEQ ID NO: 7124069 - DNA, 22 bp, Homo sapiens
catggcactgagcaggtatgca

SEQ ID NO: 7124070 - DNA, 22 bp, Homo sapiens
aggaccaacatagcagcagtgg

SEQ ID NO: 7124071 - DNA, 22 bp, Homo sapiens
aggaccagaccgaactagctaa

SEQ ID NO: 7124072 - DNA, 22 bp, Homo sapiens
aggaccagaggccagagtcagc

SEQ ID NO: 7124073 - DNA, 22 bp, Homo sapiens
aggaccagaggccagagtcagc

SEQ ID NO: 7124074 - DNA, 22 bp, Homo sapiens
aggaccagaccgaactagctaa

SEQ ID NO: 7124075 - DNA, 22 bp, Homo sapiens
aggaccagcctccaggtctctt

SEQ ID NO: 7124076 - DNA, 22 bp, Homo sapiens
aggaccaggtctaatgaagaca

SEQ ID NO: 7124077 - DNA, 22 bp, Homo sapiens
aggaccagtgagtctggcaagt

SEQ ID NO: 7124078 - DNA, 22 bp, Homo sapiens
aggaccattatgcttgctgaaa

SEQ ID NO: 7124079 - DNA, 22 bp, Homo sapiens
aggacccaagcacagttcctgg

SEQ ID NO: 7124080 - DNA, 22 bp, Homo sapiens
aggaccagtatgagagcatctg

SEQ ID NO: 7124081 - DNA, 22 bp, Homo sapiens
aggaccagtatgagagcatctg

SEQ ID NO: 7124082 - DNA, 22 bp, Homo sapiens
aggaccagtgagtctggcaagt

SEQ ID NO: 7124083 - DNA, 22 bp, Homo sapiens
aggacctgactggctcctgctt

SEQ ID NO: 7124084 - DNA, 22 bp, Homo sapiens
aggacccaagcacagttcctgg

SEQ ID NO: 7124085 - DNA, 22 bp, Homo sapiens
aggacccagaaggtgcagcaga

SEQ ID NO: 7124086 - DNA, 22 bp, Homo sapiens
aggaccctgctcaagcatctcc

SEQ ID NO: 7124087 - DNA, 22 bp, Homo sapiens
caggtgcagctggatggaagcc

SEQ ID NO: 7124088 - DNA, 22 bp, Homo sapiens
caggtggcttctccctaggcca

SEQ ID NO: 7124089 - DNA, 22 bp, Homo sapiens
caggtggcttctccctaggcca

SEQ ID NO: 7124090 - DNA, 22 bp, Homo sapiens
caggtggcttctctgcagcctt

SEQ ID NO: 7124091 - DNA, 22 bp, Homo sapiens
caggtgggaccatgatagggca

SEQ ID NO: 7124092 - DNA, 22 bp, Homo sapiens
caggtgggaccatgatagggca

SEQ ID NO: 7124093 - DNA, 22 bp, Homo sapiens
caggtgggaccatgatagggca

SEQ ID NO: 7124094 - DNA, 22 bp, Homo sapiens
caggtgggaccatgatagggca

SEQ ID NO: 7124095 - DNA, 22 bp, Homo sapiens
caggtgggagccacagcgtaca

SEQ ID NO: 7124096 - DNA, 22 bp, Homo sapiens
caggtgggagccacagcgtaca

SEQ ID NO: 7124097 - DNA, 22 bp, Homo sapiens
caggtgggagccacagcgtaca

SEQ ID NO: 7124098 - DNA, 22 bp, Homo sapiens
aggacaggattgagctgaactg

SEQ ID NO: 7124099 - DNA, 22 bp, Homo sapiens
caggtgggattttgctgcttga

SEQ ID NO: 7124100 - DNA, 22 bp, Homo sapiens
aggacaggattgagctgaactg

SEQ ID NO: 7124101 - DNA, 22 bp, Homo sapiens
aggacatgtaaatggagaggga

SEQ ID NO: 7124102 - DNA, 22 bp, Homo sapiens
aggacatgtaaatggagaggga

SEQ ID NO: 7124103 - DNA, 22 bp, Homo sapiens
aggacatgtgcctccagggcag

SEQ ID NO: 7124104 - DNA, 22 bp, Homo sapiens
aggacatgtttgtatcttcctt

SEQ ID NO: 7124105 - DNA, 22 bp, Homo sapiens
aggacatgtgcctccagggcag

SEQ ID NO: 7124106 - DNA, 22 bp, Homo sapiens
aggacattatgctaagtaaatg

SEQ ID NO: 7124107 - DNA, 22 bp, Homo sapiens
aggacattcatttcaaggagga

SEQ ID NO: 7124108 - DNA, 22 bp, Homo sapiens
aggacattgaaatcgaagagaa

SEQ ID NO: 7124109 - DNA, 22 bp, Homo sapiens
caggtgggagcgaggagctact

SEQ ID NO: 7124110 - DNA, 22 bp, Homo sapiens
caggtgggagcgaggagctact

SEQ ID NO: 7124111 - DNA, 22 bp, Homo sapiens
caggtgggagcgaggagctact

SEQ ID NO: 7124112 - DNA, 22 bp, Homo sapiens
caggtgggagcgaggagctact

SEQ ID NO: 7124113 - DNA, 22 bp, Homo sapiens
caggtgggagcgaggagctact

SEQ ID NO: 7124114 - DNA, 22 bp, Homo sapiens
caggtgggagcgaggagctact

SEQ ID NO: 7124115 - DNA, 22 bp, Homo sapiens
aggacaggattccttgccttgc

SEQ ID NO: 7124116 - DNA, 22 bp, Homo sapiens
caggtgggagcggagactgatt

SEQ ID NO: 7124117 - DNA, 22 bp, Homo sapiens
caggtgggagcgaggagctact

SEQ ID NO: 7124118 - DNA, 22 bp, Homo sapiens
caggtgggagcgaggagctact

SEQ ID NO: 7124119 - DNA, 22 bp, Homo sapiens
caggtgggagcggagactgatt

SEQ ID NO: 7124120 - DNA, 22 bp, Homo sapiens
caggtgggagcggagactgatt

SEQ ID NO: 7124121 - DNA, 22 bp, Homo sapiens
aggagaaggaagtgcatcacta

SEQ ID NO: 7124122 - DNA, 22 bp, Homo sapiens
cagtgctcctgatgtacccttg

SEQ ID NO: 7124123 - DNA, 22 bp, Homo sapiens
cagtgctcccgctgccgctgtg

SEQ ID NO: 7124124 - DNA, 22 bp, Homo sapiens
cagtgctcatagctgttcctcc

SEQ ID NO: 7124125 - DNA, 22 bp, Homo sapiens
cagtgctcatagctgttcctcc

SEQ ID NO: 7124126 - DNA, 22 bp, Homo sapiens
cagtgctcatagctgttcctcc

SEQ ID NO: 7124127 - DNA, 22 bp, Homo sapiens
cagtgctataatccagtgtcgt

SEQ ID NO: 7124128 - DNA, 20 bp, Homo sapiens
cagtgcctgccccttgggtt

SEQ ID NO: 7124129 - DNA, 20 bp, Homo sapiens
cagtgcctgccccttgggtt

SEQ ID NO: 7124130 - DNA, 22 bp, Homo sapiens
cagtgcctggatagcaacatga

SEQ ID NO: 7124131 - DNA, 22 bp, Homo sapiens
cagtgcctggatagcaacatga

SEQ ID NO: 7124132 - DNA, 22 bp, Homo sapiens
cagtgcctggcatagaggcggc

SEQ ID NO: 7124133 - DNA, 22 bp, Homo sapiens
cagtgcctggcatagaggcggc

SEQ ID NO: 7124134 - DNA, 22 bp, Homo sapiens
cagtgcctggccggcttccatt

SEQ ID NO: 7124135 - DNA, 22 bp, Homo sapiens
cagtgcctggccggcttccatt

SEQ ID NO: 7124136 - DNA, 22 bp, Homo sapiens
cagtgcctgggacccggctgtg

SEQ ID NO: 7124137 - DNA, 22 bp, Homo sapiens
cagtgcctgtgggcttcttcca

SEQ ID NO: 7124138 - DNA, 22 bp, Homo sapiens
cagtgcaggtggcagaggacag

SEQ ID NO: 7124139 - DNA, 21 bp, Homo sapiens
cagtgcaggggttagcgtgta

SEQ ID NO: 7124140 - DNA, 22 bp, Homo sapiens
aggactgacttttgccatgaaa

SEQ ID NO: 7124141 - DNA, 22 bp, Homo sapiens
aggactcctgctgggaatggct

SEQ ID NO: 7124142 - DNA, 18 bp, Homo sapiens
aggactcctgggagttgg

SEQ ID NO: 7124143 - DNA, 18 bp, Homo sapiens
aggactctgctaccgtat

SEQ ID NO: 7124144 - DNA, 22 bp, Homo sapiens
aggacgctctcgctgaacttct

SEQ ID NO: 7124145 - DNA, 22 bp, Homo sapiens
aggacgctctcgctgaacttct

SEQ ID NO: 7124146 - DNA, 22 bp, Homo sapiens
aggacgtttcctggagagaatt

SEQ ID NO: 7124147 - DNA, 22 bp, Homo sapiens
aggactaaagggagcctagact

SEQ ID NO: 7124148 - DNA, 22 bp, Homo sapiens
aggactcatccctgcttgtcag

SEQ ID NO: 7124149 - DNA, 22 bp, Homo sapiens
aggactccatgtgtcctggaga

SEQ ID NO: 7124150 - DNA, 22 bp, Homo sapiens
cagtgcccttccaggactgcag

SEQ ID NO: 7124151 - DNA, 22 bp, Homo sapiens
cagtgcccttccaggactgcag

SEQ ID NO: 7124152 - DNA, 19 bp, Homo sapiens
cagtgcccgacgcaggtct

SEQ ID NO: 7124153 - DNA, 22 bp, Homo sapiens
cagtgcctcaggccagcctgca

SEQ ID NO: 7124154 - DNA, 22 bp, Homo sapiens
cagtgcctcaggccagcctgca

SEQ ID NO: 7124155 - DNA, 20 bp, Homo sapiens
cagtgcctatcattaattcc

SEQ ID NO: 7124156 - DNA, 22 bp, Homo sapiens
cagtgcctcttaagtgtcaccc

SEQ ID NO: 7124157 - DNA, 22 bp, Homo sapiens
cagtgcctcttaagtgtcaccc

SEQ ID NO: 7124158 - DNA, 19 bp, Homo sapiens
aggagaagtagcagaaatt

SEQ ID NO: 7124159 - DNA, 19 bp, Homo sapiens
aggagaagtagcagaaatt

SEQ ID NO: 7124160 - DNA, 19 bp, Homo sapiens
aggagaagtagcagaaatt

SEQ ID NO: 7124161 - DNA, 22 bp, Homo sapiens
aggagaagtaaggctagatgat

SEQ ID NO: 7124162 - DNA, 19 bp, Homo sapiens
aggagaagtagcagaaatt

SEQ ID NO: 7124163 - DNA, 19 bp, Homo sapiens
aggagaagtagcagaaatt

SEQ ID NO: 7124164 - DNA, 19 bp, Homo sapiens
aggagaagtagcagaaatt

SEQ ID NO: 7124165 - DNA, 19 bp, Homo sapiens
aggagaagtagcagaaatt

SEQ ID NO: 7124166 - DNA, 22 bp, Homo sapiens
cagtggagagacttttactctt

SEQ ID NO: 7124167 - DNA, 22 bp, Homo sapiens
aggagaagtaaggctagatgat

SEQ ID NO: 7124168 - DNA, 22 bp, Homo sapiens
aggagaagtaaggctagatgat

SEQ ID NO: 7124169 - DNA, 22 bp, Homo sapiens
aggagaagtaaggctagatgat

SEQ ID NO: 7124170 - DNA, 22 bp, Homo sapiens
aggagaagtaaggctagatgat

SEQ ID NO: 7124171 - DNA, 22 bp, Homo sapiens
aggagaaggaggcccctcacac

SEQ ID NO: 7124172 - DNA, 22 bp, Homo sapiens
aggagaaggaggcccctcacac

SEQ ID NO: 7124173 - DNA, 22 bp, Homo sapiens
cagtgctcctgatgtacccttg

SEQ ID NO: 7124174 - DNA, 22 bp, Homo sapiens
cagtgctcctgatgtacccttg

SEQ ID NO: 7124175 - DNA, 22 bp, Homo sapiens
aggagaaggaagtgcatcacta

SEQ ID NO: 7124176 - DNA, 22 bp, Homo sapiens
aggagaaggaagtgcatcacta

SEQ ID NO: 7124177 - DNA, 22 bp, Homo sapiens
aggagaaggaagtgcatcacta

SEQ ID NO: 7124178 - DNA, 18 bp, Homo sapiens
cagtggcatagttgagta

SEQ ID NO: 7124179 - DNA, 22 bp, Homo sapiens
cagtggcatacttggctgatat

SEQ ID NO: 7124180 - DNA, 22 bp, Homo sapiens
cagtggagaggcatgcttggca

SEQ ID NO: 7124181 - DNA, 22 bp, Homo sapiens
cagtggccaacttcctgcctct

SEQ ID NO: 7124182 - DNA, 22 bp, Homo sapiens
cagtggccaacttcctgcctct

SEQ ID NO: 7124183 - DNA, 22 bp, Homo sapiens
cagtggccaacttcctgcctct

SEQ ID NO: 7124184 - DNA, 22 bp, Homo sapiens
cagtggcatggttgactgcagt

SEQ ID NO: 7124185 - DNA, 22 bp, Homo sapiens
cagtggccatggtggcaggggt

SEQ ID NO: 7124186 - DNA, 22 bp, Homo sapiens
cagtggccgcggggctgtgggt

SEQ ID NO: 7124187 - DNA, 22 bp, Homo sapiens
cagtggccgcggggctgtgggt

SEQ ID NO: 7124188 - DNA, 19 bp, Homo sapiens
cagtggcctggaggtctct

SEQ ID NO: 7124189 - DNA, 22 bp, Homo sapiens
cagtggcctttcctgctgctca

SEQ ID NO: 7124190 - DNA, 22 bp, Homo sapiens
cagtggcctttcctgctgctca

SEQ ID NO: 7124191 - DNA, 22 bp, Homo sapiens
catagcaaggtgctttccacat

SEQ ID NO: 7124192 - DNA, 22 bp, Homo sapiens
catagattcttatttccatctt

SEQ ID NO: 7124193 - DNA, 22 bp, Homo sapiens
catagcaacagcatcaagtcaa

SEQ ID NO: 7124194 - DNA, 22 bp, Homo sapiens
catagaggtgtcagggacatct

SEQ ID NO: 7124195 - DNA, 22 bp, Homo sapiens
catagaggctaaaattatttgg

SEQ ID NO: 7124196 - DNA, 22 bp, Homo sapiens
catagaggctaaaattatttgg

SEQ ID NO: 7124197 - DNA, 22 bp, Homo sapiens
catagacattgataggttatat

SEQ ID NO: 7124198 - DNA, 22 bp, Homo sapiens
catagaggcaaaatggctgtac

SEQ ID NO: 7124199 - DNA, 22 bp, Homo sapiens
cagttttatcatctgtgaaatg

SEQ ID NO: 7124200 - DNA, 22 bp, Homo sapiens
cagttttatcatctgtgaaatg

SEQ ID NO: 7124201 - DNA, 22 bp, Homo sapiens
cagttttatacactgcagctcc

SEQ ID NO: 7124202 - DNA, 22 bp, Homo sapiens
cagttttatgaatgcttattag

SEQ ID NO: 7124203 - DNA, 22 bp, Homo sapiens
cagttttatgaatgcttattag

SEQ ID NO: 7124204 - DNA, 22 bp, Homo sapiens
cagttttatgtcgaatgtatac

SEQ ID NO: 7124205 - DNA, 22 bp, Homo sapiens
catacattacctaacttaatgc

SEQ ID NO: 7124206 - DNA, 22 bp, Homo sapiens
cagttttatgtcgaatgtatac

SEQ ID NO: 7124207 - DNA, 22 bp, Homo sapiens
catataaatacaacatgtgtta

SEQ ID NO: 7124208 - DNA, 22 bp, Homo sapiens
catataaatacaacatgtgtta

SEQ ID NO: 7124209 - DNA, 22 bp, Homo sapiens
catataaatacaacatgtgtta

SEQ ID NO: 7124210 - DNA, 22 bp, Homo sapiens
catataaatacaacatgtgtta

SEQ ID NO: 7124211 - DNA, 22 bp, Homo sapiens
catataaatacaacatgtgtta

SEQ ID NO: 7124212 - DNA, 22 bp, Homo sapiens
catataaatacaacatgtgtta

SEQ ID NO: 7124213 - DNA, 22 bp, Homo sapiens
catagtgtctggtaacatagta

SEQ ID NO: 7124214 - DNA, 22 bp, Homo sapiens
catataaatacaacatgtgtta

SEQ ID NO: 7124215 - DNA, 22 bp, Homo sapiens
catataaatacaacatgtgtta

SEQ ID NO: 7124216 - DNA, 22 bp, Homo sapiens
catataaatacaacatgtgtta

SEQ ID NO: 7124217 - DNA, 22 bp, Homo sapiens
cataggaagccatctcagtcac

SEQ ID NO: 7124218 - DNA, 22 bp, Homo sapiens
catagcggtattccacgtggtt

SEQ ID NO: 7124219 - DNA, 22 bp, Homo sapiens
cataggctcttcagagaactga

SEQ ID NO: 7124220 - DNA, 22 bp, Homo sapiens
cataggtcactgtacaggttaa

SEQ ID NO: 7124221 - DNA, 22 bp, Homo sapiens
cataggtgttcccgtgggtcac

SEQ ID NO: 7124222 - DNA, 22 bp, Homo sapiens
aggagggagcactatatgggga

SEQ ID NO: 7124223 - DNA, 22 bp, Homo sapiens
aggagggagcttaagccaggca

SEQ ID NO: 7124224 - DNA, 22 bp, Homo sapiens
aggagggagcttaagccaggca

SEQ ID NO: 7124225 - DNA, 22 bp, Homo sapiens
aggagggagcttaagccaggca

SEQ ID NO: 7124226 - DNA, 22 bp, Homo sapiens
aggagggagcttaagccaggca

SEQ ID NO: 7124227 - DNA, 22 bp, Homo sapiens
catatttcagtctaagatgtgt

SEQ ID NO: 7124228 - DNA, 22 bp, Homo sapiens
catattttagttgctgaacagc

SEQ ID NO: 7124229 - DNA, 22 bp, Homo sapiens
catattttagttgctgaacagc

SEQ ID NO: 7124230 - DNA, 22 bp, Homo sapiens
catatttattcttctgccagtg

SEQ ID NO: 7124231 - DNA, 22 bp, Homo sapiens
catatttattcttctgccagtg

SEQ ID NO: 7124232 - DNA, 21 bp, Homo sapiens
aggaggctgtctctttcagct

SEQ ID NO: 7124233 - DNA, 22 bp, Homo sapiens
aggaggctgtggagcactccat

SEQ ID NO: 7124234 - DNA, 22 bp, Homo sapiens
catatttatagatctggcattt

SEQ ID NO: 7124235 - DNA, 22 bp, Homo sapiens
catatttattcttctgccagtg

SEQ ID NO: 7124236 - DNA, 22 bp, Homo sapiens
catatttattcttctgccagtg

SEQ ID NO: 7124237 - DNA, 22 bp, Homo sapiens
catatttatagatctggcattt

SEQ ID NO: 7124238 - DNA, 22 bp, Homo sapiens
catatttagtgtttggagatcg

SEQ ID NO: 7124239 - DNA, 22 bp, Homo sapiens
catatttagtgtttggagatcg

SEQ ID NO: 7124240 - DNA, 22 bp, Homo sapiens
catatttagtgtttggagatcg

SEQ ID NO: 7124241 - DNA, 22 bp, Homo sapiens
catatttagtgtttggagatcg

SEQ ID NO: 7124242 - DNA, 22 bp, Homo sapiens
catattagcctccactgggaca

SEQ ID NO: 7124243 - DNA, 22 bp, Homo sapiens
catattagacacttatgtccac

SEQ ID NO: 7124244 - DNA, 22 bp, Homo sapiens
catattctttaagcaatgctct

SEQ ID NO: 7124245 - DNA, 22 bp, Homo sapiens
catattctttaagcaatgctct

SEQ ID NO: 7124246 - DNA, 22 bp, Homo sapiens
catattgctgtcattgtccctc

SEQ ID NO: 7124247 - DNA, 22 bp, Homo sapiens
catattcaaggggtaaggcaaa

SEQ ID NO: 7124248 - DNA, 22 bp, Homo sapiens
catattctgttggtcacataga

SEQ ID NO: 7124249 - DNA, 22 bp, Homo sapiens
catattctgttggtcacataga

SEQ ID NO: 7124250 - DNA, 22 bp, Homo sapiens
catattctgttggtcacataga

SEQ ID NO: 7124251 - DNA, 18 bp, Homo sapiens
cagtggtgctgggatgtg

SEQ ID NO: 7124252 - DNA, 18 bp, Homo sapiens
cagtggtgctgggatgtg

SEQ ID NO: 7124253 - DNA, 22 bp, Homo sapiens
cagtggtgaagagcaggggctc

SEQ ID NO: 7124254 - DNA, 22 bp, Homo sapiens
cagtggttatacttactgtttc

SEQ ID NO: 7124255 - DNA, 18 bp, Homo sapiens
cagtggtgctgggatgtg

SEQ ID NO: 7124256 - DNA, 20 bp, Homo sapiens
cagtttatctttccggagct

SEQ ID NO: 7124257 - DNA, 22 bp, Homo sapiens
cagtttatattctagtgctgtt

SEQ ID NO: 7124258 - DNA, 20 bp, Homo sapiens
cagtttatctttccggagct

SEQ ID NO: 7124259 - DNA, 22 bp, Homo sapiens
cagtttatgcagctggaataga

SEQ ID NO: 7124260 - DNA, 22 bp, Homo sapiens
cagtttatattctagtgctgtt

SEQ ID NO: 7124261 - DNA, 22 bp, Homo sapiens
cagtttatattctagtgctgtt

SEQ ID NO: 7124262 - DNA, 22 bp, Homo sapiens
cagtttatatgtcagagctgta

SEQ ID NO: 7124263 - DNA, 22 bp, Homo sapiens
cagttctggaggatagaagtct

SEQ ID NO: 7124264 - DNA, 22 bp, Homo sapiens
cagtggctgagagtggacactg

SEQ ID NO: 7124265 - DNA, 22 bp, Homo sapiens
cagtgggtgccatcgtgccctt

SEQ ID NO: 7124266 - DNA, 22 bp, Homo sapiens
cagtggccttgatgcctcattc

SEQ ID NO: 7124267 - DNA, 22 bp, Homo sapiens
cagtggcgtgatctctgctcac

SEQ ID NO: 7124268 - DNA, 22 bp, Homo sapiens
cagtggtatttgagagaatgga

SEQ ID NO: 7124269 - DNA, 22 bp, Homo sapiens
cagtggtatttgagagaatgga

SEQ ID NO: 7124270 - DNA, 22 bp, Homo sapiens
cagtgggtggcctcttgagtca

SEQ ID NO: 7124271 - DNA, 22 bp, Homo sapiens
cagtgggtggctaagtggctga

SEQ ID NO: 7124272 - DNA, 22 bp, Homo sapiens
cagtgggtggctaagtggctga

SEQ ID NO: 7124273 - DNA, 22 bp, Homo sapiens
cagtgggtggctaagtggctga

SEQ ID NO: 7124274 - DNA, 22 bp, Homo sapiens
cagtgggtggctaagtggctga

SEQ ID NO: 7124275 - DNA, 22 bp, Homo sapiens
cagtttatttccaagatgacaa

SEQ ID NO: 7124276 - DNA, 22 bp, Homo sapiens
cagtttattgttgcgttcacat

SEQ ID NO: 7124277 - DNA, 19 bp, Homo sapiens
cagtttatgctttggggac

SEQ ID NO: 7124278 - DNA, 22 bp, Homo sapiens
cagtttattgttgcgttcacat

SEQ ID NO: 7124279 - DNA, 22 bp, Homo sapiens
cagtttatttccaagatgacaa

SEQ ID NO: 7124280 - DNA, 22 bp, Homo sapiens
cagtttcagaatcaaaacatca

SEQ ID NO: 7124281 - DNA, 22 bp, Homo sapiens
cagtttcagctcaagcactcag

SEQ ID NO: 7124282 - DNA, 22 bp, Homo sapiens
cagtttccttgtttacctactg

SEQ ID NO: 7124283 - DNA, 22 bp, Homo sapiens
cagtttctacgaaggtcaaccc

SEQ ID NO: 7124284 - DNA, 22 bp, Homo sapiens
cagtttcctgaagagaaagaat

SEQ ID NO: 7124285 - DNA, 22 bp, Homo sapiens
cagtttctacgacttaagcaca

SEQ ID NO: 7124286 - DNA, 22 bp, Homo sapiens
cagtttctacgacttaagcaca

SEQ ID NO: 7124287 - DNA, 22 bp, Homo sapiens
cagtttctacgacttaagcaca

SEQ ID NO: 7124288 - DNA, 22 bp, Homo sapiens
cagttttaaattttgaatgtct

SEQ ID NO: 7124289 - DNA, 22 bp, Homo sapiens
cagttttaaattttgaatgtct

SEQ ID NO: 7124290 - DNA, 22 bp, Homo sapiens
cagttttaaattttgaatgtct

SEQ ID NO: 7124291 - DNA, 16 bp, Homo sapiens
cagttttaaggcccaa

SEQ ID NO: 7124292 - DNA, 22 bp, Homo sapiens
cagttttaaattgttagataat

SEQ ID NO: 7124293 - DNA, 22 bp, Homo sapiens
cagtttctctcaataagcatcg

SEQ ID NO: 7124294 - DNA, 22 bp, Homo sapiens
cagtttctctcaataagcatcg

SEQ ID NO: 7124295 - DNA, 22 bp, Homo sapiens
cagttttagctagagcaaacca

SEQ ID NO: 7124296 - DNA, 22 bp, Homo sapiens
cagttttacccaagcttatttt

SEQ ID NO: 7124297 - DNA, 22 bp, Homo sapiens
cagttttacccaagcttatttt

SEQ ID NO: 7124298 - DNA, 22 bp, Homo sapiens
cagttttaggacatgtggatgt

SEQ ID NO: 7124299 - DNA, 22 bp, Homo sapiens
cagttttagctagagcaaacca

SEQ ID NO: 7124300 - DNA, 22 bp, Homo sapiens
cagttttagctagagcaaacca

SEQ ID NO: 7124301 - DNA, 22 bp, Homo sapiens
cagttttaggacatgtggatgt

SEQ ID NO: 7124302 - DNA, 22 bp, Homo sapiens
cagttttagggcaatgtgaaga

SEQ ID NO: 7124303 - DNA, 22 bp, Homo sapiens
cagttttagggcaatgtgaaga

SEQ ID NO: 7124304 - DNA, 22 bp, Homo sapiens
cagttttatacactgcagctcc

SEQ ID NO: 7124305 - DNA, 22 bp, Homo sapiens
cagttttatacactgcagctcc

SEQ ID NO: 7124306 - DNA, 22 bp, Homo sapiens
agcccaaggcttccctgctggc

SEQ ID NO: 7124307 - DNA, 22 bp, Homo sapiens
agcccactgttttcatttctct

SEQ ID NO: 7124308 - DNA, 22 bp, Homo sapiens
agcccactgttttcatttctct

SEQ ID NO: 7124309 - DNA, 22 bp, Homo sapiens
agcccagaaatgaaaggatgat

SEQ ID NO: 7124310 - DNA, 23 bp, Homo sapiens
agcccaccttgttagtcctgtgg

SEQ ID NO: 7124311 - DNA, 22 bp, Homo sapiens
agcccactccaagggtttttct

SEQ ID NO: 7124312 - DNA, 22 bp, Homo sapiens
agcccagaaatgaaaggatgat

SEQ ID NO: 7124313 - DNA, 22 bp, Homo sapiens
agcccagagacaatgctcagta

SEQ ID NO: 7124314 - DNA, 22 bp, Homo sapiens
agcccagagacaatgctcagta

SEQ ID NO: 7124315 - DNA, 22 bp, Homo sapiens
agcccagagccccggccatgtt

SEQ ID NO: 7124316 - DNA, 22 bp, Homo sapiens
agcccagagccccggccatgtt

SEQ ID NO: 7124317 - DNA, 22 bp, Homo sapiens
agcccagagccccggccatgtt

SEQ ID NO: 7124318 - DNA, 22 bp, Homo sapiens
agcccagaggctgggcgtgcat

SEQ ID NO: 7124319 - DNA, 22 bp, Homo sapiens
agcccagaggctgggcgtgcat

SEQ ID NO: 7124320 - DNA, 22 bp, Homo sapiens
agcccagaggggtttgaggact

SEQ ID NO: 7124321 - DNA, 22 bp, Homo sapiens
agcccagaggggtttgaggact

SEQ ID NO: 7124322 - DNA, 22 bp, Homo sapiens
agcccagagggtagcagaagaa

SEQ ID NO: 7124323 - DNA, 22 bp, Homo sapiens
agcccagataaagtacaaccat

SEQ ID NO: 7124324 - DNA, 22 bp, Homo sapiens
agcccagatggtagccctagaa

SEQ ID NO: 7124325 - DNA, 22 bp, Homo sapiens
agcccagatggtagccctagaa

SEQ ID NO: 7124326 - DNA, 22 bp, Homo sapiens
agcccagatggtagccctagaa

SEQ ID NO: 7124327 - DNA, 22 bp, Homo sapiens
agcccagcaaagggaggttcag

SEQ ID NO: 7124328 - DNA, 22 bp, Homo sapiens
agcccagcccgggctgcgcttt

SEQ ID NO: 7124329 - DNA, 22 bp, Homo sapiens
agcccagccactattaaatgtt

SEQ ID NO: 7124330 - DNA, 22 bp, Homo sapiens
agcccagcagaaagtccagcct

SEQ ID NO: 7124331 - DNA, 23 bp, Homo sapiens
agcccagcagagaacctaggtcc

SEQ ID NO: 7124332 - DNA, 23 bp, Homo sapiens
agcccagcagagaacctaggtcc

SEQ ID NO: 7124333 - DNA, 23 bp, Homo sapiens
agcccagcagagaacctaggtcc

SEQ ID NO: 7124334 - DNA, 23 bp, Homo sapiens
agcccagcagagaacctaggtcc

SEQ ID NO: 7124335 - DNA, 22 bp, Homo sapiens
agcccagcagtaagattagaga

SEQ ID NO: 7124336 - DNA, 22 bp, Homo sapiens
agcccagcaaagggaggttcag

SEQ ID NO: 7124337 - DNA, 22 bp, Homo sapiens
agcccagcaaagggaggttcag

SEQ ID NO: 7124338 - DNA, 22 bp, Homo sapiens
agcccagcaaaggggtttgaga

SEQ ID NO: 7124339 - DNA, 22 bp, Homo sapiens
agcccagcactgggggcccagc

SEQ ID NO: 7124340 - DNA, 22 bp, Homo sapiens
agcccagcactgggggcccagc

SEQ ID NO: 7124341 - DNA, 22 bp, Homo sapiens
agcccagcagaaagtccagcct

SEQ ID NO: 7124342 - DNA, 22 bp, Homo sapiens
agcccagcagaaagtccagcct

SEQ ID NO: 7124343 - DNA, 22 bp, Homo sapiens
agcccagcactgggggcccagc

SEQ ID NO: 7124344 - DNA, 22 bp, Homo sapiens
agcccagcagaaagtccagcct

SEQ ID NO: 7124345 - DNA, 22 bp, Homo sapiens
agcccagcagaaagtccagcct

SEQ ID NO: 7124346 - DNA, 22 bp, Homo sapiens
agcccagcagaaagtccagcct

SEQ ID NO: 7124347 - DNA, 22 bp, Homo sapiens
agcccaagctatgaggtgacct

SEQ ID NO: 7124348 - DNA, 22 bp, Homo sapiens
agcccaagctatgaggtgacct

SEQ ID NO: 7124349 - DNA, 22 bp, Homo sapiens
agcccaagcctggctggcgatg

SEQ ID NO: 7124350 - DNA, 22 bp, Homo sapiens
agcccaagcctggctggcgatg

SEQ ID NO: 7124351 - DNA, 22 bp, Homo sapiens
agcccaagcctggctggcgatg

SEQ ID NO: 7124352 - DNA, 22 bp, Homo sapiens
agccatcactggggcccaccat

SEQ ID NO: 7124353 - DNA, 22 bp, Homo sapiens
agccatcactggggcccaccat

SEQ ID NO: 7124354 - DNA, 22 bp, Homo sapiens
agccatcacttgagaatctatt

SEQ ID NO: 7124355 - DNA, 16 bp, Homo sapiens
agccatcatcaacttg

SEQ ID NO: 7124356 - DNA, 23 bp, Homo sapiens
agccatcatcctgctgctggggc

SEQ ID NO: 7124357 - DNA, 22 bp, Homo sapiens
agccatcatttctgtcactggc

SEQ ID NO: 7124358 - DNA, 22 bp, Homo sapiens
agccatcatttctgtcactggc

SEQ ID NO: 7124359 - DNA, 22 bp, Homo sapiens
agccatcctactacctcagcat

SEQ ID NO: 7124360 - DNA, 22 bp, Homo sapiens
agcccaagaagagctttcttgc

SEQ ID NO: 7124361 - DNA, 22 bp, Homo sapiens
agcccaagcataggagggaggc

SEQ ID NO: 7124362 - DNA, 22 bp, Homo sapiens
cagagaaagacttgcccttagt

SEQ ID NO: 7124363 - DNA, 22 bp, Homo sapiens
cagagaaagaagcccattcatt

SEQ ID NO: 7124364 - DNA, 22 bp, Homo sapiens
cagagaaagaagcccattcatt

SEQ ID NO: 7124365 - DNA, 22 bp, Homo sapiens
cagagaaagggtgaattccttc

SEQ ID NO: 7124366 - DNA, 22 bp, Homo sapiens
cagagaaagaagcccattcatt

SEQ ID NO: 7124367 - DNA, 22 bp, Homo sapiens
cagagaaagaagcccattcatt

SEQ ID NO: 7124368 - DNA, 22 bp, Homo sapiens
cagagaaactcagatagctgat

SEQ ID NO: 7124369 - DNA, 22 bp, Homo sapiens
cagagaaactcagatagctgat

SEQ ID NO: 7124370 - DNA, 22 bp, Homo sapiens
cagagaaagaagcccattcatt

SEQ ID NO: 7124371 - DNA, 22 bp, Homo sapiens
cagagaaaaaatcctgctctca

SEQ ID NO: 7124372 - DNA, 22 bp, Homo sapiens
cagagaaactcagatagctgat

SEQ ID NO: 7124373 - DNA, 22 bp, Homo sapiens
cagacatggaaatttagtgtta

SEQ ID NO: 7124374 - DNA, 22 bp, Homo sapiens
cagactttcaaggagtgaaggc

SEQ ID NO: 7124375 - DNA, 22 bp, Homo sapiens
cagacttttgacattaatacag

SEQ ID NO: 7124376 - DNA, 22 bp, Homo sapiens
cagagaaaaaatcctgctctca

SEQ ID NO: 7124377 - DNA, 22 bp, Homo sapiens
cagaggcatactcccagtcttg

SEQ ID NO: 7124378 - DNA, 22 bp, Homo sapiens
cagaggcagtggggttgctcct

SEQ ID NO: 7124379 - DNA, 21 bp, Homo sapiens
cagaggcaggtcctgggacgg

SEQ ID NO: 7124380 - DNA, 22 bp, Homo sapiens
cagaggcagtggggttgctcct

SEQ ID NO: 7124381 - DNA, 22 bp, Homo sapiens
cagaggcagtggggttgctcct

SEQ ID NO: 7124382 - DNA, 21 bp, Homo sapiens
cagaggcaggtcctgggacgg

SEQ ID NO: 7124383 - DNA, 21 bp, Homo sapiens
cagaggcaggtcctgggacgg

SEQ ID NO: 7124384 - DNA, 21 bp, Homo sapiens
cagaggcaggtcctgggacgg

SEQ ID NO: 7124385 - DNA, 21 bp, Homo sapiens
cagaggcaggtcctgggacgg

SEQ ID NO: 7124386 - DNA, 21 bp, Homo sapiens
cagaggcaggtcctgggacgg

SEQ ID NO: 7124387 - DNA, 21 bp, Homo sapiens
cagaggcaggtcctgggacgg

SEQ ID NO: 7124388 - DNA, 21 bp, Homo sapiens
cagaggcaggctctgtgtgtg

SEQ ID NO: 7124389 - DNA, 22 bp, Homo sapiens
agcccagccggattcccagttc

SEQ ID NO: 7124390 - DNA, 22 bp, Homo sapiens
agcccagccggattcccagttc

SEQ ID NO: 7124391 - DNA, 22 bp, Homo sapiens
agcccagccggattcccagttc

SEQ ID NO: 7124392 - DNA, 22 bp, Homo sapiens
agcccagccggattcccagttc

SEQ ID NO: 7124393 - DNA, 22 bp, Homo sapiens
agcccagccggattcccagttc

SEQ ID NO: 7124394 - DNA, 22 bp, Homo sapiens
cagaggagttcagtacacagcc

SEQ ID NO: 7124395 - DNA, 23 bp, Homo sapiens
cagaggcatcggattcaacatca

SEQ ID NO: 7124396 - DNA, 23 bp, Homo sapiens
cagaggcatcggattcaacatca

SEQ ID NO: 7124397 - DNA, 23 bp, Homo sapiens
cagaggcatcggattcaacatca

SEQ ID NO: 7124398 - DNA, 23 bp, Homo sapiens
cagaggcatcggattcaacatca

SEQ ID NO: 7124399 - DNA, 22 bp, Homo sapiens
cagaggcatataattgctgggg

SEQ ID NO: 7124400 - DNA, 20 bp, Homo sapiens
cagaggcattttcagactct

SEQ ID NO: 7124401 - DNA, 22 bp, Homo sapiens
agcccaggcagagggatgcttg

SEQ ID NO: 7124402 - DNA, 22 bp, Homo sapiens
agcccaggcagagggatgcttg

SEQ ID NO: 7124403 - DNA, 22 bp, Homo sapiens
cagaggcattactgaaaaggtg

SEQ ID NO: 7124404 - DNA, 22 bp, Homo sapiens
cagaggcattactgaaaaggtg

SEQ ID NO: 7124405 - DNA, 22 bp, Homo sapiens
agcccaggcagagggatgcttg

SEQ ID NO: 7124406 - DNA, 22 bp, Homo sapiens
agcccaggcagagggatgcttg

SEQ ID NO: 7124407 - DNA, 22 bp, Homo sapiens
agcccaggcagagggatgcttg

SEQ ID NO: 7124408 - DNA, 22 bp, Homo sapiens
cagagggagccctccaggagca

SEQ ID NO: 7124409 - DNA, 22 bp, Homo sapiens
cagagggagccctccaggagca

SEQ ID NO: 7124410 - DNA, 22 bp, Homo sapiens
cagagggagccctccaggagca

SEQ ID NO: 7124411 - DNA, 22 bp, Homo sapiens
cagagggagtttctgaggttgc

SEQ ID NO: 7124412 - DNA, 22 bp, Homo sapiens
cagagggaccagaacatactgt

SEQ ID NO: 7124413 - DNA, 22 bp, Homo sapiens
cagagggaccagaacatactgt

SEQ ID NO: 7124414 - DNA, 22 bp, Homo sapiens
cagagggagccctccaggagca

SEQ ID NO: 7124415 - DNA, 22 bp, Homo sapiens
cagagggagccctccaggagca

SEQ ID NO: 7124416 - DNA, 22 bp, Homo sapiens
cagagggacagtatgatgaaag

SEQ ID NO: 7124417 - DNA, 22 bp, Homo sapiens
cagagggacagtgtaatgcata

SEQ ID NO: 7124418 - DNA, 22 bp, Homo sapiens
cagaggctgacaaaatattgct

SEQ ID NO: 7124419 - DNA, 22 bp, Homo sapiens
cagagggaaaaggggagtaata

SEQ ID NO: 7124420 - DNA, 22 bp, Homo sapiens
cagagggaaaaggggagtaata

SEQ ID NO: 7124421 - DNA, 22 bp, Homo sapiens
cagagggaaaaggggagtaata

SEQ ID NO: 7124422 - DNA, 22 bp, Homo sapiens
cagagggacagtatgatgaaag

SEQ ID NO: 7124423 - DNA, 22 bp, Homo sapiens
cagagggacagtatgatgaaag

SEQ ID NO: 7124424 - DNA, 22 bp, Homo sapiens
cagagggacagtatgatgaaag

SEQ ID NO: 7124425 - DNA, 22 bp, Homo sapiens
cagagggacagtatgatgaaag

SEQ ID NO: 7124426 - DNA, 22 bp, Homo sapiens
cagaggctcttcctcactgccc

SEQ ID NO: 7124427 - DNA, 22 bp, Homo sapiens
agcccagggaaccaggaagtgg

SEQ ID NO: 7124428 - DNA, 22 bp, Homo sapiens
agcccagggaaccaggaagtgg

SEQ ID NO: 7124429 - DNA, 20 bp, Homo sapiens
agcccaggcctgtgtgagtc

SEQ ID NO: 7124430 - DNA, 20 bp, Homo sapiens
agcccaggcctgtgtgagtc

SEQ ID NO: 7124431 - DNA, 20 bp, Homo sapiens
agcccaggcctgtgtgagtc

SEQ ID NO: 7124432 - DNA, 20 bp, Homo sapiens
agcccaggcctgtgtgagtc

SEQ ID NO: 7124433 - DNA, 20 bp, Homo sapiens
agcccaggcctgtgtgagtc

SEQ ID NO: 7124434 - DNA, 18 bp, Homo sapiens
agcccaggcatcgtctgc

SEQ ID NO: 7124435 - DNA, 18 bp, Homo sapiens
agcccaggcatcgtctgc

SEQ ID NO: 7124436 - DNA, 22 bp, Homo sapiens
agcccagggaaccaggaagtgg

SEQ ID NO: 7124437 - DNA, 22 bp, Homo sapiens
agcccagggaaccaggaagtgg

SEQ ID NO: 7124438 - DNA, 22 bp, Homo sapiens
agcccagggaaccaggaagtgg

SEQ ID NO: 7124439 - DNA, 22 bp, Homo sapiens
agcccagggaaccaggaagtgg

SEQ ID NO: 7124440 - DNA, 22 bp, Homo sapiens
agcccaggctggagtgcagtgg

SEQ ID NO: 7124441 - DNA, 22 bp, Homo sapiens
agcccaggctggagtgcagtgg

SEQ ID NO: 7124442 - DNA, 22 bp, Homo sapiens
agcccaggctggagtgcagtgg

SEQ ID NO: 7124443 - DNA, 22 bp, Homo sapiens
agcccaggctggagtgcagtgg

SEQ ID NO: 7124444 - DNA, 22 bp, Homo sapiens
agcccaggctggagtgcagtgg

SEQ ID NO: 7124445 - DNA, 22 bp, Homo sapiens
cagaaggagcgctaaggtccca

SEQ ID NO: 7124446 - DNA, 22 bp, Homo sapiens
cagaaatatttattgagtgaca

SEQ ID NO: 7124447 - DNA, 18 bp, Homo sapiens
cagaaatcacaccagcac

SEQ ID NO: 7124448 - DNA, 18 bp, Homo sapiens
cagaaatcacaccagcac

SEQ ID NO: 7124449 - DNA, 22 bp, Homo sapiens
cagaaggcaaacaaaaggattt

SEQ ID NO: 7124450 - DNA, 22 bp, Homo sapiens
cagaaggagggggcaagccctg

SEQ ID NO: 7124451 - DNA, 22 bp, Homo sapiens
cagaataccctatagacagaat

SEQ ID NO: 7124452 - DNA, 22 bp, Homo sapiens
cagaaatatgtgccatgcctta

SEQ ID NO: 7124453 - DNA, 22 bp, Homo sapiens
cagaaatatgtgccatgcctta

SEQ ID NO: 7124454 - DNA, 22 bp, Homo sapiens
cagaaatattccaagtactgca

SEQ ID NO: 7124455 - DNA, 22 bp, Homo sapiens
cagaaatattccaagtactgca

SEQ ID NO: 7124456 - DNA, 22 bp, Homo sapiens
cagaaatattccaagtactgca

SEQ ID NO: 7124457 - DNA, 22 bp, Homo sapiens
cagaaatatttattgagtgaca

SEQ ID NO: 7124458 - DNA, 22 bp, Homo sapiens
cagaaatatttattgagtgaca

SEQ ID NO: 7124459 - DNA, 22 bp, Homo sapiens
cagaaatatttattgagtgaca

SEQ ID NO: 7124460 - DNA, 22 bp, Homo sapiens
cagaaatatttattgagtgaca

SEQ ID NO: 7124461 - DNA, 22 bp, Homo sapiens
cagaaatatcagttgaaagtgc

SEQ ID NO: 7124462 - DNA, 22 bp, Homo sapiens
cagaaatatcagttgaaagtgc

SEQ ID NO: 7124463 - DNA, 22 bp, Homo sapiens
cagaaatatcagttgaaagtgc

SEQ ID NO: 7124464 - DNA, 22 bp, Homo sapiens
cagaaatatatatgggtcagag

SEQ ID NO: 7124465 - DNA, 22 bp, Homo sapiens
cagaaatatcacctggactcta

SEQ ID NO: 7124466 - DNA, 22 bp, Homo sapiens
cagaaatatcacctggactcta

SEQ ID NO: 7124467 - DNA, 22 bp, Homo sapiens
cagaaatatcagttgaaagtgc

SEQ ID NO: 7124468 - DNA, 22 bp, Homo sapiens
cagaaatatcagttgaaagtgc

SEQ ID NO: 7124469 - DNA, 21 bp, Homo sapiens
cagaaatatgaatgatggtga

SEQ ID NO: 7124470 - DNA, 19 bp, Homo sapiens
cagaaatagcgaagtgtaa

SEQ ID NO: 7124471 - DNA, 22 bp, Homo sapiens
agccactggtaaactggtagga

SEQ ID NO: 7124472 - DNA, 22 bp, Homo sapiens
agccactgtaaggggaattgcc

SEQ ID NO: 7124473 - DNA, 22 bp, Homo sapiens
agccactgtaaggggaattgcc

SEQ ID NO: 7124474 - DNA, 19 bp, Homo sapiens
cagaaatagcgaagtgtaa

SEQ ID NO: 7124475 - DNA, 19 bp, Homo sapiens
cagaaatagcgaagtgtaa

SEQ ID NO: 7124476 - DNA, 22 bp, Homo sapiens
cagaaatatatatgggtcagag

SEQ ID NO: 7124477 - DNA, 22 bp, Homo sapiens
cagaaatatatatgggtcagag

SEQ ID NO: 7124478 - DNA, 22 bp, Homo sapiens
agccactggcctgggcagctct

SEQ ID NO: 7124479 - DNA, 22 bp, Homo sapiens
agccactggtaaactggtagga

SEQ ID NO: 7124480 - DNA, 22 bp, Homo sapiens
agccactggtaaactggtagga

SEQ ID NO: 7124481 - DNA, 22 bp, Homo sapiens
agccactggcctgggcagctct

SEQ ID NO: 7124482 - DNA, 22 bp, Homo sapiens
agccactcagtgctgtattgac

SEQ ID NO: 7124483 - DNA, 22 bp, Homo sapiens
agccaccttctccaaggcctag

SEQ ID NO: 7124484 - DNA, 22 bp, Homo sapiens
agccacctctgtgcaggcctcg

SEQ ID NO: 7124485 - DNA, 22 bp, Homo sapiens
agccacctctgtgcaggcctcg

SEQ ID NO: 7124486 - DNA, 22 bp, Homo sapiens
agccacctggacacaggcttgc

SEQ ID NO: 7124487 - DNA, 20 bp, Homo sapiens
agccacctcatttccctacc

SEQ ID NO: 7124488 - DNA, 20 bp, Homo sapiens
agccacctcatttccctacc

SEQ ID NO: 7124489 - DNA, 16 bp, Homo sapiens
agccacctcagaggac

SEQ ID NO: 7124490 - DNA, 22 bp, Homo sapiens
agccaccaccactgaaaggtta

SEQ ID NO: 7124491 - DNA, 22 bp, Homo sapiens
agccacagtgggctaccagctc

SEQ ID NO: 7124492 - DNA, 22 bp, Homo sapiens
agccacatgagtgagccatctt

SEQ ID NO: 7124493 - DNA, 22 bp, Homo sapiens
agccacatttttctgctcctga

SEQ ID NO: 7124494 - DNA, 22 bp, Homo sapiens
agccacagtgggctaccagctc

SEQ ID NO: 7124495 - DNA, 22 bp, Homo sapiens
agccacagtgggctaccagctc

SEQ ID NO: 7124496 - DNA, 22 bp, Homo sapiens
agccacagtgggctaccagctc

SEQ ID NO: 7124497 - DNA, 22 bp, Homo sapiens
agcatatacaaactcatataca

SEQ ID NO: 7124498 - DNA, 22 bp, Homo sapiens
agcatagatacattgagccaca

SEQ ID NO: 7124499 - DNA, 22 bp, Homo sapiens
agcatagattctttcctttgcc

SEQ ID NO: 7124500 - DNA, 22 bp, Homo sapiens
agcataggcggtggtaggaccc

SEQ ID NO: 7124501 - DNA, 22 bp, Homo sapiens
agcatagggtcctagtacacag

SEQ ID NO: 7124502 - DNA, 22 bp, Homo sapiens
agcataggttttccggtgtgcc

SEQ ID NO: 7124503 - DNA, 22 bp, Homo sapiens
agcatataaatggacatatttg

SEQ ID NO: 7124504 - DNA, 22 bp, Homo sapiens
agcatatagctatctttgattg

SEQ ID NO: 7124505 - DNA, 22 bp, Homo sapiens
agccacaggaaacagagacagc

SEQ ID NO: 7124506 - DNA, 22 bp, Homo sapiens
agccacaggaaacagagacagc

SEQ ID NO: 7124507 - DNA, 22 bp, Homo sapiens
agccacagtctgtagccagctt

SEQ ID NO: 7124508 - DNA, 22 bp, Homo sapiens
agccacagtctgtagccagctt

SEQ ID NO: 7124509 - DNA, 22 bp, Homo sapiens
agccacagtgcaagagagaaaa

SEQ ID NO: 7124510 - DNA, 22 bp, Homo sapiens
agccagagactttacctgtgca

SEQ ID NO: 7124511 - DNA, 22 bp, Homo sapiens
agccagagactttacctgtgca

SEQ ID NO: 7124512 - DNA, 22 bp, Homo sapiens
agccagagactgtgtctgtaat

SEQ ID NO: 7124513 - DNA, 22 bp, Homo sapiens
agccagagactgtgtctgtaat

SEQ ID NO: 7124514 - DNA, 22 bp, Homo sapiens
agccagacatggctcctgctcc

SEQ ID NO: 7124515 - DNA, 22 bp, Homo sapiens
agccagagaacagcaggaaatg

SEQ ID NO: 7124516 - DNA, 22 bp, Homo sapiens
agccagagactttacctgtgca

SEQ ID NO: 7124517 - DNA, 22 bp, Homo sapiens
agccagagagccccaggttcta

SEQ ID NO: 7124518 - DNA, 22 bp, Homo sapiens
agccagagagccccaggttcta

SEQ ID NO: 7124519 - DNA, 22 bp, Homo sapiens
cagacaggaagttcagaagaaa

SEQ ID NO: 7124520 - DNA, 22 bp, Homo sapiens
agccagagagccccaggttcta

SEQ ID NO: 7124521 - DNA, 22 bp, Homo sapiens
agccagagagtgttggagatgt

SEQ ID NO: 7124522 - DNA, 22 bp, Homo sapiens
cagacaggaagttcagaagaaa

SEQ ID NO: 7124523 - DNA, 22 bp, Homo sapiens
cagacaggaagttcagaagaaa

SEQ ID NO: 7124524 - DNA, 22 bp, Homo sapiens
agccagagagtgttggagatgt

SEQ ID NO: 7124525 - DNA, 22 bp, Homo sapiens
cagacagggtgggtttctgggc

SEQ ID NO: 7124526 - DNA, 22 bp, Homo sapiens
cagacagggtgggtttctgggc

SEQ ID NO: 7124527 - DNA, 22 bp, Homo sapiens
cagacagggttttggtctttgg

SEQ ID NO: 7124528 - DNA, 22 bp, Homo sapiens
cagacagggttttggtctttgg

SEQ ID NO: 7124529 - DNA, 22 bp, Homo sapiens
cagacagggttttggtctttgg

SEQ ID NO: 7124530 - DNA, 22 bp, Homo sapiens
cagacagggttttggtctttgg

SEQ ID NO: 7124531 - DNA, 22 bp, Homo sapiens
cagacagtggacttgataaagg

SEQ ID NO: 7124532 - DNA, 22 bp, Homo sapiens
cagacagtggacttgataaagg

SEQ ID NO: 7124533 - DNA, 22 bp, Homo sapiens
cagacagtggacttgataaagg

SEQ ID NO: 7124534 - DNA, 22 bp, Homo sapiens
cagacagtgttagagtcaagct

SEQ ID NO: 7124535 - DNA, 22 bp, Homo sapiens
cagacagtgttagagtcaagct

SEQ ID NO: 7124536 - DNA, 22 bp, Homo sapiens
cagacagtttatcctaaataac

SEQ ID NO: 7124537 - DNA, 22 bp, Homo sapiens
cagacagtttatcctaaataac

SEQ ID NO: 7124538 - DNA, 22 bp, Homo sapiens
cagacagtttatcctaaataac

SEQ ID NO: 7124539 - DNA, 22 bp, Homo sapiens
cagacaggtagggacagaacat

SEQ ID NO: 7124540 - DNA, 22 bp, Homo sapiens
cagacaggtagggacagaacat

SEQ ID NO: 7124541 - DNA, 22 bp, Homo sapiens
cagacaggtagggacagaacat

SEQ ID NO: 7124542 - DNA, 22 bp, Homo sapiens
cagacaggttgcaaaacttcaa

SEQ ID NO: 7124543 - DNA, 22 bp, Homo sapiens
cagacaggttgcaaaacttcaa

SEQ ID NO: 7124544 - DNA, 22 bp, Homo sapiens
cagacaggttgcaaaacttcaa

SEQ ID NO: 7124545 - DNA, 22 bp, Homo sapiens
cagacatatgttttaacagatt

SEQ ID NO: 7124546 - DNA, 22 bp, Homo sapiens
cagacatccaggtacgagcttt

SEQ ID NO: 7124547 - DNA, 22 bp, Homo sapiens
cagacatgatgtaagcagaggc

SEQ ID NO: 7124548 - DNA, 22 bp, Homo sapiens
agccactttactttcatatttt

SEQ ID NO: 7124549 - DNA, 22 bp, Homo sapiens
agccagaacgcatcgccaaggc

SEQ ID NO: 7124550 - DNA, 22 bp, Homo sapiens
agccagaaccactggaacggtg

SEQ ID NO: 7124551 - DNA, 22 bp, Homo sapiens
agccactgtgcaggagcagtgt

SEQ ID NO: 7124552 - DNA, 22 bp, Homo sapiens
agccactgtgcaggagcagtgt

SEQ ID NO: 7124553 - DNA, 22 bp, Homo sapiens
agccactgtgcaggagcagtgt

SEQ ID NO: 7124554 - DNA, 22 bp, Homo sapiens
agccactgtgtgaccagctgtc

SEQ ID NO: 7124555 - DNA, 22 bp, Homo sapiens
agccactgtgtgaccagctgtc

SEQ ID NO: 7124556 - DNA, 22 bp, Homo sapiens
agccactgtgtgaccagctgtc

SEQ ID NO: 7124557 - DNA, 22 bp, Homo sapiens
agccactgtgtgaccagctgtc

SEQ ID NO: 7124558 - DNA, 23 bp, Homo sapiens
agccacttctatcttgctcctgg

SEQ ID NO: 7124559 - DNA, 22 bp, Homo sapiens
agccactgtctgaacttctgtg

SEQ ID NO: 7124560 - DNA, 22 bp, Homo sapiens
agccactgtgagaggaccaggg

SEQ ID NO: 7124561 - DNA, 22 bp, Homo sapiens
agccactgtctgaacttctgtg

SEQ ID NO: 7124562 - DNA, 22 bp, Homo sapiens
agccactgtgagaggaccaggg

SEQ ID NO: 7124563 - DNA, 22 bp, Homo sapiens
agccactgtgagaggaccaggg

SEQ ID NO: 7124564 - DNA, 22 bp, Homo sapiens
cagaatctgagtcgtgattgta

SEQ ID NO: 7124565 - DNA, 22 bp, Homo sapiens
cagaatctgagtcgtgattgta

SEQ ID NO: 7124566 - DNA, 22 bp, Homo sapiens
cagaatctgttggggttgcaga

SEQ ID NO: 7124567 - DNA, 22 bp, Homo sapiens
cagaatgaaatgtaagaacacc

SEQ ID NO: 7124568 - DNA, 22 bp, Homo sapiens
cagaatgaaatgtaagaacacc

SEQ ID NO: 7124569 - DNA, 22 bp, Homo sapiens
cagaatgagataacccagattg

SEQ ID NO: 7124570 - DNA, 22 bp, Homo sapiens
cagaatgagataacccagattg

SEQ ID NO: 7124571 - DNA, 22 bp, Homo sapiens
cagaatgagtagcatcttcacc

SEQ ID NO: 7124572 - DNA, 22 bp, Homo sapiens
cagaatcagtgacacatgtata

SEQ ID NO: 7124573 - DNA, 22 bp, Homo sapiens
cagaatcagtgacacatgtata

SEQ ID NO: 7124574 - DNA, 22 bp, Homo sapiens
cagaatccacaacagaagttga

SEQ ID NO: 7124575 - DNA, 22 bp, Homo sapiens
cagaatccacaacagaagttga

SEQ ID NO: 7124576 - DNA, 22 bp, Homo sapiens
cagaatccagaattgctgaggt

SEQ ID NO: 7124577 - DNA, 22 bp, Homo sapiens
cagaatccagaattgctgaggt

SEQ ID NO: 7124578 - DNA, 22 bp, Homo sapiens
cagaatccagaattgctgaggt

SEQ ID NO: 7124579 - DNA, 21 bp, Homo sapiens
cagaatccagtctcttattac

SEQ ID NO: 7124580 - DNA, 22 bp, Homo sapiens
cagaatccatgacagacgttga

SEQ ID NO: 7124581 - DNA, 22 bp, Homo sapiens
cagaatccatgacagacgttga

SEQ ID NO: 7124582 - DNA, 22 bp, Homo sapiens
cagcaggggtgtcattgtagtt

SEQ ID NO: 7124583 - DNA, 22 bp, Homo sapiens
cagcagggggcagcgcagatca

SEQ ID NO: 7124584 - DNA, 22 bp, Homo sapiens
cagcaggggtgtcattgtagtt

SEQ ID NO: 7124585 - DNA, 22 bp, Homo sapiens
cagcagggggcagcgcagatca

SEQ ID NO: 7124586 - DNA, 22 bp, Homo sapiens
cagcaggggaactgtgggccag

SEQ ID NO: 7124587 - DNA, 22 bp, Homo sapiens
cagcaggggaactgtgggccag

SEQ ID NO: 7124588 - DNA, 22 bp, Homo sapiens
cagcagggggcagcgcagatca

SEQ ID NO: 7124589 - DNA, 22 bp, Homo sapiens
cagcagggtatacagggaattt

SEQ ID NO: 7124590 - DNA, 22 bp, Homo sapiens
cagcagggttaagtgactcacc

SEQ ID NO: 7124591 - DNA, 22 bp, Homo sapiens
cagcagggttaagtgactcacc

SEQ ID NO: 7124592 - DNA, 22 bp, Homo sapiens
cagcagtgtctccagcatcaca

SEQ ID NO: 7124593 - DNA, 22 bp, Homo sapiens
cagcagggtaggttgtatcagt

SEQ ID NO: 7124594 - DNA, 22 bp, Homo sapiens
cagcagggtatacagggaattt

SEQ ID NO: 7124595 - DNA, 22 bp, Homo sapiens
cagcagggtatacagggaattt

SEQ ID NO: 7124596 - DNA, 22 bp, Homo sapiens
cagcagttatgagtagaatagt

SEQ ID NO: 7124597 - DNA, 22 bp, Homo sapiens
cagcagttatgagtagaatagt

SEQ ID NO: 7124598 - DNA, 21 bp, Homo sapiens
cagcagtgtgtctgagctaga

SEQ ID NO: 7124599 - DNA, 22 bp, Homo sapiens
cagcagtgtggaagctgagggg

SEQ ID NO: 7124600 - DNA, 22 bp, Homo sapiens
cagcagtgtggaagctgagggg

SEQ ID NO: 7124601 - DNA, 22 bp, Homo sapiens
cagcagtgtggaagctgagggg

SEQ ID NO: 7124602 - DNA, 22 bp, Homo sapiens
cagcagttctgtactttagagt

SEQ ID NO: 7124603 - DNA, 22 bp, Homo sapiens
cagcagttctgtactttagagt

SEQ ID NO: 7124604 - DNA, 22 bp, Homo sapiens
cagcagttgaaattgacatgtg

SEQ ID NO: 7124605 - DNA, 22 bp, Homo sapiens
cagcagtttcctatggttcagc

SEQ ID NO: 7124606 - DNA, 22 bp, Homo sapiens
cagcagttttgaagtgtggaga

SEQ ID NO: 7124607 - DNA, 22 bp, Homo sapiens
cagcatactgcatcaaatgagg

SEQ ID NO: 7124608 - DNA, 22 bp, Homo sapiens
cagccctgcagagggcgctcct

SEQ ID NO: 7124609 - DNA, 22 bp, Homo sapiens
cagccctgcagagggcgctcct

SEQ ID NO: 7124610 - DNA, 22 bp, Homo sapiens
cagccctgcagagggcgctcct

SEQ ID NO: 7124611 - DNA, 22 bp, Homo sapiens
cagccctgcagagggcgctcct

SEQ ID NO: 7124612 - DNA, 22 bp, Homo sapiens
agctcagagaatagggcttgag

SEQ ID NO: 7124613 - DNA, 22 bp, Homo sapiens
agctcagagataatcaagagac

SEQ ID NO: 7124614 - DNA, 22 bp, Homo sapiens
agctcagagataatcaagagac

SEQ ID NO: 7124615 - DNA, 22 bp, Homo sapiens
cagccctgcacgctgcctccgc

SEQ ID NO: 7124616 - DNA, 22 bp, Homo sapiens
cagccctgcacgctgcctccgc

SEQ ID NO: 7124617 - DNA, 22 bp, Homo sapiens
cagccctgcacgctgcctccgc

SEQ ID NO: 7124618 - DNA, 22 bp, Homo sapiens
cagccctgcagagggcgctcct

SEQ ID NO: 7124619 - DNA, 22 bp, Homo sapiens
cagccctgcagagggcgctcct

SEQ ID NO: 7124620 - DNA, 22 bp, Homo sapiens
cagccctgcagagggcgctcct

SEQ ID NO: 7124621 - DNA, 22 bp, Homo sapiens
cagccctgagttagcccacgga

SEQ ID NO: 7124622 - DNA, 22 bp, Homo sapiens
cagccctgagttagcccacgga

SEQ ID NO: 7124623 - DNA, 22 bp, Homo sapiens
cagccctgcacgctgcctccgc

SEQ ID NO: 7124624 - DNA, 22 bp, Homo sapiens
cagccctgcacgctgcctccgc

SEQ ID NO: 7124625 - DNA, 22 bp, Homo sapiens
cagccctgagcaaggcttttaa

SEQ ID NO: 7124626 - DNA, 16 bp, Homo sapiens
cagccctgaggaagaa

SEQ ID NO: 7124627 - DNA, 16 bp, Homo sapiens
cagccctgaggaagaa

SEQ ID NO: 7124628 - DNA, 22 bp, Homo sapiens
cagccctgagttagcccacgga

SEQ ID NO: 7124629 - DNA, 22 bp, Homo sapiens
cagccctgagttagcccacgga

SEQ ID NO: 7124630 - DNA, 22 bp, Homo sapiens
cagccctgagagaaccatctat

SEQ ID NO: 7124631 - DNA, 23 bp, Homo sapiens
cagccctgaaatcgaggtgacac

SEQ ID NO: 7124632 - DNA, 22 bp, Homo sapiens
cagccctgagaaggaggatctc

SEQ ID NO: 7124633 - DNA, 22 bp, Homo sapiens
cagccctgagaaggaggatctc

SEQ ID NO: 7124634 - DNA, 22 bp, Homo sapiens
cagccctgagaaggaggatctc

SEQ ID NO: 7124635 - DNA, 22 bp, Homo sapiens
cagccctgagaaggaggatctc

SEQ ID NO: 7124636 - DNA, 22 bp, Homo sapiens
cagccctgagaaggaggatctc

SEQ ID NO: 7124637 - DNA, 22 bp, Homo sapiens
cagccctgagaaggaggatctc

SEQ ID NO: 7124638 - DNA, 22 bp, Homo sapiens
cagccccatggtgtgctccagc

SEQ ID NO: 7124639 - DNA, 22 bp, Homo sapiens
cagccccagcacttagctgagt

SEQ ID NO: 7124640 - DNA, 22 bp, Homo sapiens
cagccccatggtgtgctccagc

SEQ ID NO: 7124641 - DNA, 22 bp, Homo sapiens
cagccccatggtgtgctccagc

SEQ ID NO: 7124642 - DNA, 22 bp, Homo sapiens
cagccccacacggtctagctct

SEQ ID NO: 7124643 - DNA, 22 bp, Homo sapiens
cagccccacacggtctagctct

SEQ ID NO: 7124644 - DNA, 22 bp, Homo sapiens
cagccccagcacttagctgagt

SEQ ID NO: 7124645 - DNA, 22 bp, Homo sapiens
cagccccagcacttagctgagt

SEQ ID NO: 7124646 - DNA, 22 bp, Homo sapiens
cagcatcaccaacttgagcaat

SEQ ID NO: 7124647 - DNA, 22 bp, Homo sapiens
cagcatcacagtgcccgaagtc

SEQ ID NO: 7124648 - DNA, 22 bp, Homo sapiens
cagcataggatgtggagccagg

SEQ ID NO: 7124649 - DNA, 22 bp, Homo sapiens
cagcatcaacattctcagctct

SEQ ID NO: 7124650 - DNA, 22 bp, Homo sapiens
cagcatcaacattctcagctct

SEQ ID NO: 7124651 - DNA, 22 bp, Homo sapiens
agctcctgatacatgcaggaat

SEQ ID NO: 7124652 - DNA, 22 bp, Homo sapiens
agctcctgatacatgcaggaat

SEQ ID NO: 7124653 - DNA, 22 bp, Homo sapiens
agctcctgattctcagagatag

SEQ ID NO: 7124654 - DNA, 22 bp, Homo sapiens
agctcctgattctcagagatag

SEQ ID NO: 7124655 - DNA, 22 bp, Homo sapiens
agctcctgattctcagagatag

SEQ ID NO: 7124656 - DNA, 22 bp, Homo sapiens
cagctctgagactgaggctatg

SEQ ID NO: 7124657 - DNA, 22 bp, Homo sapiens
cagctctgagactgaggctatg

SEQ ID NO: 7124658 - DNA, 22 bp, Homo sapiens
cagctctgagactgaggctatg

SEQ ID NO: 7124659 - DNA, 22 bp, Homo sapiens
cagctctgagactgaggctatg

SEQ ID NO: 7124660 - DNA, 22 bp, Homo sapiens
cagctctgagactgaggctatg

SEQ ID NO: 7124661 - DNA, 22 bp, Homo sapiens
cagctctgagactgaggctatg

SEQ ID NO: 7124662 - DNA, 22 bp, Homo sapiens
cagctctgagactgaggctatg

SEQ ID NO: 7124663 - DNA, 23 bp, Homo sapiens
agctcctgaggccagcctctcct

SEQ ID NO: 7124664 - DNA, 23 bp, Homo sapiens
agctcctgaggccagcctctcct

SEQ ID NO: 7124665 - DNA, 23 bp, Homo sapiens
agctcctgaggccagcctctcct

SEQ ID NO: 7124666 - DNA, 23 bp, Homo sapiens
agctcctgaggccagcctctcct

SEQ ID NO: 7124667 - DNA, 23 bp, Homo sapiens
agctcctgaggccagcctctcct

SEQ ID NO: 7124668 - DNA, 20 bp, Homo sapiens
agctcctgagggttactttc

SEQ ID NO: 7124669 - DNA, 20 bp, Homo sapiens
agctcctgagggttactttc

SEQ ID NO: 7124670 - DNA, 22 bp, Homo sapiens
agctcctgagtagctttactca

SEQ ID NO: 7124671 - DNA, 22 bp, Homo sapiens
agctcctgagtagctttactca

SEQ ID NO: 7124672 - DNA, 22 bp, Homo sapiens
agctcctgatacatgcaggaat

SEQ ID NO: 7124673 - DNA, 22 bp, Homo sapiens
cagctccaaagccccactgtcc

SEQ ID NO: 7124674 - DNA, 22 bp, Homo sapiens
cagctccaaagccccactgtcc

SEQ ID NO: 7124675 - DNA, 22 bp, Homo sapiens
agctcctgaaaagcgcttgctt

SEQ ID NO: 7124676 - DNA, 22 bp, Homo sapiens
cagctcattcctcaatctagga

SEQ ID NO: 7124677 - DNA, 22 bp, Homo sapiens
agctcctgaaaatccagactgg

SEQ ID NO: 7124678 - DNA, 22 bp, Homo sapiens
agctcctgaaaatccagactgg

SEQ ID NO: 7124679 - DNA, 22 bp, Homo sapiens
agctcctgaaaatccagactgg

SEQ ID NO: 7124680 - DNA, 18 bp, Homo sapiens
agctcctgaactctgtgg

SEQ ID NO: 7124681 - DNA, 18 bp, Homo sapiens
agctcctgaactctgtgg

SEQ ID NO: 7124682 - DNA, 22 bp, Homo sapiens
cagctcagtctggagagatgca

SEQ ID NO: 7124683 - DNA, 22 bp, Homo sapiens
cagctcagtcttgaagcactgg

SEQ ID NO: 7124684 - DNA, 22 bp, Homo sapiens
cagctcagtcttgaagcactgg

SEQ ID NO: 7124685 - DNA, 22 bp, Homo sapiens
cagctcagtcttgaagcactgg

SEQ ID NO: 7124686 - DNA, 22 bp, Homo sapiens
cagctcagtgatgccttcacag

SEQ ID NO: 7124687 - DNA, 22 bp, Homo sapiens
cagctcagtgatgccttcacag

SEQ ID NO: 7124688 - DNA, 22 bp, Homo sapiens
cagctcagtgatgccttcacag

SEQ ID NO: 7124689 - DNA, 22 bp, Homo sapiens
cagctcagtgatgccttcacag

SEQ ID NO: 7124690 - DNA, 22 bp, Homo sapiens
cagctcagtgatgccttcacag

SEQ ID NO: 7124691 - DNA, 22 bp, Homo sapiens
cagctcagtttcaataccaggt

SEQ ID NO: 7124692 - DNA, 22 bp, Homo sapiens
cagctcagtttcaataccaggt

SEQ ID NO: 7124693 - DNA, 22 bp, Homo sapiens
cagctcagtttcaataccaggt

SEQ ID NO: 7124694 - DNA, 22 bp, Homo sapiens
cagctcagtttcaataccaggt

SEQ ID NO: 7124695 - DNA, 22 bp, Homo sapiens
cagctcatgacctttgttatct

SEQ ID NO: 7124696 - DNA, 22 bp, Homo sapiens
cagctcatgacctttgttatct

SEQ ID NO: 7124697 - DNA, 22 bp, Homo sapiens
agctcagagataatcaagagac

SEQ ID NO: 7124698 - DNA, 22 bp, Homo sapiens
agctcagagctcgggaggatgg

SEQ ID NO: 7124699 - DNA, 21 bp, Homo sapiens
agctcagcaagatggaggctc

SEQ ID NO: 7124700 - DNA, 21 bp, Homo sapiens
agctcagcaagatggaggctc

SEQ ID NO: 7124701 - DNA, 22 bp, Homo sapiens
agctcagcactgtcagcactcc

SEQ ID NO: 7124702 - DNA, 22 bp, Homo sapiens
agctcagcactgtcagcactcc

SEQ ID NO: 7124703 - DNA, 22 bp, Homo sapiens
agctcagcactgtcagcactcc

SEQ ID NO: 7124704 - DNA, 22 bp, Homo sapiens
agctcagcactgtcagcactcc

SEQ ID NO: 7124705 - DNA, 22 bp, Homo sapiens
agctcagccctcctgtgcagct

SEQ ID NO: 7124706 - DNA, 22 bp, Homo sapiens
agctcagccctcctgtgcagct

SEQ ID NO: 7124707 - DNA, 21 bp, Homo sapiens
agctcagccgggcacagtggc

SEQ ID NO: 7124708 - DNA, 21 bp, Homo sapiens
agctcagccgggcacagtggc

SEQ ID NO: 7124709 - DNA, 21 bp, Homo sapiens
agctcagccgggcacagtggc

SEQ ID NO: 7124710 - DNA, 21 bp, Homo sapiens
agctcagccgggcacagtggc

SEQ ID NO: 7124711 - DNA, 22 bp, Homo sapiens
agctcagcgggcttctggtaag

SEQ ID NO: 7124712 - DNA, 22 bp, Homo sapiens
agctcagcttcctctccatgct

SEQ ID NO: 7124713 - DNA, 22 bp, Homo sapiens
agctcagcttcctctccatgct

SEQ ID NO: 7124714 - DNA, 22 bp, Homo sapiens
agctcagcttcctctccatgct

SEQ ID NO: 7124715 - DNA, 22 bp, Homo sapiens
agctcaggcaactctgggcccc

SEQ ID NO: 7124716 - DNA, 22 bp, Homo sapiens
agctcaggcaactctgggcccc

SEQ ID NO: 7124717 - DNA, 22 bp, Homo sapiens
agctcaggcaactctgggcccc

SEQ ID NO: 7124718 - DNA, 22 bp, Homo sapiens
cagctcaggctctccatgctcc

SEQ ID NO: 7124719 - DNA, 22 bp, Homo sapiens
cagctcaggctctccatgctcc

SEQ ID NO: 7124720 - DNA, 22 bp, Homo sapiens
cagctcaggctctccatgctcc

SEQ ID NO: 7124721 - DNA, 22 bp, Homo sapiens
cagctcagtctggagagatgca

SEQ ID NO: 7124722 - DNA, 22 bp, Homo sapiens
cagctcagtctggagagatgca

SEQ ID NO: 7124723 - DNA, 22 bp, Homo sapiens
cagctcagtctggagagatgca

SEQ ID NO: 7124724 - DNA, 19 bp, Homo sapiens
cagctcaggactcagcccc

SEQ ID NO: 7124725 - DNA, 19 bp, Homo sapiens
cagctcaggactcagcccc

SEQ ID NO: 7124726 - DNA, 19 bp, Homo sapiens
cagctcaggactcagcccc

SEQ ID NO: 7124727 - DNA, 19 bp, Homo sapiens
cagctcaggactcagcccc

SEQ ID NO: 7124728 - DNA, 22 bp, Homo sapiens
cagctcaggcactggcgcggga

SEQ ID NO: 7124729 - DNA, 22 bp, Homo sapiens
cagctcaggcactggcgcggga

SEQ ID NO: 7124730 - DNA, 22 bp, Homo sapiens
cagctcaggcactggcgcggga

SEQ ID NO: 7124731 - DNA, 22 bp, Homo sapiens
cagctcaggctctccatgctcc

SEQ ID NO: 7124732 - DNA, 22 bp, Homo sapiens
cagctcaggctctccatgctcc

SEQ ID NO: 7124733 - DNA, 22 bp, Homo sapiens
agctcaggcaactctgggcccc

SEQ ID NO: 7124734 - DNA, 22 bp, Homo sapiens
agctcaggcaactctgggcccc

SEQ ID NO: 7124735 - DNA, 22 bp, Homo sapiens
cagcgtctcgttgtgggcctcg

SEQ ID NO: 7124736 - DNA, 22 bp, Homo sapiens
cagctaagaatgtctgagatca

SEQ ID NO: 7124737 - DNA, 22 bp, Homo sapiens
cagctaagaatgtctgagatca

SEQ ID NO: 7124738 - DNA, 22 bp, Homo sapiens
cagctcaggaaggaaggccggc

SEQ ID NO: 7124739 - DNA, 22 bp, Homo sapiens
cagctcaggaaggaaggccggc

SEQ ID NO: 7124740 - DNA, 22 bp, Homo sapiens
cagctcaggaaggaaggccggc

SEQ ID NO: 7124741 - DNA, 19 bp, Homo sapiens
cagctcaggactcagcccc

SEQ ID NO: 7124742 - DNA, 19 bp, Homo sapiens
cagctcaggactcagcccc

SEQ ID NO: 7124743 - DNA, 19 bp, Homo sapiens
cagctcaggactcagcccc

SEQ ID NO: 7124744 - DNA, 19 bp, Homo sapiens
cagctcaggactcagcccc

SEQ ID NO: 7124745 - DNA, 22 bp, Homo sapiens
cagcagggcccccgggtgcgcc

SEQ ID NO: 7124746 - DNA, 22 bp, Homo sapiens
cagcagggcccccgggtgcgcc

SEQ ID NO: 7124747 - DNA, 22 bp, Homo sapiens
cagcagggcccccgggtgcgcc

SEQ ID NO: 7124748 - DNA, 22 bp, Homo sapiens
cagcagggcccccgggtgcgcc

SEQ ID NO: 7124749 - DNA, 22 bp, Homo sapiens
cagcagggcccccgggtgcgcc

SEQ ID NO: 7124750 - DNA, 22 bp, Homo sapiens
cagcaggggaactgtgggccag

SEQ ID NO: 7124751 - DNA, 22 bp, Homo sapiens
cagcagggctgtgctaccccat

SEQ ID NO: 7124752 - DNA, 22 bp, Homo sapiens
cagcaggggaactgtgggccag

SEQ ID NO: 7124753 - DNA, 22 bp, Homo sapiens
cagcaggggaactgtgggccag

SEQ ID NO: 7124754 - DNA, 22 bp, Homo sapiens
cagcaggggaactgtgggccag

SEQ ID NO: 7124755 - DNA, 22 bp, Homo sapiens
cagcaggggaactgtgggccag

SEQ ID NO: 7124756 - DNA, 22 bp, Homo sapiens
cagcagggcccccgggtgcgcc

SEQ ID NO: 7124757 - DNA, 22 bp, Homo sapiens
cagcagggctgtgctaccccat

SEQ ID NO: 7124758 - DNA, 22 bp, Homo sapiens
agcctggcactgaggcagggcg

SEQ ID NO: 7124759 - DNA, 22 bp, Homo sapiens
agcctggcactgccccatccat

SEQ ID NO: 7124760 - DNA, 22 bp, Homo sapiens
agcctggcactgccccatccat

SEQ ID NO: 7124761 - DNA, 22 bp, Homo sapiens
agcctggcactgccccatccat

SEQ ID NO: 7124762 - DNA, 22 bp, Homo sapiens
cagcaggatatggtggagagag

SEQ ID NO: 7124763 - DNA, 22 bp, Homo sapiens
cagcaggatatggtggagagag

SEQ ID NO: 7124764 - DNA, 22 bp, Homo sapiens
cagcaggatatggtggagagag

SEQ ID NO: 7124765 - DNA, 22 bp, Homo sapiens
cagcaggatatggtggagagag

SEQ ID NO: 7124766 - DNA, 22 bp, Homo sapiens
cagcagctgaggcgctggcgtg

SEQ ID NO: 7124767 - DNA, 22 bp, Homo sapiens
cagcagctgatggggaagtgat

SEQ ID NO: 7124768 - DNA, 22 bp, Homo sapiens
agcctggaggtaatgaggaaac

SEQ ID NO: 7124769 - DNA, 22 bp, Homo sapiens
agcctggagttcccaggagaag

SEQ ID NO: 7124770 - DNA, 22 bp, Homo sapiens
agcctggagttcccaggagaag

SEQ ID NO: 7124771 - DNA, 22 bp, Homo sapiens
agcctggagttcccaggagaag

SEQ ID NO: 7124772 - DNA, 22 bp, Homo sapiens
agcctggagttcccaggagaag

SEQ ID NO: 7124773 - DNA, 22 bp, Homo sapiens
agcctggatccatgtggctacc

SEQ ID NO: 7124774 - DNA, 22 bp, Homo sapiens
agcctggatccatgtggctacc

SEQ ID NO: 7124775 - DNA, 22 bp, Homo sapiens
agcctggatccatgtggctacc

SEQ ID NO: 7124776 - DNA, 22 bp, Homo sapiens
agcctggatcctaggctcagct

SEQ ID NO: 7124777 - DNA, 22 bp, Homo sapiens
agcctggatcctaggctcagct

SEQ ID NO: 7124778 - DNA, 22 bp, Homo sapiens
agcctggatcctaggctcagct

SEQ ID NO: 7124779 - DNA, 22 bp, Homo sapiens
agcctggatcctaggctcagct

SEQ ID NO: 7124780 - DNA, 22 bp, Homo sapiens
agcctggatcctaggctcagct

SEQ ID NO: 7124781 - DNA, 22 bp, Homo sapiens
agcctggattcgtgcatccaca

SEQ ID NO: 7124782 - DNA, 22 bp, Homo sapiens
agcctggattcgtgcatccaca

SEQ ID NO: 7124783 - DNA, 22 bp, Homo sapiens
agcctggattcgtgcatccaca

SEQ ID NO: 7124784 - DNA, 23 bp, Homo sapiens
agcctggcacctgcagatcggag

SEQ ID NO: 7124785 - DNA, 23 bp, Homo sapiens
agcctggcacctgcagatcggag

SEQ ID NO: 7124786 - DNA, 22 bp, Homo sapiens
agcctggcactgaggcagggcg

SEQ ID NO: 7124787 - DNA, 22 bp, Homo sapiens
agcctggcactgaggcagggcg

SEQ ID NO: 7124788 - DNA, 22 bp, Homo sapiens
agcctggcactgaggcagggcg

SEQ ID NO: 7124789 - DNA, 22 bp, Homo sapiens
cagcagctcaggctgcttccca

SEQ ID NO: 7124790 - DNA, 22 bp, Homo sapiens
cagcagctcaggctgcttccca

SEQ ID NO: 7124791 - DNA, 22 bp, Homo sapiens
cagcagctcagtctctcagtag

SEQ ID NO: 7124792 - DNA, 22 bp, Homo sapiens
cagcagctcagtctctcagtag

SEQ ID NO: 7124793 - DNA, 22 bp, Homo sapiens
cagcagctcaggctccttccca

SEQ ID NO: 7124794 - DNA, 22 bp, Homo sapiens
cagcagctcaggctccttccca

SEQ ID NO: 7124795 - DNA, 22 bp, Homo sapiens
cagcagctcaggctccttccca

SEQ ID NO: 7124796 - DNA, 22 bp, Homo sapiens
cagcagctcaggctgcttccca

SEQ ID NO: 7124797 - DNA, 22 bp, Homo sapiens
cagcagctcaggctgcttccca

SEQ ID NO: 7124798 - DNA, 22 bp, Homo sapiens
cagcagctcaggctgcttccca

SEQ ID NO: 7124799 - DNA, 22 bp, Homo sapiens
cagcagctcagtctctcagtag

SEQ ID NO: 7124800 - DNA, 22 bp, Homo sapiens
cagcagctccaaagaatagcca

SEQ ID NO: 7124801 - DNA, 22 bp, Homo sapiens
cagcagctccaaagaatagcca

SEQ ID NO: 7124802 - DNA, 22 bp, Homo sapiens
cagcagctcccatccgctgagc

SEQ ID NO: 7124803 - DNA, 22 bp, Homo sapiens
agcctgagccccatccagctga

SEQ ID NO: 7124804 - DNA, 22 bp, Homo sapiens
agcctcttccagctcctttcta

SEQ ID NO: 7124805 - DNA, 23 bp, Homo sapiens
agcctcttttctcctgccctgca

SEQ ID NO: 7124806 - DNA, 22 bp, Homo sapiens
agcctgagagccaagctgtgca

SEQ ID NO: 7124807 - DNA, 22 bp, Homo sapiens
agcctgagctgcctgccgcctc

SEQ ID NO: 7124808 - DNA, 22 bp, Homo sapiens
cagcagcattgctctggattcc

SEQ ID NO: 7124809 - DNA, 22 bp, Homo sapiens
cagcagcattgctctggattcc

SEQ ID NO: 7124810 - DNA, 22 bp, Homo sapiens
cagcagctcactcaggtggctc

SEQ ID NO: 7124811 - DNA, 22 bp, Homo sapiens
cagcagctcactgaataatgac

SEQ ID NO: 7124812 - DNA, 22 bp, Homo sapiens
cagaggtgctggagtgagtcct

SEQ ID NO: 7124813 - DNA, 22 bp, Homo sapiens
agcctccctatgcaccttcagg

SEQ ID NO: 7124814 - DNA, 22 bp, Homo sapiens
cagaggtgcatacaggtcatta

SEQ ID NO: 7124815 - DNA, 22 bp, Homo sapiens
cagaggtgcatacaggtcatta

SEQ ID NO: 7124816 - DNA, 22 bp, Homo sapiens
cagaggtgcatacaggtcatta

SEQ ID NO: 7124817 - DNA, 19 bp, Homo sapiens
cagaggtgatatatgccca

SEQ ID NO: 7124818 - DNA, 22 bp, Homo sapiens
cagaggtctgatgcgtccctgc

SEQ ID NO: 7124819 - DNA, 22 bp, Homo sapiens
cagaggtgcatacaggtcatta

SEQ ID NO: 7124820 - DNA, 22 bp, Homo sapiens
cagaggtgcatacaggtcatta

SEQ ID NO: 7124821 - DNA, 22 bp, Homo sapiens
cagaggtgacccatagtacctc

SEQ ID NO: 7124822 - DNA, 22 bp, Homo sapiens
cagaggtgacccatagtacctc

SEQ ID NO: 7124823 - DNA, 22 bp, Homo sapiens
cagaggtctgatgcgtccctgc

SEQ ID NO: 7124824 - DNA, 22 bp, Homo sapiens
cagaggtctgacactgaatggt

SEQ ID NO: 7124825 - DNA, 22 bp, Homo sapiens
cagaggtctccatcaccctcct

SEQ ID NO: 7124826 - DNA, 22 bp, Homo sapiens
cagaggtctccatcaccctcct

SEQ ID NO: 7124827 - DNA, 22 bp, Homo sapiens
cagaggtccagcatacatttcc

SEQ ID NO: 7124828 - DNA, 21 bp, Homo sapiens
cagaggtcatcctgaggacaa

SEQ ID NO: 7124829 - DNA, 21 bp, Homo sapiens
cagaggtcatcctgaggacaa

SEQ ID NO: 7124830 - DNA, 22 bp, Homo sapiens
cagaggtccctatttctttgtt

SEQ ID NO: 7124831 - DNA, 22 bp, Homo sapiens
cagaggtccctgttcttaagga

SEQ ID NO: 7124832 - DNA, 22 bp, Homo sapiens
cagagggatcatcttcctgaag

SEQ ID NO: 7124833 - DNA, 22 bp, Homo sapiens
cagagggatcatcttcctgaag

SEQ ID NO: 7124834 - DNA, 22 bp, Homo sapiens
cagagggagtttctgaggttgc

SEQ ID NO: 7124835 - DNA, 22 bp, Homo sapiens
cagagggcactcggagtgacat

SEQ ID NO: 7124836 - DNA, 22 bp, Homo sapiens
cagagggcactcggagtgacat

SEQ ID NO: 7124837 - DNA, 22 bp, Homo sapiens
cagagggcactcggagtgacat

SEQ ID NO: 7124838 - DNA, 22 bp, Homo sapiens
cagagggcactcggagtgacat

SEQ ID NO: 7124839 - DNA, 22 bp, Homo sapiens
cagaggtattttgataaacgcc

SEQ ID NO: 7124840 - DNA, 22 bp, Homo sapiens
cagaggtcaagatctgaagtga

SEQ ID NO: 7124841 - DNA, 22 bp, Homo sapiens
cagaggtcaggacttcattata

SEQ ID NO: 7124842 - DNA, 22 bp, Homo sapiens
cagaggtcaggttggacattat

SEQ ID NO: 7124843 - DNA, 22 bp, Homo sapiens
cagaggtcaggttggacattat

SEQ ID NO: 7124844 - DNA, 22 bp, Homo sapiens
cagaggtattgcaaaagcctag

SEQ ID NO: 7124845 - DNA, 22 bp, Homo sapiens
cagagggccccctggccacagt

SEQ ID NO: 7124846 - DNA, 22 bp, Homo sapiens
cagagggccccctggccacagt

SEQ ID NO: 7124847 - DNA, 22 bp, Homo sapiens
agcctctgtcaagcttttcaaa

SEQ ID NO: 7124848 - DNA, 22 bp, Homo sapiens
agcctctgtgactcacaggtca

SEQ ID NO: 7124849 - DNA, 22 bp, Homo sapiens
agcctctgtgactcacaggtca

SEQ ID NO: 7124850 - DNA, 22 bp, Homo sapiens
agcctctgtgactcacaggtca

SEQ ID NO: 7124851 - DNA, 22 bp, Homo sapiens
agcctctgtgactcacaggtca

SEQ ID NO: 7124852 - DNA, 22 bp, Homo sapiens
agcctctgtagaaagcagtgtg

SEQ ID NO: 7124853 - DNA, 22 bp, Homo sapiens
agcctctgtagaaagcagtgtg

SEQ ID NO: 7124854 - DNA, 22 bp, Homo sapiens
agcctctgtagaaagcagtgtg

SEQ ID NO: 7124855 - DNA, 22 bp, Homo sapiens
agcctctgtagaaagcagtgtg

SEQ ID NO: 7124856 - DNA, 22 bp, Homo sapiens
agcctctggtcctccctcagct

SEQ ID NO: 7124857 - DNA, 22 bp, Homo sapiens
agcctctgggggagctgggagc

SEQ ID NO: 7124858 - DNA, 22 bp, Homo sapiens
agcctctgggggagctgggagc

SEQ ID NO: 7124859 - DNA, 22 bp, Homo sapiens
agcctctggtcctccctcagct

SEQ ID NO: 7124860 - DNA, 22 bp, Homo sapiens
agcctctggtcctccctcagct

SEQ ID NO: 7124861 - DNA, 22 bp, Homo sapiens
agcctctggtcctccctcagct

SEQ ID NO: 7124862 - DNA, 22 bp, Homo sapiens
agcctctggccctagactgctt

SEQ ID NO: 7124863 - DNA, 22 bp, Homo sapiens
agcctctgggggagctgggagc

SEQ ID NO: 7124864 - DNA, 22 bp, Homo sapiens
agcctctgggggagctgggagc

SEQ ID NO: 7124865 - DNA, 22 bp, Homo sapiens
agcctctgctggccctggcact

SEQ ID NO: 7124866 - DNA, 20 bp, Homo sapiens
agcctctgcccttcccactg

SEQ ID NO: 7124867 - DNA, 20 bp, Homo sapiens
agcctctgcccttcccactg

SEQ ID NO: 7124868 - DNA, 22 bp, Homo sapiens
agcctctgcacttcttacaggt

SEQ ID NO: 7124869 - DNA, 22 bp, Homo sapiens
agcctctgcacttcttacaggt

SEQ ID NO: 7124870 - DNA, 22 bp, Homo sapiens
agcctctgcacttcttacaggt

SEQ ID NO: 7124871 - DNA, 20 bp, Homo sapiens
agcctctgcccttcccactg

SEQ ID NO: 7124872 - DNA, 22 bp, Homo sapiens
agcctctgcacgggcacgggtg

SEQ ID NO: 7124873 - DNA, 22 bp, Homo sapiens
agcctctgcacgggcacgggtg

SEQ ID NO: 7124874 - DNA, 22 bp, Homo sapiens
agcctctgcacgggcacgggtg

SEQ ID NO: 7124875 - DNA, 22 bp, Homo sapiens
agcctctgcacttcttacaggt

SEQ ID NO: 7124876 - DNA, 22 bp, Homo sapiens
agcctctgatggctcccaagga

SEQ ID NO: 7124877 - DNA, 22 bp, Homo sapiens
agcctcctggagtttctgggat

SEQ ID NO: 7124878 - DNA, 22 bp, Homo sapiens
agcctctgatggctcccaagga

SEQ ID NO: 7124879 - DNA, 22 bp, Homo sapiens
agcctctgctggccctggcact

SEQ ID NO: 7124880 - DNA, 22 bp, Homo sapiens
agcctctgctggccctggcact

SEQ ID NO: 7124881 - DNA, 22 bp, Homo sapiens
agcctctgcttatgcaaaggta

SEQ ID NO: 7124882 - DNA, 22 bp, Homo sapiens
agcctctgctggccctggcact

SEQ ID NO: 7124883 - DNA, 22 bp, Homo sapiens
agcctctggccctagactgctt

SEQ ID NO: 7124884 - DNA, 22 bp, Homo sapiens
agcctctggccctagactgctt

SEQ ID NO: 7124885 - DNA, 18 bp, Homo sapiens
agcctctggcagagagaa

SEQ ID NO: 7124886 - DNA, 22 bp, Homo sapiens
caattttttccatgctcttaca

SEQ ID NO: 7124887 - DNA, 22 bp, Homo sapiens
caattttttccatgctcttaca

SEQ ID NO: 7124888 - DNA, 22 bp, Homo sapiens
cacaagaaataagctgcctttc

SEQ ID NO: 7124889 - DNA, 22 bp, Homo sapiens
cacaagaaataagctgcctttc

SEQ ID NO: 7124890 - DNA, 20 bp, Homo sapiens
cacaagagaatacacactgg

SEQ ID NO: 7124891 - DNA, 20 bp, Homo sapiens
cacaagagaatacacactgg

SEQ ID NO: 7124892 - DNA, 20 bp, Homo sapiens
cacaagagaatacacactgg

SEQ ID NO: 7124893 - DNA, 20 bp, Homo sapiens
cacaagagaatacacactgg

SEQ ID NO: 7124894 - DNA, 20 bp, Homo sapiens
cacaagagaatacacactgg

SEQ ID NO: 7124895 - DNA, 20 bp, Homo sapiens
cacaagagaatacacactgg

SEQ ID NO: 7124896 - DNA, 22 bp, Homo sapiens
agcagcagggtgatagtgccca

SEQ ID NO: 7124897 - DNA, 22 bp, Homo sapiens
agcagcagggtgatagtgccca

SEQ ID NO: 7124898 - DNA, 22 bp, Homo sapiens
agcagcagggtcattgctcttt

SEQ ID NO: 7124899 - DNA, 22 bp, Homo sapiens
agcagcagggtgatagtgccca

SEQ ID NO: 7124900 - DNA, 22 bp, Homo sapiens
agcagcagggtgtaattgggca

SEQ ID NO: 7124901 - DNA, 22 bp, Homo sapiens
caatttttgtacttatagtact

SEQ ID NO: 7124902 - DNA, 22 bp, Homo sapiens
caatttttgtacttatagtact

SEQ ID NO: 7124903 - DNA, 22 bp, Homo sapiens
agcagcagggctctgcccgtgc

SEQ ID NO: 7124904 - DNA, 22 bp, Homo sapiens
agcagcagggctctgcccgtgc

SEQ ID NO: 7124905 - DNA, 22 bp, Homo sapiens
agcagcagggcatgtcttactc

SEQ ID NO: 7124906 - DNA, 22 bp, Homo sapiens
agcagcagggcatgtcttactc

SEQ ID NO: 7124907 - DNA, 22 bp, Homo sapiens
agcagcagggtcattgctcttt

SEQ ID NO: 7124908 - DNA, 22 bp, Homo sapiens
agcagcagggacaaaggaacag

SEQ ID NO: 7124909 - DNA, 22 bp, Homo sapiens
agcagcaggcttaaggaaaagt

SEQ ID NO: 7124910 - DNA, 22 bp, Homo sapiens
agcagcaggcttaaggaaaagt

SEQ ID NO: 7124911 - DNA, 21 bp, Homo sapiens
agcagcagggaagcctcatcc

SEQ ID NO: 7124912 - DNA, 21 bp, Homo sapiens
agcagcagggaagcctcatcc

SEQ ID NO: 7124913 - DNA, 21 bp, Homo sapiens
agcagcagggaagcctcatcc

SEQ ID NO: 7124914 - DNA, 21 bp, Homo sapiens
agcagcagggaagcctcatcc

SEQ ID NO: 7124915 - DNA, 22 bp, Homo sapiens
agcagcagggacaaaggaacag

SEQ ID NO: 7124916 - DNA, 22 bp, Homo sapiens
agcagccagaaatccagaggtg

SEQ ID NO: 7124917 - DNA, 22 bp, Homo sapiens
agcagccagaaagggcagtcga

SEQ ID NO: 7124918 - DNA, 22 bp, Homo sapiens
agcagccacccagctgctcatt

SEQ ID NO: 7124919 - DNA, 22 bp, Homo sapiens
agcagccagaaatccagaggtg

SEQ ID NO: 7124920 - DNA, 22 bp, Homo sapiens
agcagctccctcctcagccacc

SEQ ID NO: 7124921 - DNA, 22 bp, Homo sapiens
agcagctccctcctcagccacc

SEQ ID NO: 7124922 - DNA, 22 bp, Homo sapiens
agcagccacccagctgctcatt

SEQ ID NO: 7124923 - DNA, 22 bp, Homo sapiens
agcagccacagtctgggacagg

SEQ ID NO: 7124924 - DNA, 22 bp, Homo sapiens
agcagccacagtctgggacagg

SEQ ID NO: 7124925 - DNA, 22 bp, Homo sapiens
agcagccacccagctgctcatt

SEQ ID NO: 7124926 - DNA, 22 bp, Homo sapiens
agcagccacccagctgctcatt

SEQ ID NO: 7124927 - DNA, 22 bp, Homo sapiens
agcagccacacgcctccttctc

SEQ ID NO: 7124928 - DNA, 22 bp, Homo sapiens
agcagccaattggaggatgaag

SEQ ID NO: 7124929 - DNA, 22 bp, Homo sapiens
agcagccaattggaggatgaag

SEQ ID NO: 7124930 - DNA, 22 bp, Homo sapiens
agcagccaattggaggatgaag

SEQ ID NO: 7124931 - DNA, 22 bp, Homo sapiens
agcagccaaggtaacctgtgct

SEQ ID NO: 7124932 - DNA, 22 bp, Homo sapiens
cacaagggagcttagaaaacat

SEQ ID NO: 7124933 - DNA, 22 bp, Homo sapiens
agcagcatttaagtttcttcta

SEQ ID NO: 7124934 - DNA, 22 bp, Homo sapiens
cacaaggccctgggtcaccaca

SEQ ID NO: 7124935 - DNA, 22 bp, Homo sapiens
cacaaggctgggacaagtgctg

SEQ ID NO: 7124936 - DNA, 22 bp, Homo sapiens
cacaaggctttcatctggcata

SEQ ID NO: 7124937 - DNA, 20 bp, Homo sapiens
cacaagaggagttccctgag

SEQ ID NO: 7124938 - DNA, 22 bp, Homo sapiens
cacaagatggtcacataagtgc

SEQ ID NO: 7124939 - DNA, 22 bp, Homo sapiens
cacaagatggtcacataagtgc

SEQ ID NO: 7124940 - DNA, 22 bp, Homo sapiens
cacaagatggtttccagatgct

SEQ ID NO: 7124941 - DNA, 22 bp, Homo sapiens
cacaagctccttatgtggagaa

SEQ ID NO: 7124942 - DNA, 22 bp, Homo sapiens
cacaagctgggcaagtgtatat

SEQ ID NO: 7124943 - DNA, 22 bp, Homo sapiens
cacaaggaggtcctgaggaagc

SEQ ID NO: 7124944 - DNA, 22 bp, Homo sapiens
agcagcaggctgtgtggactga

SEQ ID NO: 7124945 - DNA, 22 bp, Homo sapiens
agcagcaggctgtgtggactga

SEQ ID NO: 7124946 - DNA, 22 bp, Homo sapiens
agcagcaggctgtgtggactga

SEQ ID NO: 7124947 - DNA, 22 bp, Homo sapiens
agcagcaggcttaaggaaaagt

SEQ ID NO: 7124948 - DNA, 22 bp, Homo sapiens
agcagcaggctgggatgagtct

SEQ ID NO: 7124949 - DNA, 22 bp, Homo sapiens
agcagcaggctgggatgagtct

SEQ ID NO: 7124950 - DNA, 22 bp, Homo sapiens
agcagcaggctgggatgagtct

SEQ ID NO: 7124951 - DNA, 22 bp, Homo sapiens
agcagcaggctgggatgagtct

SEQ ID NO: 7124952 - DNA, 22 bp, Homo sapiens
agcagcaggctgtgtggactga

SEQ ID NO: 7124953 - DNA, 22 bp, Homo sapiens
agcagcaggctgtgtggactga

SEQ ID NO: 7124954 - DNA, 22 bp, Homo sapiens
agcagcaggctgtgtggactga

SEQ ID NO: 7124955 - DNA, 23 bp, Homo sapiens
agcagcaggaggtattgataagg

SEQ ID NO: 7124956 - DNA, 22 bp, Homo sapiens
agcagcaggattttcgttggga

SEQ ID NO: 7124957 - DNA, 22 bp, Homo sapiens
agcagcaggattttcgttggga

SEQ ID NO: 7124958 - DNA, 22 bp, Homo sapiens
agcagcaggctagggaactgct

SEQ ID NO: 7124959 - DNA, 22 bp, Homo sapiens
agcagcaggctagggaactgct

SEQ ID NO: 7124960 - DNA, 22 bp, Homo sapiens
agcagcaggctagggaactgct

SEQ ID NO: 7124961 - DNA, 22 bp, Homo sapiens
agcagcaggctagggaactgct

SEQ ID NO: 7124962 - DNA, 22 bp, Homo sapiens
agcagcaggctagggaactgct

SEQ ID NO: 7124963 - DNA, 22 bp, Homo sapiens
agcagcaggaggctgtccacca

SEQ ID NO: 7124964 - DNA, 22 bp, Homo sapiens
agcagcaggaggctgtccacca

SEQ ID NO: 7124965 - DNA, 22 bp, Homo sapiens
agcagcaggaggccattgtctt

SEQ ID NO: 7124966 - DNA, 23 bp, Homo sapiens
agcagcaggaggtattgataagg

SEQ ID NO: 7124967 - DNA, 22 bp, Homo sapiens
agcagcaggagccgtggggtga

SEQ ID NO: 7124968 - DNA, 22 bp, Homo sapiens
agcagcaggagccgtggggtga

SEQ ID NO: 7124969 - DNA, 22 bp, Homo sapiens
caagcagagaagtctctaggct

SEQ ID NO: 7124970 - DNA, 22 bp, Homo sapiens
caagcagagactagatagctgt

SEQ ID NO: 7124971 - DNA, 22 bp, Homo sapiens
caagcagagactagatagctgt

SEQ ID NO: 7124972 - DNA, 22 bp, Homo sapiens
caagcagagaggtcaactaata

SEQ ID NO: 7124973 - DNA, 20 bp, Homo sapiens
agcagcagatgttggaggtg

SEQ ID NO: 7124974 - DNA, 22 bp, Homo sapiens
agcagcagattatggtctacat

SEQ ID NO: 7124975 - DNA, 22 bp, Homo sapiens
caagagacttatgtggaaacct

SEQ ID NO: 7124976 - DNA, 22 bp, Homo sapiens
caagagacttatgtggaaacct

SEQ ID NO: 7124977 - DNA, 22 bp, Homo sapiens
caagagacgggcaaggcaagag

SEQ ID NO: 7124978 - DNA, 17 bp, Homo sapiens
caagagagatgactgga

SEQ ID NO: 7124979 - DNA, 17 bp, Homo sapiens
caagagagatgactgga

SEQ ID NO: 7124980 - DNA, 22 bp, Homo sapiens
caagagagatgcagctcactca

SEQ ID NO: 7124981 - DNA, 22 bp, Homo sapiens
caagagagatgcagctcactca

SEQ ID NO: 7124982 - DNA, 22 bp, Homo sapiens
caagagatacatttctagtagg

SEQ ID NO: 7124983 - DNA, 22 bp, Homo sapiens
caagagcacgtgccctccataa

SEQ ID NO: 7124984 - DNA, 22 bp, Homo sapiens
caagagcaggtgctgcttccat

SEQ ID NO: 7124985 - DNA, 22 bp, Homo sapiens
caagagcatccctgcatccagc

SEQ ID NO: 7124986 - DNA, 22 bp, Homo sapiens
caagagcatccctgcatccagc

SEQ ID NO: 7124987 - DNA, 22 bp, Homo sapiens
caagatttatattttcacacaa

SEQ ID NO: 7124988 - DNA, 22 bp, Homo sapiens
caagatttccaaccctgggtaa

SEQ ID NO: 7124989 - DNA, 22 bp, Homo sapiens
caagatttagctcccttatctc

SEQ ID NO: 7124990 - DNA, 22 bp, Homo sapiens
caagatttagcctgctgcctgt

SEQ ID NO: 7124991 - DNA, 22 bp, Homo sapiens
caagagctagactttgtcagga

SEQ ID NO: 7124992 - DNA, 22 bp, Homo sapiens
caagagcatttagttagctggt

SEQ ID NO: 7124993 - DNA, 22 bp, Homo sapiens
caagagcatttagttagctggt

SEQ ID NO: 7124994 - DNA, 22 bp, Homo sapiens
caagagcatttagttagctggt

SEQ ID NO: 7124995 - DNA, 22 bp, Homo sapiens
caagagcctttgggcagaagga

SEQ ID NO: 7124996 - DNA, 22 bp, Homo sapiens
caagagctaccctgtgccatat

SEQ ID NO: 7124997 - DNA, 22 bp, Homo sapiens
caagagctagaaattggttaga

SEQ ID NO: 7124998 - DNA, 19 bp, Homo sapiens
caagatttgttcacacatg

SEQ ID NO: 7124999 - DNA, 22 bp, Homo sapiens
caagatttgggggcacggaatc

SEQ ID NO: 7125000 - DNA, 22 bp, Homo sapiens
caagatttgtattgggcctctg

SEQ ID NO: 7125001 - DNA, 22 bp, Homo sapiens
caagattttatctccgtttctg

SEQ ID NO: 7125002 - DNA, 22 bp, Homo sapiens
caagatttggcaactttgtcat

SEQ ID NO: 7125003 - DNA, 22 bp, Homo sapiens
caagatttggcattctgaggag

SEQ ID NO: 7125004 - DNA, 22 bp, Homo sapiens
caagatttgccagtggccaact

SEQ ID NO: 7125005 - DNA, 22 bp, Homo sapiens
caagatttgacttcgtggtttg

SEQ ID NO: 7125006 - DNA, 22 bp, Homo sapiens
caagcagaagcctcaggggcat

SEQ ID NO: 7125007 - DNA, 22 bp, Homo sapiens
caagcactgtggcactcgcagg

SEQ ID NO: 7125008 - DNA, 22 bp, Homo sapiens
caagcaatattttagaaaggta

SEQ ID NO: 7125009 - DNA, 22 bp, Homo sapiens
caagcaatgccctggtatatta

SEQ ID NO: 7125010 - DNA, 22 bp, Homo sapiens
caagcaatgctatactcattat

SEQ ID NO: 7125011 - DNA, 22 bp, Homo sapiens
caagacattgattttgtacaga

SEQ ID NO: 7125012 - DNA, 22 bp, Homo sapiens
caagacattgattttgtacaga

SEQ ID NO: 7125013 - DNA, 21 bp, Homo sapiens
caagacatatgagtactctgg

SEQ ID NO: 7125014 - DNA, 22 bp, Homo sapiens
caagacctcaaaatgagagggg

SEQ ID NO: 7125015 - DNA, 22 bp, Homo sapiens
caagagacttatgtggaaacct

SEQ ID NO: 7125016 - DNA, 22 bp, Homo sapiens
caacttggctctctggctatcc

SEQ ID NO: 7125017 - DNA, 22 bp, Homo sapiens
agcaccaggcagtatatcaaag

SEQ ID NO: 7125018 - DNA, 22 bp, Homo sapiens
agcaccaggccatggggtccct

SEQ ID NO: 7125019 - DNA, 22 bp, Homo sapiens
agcaccaggctgttggaagccc

SEQ ID NO: 7125020 - DNA, 22 bp, Homo sapiens
agcaccaggctgttggaagccc

SEQ ID NO: 7125021 - DNA, 22 bp, Homo sapiens
agcaccaggctgttggaagccc

SEQ ID NO: 7125022 - DNA, 22 bp, Homo sapiens
agcaccaggctgttggaagccc

SEQ ID NO: 7125023 - DNA, 22 bp, Homo sapiens
agcaccaggtcgctggcacgct

SEQ ID NO: 7125024 - DNA, 22 bp, Homo sapiens
agcaccaggtcgctggcacgct

SEQ ID NO: 7125025 - DNA, 22 bp, Homo sapiens
agcaccaggtcgctggcacgct

SEQ ID NO: 7125026 - DNA, 22 bp, Homo sapiens
agcaccaggatattgttggaga

SEQ ID NO: 7125027 - DNA, 22 bp, Homo sapiens
agcaccaggatattgttggaga

SEQ ID NO: 7125028 - DNA, 22 bp, Homo sapiens
agcaccaggcaccaaagggcct

SEQ ID NO: 7125029 - DNA, 23 bp, Homo sapiens
agcaccaggaacagtgtggtcct

SEQ ID NO: 7125030 - DNA, 23 bp, Homo sapiens
agcaccaggaacagtgtggtcct

SEQ ID NO: 7125031 - DNA, 22 bp, Homo sapiens
agcaccaggaaagaaggggcca

SEQ ID NO: 7125032 - DNA, 22 bp, Homo sapiens
agcaccagcaactatgggctgc

SEQ ID NO: 7125033 - DNA, 22 bp, Homo sapiens
agcaccagcaactatgggctgc

SEQ ID NO: 7125034 - DNA, 22 bp, Homo sapiens
agcaccagcaactatgggctgc

SEQ ID NO: 7125035 - DNA, 22 bp, Homo sapiens
agcaccagcaactatgggctgc

SEQ ID NO: 7125036 - DNA, 22 bp, Homo sapiens
agcaccagcgtgggggccgttg

SEQ ID NO: 7125037 - DNA, 22 bp, Homo sapiens
agcaccagcgtgggggccgttg

SEQ ID NO: 7125038 - DNA, 22 bp, Homo sapiens
agcaccagctcaaggtgcacct

SEQ ID NO: 7125039 - DNA, 22 bp, Homo sapiens
agcaccagctcaaggtgcacct

SEQ ID NO: 7125040 - DNA, 22 bp, Homo sapiens
agcaccagctcaaggtgcacct

SEQ ID NO: 7125041 - DNA, 22 bp, Homo sapiens
agcacattcccacctgtacttc

SEQ ID NO: 7125042 - DNA, 22 bp, Homo sapiens
agcacattctgccttgctttgc

SEQ ID NO: 7125043 - DNA, 22 bp, Homo sapiens
agcacattcttgccttaacctc

SEQ ID NO: 7125044 - DNA, 22 bp, Homo sapiens
agcacattgatttattttggag

SEQ ID NO: 7125045 - DNA, 22 bp, Homo sapiens
agcacatttaagtatgaaatat

SEQ ID NO: 7125046 - DNA, 22 bp, Homo sapiens
agcacatttaagtatgaaatat

SEQ ID NO: 7125047 - DNA, 22 bp, Homo sapiens
agcacatttaagtatgaaatat

SEQ ID NO: 7125048 - DNA, 22 bp, Homo sapiens
agcacatttaagtatgaaatat

SEQ ID NO: 7125049 - DNA, 22 bp, Homo sapiens
agcacattttatttaagaaaat

SEQ ID NO: 7125050 - DNA, 22 bp, Homo sapiens
agcacattttatttaagaaaat

SEQ ID NO: 7125051 - DNA, 22 bp, Homo sapiens
agcacattttctcaaagctcat

SEQ ID NO: 7125052 - DNA, 22 bp, Homo sapiens
agcaccagagctatgggcctgc

SEQ ID NO: 7125053 - DNA, 22 bp, Homo sapiens
agcaccagagctatgggcctgc

SEQ ID NO: 7125054 - DNA, 16 bp, Homo sapiens
agcaccagatcatatc

SEQ ID NO: 7125055 - DNA, 22 bp, Homo sapiens
caacagagagaccagaaacagg

SEQ ID NO: 7125056 - DNA, 22 bp, Homo sapiens
caacagagagaccagaaacagg

SEQ ID NO: 7125057 - DNA, 22 bp, Homo sapiens
caacagaaggtgtactactgaa

SEQ ID NO: 7125058 - DNA, 22 bp, Homo sapiens
caacagaaggtgtactactgaa

SEQ ID NO: 7125059 - DNA, 22 bp, Homo sapiens
caacagaaggtgtactactgaa

SEQ ID NO: 7125060 - DNA, 22 bp, Homo sapiens
caacagaaggtgtactactgaa

SEQ ID NO: 7125061 - DNA, 22 bp, Homo sapiens
caacagacctggattcaaaaac

SEQ ID NO: 7125062 - DNA, 22 bp, Homo sapiens
caacagagggaatggatctcat

SEQ ID NO: 7125063 - DNA, 20 bp, Homo sapiens
caacagaggggtctggagta

SEQ ID NO: 7125064 - DNA, 22 bp, Homo sapiens
caacagaggagtggcctgatcc

SEQ ID NO: 7125065 - DNA, 22 bp, Homo sapiens
caacagagcagttgatcaggaa

SEQ ID NO: 7125066 - DNA, 22 bp, Homo sapiens
caacaggctttatgtttaaagt

SEQ ID NO: 7125067 - DNA, 22 bp, Homo sapiens
caacagctttagaaacactttc

SEQ ID NO: 7125068 - DNA, 22 bp, Homo sapiens
agcacattaagtgagttcatgt

SEQ ID NO: 7125069 - DNA, 22 bp, Homo sapiens
agcacattagtatctaagaaca

SEQ ID NO: 7125070 - DNA, 22 bp, Homo sapiens
agcacattagtatctaagaaca

SEQ ID NO: 7125071 - DNA, 22 bp, Homo sapiens
agcacattagtatctaagaaca

SEQ ID NO: 7125072 - DNA, 22 bp, Homo sapiens
agcacattagtatctaagaaca

SEQ ID NO: 7125073 - DNA, 22 bp, Homo sapiens
agcacattcccacctgtacttc

SEQ ID NO: 7125074 - DNA, 23 bp, Homo sapiens
caacagctgttagatatgggctt

SEQ ID NO: 7125075 - DNA, 22 bp, Homo sapiens
caacagctggaggcttggcccg

SEQ ID NO: 7125076 - DNA, 22 bp, Homo sapiens
caacagctgatctttgatgaag

SEQ ID NO: 7125077 - DNA, 22 bp, Homo sapiens
caacagctcagacacgggacct

SEQ ID NO: 7125078 - DNA, 22 bp, Homo sapiens
caacagctgatctttgatgaag

SEQ ID NO: 7125079 - DNA, 23 bp, Homo sapiens
caacactgccttcaggtgaagaa

SEQ ID NO: 7125080 - DNA, 20 bp, Homo sapiens
caacactgcccattgtttgc

SEQ ID NO: 7125081 - DNA, 22 bp, Homo sapiens
caaattaccctcaacatctaga

SEQ ID NO: 7125082 - DNA, 23 bp, Homo sapiens
caacactgccttcaggtgaagaa

SEQ ID NO: 7125083 - DNA, 22 bp, Homo sapiens
caacacttcttatacttactga

SEQ ID NO: 7125084 - DNA, 22 bp, Homo sapiens
caacagaaatcaattttcccat

SEQ ID NO: 7125085 - DNA, 22 bp, Homo sapiens
caacagaaatcaattttcccat

SEQ ID NO: 7125086 - DNA, 22 bp, Homo sapiens
caacagaaatcaattttcccat

SEQ ID NO: 7125087 - DNA, 22 bp, Homo sapiens
caacagaaggaagcagggtcag

SEQ ID NO: 7125088 - DNA, 22 bp, Homo sapiens
caacagaaggaagcagggtcag

SEQ ID NO: 7125089 - DNA, 22 bp, Homo sapiens
caacagaaggtgtactactgaa

SEQ ID NO: 7125090 - DNA, 22 bp, Homo sapiens
caacagaaggtgtactactgaa

SEQ ID NO: 7125091 - DNA, 22 bp, Homo sapiens
caacagaaggtgtactactgaa

SEQ ID NO: 7125092 - DNA, 22 bp, Homo sapiens
caaatatctttggcaaagagaa

SEQ ID NO: 7125093 - DNA, 22 bp, Homo sapiens
caaatattccaggtacatccct

SEQ ID NO: 7125094 - DNA, 22 bp, Homo sapiens
caaattaatgtgtctcaaaata

SEQ ID NO: 7125095 - DNA, 22 bp, Homo sapiens
caaatagtgtcacattgtgagg

SEQ ID NO: 7125096 - DNA, 22 bp, Homo sapiens
caaatagtttttcatgtattat

SEQ ID NO: 7125097 - DNA, 22 bp, Homo sapiens
caaatagtttttcatgtattat

SEQ ID NO: 7125098 - DNA, 22 bp, Homo sapiens
agcacagtttcttttccttgtc

SEQ ID NO: 7125099 - DNA, 22 bp, Homo sapiens
agcacagttttcattgcagggt

SEQ ID NO: 7125100 - DNA, 22 bp, Homo sapiens
agcacagttttcattgcagggt

SEQ ID NO: 7125101 - DNA, 20 bp, Homo sapiens
agcacataactctaccagaa

SEQ ID NO: 7125102 - DNA, 22 bp, Homo sapiens
agcacagtgctctggacagagt

SEQ ID NO: 7125103 - DNA, 22 bp, Homo sapiens
agcacagtgctctggacagagt

SEQ ID NO: 7125104 - DNA, 22 bp, Homo sapiens
agcacagtggcttctatgtcta

SEQ ID NO: 7125105 - DNA, 19 bp, Homo sapiens
agcacagtttccacatgca

SEQ ID NO: 7125106 - DNA, 22 bp, Homo sapiens
agcacaggtgaaacagtcaggt

SEQ ID NO: 7125107 - DNA, 22 bp, Homo sapiens
agcacaggtgaaacagtcaggt

SEQ ID NO: 7125108 - DNA, 22 bp, Homo sapiens
agcacaggtgaaacagtcaggt

SEQ ID NO: 7125109 - DNA, 22 bp, Homo sapiens
agcacaggtgaaacagtcaggt

SEQ ID NO: 7125110 - DNA, 22 bp, Homo sapiens
agcacaggtgaaacagtcaggt

SEQ ID NO: 7125111 - DNA, 22 bp, Homo sapiens
agcacaggtgaaacagtcaggt

SEQ ID NO: 7125112 - DNA, 22 bp, Homo sapiens
agcacaggtgaaacagtcaggt

SEQ ID NO: 7125113 - DNA, 22 bp, Homo sapiens
agcacagtaaagcagtgtcaca

SEQ ID NO: 7125114 - DNA, 22 bp, Homo sapiens
agcacagtaaagcagtgtcaca

SEQ ID NO: 7125115 - DNA, 22 bp, Homo sapiens
agcacagtgaatggtttactca

SEQ ID NO: 7125116 - DNA, 22 bp, Homo sapiens
agcacagtgcctgacatatatg

SEQ ID NO: 7125117 - DNA, 22 bp, Homo sapiens
caaatagtatgagcaatgattc

SEQ ID NO: 7125118 - DNA, 22 bp, Homo sapiens
caaatagtgaaacagatggggg

SEQ ID NO: 7125119 - DNA, 22 bp, Homo sapiens
caaatagattgttcaatcctga

SEQ ID NO: 7125120 - DNA, 22 bp, Homo sapiens
caaataggtaaatgtatgctgt

SEQ ID NO: 7125121 - DNA, 22 bp, Homo sapiens
caaataggtaaatgtatgctgt

SEQ ID NO: 7125122 - DNA, 22 bp, Homo sapiens
caaatagtatgagcaatgattc

SEQ ID NO: 7125123 - DNA, 22 bp, Homo sapiens
caaatagattgttcaatcctga

SEQ ID NO: 7125124 - DNA, 22 bp, Homo sapiens
caaatagattgttcaatcctga

SEQ ID NO: 7125125 - DNA, 22 bp, Homo sapiens
agcacatgcacagtgctacact

SEQ ID NO: 7125126 - DNA, 22 bp, Homo sapiens
agcacatgacttttagtcgagt

SEQ ID NO: 7125127 - DNA, 22 bp, Homo sapiens
agcacatattcagttcatacaa

SEQ ID NO: 7125128 - DNA, 22 bp, Homo sapiens
agcacatgcacagtgctacact

SEQ ID NO: 7125129 - DNA, 20 bp, Homo sapiens
agcacattaaacatactcct

SEQ ID NO: 7125130 - DNA, 20 bp, Homo sapiens
agcacattaaacatactcct

SEQ ID NO: 7125131 - DNA, 20 bp, Homo sapiens
agcacattaaacatactcct

SEQ ID NO: 7125132 - DNA, 22 bp, Homo sapiens
caaatagacttcaatctcttga

SEQ ID NO: 7125133 - DNA, 22 bp, Homo sapiens
caaatagacttcaatctcttga

SEQ ID NO: 7125134 - DNA, 20 bp, Homo sapiens
agcaaactcttcccatcttc

SEQ ID NO: 7125135 - DNA, 22 bp, Homo sapiens
caaaataccacgacttgtttta

SEQ ID NO: 7125136 - DNA, 22 bp, Homo sapiens
caaaataccacgacttgtttta

SEQ ID NO: 7125137 - DNA, 22 bp, Homo sapiens
caaaagtctgtcctttaacttc

SEQ ID NO: 7125138 - DNA, 22 bp, Homo sapiens
caaaagtcttcctattctctta

SEQ ID NO: 7125139 - DNA, 22 bp, Homo sapiens
agcaaagaaatggaggctcaga

SEQ ID NO: 7125140 - DNA, 22 bp, Homo sapiens
agcaaagaaatggaggctcaga

SEQ ID NO: 7125141 - DNA, 22 bp, Homo sapiens
agcaaagaaatggaggctcaga

SEQ ID NO: 7125142 - DNA, 22 bp, Homo sapiens
agcaaagaaatggaggctcaga

SEQ ID NO: 7125143 - DNA, 22 bp, Homo sapiens
agcaaagaaatggaggctcaga

SEQ ID NO: 7125144 - DNA, 22 bp, Homo sapiens
agcaaagaagacacaggcttca

SEQ ID NO: 7125145 - DNA, 22 bp, Homo sapiens
agcaaagaagacacaggcttca

SEQ ID NO: 7125146 - DNA, 22 bp, Homo sapiens
agcaaagaagacacaggcttca

SEQ ID NO: 7125147 - DNA, 22 bp, Homo sapiens
agcaaagaagacacaggcttca

SEQ ID NO: 7125148 - DNA, 22 bp, Homo sapiens
agcaaagaagggttcttcatta

SEQ ID NO: 7125149 - DNA, 22 bp, Homo sapiens
agcaaagaagggttcttcatta

SEQ ID NO: 7125150 - DNA, 22 bp, Homo sapiens
agcaaagaagacacaggcttca

SEQ ID NO: 7125151 - DNA, 22 bp, Homo sapiens
agcaaagacagggacgaccaag

SEQ ID NO: 7125152 - DNA, 22 bp, Homo sapiens
agcaaagacagggacgaccaag

SEQ ID NO: 7125153 - DNA, 22 bp, Homo sapiens
agcaaagacagggacgaccaag

SEQ ID NO: 7125154 - DNA, 22 bp, Homo sapiens
agcaaagacagggacgaccaag

SEQ ID NO: 7125155 - DNA, 22 bp, Homo sapiens
agcaaagagtaattttgttttg

SEQ ID NO: 7125156 - DNA, 22 bp, Homo sapiens
agcaaagagtaattttgttttg

SEQ ID NO: 7125157 - DNA, 22 bp, Homo sapiens
agcaaagatgtccggggcaagc

SEQ ID NO: 7125158 - DNA, 22 bp, Homo sapiens
agcaaagatgtccggggcaagc

SEQ ID NO: 7125159 - DNA, 18 bp, Homo sapiens
agcaaagcaagagatcac

SEQ ID NO: 7125160 - DNA, 18 bp, Homo sapiens
agcaaagcaagagatcac

SEQ ID NO: 7125161 - DNA, 22 bp, Homo sapiens
agcaaagcaccatatggcagtt

SEQ ID NO: 7125162 - DNA, 22 bp, Homo sapiens
agcaaagcactttgcatacata

SEQ ID NO: 7125163 - DNA, 22 bp, Homo sapiens
agcaaagcagtggctaagctga

SEQ ID NO: 7125164 - DNA, 22 bp, Homo sapiens
agcaaagcatcactccaatctg

SEQ ID NO: 7125165 - DNA, 22 bp, Homo sapiens
agcaaagccgagacagccagtg

SEQ ID NO: 7125166 - DNA, 22 bp, Homo sapiens
agcaaagctatctctatggaga

SEQ ID NO: 7125167 - DNA, 22 bp, Homo sapiens
agcacagcttcaccgagcccat

SEQ ID NO: 7125168 - DNA, 22 bp, Homo sapiens
agcacagcttcaccgagcccat

SEQ ID NO: 7125169 - DNA, 21 bp, Homo sapiens
agcacagctttaagccatgtg

SEQ ID NO: 7125170 - DNA, 21 bp, Homo sapiens
agcacagctttaagccatgtg

SEQ ID NO: 7125171 - DNA, 21 bp, Homo sapiens
agcacagctttaagccatgtg

SEQ ID NO: 7125172 - DNA, 21 bp, Homo sapiens
agcacagctttaagccatgtg

SEQ ID NO: 7125173 - DNA, 22 bp, Homo sapiens
agcacaggtgaaacagtcaggt

SEQ ID NO: 7125174 - DNA, 22 bp, Homo sapiens
agcagctgatcaaagcacttat

SEQ ID NO: 7125175 - DNA, 22 bp, Homo sapiens
agcagctgatcaaagcacttat

SEQ ID NO: 7125176 - DNA, 22 bp, Homo sapiens
agcagctgatggggaaggagtt

SEQ ID NO: 7125177 - DNA, 22 bp, Homo sapiens
agcagctgatggggaaggagtt

SEQ ID NO: 7125178 - DNA, 22 bp, Homo sapiens
agcagctgatggggaaggagtt

SEQ ID NO: 7125179 - DNA, 22 bp, Homo sapiens
agcagctgcagagggctccccc

SEQ ID NO: 7125180 - DNA, 22 bp, Homo sapiens
agcagctgcagagggctccccc

SEQ ID NO: 7125181 - DNA, 22 bp, Homo sapiens
agcagctgcagagggctccccc

SEQ ID NO: 7125182 - DNA, 22 bp, Homo sapiens
agcagctgcagggagggtctgc

SEQ ID NO: 7125183 - DNA, 22 bp, Homo sapiens
agcagctgcagggagggtctgc

SEQ ID NO: 7125184 - DNA, 22 bp, Homo sapiens
agcagctgcagggagggtctgc

SEQ ID NO: 7125185 - DNA, 21 bp, Homo sapiens
agcagctgcagtttctatctg

SEQ ID NO: 7125186 - DNA, 22 bp, Homo sapiens
cacacacagttttgtattctgt

SEQ ID NO: 7125187 - DNA, 22 bp, Homo sapiens
cacacacagttttgtattctgt

SEQ ID NO: 7125188 - DNA, 22 bp, Homo sapiens
cacacacagttttgtattctgt

SEQ ID NO: 7125189 - DNA, 22 bp, Homo sapiens
agcagctgctccacttgcttaa

SEQ ID NO: 7125190 - DNA, 22 bp, Homo sapiens
agcagctgctccacttgcttaa

SEQ ID NO: 7125191 - DNA, 22 bp, Homo sapiens
cacaattttcctttaagtgtat

SEQ ID NO: 7125192 - DNA, 22 bp, Homo sapiens
cacaattttcctttaagtgtat

SEQ ID NO: 7125193 - DNA, 22 bp, Homo sapiens
cacaattttcctttaagtgtat

SEQ ID NO: 7125194 - DNA, 22 bp, Homo sapiens
cacaatttttcttaggtcctgg

SEQ ID NO: 7125195 - DNA, 22 bp, Homo sapiens
cacacaaatattctggaggcaa

SEQ ID NO: 7125196 - DNA, 21 bp, Homo sapiens
agcagctgcagtttctatctg

SEQ ID NO: 7125197 - DNA, 21 bp, Homo sapiens
agcagctgcagtttctatctg

SEQ ID NO: 7125198 - DNA, 22 bp, Homo sapiens
agcagctgccactggaatagga

SEQ ID NO: 7125199 - DNA, 22 bp, Homo sapiens
agcagctgccactggaatagga

SEQ ID NO: 7125200 - DNA, 22 bp, Homo sapiens
agcagctgccactggaatagga

SEQ ID NO: 7125201 - DNA, 22 bp, Homo sapiens
agcagctgccactggaatagga

SEQ ID NO: 7125202 - DNA, 22 bp, Homo sapiens
agcagctgccagagagagttcc

SEQ ID NO: 7125203 - DNA, 22 bp, Homo sapiens
agcagctgccagagagagttcc

SEQ ID NO: 7125204 - DNA, 22 bp, Homo sapiens
agcagctgccagagagagttcc

SEQ ID NO: 7125205 - DNA, 22 bp, Homo sapiens
agcagctgccagagagagttcc

SEQ ID NO: 7125206 - DNA, 22 bp, Homo sapiens
cacacagaaccgctcgccactt

SEQ ID NO: 7125207 - DNA, 22 bp, Homo sapiens
cacacactgttaatgtaggagt

SEQ ID NO: 7125208 - DNA, 22 bp, Homo sapiens
agcaggagcatttccatgattc

SEQ ID NO: 7125209 - DNA, 22 bp, Homo sapiens
agcaggagcccttatcaccagg

SEQ ID NO: 7125210 - DNA, 22 bp, Homo sapiens
agcaggagtgtcccctggctgt

SEQ ID NO: 7125211 - DNA, 22 bp, Homo sapiens
cacacactggagcaaggagatg

SEQ ID NO: 7125212 - DNA, 22 bp, Homo sapiens
cacacactcttcctggcaccta

SEQ ID NO: 7125213 - DNA, 22 bp, Homo sapiens
cacacactcttcctggcaccta

SEQ ID NO: 7125214 - DNA, 22 bp, Homo sapiens
cacacacagttttgtattctgt

SEQ ID NO: 7125215 - DNA, 23 bp, Homo sapiens
agcaggataattttattatgccc

SEQ ID NO: 7125216 - DNA, 22 bp, Homo sapiens
agcaggattttgaagtgcaagt

SEQ ID NO: 7125217 - DNA, 22 bp, Homo sapiens
agcaggattttgaagtgcaagt

SEQ ID NO: 7125218 - DNA, 21 bp, Homo sapiens
agcaggcaaaggtgaagtctt

SEQ ID NO: 7125219 - DNA, 21 bp, Homo sapiens
agcaggcaaaggtgaagtctt

SEQ ID NO: 7125220 - DNA, 21 bp, Homo sapiens
agcaggcaaaggtgaagtctt

SEQ ID NO: 7125221 - DNA, 21 bp, Homo sapiens
agcaggcaaaggtgaagtctt

SEQ ID NO: 7125222 - DNA, 22 bp, Homo sapiens
agcaggcaaggtccgtgcctcg

SEQ ID NO: 7125223 - DNA, 22 bp, Homo sapiens
agcaggcaagcgtgagttctct

SEQ ID NO: 7125224 - DNA, 22 bp, Homo sapiens
agcaggcaaggtccgtgcctcg

SEQ ID NO: 7125225 - DNA, 22 bp, Homo sapiens
agcaggcaagcgtgagttctct

SEQ ID NO: 7125226 - DNA, 22 bp, Homo sapiens
agcaggcaagcgtgagttctct

SEQ ID NO: 7125227 - DNA, 21 bp, Homo sapiens
agcaggcaaaggtgaagtctt

SEQ ID NO: 7125228 - DNA, 22 bp, Homo sapiens
agcaggcaagcgtgagttctct

SEQ ID NO: 7125229 - DNA, 21 bp, Homo sapiens
agcaggcaaaggtgaagtctt

SEQ ID NO: 7125230 - DNA, 17 bp, Homo sapiens
agcaggcacgtcagcac

SEQ ID NO: 7125231 - DNA, 17 bp, Homo sapiens
agcaggcacgtcagcac

SEQ ID NO: 7125232 - DNA, 22 bp, Homo sapiens
agcaggcacgctccctgcgcga

SEQ ID NO: 7125233 - DNA, 17 bp, Homo sapiens
agcaggcacgtcagcac

SEQ ID NO: 7125234 - DNA, 22 bp, Homo sapiens
agcaggcacgctccctgcgcga

SEQ ID NO: 7125235 - DNA, 22 bp, Homo sapiens
agcaggcacgctccctgcgcga

SEQ ID NO: 7125236 - DNA, 22 bp, Homo sapiens
agcaggcacgctccctgcgcga

SEQ ID NO: 7125237 - DNA, 22 bp, Homo sapiens
agcaggcacgctccctgcgcga

SEQ ID NO: 7125238 - DNA, 22 bp, Homo sapiens
agcaggcaaggtccgtgcctcg

SEQ ID NO: 7125239 - DNA, 22 bp, Homo sapiens
agcaggcacaagaaagggaggt

SEQ ID NO: 7125240 - DNA, 22 bp, Homo sapiens
agcaggcaccagggctcgtcct

SEQ ID NO: 7125241 - DNA, 22 bp, Homo sapiens
agcaggcaccagggctcgtcct

SEQ ID NO: 7125242 - DNA, 22 bp, Homo sapiens
agcaggcaccagggctcgtcct

SEQ ID NO: 7125243 - DNA, 22 bp, Homo sapiens
agcaggcaggaatggtggaaca

SEQ ID NO: 7125244 - DNA, 22 bp, Homo sapiens
agcaggcaggaggctactaagg

SEQ ID NO: 7125245 - DNA, 22 bp, Homo sapiens
agcaggcaggaggctactaagg

SEQ ID NO: 7125246 - DNA, 22 bp, Homo sapiens
agcaggcaggaggctactaagg

SEQ ID NO: 7125247 - DNA, 22 bp, Homo sapiens
cacagtcccgtgcttaccatgt

SEQ ID NO: 7125248 - DNA, 22 bp, Homo sapiens
agcaggcaggaaggcagcactg

SEQ ID NO: 7125249 - DNA, 22 bp, Homo sapiens
agcaggcaggaaggcagcactg

SEQ ID NO: 7125250 - DNA, 22 bp, Homo sapiens
agcaggcaggaatggtggaaca

SEQ ID NO: 7125251 - DNA, 22 bp, Homo sapiens
agcaggcaggaatggtggaaca

SEQ ID NO: 7125252 - DNA, 19 bp, Homo sapiens
cacagtcctatgtttatca

SEQ ID NO: 7125253 - DNA, 22 bp, Homo sapiens
cacagtcctgccagagggcctt

SEQ ID NO: 7125254 - DNA, 22 bp, Homo sapiens
cacagtcctgccagagggcctt

SEQ ID NO: 7125255 - DNA, 22 bp, Homo sapiens
cacagttagctccagtcttagc

SEQ ID NO: 7125256 - DNA, 22 bp, Homo sapiens
cacagttatatgttcacaagga

SEQ ID NO: 7125257 - DNA, 22 bp, Homo sapiens
cacagttatatgttcacaagga

SEQ ID NO: 7125258 - DNA, 22 bp, Homo sapiens
agcaggcagcatgggaccctcc

SEQ ID NO: 7125259 - DNA, 22 bp, Homo sapiens
agcaggcagccatttggaaggc

SEQ ID NO: 7125260 - DNA, 22 bp, Homo sapiens
agcaggcagcatgggaccctcc

SEQ ID NO: 7125261 - DNA, 22 bp, Homo sapiens
agcaggcagcatgggaccctcc

SEQ ID NO: 7125262 - DNA, 22 bp, Homo sapiens
agcaggcacttcatagggttcc

SEQ ID NO: 7125263 - DNA, 22 bp, Homo sapiens
agcaggcacttcatagggttcc

SEQ ID NO: 7125264 - DNA, 22 bp, Homo sapiens
agcaggcagcatgggaccctcc

SEQ ID NO: 7125265 - DNA, 17 bp, Homo sapiens
agcaggcacgtcagcac

SEQ ID NO: 7125266 - DNA, 22 bp, Homo sapiens
agcaggcactatgccaggatct

SEQ ID NO: 7125267 - DNA, 22 bp, Homo sapiens
agcaggcactatgccaggatct

SEQ ID NO: 7125268 - DNA, 22 bp, Homo sapiens
agcaggcactatgccaggatct

SEQ ID NO: 7125269 - DNA, 22 bp, Homo sapiens
agcaggcactatgccaggatct

SEQ ID NO: 7125270 - DNA, 22 bp, Homo sapiens
agcaggcacttcatagggttcc

SEQ ID NO: 7125271 - DNA, 22 bp, Homo sapiens
agcaggcagctgggggagttga

SEQ ID NO: 7125272 - DNA, 22 bp, Homo sapiens
agcaggcagctgggggagttga

SEQ ID NO: 7125273 - DNA, 22 bp, Homo sapiens
agcaggcaggaaggcagcactg

SEQ ID NO: 7125274 - DNA, 22 bp, Homo sapiens
agcaggcaggaaggcagcactg

SEQ ID NO: 7125275 - DNA, 22 bp, Homo sapiens
agcaggcaggaaggcagcactg

SEQ ID NO: 7125276 - DNA, 22 bp, Homo sapiens
agcaggcagcctaggaagtgaa

SEQ ID NO: 7125277 - DNA, 22 bp, Homo sapiens
agcaggcagctgggggagttga

SEQ ID NO: 7125278 - DNA, 22 bp, Homo sapiens
agcaggcagctgggggagttga

SEQ ID NO: 7125279 - DNA, 22 bp, Homo sapiens
agcaggcagcctaggaagtgaa

SEQ ID NO: 7125280 - DNA, 22 bp, Homo sapiens
agcaggcagcctaggaagtgaa

SEQ ID NO: 7125281 - DNA, 22 bp, Homo sapiens
agcaggcagcctaggaagtgaa

SEQ ID NO: 7125282 - DNA, 22 bp, Homo sapiens
cacagttcctgaatatatcaca

SEQ ID NO: 7125283 - DNA, 22 bp, Homo sapiens
cacagttgtttgttcataagaa

SEQ ID NO: 7125284 - DNA, 22 bp, Homo sapiens
cacagtttatgatctcagtgaa

SEQ ID NO: 7125285 - DNA, 22 bp, Homo sapiens
cacagtttcaataattattctt

SEQ ID NO: 7125286 - DNA, 22 bp, Homo sapiens
cacagtttctataggtcagaat

SEQ ID NO: 7125287 - DNA, 22 bp, Homo sapiens
cacagtttcaataattattctt

SEQ ID NO: 7125288 - DNA, 22 bp, Homo sapiens
cacagtttcaataattattctt

SEQ ID NO: 7125289 - DNA, 22 bp, Homo sapiens
cacagtttctataggtcagaat

SEQ ID NO: 7125290 - DNA, 22 bp, Homo sapiens
cacagtttctgaacactttgca

SEQ ID NO: 7125291 - DNA, 22 bp, Homo sapiens
cacagtttgcataggaaaaaca

SEQ ID NO: 7125292 - DNA, 22 bp, Homo sapiens
cacagtttgggtctccggggca

SEQ ID NO: 7125293 - DNA, 22 bp, Homo sapiens
cacagtttggtatagaagtgat

SEQ ID NO: 7125294 - DNA, 22 bp, Homo sapiens
cacagtttggttttgctgtaat

SEQ ID NO: 7125295 - DNA, 22 bp, Homo sapiens
cacagtttggttttgctgtaat

SEQ ID NO: 7125296 - DNA, 22 bp, Homo sapiens
agcaggctccaggctggccatc

SEQ ID NO: 7125297 - DNA, 22 bp, Homo sapiens
agcaggctccaggctggccatc

SEQ ID NO: 7125298 - DNA, 22 bp, Homo sapiens
agcaggctccaggctggccatc

SEQ ID NO: 7125299 - DNA, 22 bp, Homo sapiens
agcaggctccaggctggccatc

SEQ ID NO: 7125300 - DNA, 22 bp, Homo sapiens
agcaggctccttccttctctgg

SEQ ID NO: 7125301 - DNA, 22 bp, Homo sapiens
agcaggctccttccttctctgg

SEQ ID NO: 7125302 - DNA, 22 bp, Homo sapiens
agcaggctccttccttctctgg

SEQ ID NO: 7125303 - DNA, 22 bp, Homo sapiens
agcaggctgagcacccaggggg

SEQ ID NO: 7125304 - DNA, 22 bp, Homo sapiens
agcaggctgagcacccaggggg

SEQ ID NO: 7125305 - DNA, 22 bp, Homo sapiens
agcaggctgagcacccaggggg

SEQ ID NO: 7125306 - DNA, 22 bp, Homo sapiens
agcaggctgatgggcatgcttg

SEQ ID NO: 7125307 - DNA, 22 bp, Homo sapiens
agcaggctgatgggcatgcttg

SEQ ID NO: 7125308 - DNA, 22 bp, Homo sapiens
agcaggctgatgggcatgcttg

SEQ ID NO: 7125309 - DNA, 22 bp, Homo sapiens
agcaggctgatgggcatgcttg

SEQ ID NO: 7125310 - DNA, 22 bp, Homo sapiens
agcaggctgatgggcatgcttg

SEQ ID NO: 7125311 - DNA, 17 bp, Homo sapiens
agcaggctgcagaggcc

SEQ ID NO: 7125312 - DNA, 17 bp, Homo sapiens
agcaggctgcagaggcc

SEQ ID NO: 7125313 - DNA, 17 bp, Homo sapiens
agcaggctgcagaggcc

SEQ ID NO: 7125314 - DNA, 17 bp, Homo sapiens
agcaggctgcagaggcc

SEQ ID NO: 7125315 - DNA, 17 bp, Homo sapiens
agcaggctgcagaggcc

SEQ ID NO: 7125316 - DNA, 20 bp, Homo sapiens
agcaggctgcagggtgaaat

SEQ ID NO: 7125317 - DNA, 20 bp, Homo sapiens
agcaggctgcagggtgaaat

SEQ ID NO: 7125318 - DNA, 22 bp, Homo sapiens
agcaggggtggaaggtagcttt

SEQ ID NO: 7125319 - DNA, 22 bp, Homo sapiens
agcaggggtctctgctaatgaa

SEQ ID NO: 7125320 - DNA, 22 bp, Homo sapiens
agcaggggtggaaggtagcttt

SEQ ID NO: 7125321 - DNA, 22 bp, Homo sapiens
agcaggggtggaaggtagcttt

SEQ ID NO: 7125322 - DNA, 22 bp, Homo sapiens
agcagggtatgttagagctgta

SEQ ID NO: 7125323 - DNA, 22 bp, Homo sapiens
agcagggtttggggattggcac

SEQ ID NO: 7125324 - DNA, 22 bp, Homo sapiens
agcagggttctcagttggtgct

SEQ ID NO: 7125325 - DNA, 22 bp, Homo sapiens
agcagggttccttaaggccata

SEQ ID NO: 7125326 - DNA, 22 bp, Homo sapiens
agcagggttccttaaggccata

SEQ ID NO: 7125327 - DNA, 22 bp, Homo sapiens
agcagggttccttaaggccata

SEQ ID NO: 7125328 - DNA, 22 bp, Homo sapiens
agcagggtcctgaggtgagtca

SEQ ID NO: 7125329 - DNA, 22 bp, Homo sapiens
agcagggtgtggtggccctgga

SEQ ID NO: 7125330 - DNA, 22 bp, Homo sapiens
agcagggtgtggtggccctgga

SEQ ID NO: 7125331 - DNA, 22 bp, Homo sapiens
agcagggtcctgaggtgagtca

SEQ ID NO: 7125332 - DNA, 22 bp, Homo sapiens
agcagggtatgttagagctgta

SEQ ID NO: 7125333 - DNA, 22 bp, Homo sapiens
cacccaggctggagtgcagtga

SEQ ID NO: 7125334 - DNA, 22 bp, Homo sapiens
cacccaggctggagtgcagtga

SEQ ID NO: 7125335 - DNA, 22 bp, Homo sapiens
cacccaggctggagtgcagggg

SEQ ID NO: 7125336 - DNA, 22 bp, Homo sapiens
cacccaggctggagagcagtgg

SEQ ID NO: 7125337 - DNA, 22 bp, Homo sapiens
cacccaggctggagagcagtgg

SEQ ID NO: 7125338 - DNA, 22 bp, Homo sapiens
cacccaggctggagagcagtgg

SEQ ID NO: 7125339 - DNA, 22 bp, Homo sapiens
cacccaggctggagagcagtgg

SEQ ID NO: 7125340 - DNA, 22 bp, Homo sapiens
caccaggttccgggcagagctg

SEQ ID NO: 7125341 - DNA, 20 bp, Homo sapiens
agcaggtaaggcacagcagt

SEQ ID NO: 7125342 - DNA, 22 bp, Homo sapiens
caccaggtggaaatgtcacagc

SEQ ID NO: 7125343 - DNA, 22 bp, Homo sapiens
agcagggggccacagtcacagc

SEQ ID NO: 7125344 - DNA, 22 bp, Homo sapiens
agcagggggccacagtcacagc

SEQ ID NO: 7125345 - DNA, 22 bp, Homo sapiens
agcagggggccacagtcacagc

SEQ ID NO: 7125346 - DNA, 22 bp, Homo sapiens
agcagggggccacagtcacagc

SEQ ID NO: 7125347 - DNA, 22 bp, Homo sapiens
agcagggggccacagtcacagc

SEQ ID NO: 7125348 - DNA, 22 bp, Homo sapiens
agcaggggtaacagaaggaaag

SEQ ID NO: 7125349 - DNA, 22 bp, Homo sapiens
agcaggggtaacagaaggaaag

SEQ ID NO: 7125350 - DNA, 22 bp, Homo sapiens
agcaggggtaacagaaggaaag

SEQ ID NO: 7125351 - DNA, 22 bp, Homo sapiens
agcaggggtctctgctaatgaa

SEQ ID NO: 7125352 - DNA, 22 bp, Homo sapiens
agcaggggtaacagaaggaaag

SEQ ID NO: 7125353 - DNA, 22 bp, Homo sapiens
agcaggggtaacagaaggaaag

SEQ ID NO: 7125354 - DNA, 22 bp, Homo sapiens
agcagggggagttagactagat

SEQ ID NO: 7125355 - DNA, 22 bp, Homo sapiens
agcaggggctcctccacagcca

SEQ ID NO: 7125356 - DNA, 22 bp, Homo sapiens
agcagggggagttagactagat

SEQ ID NO: 7125357 - DNA, 22 bp, Homo sapiens
agcagggggagttagactagat

SEQ ID NO: 7125358 - DNA, 22 bp, Homo sapiens
agcagggggcatccttgccctt

SEQ ID NO: 7125359 - DNA, 22 bp, Homo sapiens
agcagggggcatccttgccctt

SEQ ID NO: 7125360 - DNA, 22 bp, Homo sapiens
agcagggggcatccttgccctt

SEQ ID NO: 7125361 - DNA, 22 bp, Homo sapiens
agcagggggcatccttgccctt

SEQ ID NO: 7125362 - DNA, 23 bp, Homo sapiens
agcaggctgcttctccacagctg

SEQ ID NO: 7125363 - DNA, 22 bp, Homo sapiens
agcagggctggggcacgagcca

SEQ ID NO: 7125364 - DNA, 22 bp, Homo sapiens
agcagggctgtgctccttccga

SEQ ID NO: 7125365 - DNA, 23 bp, Homo sapiens
agcaggctgcttctccacagctg

SEQ ID NO: 7125366 - DNA, 23 bp, Homo sapiens
agcaggctgcttctccacagctg

SEQ ID NO: 7125367 - DNA, 23 bp, Homo sapiens
agcaggctgcttctccacagctg

SEQ ID NO: 7125368 - DNA, 22 bp, Homo sapiens
agcaggggctcctccacagcca

SEQ ID NO: 7125369 - DNA, 22 bp, Homo sapiens
agcaggggctcctccacagcca

SEQ ID NO: 7125370 - DNA, 22 bp, Homo sapiens
agcaggggctcctccacagcca

SEQ ID NO: 7125371 - DNA, 22 bp, Homo sapiens
agcaggggctcctccacagcca

SEQ ID NO: 7125372 - DNA, 22 bp, Homo sapiens
agcaggggctcctccacagcca

SEQ ID NO: 7125373 - DNA, 22 bp, Homo sapiens
agcaggggcagggttttgtgct

SEQ ID NO: 7125374 - DNA, 22 bp, Homo sapiens
agcaggggcagggttttgtgct

SEQ ID NO: 7125375 - DNA, 22 bp, Homo sapiens
agcaggggcagggttttgtgct

SEQ ID NO: 7125376 - DNA, 22 bp, Homo sapiens
agcagggctttgtctctgtgaa

SEQ ID NO: 7125377 - DNA, 20 bp, Homo sapiens
agcatacatcataagaaacc

SEQ ID NO: 7125378 - DNA, 22 bp, Homo sapiens
agcatacattggtatgtggttt

SEQ ID NO: 7125379 - DNA, 22 bp, Homo sapiens
agcatagaaaagattcccagag

SEQ ID NO: 7125380 - DNA, 22 bp, Homo sapiens
agcatagaataagctgaagtca

SEQ ID NO: 7125381 - DNA, 19 bp, Homo sapiens
agcatagacttctcaggaa

SEQ ID NO: 7125382 - DNA, 20 bp, Homo sapiens
agcatagagcaccagaaggc

SEQ ID NO: 7125383 - DNA, 22 bp, Homo sapiens
agcatagagcaggaagttaaga

SEQ ID NO: 7125384 - DNA, 22 bp, Homo sapiens
agcatacaggtctgaaacagct

SEQ ID NO: 7125385 - DNA, 22 bp, Homo sapiens
agcatacagtaggtgctcagtt

SEQ ID NO: 7125386 - DNA, 22 bp, Homo sapiens
agcatacagttgaaagtggctt

SEQ ID NO: 7125387 - DNA, 20 bp, Homo sapiens
agcatacatcataagaaacc

SEQ ID NO: 7125388 - DNA, 22 bp, Homo sapiens
cactgcttgattgacatgcacg

SEQ ID NO: 7125389 - DNA, 22 bp, Homo sapiens
cactgcttctggaggaatttgg

SEQ ID NO: 7125390 - DNA, 22 bp, Homo sapiens
cactgcttgattgacatgcacg

SEQ ID NO: 7125391 - DNA, 22 bp, Homo sapiens
cactgcttgcagtatgagtgga

SEQ ID NO: 7125392 - DNA, 22 bp, Homo sapiens
cactgcttggccctgagggcag

SEQ ID NO: 7125393 - DNA, 22 bp, Homo sapiens
cactgcttggttgcaacattgc

SEQ ID NO: 7125394 - DNA, 22 bp, Homo sapiens
cactgcttggttgcaacattgc

SEQ ID NO: 7125395 - DNA, 22 bp, Homo sapiens
cactgctttaaggctgagtaac

SEQ ID NO: 7125396 - DNA, 22 bp, Homo sapiens
cactgctttaaggctgagtaac

SEQ ID NO: 7125397 - DNA, 22 bp, Homo sapiens
cactgctttaaggctgagtaac

SEQ ID NO: 7125398 - DNA, 22 bp, Homo sapiens
cactgctttaaggctgagtaac

SEQ ID NO: 7125399 - DNA, 22 bp, Homo sapiens
agcatacaccctaaactgctta

SEQ ID NO: 7125400 - DNA, 22 bp, Homo sapiens
agcatacaccctaaactgctta

SEQ ID NO: 7125401 - DNA, 22 bp, Homo sapiens
agcatacaccctaaactgctta

SEQ ID NO: 7125402 - DNA, 22 bp, Homo sapiens
agcatacaggtctgaaacagct

SEQ ID NO: 7125403 - DNA, 22 bp, Homo sapiens
cactgcttagttggtaaatgtg

SEQ ID NO: 7125404 - DNA, 22 bp, Homo sapiens
cactgcttagttggtaaatgtg

SEQ ID NO: 7125405 - DNA, 22 bp, Homo sapiens
cactgcttagatcttccttcaa

SEQ ID NO: 7125406 - DNA, 22 bp, Homo sapiens
cactgcttataaattctaggca

SEQ ID NO: 7125407 - DNA, 22 bp, Homo sapiens
cactgcttataaattctaggca

SEQ ID NO: 7125408 - DNA, 22 bp, Homo sapiens
cactgcttatgtctccttttca

SEQ ID NO: 7125409 - DNA, 22 bp, Homo sapiens
cactgcttcagtcagagaaatt

SEQ ID NO: 7125410 - DNA, 22 bp, Homo sapiens
cactgcttccattgttcacctg

SEQ ID NO: 7125411 - DNA, 22 bp, Homo sapiens
cactgcttctggaggaatttgg

SEQ ID NO: 7125412 - DNA, 22 bp, Homo sapiens
cactgctcgctgcagcatggcc

SEQ ID NO: 7125413 - DNA, 22 bp, Homo sapiens
cactgctcgctgcagcatggcc

SEQ ID NO: 7125414 - DNA, 22 bp, Homo sapiens
cactgctgtttttaccacactg

SEQ ID NO: 7125415 - DNA, 22 bp, Homo sapiens
cactgcttagatcttccttcaa

SEQ ID NO: 7125416 - DNA, 22 bp, Homo sapiens
cactgctagtctgaagtactgg

SEQ ID NO: 7125417 - DNA, 22 bp, Homo sapiens
cactgctatgatgatgatattt

SEQ ID NO: 7125418 - DNA, 22 bp, Homo sapiens
cactgctagtctgaagtactgg

SEQ ID NO: 7125419 - DNA, 22 bp, Homo sapiens
cactgctattattagacaatgt

SEQ ID NO: 7125420 - DNA, 22 bp, Homo sapiens
cactgctattattagacaatgt

SEQ ID NO: 7125421 - DNA, 23 bp, Homo sapiens
cactgccttcagttgcttcacct

SEQ ID NO: 7125422 - DNA, 22 bp, Homo sapiens
cactgcagatcagaggctgaga

SEQ ID NO: 7125423 - DNA, 22 bp, Homo sapiens
cactgcacttcagcctgggtga

SEQ ID NO: 7125424 - DNA, 22 bp, Homo sapiens
cactgcacttcagcctgggtga

SEQ ID NO: 7125425 - DNA, 22 bp, Homo sapiens
cactgcctgtgagctgtgtgcc

SEQ ID NO: 7125426 - DNA, 22 bp, Homo sapiens
cacctgagcaaccctgtgcggg

SEQ ID NO: 7125427 - DNA, 22 bp, Homo sapiens
cacctgagcactggggccgccc

SEQ ID NO: 7125428 - DNA, 22 bp, Homo sapiens
cactgcacttcagcctgggtga

SEQ ID NO: 7125429 - DNA, 20 bp, Homo sapiens
cacctctgaaagtttccagc

SEQ ID NO: 7125430 - DNA, 22 bp, Homo sapiens
cacctctgcctcaagcttccca

SEQ ID NO: 7125431 - DNA, 22 bp, Homo sapiens
cacctctgcctcaagcttccca

SEQ ID NO: 7125432 - DNA, 22 bp, Homo sapiens
cacctctttgatttgaggcaag

SEQ ID NO: 7125433 - DNA, 22 bp, Homo sapiens
cacctctttgatttgaggcaag

SEQ ID NO: 7125434 - DNA, 22 bp, Homo sapiens
cacctctcagctaggagtaagt

SEQ ID NO: 7125435 - DNA, 22 bp, Homo sapiens
cacctctcatttctacagattc

SEQ ID NO: 7125436 - DNA, 22 bp, Homo sapiens
cacctagggcatccctgcccca

SEQ ID NO: 7125437 - DNA, 22 bp, Homo sapiens
cacctagcattcctcttcctca

SEQ ID NO: 7125438 - DNA, 22 bp, Homo sapiens
cacctagcatgaaattcagcag

SEQ ID NO: 7125439 - DNA, 22 bp, Homo sapiens
cacctagcagaacagaggtgct

SEQ ID NO: 7125440 - DNA, 22 bp, Homo sapiens
cacctagcagagcactactgca

SEQ ID NO: 7125441 - DNA, 22 bp, Homo sapiens
cacctagcagagcactactgca

SEQ ID NO: 7125442 - DNA, 22 bp, Homo sapiens
cacctagggtttcgcctttctt

SEQ ID NO: 7125443 - DNA, 22 bp, Homo sapiens
cacccttcagctttcttagctc

SEQ ID NO: 7125444 - DNA, 22 bp, Homo sapiens
caccgcggagtgatggagaaac

SEQ ID NO: 7125445 - DNA, 22 bp, Homo sapiens
caccgtggaggagctggagggc

SEQ ID NO: 7125446 - DNA, 22 bp, Homo sapiens
caccgtggaggagctggagggc

SEQ ID NO: 7125447 - DNA, 22 bp, Homo sapiens
caccgcggagtgatggagaaac

SEQ ID NO: 7125448 - DNA, 22 bp, Homo sapiens
cacccaggctggagtgcagtgg

SEQ ID NO: 7125449 - DNA, 22 bp, Homo sapiens
cacccaggctggagtgcagtgg

SEQ ID NO: 7125450 - DNA, 22 bp, Homo sapiens
cacccaggctggagtgcattgg

SEQ ID NO: 7125451 - DNA, 22 bp, Homo sapiens
cacccaggctggattgcagtgg

SEQ ID NO: 7125452 - DNA, 22 bp, Homo sapiens
cacccaggctggattgcagtgg

SEQ ID NO: 7125453 - DNA, 22 bp, Homo sapiens
cacccagggctgtgcctgccca

SEQ ID NO: 7125454 - DNA, 22 bp, Homo sapiens
cacccagggctgtgcctgccca

SEQ ID NO: 7125455 - DNA, 22 bp, Homo sapiens
caccctgtcagttgcaggatag

SEQ ID NO: 7125456 - DNA, 22 bp, Homo sapiens
attattattttagagagaggcc

SEQ ID NO: 7125457 - DNA, 21 bp, Homo sapiens
attattatttctgtgtccagc

SEQ ID NO: 7125458 - DNA, 21 bp, Homo sapiens
attattatttctgtgtccagc

SEQ ID NO: 7125459 - DNA, 21 bp, Homo sapiens
attattatttctgtgtccagc

SEQ ID NO: 7125460 - DNA, 22 bp, Homo sapiens
attattattgttgatgttaggg

SEQ ID NO: 7125461 - DNA, 22 bp, Homo sapiens
attattattgttgatgttaggg

SEQ ID NO: 7125462 - DNA, 22 bp, Homo sapiens
attattatggttgctcttttcc

SEQ ID NO: 7125463 - DNA, 22 bp, Homo sapiens
attattattgttgatgttaggg

SEQ ID NO: 7125464 - DNA, 22 bp, Homo sapiens
attattatggttgctcttttcc

SEQ ID NO: 7125465 - DNA, 22 bp, Homo sapiens
attattattgttgatgttaggg

SEQ ID NO: 7125466 - DNA, 22 bp, Homo sapiens
attattcaaattcccactatac

SEQ ID NO: 7125467 - DNA, 22 bp, Homo sapiens
attattcaaattcccactatac

SEQ ID NO: 7125468 - DNA, 22 bp, Homo sapiens
attattcaacacttgagaaatt

SEQ ID NO: 7125469 - DNA, 22 bp, Homo sapiens
agaggcagaagtgttcaaaccc

SEQ ID NO: 7125470 - DNA, 22 bp, Homo sapiens
agaggcagaagtgttcaaaccc

SEQ ID NO: 7125471 - DNA, 23 bp, Homo sapiens
attattaaggacatggactttgt

SEQ ID NO: 7125472 - DNA, 23 bp, Homo sapiens
attattaaggacatggactttgt

SEQ ID NO: 7125473 - DNA, 22 bp, Homo sapiens
attattagacttatatggtagt

SEQ ID NO: 7125474 - DNA, 22 bp, Homo sapiens
attattagacttatatggtagt

SEQ ID NO: 7125475 - DNA, 21 bp, Homo sapiens
attattataaagaccacaggg

SEQ ID NO: 7125476 - DNA, 22 bp, Homo sapiens
attattataaagtgcatgacct

SEQ ID NO: 7125477 - DNA, 22 bp, Homo sapiens
attattatatagggaaagtccc

SEQ ID NO: 7125478 - DNA, 22 bp, Homo sapiens
attattatatagggaaagtccc

SEQ ID NO: 7125479 - DNA, 22 bp, Homo sapiens
attattagattcttaattgtaa

SEQ ID NO: 7125480 - DNA, 22 bp, Homo sapiens
attattagattcttaattgtaa

SEQ ID NO: 7125481 - DNA, 22 bp, Homo sapiens
attattaggactactggggttg

SEQ ID NO: 7125482 - DNA, 22 bp, Homo sapiens
attattaggtgctctctgacaa

SEQ ID NO: 7125483 - DNA, 22 bp, Homo sapiens
attattaggtgctctctgacaa

SEQ ID NO: 7125484 - DNA, 22 bp, Homo sapiens
attattagtgatgttgttactg

SEQ ID NO: 7125485 - DNA, 22 bp, Homo sapiens
attattagtgatgttgttactg

SEQ ID NO: 7125486 - DNA, 22 bp, Homo sapiens
agaggaggccaggcccacacct

SEQ ID NO: 7125487 - DNA, 22 bp, Homo sapiens
agaggaggccaggcccacacct

SEQ ID NO: 7125488 - DNA, 22 bp, Homo sapiens
agaggaggcagcttaactcagt

SEQ ID NO: 7125489 - DNA, 22 bp, Homo sapiens
agaggaggatttgtaaaggtct

SEQ ID NO: 7125490 - DNA, 22 bp, Homo sapiens
agaggaggatttgtaaaggtct

SEQ ID NO: 7125491 - DNA, 22 bp, Homo sapiens
agaggaggcagcttaactcagt

SEQ ID NO: 7125492 - DNA, 22 bp, Homo sapiens
agaggaggcagcttaactcagt

SEQ ID NO: 7125493 - DNA, 22 bp, Homo sapiens
agaggaggcagcttaactcagt

SEQ ID NO: 7125494 - DNA, 22 bp, Homo sapiens
agaggaggcagcttaactcagt

SEQ ID NO: 7125495 - DNA, 22 bp, Homo sapiens
agaggaggctgggtccagataa

SEQ ID NO: 7125496 - DNA, 22 bp, Homo sapiens
attataggcttgagccaccgtg

SEQ ID NO: 7125497 - DNA, 22 bp, Homo sapiens
attataggcttgagccaccgtg

SEQ ID NO: 7125498 - DNA, 22 bp, Homo sapiens
agaggaggctctgggatcgtcc

SEQ ID NO: 7125499 - DNA, 22 bp, Homo sapiens
agaggaggctgggtccagataa

SEQ ID NO: 7125500 - DNA, 22 bp, Homo sapiens
agaggaggctgggtccagataa

SEQ ID NO: 7125501 - DNA, 22 bp, Homo sapiens
agaggaggctctgggatcgtcc

SEQ ID NO: 7125502 - DNA, 22 bp, Homo sapiens
agaggaggccaggcccacacct

SEQ ID NO: 7125503 - DNA, 22 bp, Homo sapiens
agaggaggctctgggatcgtcc

SEQ ID NO: 7125504 - DNA, 22 bp, Homo sapiens
agaggaggctctgggatcgtcc

SEQ ID NO: 7125505 - DNA, 22 bp, Homo sapiens
agaggaggctctgggatcgtcc

SEQ ID NO: 7125506 - DNA, 22 bp, Homo sapiens
agaggaggatttgtaaaggtct

SEQ ID NO: 7125507 - DNA, 20 bp, Homo sapiens
agaggaggattattttattc

SEQ ID NO: 7125508 - DNA, 20 bp, Homo sapiens
agaggaggattattttattc

SEQ ID NO: 7125509 - DNA, 22 bp, Homo sapiens
agaggaggatttgtaaaggtct

SEQ ID NO: 7125510 - DNA, 22 bp, Homo sapiens
agaggaggatttgtaaaggtct

SEQ ID NO: 7125511 - DNA, 22 bp, Homo sapiens
agaggaggatttgtaaaggtct

SEQ ID NO: 7125512 - DNA, 22 bp, Homo sapiens
agaggaggatttgtaaaggtct

SEQ ID NO: 7125513 - DNA, 22 bp, Homo sapiens
agaggaggatttgtaaaggtct

SEQ ID NO: 7125514 - DNA, 22 bp, Homo sapiens
agaggaggaagagctttaaaat

SEQ ID NO: 7125515 - DNA, 20 bp, Homo sapiens
agaggaggattattttattc

SEQ ID NO: 7125516 - DNA, 22 bp, Homo sapiens
agaggaggaagagctttaaaat

SEQ ID NO: 7125517 - DNA, 22 bp, Homo sapiens
agaggaggaagagctttaaaat

SEQ ID NO: 7125518 - DNA, 22 bp, Homo sapiens
agaggaggaagagctttaaaat

SEQ ID NO: 7125519 - DNA, 22 bp, Homo sapiens
agaggagaatccgtttccttgc

SEQ ID NO: 7125520 - DNA, 22 bp, Homo sapiens
agaggacaggttttccatgggc

SEQ ID NO: 7125521 - DNA, 22 bp, Homo sapiens
agaggacaggttttccatgggc

SEQ ID NO: 7125522 - DNA, 22 bp, Homo sapiens
agaggagctgggaggccctcgt

SEQ ID NO: 7125523 - DNA, 22 bp, Homo sapiens
agaggaagctgagatgcctctt

SEQ ID NO: 7125524 - DNA, 22 bp, Homo sapiens
agaggacaaaatgagaagtgct

SEQ ID NO: 7125525 - DNA, 22 bp, Homo sapiens
atgtttatgttgggctatattt

SEQ ID NO: 7125526 - DNA, 22 bp, Homo sapiens
atgtttatggagcaggtattag

SEQ ID NO: 7125527 - DNA, 22 bp, Homo sapiens
atgtttatggagcaggtattag

SEQ ID NO: 7125528 - DNA, 22 bp, Homo sapiens
agaggacagcccccttgtctgg

SEQ ID NO: 7125529 - DNA, 22 bp, Homo sapiens
agaggacagcccccttgtctgg

SEQ ID NO: 7125530 - DNA, 22 bp, Homo sapiens
agaggacagagtgctggattta

SEQ ID NO: 7125531 - DNA, 22 bp, Homo sapiens
agaggacagacggaaagtgcca

SEQ ID NO: 7125532 - DNA, 22 bp, Homo sapiens
agaggacagacggaaagtgcca

SEQ ID NO: 7125533 - DNA, 22 bp, Homo sapiens
agaggacagacggaaagtgcca

SEQ ID NO: 7125534 - DNA, 22 bp, Homo sapiens
agaggacaaaatgagaagtgct

SEQ ID NO: 7125535 - DNA, 22 bp, Homo sapiens
atgtttacaattcagtattaca

SEQ ID NO: 7125536 - DNA, 22 bp, Homo sapiens
atgtttacaattcagtattaca

SEQ ID NO: 7125537 - DNA, 21 bp, Homo sapiens
atgtttacactgactactgtg

SEQ ID NO: 7125538 - DNA, 22 bp, Homo sapiens
atgtttagtcattcagctcctt

SEQ ID NO: 7125539 - DNA, 22 bp, Homo sapiens
atgtttactggtttatagaata

SEQ ID NO: 7125540 - DNA, 22 bp, Homo sapiens
atgtttatgcaaacatgtgagt

SEQ ID NO: 7125541 - DNA, 22 bp, Homo sapiens
agagctgtttattgatgtcaca

SEQ ID NO: 7125542 - DNA, 22 bp, Homo sapiens
agagctgtatccccttaccagt

SEQ ID NO: 7125543 - DNA, 22 bp, Homo sapiens
agagctgtatccccttaccagt

SEQ ID NO: 7125544 - DNA, 22 bp, Homo sapiens
agagctgtgaaaatgaggtttg

SEQ ID NO: 7125545 - DNA, 22 bp, Homo sapiens
agagctgtggatagtcctggat

SEQ ID NO: 7125546 - DNA, 22 bp, Homo sapiens
atgtgtagggaagtgaaatgta

SEQ ID NO: 7125547 - DNA, 22 bp, Homo sapiens
atgtgtatacttgtgcttactc

SEQ ID NO: 7125548 - DNA, 21 bp, Homo sapiens
agagctggtaggtaggtaggt

SEQ ID NO: 7125549 - DNA, 21 bp, Homo sapiens
agagctggtaggtaggtaggt

SEQ ID NO: 7125550 - DNA, 22 bp, Homo sapiens
agagctgggacttggactcaat

SEQ ID NO: 7125551 - DNA, 22 bp, Homo sapiens
agagctggtgcatattcagaaa

SEQ ID NO: 7125552 - DNA, 22 bp, Homo sapiens
agagctggtttactcaggaatt

SEQ ID NO: 7125553 - DNA, 22 bp, Homo sapiens
agagctggtttactcaggaatt

SEQ ID NO: 7125554 - DNA, 22 bp, Homo sapiens
agagggaatgtgattgcaccat

SEQ ID NO: 7125555 - DNA, 22 bp, Homo sapiens
agagggaatgtgattgcaccat

SEQ ID NO: 7125556 - DNA, 22 bp, Homo sapiens
agagggaatgtgattgcaccat

SEQ ID NO: 7125557 - DNA, 22 bp, Homo sapiens
agagggaatgtgattgcaccat

SEQ ID NO: 7125558 - DNA, 22 bp, Homo sapiens
agagggagaaaagaatcagttg

SEQ ID NO: 7125559 - DNA, 22 bp, Homo sapiens
agagggagaaaagaatcagttg

SEQ ID NO: 7125560 - DNA, 22 bp, Homo sapiens
agagggagaaaagaatcagttg

SEQ ID NO: 7125561 - DNA, 22 bp, Homo sapiens
agagggagaaaagaatcagttg

SEQ ID NO: 7125562 - DNA, 22 bp, Homo sapiens
agagggagaagctaaaataact

SEQ ID NO: 7125563 - DNA, 22 bp, Homo sapiens
agagggagaagctaaaataact

SEQ ID NO: 7125564 - DNA, 21 bp, Homo sapiens
agagggagagtggcccttcca

SEQ ID NO: 7125565 - DNA, 21 bp, Homo sapiens
agagggagagtggcccttcca

SEQ ID NO: 7125566 - DNA, 21 bp, Homo sapiens
agagggagagtggcccttcca

SEQ ID NO: 7125567 - DNA, 22 bp, Homo sapiens
attccagacaggtaaattaggt

SEQ ID NO: 7125568 - DNA, 22 bp, Homo sapiens
attccagagaggttctggaggt

SEQ ID NO: 7125569 - DNA, 22 bp, Homo sapiens
attccagagaggttctggaggt

SEQ ID NO: 7125570 - DNA, 22 bp, Homo sapiens
attccagatgaattgcatagtt

SEQ ID NO: 7125571 - DNA, 22 bp, Homo sapiens
agagggaaatccaggagtgctt

SEQ ID NO: 7125572 - DNA, 22 bp, Homo sapiens
agagggaaatccaggagtgctt

SEQ ID NO: 7125573 - DNA, 22 bp, Homo sapiens
agagggaaatccaggagtgctt

SEQ ID NO: 7125574 - DNA, 18 bp, Homo sapiens
agagggaaagcaggctga

SEQ ID NO: 7125575 - DNA, 22 bp, Homo sapiens
agagggaaatccaggagtgctt

SEQ ID NO: 7125576 - DNA, 22 bp, Homo sapiens
agagggaacggatcccagcgcg

SEQ ID NO: 7125577 - DNA, 22 bp, Homo sapiens
agagggaagatggtccaatctt

SEQ ID NO: 7125578 - DNA, 22 bp, Homo sapiens
agagggaaggacagatgtttca

SEQ ID NO: 7125579 - DNA, 22 bp, Homo sapiens
agagggaaggacagatgtttca

SEQ ID NO: 7125580 - DNA, 18 bp, Homo sapiens
agagggaatcagttggat

SEQ ID NO: 7125581 - DNA, 18 bp, Homo sapiens
agagggaatcagttggat

SEQ ID NO: 7125582 - DNA, 18 bp, Homo sapiens
agagggaatcagttggat

SEQ ID NO: 7125583 - DNA, 17 bp, Homo sapiens
agagggaaaatgcggtt

SEQ ID NO: 7125584 - DNA, 18 bp, Homo sapiens
agagggaaagcaggctga

SEQ ID NO: 7125585 - DNA, 22 bp, Homo sapiens
agaggctgtgcagagggagtgc

SEQ ID NO: 7125586 - DNA, 22 bp, Homo sapiens
agaggctgtgcagagggagtgc

SEQ ID NO: 7125587 - DNA, 22 bp, Homo sapiens
agaggctgtgcagagggagtgc

SEQ ID NO: 7125588 - DNA, 22 bp, Homo sapiens
agaggctgtgcagagggagtgc

SEQ ID NO: 7125589 - DNA, 22 bp, Homo sapiens
agagggaaaaactcatgtcatt

SEQ ID NO: 7125590 - DNA, 22 bp, Homo sapiens
agagggaaaaactcatgtcatt

SEQ ID NO: 7125591 - DNA, 22 bp, Homo sapiens
agagggaaaaactcatgtcatt

SEQ ID NO: 7125592 - DNA, 22 bp, Homo sapiens
attccattgtatgtgtagacta

SEQ ID NO: 7125593 - DNA, 22 bp, Homo sapiens
attccattgtgtaaggatatcg

SEQ ID NO: 7125594 - DNA, 22 bp, Homo sapiens
attgagggctgagaagggccct

SEQ ID NO: 7125595 - DNA, 22 bp, Homo sapiens
attgagtaataattgatcttgg

SEQ ID NO: 7125596 - DNA, 22 bp, Homo sapiens
attgataaattgcaatggggct

SEQ ID NO: 7125597 - DNA, 22 bp, Homo sapiens
attgataaattgcaatggggct

SEQ ID NO: 7125598 - DNA, 22 bp, Homo sapiens
attgagtacttagtgtcatata

SEQ ID NO: 7125599 - DNA, 22 bp, Homo sapiens
attgataaattgcaatggggct

SEQ ID NO: 7125600 - DNA, 22 bp, Homo sapiens
attgcaggatacccaggtagag

SEQ ID NO: 7125601 - DNA, 22 bp, Homo sapiens
attgcaggcaaagtgctgtgtc

SEQ ID NO: 7125602 - DNA, 22 bp, Homo sapiens
attgcaggccagtgtcctgggc

SEQ ID NO: 7125603 - DNA, 22 bp, Homo sapiens
attgcagggaggcaggtagatg

SEQ ID NO: 7125604 - DNA, 22 bp, Homo sapiens
attgcaggttgtagcccattag

SEQ ID NO: 7125605 - DNA, 22 bp, Homo sapiens
attgcagtgtgtgttccatgag

SEQ ID NO: 7125606 - DNA, 22 bp, Homo sapiens
attgcagtgttgcctggggcct

SEQ ID NO: 7125607 - DNA, 20 bp, Homo sapiens
attgcagttggacctgtctc

SEQ ID NO: 7125608 - DNA, 22 bp, Homo sapiens
attgcatatgcagcacatcagg

SEQ ID NO: 7125609 - DNA, 22 bp, Homo sapiens
attgcatgacatatccacttgt

SEQ ID NO: 7125610 - DNA, 22 bp, Homo sapiens
attgcatgacatatccacttgt

SEQ ID NO: 7125611 - DNA, 22 bp, Homo sapiens
attgcattcattgacatatgag

SEQ ID NO: 7125612 - DNA, 22 bp, Homo sapiens
attccaggagctaactgtggtc

SEQ ID NO: 7125613 - DNA, 23 bp, Homo sapiens
attccaggaaatacttggctttc

SEQ ID NO: 7125614 - DNA, 22 bp, Homo sapiens
attccagatgttactgaaaggc

SEQ ID NO: 7125615 - DNA, 22 bp, Homo sapiens
attccagtgtgcttccttgcta

SEQ ID NO: 7125616 - DNA, 22 bp, Homo sapiens
attccattacagatcttttcct

SEQ ID NO: 7125617 - DNA, 22 bp, Homo sapiens
agaggcaggaagagctgatttt

SEQ ID NO: 7125618 - DNA, 22 bp, Homo sapiens
agaggcaggaagagctgatttt

SEQ ID NO: 7125619 - DNA, 22 bp, Homo sapiens
agaggcaggaagagctgatttt

SEQ ID NO: 7125620 - DNA, 22 bp, Homo sapiens
agaggcagccgtatttcaaagg

SEQ ID NO: 7125621 - DNA, 22 bp, Homo sapiens
agaggcagccgtatttcaaagg

SEQ ID NO: 7125622 - DNA, 22 bp, Homo sapiens
agaggcagccgtatttcaaagg

SEQ ID NO: 7125623 - DNA, 22 bp, Homo sapiens
agaggcaggaggttgacttgag

SEQ ID NO: 7125624 - DNA, 22 bp, Homo sapiens
agaggcaggaggttgacttgag

SEQ ID NO: 7125625 - DNA, 22 bp, Homo sapiens
agaggcagcagtcatactacag

SEQ ID NO: 7125626 - DNA, 22 bp, Homo sapiens
agaggcagcagtcatactacag

SEQ ID NO: 7125627 - DNA, 22 bp, Homo sapiens
agaggcagcagtcatactacag

SEQ ID NO: 7125628 - DNA, 22 bp, Homo sapiens
agaggcagcagtcatactacag

SEQ ID NO: 7125629 - DNA, 17 bp, Homo sapiens
agaggcagatacttgga

SEQ ID NO: 7125630 - DNA, 17 bp, Homo sapiens
agaggcagatacttgga

SEQ ID NO: 7125631 - DNA, 17 bp, Homo sapiens
agaggcagatacttgga

SEQ ID NO: 7125632 - DNA, 17 bp, Homo sapiens
agaggcagatacttgga

SEQ ID NO: 7125633 - DNA, 17 bp, Homo sapiens
agaggcagatacttgga

SEQ ID NO: 7125634 - DNA, 22 bp, Homo sapiens
attcattccaggtcagtcagac

SEQ ID NO: 7125635 - DNA, 22 bp, Homo sapiens
attcattctgacctcaagagaa

SEQ ID NO: 7125636 - DNA, 22 bp, Homo sapiens
attcattctgacctcaagagaa

SEQ ID NO: 7125637 - DNA, 20 bp, Homo sapiens
attcatgtctttataaaagc

SEQ ID NO: 7125638 - DNA, 22 bp, Homo sapiens
attcatgtggggagccttctgt

SEQ ID NO: 7125639 - DNA, 22 bp, Homo sapiens
attcatgttagcccacatgtag

SEQ ID NO: 7125640 - DNA, 22 bp, Homo sapiens
attcatgttttcttgcttcaag

SEQ ID NO: 7125641 - DNA, 22 bp, Homo sapiens
attcatgtagtgattgagtcac

SEQ ID NO: 7125642 - DNA, 22 bp, Homo sapiens
attcatgtaaaattggatagac

SEQ ID NO: 7125643 - DNA, 22 bp, Homo sapiens
attcatgtaacattagagaaat

SEQ ID NO: 7125644 - DNA, 22 bp, Homo sapiens
attcatgtaacattagagaaat

SEQ ID NO: 7125645 - DNA, 22 bp, Homo sapiens
agaggcaggaggttgacttgag

SEQ ID NO: 7125646 - DNA, 22 bp, Homo sapiens
attcagtagaagttagctatta

SEQ ID NO: 7125647 - DNA, 22 bp, Homo sapiens
attcatttgctattgtgtatgg

SEQ ID NO: 7125648 - DNA, 22 bp, Homo sapiens
attcatttgctattgtgtatgg

SEQ ID NO: 7125649 - DNA, 22 bp, Homo sapiens
attcatttaggtattcacttac

SEQ ID NO: 7125650 - DNA, 22 bp, Homo sapiens
attcatttaggtattcacttac

SEQ ID NO: 7125651 - DNA, 22 bp, Homo sapiens
attcatttaggtattcacttac

SEQ ID NO: 7125652 - DNA, 22 bp, Homo sapiens
attcatttagagggattaagca

SEQ ID NO: 7125653 - DNA, 22 bp, Homo sapiens
attcattggcttgaactccacc

SEQ ID NO: 7125654 - DNA, 22 bp, Homo sapiens
attcatttagagggattaagca

SEQ ID NO: 7125655 - DNA, 22 bp, Homo sapiens
attcatttagagggattaagca

SEQ ID NO: 7125656 - DNA, 22 bp, Homo sapiens
attcatttagagggattaagca

SEQ ID NO: 7125657 - DNA, 22 bp, Homo sapiens
attcatttgctattgtgtatgg

SEQ ID NO: 7125658 - DNA, 22 bp, Homo sapiens
attcatttgctattgtgtatgg

SEQ ID NO: 7125659 - DNA, 22 bp, Homo sapiens
attcatttgctattgtgtatgg

SEQ ID NO: 7125660 - DNA, 22 bp, Homo sapiens
agaggcctgtgtgctccagtgg

SEQ ID NO: 7125661 - DNA, 22 bp, Homo sapiens
agaggcctgtgtgctccagtgg

SEQ ID NO: 7125662 - DNA, 22 bp, Homo sapiens
agaggcctgtgtgctccagtgg

SEQ ID NO: 7125663 - DNA, 22 bp, Homo sapiens
agaggcctgtgtgctccagtgg

SEQ ID NO: 7125664 - DNA, 21 bp, Homo sapiens
agaggccttacaggatagacc

SEQ ID NO: 7125665 - DNA, 21 bp, Homo sapiens
agaggccttacaggatagacc

SEQ ID NO: 7125666 - DNA, 22 bp, Homo sapiens
agaggcctttctgttgagtgaa

SEQ ID NO: 7125667 - DNA, 22 bp, Homo sapiens
agaggcctttctgttgagtgaa

SEQ ID NO: 7125668 - DNA, 22 bp, Homo sapiens
agaggctaggaccatgtatcat

SEQ ID NO: 7125669 - DNA, 22 bp, Homo sapiens
agaggctcactcttggaaccca

SEQ ID NO: 7125670 - DNA, 23 bp, Homo sapiens
agaggctcagcgtccacctctac

SEQ ID NO: 7125671 - DNA, 22 bp, Homo sapiens
agaggctcagaggcctggtcct

SEQ ID NO: 7125672 - DNA, 22 bp, Homo sapiens
agaggctcagaggcctggtcct

SEQ ID NO: 7125673 - DNA, 22 bp, Homo sapiens
agaggctcagaggcctggtcct

SEQ ID NO: 7125674 - DNA, 22 bp, Homo sapiens
agaggctccaccttctctgtcc

SEQ ID NO: 7125675 - DNA, 22 bp, Homo sapiens
agaggctccaccttctctgtcc

SEQ ID NO: 7125676 - DNA, 22 bp, Homo sapiens
agaggctcctcggtgcctcgtg

SEQ ID NO: 7125677 - DNA, 22 bp, Homo sapiens
agaggctcctagccactggctt

SEQ ID NO: 7125678 - DNA, 22 bp, Homo sapiens
agaggctcctagccactggctt

SEQ ID NO: 7125679 - DNA, 20 bp, Homo sapiens
agagtgggtgtcacaggctg

SEQ ID NO: 7125680 - DNA, 20 bp, Homo sapiens
agagtgggtgtcacaggctg

SEQ ID NO: 7125681 - DNA, 22 bp, Homo sapiens
agagttctgctcttctcagtga

SEQ ID NO: 7125682 - DNA, 22 bp, Homo sapiens
agagttctgaaattatctttac

SEQ ID NO: 7125683 - DNA, 22 bp, Homo sapiens
agagttctgtctgccacacgaa

SEQ ID NO: 7125684 - DNA, 22 bp, Homo sapiens
agagttctgtctgccacacgaa

SEQ ID NO: 7125685 - DNA, 22 bp, Homo sapiens
agagttcttgccctagaaaatg

SEQ ID NO: 7125686 - DNA, 22 bp, Homo sapiens
agagttcttgccctagaaaatg

SEQ ID NO: 7125687 - DNA, 21 bp, Homo sapiens
agagttgcagcaaatggggga

SEQ ID NO: 7125688 - DNA, 22 bp, Homo sapiens
agaggtgacataggagaggctc

SEQ ID NO: 7125689 - DNA, 22 bp, Homo sapiens
agaggtgaaagaatttggctct

SEQ ID NO: 7125690 - DNA, 22 bp, Homo sapiens
agagtggggacagggcctgtcc

SEQ ID NO: 7125691 - DNA, 22 bp, Homo sapiens
agagtgggtgatctctgttgtc

SEQ ID NO: 7125692 - DNA, 22 bp, Homo sapiens
agagtgggtgatctctgttgtc

SEQ ID NO: 7125693 - DNA, 22 bp, Homo sapiens
agaggtcttaagatctagactg

SEQ ID NO: 7125694 - DNA, 22 bp, Homo sapiens
agaggtcttaagttccttgatg

SEQ ID NO: 7125695 - DNA, 22 bp, Homo sapiens
agaggtcttcacatggcaatga

SEQ ID NO: 7125696 - DNA, 22 bp, Homo sapiens
agaggtcttcagcatttgaact

SEQ ID NO: 7125697 - DNA, 22 bp, Homo sapiens
agaggtcttttggtctgcagaa

SEQ ID NO: 7125698 - DNA, 22 bp, Homo sapiens
agagtttcttgtgagcactgac

SEQ ID NO: 7125699 - DNA, 22 bp, Homo sapiens
agagtttaggggacacagaata

SEQ ID NO: 7125700 - DNA, 22 bp, Homo sapiens
agagtttaggggacacagaata

SEQ ID NO: 7125701 - DNA, 22 bp, Homo sapiens
agagtttaggggtaagcatagt

SEQ ID NO: 7125702 - DNA, 19 bp, Homo sapiens
agagtttaggtctatcagg

SEQ ID NO: 7125703 - DNA, 22 bp, Homo sapiens
agagtttaaacactgtcacaga

SEQ ID NO: 7125704 - DNA, 22 bp, Homo sapiens
agagtttaacacaagaaaagtt

SEQ ID NO: 7125705 - DNA, 22 bp, Homo sapiens
agagtttacagaaataagctgt

SEQ ID NO: 7125706 - DNA, 22 bp, Homo sapiens
agagtttacagaaataagctgt

SEQ ID NO: 7125707 - DNA, 22 bp, Homo sapiens
agagtttaccactatttttggt

SEQ ID NO: 7125708 - DNA, 22 bp, Homo sapiens
agagtttaccactatttttggt

SEQ ID NO: 7125709 - DNA, 22 bp, Homo sapiens
agagtttaccactatttttggt

SEQ ID NO: 7125710 - DNA, 22 bp, Homo sapiens
agagtttagggctgagagcttg

SEQ ID NO: 7125711 - DNA, 22 bp, Homo sapiens
agagttggcccacgtgtaggcg

SEQ ID NO: 7125712 - DNA, 22 bp, Homo sapiens
agagttggccaaaaggggcatt

SEQ ID NO: 7125713 - DNA, 22 bp, Homo sapiens
agagttggagaaattaaaattt

SEQ ID NO: 7125714 - DNA, 22 bp, Homo sapiens
agagttggccaaaaggggcatt

SEQ ID NO: 7125715 - DNA, 22 bp, Homo sapiens
agagttggcccacgtgtaggcg

SEQ ID NO: 7125716 - DNA, 19 bp, Homo sapiens
agagttgggcactgtttca

SEQ ID NO: 7125717 - DNA, 22 bp, Homo sapiens
agagttgtattggaatagctat

SEQ ID NO: 7125718 - DNA, 22 bp, Homo sapiens
agagttgcttatgtcaggtgag

SEQ ID NO: 7125719 - DNA, 22 bp, Homo sapiens
agaggtctcagttatgtttaaa

SEQ ID NO: 7125720 - DNA, 22 bp, Homo sapiens
agaggtctcagttatgtttaaa

SEQ ID NO: 7125721 - DNA, 22 bp, Homo sapiens
agaggtctgactcagcagatta

SEQ ID NO: 7125722 - DNA, 22 bp, Homo sapiens
agaggtctgagcaatctcaagc

SEQ ID NO: 7125723 - DNA, 22 bp, Homo sapiens
agaggtccccagatgattccag

SEQ ID NO: 7125724 - DNA, 21 bp, Homo sapiens
agaggtctaagattctagctt

SEQ ID NO: 7125725 - DNA, 22 bp, Homo sapiens
agaggtctatgctaggggaact

SEQ ID NO: 7125726 - DNA, 22 bp, Homo sapiens
agaggtcagagcaggaaaggca

SEQ ID NO: 7125727 - DNA, 22 bp, Homo sapiens
agaggtcagatttctcctggtg

SEQ ID NO: 7125728 - DNA, 22 bp, Homo sapiens
agaggtcagctgcatgccacat

SEQ ID NO: 7125729 - DNA, 22 bp, Homo sapiens
agaggtattaggtaattcagta

SEQ ID NO: 7125730 - DNA, 22 bp, Homo sapiens
agaggtattagatttgcatagg

SEQ ID NO: 7125731 - DNA, 22 bp, Homo sapiens
agaggtattagatttgcatagg

SEQ ID NO: 7125732 - DNA, 22 bp, Homo sapiens
agaggtcaatgggacttggatc

SEQ ID NO: 7125733 - DNA, 22 bp, Homo sapiens
agaggtcaatgggacttggatc

SEQ ID NO: 7125734 - DNA, 22 bp, Homo sapiens
agaggtcactccaccttcttct

SEQ ID NO: 7125735 - DNA, 22 bp, Homo sapiens
attgctgaacttataaatgaat

SEQ ID NO: 7125736 - DNA, 22 bp, Homo sapiens
attgctgaatctaaggcttcca

SEQ ID NO: 7125737 - DNA, 22 bp, Homo sapiens
attgctgactcaataattgaag

SEQ ID NO: 7125738 - DNA, 22 bp, Homo sapiens
attgctgactttaatattatat

SEQ ID NO: 7125739 - DNA, 22 bp, Homo sapiens
attgctgaaagtattttatgac

SEQ ID NO: 7125740 - DNA, 22 bp, Homo sapiens
attgctgaaagtattttatgac

SEQ ID NO: 7125741 - DNA, 22 bp, Homo sapiens
attgctgaaatgaaaggatatg

SEQ ID NO: 7125742 - DNA, 21 bp, Homo sapiens
attgctctgttgtgtctagaa

SEQ ID NO: 7125743 - DNA, 22 bp, Homo sapiens
attgctaatgtgcgaatgtgta

SEQ ID NO: 7125744 - DNA, 22 bp, Homo sapiens
attgctacttcctcaggaaaac

SEQ ID NO: 7125745 - DNA, 22 bp, Homo sapiens
attgctaggaacaggttgcacc

SEQ ID NO: 7125746 - DNA, 22 bp, Homo sapiens
attgctcagcacaagcagcaga

SEQ ID NO: 7125747 - DNA, 22 bp, Homo sapiens
attgctcagcacaagcagcaga

SEQ ID NO: 7125748 - DNA, 22 bp, Homo sapiens
attgctcagcacaagcagcaga

SEQ ID NO: 7125749 - DNA, 22 bp, Homo sapiens
attgcattcattgacatatgag

SEQ ID NO: 7125750 - DNA, 22 bp, Homo sapiens
attgcattgtattgtaaatgtt

SEQ ID NO: 7125751 - DNA, 19 bp, Homo sapiens
attgccacattgggtcagg

SEQ ID NO: 7125752 - DNA, 19 bp, Homo sapiens
attgccacattgggtcagg

SEQ ID NO: 7125753 - DNA, 22 bp, Homo sapiens
attgccacctgttgctatggag

SEQ ID NO: 7125754 - DNA, 22 bp, Homo sapiens
atttcacaggccagtggtgggg

SEQ ID NO: 7125755 - DNA, 22 bp, Homo sapiens
atttcacaggccagtggtgggg

SEQ ID NO: 7125756 - DNA, 22 bp, Homo sapiens
atttcacagctgtcagtgttac

SEQ ID NO: 7125757 - DNA, 22 bp, Homo sapiens
atttcacagctgtcagtgttac

SEQ ID NO: 7125758 - DNA, 22 bp, Homo sapiens
atttcacagctgtcagtgttac

SEQ ID NO: 7125759 - DNA, 22 bp, Homo sapiens
atttcacattaatttgatgctc

SEQ ID NO: 7125760 - DNA, 22 bp, Homo sapiens
atttcacattaatttgatgctc

SEQ ID NO: 7125761 - DNA, 22 bp, Homo sapiens
atttcacattaatttgatgctc

SEQ ID NO: 7125762 - DNA, 22 bp, Homo sapiens
atttcacattaatttgatgctc

SEQ ID NO: 7125763 - DNA, 21 bp, Homo sapiens
atttcagaaatattggtggga

SEQ ID NO: 7125764 - DNA, 17 bp, Homo sapiens
atttcacttagcatgag

SEQ ID NO: 7125765 - DNA, 20 bp, Homo sapiens
agatacagtttaattactct

SEQ ID NO: 7125766 - DNA, 22 bp, Homo sapiens
agatacatagctgtgagcacac

SEQ ID NO: 7125767 - DNA, 22 bp, Homo sapiens
agatacatagctgtgagcacac

SEQ ID NO: 7125768 - DNA, 22 bp, Homo sapiens
agatacatagctgtgagcacac

SEQ ID NO: 7125769 - DNA, 22 bp, Homo sapiens
agatacatagctgtgagcacac

SEQ ID NO: 7125770 - DNA, 22 bp, Homo sapiens
agatacatatagaaaacatcaa

SEQ ID NO: 7125771 - DNA, 22 bp, Homo sapiens
agatacatatagaaaacatcaa

SEQ ID NO: 7125772 - DNA, 22 bp, Homo sapiens
agatacatatagaaaacatcaa

SEQ ID NO: 7125773 - DNA, 22 bp, Homo sapiens
agatacatatagaaaacatcaa

SEQ ID NO: 7125774 - DNA, 22 bp, Homo sapiens
agatacatcttgaacttctaga

SEQ ID NO: 7125775 - DNA, 22 bp, Homo sapiens
agatacatcttgaacttctaga

SEQ ID NO: 7125776 - DNA, 22 bp, Homo sapiens
agatacatggaacgtcaaacct

SEQ ID NO: 7125777 - DNA, 22 bp, Homo sapiens
agatacatggaacgtcaaacct

SEQ ID NO: 7125778 - DNA, 22 bp, Homo sapiens
agatacatggaacgtcaaacct

SEQ ID NO: 7125779 - DNA, 22 bp, Homo sapiens
agatacatgtcaagagacttat

SEQ ID NO: 7125780 - DNA, 22 bp, Homo sapiens
agatacattgcacgatgcagat

SEQ ID NO: 7125781 - DNA, 22 bp, Homo sapiens
agatacattgagtttcctcctg

SEQ ID NO: 7125782 - DNA, 22 bp, Homo sapiens
agatacattgttctaagcattg

SEQ ID NO: 7125783 - DNA, 22 bp, Homo sapiens
atttcacagctgctgttcaggt

SEQ ID NO: 7125784 - DNA, 22 bp, Homo sapiens
atttcacagctgctgttcaggt

SEQ ID NO: 7125785 - DNA, 22 bp, Homo sapiens
atttcacagctgctgttcaggt

SEQ ID NO: 7125786 - DNA, 22 bp, Homo sapiens
atttcacagctgctgttcaggt

SEQ ID NO: 7125787 - DNA, 22 bp, Homo sapiens
atttcacagcgtggttgactgc

SEQ ID NO: 7125788 - DNA, 22 bp, Homo sapiens
atttcacagcgtggttgactgc

SEQ ID NO: 7125789 - DNA, 22 bp, Homo sapiens
atttattgagacttaacaaccc

SEQ ID NO: 7125790 - DNA, 22 bp, Homo sapiens
atttcacaaagaacagatgcag

SEQ ID NO: 7125791 - DNA, 21 bp, Homo sapiens
atttcacaccctcctttttct

SEQ ID NO: 7125792 - DNA, 22 bp, Homo sapiens
agataaaatggttcaaaggcta

SEQ ID NO: 7125793 - DNA, 22 bp, Homo sapiens
agataaattcctaagatttcag

SEQ ID NO: 7125794 - DNA, 22 bp, Homo sapiens
atttattgaagcttattacgtt

SEQ ID NO: 7125795 - DNA, 22 bp, Homo sapiens
atttattgaagcttattacgtt

SEQ ID NO: 7125796 - DNA, 22 bp, Homo sapiens
atttattgagacttaacaaccc

SEQ ID NO: 7125797 - DNA, 22 bp, Homo sapiens
atttattgagacttaacaaccc

SEQ ID NO: 7125798 - DNA, 22 bp, Homo sapiens
agagtttgttgaatttacttgg

SEQ ID NO: 7125799 - DNA, 22 bp, Homo sapiens
agagtttgtgggcttttcctcc

SEQ ID NO: 7125800 - DNA, 22 bp, Homo sapiens
agagtttgtgtcctttatcagg

SEQ ID NO: 7125801 - DNA, 22 bp, Homo sapiens
agataaaatgattttctggatc

SEQ ID NO: 7125802 - DNA, 22 bp, Homo sapiens
agataaaatgattttctggatc

SEQ ID NO: 7125803 - DNA, 22 bp, Homo sapiens
agataaaatggttcaaaggcta

SEQ ID NO: 7125804 - DNA, 22 bp, Homo sapiens
agataaaatggttcaaaggcta

SEQ ID NO: 7125805 - DNA, 22 bp, Homo sapiens
agagtttgtagtggtgaatgta

SEQ ID NO: 7125806 - DNA, 22 bp, Homo sapiens
agagtttgtatttttcagtgaa

SEQ ID NO: 7125807 - DNA, 22 bp, Homo sapiens
agagtttggtgaagcaatttga

SEQ ID NO: 7125808 - DNA, 22 bp, Homo sapiens
agagtttggaggtgttcctgga

SEQ ID NO: 7125809 - DNA, 22 bp, Homo sapiens
agagtttggagagggtgaggca

SEQ ID NO: 7125810 - DNA, 22 bp, Homo sapiens
agagtttggagagggtgaggca

SEQ ID NO: 7125811 - DNA, 22 bp, Homo sapiens
agagtttgaattttgaaaagat

SEQ ID NO: 7125812 - DNA, 22 bp, Homo sapiens
agagtttgaagttatctttgac

SEQ ID NO: 7125813 - DNA, 20 bp, Homo sapiens
atttgtttctactctctgac

SEQ ID NO: 7125814 - DNA, 20 bp, Homo sapiens
atttgtttctactctctgac

SEQ ID NO: 7125815 - DNA, 22 bp, Homo sapiens
atttgtttcagggccttggtat

SEQ ID NO: 7125816 - DNA, 20 bp, Homo sapiens
atttgtttctactctctgac

SEQ ID NO: 7125817 - DNA, 20 bp, Homo sapiens
atttgtttctactctctgac

SEQ ID NO: 7125818 - DNA, 22 bp, Homo sapiens
atttgtttcagggccttggtat

SEQ ID NO: 7125819 - DNA, 22 bp, Homo sapiens
atttgtttcagggccttggtat

SEQ ID NO: 7125820 - DNA, 22 bp, Homo sapiens
atttgtttcagggccttggtat

SEQ ID NO: 7125821 - DNA, 22 bp, Homo sapiens
atttgtttatcgtcgattgtag

SEQ ID NO: 7125822 - DNA, 22 bp, Homo sapiens
atttgttgttgctcccctaaga

SEQ ID NO: 7125823 - DNA, 22 bp, Homo sapiens
atttgtttatcgtcgattgtag

SEQ ID NO: 7125824 - DNA, 22 bp, Homo sapiens
attttaaccctcttatatatac

SEQ ID NO: 7125825 - DNA, 22 bp, Homo sapiens
attttaaccctcttatatatac

SEQ ID NO: 7125826 - DNA, 22 bp, Homo sapiens
attttaaccctcttatatatac

SEQ ID NO: 7125827 - DNA, 22 bp, Homo sapiens
caaaaaacacagatgtctgtgt

SEQ ID NO: 7125828 - DNA, 21 bp, Homo sapiens
caaaaggataggaaattaggg

SEQ ID NO: 7125829 - DNA, 21 bp, Homo sapiens
caaaaggataggaaattaggg

SEQ ID NO: 7125830 - DNA, 22 bp, Homo sapiens
caaaagtagtgaagttgtacat

SEQ ID NO: 7125831 - DNA, 22 bp, Homo sapiens
caaaagtaccttgtgtgctttg

SEQ ID NO: 7125832 - DNA, 22 bp, Homo sapiens
caaaagtaattgcagtttttgc

SEQ ID NO: 7125833 - DNA, 22 bp, Homo sapiens
caaaagggagttctctggaagg

SEQ ID NO: 7125834 - DNA, 22 bp, Homo sapiens
caaaaggcaggggaaagagtgc

SEQ ID NO: 7125835 - DNA, 22 bp, Homo sapiens
caaaaggcaggggaaagagtgc

SEQ ID NO: 7125836 - DNA, 22 bp, Homo sapiens
caaaaggccagtactttgtttg

SEQ ID NO: 7125837 - DNA, 22 bp, Homo sapiens
caaaaggccagtactttgtttg

SEQ ID NO: 7125838 - DNA, 22 bp, Homo sapiens
caaaagtaatgtatgctcatcg

SEQ ID NO: 7125839 - DNA, 22 bp, Homo sapiens
caaaagtaatgtatgctcatcg

SEQ ID NO: 7125840 - DNA, 22 bp, Homo sapiens
caaaagtaatgtatgctcatcg

SEQ ID NO: 7125841 - DNA, 22 bp, Homo sapiens
caaaagtaattgcagtttttgc

SEQ ID NO: 7125842 - DNA, 22 bp, Homo sapiens
caaaagtaattgcagtttttgc

SEQ ID NO: 7125843 - DNA, 20 bp, Homo sapiens
atttggcatagtttaagcaa

SEQ ID NO: 7125844 - DNA, 20 bp, Homo sapiens
atttggcatgaagtattgat

SEQ ID NO: 7125845 - DNA, 15 bp, Homo sapiens
atttggcatggcctc

SEQ ID NO: 7125846 - DNA, 22 bp, Homo sapiens
atttggcataggcagaggccca

SEQ ID NO: 7125847 - DNA, 22 bp, Homo sapiens
atttggcataggcagaggccca

SEQ ID NO: 7125848 - DNA, 22 bp, Homo sapiens
atttggcagccacagcaatctt

SEQ ID NO: 7125849 - DNA, 22 bp, Homo sapiens
atttggcagccacagcaatctt

SEQ ID NO: 7125850 - DNA, 22 bp, Homo sapiens
atttggcagtataaattctggc

SEQ ID NO: 7125851 - DNA, 22 bp, Homo sapiens
atttggcagtgaagggatcaca

SEQ ID NO: 7125852 - DNA, 22 bp, Homo sapiens
atttggcagtgaagggatcaca

SEQ ID NO: 7125853 - DNA, 22 bp, Homo sapiens
atttggcatagagtatcattct

SEQ ID NO: 7125854 - DNA, 22 bp, Homo sapiens
atttggcaatgctagagaagtt

SEQ ID NO: 7125855 - DNA, 22 bp, Homo sapiens
atttggcaacattaattgaatc

SEQ ID NO: 7125856 - DNA, 22 bp, Homo sapiens
atttggcacactgggttctcgt

SEQ ID NO: 7125857 - DNA, 22 bp, Homo sapiens
atttggcacactgggttctcgt

SEQ ID NO: 7125858 - DNA, 22 bp, Homo sapiens
atttggcacagcttttcctacc

SEQ ID NO: 7125859 - DNA, 18 bp, Homo sapiens
atttggcagatgatgaac

SEQ ID NO: 7125860 - DNA, 22 bp, Homo sapiens
atttggcaaataatttgagggt

SEQ ID NO: 7125861 - DNA, 21 bp, Homo sapiens
atttggcaaaggcgatgcaca

SEQ ID NO: 7125862 - DNA, 21 bp, Homo sapiens
atttggcaaaggcgatgcaca

SEQ ID NO: 7125863 - DNA, 22 bp, Homo sapiens
atttggcaaaagttagaagaaa

SEQ ID NO: 7125864 - DNA, 22 bp, Homo sapiens
atttggcaaaaattagcagtag

SEQ ID NO: 7125865 - DNA, 22 bp, Homo sapiens
atttggctaccatgaggatggg

SEQ ID NO: 7125866 - DNA, 22 bp, Homo sapiens
atttgtgataatttgttacagc

SEQ ID NO: 7125867 - DNA, 17 bp, Homo sapiens
atttgtgatgtaacgtc

SEQ ID NO: 7125868 - DNA, 22 bp, Homo sapiens
atttgtgggactataatgcagg

SEQ ID NO: 7125869 - DNA, 22 bp, Homo sapiens
atttgttaattatgaggcatac

SEQ ID NO: 7125870 - DNA, 22 bp, Homo sapiens
atttgttcacaatcagggcagg

SEQ ID NO: 7125871 - DNA, 22 bp, Homo sapiens
atttgttcagcattgaatttgg

SEQ ID NO: 7125872 - DNA, 22 bp, Homo sapiens
atttgttcatgggttgttatgc

SEQ ID NO: 7125873 - DNA, 22 bp, Homo sapiens
atttgttccatgagtaaggcta

SEQ ID NO: 7125874 - DNA, 22 bp, Homo sapiens
atttgttgaataaattagtatt

SEQ ID NO: 7125875 - DNA, 21 bp, Homo sapiens
agatagttgggcatgcagctg

SEQ ID NO: 7125876 - DNA, 22 bp, Homo sapiens
agataggagccaggacttaaca

SEQ ID NO: 7125877 - DNA, 22 bp, Homo sapiens
agatactatggaattttatgag

SEQ ID NO: 7125878 - DNA, 22 bp, Homo sapiens
agatactatggaattttatgag

SEQ ID NO: 7125879 - DNA, 22 bp, Homo sapiens
agatacatttgtgtgcatgtat

SEQ ID NO: 7125880 - DNA, 22 bp, Homo sapiens
agatacgcggctcttttcttga

SEQ ID NO: 7125881 - DNA, 22 bp, Homo sapiens
agatactaagcatttccagcac

SEQ ID NO: 7125882 - DNA, 22 bp, Homo sapiens
agatactaagcatttccagcac

SEQ ID NO: 7125883 - DNA, 22 bp, Homo sapiens
agatactacatgaatgggaatt

SEQ ID NO: 7125884 - DNA, 22 bp, Homo sapiens
atttcctatttcttgtccccta

SEQ ID NO: 7125885 - DNA, 22 bp, Homo sapiens
atttcctatggatacaggcaga

SEQ ID NO: 7125886 - DNA, 22 bp, Homo sapiens
atttcctatcctggtcttaaaa

SEQ ID NO: 7125887 - DNA, 22 bp, Homo sapiens
atttcctatagatatggtgagt

SEQ ID NO: 7125888 - DNA, 22 bp, Homo sapiens
atttcctatagatatggtgagt

SEQ ID NO: 7125889 - DNA, 22 bp, Homo sapiens
atttcctatacagttgtccata

SEQ ID NO: 7125890 - DNA, 22 bp, Homo sapiens
atttcctaggtgctcgagtgct

SEQ ID NO: 7125891 - DNA, 17 bp, Homo sapiens
atttccagagtggccct

SEQ ID NO: 7125892 - DNA, 22 bp, Homo sapiens
atttcctgacttccattgaggc

SEQ ID NO: 7125893 - DNA, 22 bp, Homo sapiens
atttcctgatctgtaaaatagc

SEQ ID NO: 7125894 - DNA, 22 bp, Homo sapiens
atttcctgatttgtaaaattcc

SEQ ID NO: 7125895 - DNA, 22 bp, Homo sapiens
atttcctgcaggggctggtggg

SEQ ID NO: 7125896 - DNA, 22 bp, Homo sapiens
atttccttcagtgtttaatact

SEQ ID NO: 7125897 - DNA, 22 bp, Homo sapiens
atttcctgggtctcactccaga

SEQ ID NO: 7125898 - DNA, 22 bp, Homo sapiens
atttcctggttgcattggcttt

SEQ ID NO: 7125899 - DNA, 22 bp, Homo sapiens
atttctctcattgttagctagg

SEQ ID NO: 7125900 - DNA, 22 bp, Homo sapiens
atttctctcattgttagctagg

SEQ ID NO: 7125901 - DNA, 22 bp, Homo sapiens
atttctctcattgttagctagg

SEQ ID NO: 7125902 - DNA, 22 bp, Homo sapiens
atttctcattttgcttcaaagg

SEQ ID NO: 7125903 - DNA, 22 bp, Homo sapiens
atttctctaagcatccgtttgc

SEQ ID NO: 7125904 - DNA, 22 bp, Homo sapiens
atttctcattttgcttcaaagg

SEQ ID NO: 7125905 - DNA, 22 bp, Homo sapiens
atttctcatgtacaaaaacact

SEQ ID NO: 7125906 - DNA, 22 bp, Homo sapiens
atttctcatgtacaaaaacact

SEQ ID NO: 7125907 - DNA, 22 bp, Homo sapiens
atttctcatgtacaaaaacact

SEQ ID NO: 7125908 - DNA, 22 bp, Homo sapiens
atttctcattaagatcttccaa

SEQ ID NO: 7125909 - DNA, 22 bp, Homo sapiens
atttccttcatcagcctatcct

SEQ ID NO: 7125910 - DNA, 22 bp, Homo sapiens
atttctcatcaagtgccaactc

SEQ ID NO: 7125911 - DNA, 22 bp, Homo sapiens
atttctcatcaagtgccaactc

SEQ ID NO: 7125912 - DNA, 22 bp, Homo sapiens
atttctcatctttgtgaatggt

SEQ ID NO: 7125913 - DNA, 22 bp, Homo sapiens
atttgcttttactatgttaaaa

SEQ ID NO: 7125914 - DNA, 22 bp, Homo sapiens
atttggaaaagcggtaacttgc

SEQ ID NO: 7125915 - DNA, 22 bp, Homo sapiens
atttgcttttactatgttaaaa

SEQ ID NO: 7125916 - DNA, 17 bp, Homo sapiens
atttggaatttctcttc

SEQ ID NO: 7125917 - DNA, 22 bp, Homo sapiens
atttggatatcactgaatacat

SEQ ID NO: 7125918 - DNA, 22 bp, Homo sapiens
atttggatatcactgaatacat

SEQ ID NO: 7125919 - DNA, 22 bp, Homo sapiens
atttggatatcactgaatacat

SEQ ID NO: 7125920 - DNA, 21 bp, Homo sapiens
atttggatattgctggcaaat

SEQ ID NO: 7125921 - DNA, 22 bp, Homo sapiens
atttggatgaacaatggaaaaa

SEQ ID NO: 7125922 - DNA, 22 bp, Homo sapiens
atttggatgcactaaataaaat

SEQ ID NO: 7125923 - DNA, 22 bp, Homo sapiens
atttggattcttatttagcact

SEQ ID NO: 7125924 - DNA, 22 bp, Homo sapiens
atttggattcttatttagcact

SEQ ID NO: 7125925 - DNA, 22 bp, Homo sapiens
atttctctgcctcagcttctgc

SEQ ID NO: 7125926 - DNA, 22 bp, Homo sapiens
atttctctgcctcagcttctgc

SEQ ID NO: 7125927 - DNA, 22 bp, Homo sapiens
atttctcttagcaagacattac

SEQ ID NO: 7125928 - DNA, 22 bp, Homo sapiens
atttctcttagcaagacattac

SEQ ID NO: 7125929 - DNA, 22 bp, Homo sapiens
atttctcttagcaagacattac

SEQ ID NO: 7125930 - DNA, 22 bp, Homo sapiens
atttctcttagcaagacattac

SEQ ID NO: 7125931 - DNA, 22 bp, Homo sapiens
atttgctttgggacagcttaaa

SEQ ID NO: 7125932 - DNA, 22 bp, Homo sapiens
atttgcttttactatgttaaaa

SEQ ID NO: 7125933 - DNA, 22 bp, Homo sapiens
agaccagggtcccacagagtct

SEQ ID NO: 7125934 - DNA, 22 bp, Homo sapiens
agaccaggtctttatggctcca

SEQ ID NO: 7125935 - DNA, 22 bp, Homo sapiens
agaccaggtctttatggctcca

SEQ ID NO: 7125936 - DNA, 22 bp, Homo sapiens
agaccaggtctttatggctcca

SEQ ID NO: 7125937 - DNA, 22 bp, Homo sapiens
agaccactggcctcctgcagac

SEQ ID NO: 7125938 - DNA, 22 bp, Homo sapiens
agaccaggaaggcctacagata

SEQ ID NO: 7125939 - DNA, 22 bp, Homo sapiens
agaccagtaaaattagtgggag

SEQ ID NO: 7125940 - DNA, 22 bp, Homo sapiens
agaccagtagtatggattatga

SEQ ID NO: 7125941 - DNA, 22 bp, Homo sapiens
agaccagtgagtaggccttaga

SEQ ID NO: 7125942 - DNA, 22 bp, Homo sapiens
agaccagtgcatggcgtttgct

SEQ ID NO: 7125943 - DNA, 21 bp, Homo sapiens
agaccagtgggataaataggt

SEQ ID NO: 7125944 - DNA, 22 bp, Homo sapiens
agaccagtgttttagttagaag

SEQ ID NO: 7125945 - DNA, 22 bp, Homo sapiens
agaccagttacattagaacttc

SEQ ID NO: 7125946 - DNA, 22 bp, Homo sapiens
agaccagttcccttcttggctg

SEQ ID NO: 7125947 - DNA, 22 bp, Homo sapiens
agaccagttttattatttgagt

SEQ ID NO: 7125948 - DNA, 22 bp, Homo sapiens
agacccagaaagcagctgcatt

SEQ ID NO: 7125949 - DNA, 22 bp, Homo sapiens
agacccagaaagcagctgcatt

SEQ ID NO: 7125950 - DNA, 22 bp, Homo sapiens
agaccacaggcatgcacagagc

SEQ ID NO: 7125951 - DNA, 22 bp, Homo sapiens
agaccacaggcatgcacagagc

SEQ ID NO: 7125952 - DNA, 22 bp, Homo sapiens
agaccactcaaaattagtgtct

SEQ ID NO: 7125953 - DNA, 22 bp, Homo sapiens
agaccactaaaactttctctat

SEQ ID NO: 7125954 - DNA, 22 bp, Homo sapiens
agaccactaaaactttctctat

SEQ ID NO: 7125955 - DNA, 22 bp, Homo sapiens
agacattttggaaagtattact

SEQ ID NO: 7125956 - DNA, 22 bp, Homo sapiens
agacattttgatacccctaccg

SEQ ID NO: 7125957 - DNA, 22 bp, Homo sapiens
agacattttcgttggagaggtt

SEQ ID NO: 7125958 - DNA, 22 bp, Homo sapiens
agacattttcgttggagaggtt

SEQ ID NO: 7125959 - DNA, 22 bp, Homo sapiens
agacattttgatacccctaccg

SEQ ID NO: 7125960 - DNA, 22 bp, Homo sapiens
agacattttgcaatgggtagct

SEQ ID NO: 7125961 - DNA, 22 bp, Homo sapiens
agacattttgcaatgggtagct

SEQ ID NO: 7125962 - DNA, 22 bp, Homo sapiens
agacattttgcattccctgaag

SEQ ID NO: 7125963 - DNA, 22 bp, Homo sapiens
agacattttggaaagtattact

SEQ ID NO: 7125964 - DNA, 22 bp, Homo sapiens
agacattttggaaagtattact

SEQ ID NO: 7125965 - DNA, 23 bp, Homo sapiens
agacattttaataaggacttttt

SEQ ID NO: 7125966 - DNA, 22 bp, Homo sapiens
agacattttacattcttccatt

SEQ ID NO: 7125967 - DNA, 22 bp, Homo sapiens
agacattttacattcttccatt

SEQ ID NO: 7125968 - DNA, 22 bp, Homo sapiens
agacattttagacataaaagat

SEQ ID NO: 7125969 - DNA, 22 bp, Homo sapiens
agacattttagacataaaagat

SEQ ID NO: 7125970 - DNA, 23 bp, Homo sapiens
agacccagagactggctctgctc

SEQ ID NO: 7125971 - DNA, 22 bp, Homo sapiens
agacccagagggctgctgggag

SEQ ID NO: 7125972 - DNA, 22 bp, Homo sapiens
atggcagcctgagcagaggaat

SEQ ID NO: 7125973 - DNA, 23 bp, Homo sapiens
agacccagagactggctctgctc

SEQ ID NO: 7125974 - DNA, 22 bp, Homo sapiens
atggcagcctgtggacagtcaa

SEQ ID NO: 7125975 - DNA, 22 bp, Homo sapiens
atggcagcggagctggaaatga

SEQ ID NO: 7125976 - DNA, 22 bp, Homo sapiens
atggccagcaagttcagaattt

SEQ ID NO: 7125977 - DNA, 22 bp, Homo sapiens
atggccagggtggcactgtggt

SEQ ID NO: 7125978 - DNA, 22 bp, Homo sapiens
atggccagggtggcactgtggt

SEQ ID NO: 7125979 - DNA, 22 bp, Homo sapiens
agagaagagcaatgataaattt

SEQ ID NO: 7125980 - DNA, 22 bp, Homo sapiens
agagaagagcaatgataaattt

SEQ ID NO: 7125981 - DNA, 22 bp, Homo sapiens
agagaagagcaatgataaattt

SEQ ID NO: 7125982 - DNA, 22 bp, Homo sapiens
agagaagacttacagccacagt

SEQ ID NO: 7125983 - DNA, 22 bp, Homo sapiens
agagaagagcaatgataaattt

SEQ ID NO: 7125984 - DNA, 22 bp, Homo sapiens
agagaagagcaatgataaattt

SEQ ID NO: 7125985 - DNA, 18 bp, Homo sapiens
agagaagaggtgttagtc

SEQ ID NO: 7125986 - DNA, 22 bp, Homo sapiens
agagaccagaatccagctgcct

SEQ ID NO: 7125987 - DNA, 22 bp, Homo sapiens
agagaccaagggaatagtctca

SEQ ID NO: 7125988 - DNA, 22 bp, Homo sapiens
agagaccaagggaatagtctca

SEQ ID NO: 7125989 - DNA, 22 bp, Homo sapiens
agagaccaagggaatagtctca

SEQ ID NO: 7125990 - DNA, 19 bp, Homo sapiens
agagaccacagagctgcct

SEQ ID NO: 7125991 - DNA, 21 bp, Homo sapiens
agagaccagctgttactccca

SEQ ID NO: 7125992 - DNA, 22 bp, Homo sapiens
agagacccattgccggaatcac

SEQ ID NO: 7125993 - DNA, 22 bp, Homo sapiens
agagacagggttttgtcgtgtt

SEQ ID NO: 7125994 - DNA, 22 bp, Homo sapiens
agagacagggttttgtcgtgtt

SEQ ID NO: 7125995 - DNA, 22 bp, Homo sapiens
agagacagggttttgtcgtgtt

SEQ ID NO: 7125996 - DNA, 22 bp, Homo sapiens
agagacatgcagttgttgtgaa

SEQ ID NO: 7125997 - DNA, 22 bp, Homo sapiens
agagacatggagaggcaaagtt

SEQ ID NO: 7125998 - DNA, 22 bp, Homo sapiens
agagacatggagaggcaaagtt

SEQ ID NO: 7125999 - DNA, 23 bp, Homo sapiens
agagacatttggatacagaaaca

SEQ ID NO: 7126000 - DNA, 22 bp, Homo sapiens
agagaccaagggaatagtctca

SEQ ID NO: 7126001 - DNA, 22 bp, Homo sapiens
agagaagattcttatatgtctt

SEQ ID NO: 7126002 - DNA, 22 bp, Homo sapiens
agagaagcagggagtcatctgt

SEQ ID NO: 7126003 - DNA, 22 bp, Homo sapiens
agagaagagtcttgtcaaatta

SEQ ID NO: 7126004 - DNA, 22 bp, Homo sapiens
agagaagattcttatatgtctt

SEQ ID NO: 7126005 - DNA, 22 bp, Homo sapiens
agagaagattcttatatgtctt

SEQ ID NO: 7126006 - DNA, 22 bp, Homo sapiens
agagaagattcttatatgtctt

SEQ ID NO: 7126007 - DNA, 22 bp, Homo sapiens
agagacagggttttgtcgtgtt

SEQ ID NO: 7126008 - DNA, 21 bp, Homo sapiens
agagacagagaaagtaacatt

SEQ ID NO: 7126009 - DNA, 22 bp, Homo sapiens
agagaaggaaagctgacatggg

SEQ ID NO: 7126010 - DNA, 22 bp, Homo sapiens
agagaaggaaagctgacatggg

SEQ ID NO: 7126011 - DNA, 22 bp, Homo sapiens
agagaaggaaagctgacatggg

SEQ ID NO: 7126012 - DNA, 22 bp, Homo sapiens
agagaaggaaagctgacatggg

SEQ ID NO: 7126013 - DNA, 22 bp, Homo sapiens
agagaaggaaagctgacatggg

SEQ ID NO: 7126014 - DNA, 22 bp, Homo sapiens
agagactgatggagctcactct

SEQ ID NO: 7126015 - DNA, 22 bp, Homo sapiens
agagactgatggagctcactct

SEQ ID NO: 7126016 - DNA, 22 bp, Homo sapiens
agagactaatgggagcggaagt

SEQ ID NO: 7126017 - DNA, 23 bp, Homo sapiens
agagactataagttatgttctgt

SEQ ID NO: 7126018 - DNA, 22 bp, Homo sapiens
atggcctctagctgagaccaat

SEQ ID NO: 7126019 - DNA, 22 bp, Homo sapiens
atggcctgatgcacctgtccca

SEQ ID NO: 7126020 - DNA, 22 bp, Homo sapiens
agagacctgagatcctcgacat

SEQ ID NO: 7126021 - DNA, 22 bp, Homo sapiens
agagaccttcctgactccagag

SEQ ID NO: 7126022 - DNA, 22 bp, Homo sapiens
agagaccttcctgactccagag

SEQ ID NO: 7126023 - DNA, 22 bp, Homo sapiens
agagacctttgttattctagga

SEQ ID NO: 7126024 - DNA, 22 bp, Homo sapiens
agagaccttttgccttctagtt

SEQ ID NO: 7126025 - DNA, 22 bp, Homo sapiens
agagacctttgttattctagga

SEQ ID NO: 7126026 - DNA, 22 bp, Homo sapiens
agagaccttttgccttctagtt

SEQ ID NO: 7126027 - DNA, 22 bp, Homo sapiens
agagactaagccagcatagtgc

SEQ ID NO: 7126028 - DNA, 22 bp, Homo sapiens
atggcctgcagtgctgccacag

SEQ ID NO: 7126029 - DNA, 22 bp, Homo sapiens
atggcctgggcccgcttcagat

SEQ ID NO: 7126030 - DNA, 22 bp, Homo sapiens
atggcctggggagcatgggaag

SEQ ID NO: 7126031 - DNA, 22 bp, Homo sapiens
atggcctggggagcatgggaag

SEQ ID NO: 7126032 - DNA, 22 bp, Homo sapiens
atggcctggggattcctgagca

SEQ ID NO: 7126033 - DNA, 22 bp, Homo sapiens
atggctcagcgcctttctgtgg

SEQ ID NO: 7126034 - DNA, 22 bp, Homo sapiens
atggctcagcgcctttctgtgg

SEQ ID NO: 7126035 - DNA, 22 bp, Homo sapiens
atggctcagcccatggaagaaa

SEQ ID NO: 7126036 - DNA, 22 bp, Homo sapiens
atggctcagcccatggaagaaa

SEQ ID NO: 7126037 - DNA, 22 bp, Homo sapiens
agagagttgtaccacactcata

SEQ ID NO: 7126038 - DNA, 22 bp, Homo sapiens
agagatgaaaagtggagactgg

SEQ ID NO: 7126039 - DNA, 22 bp, Homo sapiens
agagatgaacataaaacaagga

SEQ ID NO: 7126040 - DNA, 22 bp, Homo sapiens
agagagttgtatgtttctaaaa

SEQ ID NO: 7126041 - DNA, 22 bp, Homo sapiens
agagatgaaaagtggagactgg

SEQ ID NO: 7126042 - DNA, 22 bp, Homo sapiens
atggcctttctcagtggtgctt

SEQ ID NO: 7126043 - DNA, 17 bp, Homo sapiens
atggctcacctgtgggc

SEQ ID NO: 7126044 - DNA, 17 bp, Homo sapiens
atggctcacctgtgggc

SEQ ID NO: 7126045 - DNA, 17 bp, Homo sapiens
atggctcacctgtgggc

SEQ ID NO: 7126046 - DNA, 17 bp, Homo sapiens
atggctcacctgtgggc

SEQ ID NO: 7126047 - DNA, 22 bp, Homo sapiens
atgggtggaggagaaaggcatc

SEQ ID NO: 7126048 - DNA, 22 bp, Homo sapiens
atgggtgagtatgagttgactt

SEQ ID NO: 7126049 - DNA, 22 bp, Homo sapiens
atgggtggaggagaaaggcatc

SEQ ID NO: 7126050 - DNA, 22 bp, Homo sapiens
atgggtggagggtgacacggat

SEQ ID NO: 7126051 - DNA, 22 bp, Homo sapiens
atgggtggagggtgacacggat

SEQ ID NO: 7126052 - DNA, 22 bp, Homo sapiens
atgggtggagggtgacacggat

SEQ ID NO: 7126053 - DNA, 22 bp, Homo sapiens
atggggtggagtccgggcagcg

SEQ ID NO: 7126054 - DNA, 22 bp, Homo sapiens
atggggttcacctgacagagaa

SEQ ID NO: 7126055 - DNA, 22 bp, Homo sapiens
atggggttcacctgacagagaa

SEQ ID NO: 7126056 - DNA, 22 bp, Homo sapiens
atgggtagaatcatttctggac

SEQ ID NO: 7126057 - DNA, 22 bp, Homo sapiens
atgggtaggatttactcagatg

SEQ ID NO: 7126058 - DNA, 22 bp, Homo sapiens
agagcatctaacacataagcct

SEQ ID NO: 7126059 - DNA, 23 bp, Homo sapiens
agagcatcatgatgctaagtctg

SEQ ID NO: 7126060 - DNA, 22 bp, Homo sapiens
agagccaaggcctcagtctcaa

SEQ ID NO: 7126061 - DNA, 22 bp, Homo sapiens
atgggtggagggtgacacggat

SEQ ID NO: 7126062 - DNA, 22 bp, Homo sapiens
agagcagcctcagctccctgtg

SEQ ID NO: 7126063 - DNA, 22 bp, Homo sapiens
agagcagcctgtgatgatgcac

SEQ ID NO: 7126064 - DNA, 18 bp, Homo sapiens
agagcagcggcatcacac

SEQ ID NO: 7126065 - DNA, 22 bp, Homo sapiens
agagccagatggagccgtgtgt

SEQ ID NO: 7126066 - DNA, 22 bp, Homo sapiens
agagccagagacctgggttcac

SEQ ID NO: 7126067 - DNA, 22 bp, Homo sapiens
agagccagagacctgggttcac

SEQ ID NO: 7126068 - DNA, 22 bp, Homo sapiens
agagccagaccattgccgtgca

SEQ ID NO: 7126069 - DNA, 22 bp, Homo sapiens
agagccagagacctgggttcac

SEQ ID NO: 7126070 - DNA, 22 bp, Homo sapiens
agagccagagacctgggttcac

SEQ ID NO: 7126071 - DNA, 22 bp, Homo sapiens
agagccagaccattgccgtgca

SEQ ID NO: 7126072 - DNA, 22 bp, Homo sapiens
agagccagaccattgccgtgca

SEQ ID NO: 7126073 - DNA, 22 bp, Homo sapiens
agagccagaccattgccgtgca

SEQ ID NO: 7126074 - DNA, 22 bp, Homo sapiens
agagccagaccattgccgtgca

SEQ ID NO: 7126075 - DNA, 19 bp, Homo sapiens
agagccagacagcatagga

SEQ ID NO: 7126076 - DNA, 19 bp, Homo sapiens
agagccagacagcatagga

SEQ ID NO: 7126077 - DNA, 19 bp, Homo sapiens
agagccagacagcatagga

SEQ ID NO: 7126078 - DNA, 22 bp, Homo sapiens
agagccacggcaggcctaggaa

SEQ ID NO: 7126079 - DNA, 22 bp, Homo sapiens
agagccactgggagacagagca

SEQ ID NO: 7126080 - DNA, 22 bp, Homo sapiens
agagccactgggagacagagca

SEQ ID NO: 7126081 - DNA, 22 bp, Homo sapiens
agagccacggcaggcctaggaa

SEQ ID NO: 7126082 - DNA, 22 bp, Homo sapiens
atgggggaaagtacgagcatgg

SEQ ID NO: 7126083 - DNA, 22 bp, Homo sapiens
agagatggcgtctcagagcctg

SEQ ID NO: 7126084 - DNA, 22 bp, Homo sapiens
agagatggatgttattatgggt

SEQ ID NO: 7126085 - DNA, 22 bp, Homo sapiens
agagatggccttaggtgggaat

SEQ ID NO: 7126086 - DNA, 22 bp, Homo sapiens
agagatggccttaggtgggaat

SEQ ID NO: 7126087 - DNA, 22 bp, Homo sapiens
agagatggccttaggtgggaat

SEQ ID NO: 7126088 - DNA, 22 bp, Homo sapiens
agagatggccttaggtgggaat

SEQ ID NO: 7126089 - DNA, 22 bp, Homo sapiens
atggggtgagactaggattaaa

SEQ ID NO: 7126090 - DNA, 22 bp, Homo sapiens
atggggtgagactaggattaaa

SEQ ID NO: 7126091 - DNA, 22 bp, Homo sapiens
atggggtgcatgcagattggga

SEQ ID NO: 7126092 - DNA, 22 bp, Homo sapiens
atggggtgcatgcagattggga

SEQ ID NO: 7126093 - DNA, 22 bp, Homo sapiens
atggggtgcatgcagattggga

SEQ ID NO: 7126094 - DNA, 22 bp, Homo sapiens
atggggtgcatgcagattggga

SEQ ID NO: 7126095 - DNA, 22 bp, Homo sapiens
atggggtggagtccgggcagcg

SEQ ID NO: 7126096 - DNA, 22 bp, Homo sapiens
atggggtggagtccgggcagcg

SEQ ID NO: 7126097 - DNA, 22 bp, Homo sapiens
atggggtggagtccgggcagcg

SEQ ID NO: 7126098 - DNA, 22 bp, Homo sapiens
atggggtgaccatgagcattta

SEQ ID NO: 7126099 - DNA, 22 bp, Homo sapiens
atggggtgaccatgagcattta

SEQ ID NO: 7126100 - DNA, 22 bp, Homo sapiens
agagatggagagcactggggct

SEQ ID NO: 7126101 - DNA, 22 bp, Homo sapiens
agagatggagagcactggggct

SEQ ID NO: 7126102 - DNA, 19 bp, Homo sapiens
agagatgctaagagtcttt

SEQ ID NO: 7126103 - DNA, 22 bp, Homo sapiens
agagatgagaacatgcttggat

SEQ ID NO: 7126104 - DNA, 22 bp, Homo sapiens
agagatgcatctcttaaaattg

SEQ ID NO: 7126105 - DNA, 22 bp, Homo sapiens
agagatgactgatggctgatta

SEQ ID NO: 7126106 - DNA, 22 bp, Homo sapiens
agagatgacatgagggacttaa

SEQ ID NO: 7126107 - DNA, 22 bp, Homo sapiens
agagatgaatcttgagactctg

SEQ ID NO: 7126108 - DNA, 22 bp, Homo sapiens
agagatgaatcttgagactctg

SEQ ID NO: 7126109 - DNA, 22 bp, Homo sapiens
agagatgacatgagggacttaa

SEQ ID NO: 7126110 - DNA, 22 bp, Homo sapiens
agagatgacatgagggacttaa

SEQ ID NO: 7126111 - DNA, 22 bp, Homo sapiens
atgtgggccgtgcgggtgtcct

SEQ ID NO: 7126112 - DNA, 22 bp, Homo sapiens
atgtgggagatttcaggaggtg

SEQ ID NO: 7126113 - DNA, 22 bp, Homo sapiens
atgtgggccgtgcgggtgtcct

SEQ ID NO: 7126114 - DNA, 22 bp, Homo sapiens
atgtgggccttcaggagaaaga

SEQ ID NO: 7126115 - DNA, 22 bp, Homo sapiens
atgtggggacaaaatgatggcc

SEQ ID NO: 7126116 - DNA, 22 bp, Homo sapiens
atgtggggacaaaatgatggcc

SEQ ID NO: 7126117 - DNA, 22 bp, Homo sapiens
atgtgtaaaaagtgcttaatat

SEQ ID NO: 7126118 - DNA, 22 bp, Homo sapiens
atgtgtaaaaggcatgttttat

SEQ ID NO: 7126119 - DNA, 22 bp, Homo sapiens
atgtggggactctgagagaatt

SEQ ID NO: 7126120 - DNA, 22 bp, Homo sapiens
atgtgggtgagtgagagataga

SEQ ID NO: 7126121 - DNA, 22 bp, Homo sapiens
atgtgtaaagttagatgtctga

SEQ ID NO: 7126122 - DNA, 22 bp, Homo sapiens
atgtgtaaattgttaggtttaa

SEQ ID NO: 7126123 - DNA, 22 bp, Homo sapiens
atgtgtaatgtggtattttaat

SEQ ID NO: 7126124 - DNA, 22 bp, Homo sapiens
agagcctgtgattgtcatcacc

SEQ ID NO: 7126125 - DNA, 22 bp, Homo sapiens
agagcctgtgattgtcatcacc

SEQ ID NO: 7126126 - DNA, 22 bp, Homo sapiens
agagcctgtgattgtcatcacc

SEQ ID NO: 7126127 - DNA, 22 bp, Homo sapiens
agagcctgtgggagatgcagct

SEQ ID NO: 7126128 - DNA, 22 bp, Homo sapiens
agagcctgtgggagatgcagct

SEQ ID NO: 7126129 - DNA, 22 bp, Homo sapiens
agagcctgttcggaggcgcccc

SEQ ID NO: 7126130 - DNA, 22 bp, Homo sapiens
agagcctgttcggaggcgcccc

SEQ ID NO: 7126131 - DNA, 22 bp, Homo sapiens
agagcctgttttgtgggagatg

SEQ ID NO: 7126132 - DNA, 22 bp, Homo sapiens
agagcctgtctgcctttctacc

SEQ ID NO: 7126133 - DNA, 22 bp, Homo sapiens
agagcctgtcaattgtaaagag

SEQ ID NO: 7126134 - DNA, 22 bp, Homo sapiens
agagcctgtcaattgtaaagag

SEQ ID NO: 7126135 - DNA, 22 bp, Homo sapiens
agagcctgtcaattgtaaagag

SEQ ID NO: 7126136 - DNA, 22 bp, Homo sapiens
agagcctggtctgagataggac

SEQ ID NO: 7126137 - DNA, 22 bp, Homo sapiens
agagcctgtaacatctttctta

SEQ ID NO: 7126138 - DNA, 22 bp, Homo sapiens
agagcctgtaacatctttctta

SEQ ID NO: 7126139 - DNA, 22 bp, Homo sapiens
agagcctggttcaaattttacc

SEQ ID NO: 7126140 - DNA, 22 bp, Homo sapiens
agagcctgtacttttctgtgaa

SEQ ID NO: 7126141 - DNA, 22 bp, Homo sapiens
agagccagcaactctagccctg

SEQ ID NO: 7126142 - DNA, 22 bp, Homo sapiens
agagccagcaactctagccctg

SEQ ID NO: 7126143 - DNA, 22 bp, Homo sapiens
agagccagcaactctagccctg

SEQ ID NO: 7126144 - DNA, 22 bp, Homo sapiens
agagccagatggagccgtgtgt

SEQ ID NO: 7126145 - DNA, 22 bp, Homo sapiens
agagccagcaagtgaatagtga

SEQ ID NO: 7126146 - DNA, 22 bp, Homo sapiens
agagccagcaagtgaatagtga

SEQ ID NO: 7126147 - DNA, 22 bp, Homo sapiens
atgtatttgaaatttgagacat

SEQ ID NO: 7126148 - DNA, 22 bp, Homo sapiens
atgtatttgaaatttgagacat

SEQ ID NO: 7126149 - DNA, 22 bp, Homo sapiens
atgtatttgcgaggttaggaaa

SEQ ID NO: 7126150 - DNA, 22 bp, Homo sapiens
atgtatttgcgtatggacatac

SEQ ID NO: 7126151 - DNA, 22 bp, Homo sapiens
atgtatttgcttgttatggatt

SEQ ID NO: 7126152 - DNA, 22 bp, Homo sapiens
atgtatttgcttgttatggatt

SEQ ID NO: 7126153 - DNA, 22 bp, Homo sapiens
atgtattttaagatttgcctca

SEQ ID NO: 7126154 - DNA, 22 bp, Homo sapiens
agagcctggggattggcaaggg

SEQ ID NO: 7126155 - DNA, 22 bp, Homo sapiens
agagcctgggcagctcctctgg

SEQ ID NO: 7126156 - DNA, 22 bp, Homo sapiens
agagcctgggcagctcctctgg

SEQ ID NO: 7126157 - DNA, 22 bp, Homo sapiens
agagcctgcagtggagaccttg

SEQ ID NO: 7126158 - DNA, 22 bp, Homo sapiens
agagcctgcagtggagaccttg

SEQ ID NO: 7126159 - DNA, 22 bp, Homo sapiens
agagcctgcatcaggcttgggg

SEQ ID NO: 7126160 - DNA, 22 bp, Homo sapiens
agagcctggctcccagctaccg

SEQ ID NO: 7126161 - DNA, 22 bp, Homo sapiens
agagcctgggaatttgcatgtt

SEQ ID NO: 7126162 - DNA, 22 bp, Homo sapiens
atgtcaaatcagttttatcaga

SEQ ID NO: 7126163 - DNA, 22 bp, Homo sapiens
agagcctgcagctgtgaagaaa

SEQ ID NO: 7126164 - DNA, 22 bp, Homo sapiens
atgtcaaacacaacaccagtgg

SEQ ID NO: 7126165 - DNA, 22 bp, Homo sapiens
atgtattttaagatttgcctca

SEQ ID NO: 7126166 - DNA, 22 bp, Homo sapiens
atgtattttgccagactgtctc

SEQ ID NO: 7126167 - DNA, 22 bp, Homo sapiens
atgtattttgccagactgtctc

SEQ ID NO: 7126168 - DNA, 22 bp, Homo sapiens
atgtcaaacacaacaccagtgg

SEQ ID NO: 7126169 - DNA, 22 bp, Homo sapiens
agaagtgctccagtgagttggg

SEQ ID NO: 7126170 - DNA, 23 bp, Homo sapiens
agaagtggaatggccgtggggtc

SEQ ID NO: 7126171 - DNA, 23 bp, Homo sapiens
agaagtggaatggccgtggggtc

SEQ ID NO: 7126172 - DNA, 22 bp, Homo sapiens
agaagtgctccagtgagttggg

SEQ ID NO: 7126173 - DNA, 22 bp, Homo sapiens
agaagtgccgaaaggaagacag

SEQ ID NO: 7126174 - DNA, 22 bp, Homo sapiens
agaagtgagtgtgactcagcag

SEQ ID NO: 7126175 - DNA, 22 bp, Homo sapiens
agaagtgaggaaatcctcttta

SEQ ID NO: 7126176 - DNA, 22 bp, Homo sapiens
agaagtgagactcagttgatga

SEQ ID NO: 7126177 - DNA, 22 bp, Homo sapiens
agaagtgagactcagttgatga

SEQ ID NO: 7126178 - DNA, 22 bp, Homo sapiens
agaagtgagtgtgactcagcag

SEQ ID NO: 7126179 - DNA, 22 bp, Homo sapiens
agaagtgagtgtgactcagcag

SEQ ID NO: 7126180 - DNA, 22 bp, Homo sapiens
agaagtgagtgtgactcagcag

SEQ ID NO: 7126181 - DNA, 22 bp, Homo sapiens
agaagtgagttgtgactatggg

SEQ ID NO: 7126182 - DNA, 21 bp, Homo sapiens
agaagtcaattgaactgaaat

SEQ ID NO: 7126183 - DNA, 20 bp, Homo sapiens
agaagtcagctcagaagtga

SEQ ID NO: 7126184 - DNA, 22 bp, Homo sapiens
agaagtctggaattcctgcagg

SEQ ID NO: 7126185 - DNA, 22 bp, Homo sapiens
agaagtctggttgcaaagcgct

SEQ ID NO: 7126186 - DNA, 22 bp, Homo sapiens
agaagtgaaactgcaaaagtgt

SEQ ID NO: 7126187 - DNA, 22 bp, Homo sapiens
agaagtgagactcagttgatga

SEQ ID NO: 7126188 - DNA, 22 bp, Homo sapiens
atctcaggaggaccctgatgct

SEQ ID NO: 7126189 - DNA, 22 bp, Homo sapiens
atctcaggaggaccctgatgct

SEQ ID NO: 7126190 - DNA, 22 bp, Homo sapiens
atctcagaaacatatctaatcc

SEQ ID NO: 7126191 - DNA, 22 bp, Homo sapiens
atctcagaaacatatctaatcc

SEQ ID NO: 7126192 - DNA, 22 bp, Homo sapiens
atctcagaaagtttaatttttc

SEQ ID NO: 7126193 - DNA, 22 bp, Homo sapiens
atctcagacatgttgtccatga

SEQ ID NO: 7126194 - DNA, 22 bp, Homo sapiens
atctcaggaggaccctgatgct

SEQ ID NO: 7126195 - DNA, 22 bp, Homo sapiens
agaaggctggccctgggtggcc

SEQ ID NO: 7126196 - DNA, 22 bp, Homo sapiens
agaagtatttggctaaaagaca

SEQ ID NO: 7126197 - DNA, 22 bp, Homo sapiens
agaagggaactcagagatgatt

SEQ ID NO: 7126198 - DNA, 22 bp, Homo sapiens
agaagggaactcagagatgatt

SEQ ID NO: 7126199 - DNA, 22 bp, Homo sapiens
agaagtatttggctaaaagaca

SEQ ID NO: 7126200 - DNA, 22 bp, Homo sapiens
agaagtcaagtggtctatgaaa

SEQ ID NO: 7126201 - DNA, 22 bp, Homo sapiens
agaagtcaagtggtctatgaaa

SEQ ID NO: 7126202 - DNA, 22 bp, Homo sapiens
agaagtcaatgatgagagtgct

SEQ ID NO: 7126203 - DNA, 22 bp, Homo sapiens
atgaaacatgctttgtggatga

SEQ ID NO: 7126204 - DNA, 22 bp, Homo sapiens
atctttgttatctcagatcttg

SEQ ID NO: 7126205 - DNA, 22 bp, Homo sapiens
atctttgttgctctcatttctg

SEQ ID NO: 7126206 - DNA, 23 bp, Homo sapiens
atgaaactcaagccagatccaag

SEQ ID NO: 7126207 - DNA, 23 bp, Homo sapiens
atgaaactcaagccagatccaag

SEQ ID NO: 7126208 - DNA, 22 bp, Homo sapiens
atgaaactctaacttaacaagt

SEQ ID NO: 7126209 - DNA, 22 bp, Homo sapiens
atgaaactctaacttaacaagt

SEQ ID NO: 7126210 - DNA, 22 bp, Homo sapiens
atgaaactctagctttcagcac

SEQ ID NO: 7126211 - DNA, 22 bp, Homo sapiens
atgaaactgaaggacaaccaga

SEQ ID NO: 7126212 - DNA, 22 bp, Homo sapiens
agaagtttggtcctataaactc

SEQ ID NO: 7126213 - DNA, 22 bp, Homo sapiens
agaagtttgaaattaggagaaa

SEQ ID NO: 7126214 - DNA, 22 bp, Homo sapiens
agaagtttccagtctagtaagg

SEQ ID NO: 7126215 - DNA, 22 bp, Homo sapiens
agaagttgttcaaggtggtgag

SEQ ID NO: 7126216 - DNA, 22 bp, Homo sapiens
agaagttatccaccttagatgc

SEQ ID NO: 7126217 - DNA, 22 bp, Homo sapiens
agaagttatccaccttagatgc

SEQ ID NO: 7126218 - DNA, 23 bp, Homo sapiens
agaagttcaagaccagcctgccc

SEQ ID NO: 7126219 - DNA, 22 bp, Homo sapiens
agaagtgtctcatcaggcaata

SEQ ID NO: 7126220 - DNA, 22 bp, Homo sapiens
agaagtgtggtctagcagtggc

SEQ ID NO: 7126221 - DNA, 22 bp, Homo sapiens
agaagtgtttatttcagcaaca

SEQ ID NO: 7126222 - DNA, 20 bp, Homo sapiens
agaagtggctgcagacacta

SEQ ID NO: 7126223 - DNA, 20 bp, Homo sapiens
agaagtggctgcagacacta

SEQ ID NO: 7126224 - DNA, 22 bp, Homo sapiens
agaagtggtgtgtggccgagct

SEQ ID NO: 7126225 - DNA, 22 bp, Homo sapiens
agaagtggtgtgtggccgagct

SEQ ID NO: 7126226 - DNA, 22 bp, Homo sapiens
agaagtggtgtgtggccgagct

SEQ ID NO: 7126227 - DNA, 22 bp, Homo sapiens
agaagtggtgtgtggccgagct

SEQ ID NO: 7126228 - DNA, 22 bp, Homo sapiens
atgaacaaaaacaaggcctgtt

SEQ ID NO: 7126229 - DNA, 22 bp, Homo sapiens
atgaaattttaattatacctct

SEQ ID NO: 7126230 - DNA, 22 bp, Homo sapiens
atgaaattttaattatacctct

SEQ ID NO: 7126231 - DNA, 22 bp, Homo sapiens
atgaaatttgctgctaagttcc

SEQ ID NO: 7126232 - DNA, 22 bp, Homo sapiens
atgaaatttgctgctaagttcc

SEQ ID NO: 7126233 - DNA, 22 bp, Homo sapiens
atgaacaacttgaagctccatg

SEQ ID NO: 7126234 - DNA, 22 bp, Homo sapiens
atgaacaagtatttgcatgagc

SEQ ID NO: 7126235 - DNA, 22 bp, Homo sapiens
atgaacaataaaatagatcaca

SEQ ID NO: 7126236 - DNA, 22 bp, Homo sapiens
atgaacaataaaatagatcaca

SEQ ID NO: 7126237 - DNA, 22 bp, Homo sapiens
atgaacaataaaatagatcaca

SEQ ID NO: 7126238 - DNA, 22 bp, Homo sapiens
atgaaatttgaccaattattta

SEQ ID NO: 7126239 - DNA, 22 bp, Homo sapiens
atgaaatttgaccaattattta

SEQ ID NO: 7126240 - DNA, 22 bp, Homo sapiens
atgaaatttgaccaattattta

SEQ ID NO: 7126241 - DNA, 22 bp, Homo sapiens
atgaaagtttgcattcctcagt

SEQ ID NO: 7126242 - DNA, 23 bp, Homo sapiens
atgaaagttcttaaaatgtcatg

SEQ ID NO: 7126243 - DNA, 20 bp, Homo sapiens
atgaaattcctgttttctga

SEQ ID NO: 7126244 - DNA, 22 bp, Homo sapiens
atgaaattgatcttgaactttt

SEQ ID NO: 7126245 - DNA, 22 bp, Homo sapiens
atgaaattgatcttgaactttt

SEQ ID NO: 7126246 - DNA, 22 bp, Homo sapiens
atgaaattgatcttgaactttt

SEQ ID NO: 7126247 - DNA, 22 bp, Homo sapiens
atgaaagctcagtgcactgaca

SEQ ID NO: 7126248 - DNA, 22 bp, Homo sapiens
atgaaagcaggaattgttctgt

SEQ ID NO: 7126249 - DNA, 22 bp, Homo sapiens
atgaaagtacctgtaatatgtt

SEQ ID NO: 7126250 - DNA, 22 bp, Homo sapiens
atgaaagtagggtaaaatcaca

SEQ ID NO: 7126251 - DNA, 22 bp, Homo sapiens
atgaaagtacctgtaatatgtt

SEQ ID NO: 7126252 - DNA, 22 bp, Homo sapiens
atgaaagtgaaggtttactaag

SEQ ID NO: 7126253 - DNA, 22 bp, Homo sapiens
atgaaagtgaaggtttactaag

SEQ ID NO: 7126254 - DNA, 22 bp, Homo sapiens
atgaaagtggcttgattaaatg

SEQ ID NO: 7126255 - DNA, 22 bp, Homo sapiens
atgaaagtgtttaagtttatgt

SEQ ID NO: 7126256 - DNA, 22 bp, Homo sapiens
atgaaagtgtttaagtttatgt

SEQ ID NO: 7126257 - DNA, 23 bp, Homo sapiens
atgaaagttcttaaaatgtcatg

SEQ ID NO: 7126258 - DNA, 22 bp, Homo sapiens
atgaaactgaaggacaaccaga

SEQ ID NO: 7126259 - DNA, 22 bp, Homo sapiens
atgaaactgggataactatagc

SEQ ID NO: 7126260 - DNA, 22 bp, Homo sapiens
atgaaagatgatttaaagtact

SEQ ID NO: 7126261 - DNA, 22 bp, Homo sapiens
atgaaagatgatttaaagtact

SEQ ID NO: 7126262 - DNA, 22 bp, Homo sapiens
atgaaagatgatttaaagtact

SEQ ID NO: 7126263 - DNA, 22 bp, Homo sapiens
atgaaagatgatttaaagtact

SEQ ID NO: 7126264 - DNA, 22 bp, Homo sapiens
atgaaagatgatttaaagtact

SEQ ID NO: 7126265 - DNA, 22 bp, Homo sapiens
atgaaagcaaattataggccat

SEQ ID NO: 7126266 - DNA, 22 bp, Homo sapiens
atgaaagcaacttatttgagat

SEQ ID NO: 7126267 - DNA, 22 bp, Homo sapiens
atgaaagcaagaagtgagttga

SEQ ID NO: 7126268 - DNA, 22 bp, Homo sapiens
atgaaagcacgtgggaagataa

SEQ ID NO: 7126269 - DNA, 22 bp, Homo sapiens
agacaaatgaacaaatatgtga

SEQ ID NO: 7126270 - DNA, 22 bp, Homo sapiens
agacaaataagtgctgggattt

SEQ ID NO: 7126271 - DNA, 22 bp, Homo sapiens
agacaaaggattaatgatgatg

SEQ ID NO: 7126272 - DNA, 22 bp, Homo sapiens
agacaaaggattaatgatgatg

SEQ ID NO: 7126273 - DNA, 22 bp, Homo sapiens
agacaaaggattaatgatgatg

SEQ ID NO: 7126274 - DNA, 22 bp, Homo sapiens
agacaaaggattaatgatgatg

SEQ ID NO: 7126275 - DNA, 22 bp, Homo sapiens
agacaaatgaacaaatatgtga

SEQ ID NO: 7126276 - DNA, 22 bp, Homo sapiens
agacaaatggagtatgagcaac

SEQ ID NO: 7126277 - DNA, 22 bp, Homo sapiens
agacaaatggtaattatgtcta

SEQ ID NO: 7126278 - DNA, 22 bp, Homo sapiens
agacaaattgggacattgtgtt

SEQ ID NO: 7126279 - DNA, 22 bp, Homo sapiens
agacaaatttcctgcaatgaag

SEQ ID NO: 7126280 - DNA, 22 bp, Homo sapiens
agacaaatttcctgcaatgaag

SEQ ID NO: 7126281 - DNA, 22 bp, Homo sapiens
atgaacaatctggcaagaactt

SEQ ID NO: 7126282 - DNA, 22 bp, Homo sapiens
atgaacaatctggcaagaactt

SEQ ID NO: 7126283 - DNA, 22 bp, Homo sapiens
atgaacaatctgttgacttctg

SEQ ID NO: 7126284 - DNA, 22 bp, Homo sapiens
atgaacaatgactacatattga

SEQ ID NO: 7126285 - DNA, 22 bp, Homo sapiens
atgaacaataatcatgtctatg

SEQ ID NO: 7126286 - DNA, 22 bp, Homo sapiens
atgaacaatctggcaagaactt

SEQ ID NO: 7126287 - DNA, 22 bp, Homo sapiens
atgaacaatgactacatattga

SEQ ID NO: 7126288 - DNA, 22 bp, Homo sapiens
agacaaaccttgttttatgatg

SEQ ID NO: 7126289 - DNA, 22 bp, Homo sapiens
agacaaaccttgttttatgatg

SEQ ID NO: 7126290 - DNA, 22 bp, Homo sapiens
agacaaaccttgttttatgatg

SEQ ID NO: 7126291 - DNA, 23 bp, Homo sapiens
agacaaacttccttcactgcacc

SEQ ID NO: 7126292 - DNA, 23 bp, Homo sapiens
agacaaacttccttcactgcacc

SEQ ID NO: 7126293 - DNA, 18 bp, Homo sapiens
agacaaacttcttctgcc

SEQ ID NO: 7126294 - DNA, 22 bp, Homo sapiens
agacaaagaaaccgtagaagca

SEQ ID NO: 7126295 - DNA, 22 bp, Homo sapiens
agacaaagaaaccgtagaagca

SEQ ID NO: 7126296 - DNA, 22 bp, Homo sapiens
agacaaagaaaccgtagaagca

SEQ ID NO: 7126297 - DNA, 22 bp, Homo sapiens
agacaaagaaaccgtagaagca

SEQ ID NO: 7126298 - DNA, 22 bp, Homo sapiens
agacaaagacagcatctcaggt

SEQ ID NO: 7126299 - DNA, 22 bp, Homo sapiens
agacaaagacagcatctcaggt

SEQ ID NO: 7126300 - DNA, 22 bp, Homo sapiens
agacaaagacagcatctcaggt

SEQ ID NO: 7126301 - DNA, 22 bp, Homo sapiens
agacaaagacagcatctcaggt

SEQ ID NO: 7126302 - DNA, 22 bp, Homo sapiens
agacaaagacagcatctcaggt

SEQ ID NO: 7126303 - DNA, 20 bp, Homo sapiens
agacaggagcccccattcag

SEQ ID NO: 7126304 - DNA, 22 bp, Homo sapiens
agacaggatgcatactcttggt

SEQ ID NO: 7126305 - DNA, 22 bp, Homo sapiens
agacaggcagaggctgcagagg

SEQ ID NO: 7126306 - DNA, 22 bp, Homo sapiens
agacaggcagaggctgcagagg

SEQ ID NO: 7126307 - DNA, 22 bp, Homo sapiens
agacaggacacaagctgcataa

SEQ ID NO: 7126308 - DNA, 22 bp, Homo sapiens
agacaggacacaagctgcataa

SEQ ID NO: 7126309 - DNA, 22 bp, Homo sapiens
agacaggagagggaactgccgg

SEQ ID NO: 7126310 - DNA, 22 bp, Homo sapiens
agacaggagagggaactgccgg

SEQ ID NO: 7126311 - DNA, 22 bp, Homo sapiens
agacagctgggaaatggagtgt

SEQ ID NO: 7126312 - DNA, 22 bp, Homo sapiens
agacagctgctcgcagagctat

SEQ ID NO: 7126313 - DNA, 22 bp, Homo sapiens
agacatatggtgaaacatttta

SEQ ID NO: 7126314 - DNA, 22 bp, Homo sapiens
agacatattggcttgctttaat

SEQ ID NO: 7126315 - DNA, 22 bp, Homo sapiens
agacatattggcttgctttaat

SEQ ID NO: 7126316 - DNA, 22 bp, Homo sapiens
agacatcaatgatcagaggtag

SEQ ID NO: 7126317 - DNA, 22 bp, Homo sapiens
agacatttattcacacatttat

SEQ ID NO: 7126318 - DNA, 22 bp, Homo sapiens
agacatttattgaacacctagc

SEQ ID NO: 7126319 - DNA, 22 bp, Homo sapiens
agacatttcctagacatcaatg

SEQ ID NO: 7126320 - DNA, 22 bp, Homo sapiens
agacatttcctagacatcaatg

SEQ ID NO: 7126321 - DNA, 22 bp, Homo sapiens
agacatttcctgtgaacctact

SEQ ID NO: 7126322 - DNA, 22 bp, Homo sapiens
agacatttggaagatacacata

SEQ ID NO: 7126323 - DNA, 22 bp, Homo sapiens
agacatttggagccaactttcc

SEQ ID NO: 7126324 - DNA, 22 bp, Homo sapiens
agacatttggagccaactttcc

SEQ ID NO: 7126325 - DNA, 22 bp, Homo sapiens
agacattttaacatctgggttt

SEQ ID NO: 7126326 - DNA, 22 bp, Homo sapiens
agacattttaacatctgggttt

SEQ ID NO: 7126327 - DNA, 23 bp, Homo sapiens
agacattttaataaggacttttt

SEQ ID NO: 7126328 - DNA, 18 bp, Homo sapiens
agacagctgaaaggaaaa

SEQ ID NO: 7126329 - DNA, 22 bp, Homo sapiens
agacagctgctcgcagagctat

SEQ ID NO: 7126330 - DNA, 22 bp, Homo sapiens
agacagctccaagtgtctctgt

SEQ ID NO: 7126331 - DNA, 19 bp, Homo sapiens
agacagctctattattttg

SEQ ID NO: 7126332 - DNA, 22 bp, Homo sapiens
agacagctaataaatgagtgtg

SEQ ID NO: 7126333 - DNA, 22 bp, Homo sapiens
agacagctagggctgcagggac

SEQ ID NO: 7126334 - DNA, 22 bp, Homo sapiens
agacagctagggctgcagggac

SEQ ID NO: 7126335 - DNA, 22 bp, Homo sapiens
agacagctagggctgcagggac

SEQ ID NO: 7126336 - DNA, 22 bp, Homo sapiens
agacagctatcaacaactttct

SEQ ID NO: 7126337 - DNA, 22 bp, Homo sapiens
agacagcatggagctgataaca

SEQ ID NO: 7126338 - DNA, 22 bp, Homo sapiens
agacagcatggagctgataaca

SEQ ID NO: 7126339 - DNA, 22 bp, Homo sapiens
agacagcatttctagcaccagg

SEQ ID NO: 7126340 - DNA, 22 bp, Homo sapiens
agacagcatgatacatgatgct

SEQ ID NO: 7126341 - DNA, 22 bp, Homo sapiens
agacagcatgatacatgatgct

SEQ ID NO: 7126342 - DNA, 22 bp, Homo sapiens
agacagcaggggagtctggttt

SEQ ID NO: 7126343 - DNA, 22 bp, Homo sapiens
agacagcagggagcaggattca

SEQ ID NO: 7126344 - DNA, 22 bp, Homo sapiens
agacagcagggagcaggattca

SEQ ID NO: 7126345 - DNA, 22 bp, Homo sapiens
agacagcagggagcaggattca

SEQ ID NO: 7126346 - DNA, 22 bp, Homo sapiens
agacagcatgagcctgctgatg

SEQ ID NO: 7126347 - DNA, 22 bp, Homo sapiens
agacagcatgagcctgctgatg

SEQ ID NO: 7126348 - DNA, 22 bp, Homo sapiens
agacagcatgatacatgatgct

SEQ ID NO: 7126349 - DNA, 22 bp, Homo sapiens
agacagcatgatacatgatgct

SEQ ID NO: 7126350 - DNA, 22 bp, Homo sapiens
agacagcatgatacatgatgct

SEQ ID NO: 7126351 - DNA, 22 bp, Homo sapiens
agacagactggtttgaattggt

SEQ ID NO: 7126352 - DNA, 22 bp, Homo sapiens
agacagactggtttgaattggt

SEQ ID NO: 7126353 - DNA, 22 bp, Homo sapiens
agacagactgtgtttgaatcct

SEQ ID NO: 7126354 - DNA, 22 bp, Homo sapiens
agacagacttgaaaatgttctt

SEQ ID NO: 7126355 - DNA, 22 bp, Homo sapiens
agacagacttgaaaatgttctt

SEQ ID NO: 7126356 - DNA, 22 bp, Homo sapiens
agacagacttgaaaatgttctt

SEQ ID NO: 7126357 - DNA, 22 bp, Homo sapiens
agacagactttgatctggatgt

SEQ ID NO: 7126358 - DNA, 22 bp, Homo sapiens
agacagcagaaactagagcact

SEQ ID NO: 7126359 - DNA, 22 bp, Homo sapiens
agacagcagcagaggggctccc

SEQ ID NO: 7126360 - DNA, 22 bp, Homo sapiens
agacagcagggagcaggattca

SEQ ID NO: 7126361 - DNA, 22 bp, Homo sapiens
atgcacctgaactccatcagct

SEQ ID NO: 7126362 - DNA, 22 bp, Homo sapiens
atgcacctgaactccatcagct

SEQ ID NO: 7126363 - DNA, 22 bp, Homo sapiens
atgcacctgaactccatcagct

SEQ ID NO: 7126364 - DNA, 22 bp, Homo sapiens
atgcacctgaactccatcagct

SEQ ID NO: 7126365 - DNA, 22 bp, Homo sapiens
atgcactacttggctttactga

SEQ ID NO: 7126366 - DNA, 22 bp, Homo sapiens
atgcactatgatgagctagtct

SEQ ID NO: 7126367 - DNA, 22 bp, Homo sapiens
atgcactgggccacagtatgac

SEQ ID NO: 7126368 - DNA, 22 bp, Homo sapiens
atgcactgggtgaggaaggaga

SEQ ID NO: 7126369 - DNA, 22 bp, Homo sapiens
atgcactgggtgaggaaggaga

SEQ ID NO: 7126370 - DNA, 22 bp, Homo sapiens
atgcactgtaagactagccatg

SEQ ID NO: 7126371 - DNA, 22 bp, Homo sapiens
atgcactgtaggtgccatctgc

SEQ ID NO: 7126372 - DNA, 22 bp, Homo sapiens
atgcacatgtatctatatacaa

SEQ ID NO: 7126373 - DNA, 22 bp, Homo sapiens
atgcacatgtatgtcaatattt

SEQ ID NO: 7126374 - DNA, 22 bp, Homo sapiens
atgcacatgtatgtcaatattt

SEQ ID NO: 7126375 - DNA, 22 bp, Homo sapiens
atgcacatgaggcaagcaaaat

SEQ ID NO: 7126376 - DNA, 22 bp, Homo sapiens
atgcacatgaggcaagcaaaat

SEQ ID NO: 7126377 - DNA, 17 bp, Homo sapiens
atgcacatgtaagagga

SEQ ID NO: 7126378 - DNA, 22 bp, Homo sapiens
atgcacatgtatgtcaatattt

SEQ ID NO: 7126379 - DNA, 22 bp, Homo sapiens
atgcacatgtggctttatgtat

SEQ ID NO: 7126380 - DNA, 22 bp, Homo sapiens
atgcacatgtggctttatgtat

SEQ ID NO: 7126381 - DNA, 22 bp, Homo sapiens
atgcacattgtagccacacaat

SEQ ID NO: 7126382 - DNA, 22 bp, Homo sapiens
atgcacattgtagccacacaat

SEQ ID NO: 7126383 - DNA, 22 bp, Homo sapiens
agacagactggtttgaattggt

SEQ ID NO: 7126384 - DNA, 22 bp, Homo sapiens
agacagactggtttgaattggt

SEQ ID NO: 7126385 - DNA, 21 bp, Homo sapiens
agacagactgcctgacccacg

SEQ ID NO: 7126386 - DNA, 21 bp, Homo sapiens
agacagactgcctgacccacg

SEQ ID NO: 7126387 - DNA, 22 bp, Homo sapiens
agacagacgtagtgtgagagta

SEQ ID NO: 7126388 - DNA, 22 bp, Homo sapiens
agacagacggctttatacacag

SEQ ID NO: 7126389 - DNA, 22 bp, Homo sapiens
agacagacgtagtgtgagagta

SEQ ID NO: 7126390 - DNA, 22 bp, Homo sapiens
agacagacgtagtgtgagagta

SEQ ID NO: 7126391 - DNA, 17 bp, Homo sapiens
agacagacctctgcatc

SEQ ID NO: 7126392 - DNA, 17 bp, Homo sapiens
agacagacctctgcatc

SEQ ID NO: 7126393 - DNA, 17 bp, Homo sapiens
agacagacctctgcatc

SEQ ID NO: 7126394 - DNA, 17 bp, Homo sapiens
agacagacctctgcatc

SEQ ID NO: 7126395 - DNA, 22 bp, Homo sapiens
agacagacggctttatacacag

SEQ ID NO: 7126396 - DNA, 22 bp, Homo sapiens
agacagacggctttatacacag

SEQ ID NO: 7126397 - DNA, 22 bp, Homo sapiens
agacagaccatggctattcaga

SEQ ID NO: 7126398 - DNA, 22 bp, Homo sapiens
agacagaccatggctattcaga

SEQ ID NO: 7126399 - DNA, 22 bp, Homo sapiens
agacagacattctagagccacc

SEQ ID NO: 7126400 - DNA, 22 bp, Homo sapiens
agacagacattctagagccacc

SEQ ID NO: 7126401 - DNA, 22 bp, Homo sapiens
agacagacattctagagccacc

SEQ ID NO: 7126402 - DNA, 22 bp, Homo sapiens
agacagacatgctagttttctt

SEQ ID NO: 7126403 - DNA, 22 bp, Homo sapiens
agacagacatagaaattagtaa

SEQ ID NO: 7126404 - DNA, 22 bp, Homo sapiens
agacagacatgctagttttctt

SEQ ID NO: 7126405 - DNA, 22 bp, Homo sapiens
atgcactgtgagagtgaggggt

SEQ ID NO: 7126406 - DNA, 22 bp, Homo sapiens
atgcactgtgagagtgaggggt

SEQ ID NO: 7126407 - DNA, 22 bp, Homo sapiens
atgcactgttggatatatttgt

SEQ ID NO: 7126408 - DNA, 22 bp, Homo sapiens
atgcactgttggatatatttgt

SEQ ID NO: 7126409 - DNA, 22 bp, Homo sapiens
atgcacttaaataacataactt

SEQ ID NO: 7126410 - DNA, 22 bp, Homo sapiens
atgcacataggccaaatcattt

SEQ ID NO: 7126411 - DNA, 22 bp, Homo sapiens
atgcacataggccaaatcattt

SEQ ID NO: 7126412 - DNA, 22 bp, Homo sapiens
atgcacatcactctgaagaaaa

SEQ ID NO: 7126413 - DNA, 22 bp, Homo sapiens
atgcacatcttacagatgcaga

SEQ ID NO: 7126414 - DNA, 22 bp, Homo sapiens
atgcacatcttacagatgcaga

SEQ ID NO: 7126415 - DNA, 19 bp, Homo sapiens
atgcacagtcatttgtaag

SEQ ID NO: 7126416 - DNA, 22 bp, Homo sapiens
atgcacatacatatgctctata

SEQ ID NO: 7126417 - DNA, 20 bp, Homo sapiens
atgcacatacgcatgcacat

SEQ ID NO: 7126418 - DNA, 20 bp, Homo sapiens
atgcacatacgcatgcacat

SEQ ID NO: 7126419 - DNA, 22 bp, Homo sapiens
atgacaaattcagaccatagca

SEQ ID NO: 7126420 - DNA, 22 bp, Homo sapiens
atgacaaattcagaccatagca

SEQ ID NO: 7126421 - DNA, 22 bp, Homo sapiens
atgacaacacatggtgctgaat

SEQ ID NO: 7126422 - DNA, 22 bp, Homo sapiens
atgacaagagtgttcagggaga

SEQ ID NO: 7126423 - DNA, 22 bp, Homo sapiens
atgacaagggagggtcctgcta

SEQ ID NO: 7126424 - DNA, 22 bp, Homo sapiens
atgacaagggttgacacatgtc

SEQ ID NO: 7126425 - DNA, 22 bp, Homo sapiens
atgacaagggttgacacatgtc

SEQ ID NO: 7126426 - DNA, 22 bp, Homo sapiens
atgacaaattcagaccatagca

SEQ ID NO: 7126427 - DNA, 22 bp, Homo sapiens
atgacaaattcagaccatagca

SEQ ID NO: 7126428 - DNA, 22 bp, Homo sapiens
atgacaaaggctgaaagggaaa

SEQ ID NO: 7126429 - DNA, 22 bp, Homo sapiens
atgacaaacccaggatgtaaca

SEQ ID NO: 7126430 - DNA, 22 bp, Homo sapiens
atgacaaaggctgaaagggaaa

SEQ ID NO: 7126431 - DNA, 22 bp, Homo sapiens
atgacaaaggctgaaagggaaa

SEQ ID NO: 7126432 - DNA, 22 bp, Homo sapiens
atgacaaaattcacaggtgtga

SEQ ID NO: 7126433 - DNA, 23 bp, Homo sapiens
atgacaaacaggacatcttgtgc

SEQ ID NO: 7126434 - DNA, 23 bp, Homo sapiens
atgacaaacaggacatcttgtgc

SEQ ID NO: 7126435 - DNA, 23 bp, Homo sapiens
atgacaaacaggacatcttgtgc

SEQ ID NO: 7126436 - DNA, 23 bp, Homo sapiens
atgacaaacaggacatcttgtgc

SEQ ID NO: 7126437 - DNA, 22 bp, Homo sapiens
atgacaaacccaggatgtaaca

SEQ ID NO: 7126438 - DNA, 22 bp, Homo sapiens
atgacaaaatgaatgcagctag

SEQ ID NO: 7126439 - DNA, 22 bp, Homo sapiens
atgacaaaataaatggtctctg

SEQ ID NO: 7126440 - DNA, 22 bp, Homo sapiens
atgacaaaataaatggtctctg

SEQ ID NO: 7126441 - DNA, 22 bp, Homo sapiens
atgacaaaataaatggtctctg

SEQ ID NO: 7126442 - DNA, 22 bp, Homo sapiens
atgacaaaatgaatgcagctag

SEQ ID NO: 7126443 - DNA, 22 bp, Homo sapiens
atgacaaaattcacaggtgtga

SEQ ID NO: 7126444 - DNA, 22 bp, Homo sapiens
atgacaaaatgaatgcagctag

SEQ ID NO: 7126445 - DNA, 22 bp, Homo sapiens
atgacaaaagaagacatgaggt

SEQ ID NO: 7126446 - DNA, 22 bp, Homo sapiens
atgacaaaagaagacatgaggt

SEQ ID NO: 7126447 - DNA, 22 bp, Homo sapiens
atgacaaaagaagacatgaggt

SEQ ID NO: 7126448 - DNA, 22 bp, Homo sapiens
atgacaaaagaagacatgaggt

SEQ ID NO: 7126449 - DNA, 22 bp, Homo sapiens
atgacaaaagaagacatgaggt

SEQ ID NO: 7126450 - DNA, 18 bp, Homo sapiens
agggagagaccgcgggtc

SEQ ID NO: 7126451 - DNA, 18 bp, Homo sapiens
agggagagaccgcgggtc

SEQ ID NO: 7126452 - DNA, 18 bp, Homo sapiens
agggagagaccgcgggtc

SEQ ID NO: 7126453 - DNA, 22 bp, Homo sapiens
agggagagacatttccttcttg

SEQ ID NO: 7126454 - DNA, 22 bp, Homo sapiens
agggagagacatttccttcttg

SEQ ID NO: 7126455 - DNA, 22 bp, Homo sapiens
agggagagaagttatacaagat

SEQ ID NO: 7126456 - DNA, 22 bp, Homo sapiens
agggagagaagttatacaagat

SEQ ID NO: 7126457 - DNA, 22 bp, Homo sapiens
agggagagaagttatacaagat

SEQ ID NO: 7126458 - DNA, 22 bp, Homo sapiens
agggagagaagttatacaagat

SEQ ID NO: 7126459 - DNA, 22 bp, Homo sapiens
agggagagacatttccttcttg

SEQ ID NO: 7126460 - DNA, 22 bp, Homo sapiens
agggagagacatttccttcttg

SEQ ID NO: 7126461 - DNA, 22 bp, Homo sapiens
agggagagacatttccttcttg

SEQ ID NO: 7126462 - DNA, 18 bp, Homo sapiens
agggagagaccgcgggtc

SEQ ID NO: 7126463 - DNA, 18 bp, Homo sapiens
agggagagaccgcgggtc

SEQ ID NO: 7126464 - DNA, 16 bp, Homo sapiens
agggagagaggaacat

SEQ ID NO: 7126465 - DNA, 16 bp, Homo sapiens
agggagagaggaacat

SEQ ID NO: 7126466 - DNA, 16 bp, Homo sapiens
agggagagaggaacat

SEQ ID NO: 7126467 - DNA, 16 bp, Homo sapiens
agggagagaggaacat

SEQ ID NO: 7126468 - DNA, 22 bp, Homo sapiens
agggagaggagcgtttcacatc

SEQ ID NO: 7126469 - DNA, 22 bp, Homo sapiens
agggagaggagcgtttcacatc

SEQ ID NO: 7126470 - DNA, 22 bp, Homo sapiens
agggagaggagcgtttcacatc

SEQ ID NO: 7126471 - DNA, 22 bp, Homo sapiens
agggagaggagcgtttcacatc

SEQ ID NO: 7126472 - DNA, 22 bp, Homo sapiens
agggagaggagcgtttcacatc

SEQ ID NO: 7126473 - DNA, 22 bp, Homo sapiens
agggagaggagggtcttgttga

SEQ ID NO: 7126474 - DNA, 22 bp, Homo sapiens
agggagaggagggtcttgttga

SEQ ID NO: 7126475 - DNA, 22 bp, Homo sapiens
agggagaggagggtcttgttga

SEQ ID NO: 7126476 - DNA, 22 bp, Homo sapiens
agggagaggagggtcttgttga

SEQ ID NO: 7126477 - DNA, 22 bp, Homo sapiens
agggagaggctgaactatccta

SEQ ID NO: 7126478 - DNA, 22 bp, Homo sapiens
accagcctggccaacatggcaa

SEQ ID NO: 7126479 - DNA, 22 bp, Homo sapiens
accagcctggccaacatggcaa

SEQ ID NO: 7126480 - DNA, 22 bp, Homo sapiens
accagcctggccaacatggcaa

SEQ ID NO: 7126481 - DNA, 22 bp, Homo sapiens
accagcctggccaacatggcaa

SEQ ID NO: 7126482 - DNA, 22 bp, Homo sapiens
accagccctcaggtcagatact

SEQ ID NO: 7126483 - DNA, 22 bp, Homo sapiens
accagcctcctagctgctcctg

SEQ ID NO: 7126484 - DNA, 17 bp, Homo sapiens
accagcctctcctgggg

SEQ ID NO: 7126485 - DNA, 17 bp, Homo sapiens
accagcctctcctgggg

SEQ ID NO: 7126486 - DNA, 22 bp, Homo sapiens
accagcctggccaacatggtga

SEQ ID NO: 7126487 - DNA, 22 bp, Homo sapiens
accagcctggccaacatggtga

SEQ ID NO: 7126488 - DNA, 22 bp, Homo sapiens
accagcctgtctgagtcgtggg

SEQ ID NO: 7126489 - DNA, 22 bp, Homo sapiens
accagcctgtctgagtcgtggg

SEQ ID NO: 7126490 - DNA, 22 bp, Homo sapiens
accagcctgtctgagtcgtggg

SEQ ID NO: 7126491 - DNA, 22 bp, Homo sapiens
accagctagggtagcacatctc

SEQ ID NO: 7126492 - DNA, 22 bp, Homo sapiens
accagctagggtagcacatctc

SEQ ID NO: 7126493 - DNA, 22 bp, Homo sapiens
accagctcagaagccagaaaga

SEQ ID NO: 7126494 - DNA, 22 bp, Homo sapiens
accagctcagaagccagaaaga

SEQ ID NO: 7126495 - DNA, 22 bp, Homo sapiens
accagctcagagcaggctcctg

SEQ ID NO: 7126496 - DNA, 22 bp, Homo sapiens
accagctcagagcaggctcctg

SEQ ID NO: 7126497 - DNA, 22 bp, Homo sapiens
accagctcagagcaggctcctg

SEQ ID NO: 7126498 - DNA, 22 bp, Homo sapiens
accagctcagagcaggctcctg

SEQ ID NO: 7126499 - DNA, 22 bp, Homo sapiens
accagctcataattttcaaaac

SEQ ID NO: 7126500 - DNA, 22 bp, Homo sapiens
agggcagcaatgcagctgctgc

SEQ ID NO: 7126501 - DNA, 22 bp, Homo sapiens
agggcagcaatgcagctgctgc

SEQ ID NO: 7126502 - DNA, 22 bp, Homo sapiens
agggcagcaatgcagctgctgc

SEQ ID NO: 7126503 - DNA, 22 bp, Homo sapiens
agggcagcaatgcagctgctgc

SEQ ID NO: 7126504 - DNA, 22 bp, Homo sapiens
agggcagatggaacttccccga

SEQ ID NO: 7126505 - DNA, 21 bp, Homo sapiens
agggcagattagctgtaagag

SEQ ID NO: 7126506 - DNA, 22 bp, Homo sapiens
agggcagcaaagtttgacctca

SEQ ID NO: 7126507 - DNA, 22 bp, Homo sapiens
agggcagcaaagtttgacctca

SEQ ID NO: 7126508 - DNA, 22 bp, Homo sapiens
agggcacttgaggctgggcctg

SEQ ID NO: 7126509 - DNA, 22 bp, Homo sapiens
agggcacttcctctgggtccct

SEQ ID NO: 7126510 - DNA, 22 bp, Homo sapiens
agggcacttcctctgggtccct

SEQ ID NO: 7126511 - DNA, 22 bp, Homo sapiens
accagctctctagccctggtcc

SEQ ID NO: 7126512 - DNA, 22 bp, Homo sapiens
agggcacttcagtcagactgag

SEQ ID NO: 7126513 - DNA, 22 bp, Homo sapiens
accagctctggacaggcatttc

SEQ ID NO: 7126514 - DNA, 22 bp, Homo sapiens
accagctctggacaggcatttc

SEQ ID NO: 7126515 - DNA, 22 bp, Homo sapiens
accagctcttctgctctagttg

SEQ ID NO: 7126516 - DNA, 22 bp, Homo sapiens
accagctcttctgctctagttg

SEQ ID NO: 7126517 - DNA, 22 bp, Homo sapiens
accagctcataattttcaaaac

SEQ ID NO: 7126518 - DNA, 22 bp, Homo sapiens
accagctccaggcccctgctga

SEQ ID NO: 7126519 - DNA, 22 bp, Homo sapiens
accagctcagagcaggctcctg

SEQ ID NO: 7126520 - DNA, 22 bp, Homo sapiens
accagctccaggcccctgctga

SEQ ID NO: 7126521 - DNA, 22 bp, Homo sapiens
accagctccaggcccctgctga

SEQ ID NO: 7126522 - DNA, 22 bp, Homo sapiens
accagctccaggcccctgctga

SEQ ID NO: 7126523 - DNA, 22 bp, Homo sapiens
accagctccaggcccctgctgg

SEQ ID NO: 7126524 - DNA, 22 bp, Homo sapiens
accagctccaggcccctgctgg

SEQ ID NO: 7126525 - DNA, 22 bp, Homo sapiens
accagctccaggcccctgctgg

SEQ ID NO: 7126526 - DNA, 22 bp, Homo sapiens
accagctccaggcccctgctgg

SEQ ID NO: 7126527 - DNA, 22 bp, Homo sapiens
accagctctctagccctggtcc

SEQ ID NO: 7126528 - DNA, 22 bp, Homo sapiens
accagctctctagccctggtcc

SEQ ID NO: 7126529 - DNA, 22 bp, Homo sapiens
accagctctctagccctggtcc

SEQ ID NO: 7126530 - DNA, 22 bp, Homo sapiens
accagctctctagccctggtcc

SEQ ID NO: 7126531 - DNA, 22 bp, Homo sapiens
accagctctctagccctggtcc

SEQ ID NO: 7126532 - DNA, 22 bp, Homo sapiens
accagctctggacaggcatttc

SEQ ID NO: 7126533 - DNA, 22 bp, Homo sapiens
accagctctggacaggcatttc

SEQ ID NO: 7126534 - DNA, 22 bp, Homo sapiens
agggcagcacaaggcatggact

SEQ ID NO: 7126535 - DNA, 22 bp, Homo sapiens
agggcagcacagctgtgctcct

SEQ ID NO: 7126536 - DNA, 22 bp, Homo sapiens
agggcagcacaaggcatggact

SEQ ID NO: 7126537 - DNA, 22 bp, Homo sapiens
agggcagcacaaggcatggact

SEQ ID NO: 7126538 - DNA, 22 bp, Homo sapiens
agggcagcacaaggcatggact

SEQ ID NO: 7126539 - DNA, 22 bp, Homo sapiens
agggcagcacaaggcatggact

SEQ ID NO: 7126540 - DNA, 22 bp, Homo sapiens
agggcagcacaaggcatggact

SEQ ID NO: 7126541 - DNA, 22 bp, Homo sapiens
agggcagcacaaggcatggact

SEQ ID NO: 7126542 - DNA, 22 bp, Homo sapiens
agggcagcacaaggcatggact

SEQ ID NO: 7126543 - DNA, 22 bp, Homo sapiens
agggcagcaatttggttcctgg

SEQ ID NO: 7126544 - DNA, 22 bp, Homo sapiens
agggcagcaatgcagctgctgc

SEQ ID NO: 7126545 - DNA, 22 bp, Homo sapiens
agggcagcagcggcccaggcct

SEQ ID NO: 7126546 - DNA, 22 bp, Homo sapiens
agggcagcagcggcccaggcct

SEQ ID NO: 7126547 - DNA, 22 bp, Homo sapiens
agggcagcagcggcccaggcct

SEQ ID NO: 7126548 - DNA, 22 bp, Homo sapiens
agggcagcagctcctcctagct

SEQ ID NO: 7126549 - DNA, 22 bp, Homo sapiens
agggcagcagctcctcctagct

SEQ ID NO: 7126550 - DNA, 19 bp, Homo sapiens
accaggcctcagaggccct

SEQ ID NO: 7126551 - DNA, 19 bp, Homo sapiens
accaggcctcagaggccct

SEQ ID NO: 7126552 - DNA, 22 bp, Homo sapiens
agggcagcagcccatggctctg

SEQ ID NO: 7126553 - DNA, 22 bp, Homo sapiens
agggcagcagcccatggctctg

SEQ ID NO: 7126554 - DNA, 22 bp, Homo sapiens
agggcagcagcccatggctctg

SEQ ID NO: 7126555 - DNA, 22 bp, Homo sapiens
agggacagtatccatctcacag

SEQ ID NO: 7126556 - DNA, 22 bp, Homo sapiens
agggacagtctactgttcactg

SEQ ID NO: 7126557 - DNA, 21 bp, Homo sapiens
aggctttacctctgggtaggt

SEQ ID NO: 7126558 - DNA, 22 bp, Homo sapiens
aggctttaagtggcctacagct

SEQ ID NO: 7126559 - DNA, 22 bp, Homo sapiens
aggctttaattatctacaggag

SEQ ID NO: 7126560 - DNA, 22 bp, Homo sapiens
aggcttgtggattggagcgagt

SEQ ID NO: 7126561 - DNA, 19 bp, Homo sapiens
agggagaattccaagagga

SEQ ID NO: 7126562 - DNA, 22 bp, Homo sapiens
agggagacaaaagcagctgcca

SEQ ID NO: 7126563 - DNA, 19 bp, Homo sapiens
agggagaattccaagagga

SEQ ID NO: 7126564 - DNA, 22 bp, Homo sapiens
agggagacaaaagcagctgcca

SEQ ID NO: 7126565 - DNA, 22 bp, Homo sapiens
agggagacaaaagcagctgcca

SEQ ID NO: 7126566 - DNA, 22 bp, Homo sapiens
agggagacacatgaggaagtca

SEQ ID NO: 7126567 - DNA, 22 bp, Homo sapiens
agggagacacatgaggaagtca

SEQ ID NO: 7126568 - DNA, 22 bp, Homo sapiens
agggagacacatgaggaagtca

SEQ ID NO: 7126569 - DNA, 22 bp, Homo sapiens
agggagagaagttatacaagat

SEQ ID NO: 7126570 - DNA, 22 bp, Homo sapiens
agggagagaagttatacaagat

SEQ ID NO: 7126571 - DNA, 22 bp, Homo sapiens
agggagacacatgaggaagtca

SEQ ID NO: 7126572 - DNA, 20 bp, Homo sapiens
aggcttggcttggcaggaac

SEQ ID NO: 7126573 - DNA, 20 bp, Homo sapiens
aggcttggcttggcaggaac

SEQ ID NO: 7126574 - DNA, 22 bp, Homo sapiens
accagccccaccgggactgcag

SEQ ID NO: 7126575 - DNA, 22 bp, Homo sapiens
accagccccaccgggactgcag

SEQ ID NO: 7126576 - DNA, 22 bp, Homo sapiens
accagccccaccgggactgcag

SEQ ID NO: 7126577 - DNA, 22 bp, Homo sapiens
accagccccaccgggactgcag

SEQ ID NO: 7126578 - DNA, 21 bp, Homo sapiens
aggcttgggtaaaaaggtcat

SEQ ID NO: 7126579 - DNA, 19 bp, Homo sapiens
aggcttggttgcagcaagc

SEQ ID NO: 7126580 - DNA, 22 bp, Homo sapiens
aggcttgtcagaatggattaga

SEQ ID NO: 7126581 - DNA, 22 bp, Homo sapiens
accagagctggctctgagcacc

SEQ ID NO: 7126582 - DNA, 22 bp, Homo sapiens
acatttgtctggctagaaagtt

SEQ ID NO: 7126583 - DNA, 22 bp, Homo sapiens
acatttgtctggctagaaagtt

SEQ ID NO: 7126584 - DNA, 22 bp, Homo sapiens
acatttgtatgcgtttttactg

SEQ ID NO: 7126585 - DNA, 22 bp, Homo sapiens
acatttgtatttggtgagtggt

SEQ ID NO: 7126586 - DNA, 19 bp, Homo sapiens
acatttgtcaagagaaggt

SEQ ID NO: 7126587 - DNA, 22 bp, Homo sapiens
acatttgtacattggcatgtct

SEQ ID NO: 7126588 - DNA, 22 bp, Homo sapiens
accagagctggcagagtatcaa

SEQ ID NO: 7126589 - DNA, 22 bp, Homo sapiens
accagcagctgccagagtggag

SEQ ID NO: 7126590 - DNA, 22 bp, Homo sapiens
accagcagctgcgggccactgc

SEQ ID NO: 7126591 - DNA, 21 bp, Homo sapiens
accagcaggagatcagaagga

SEQ ID NO: 7126592 - DNA, 22 bp, Homo sapiens
accagcaggccaggggcactgc

SEQ ID NO: 7126593 - DNA, 22 bp, Homo sapiens
accagcaggccaggggcactgc

SEQ ID NO: 7126594 - DNA, 22 bp, Homo sapiens
accagcagggctgggccaatgg

SEQ ID NO: 7126595 - DNA, 22 bp, Homo sapiens
accagcagttatgaggccagga

SEQ ID NO: 7126596 - DNA, 22 bp, Homo sapiens
accagcagttatgaggccagga

SEQ ID NO: 7126597 - DNA, 22 bp, Homo sapiens
accagcagttatgaggccagga

SEQ ID NO: 7126598 - DNA, 22 bp, Homo sapiens
accagcagttatgaggccagga

SEQ ID NO: 7126599 - DNA, 22 bp, Homo sapiens
accagcagttatgaggccagga

SEQ ID NO: 7126600 - DNA, 21 bp, Homo sapiens
accagcattccacactgtccc

SEQ ID NO: 7126601 - DNA, 22 bp, Homo sapiens
accagcattggacttagaatgc

SEQ ID NO: 7126602 - DNA, 22 bp, Homo sapiens
accagccaagactgcctggaat

SEQ ID NO: 7126603 - DNA, 22 bp, Homo sapiens
accagccaagactgcctggaat

SEQ ID NO: 7126604 - DNA, 22 bp, Homo sapiens
accagccaccaccaggagatcg

SEQ ID NO: 7126605 - DNA, 22 bp, Homo sapiens
accagccaccaccaggagatcg

SEQ ID NO: 7126606 - DNA, 22 bp, Homo sapiens
accagccagccacagtggctcc

SEQ ID NO: 7126607 - DNA, 19 bp, Homo sapiens
accagcccactcccagttt

SEQ ID NO: 7126608 - DNA, 19 bp, Homo sapiens
accagcccactcccagttt

SEQ ID NO: 7126609 - DNA, 22 bp, Homo sapiens
agggggaggctgtgctgcgtct

SEQ ID NO: 7126610 - DNA, 22 bp, Homo sapiens
agggggagcttggctactcctg

SEQ ID NO: 7126611 - DNA, 22 bp, Homo sapiens
aggggcctggcactgagctggc

SEQ ID NO: 7126612 - DNA, 22 bp, Homo sapiens
aggggcctggttggcctctgtt

SEQ ID NO: 7126613 - DNA, 22 bp, Homo sapiens
aggggcctggttggcctctgtt

SEQ ID NO: 7126614 - DNA, 22 bp, Homo sapiens
agggggaggctgtgctgcgtct

SEQ ID NO: 7126615 - DNA, 22 bp, Homo sapiens
agggggaggctgtgctgcgtct

SEQ ID NO: 7126616 - DNA, 22 bp, Homo sapiens
agggggaggctgtgctgcgtct

SEQ ID NO: 7126617 - DNA, 22 bp, Homo sapiens
acccaggctggcgtgcagtggc

SEQ ID NO: 7126618 - DNA, 22 bp, Homo sapiens
aggggcctggacatggacgcgc

SEQ ID NO: 7126619 - DNA, 22 bp, Homo sapiens
aggggcctggcactgagctggc

SEQ ID NO: 7126620 - DNA, 22 bp, Homo sapiens
aggggcctggcactgagctggc

SEQ ID NO: 7126621 - DNA, 22 bp, Homo sapiens
agggggcaggagagacctgctg

SEQ ID NO: 7126622 - DNA, 22 bp, Homo sapiens
agggggagtttcagttagaaag

SEQ ID NO: 7126623 - DNA, 22 bp, Homo sapiens
agggggagtttcagttagaaag

SEQ ID NO: 7126624 - DNA, 22 bp, Homo sapiens
agggggcaggagagacctgctg

SEQ ID NO: 7126625 - DNA, 22 bp, Homo sapiens
agggggcaggagagacctgctg

SEQ ID NO: 7126626 - DNA, 22 bp, Homo sapiens
agggggcaggagagacctgctg

SEQ ID NO: 7126627 - DNA, 22 bp, Homo sapiens
agggggcaggagagacctgctg

SEQ ID NO: 7126628 - DNA, 22 bp, Homo sapiens
agggggcaggagagacctgctg

SEQ ID NO: 7126629 - DNA, 22 bp, Homo sapiens
agggggcatcaggtcctggctc

SEQ ID NO: 7126630 - DNA, 22 bp, Homo sapiens
agggggcatcaggtcctggctc

SEQ ID NO: 7126631 - DNA, 22 bp, Homo sapiens
agggggcatcaggtcctggctc

SEQ ID NO: 7126632 - DNA, 22 bp, Homo sapiens
agggggctcagtgactgaagtg

SEQ ID NO: 7126633 - DNA, 22 bp, Homo sapiens
agggggctcagtgactgaagtg

SEQ ID NO: 7126634 - DNA, 22 bp, Homo sapiens
agggggctcagtgactgaagtg

SEQ ID NO: 7126635 - DNA, 22 bp, Homo sapiens
agggggctcctccggtgcttcc

SEQ ID NO: 7126636 - DNA, 22 bp, Homo sapiens
accctcagtaatcgtgcagttt

SEQ ID NO: 7126637 - DNA, 22 bp, Homo sapiens
accctccactttatctgtcttt

SEQ ID NO: 7126638 - DNA, 22 bp, Homo sapiens
accctccactttatctgtcttt

SEQ ID NO: 7126639 - DNA, 22 bp, Homo sapiens
accctccaggcgggcttgtgac

SEQ ID NO: 7126640 - DNA, 22 bp, Homo sapiens
agggggctcagcatggatggag

SEQ ID NO: 7126641 - DNA, 22 bp, Homo sapiens
agggggctcagcatggatggag

SEQ ID NO: 7126642 - DNA, 22 bp, Homo sapiens
agggggctcagcatggatggag

SEQ ID NO: 7126643 - DNA, 22 bp, Homo sapiens
agggggctcagcaggctctgga

SEQ ID NO: 7126644 - DNA, 22 bp, Homo sapiens
agggggctcagcatggatggag

SEQ ID NO: 7126645 - DNA, 22 bp, Homo sapiens
agggggctcagcatggatggag

SEQ ID NO: 7126646 - DNA, 22 bp, Homo sapiens
agggggctcagcaggctctgga

SEQ ID NO: 7126647 - DNA, 22 bp, Homo sapiens
agggggctcagcaggctctgga

SEQ ID NO: 7126648 - DNA, 22 bp, Homo sapiens
agggggcccttgcaggtgagcg

SEQ ID NO: 7126649 - DNA, 22 bp, Homo sapiens
agggggcccttgcaggtgagcg

SEQ ID NO: 7126650 - DNA, 22 bp, Homo sapiens
agggggcccttgcaggtgagcg

SEQ ID NO: 7126651 - DNA, 22 bp, Homo sapiens
agggggcccttgcaggtgagcg

SEQ ID NO: 7126652 - DNA, 22 bp, Homo sapiens
agggggcattatgaggcttttc

SEQ ID NO: 7126653 - DNA, 22 bp, Homo sapiens
acccaggctggcagaggctcct

SEQ ID NO: 7126654 - DNA, 22 bp, Homo sapiens
acccaggctggagtgcagtgtc

SEQ ID NO: 7126655 - DNA, 22 bp, Homo sapiens
acccaggctggagtgcagtggt

SEQ ID NO: 7126656 - DNA, 22 bp, Homo sapiens
acccaggctggagtgcagtggg

SEQ ID NO: 7126657 - DNA, 22 bp, Homo sapiens
acccaggctggagtgcagtggc

SEQ ID NO: 7126658 - DNA, 22 bp, Homo sapiens
agggctgcctgactccagagcc

SEQ ID NO: 7126659 - DNA, 22 bp, Homo sapiens
agggctgcctgactccagagcc

SEQ ID NO: 7126660 - DNA, 22 bp, Homo sapiens
agggctgccccagtccagccgg

SEQ ID NO: 7126661 - DNA, 22 bp, Homo sapiens
agggctgcctgactccagagcc

SEQ ID NO: 7126662 - DNA, 22 bp, Homo sapiens
agggctgcctgctctgcattga

SEQ ID NO: 7126663 - DNA, 22 bp, Homo sapiens
agggctgctaccttaatcagtt

SEQ ID NO: 7126664 - DNA, 19 bp, Homo sapiens
agggctgctctggcctggg

SEQ ID NO: 7126665 - DNA, 19 bp, Homo sapiens
agggctgctctggcctggg

SEQ ID NO: 7126666 - DNA, 22 bp, Homo sapiens
agggctgctcctccttcaggcc

SEQ ID NO: 7126667 - DNA, 22 bp, Homo sapiens
agggctgctatgttgattcaga

SEQ ID NO: 7126668 - DNA, 22 bp, Homo sapiens
agggctgctcctccttcaggcc

SEQ ID NO: 7126669 - DNA, 22 bp, Homo sapiens
acccaggctggagtgcagtgat

SEQ ID NO: 7126670 - DNA, 22 bp, Homo sapiens
agggctgctgaggaagccttgc

SEQ ID NO: 7126671 - DNA, 22 bp, Homo sapiens
acccaggagagagctataaaat

SEQ ID NO: 7126672 - DNA, 22 bp, Homo sapiens
acccaggagcaggctgggcagt

SEQ ID NO: 7126673 - DNA, 22 bp, Homo sapiens
agggctgccatttctggcccaa

SEQ ID NO: 7126674 - DNA, 22 bp, Homo sapiens
agggctgcccagtgtgagagct

SEQ ID NO: 7126675 - DNA, 22 bp, Homo sapiens
agggctgcccagtgtgagagct

SEQ ID NO: 7126676 - DNA, 22 bp, Homo sapiens
acccaggacatgggcacccgtg

SEQ ID NO: 7126677 - DNA, 22 bp, Homo sapiens
acccaggactctcttccagtag

SEQ ID NO: 7126678 - DNA, 22 bp, Homo sapiens
acccaggacttggcaacctcat

SEQ ID NO: 7126679 - DNA, 22 bp, Homo sapiens
acccaggagacaggttgcagtg

SEQ ID NO: 7126680 - DNA, 22 bp, Homo sapiens
acccaggagacaggttgcagtg

SEQ ID NO: 7126681 - DNA, 22 bp, Homo sapiens
acccaggagacaggttgcagtg

SEQ ID NO: 7126682 - DNA, 22 bp, Homo sapiens
acccaggagacaggttgcagtg

SEQ ID NO: 7126683 - DNA, 22 bp, Homo sapiens
acccaggagacggaggtgcagt

SEQ ID NO: 7126684 - DNA, 22 bp, Homo sapiens
acccaggagacggaggtgcagt

SEQ ID NO: 7126685 - DNA, 22 bp, Homo sapiens
acccaggagacggaggtgcagt

SEQ ID NO: 7126686 - DNA, 22 bp, Homo sapiens
acccaggagacggaggtgcagt

SEQ ID NO: 7126687 - DNA, 22 bp, Homo sapiens
acccagctctttgatggtcttg

SEQ ID NO: 7126688 - DNA, 22 bp, Homo sapiens
acccagctctttgatggtcttg

SEQ ID NO: 7126689 - DNA, 22 bp, Homo sapiens
acccagctggatgcatggaggc

SEQ ID NO: 7126690 - DNA, 22 bp, Homo sapiens
acccagctggatgcatggaggc

SEQ ID NO: 7126691 - DNA, 22 bp, Homo sapiens
acccagctgtttcccgtgtcat

SEQ ID NO: 7126692 - DNA, 22 bp, Homo sapiens
acccagctggatgcatggaggc

SEQ ID NO: 7126693 - DNA, 22 bp, Homo sapiens
acccagctggatgcatggaggc

SEQ ID NO: 7126694 - DNA, 22 bp, Homo sapiens
acccaggaaaacatggtgcaga

SEQ ID NO: 7126695 - DNA, 22 bp, Homo sapiens
acccaggaaaacatggtgcaga

SEQ ID NO: 7126696 - DNA, 22 bp, Homo sapiens
acccaggacaaaataaccaggt

SEQ ID NO: 7126697 - DNA, 22 bp, Homo sapiens
acccaggacacagagatgaccc

SEQ ID NO: 7126698 - DNA, 22 bp, Homo sapiens
acccaggacacagagatgaccc

SEQ ID NO: 7126699 - DNA, 22 bp, Homo sapiens
acccaggacacagagatgaccc

SEQ ID NO: 7126700 - DNA, 22 bp, Homo sapiens
acccagcaaagataaacttatg

SEQ ID NO: 7126701 - DNA, 22 bp, Homo sapiens
acccagagcccttagcacagac

SEQ ID NO: 7126702 - DNA, 22 bp, Homo sapiens
acccagcatgacacctgcacat

SEQ ID NO: 7126703 - DNA, 22 bp, Homo sapiens
acccagccacagcattgaggga

SEQ ID NO: 7126704 - DNA, 22 bp, Homo sapiens
acccagccatgttcagttctct

SEQ ID NO: 7126705 - DNA, 22 bp, Homo sapiens
acccagccacagcattgaggga

SEQ ID NO: 7126706 - DNA, 22 bp, Homo sapiens
acccagcccagaatctggggcc

SEQ ID NO: 7126707 - DNA, 22 bp, Homo sapiens
acccagcccagaatctggggcc

SEQ ID NO: 7126708 - DNA, 19 bp, Homo sapiens
acccagcccaggagtggca

SEQ ID NO: 7126709 - DNA, 22 bp, Homo sapiens
acccagcctacaaagctcacct

SEQ ID NO: 7126710 - DNA, 22 bp, Homo sapiens
acccagcctacaaagctcacct

SEQ ID NO: 7126711 - DNA, 22 bp, Homo sapiens
acccagcctacaaagctcacct

SEQ ID NO: 7126712 - DNA, 22 bp, Homo sapiens
acccagcctacaaagctcacct

SEQ ID NO: 7126713 - DNA, 22 bp, Homo sapiens
accaggctgtgaagtgagacta

SEQ ID NO: 7126714 - DNA, 22 bp, Homo sapiens
acccagagcagagcttggcttc

SEQ ID NO: 7126715 - DNA, 22 bp, Homo sapiens
acccagagccagggtcaggagc

SEQ ID NO: 7126716 - DNA, 22 bp, Homo sapiens
accaggctgtgaagtgagacta

SEQ ID NO: 7126717 - DNA, 22 bp, Homo sapiens
accaggctggagtgcagtggcg

SEQ ID NO: 7126718 - DNA, 22 bp, Homo sapiens
accaggctggagtgcagtggcg

SEQ ID NO: 7126719 - DNA, 22 bp, Homo sapiens
accaggctggagtgcagtggcg

SEQ ID NO: 7126720 - DNA, 22 bp, Homo sapiens
accaggctggagtgcagtggcg

SEQ ID NO: 7126721 - DNA, 22 bp, Homo sapiens
accaggctctgccagtgtttac

SEQ ID NO: 7126722 - DNA, 22 bp, Homo sapiens
accaggctccccttggatcctg

SEQ ID NO: 7126723 - DNA, 19 bp, Homo sapiens
accaggcctcagaggccct

SEQ ID NO: 7126724 - DNA, 22 bp, Homo sapiens
accaggcctggctgggcagcca

SEQ ID NO: 7126725 - DNA, 22 bp, Homo sapiens
accaggcctggctgggcagcca

SEQ ID NO: 7126726 - DNA, 22 bp, Homo sapiens
accaggcctggctgggcagcca

SEQ ID NO: 7126727 - DNA, 22 bp, Homo sapiens
accaggcctggctgggcagcca

SEQ ID NO: 7126728 - DNA, 22 bp, Homo sapiens
accaggcctggctgggcagcca

SEQ ID NO: 7126729 - DNA, 22 bp, Homo sapiens
aggctgaggagggatgttgctt

SEQ ID NO: 7126730 - DNA, 22 bp, Homo sapiens
aggctgaggagggatgttgctt

SEQ ID NO: 7126731 - DNA, 22 bp, Homo sapiens
aggctgagctggtagtgagtac

SEQ ID NO: 7126732 - DNA, 22 bp, Homo sapiens
aggctgagctggtagtgagtac

SEQ ID NO: 7126733 - DNA, 22 bp, Homo sapiens
aggctgaggagggatgttgctt

SEQ ID NO: 7126734 - DNA, 22 bp, Homo sapiens
aggctgagctggtagtgagtac

SEQ ID NO: 7126735 - DNA, 22 bp, Homo sapiens
aggctgagctggtagtgagtac

SEQ ID NO: 7126736 - DNA, 22 bp, Homo sapiens
aggctgagctggcccttgaaat

SEQ ID NO: 7126737 - DNA, 22 bp, Homo sapiens
aggctgagctggtagtgagtac

SEQ ID NO: 7126738 - DNA, 22 bp, Homo sapiens
aggctgagctggcccttgaaat

SEQ ID NO: 7126739 - DNA, 22 bp, Homo sapiens
aggctgagctggcccttgaaat

SEQ ID NO: 7126740 - DNA, 18 bp, Homo sapiens
acatttctatgcttctgg

SEQ ID NO: 7126741 - DNA, 18 bp, Homo sapiens
acatttctatgcttctgg

SEQ ID NO: 7126742 - DNA, 22 bp, Homo sapiens
acatttctcagggagttttgct

SEQ ID NO: 7126743 - DNA, 22 bp, Homo sapiens
acatttctttctattcagtagc

SEQ ID NO: 7126744 - DNA, 22 bp, Homo sapiens
acatttcttcctaattatccct

SEQ ID NO: 7126745 - DNA, 22 bp, Homo sapiens
acatttcttgatgcctctgtga

SEQ ID NO: 7126746 - DNA, 22 bp, Homo sapiens
aggctgaggatccctgtgttct

SEQ ID NO: 7126747 - DNA, 22 bp, Homo sapiens
acatttctttgctagacagcag

SEQ ID NO: 7126748 - DNA, 22 bp, Homo sapiens
acatttcttttcatctctatat

SEQ ID NO: 7126749 - DNA, 22 bp, Homo sapiens
acatttcttttcatctctatat

SEQ ID NO: 7126750 - DNA, 22 bp, Homo sapiens
acatttctttgctagacagcag

SEQ ID NO: 7126751 - DNA, 22 bp, Homo sapiens
acatttggcaagaaagagaaac

SEQ ID NO: 7126752 - DNA, 22 bp, Homo sapiens
acatttgattgatgaatcaaat

SEQ ID NO: 7126753 - DNA, 22 bp, Homo sapiens
acatttggacaatagtagacaa

SEQ ID NO: 7126754 - DNA, 22 bp, Homo sapiens
acatttggacaatagtagacaa

SEQ ID NO: 7126755 - DNA, 23 bp, Homo sapiens
acatttggccaaaaattatttct

SEQ ID NO: 7126756 - DNA, 22 bp, Homo sapiens
acatttggcttttggagtaaga

SEQ ID NO: 7126757 - DNA, 22 bp, Homo sapiens
acatttggtaacacttgagcat

SEQ ID NO: 7126758 - DNA, 22 bp, Homo sapiens
acatttggtaacacttgagcat

SEQ ID NO: 7126759 - DNA, 22 bp, Homo sapiens
acatttgataattataaagaca

SEQ ID NO: 7126760 - DNA, 22 bp, Homo sapiens
acatttgagcatctactaagtg

SEQ ID NO: 7126761 - DNA, 22 bp, Homo sapiens
acatttgaggatgttaagaatg

SEQ ID NO: 7126762 - DNA, 22 bp, Homo sapiens
acatttgactacatttatatat

SEQ ID NO: 7126763 - DNA, 22 bp, Homo sapiens
acatttgacatttagtatcagc

SEQ ID NO: 7126764 - DNA, 22 bp, Homo sapiens
acatttgaaatgccatgtgagg

SEQ ID NO: 7126765 - DNA, 22 bp, Homo sapiens
aggctctgtttgctgtggtacc

SEQ ID NO: 7126766 - DNA, 22 bp, Homo sapiens
aggctctgttattctagagggc

SEQ ID NO: 7126767 - DNA, 22 bp, Homo sapiens
aggctgaaaacgagatggcaat

SEQ ID NO: 7126768 - DNA, 22 bp, Homo sapiens
aggctgacaagttcgtctaaag

SEQ ID NO: 7126769 - DNA, 22 bp, Homo sapiens
aggctctttccactctggtgca

SEQ ID NO: 7126770 - DNA, 22 bp, Homo sapiens
aggctctttccactctggtgca

SEQ ID NO: 7126771 - DNA, 22 bp, Homo sapiens
aggctctttccactctggtgca

SEQ ID NO: 7126772 - DNA, 22 bp, Homo sapiens
aggctctttgagactacctgga

SEQ ID NO: 7126773 - DNA, 22 bp, Homo sapiens
aggctctttgagactacctgga

SEQ ID NO: 7126774 - DNA, 22 bp, Homo sapiens
aggctctttgagactacctgga

SEQ ID NO: 7126775 - DNA, 18 bp, Homo sapiens
aggcctgcccagcactgt

SEQ ID NO: 7126776 - DNA, 22 bp, Homo sapiens
aggcctgcccgtgggacctgtg

SEQ ID NO: 7126777 - DNA, 22 bp, Homo sapiens
aggctctggctactacagagct

SEQ ID NO: 7126778 - DNA, 22 bp, Homo sapiens
aggctctggctactacagagct

SEQ ID NO: 7126779 - DNA, 22 bp, Homo sapiens
aggctctggctactacagagct

SEQ ID NO: 7126780 - DNA, 22 bp, Homo sapiens
aggctctgggaacagacgggtg

SEQ ID NO: 7126781 - DNA, 22 bp, Homo sapiens
aggctgagaaagtgggaagatg

SEQ ID NO: 7126782 - DNA, 22 bp, Homo sapiens
aggctgagaaagtgggaagatg

SEQ ID NO: 7126783 - DNA, 22 bp, Homo sapiens
aggctgagaaagtgggaagatg

SEQ ID NO: 7126784 - DNA, 22 bp, Homo sapiens
aggctgagactgtgcattagtg

SEQ ID NO: 7126785 - DNA, 22 bp, Homo sapiens
aggctgagactgtgcattagtg

SEQ ID NO: 7126786 - DNA, 18 bp, Homo sapiens
acattgatggctttaagc

SEQ ID NO: 7126787 - DNA, 22 bp, Homo sapiens
acattgatcagcctcccatgca

SEQ ID NO: 7126788 - DNA, 22 bp, Homo sapiens
acattgctgcattctccttccc

SEQ ID NO: 7126789 - DNA, 22 bp, Homo sapiens
acattgcaataataattctctt

SEQ ID NO: 7126790 - DNA, 22 bp, Homo sapiens
acattgcaataataattctctt

SEQ ID NO: 7126791 - DNA, 22 bp, Homo sapiens
acattgcaataataattctctt

SEQ ID NO: 7126792 - DNA, 22 bp, Homo sapiens
acattgcaattaggtacctatg

SEQ ID NO: 7126793 - DNA, 22 bp, Homo sapiens
acatttctagttgttcatctcc

SEQ ID NO: 7126794 - DNA, 22 bp, Homo sapiens
acatttctagttgttcatctcc

SEQ ID NO: 7126795 - DNA, 22 bp, Homo sapiens
acatttctagttgttcatctcc

SEQ ID NO: 7126796 - DNA, 22 bp, Homo sapiens
acatttctatagtgcatctgtt

SEQ ID NO: 7126797 - DNA, 18 bp, Homo sapiens
acatttctaggtgaaagc

SEQ ID NO: 7126798 - DNA, 22 bp, Homo sapiens
acatttctaatttaatgtaaca

SEQ ID NO: 7126799 - DNA, 17 bp, Homo sapiens
acatttcctaactgaag

SEQ ID NO: 7126800 - DNA, 17 bp, Homo sapiens
acatttcctaactgaag

SEQ ID NO: 7126801 - DNA, 22 bp, Homo sapiens
acatttcactgttcacagcagg

SEQ ID NO: 7126802 - DNA, 22 bp, Homo sapiens
acatttcagaatcacacagctt

SEQ ID NO: 7126803 - DNA, 22 bp, Homo sapiens
acatttcatttgcagtatggat

SEQ ID NO: 7126804 - DNA, 22 bp, Homo sapiens
acatttccacagactgaggtca

SEQ ID NO: 7126805 - DNA, 22 bp, Homo sapiens
acatttcctaacgtatacactg

SEQ ID NO: 7126806 - DNA, 22 bp, Homo sapiens
acattgtataatgattatcaca

SEQ ID NO: 7126807 - DNA, 22 bp, Homo sapiens
acattggtcaactgtatcttgg

SEQ ID NO: 7126808 - DNA, 22 bp, Homo sapiens
acattggtcactgaagaatgag

SEQ ID NO: 7126809 - DNA, 22 bp, Homo sapiens
acattggtcactgaagaatgag

SEQ ID NO: 7126810 - DNA, 19 bp, Homo sapiens
acattggacatggatcttg

SEQ ID NO: 7126811 - DNA, 22 bp, Homo sapiens
acattgtactcttagcgttgtt

SEQ ID NO: 7126812 - DNA, 22 bp, Homo sapiens
acattgtagacttttcatatgt

SEQ ID NO: 7126813 - DNA, 22 bp, Homo sapiens
acattgtagttgttctgcagca

SEQ ID NO: 7126814 - DNA, 22 bp, Homo sapiens
acattgtataatgattatcaca

SEQ ID NO: 7126815 - DNA, 22 bp, Homo sapiens
aggcctgaggaccagataaatg

SEQ ID NO: 7126816 - DNA, 22 bp, Homo sapiens
aggcctgaggaccttctggagg

SEQ ID NO: 7126817 - DNA, 22 bp, Homo sapiens
aggcctcttgtcttcctcacat

SEQ ID NO: 7126818 - DNA, 22 bp, Homo sapiens
aggcctgaaggaagatgagctg

SEQ ID NO: 7126819 - DNA, 22 bp, Homo sapiens
aggcctctgttccccatgtttt

SEQ ID NO: 7126820 - DNA, 22 bp, Homo sapiens
aggcctctgttccccatgtttt

SEQ ID NO: 7126821 - DNA, 22 bp, Homo sapiens
aggcctcttcagggagcatgga

SEQ ID NO: 7126822 - DNA, 20 bp, Homo sapiens
aggcctcttcatgacagctg

SEQ ID NO: 7126823 - DNA, 20 bp, Homo sapiens
aggcctcttcatgacagctg

SEQ ID NO: 7126824 - DNA, 19 bp, Homo sapiens
acatgttttgcagaacagc

SEQ ID NO: 7126825 - DNA, 19 bp, Homo sapiens
acatgttttgcagaacagc

SEQ ID NO: 7126826 - DNA, 19 bp, Homo sapiens
acatgttttgcagaacagc

SEQ ID NO: 7126827 - DNA, 22 bp, Homo sapiens
aggcctctgggtctcctctgac

SEQ ID NO: 7126828 - DNA, 22 bp, Homo sapiens
acatgtttgcctgcaggcttag

SEQ ID NO: 7126829 - DNA, 22 bp, Homo sapiens
acatgtttgataaatatttggg

SEQ ID NO: 7126830 - DNA, 22 bp, Homo sapiens
acatgtttgataaatatttggg

SEQ ID NO: 7126831 - DNA, 22 bp, Homo sapiens
acatgtttggctctatgctata

SEQ ID NO: 7126832 - DNA, 22 bp, Homo sapiens
acatgtttggctctatgctata

SEQ ID NO: 7126833 - DNA, 22 bp, Homo sapiens
acatgtttacattaggtgatat

SEQ ID NO: 7126834 - DNA, 22 bp, Homo sapiens
acatgtttgataaatatttggg

SEQ ID NO: 7126835 - DNA, 22 bp, Homo sapiens
acatgtttaagtttgttatatg

SEQ ID NO: 7126836 - DNA, 22 bp, Homo sapiens
acatgtttaagtttgttatatg

SEQ ID NO: 7126837 - DNA, 22 bp, Homo sapiens
acatgtttaagtttgttatatg

SEQ ID NO: 7126838 - DNA, 22 bp, Homo sapiens
acatgtttaagtttgttatatg

SEQ ID NO: 7126839 - DNA, 22 bp, Homo sapiens
acatgttagggacagagtatgt

SEQ ID NO: 7126840 - DNA, 22 bp, Homo sapiens
acatgttagggacagagtatgt

SEQ ID NO: 7126841 - DNA, 22 bp, Homo sapiens
acatgttagaaatgcagaatct

SEQ ID NO: 7126842 - DNA, 22 bp, Homo sapiens
acatgttagaaatgcagaatct

SEQ ID NO: 7126843 - DNA, 22 bp, Homo sapiens
acatgttagggacagagtatgt

SEQ ID NO: 7126844 - DNA, 22 bp, Homo sapiens
acatgttcatgcatgcacaggt

SEQ ID NO: 7126845 - DNA, 22 bp, Homo sapiens
acatgttgctaaatccaatggt

SEQ ID NO: 7126846 - DNA, 22 bp, Homo sapiens
acatgttgtttgccccagttgt

SEQ ID NO: 7126847 - DNA, 22 bp, Homo sapiens
acatgtttaagtttaatgaaaa

SEQ ID NO: 7126848 - DNA, 22 bp, Homo sapiens
aggccagggtcccacactcgca

SEQ ID NO: 7126849 - DNA, 22 bp, Homo sapiens
aggccagggtcccacactcgca

SEQ ID NO: 7126850 - DNA, 22 bp, Homo sapiens
aggccagggtcccacactcgca

SEQ ID NO: 7126851 - DNA, 22 bp, Homo sapiens
aggccagggtcccacactcgca

SEQ ID NO: 7126852 - DNA, 22 bp, Homo sapiens
aggccagggtcccacactcgca

SEQ ID NO: 7126853 - DNA, 22 bp, Homo sapiens
acatgtgtaaggtctctcagtc

SEQ ID NO: 7126854 - DNA, 22 bp, Homo sapiens
acatgtgtaaggtctctcagtc

SEQ ID NO: 7126855 - DNA, 22 bp, Homo sapiens
acatgtgtaaggtctctcagtc

SEQ ID NO: 7126856 - DNA, 22 bp, Homo sapiens
aggccaggggtgagcacttctg

SEQ ID NO: 7126857 - DNA, 22 bp, Homo sapiens
aggccaggggtgagcacttctg

SEQ ID NO: 7126858 - DNA, 22 bp, Homo sapiens
aggccaggggtgagcacttctg

SEQ ID NO: 7126859 - DNA, 22 bp, Homo sapiens
aggccaggggtgagcacttctg

SEQ ID NO: 7126860 - DNA, 22 bp, Homo sapiens
aggccagggtagggcccattgt

SEQ ID NO: 7126861 - DNA, 22 bp, Homo sapiens
aggccagggtagggcccattgt

SEQ ID NO: 7126862 - DNA, 22 bp, Homo sapiens
aggccagggccagattagccac

SEQ ID NO: 7126863 - DNA, 22 bp, Homo sapiens
aggccagggccagattagccac

SEQ ID NO: 7126864 - DNA, 22 bp, Homo sapiens
aggccagggccagattagccac

SEQ ID NO: 7126865 - DNA, 22 bp, Homo sapiens
aggccaggggtgagcacttctg

SEQ ID NO: 7126866 - DNA, 22 bp, Homo sapiens
aggccaggggtgagcacttctg

SEQ ID NO: 7126867 - DNA, 22 bp, Homo sapiens
aggccagggcactgctctttag

SEQ ID NO: 7126868 - DNA, 22 bp, Homo sapiens
aggccagggcactgctctttag

SEQ ID NO: 7126869 - DNA, 22 bp, Homo sapiens
aggccaggcgagacacccggct

SEQ ID NO: 7126870 - DNA, 22 bp, Homo sapiens
aggccagggcactgctctttag

SEQ ID NO: 7126871 - DNA, 22 bp, Homo sapiens
aggccaggcctttctccattcc

SEQ ID NO: 7126872 - DNA, 22 bp, Homo sapiens
aggccaggcctttctccattcc

SEQ ID NO: 7126873 - DNA, 22 bp, Homo sapiens
aggccaggcgagacacccggct

SEQ ID NO: 7126874 - DNA, 22 bp, Homo sapiens
aggccaggcctttctccattcc

SEQ ID NO: 7126875 - DNA, 22 bp, Homo sapiens
aggccaggcaacattctgaagt

SEQ ID NO: 7126876 - DNA, 22 bp, Homo sapiens
acatggaaaactaactgctttt

SEQ ID NO: 7126877 - DNA, 22 bp, Homo sapiens
acatgcttttcccacaattata

SEQ ID NO: 7126878 - DNA, 22 bp, Homo sapiens
acatgcttttcccacaattata

SEQ ID NO: 7126879 - DNA, 22 bp, Homo sapiens
acatgctttatcggattgacac

SEQ ID NO: 7126880 - DNA, 22 bp, Homo sapiens
acatgctttctaggtccttctg

SEQ ID NO: 7126881 - DNA, 22 bp, Homo sapiens
acatgctttctaggtccttctg

SEQ ID NO: 7126882 - DNA, 22 bp, Homo sapiens
acatgctttgcacttacatcat

SEQ ID NO: 7126883 - DNA, 22 bp, Homo sapiens
acatgctttgcacttacatcat

SEQ ID NO: 7126884 - DNA, 22 bp, Homo sapiens
acatgctcattaaatattagct

SEQ ID NO: 7126885 - DNA, 22 bp, Homo sapiens
acatgctctcctaaggccctgt

SEQ ID NO: 7126886 - DNA, 22 bp, Homo sapiens
acatgctctcctaaggccctgt

SEQ ID NO: 7126887 - DNA, 22 bp, Homo sapiens
acatgctggatgaattacctac

SEQ ID NO: 7126888 - DNA, 22 bp, Homo sapiens
acatgctggatgaattacctac

SEQ ID NO: 7126889 - DNA, 22 bp, Homo sapiens
acatgctgggcaatgttgtttt

SEQ ID NO: 7126890 - DNA, 22 bp, Homo sapiens
acatgctgggcaatgttgtttt

SEQ ID NO: 7126891 - DNA, 22 bp, Homo sapiens
acatgctgggtttctttaatgg

SEQ ID NO: 7126892 - DNA, 22 bp, Homo sapiens
acatgctgtcctgtctttgtca

SEQ ID NO: 7126893 - DNA, 22 bp, Homo sapiens
acatgctgtcctgtctttgtca

SEQ ID NO: 7126894 - DNA, 22 bp, Homo sapiens
acatgcttcatattataaccaa

SEQ ID NO: 7126895 - DNA, 22 bp, Homo sapiens
acatgcttccaaattatgttgg

SEQ ID NO: 7126896 - DNA, 20 bp, Homo sapiens
acatgcttgagaggatgcag

SEQ ID NO: 7126897 - DNA, 22 bp, Homo sapiens
acatgcttgtttttcacaacct

SEQ ID NO: 7126898 - DNA, 22 bp, Homo sapiens
acatgctatgagagattacttc

SEQ ID NO: 7126899 - DNA, 22 bp, Homo sapiens
acatgctaggtacagatctaaa

SEQ ID NO: 7126900 - DNA, 22 bp, Homo sapiens
acatgctaatggagatgccaag

SEQ ID NO: 7126901 - DNA, 22 bp, Homo sapiens
acatgctaatggagatgccaag

SEQ ID NO: 7126902 - DNA, 22 bp, Homo sapiens
acatgctaattgcaaagtcttg

SEQ ID NO: 7126903 - DNA, 22 bp, Homo sapiens
acatgctacagtgaaggaggaa

SEQ ID NO: 7126904 - DNA, 22 bp, Homo sapiens
acatgccagcctcagcagcagt

SEQ ID NO: 7126905 - DNA, 22 bp, Homo sapiens
acatgccatgaaggtatttttg

SEQ ID NO: 7126906 - DNA, 22 bp, Homo sapiens
acatgccatggttgtttgctgc

SEQ ID NO: 7126907 - DNA, 22 bp, Homo sapiens
acatgcctccattgagctgtgg

SEQ ID NO: 7126908 - DNA, 22 bp, Homo sapiens
acatgctaaatctgagatgctt

SEQ ID NO: 7126909 - DNA, 22 bp, Homo sapiens
acatgccagcctcagcagcagt

SEQ ID NO: 7126910 - DNA, 22 bp, Homo sapiens
acatgccagaacttgtaccaat

SEQ ID NO: 7126911 - DNA, 22 bp, Homo sapiens
acatgccagcactgcttttcag

SEQ ID NO: 7126912 - DNA, 22 bp, Homo sapiens
acatgccagcccatttaaatgg

SEQ ID NO: 7126913 - DNA, 22 bp, Homo sapiens
acatgcataagcctagccatca

SEQ ID NO: 7126914 - DNA, 22 bp, Homo sapiens
acatgcataagcctagccatca

SEQ ID NO: 7126915 - DNA, 22 bp, Homo sapiens
acatgcataagcctagccatca

SEQ ID NO: 7126916 - DNA, 22 bp, Homo sapiens
acatgcatacaagcacatgtag

SEQ ID NO: 7126917 - DNA, 22 bp, Homo sapiens
acatgcatacaagcacatgtag

SEQ ID NO: 7126918 - DNA, 22 bp, Homo sapiens
acatgcatacaagcacatgtag

SEQ ID NO: 7126919 - DNA, 22 bp, Homo sapiens
acatgcatacaagcacatgtag

SEQ ID NO: 7126920 - DNA, 22 bp, Homo sapiens
acatcatttctagttcctgtca

SEQ ID NO: 7126921 - DNA, 22 bp, Homo sapiens
acatcatttgtctgtagctgaa

SEQ ID NO: 7126922 - DNA, 22 bp, Homo sapiens
acatcattttcttcagtgtttg

SEQ ID NO: 7126923 - DNA, 22 bp, Homo sapiens
acatccagaggcgtggaaggct

SEQ ID NO: 7126924 - DNA, 22 bp, Homo sapiens
acatccagatctcagcatggct

SEQ ID NO: 7126925 - DNA, 22 bp, Homo sapiens
acatccagatctcagcatggct

SEQ ID NO: 7126926 - DNA, 22 bp, Homo sapiens
acatccagtatcagaagcatca

SEQ ID NO: 7126927 - DNA, 22 bp, Homo sapiens
acatccatcttatgagataggt

SEQ ID NO: 7126928 - DNA, 22 bp, Homo sapiens
acatcattcagggcctcgttgg

SEQ ID NO: 7126929 - DNA, 22 bp, Homo sapiens
acatcattgtttataaagggag

SEQ ID NO: 7126930 - DNA, 22 bp, Homo sapiens
acatcatttctagttcctgtca

SEQ ID NO: 7126931 - DNA, 22 bp, Homo sapiens
acatcattcagggcctcgttgg

SEQ ID NO: 7126932 - DNA, 22 bp, Homo sapiens
acatcattgtccgttgtcatga

SEQ ID NO: 7126933 - DNA, 22 bp, Homo sapiens
acatcagtccaccactgcagtt

SEQ ID NO: 7126934 - DNA, 22 bp, Homo sapiens
acatcagtcttttgcatacata

SEQ ID NO: 7126935 - DNA, 18 bp, Homo sapiens
acatcagttaccaggcca

SEQ ID NO: 7126936 - DNA, 22 bp, Homo sapiens
acatcagtgctcttggttcttg

SEQ ID NO: 7126937 - DNA, 22 bp, Homo sapiens
acatcatcgtgcacatacataa

SEQ ID NO: 7126938 - DNA, 22 bp, Homo sapiens
acatcatgagagacttaaattg

SEQ ID NO: 7126939 - DNA, 23 bp, Homo sapiens
acatcagagttagttcaatcagg

SEQ ID NO: 7126940 - DNA, 21 bp, Homo sapiens
acatcagagttgtgaaggtag

SEQ ID NO: 7126941 - DNA, 21 bp, Homo sapiens
acatcagagttgtgaaggtag

SEQ ID NO: 7126942 - DNA, 22 bp, Homo sapiens
acatcagattatgctttgctta

SEQ ID NO: 7126943 - DNA, 22 bp, Homo sapiens
acatcagtaactgtaaaacagg

SEQ ID NO: 7126944 - DNA, 22 bp, Homo sapiens
acatcagtaattaagtctcaag

SEQ ID NO: 7126945 - DNA, 22 bp, Homo sapiens
acatcacagtagttaagccaga

SEQ ID NO: 7126946 - DNA, 22 bp, Homo sapiens
acatcacagtagttaagccaga

SEQ ID NO: 7126947 - DNA, 22 bp, Homo sapiens
acatcagacaattaattattaa

SEQ ID NO: 7126948 - DNA, 22 bp, Homo sapiens
acatcagagggctcacatgatc

SEQ ID NO: 7126949 - DNA, 22 bp, Homo sapiens
acatcagagggctcacatgatc

SEQ ID NO: 7126950 - DNA, 22 bp, Homo sapiens
acatcagagggctcacatgatc

SEQ ID NO: 7126951 - DNA, 22 bp, Homo sapiens
acatattttgaaagctttctaa

SEQ ID NO: 7126952 - DNA, 20 bp, Homo sapiens
acatcaactagtcacagaca

SEQ ID NO: 7126953 - DNA, 22 bp, Homo sapiens
acatcacacgccttccaggagg

SEQ ID NO: 7126954 - DNA, 22 bp, Homo sapiens
acatcacacgccttccaggagg

SEQ ID NO: 7126955 - DNA, 22 bp, Homo sapiens
acatcacagagcccagataaag

SEQ ID NO: 7126956 - DNA, 22 bp, Homo sapiens
acatcacagagcccagataaag

SEQ ID NO: 7126957 - DNA, 23 bp, Homo sapiens
acaggaggggacaggtggccgtg

SEQ ID NO: 7126958 - DNA, 22 bp, Homo sapiens
acaggaggggcatgaaagacgg

SEQ ID NO: 7126959 - DNA, 22 bp, Homo sapiens
acaggagtagggctggtggaga

SEQ ID NO: 7126960 - DNA, 22 bp, Homo sapiens
acaggagtagggctggtggaga

SEQ ID NO: 7126961 - DNA, 22 bp, Homo sapiens
acaggagtgaatctggcactta

SEQ ID NO: 7126962 - DNA, 22 bp, Homo sapiens
acaggagtggagaggtgcctct

SEQ ID NO: 7126963 - DNA, 22 bp, Homo sapiens
acaggagtggctctaccagacc

SEQ ID NO: 7126964 - DNA, 22 bp, Homo sapiens
acaggagaattatctggaacaa

SEQ ID NO: 7126965 - DNA, 22 bp, Homo sapiens
acaggagaaatctggtcaaaag

SEQ ID NO: 7126966 - DNA, 22 bp, Homo sapiens
acaggagaattatctggaacaa

SEQ ID NO: 7126967 - DNA, 22 bp, Homo sapiens
acaggagggacaccttcctgct

SEQ ID NO: 7126968 - DNA, 22 bp, Homo sapiens
acaggagggacaccttcctgct

SEQ ID NO: 7126969 - DNA, 22 bp, Homo sapiens
acaggagggacaccttcctgct

SEQ ID NO: 7126970 - DNA, 22 bp, Homo sapiens
acaggagggacaccttcctgct

SEQ ID NO: 7126971 - DNA, 23 bp, Homo sapiens
acaggaggggacaggtggccgtg

SEQ ID NO: 7126972 - DNA, 22 bp, Homo sapiens
agctggcacagaccaggagatc

SEQ ID NO: 7126973 - DNA, 22 bp, Homo sapiens
agctggcaccaaatatagtaaa

SEQ ID NO: 7126974 - DNA, 22 bp, Homo sapiens
agctggcaccaaatatagtaaa

SEQ ID NO: 7126975 - DNA, 22 bp, Homo sapiens
agctggcacagaccaggagatc

SEQ ID NO: 7126976 - DNA, 22 bp, Homo sapiens
agctggcagctctcaggggtac

SEQ ID NO: 7126977 - DNA, 22 bp, Homo sapiens
agctggcagctctcaggggtac

SEQ ID NO: 7126978 - DNA, 21 bp, Homo sapiens
agctggcagatatggtgtctg

SEQ ID NO: 7126979 - DNA, 21 bp, Homo sapiens
agctggcagatatggtgtctg

SEQ ID NO: 7126980 - DNA, 22 bp, Homo sapiens
agctggcagagcatttgtggcc

SEQ ID NO: 7126981 - DNA, 22 bp, Homo sapiens
agctggcagagcatttgtggcc

SEQ ID NO: 7126982 - DNA, 22 bp, Homo sapiens
agctggcacagaccaggagatc

SEQ ID NO: 7126983 - DNA, 22 bp, Homo sapiens
agctggcacagaccaggagatc

SEQ ID NO: 7126984 - DNA, 22 bp, Homo sapiens
agctggcacagaccaggagatc

SEQ ID NO: 7126985 - DNA, 22 bp, Homo sapiens
agctggcaagttgaaggtggct

SEQ ID NO: 7126986 - DNA, 22 bp, Homo sapiens
agctggcaagttgaaggtggct

SEQ ID NO: 7126987 - DNA, 22 bp, Homo sapiens
agctggcaaggcaatttggatt

SEQ ID NO: 7126988 - DNA, 22 bp, Homo sapiens
agctggcaaaactaatgggaag

SEQ ID NO: 7126989 - DNA, 22 bp, Homo sapiens
agctggcaaaactaatgggaag

SEQ ID NO: 7126990 - DNA, 22 bp, Homo sapiens
acaggcagagtcaggttgggtt

SEQ ID NO: 7126991 - DNA, 17 bp, Homo sapiens
acaggcagatcacctga

SEQ ID NO: 7126992 - DNA, 17 bp, Homo sapiens
acaggcagatcacctga

SEQ ID NO: 7126993 - DNA, 21 bp, Homo sapiens
acaggcaccatgcctgtgcct

SEQ ID NO: 7126994 - DNA, 22 bp, Homo sapiens
agctggtgtgccagttccagtt

SEQ ID NO: 7126995 - DNA, 22 bp, Homo sapiens
agctggtgtgctctggaatcct

SEQ ID NO: 7126996 - DNA, 22 bp, Homo sapiens
agctggtgtggatttttgaatg

SEQ ID NO: 7126997 - DNA, 22 bp, Homo sapiens
acaggcacaggtgtgccccacc

SEQ ID NO: 7126998 - DNA, 22 bp, Homo sapiens
agctggtgtgccactgttgggg

SEQ ID NO: 7126999 - DNA, 22 bp, Homo sapiens
agctggtgtgccactgttgggg

SEQ ID NO: 7127000 - DNA, 21 bp, Homo sapiens
agctggtgtcagagctctggg

SEQ ID NO: 7127001 - DNA, 21 bp, Homo sapiens
agctggtgtcagagctctggg

SEQ ID NO: 7127002 - DNA, 18 bp, Homo sapiens
agctggtggggagacagc

SEQ ID NO: 7127003 - DNA, 18 bp, Homo sapiens
agctggtggggagacagc

SEQ ID NO: 7127004 - DNA, 22 bp, Homo sapiens
agctggtggggaagctgcaggt

SEQ ID NO: 7127005 - DNA, 22 bp, Homo sapiens
agctggtggggaagctgcaggt

SEQ ID NO: 7127006 - DNA, 22 bp, Homo sapiens
agctggtggattatgctgtaca

SEQ ID NO: 7127007 - DNA, 22 bp, Homo sapiens
agctggtggattatgctgtaca

SEQ ID NO: 7127008 - DNA, 22 bp, Homo sapiens
agctggtggattatgctgtaca

SEQ ID NO: 7127009 - DNA, 22 bp, Homo sapiens
acaggagttaaccatgggaagt

SEQ ID NO: 7127010 - DNA, 22 bp, Homo sapiens
acaggagttaaggctgagttga

SEQ ID NO: 7127011 - DNA, 22 bp, Homo sapiens
acaggagttcagaggacacccc

SEQ ID NO: 7127012 - DNA, 22 bp, Homo sapiens
acaggagttaaccatgggaagt

SEQ ID NO: 7127013 - DNA, 22 bp, Homo sapiens
acaggagtttaagaaatatttc

SEQ ID NO: 7127014 - DNA, 22 bp, Homo sapiens
acaggagtttctgacagagaca

SEQ ID NO: 7127015 - DNA, 22 bp, Homo sapiens
acaggatcgccctgttgcccag

SEQ ID NO: 7127016 - DNA, 22 bp, Homo sapiens
acaggagtttctgacagagaca

SEQ ID NO: 7127017 - DNA, 21 bp, Homo sapiens
acaggataggacagtgttcct

SEQ ID NO: 7127018 - DNA, 22 bp, Homo sapiens
acaggatcgccctgttgcccag

SEQ ID NO: 7127019 - DNA, 22 bp, Homo sapiens
agctggtggagcctttctgttt

SEQ ID NO: 7127020 - DNA, 22 bp, Homo sapiens
agctggtggagcctttctgttt

SEQ ID NO: 7127021 - DNA, 22 bp, Homo sapiens
acagctggccgaggctcaggga

SEQ ID NO: 7127022 - DNA, 22 bp, Homo sapiens
acagctggccgaggctcaggga

SEQ ID NO: 7127023 - DNA, 21 bp, Homo sapiens
acagctggccgcgcgggtcgg

SEQ ID NO: 7127024 - DNA, 21 bp, Homo sapiens
acagctggccgcgcgggtcgg

SEQ ID NO: 7127025 - DNA, 22 bp, Homo sapiens
acagctgggaactcacacagca

SEQ ID NO: 7127026 - DNA, 22 bp, Homo sapiens
acagctgggaactcacacagca

SEQ ID NO: 7127027 - DNA, 22 bp, Homo sapiens
acagctgggaactcacacagca

SEQ ID NO: 7127028 - DNA, 22 bp, Homo sapiens
acagctgggaatcagctgggga

SEQ ID NO: 7127029 - DNA, 22 bp, Homo sapiens
acagctgggaatcagctgggga

SEQ ID NO: 7127030 - DNA, 22 bp, Homo sapiens
acagctgggaatcagctgggga

SEQ ID NO: 7127031 - DNA, 22 bp, Homo sapiens
acagctgggaatcagctgggga

SEQ ID NO: 7127032 - DNA, 22 bp, Homo sapiens
acagctgggtgctgctcagagc

SEQ ID NO: 7127033 - DNA, 22 bp, Homo sapiens
acagctggcaggggggcatgaa

SEQ ID NO: 7127034 - DNA, 22 bp, Homo sapiens
acagctggcaggggggcatgaa

SEQ ID NO: 7127035 - DNA, 22 bp, Homo sapiens
acagctgctctacaggttattt

SEQ ID NO: 7127036 - DNA, 22 bp, Homo sapiens
acagctggcaggggggcatgaa

SEQ ID NO: 7127037 - DNA, 21 bp, Homo sapiens
acagctgcctgccatgggggt

SEQ ID NO: 7127038 - DNA, 21 bp, Homo sapiens
acagctgcctgccatgggggt

SEQ ID NO: 7127039 - DNA, 22 bp, Homo sapiens
acagctgctcacctgtgagccc

SEQ ID NO: 7127040 - DNA, 21 bp, Homo sapiens
acagctgcctgccatgggggt

SEQ ID NO: 7127041 - DNA, 22 bp, Homo sapiens
acagctgctcacctgtgagccc

SEQ ID NO: 7127042 - DNA, 22 bp, Homo sapiens
acagctgctcacctgtgagccc

SEQ ID NO: 7127043 - DNA, 21 bp, Homo sapiens
acagctggtgcagggcgggga

SEQ ID NO: 7127044 - DNA, 22 bp, Homo sapiens
acagctggtgaatgttctctgt

SEQ ID NO: 7127045 - DNA, 21 bp, Homo sapiens
acagctggtgcagggcgggga

SEQ ID NO: 7127046 - DNA, 22 bp, Homo sapiens
acagctgggtgtcccacttctg

SEQ ID NO: 7127047 - DNA, 22 bp, Homo sapiens
agctggaggggccagcaggtgt

SEQ ID NO: 7127048 - DNA, 22 bp, Homo sapiens
agctggaggggccagcaggtgt

SEQ ID NO: 7127049 - DNA, 21 bp, Homo sapiens
acagctggtgcagggcgggga

SEQ ID NO: 7127050 - DNA, 22 bp, Homo sapiens
acagctgtattcaagttgcaag

SEQ ID NO: 7127051 - DNA, 22 bp, Homo sapiens
agctggaggggccagcaggtgt

SEQ ID NO: 7127052 - DNA, 22 bp, Homo sapiens
agctggaggggccagcaggtgt

SEQ ID NO: 7127053 - DNA, 22 bp, Homo sapiens
agctggaggggccagcaggtgt

SEQ ID NO: 7127054 - DNA, 22 bp, Homo sapiens
agctctgggtcacggctgccga

SEQ ID NO: 7127055 - DNA, 22 bp, Homo sapiens
agctctggtactgctgaccgaa

SEQ ID NO: 7127056 - DNA, 22 bp, Homo sapiens
agctctggtatttctttaatcc

SEQ ID NO: 7127057 - DNA, 22 bp, Homo sapiens
agctctggtatttctttaatcc

SEQ ID NO: 7127058 - DNA, 22 bp, Homo sapiens
agctctggtgagatgttattca

SEQ ID NO: 7127059 - DNA, 22 bp, Homo sapiens
agctctggtgagatgttattca

SEQ ID NO: 7127060 - DNA, 22 bp, Homo sapiens
agctctggttattgaagcaggg

SEQ ID NO: 7127061 - DNA, 22 bp, Homo sapiens
agctctgggtcacggctgccga

SEQ ID NO: 7127062 - DNA, 22 bp, Homo sapiens
agctctggggtggagcccagga

SEQ ID NO: 7127063 - DNA, 22 bp, Homo sapiens
agctctggggtggagcccagga

SEQ ID NO: 7127064 - DNA, 22 bp, Homo sapiens
agctctggggtggagcccagga

SEQ ID NO: 7127065 - DNA, 22 bp, Homo sapiens
agctctgggtcacggctgccga

SEQ ID NO: 7127066 - DNA, 22 bp, Homo sapiens
agctctgggtcacggctgccga

SEQ ID NO: 7127067 - DNA, 22 bp, Homo sapiens
agctctgggtcacggctgccga

SEQ ID NO: 7127068 - DNA, 22 bp, Homo sapiens
agctgaaggctagaacagctgg

SEQ ID NO: 7127069 - DNA, 22 bp, Homo sapiens
agctgaagggaggatatgtaca

SEQ ID NO: 7127070 - DNA, 22 bp, Homo sapiens
agctgaagggaggatatgtaca

SEQ ID NO: 7127071 - DNA, 22 bp, Homo sapiens
agctgaagcagtcagttcagct

SEQ ID NO: 7127072 - DNA, 22 bp, Homo sapiens
agctgaagcagtcagttcagct

SEQ ID NO: 7127073 - DNA, 20 bp, Homo sapiens
agctgaagcccttggggaaa

SEQ ID NO: 7127074 - DNA, 20 bp, Homo sapiens
agctgaagcccttggggaaa

SEQ ID NO: 7127075 - DNA, 20 bp, Homo sapiens
agctgaagcccttggggaaa

SEQ ID NO: 7127076 - DNA, 22 bp, Homo sapiens
agctgaagctcagcccagtagt

SEQ ID NO: 7127077 - DNA, 22 bp, Homo sapiens
agctgaagcaacaacaggatgg

SEQ ID NO: 7127078 - DNA, 22 bp, Homo sapiens
agctgaagcactgggatggaag

SEQ ID NO: 7127079 - DNA, 22 bp, Homo sapiens
agctgaagcactgggatggaag

SEQ ID NO: 7127080 - DNA, 22 bp, Homo sapiens
agctctggttattgaagcaggg

SEQ ID NO: 7127081 - DNA, 22 bp, Homo sapiens
agctctggttattgaagcaggg

SEQ ID NO: 7127082 - DNA, 22 bp, Homo sapiens
agctctggttattgaagcaggg

SEQ ID NO: 7127083 - DNA, 22 bp, Homo sapiens
agctgaagtttagaattgtgaa

SEQ ID NO: 7127084 - DNA, 22 bp, Homo sapiens
agctgaagtttagaattgtgaa

SEQ ID NO: 7127085 - DNA, 22 bp, Homo sapiens
agctgaagtttagaattgtgaa

SEQ ID NO: 7127086 - DNA, 22 bp, Homo sapiens
agctgaagttcagtccagagaa

SEQ ID NO: 7127087 - DNA, 22 bp, Homo sapiens
agctgaagttcagtccagagaa

SEQ ID NO: 7127088 - DNA, 22 bp, Homo sapiens
agctgaagtcctcgcggtgcta

SEQ ID NO: 7127089 - DNA, 22 bp, Homo sapiens
agctgaagtcctcgcggtgcta

SEQ ID NO: 7127090 - DNA, 22 bp, Homo sapiens
agctgaagtcctcgcggtgcta

SEQ ID NO: 7127091 - DNA, 22 bp, Homo sapiens
agctgaagtgttggtggtttca

SEQ ID NO: 7127092 - DNA, 22 bp, Homo sapiens
agctgaagttcagtccagagaa

SEQ ID NO: 7127093 - DNA, 22 bp, Homo sapiens
agctgaagtttagaattgtgaa

SEQ ID NO: 7127094 - DNA, 22 bp, Homo sapiens
agctgaatgttctcagaccaga

SEQ ID NO: 7127095 - DNA, 22 bp, Homo sapiens
agctgacaggatggcattatta

SEQ ID NO: 7127096 - DNA, 22 bp, Homo sapiens
agctgacaggatggcattatta

SEQ ID NO: 7127097 - DNA, 22 bp, Homo sapiens
agctgacagtgcatggagggac

SEQ ID NO: 7127098 - DNA, 22 bp, Homo sapiens
agctgacagtgcatggagggac

SEQ ID NO: 7127099 - DNA, 17 bp, Homo sapiens
agctgacatcaaaactt

SEQ ID NO: 7127100 - DNA, 22 bp, Homo sapiens
agctgaccatgtttccagtggt

SEQ ID NO: 7127101 - DNA, 22 bp, Homo sapiens
agctgactcactcactcacaat

SEQ ID NO: 7127102 - DNA, 22 bp, Homo sapiens
agctgactctggcctctggtcc

SEQ ID NO: 7127103 - DNA, 22 bp, Homo sapiens
agctgactgatgaagaggcctt

SEQ ID NO: 7127104 - DNA, 22 bp, Homo sapiens
agctgacttcttgatccaatga

SEQ ID NO: 7127105 - DNA, 22 bp, Homo sapiens
agctgagacacttgagagacta

SEQ ID NO: 7127106 - DNA, 22 bp, Homo sapiens
agctgagagctgtgtcaagata

SEQ ID NO: 7127107 - DNA, 22 bp, Homo sapiens
acaggggcaggcaggacccttt

SEQ ID NO: 7127108 - DNA, 22 bp, Homo sapiens
acaggggcaggcaggacccttt

SEQ ID NO: 7127109 - DNA, 22 bp, Homo sapiens
acaggggcaggcaggacccttt

SEQ ID NO: 7127110 - DNA, 19 bp, Homo sapiens
acaggggcctttccagggt

SEQ ID NO: 7127111 - DNA, 19 bp, Homo sapiens
acaggggcctttccagggt

SEQ ID NO: 7127112 - DNA, 20 bp, Homo sapiens
acaggggcagcacaataatg

SEQ ID NO: 7127113 - DNA, 20 bp, Homo sapiens
acaggggcagcacaataatg

SEQ ID NO: 7127114 - DNA, 22 bp, Homo sapiens
acaggggcaagggctcacggcc

SEQ ID NO: 7127115 - DNA, 20 bp, Homo sapiens
acaggggcagcacaataatg

SEQ ID NO: 7127116 - DNA, 22 bp, Homo sapiens
acaggggcaagggctcacggcc

SEQ ID NO: 7127117 - DNA, 22 bp, Homo sapiens
acaggggattgattggaagtct

SEQ ID NO: 7127118 - DNA, 22 bp, Homo sapiens
acaggggcaagggctcacggcc

SEQ ID NO: 7127119 - DNA, 22 bp, Homo sapiens
acaggggcaagggctcacggcc

SEQ ID NO: 7127120 - DNA, 22 bp, Homo sapiens
acagggcttttaatcagtagtt

SEQ ID NO: 7127121 - DNA, 22 bp, Homo sapiens
acagggcttttaatcagtagtt

SEQ ID NO: 7127122 - DNA, 22 bp, Homo sapiens
acaggggacctaggaccctcgg

SEQ ID NO: 7127123 - DNA, 22 bp, Homo sapiens
acagggcttttaatcagtagtt

SEQ ID NO: 7127124 - DNA, 22 bp, Homo sapiens
acagggcttgtgacaactttaa

SEQ ID NO: 7127125 - DNA, 22 bp, Homo sapiens
acagggcttgttgaaagcggag

SEQ ID NO: 7127126 - DNA, 22 bp, Homo sapiens
acagggcttttaatcagtagtt

SEQ ID NO: 7127127 - DNA, 22 bp, Homo sapiens
aggacacactgcaagagcctgg

SEQ ID NO: 7127128 - DNA, 22 bp, Homo sapiens
aggacacactgcaagagcctgg

SEQ ID NO: 7127129 - DNA, 19 bp, Homo sapiens
acaggggctagcggaagca

SEQ ID NO: 7127130 - DNA, 19 bp, Homo sapiens
acaggggctagcggaagca

SEQ ID NO: 7127131 - DNA, 19 bp, Homo sapiens
acaggggctagcggaagca

SEQ ID NO: 7127132 - DNA, 19 bp, Homo sapiens
acaggggcctttccagggt

SEQ ID NO: 7127133 - DNA, 22 bp, Homo sapiens
aggacacaacatcatttctgtg

SEQ ID NO: 7127134 - DNA, 22 bp, Homo sapiens
aggacacaacatcatttctgtg

SEQ ID NO: 7127135 - DNA, 18 bp, Homo sapiens
acagggagggcgctgggg

SEQ ID NO: 7127136 - DNA, 18 bp, Homo sapiens
acagggagggcgctgggg

SEQ ID NO: 7127137 - DNA, 22 bp, Homo sapiens
acagggagccccagcatttcca

SEQ ID NO: 7127138 - DNA, 22 bp, Homo sapiens
acagggagccccagcatttcca

SEQ ID NO: 7127139 - DNA, 22 bp, Homo sapiens
aggaagaaactgagctctgaca

SEQ ID NO: 7127140 - DNA, 22 bp, Homo sapiens
aggaagaaactgagctctgaca

SEQ ID NO: 7127141 - DNA, 22 bp, Homo sapiens
aggaagaaactgagctctgaca

SEQ ID NO: 7127142 - DNA, 21 bp, Homo sapiens
aggaagaaaggttggaggttg

SEQ ID NO: 7127143 - DNA, 22 bp, Homo sapiens
aggaagaacctaagaaagtctc

SEQ ID NO: 7127144 - DNA, 22 bp, Homo sapiens
aggaagaacctaagaaagtctc

SEQ ID NO: 7127145 - DNA, 22 bp, Homo sapiens
aggaagaacagataatggacgc

SEQ ID NO: 7127146 - DNA, 22 bp, Homo sapiens
aggaagaacagataatggacgc

SEQ ID NO: 7127147 - DNA, 22 bp, Homo sapiens
aggaagaacctaagaaagtctc

SEQ ID NO: 7127148 - DNA, 22 bp, Homo sapiens
aggaagaacctaagaaagtctc

SEQ ID NO: 7127149 - DNA, 22 bp, Homo sapiens
aggaagaacctaagaaagtctc

SEQ ID NO: 7127150 - DNA, 21 bp, Homo sapiens
aggaagaaaggttggaggttg

SEQ ID NO: 7127151 - DNA, 22 bp, Homo sapiens
aggaagaaatgtgacttcaaac

SEQ ID NO: 7127152 - DNA, 22 bp, Homo sapiens
aggaagaaatgtgacttcaaac

SEQ ID NO: 7127153 - DNA, 22 bp, Homo sapiens
aggaagagcatctttgggtctg

SEQ ID NO: 7127154 - DNA, 23 bp, Homo sapiens
aggaagagagagtgcctctttct

SEQ ID NO: 7127155 - DNA, 22 bp, Homo sapiens
aggaagaatgtttacatatcaa

SEQ ID NO: 7127156 - DNA, 22 bp, Homo sapiens
aggaagaatgtttacatatcaa

SEQ ID NO: 7127157 - DNA, 22 bp, Homo sapiens
aggaagaatgtttacatatcaa

SEQ ID NO: 7127158 - DNA, 22 bp, Homo sapiens
acagggctcccagcaggtctgt

SEQ ID NO: 7127159 - DNA, 22 bp, Homo sapiens
acagggctatattcctcagagt

SEQ ID NO: 7127160 - DNA, 21 bp, Homo sapiens
acagggcttcagggagggtta

SEQ ID NO: 7127161 - DNA, 19 bp, Homo sapiens
acagggcttggcctgacat

SEQ ID NO: 7127162 - DNA, 22 bp, Homo sapiens
acaggcaggcttcggccagagc

SEQ ID NO: 7127163 - DNA, 22 bp, Homo sapiens
acaggcaggcgggacagcccga

SEQ ID NO: 7127164 - DNA, 22 bp, Homo sapiens
acaggcaggagctccccattcc

SEQ ID NO: 7127165 - DNA, 23 bp, Homo sapiens
acaggcaggcatggccaaatgtg

SEQ ID NO: 7127166 - DNA, 22 bp, Homo sapiens
acaggcaggcgggacagcccga

SEQ ID NO: 7127167 - DNA, 22 bp, Homo sapiens
acaggcagccctctccctggtt

SEQ ID NO: 7127168 - DNA, 22 bp, Homo sapiens
acaggcagccctctccctggtt

SEQ ID NO: 7127169 - DNA, 22 bp, Homo sapiens
acaggcagccctctccctggtt

SEQ ID NO: 7127170 - DNA, 22 bp, Homo sapiens
acaggcagcgtcattgctgctc

SEQ ID NO: 7127171 - DNA, 22 bp, Homo sapiens
acaggcagcgtcattgctgctc

SEQ ID NO: 7127172 - DNA, 22 bp, Homo sapiens
acaggcagcgtcattgctgctc

SEQ ID NO: 7127173 - DNA, 22 bp, Homo sapiens
acaggcaggagctccccattcc

SEQ ID NO: 7127174 - DNA, 22 bp, Homo sapiens
acaggcaggagctccccattcc

SEQ ID NO: 7127175 - DNA, 22 bp, Homo sapiens
acaggcagcaaaatcagcctca

SEQ ID NO: 7127176 - DNA, 22 bp, Homo sapiens
acaggcagcactaatctctggt

SEQ ID NO: 7127177 - DNA, 22 bp, Homo sapiens
acaggcagcactaatctctggt

SEQ ID NO: 7127178 - DNA, 22 bp, Homo sapiens
acaggcagcactaatctctggt

SEQ ID NO: 7127179 - DNA, 22 bp, Homo sapiens
acaggcagcaaaatcagcctca

SEQ ID NO: 7127180 - DNA, 22 bp, Homo sapiens
acaggcagattaagggtaggca

SEQ ID NO: 7127181 - DNA, 22 bp, Homo sapiens
acaggcagcaaaatcagcctca

SEQ ID NO: 7127182 - DNA, 22 bp, Homo sapiens
acaggcagcaaaatcagcctca

SEQ ID NO: 7127183 - DNA, 22 bp, Homo sapiens
acaggcagattaagggtaggca

SEQ ID NO: 7127184 - DNA, 22 bp, Homo sapiens
acaggcagattaagggtaggca

SEQ ID NO: 7127185 - DNA, 22 bp, Homo sapiens
acaggcagattaagggtaggca

SEQ ID NO: 7127186 - DNA, 22 bp, Homo sapiens
acaggcagattaagggtaggca

SEQ ID NO: 7127187 - DNA, 22 bp, Homo sapiens
acaggcagattaagggtaggca

SEQ ID NO: 7127188 - DNA, 22 bp, Homo sapiens
acaggcagatgttttagttgta

SEQ ID NO: 7127189 - DNA, 22 bp, Homo sapiens
acaggcagatgttttagttgta

SEQ ID NO: 7127190 - DNA, 17 bp, Homo sapiens
acaggcagatcacctga

SEQ ID NO: 7127191 - DNA, 17 bp, Homo sapiens
acaggcagatcacctga

SEQ ID NO: 7127192 - DNA, 22 bp, Homo sapiens
acagggaaggacatgacttggc

SEQ ID NO: 7127193 - DNA, 22 bp, Homo sapiens
acaggcagggaccttggctaag

SEQ ID NO: 7127194 - DNA, 22 bp, Homo sapiens
acaggcaggtaatttacatatt

SEQ ID NO: 7127195 - DNA, 22 bp, Homo sapiens
acaggctgttggggtccagggt

SEQ ID NO: 7127196 - DNA, 22 bp, Homo sapiens
acaggcagggacctcttgagtt

SEQ ID NO: 7127197 - DNA, 22 bp, Homo sapiens
acaggcagggaccttggctaag

SEQ ID NO: 7127198 - DNA, 22 bp, Homo sapiens
acaggcagggaccttggctaag

SEQ ID NO: 7127199 - DNA, 22 bp, Homo sapiens
acaggcaggcttcggccagagc

SEQ ID NO: 7127200 - DNA, 22 bp, Homo sapiens
acaggcaggcttcggccagagc

SEQ ID NO: 7127201 - DNA, 22 bp, Homo sapiens
acaggcaggcttcggccagagc

SEQ ID NO: 7127202 - DNA, 22 bp, Homo sapiens
acaggcagggacctcttgagtt

SEQ ID NO: 7127203 - DNA, 22 bp, Homo sapiens
acaggcagggacctcttgagtt

SEQ ID NO: 7127204 - DNA, 22 bp, Homo sapiens
acagggaatggagggatcagta

SEQ ID NO: 7127205 - DNA, 22 bp, Homo sapiens
acagggaagttctgcaacagga

SEQ ID NO: 7127206 - DNA, 22 bp, Homo sapiens
acagggaaggatttagtgggaa

SEQ ID NO: 7127207 - DNA, 22 bp, Homo sapiens
acagggaaggcatccgcgaatg

SEQ ID NO: 7127208 - DNA, 22 bp, Homo sapiens
acagggacctgtgagctccata

SEQ ID NO: 7127209 - DNA, 22 bp, Homo sapiens
acagggacctgtgagctccata

SEQ ID NO: 7127210 - DNA, 22 bp, Homo sapiens
acagggacctgtgagctccata

SEQ ID NO: 7127211 - DNA, 19 bp, Homo sapiens
acagggaatttccacagaa

SEQ ID NO: 7127212 - DNA, 22 bp, Homo sapiens
acagggaccttggaagctggaa

SEQ ID NO: 7127213 - DNA, 22 bp, Homo sapiens
acagggagatatcttcaatatc

SEQ ID NO: 7127214 - DNA, 22 bp, Homo sapiens
acagggagatgggtgaaagcgg

SEQ ID NO: 7127215 - DNA, 22 bp, Homo sapiens
acaggtgttgactcacaggccc

SEQ ID NO: 7127216 - DNA, 22 bp, Homo sapiens
acaggtgttgaatgatgtcaca

SEQ ID NO: 7127217 - DNA, 22 bp, Homo sapiens
acaggtgttgactcacaggccc

SEQ ID NO: 7127218 - DNA, 22 bp, Homo sapiens
acaggtgtacaatgcatgacag

SEQ ID NO: 7127219 - DNA, 22 bp, Homo sapiens
aggacacaggtaagccagtgga

SEQ ID NO: 7127220 - DNA, 22 bp, Homo sapiens
acaggtgtaatttgcccgaggt

SEQ ID NO: 7127221 - DNA, 22 bp, Homo sapiens
acaggtgttttggaggatgatt

SEQ ID NO: 7127222 - DNA, 22 bp, Homo sapiens
acaggtttgtctgatgtaatga

SEQ ID NO: 7127223 - DNA, 22 bp, Homo sapiens
aggacacagctgctctgcagag

SEQ ID NO: 7127224 - DNA, 21 bp, Homo sapiens
aggacacagagacacctattg

SEQ ID NO: 7127225 - DNA, 21 bp, Homo sapiens
aggacacagagacacctattg

SEQ ID NO: 7127226 - DNA, 22 bp, Homo sapiens
aggacacacttctgaggtcttt

SEQ ID NO: 7127227 - DNA, 22 bp, Homo sapiens
acagtaaaaagccttagaattt

SEQ ID NO: 7127228 - DNA, 22 bp, Homo sapiens
acagtaaaaagccttagaattt

SEQ ID NO: 7127229 - DNA, 22 bp, Homo sapiens
acagtaaaaagccttagaattt

SEQ ID NO: 7127230 - DNA, 22 bp, Homo sapiens
acagtaaaacatttttattagg

SEQ ID NO: 7127231 - DNA, 22 bp, Homo sapiens
acagtaaaacatttttattagg

SEQ ID NO: 7127232 - DNA, 22 bp, Homo sapiens
acagtaaaattaagggcagtta

SEQ ID NO: 7127233 - DNA, 22 bp, Homo sapiens
acagtaaaattaagggcagtta

SEQ ID NO: 7127234 - DNA, 22 bp, Homo sapiens
acagtaaacaatgcagcaaatt

SEQ ID NO: 7127235 - DNA, 22 bp, Homo sapiens
acagtaaacaatgcagcaaatt

SEQ ID NO: 7127236 - DNA, 18 bp, Homo sapiens
acagtaaagaaaggaatt

SEQ ID NO: 7127237 - DNA, 22 bp, Homo sapiens
acagtaaagccttctggttgac

SEQ ID NO: 7127238 - DNA, 22 bp, Homo sapiens
acagtaaagccttctggttgac

SEQ ID NO: 7127239 - DNA, 22 bp, Homo sapiens
acagtaaagccttctggttgac

SEQ ID NO: 7127240 - DNA, 16 bp, Homo sapiens
acagtaaagctggaca

SEQ ID NO: 7127241 - DNA, 22 bp, Homo sapiens
acagtaaataatgcatgttgat

SEQ ID NO: 7127242 - DNA, 22 bp, Homo sapiens
acagtaaataatgcatgttgat

SEQ ID NO: 7127243 - DNA, 22 bp, Homo sapiens
acagtaaatattaagcctgagt

SEQ ID NO: 7127244 - DNA, 22 bp, Homo sapiens
acagtaaatattaagcctgagt

SEQ ID NO: 7127245 - DNA, 22 bp, Homo sapiens
acagtaaatattaagcctgagt

SEQ ID NO: 7127246 - DNA, 22 bp, Homo sapiens
aggagcagaactgttgtggagg

SEQ ID NO: 7127247 - DNA, 22 bp, Homo sapiens
aggagcagaactgttgtggagg

SEQ ID NO: 7127248 - DNA, 22 bp, Homo sapiens
aggagcagaactgattctgact

SEQ ID NO: 7127249 - DNA, 22 bp, Homo sapiens
aggagcactgagccagcatggg

SEQ ID NO: 7127250 - DNA, 22 bp, Homo sapiens
aggagcagaactgattctgact

SEQ ID NO: 7127251 - DNA, 22 bp, Homo sapiens
aggagcagaactgattctgact

SEQ ID NO: 7127252 - DNA, 22 bp, Homo sapiens
aggagcactgagccagcatggg

SEQ ID NO: 7127253 - DNA, 22 bp, Homo sapiens
aggagcactgagccagcatggg

SEQ ID NO: 7127254 - DNA, 22 bp, Homo sapiens
acagtaaatcaacagaatatct

SEQ ID NO: 7127255 - DNA, 22 bp, Homo sapiens
acagtaaatcaacagaatatct

SEQ ID NO: 7127256 - DNA, 22 bp, Homo sapiens
aggagatggagctcagtgggca

SEQ ID NO: 7127257 - DNA, 22 bp, Homo sapiens
aggagattgtactgtcatcact

SEQ ID NO: 7127258 - DNA, 22 bp, Homo sapiens
aggagattgtggtgcaaggaat

SEQ ID NO: 7127259 - DNA, 22 bp, Homo sapiens
aggagcaaggaagctacagttt

SEQ ID NO: 7127260 - DNA, 22 bp, Homo sapiens
aggagcaaggaagctacagttt

SEQ ID NO: 7127261 - DNA, 22 bp, Homo sapiens
aggagcaaatgatgagacagca

SEQ ID NO: 7127262 - DNA, 22 bp, Homo sapiens
aggagcaaatgatgagacagca

SEQ ID NO: 7127263 - DNA, 22 bp, Homo sapiens
aggagcaaatgatgagacagca

SEQ ID NO: 7127264 - DNA, 22 bp, Homo sapiens
aggagcagaccgtagtcctgca

SEQ ID NO: 7127265 - DNA, 22 bp, Homo sapiens
aggagcagaccgtagtcctgca

SEQ ID NO: 7127266 - DNA, 22 bp, Homo sapiens
aggagcagaccgtagtcctgca

SEQ ID NO: 7127267 - DNA, 22 bp, Homo sapiens
aggagcagaccgtagtcctgca

SEQ ID NO: 7127268 - DNA, 22 bp, Homo sapiens
aggagcagaatttaatgtgcag

SEQ ID NO: 7127269 - DNA, 22 bp, Homo sapiens
aggagcagaccgtagtcctgca

SEQ ID NO: 7127270 - DNA, 22 bp, Homo sapiens
acagtacaccactgtgtacagt

SEQ ID NO: 7127271 - DNA, 22 bp, Homo sapiens
acagtatgaatgcagaatgtag

SEQ ID NO: 7127272 - DNA, 22 bp, Homo sapiens
acagtatgaatgtctgaaaaat

SEQ ID NO: 7127273 - DNA, 22 bp, Homo sapiens
acagtatgaatgtctgaaaaat

SEQ ID NO: 7127274 - DNA, 22 bp, Homo sapiens
acagtatatatggttatctgat

SEQ ID NO: 7127275 - DNA, 21 bp, Homo sapiens
acagtatattagatatttgaa

SEQ ID NO: 7127276 - DNA, 22 bp, Homo sapiens
acagtatatatagtctaaaagc

SEQ ID NO: 7127277 - DNA, 22 bp, Homo sapiens
acagtacagctaatgtcattag

SEQ ID NO: 7127278 - DNA, 22 bp, Homo sapiens
acagtatatatagtctaaaagc

SEQ ID NO: 7127279 - DNA, 22 bp, Homo sapiens
acagtatatatagtctaaaagc

SEQ ID NO: 7127280 - DNA, 22 bp, Homo sapiens
acagtcagtatcccaggcaaat

SEQ ID NO: 7127281 - DNA, 19 bp, Homo sapiens
acagtcagggaataaagac

SEQ ID NO: 7127282 - DNA, 19 bp, Homo sapiens
acagtcagggaataaagac

SEQ ID NO: 7127283 - DNA, 20 bp, Homo sapiens
acagtcagggaatagaaaaa

SEQ ID NO: 7127284 - DNA, 22 bp, Homo sapiens
acagtcagggcttactcaggga

SEQ ID NO: 7127285 - DNA, 22 bp, Homo sapiens
acagtccccataccacctgtcc

SEQ ID NO: 7127286 - DNA, 22 bp, Homo sapiens
acagtccccataccacctgtcc

SEQ ID NO: 7127287 - DNA, 22 bp, Homo sapiens
acagtatattttcttgattgtt

SEQ ID NO: 7127288 - DNA, 22 bp, Homo sapiens
acagtcaagaaatggcagagcc

SEQ ID NO: 7127289 - DNA, 22 bp, Homo sapiens
acagtcaatcagaacagcatgt

SEQ ID NO: 7127290 - DNA, 21 bp, Homo sapiens
acagtcacaaaaccaaggcag

SEQ ID NO: 7127291 - DNA, 22 bp, Homo sapiens
acagtcaggaatttgtaaaacg

SEQ ID NO: 7127292 - DNA, 22 bp, Homo sapiens
acagtcctagctgcaaagaagt

SEQ ID NO: 7127293 - DNA, 22 bp, Homo sapiens
acagtcctaagataattgtctc

SEQ ID NO: 7127294 - DNA, 22 bp, Homo sapiens
acagtcctagctgcaaagaagt

SEQ ID NO: 7127295 - DNA, 22 bp, Homo sapiens
acagtccttgtgtggaacatta

SEQ ID NO: 7127296 - DNA, 23 bp, Homo sapiens
acagtcgtaggtatccttttcct

SEQ ID NO: 7127297 - DNA, 22 bp, Homo sapiens
acagtctaggcctaggtcaaaa

SEQ ID NO: 7127298 - DNA, 22 bp, Homo sapiens
acagtctacttgagcttgtata

SEQ ID NO: 7127299 - DNA, 21 bp, Homo sapiens
acagtctccccagatctctcc

SEQ ID NO: 7127300 - DNA, 22 bp, Homo sapiens
acagtctctccacactgcaggg

SEQ ID NO: 7127301 - DNA, 22 bp, Homo sapiens
acagtctctccacactgcaggg

SEQ ID NO: 7127302 - DNA, 22 bp, Homo sapiens
acagtctctgttgctgctgttt

SEQ ID NO: 7127303 - DNA, 22 bp, Homo sapiens
acagtctcttgcttgaatacta

SEQ ID NO: 7127304 - DNA, 22 bp, Homo sapiens
acagtgtggtttgagcactggg

SEQ ID NO: 7127305 - DNA, 23 bp, Homo sapiens
acagtgtggtggacaaggagcag

SEQ ID NO: 7127306 - DNA, 22 bp, Homo sapiens
acagtgtggttgtttctggtta

SEQ ID NO: 7127307 - DNA, 22 bp, Homo sapiens
acagtgtggtgatggcacttgc

SEQ ID NO: 7127308 - DNA, 22 bp, Homo sapiens
acagtgggacagtgacggggga

SEQ ID NO: 7127309 - DNA, 22 bp, Homo sapiens
acagtctgcttgtctccatggt

SEQ ID NO: 7127310 - DNA, 22 bp, Homo sapiens
acagtctggaagcagggggcaa

SEQ ID NO: 7127311 - DNA, 22 bp, Homo sapiens
acagtctgcttgtctccatggt

SEQ ID NO: 7127312 - DNA, 17 bp, Homo sapiens
acagtctgcctgacagt

SEQ ID NO: 7127313 - DNA, 22 bp, Homo sapiens
acagtctgcatatgacctgtag

SEQ ID NO: 7127314 - DNA, 22 bp, Homo sapiens
acagtctgcagggtgaacatgt

SEQ ID NO: 7127315 - DNA, 22 bp, Homo sapiens
acagtctgcctctcagagcagc

SEQ ID NO: 7127316 - DNA, 22 bp, Homo sapiens
acagtctgcctctcagagcagc

SEQ ID NO: 7127317 - DNA, 22 bp, Homo sapiens
acagtctgcagggtgaacatgt

SEQ ID NO: 7127318 - DNA, 22 bp, Homo sapiens
acagtgggatgaggctggcccc

SEQ ID NO: 7127319 - DNA, 20 bp, Homo sapiens
acagtgggtggggagcactg

SEQ ID NO: 7127320 - DNA, 20 bp, Homo sapiens
acagtgggtggggagcactg

SEQ ID NO: 7127321 - DNA, 23 bp, Homo sapiens
acagtgtctgctgcaagatatct

SEQ ID NO: 7127322 - DNA, 22 bp, Homo sapiens
aggatgagattccagggtcaat

SEQ ID NO: 7127323 - DNA, 22 bp, Homo sapiens
aggatgagattccagggtcaat

SEQ ID NO: 7127324 - DNA, 22 bp, Homo sapiens
aggatgagattccagggtcaat

SEQ ID NO: 7127325 - DNA, 22 bp, Homo sapiens
aggatgagattccagggtcaat

SEQ ID NO: 7127326 - DNA, 22 bp, Homo sapiens
aggatgagccgcgcaagctgac

SEQ ID NO: 7127327 - DNA, 22 bp, Homo sapiens
aggatgagccgcgcaagctgac

SEQ ID NO: 7127328 - DNA, 22 bp, Homo sapiens
aggatgagagatacatggagca

SEQ ID NO: 7127329 - DNA, 22 bp, Homo sapiens
aggatgagattccagggtcaat

SEQ ID NO: 7127330 - DNA, 22 bp, Homo sapiens
acagtgtgttctgggacctcca

SEQ ID NO: 7127331 - DNA, 21 bp, Homo sapiens
aggatggaaaggactaggggt

SEQ ID NO: 7127332 - DNA, 22 bp, Homo sapiens
aggatggaattaggtagcaagt

SEQ ID NO: 7127333 - DNA, 22 bp, Homo sapiens
acagtttatcgattcacctacc

SEQ ID NO: 7127334 - DNA, 20 bp, Homo sapiens
acagtttatccagttagcag

SEQ ID NO: 7127335 - DNA, 22 bp, Homo sapiens
acagtttataaaaataatgagg

SEQ ID NO: 7127336 - DNA, 22 bp, Homo sapiens
acagtttaggatgagagaacac

SEQ ID NO: 7127337 - DNA, 22 bp, Homo sapiens
acagtttaggatgagagaacac

SEQ ID NO: 7127338 - DNA, 22 bp, Homo sapiens
acagtttataaaaataatgagg

SEQ ID NO: 7127339 - DNA, 22 bp, Homo sapiens
acagtttataaaaataatgagg

SEQ ID NO: 7127340 - DNA, 22 bp, Homo sapiens
acagtttagagcatgatgacca

SEQ ID NO: 7127341 - DNA, 22 bp, Homo sapiens
aggatggattctgtatgtggga

SEQ ID NO: 7127342 - DNA, 21 bp, Homo sapiens
acagttcatgataactccatc

SEQ ID NO: 7127343 - DNA, 19 bp, Homo sapiens
aggatggagcaggcggtga

SEQ ID NO: 7127344 - DNA, 22 bp, Homo sapiens
aggcactgggggatgagcaagg

SEQ ID NO: 7127345 - DNA, 22 bp, Homo sapiens
aggcactgggggatgagcaagg

SEQ ID NO: 7127346 - DNA, 22 bp, Homo sapiens
aggcactgggtaattagtagct

SEQ ID NO: 7127347 - DNA, 20 bp, Homo sapiens
aggcactggggataggtaag

SEQ ID NO: 7127348 - DNA, 20 bp, Homo sapiens
aggcactggggataggtaag

SEQ ID NO: 7127349 - DNA, 22 bp, Homo sapiens
aggcactgggggatgagcaagg

SEQ ID NO: 7127350 - DNA, 20 bp, Homo sapiens
aggcactggatttcttatat

SEQ ID NO: 7127351 - DNA, 18 bp, Homo sapiens
aggcactggaattaaggg

SEQ ID NO: 7127352 - DNA, 18 bp, Homo sapiens
aggcactggaattaaggg

SEQ ID NO: 7127353 - DNA, 22 bp, Homo sapiens
aggcactgggaatatgctgagg

SEQ ID NO: 7127354 - DNA, 22 bp, Homo sapiens
aggcactgggaatatgctgagg

SEQ ID NO: 7127355 - DNA, 22 bp, Homo sapiens
aggcactgcttctaagtaggaa

SEQ ID NO: 7127356 - DNA, 22 bp, Homo sapiens
aggcactgcttctaagtaggaa

SEQ ID NO: 7127357 - DNA, 22 bp, Homo sapiens
acagtttgccctgacattctcc

SEQ ID NO: 7127358 - DNA, 22 bp, Homo sapiens
acagtttgagaaccactagcct

SEQ ID NO: 7127359 - DNA, 22 bp, Homo sapiens
acagtttccccctagggcagca

SEQ ID NO: 7127360 - DNA, 22 bp, Homo sapiens
acagtttattgcacaggtaacc

SEQ ID NO: 7127361 - DNA, 22 bp, Homo sapiens
acagtttatcgattcacctacc

SEQ ID NO: 7127362 - DNA, 22 bp, Homo sapiens
acagtttatggtgttttatata

SEQ ID NO: 7127363 - DNA, 22 bp, Homo sapiens
acagtttatggtgttttatata

SEQ ID NO: 7127364 - DNA, 22 bp, Homo sapiens
acagtttatggtgttttatata

SEQ ID NO: 7127365 - DNA, 22 bp, Homo sapiens
acagtttatggtgttttatata

SEQ ID NO: 7127366 - DNA, 22 bp, Homo sapiens
acatagagcattggatatggga

SEQ ID NO: 7127367 - DNA, 22 bp, Homo sapiens
acatagagtatcatactggatg

SEQ ID NO: 7127368 - DNA, 22 bp, Homo sapiens
acatagagagcacttagaagtt

SEQ ID NO: 7127369 - DNA, 22 bp, Homo sapiens
acatagaaggaggctggcagct

SEQ ID NO: 7127370 - DNA, 22 bp, Homo sapiens
acatagaaggaggctggcagct

SEQ ID NO: 7127371 - DNA, 22 bp, Homo sapiens
acatagatttaagagcaattag

SEQ ID NO: 7127372 - DNA, 22 bp, Homo sapiens
acatagcacgtctcaatttgga

SEQ ID NO: 7127373 - DNA, 22 bp, Homo sapiens
acatagaaggaagagtagtagg

SEQ ID NO: 7127374 - DNA, 22 bp, Homo sapiens
acatagaaggaagagtagtagg

SEQ ID NO: 7127375 - DNA, 22 bp, Homo sapiens
acatagaacttcccagtgagca

SEQ ID NO: 7127376 - DNA, 22 bp, Homo sapiens
acatagaacttcgatgtctttt

SEQ ID NO: 7127377 - DNA, 22 bp, Homo sapiens
acatagaacttcccagtgagca

SEQ ID NO: 7127378 - DNA, 21 bp, Homo sapiens
acatacattatctttttaaaa

SEQ ID NO: 7127379 - DNA, 21 bp, Homo sapiens
acatacattatctttttaaaa

SEQ ID NO: 7127380 - DNA, 21 bp, Homo sapiens
acatacattatctttttaaaa

SEQ ID NO: 7127381 - DNA, 22 bp, Homo sapiens
acatagcacgtctcaatttgga

SEQ ID NO: 7127382 - DNA, 22 bp, Homo sapiens
acatagcagaggactgagcaga

SEQ ID NO: 7127383 - DNA, 22 bp, Homo sapiens
acatagcacgtctcaatttgga

SEQ ID NO: 7127384 - DNA, 22 bp, Homo sapiens
acatagcataaagaatgactct

SEQ ID NO: 7127385 - DNA, 22 bp, Homo sapiens
acatagcataaagaatgactct

SEQ ID NO: 7127386 - DNA, 22 bp, Homo sapiens
acatagcatgtttggacacatg

SEQ ID NO: 7127387 - DNA, 20 bp, Homo sapiens
acatagctatagaaagtcga

SEQ ID NO: 7127388 - DNA, 22 bp, Homo sapiens
acatagctcagcataatcgtgg

SEQ ID NO: 7127389 - DNA, 22 bp, Homo sapiens
acatagctcagcataatcgtgg

SEQ ID NO: 7127390 - DNA, 20 bp, Homo sapiens
acatagctatagaaagtcga

SEQ ID NO: 7127391 - DNA, 22 bp, Homo sapiens
acatagctcagtatcacttact

SEQ ID NO: 7127392 - DNA, 22 bp, Homo sapiens
acatagctcagtatcacttact

SEQ ID NO: 7127393 - DNA, 19 bp, Homo sapiens
acatagctggctacactgt

SEQ ID NO: 7127394 - DNA, 22 bp, Homo sapiens
acatagctcagtatcacttact

SEQ ID NO: 7127395 - DNA, 22 bp, Homo sapiens
acatagcttaaatgagaagata

SEQ ID NO: 7127396 - DNA, 22 bp, Homo sapiens
acatagtaagtgctcagtaaat

SEQ ID NO: 7127397 - DNA, 22 bp, Homo sapiens
acatagtaagtgctcagtaaat

SEQ ID NO: 7127398 - DNA, 22 bp, Homo sapiens
acatagtaagtgctcagtaaat

SEQ ID NO: 7127399 - DNA, 22 bp, Homo sapiens
acatagtgagagaaagatcagc

SEQ ID NO: 7127400 - DNA, 22 bp, Homo sapiens
acatagtgagagaaagatcagc

SEQ ID NO: 7127401 - DNA, 22 bp, Homo sapiens
acatagtgttttgagagacagc

SEQ ID NO: 7127402 - DNA, 22 bp, Homo sapiens
acatagtgttttgagagacagc

SEQ ID NO: 7127403 - DNA, 17 bp, Homo sapiens
aggcagctcagaacatc

SEQ ID NO: 7127404 - DNA, 17 bp, Homo sapiens
aggcagctcagaacatc

SEQ ID NO: 7127405 - DNA, 17 bp, Homo sapiens
aggcagctcagaacatc

SEQ ID NO: 7127406 - DNA, 22 bp, Homo sapiens
aggcagctgccctctccttcct

SEQ ID NO: 7127407 - DNA, 22 bp, Homo sapiens
aggcagctgccctctccttcct

SEQ ID NO: 7127408 - DNA, 22 bp, Homo sapiens
aggcagctggaaaactccaggc

SEQ ID NO: 7127409 - DNA, 22 bp, Homo sapiens
aggcagctggaaaactccaggc

SEQ ID NO: 7127410 - DNA, 21 bp, Homo sapiens
aggcagctggaaggcctggct

SEQ ID NO: 7127411 - DNA, 21 bp, Homo sapiens
aggcagctggaaggcctggct

SEQ ID NO: 7127412 - DNA, 21 bp, Homo sapiens
aggcagctcaggcccagagag

SEQ ID NO: 7127413 - DNA, 22 bp, Homo sapiens
aggcagctctgtggcctcccag

SEQ ID NO: 7127414 - DNA, 22 bp, Homo sapiens
aggcagctgaccacagtatgat

SEQ ID NO: 7127415 - DNA, 22 bp, Homo sapiens
aggcagctgaggtctggcgccc

SEQ ID NO: 7127416 - DNA, 22 bp, Homo sapiens
acatattgagctctaaaagtac

SEQ ID NO: 7127417 - DNA, 23 bp, Homo sapiens
acatattgaatgctgagaatttt

SEQ ID NO: 7127418 - DNA, 22 bp, Homo sapiens
acatattggcaaactggaggca

SEQ ID NO: 7127419 - DNA, 22 bp, Homo sapiens
acatattggcttagctctgtga

SEQ ID NO: 7127420 - DNA, 22 bp, Homo sapiens
acatattgaggctttgatttaa

SEQ ID NO: 7127421 - DNA, 22 bp, Homo sapiens
acatattggcaaactggaggca

SEQ ID NO: 7127422 - DNA, 22 bp, Homo sapiens
acatatttccatgcagcatgtc

SEQ ID NO: 7127423 - DNA, 22 bp, Homo sapiens
acatatttccatgcagcatgtc

SEQ ID NO: 7127424 - DNA, 22 bp, Homo sapiens
acatatttccatgcagcatgtc

SEQ ID NO: 7127425 - DNA, 22 bp, Homo sapiens
acatattttgaaagctttctaa

SEQ ID NO: 7127426 - DNA, 22 bp, Homo sapiens
acatattttgaaagctttctaa

SEQ ID NO: 7127427 - DNA, 22 bp, Homo sapiens
acatattaactgcactacacta

SEQ ID NO: 7127428 - DNA, 22 bp, Homo sapiens
acatattaactgcactacacta

SEQ ID NO: 7127429 - DNA, 20 bp, Homo sapiens
acatatcatggtagagtcct

SEQ ID NO: 7127430 - DNA, 20 bp, Homo sapiens
acatatcatggtagagtcct

SEQ ID NO: 7127431 - DNA, 20 bp, Homo sapiens
acatatcatggtagagtcct

SEQ ID NO: 7127432 - DNA, 21 bp, Homo sapiens
aggcagctggaaggcctggct

SEQ ID NO: 7127433 - DNA, 22 bp, Homo sapiens
aggcagctggacataactaacc

SEQ ID NO: 7127434 - DNA, 22 bp, Homo sapiens
aggcagctggaggcagagacta

SEQ ID NO: 7127435 - DNA, 22 bp, Homo sapiens
acatatattttcacacatggtt

SEQ ID NO: 7127436 - DNA, 22 bp, Homo sapiens
atctcaaagcatggagcagaat

SEQ ID NO: 7127437 - DNA, 22 bp, Homo sapiens
atctcaaaaatgacctagagaa

SEQ ID NO: 7127438 - DNA, 22 bp, Homo sapiens
atctcaaacatctttgaccata

SEQ ID NO: 7127439 - DNA, 22 bp, Homo sapiens
atctatttctgctaataacaat

SEQ ID NO: 7127440 - DNA, 22 bp, Homo sapiens
atctaattttcactcatttgct

SEQ ID NO: 7127441 - DNA, 22 bp, Homo sapiens
atctatttctgctaataacaat

SEQ ID NO: 7127442 - DNA, 22 bp, Homo sapiens
atctaagattttgctaagatca

SEQ ID NO: 7127443 - DNA, 22 bp, Homo sapiens
atctaagctcacaggcttgttg

SEQ ID NO: 7127444 - DNA, 21 bp, Homo sapiens
atctcacagcccagagaagcc

SEQ ID NO: 7127445 - DNA, 22 bp, Homo sapiens
atctcacagaggcccaccagga

SEQ ID NO: 7127446 - DNA, 22 bp, Homo sapiens
atctcacatcctcagtagtgca

SEQ ID NO: 7127447 - DNA, 22 bp, Homo sapiens
atctcaccaagttattacgaga

SEQ ID NO: 7127448 - DNA, 22 bp, Homo sapiens
atctcaaagcatggagcagaat

SEQ ID NO: 7127449 - DNA, 22 bp, Homo sapiens
atctcaaatgattacaccaagc

SEQ ID NO: 7127450 - DNA, 22 bp, Homo sapiens
atctcacactgggtttgagggt

SEQ ID NO: 7127451 - DNA, 20 bp, Homo sapiens
atcggcttgcctggaaacaa

SEQ ID NO: 7127452 - DNA, 22 bp, Homo sapiens
atctaaaaggagctctttatct

SEQ ID NO: 7127453 - DNA, 22 bp, Homo sapiens
atctaaaaggagctctttatct

SEQ ID NO: 7127454 - DNA, 22 bp, Homo sapiens
atctaaaaggagctctttatct

SEQ ID NO: 7127455 - DNA, 22 bp, Homo sapiens
atctaaaatgtggttagttggt

SEQ ID NO: 7127456 - DNA, 22 bp, Homo sapiens
atctaaaatgtggttagttggt

SEQ ID NO: 7127457 - DNA, 22 bp, Homo sapiens
atctaaaatgtggttagttggt

SEQ ID NO: 7127458 - DNA, 22 bp, Homo sapiens
atctaaacaggtgttctttaga

SEQ ID NO: 7127459 - DNA, 22 bp, Homo sapiens
atctaaaccctactttctttct

SEQ ID NO: 7127460 - DNA, 22 bp, Homo sapiens
atctaaagtgtcataagtagct

SEQ ID NO: 7127461 - DNA, 22 bp, Homo sapiens
atctaacactgtaaactgtctt

SEQ ID NO: 7127462 - DNA, 22 bp, Homo sapiens
atctaagacaatgagtgagact

SEQ ID NO: 7127463 - DNA, 22 bp, Homo sapiens
atctaagagagagagcatgtct

SEQ ID NO: 7127464 - DNA, 19 bp, Homo sapiens
atctaagagatgggggaaa

SEQ ID NO: 7127465 - DNA, 22 bp, Homo sapiens
atctaagagttaacatcaagaa

SEQ ID NO: 7127466 - DNA, 22 bp, Homo sapiens
atctaagagttaacatcaagaa

SEQ ID NO: 7127467 - DNA, 22 bp, Homo sapiens
atcatccatggctgatcataaa

SEQ ID NO: 7127468 - DNA, 22 bp, Homo sapiens
atcatcctagaaggaagctagg

SEQ ID NO: 7127469 - DNA, 22 bp, Homo sapiens
atcatcctagaaggaagctagg

SEQ ID NO: 7127470 - DNA, 19 bp, Homo sapiens
atcatcctgggtcatgcac

SEQ ID NO: 7127471 - DNA, 19 bp, Homo sapiens
atcatcctgggtcatgcac

SEQ ID NO: 7127472 - DNA, 22 bp, Homo sapiens
atcatcgtcccttctcttgtca

SEQ ID NO: 7127473 - DNA, 20 bp, Homo sapiens
atcatctcaaagctgaggtt

SEQ ID NO: 7127474 - DNA, 20 bp, Homo sapiens
atcatctcaaagctgaggtt

SEQ ID NO: 7127475 - DNA, 22 bp, Homo sapiens
atcatctgcacagatcctattt

SEQ ID NO: 7127476 - DNA, 22 bp, Homo sapiens
atcatctgcacagatcctattt

SEQ ID NO: 7127477 - DNA, 22 bp, Homo sapiens
atcatctgcctcatcactgcat

SEQ ID NO: 7127478 - DNA, 22 bp, Homo sapiens
atcatctgcctcatcactgcat

SEQ ID NO: 7127479 - DNA, 22 bp, Homo sapiens
atcatctggcattcagattggc

SEQ ID NO: 7127480 - DNA, 22 bp, Homo sapiens
atcatctgggttaatgtgctca

SEQ ID NO: 7127481 - DNA, 22 bp, Homo sapiens
atcatctggcattcagattggc

SEQ ID NO: 7127482 - DNA, 22 bp, Homo sapiens
atcatctgggttaatgtgctca

SEQ ID NO: 7127483 - DNA, 22 bp, Homo sapiens
atcatctgtctccttgtatgtt

SEQ ID NO: 7127484 - DNA, 22 bp, Homo sapiens
atcatccaagcgtagttcttct

SEQ ID NO: 7127485 - DNA, 22 bp, Homo sapiens
agaacaggcagttggttggatt

SEQ ID NO: 7127486 - DNA, 22 bp, Homo sapiens
agaacaggcagttggttggatt

SEQ ID NO: 7127487 - DNA, 22 bp, Homo sapiens
agaacagggactggaggcttca

SEQ ID NO: 7127488 - DNA, 22 bp, Homo sapiens
agaacagcttgcctttaataga

SEQ ID NO: 7127489 - DNA, 22 bp, Homo sapiens
agaacaggaggaagccagctcc

SEQ ID NO: 7127490 - DNA, 22 bp, Homo sapiens
agaacaggaggaagccagctcc

SEQ ID NO: 7127491 - DNA, 22 bp, Homo sapiens
agaacaggaggaagccagctcc

SEQ ID NO: 7127492 - DNA, 22 bp, Homo sapiens
agaacaggaggaagccagctcc

SEQ ID NO: 7127493 - DNA, 22 bp, Homo sapiens
agaacaggcagttggttggatt

SEQ ID NO: 7127494 - DNA, 22 bp, Homo sapiens
agaacaggcagttggttggatt

SEQ ID NO: 7127495 - DNA, 22 bp, Homo sapiens
atcatcttgaaagtctatgttt

SEQ ID NO: 7127496 - DNA, 22 bp, Homo sapiens
atcatcttcgaaaaaagtcaga

SEQ ID NO: 7127497 - DNA, 22 bp, Homo sapiens
atcatcttcgaaaaaagtcaga

SEQ ID NO: 7127498 - DNA, 22 bp, Homo sapiens
atcatcttaaggtatctcaagc

SEQ ID NO: 7127499 - DNA, 22 bp, Homo sapiens
atcatcttaaatctagaatgtg

SEQ ID NO: 7127500 - DNA, 22 bp, Homo sapiens
atcatcttaaatctagaatgtg

SEQ ID NO: 7127501 - DNA, 22 bp, Homo sapiens
atcatctgtctctgcagttgaa

SEQ ID NO: 7127502 - DNA, 22 bp, Homo sapiens
atcatctgtctctgcagttgaa

SEQ ID NO: 7127503 - DNA, 22 bp, Homo sapiens
atcatcttaaatctagaatgtg

SEQ ID NO: 7127504 - DNA, 22 bp, Homo sapiens
atcatcttaaggtatctcaagc

SEQ ID NO: 7127505 - DNA, 22 bp, Homo sapiens
atcatcttgctttctgtttact

SEQ ID NO: 7127506 - DNA, 18 bp, Homo sapiens
atcctgggagcagacagc

SEQ ID NO: 7127507 - DNA, 19 bp, Homo sapiens
atcctttcccacatacttt

SEQ ID NO: 7127508 - DNA, 19 bp, Homo sapiens
atcctttcccacatacttt

SEQ ID NO: 7127509 - DNA, 22 bp, Homo sapiens
atcgagttctgatgtcccttct

SEQ ID NO: 7127510 - DNA, 20 bp, Homo sapiens
atcggcttgcctggaaacaa

SEQ ID NO: 7127511 - DNA, 22 bp, Homo sapiens
agaaagggtcactgaaagagga

SEQ ID NO: 7127512 - DNA, 22 bp, Homo sapiens
agaaagggtcactgaaagagga

SEQ ID NO: 7127513 - DNA, 22 bp, Homo sapiens
agaaagggtcactgaaagagga

SEQ ID NO: 7127514 - DNA, 22 bp, Homo sapiens
agaaagggtcactgaaagagga

SEQ ID NO: 7127515 - DNA, 22 bp, Homo sapiens
agaaagggctattttgaggtag

SEQ ID NO: 7127516 - DNA, 22 bp, Homo sapiens
agaaagggctattttgaggtag

SEQ ID NO: 7127517 - DNA, 22 bp, Homo sapiens
agaaagggctattttgaggtag

SEQ ID NO: 7127518 - DNA, 22 bp, Homo sapiens
agaaaggtcacttagcctcagc

SEQ ID NO: 7127519 - DNA, 22 bp, Homo sapiens
agaaaggtcaaaatcgtgacat

SEQ ID NO: 7127520 - DNA, 22 bp, Homo sapiens
agaaagggttctctgaggtgct

SEQ ID NO: 7127521 - DNA, 23 bp, Homo sapiens
agaaagtcatggccaggtttgat

SEQ ID NO: 7127522 - DNA, 22 bp, Homo sapiens
agaaagtacagatgagacactt

SEQ ID NO: 7127523 - DNA, 22 bp, Homo sapiens
agaaagtacagatgagacactt

SEQ ID NO: 7127524 - DNA, 22 bp, Homo sapiens
agaaagtacagatgagacactt

SEQ ID NO: 7127525 - DNA, 22 bp, Homo sapiens
agaaagtacagatgagacactt

SEQ ID NO: 7127526 - DNA, 22 bp, Homo sapiens
agaaaggtggatgctctggaat

SEQ ID NO: 7127527 - DNA, 22 bp, Homo sapiens
agaaaggtcaaaatcgtgacat

SEQ ID NO: 7127528 - DNA, 22 bp, Homo sapiens
agaaagttaaacagtgataaga

SEQ ID NO: 7127529 - DNA, 22 bp, Homo sapiens
agaaagttaaacagtgataaga

SEQ ID NO: 7127530 - DNA, 22 bp, Homo sapiens
agaaagtgcttccctttggact

SEQ ID NO: 7127531 - DNA, 22 bp, Homo sapiens
agaaagtgcttccctttggact

SEQ ID NO: 7127532 - DNA, 22 bp, Homo sapiens
agaaagtgcttccctttggtga

SEQ ID NO: 7127533 - DNA, 22 bp, Homo sapiens
agaaagtgaacgtgttcagttt

SEQ ID NO: 7127534 - DNA, 22 bp, Homo sapiens
agaaagtgaacgtgttcagttt

SEQ ID NO: 7127535 - DNA, 22 bp, Homo sapiens
agaaagtgaacgtgttcagttt

SEQ ID NO: 7127536 - DNA, 22 bp, Homo sapiens
agaaagtgaacgtgttcagttt

SEQ ID NO: 7127537 - DNA, 22 bp, Homo sapiens
agaaagtgaccttgaaaactgg

SEQ ID NO: 7127538 - DNA, 22 bp, Homo sapiens
agaaagtgaccttgaaaactgg

SEQ ID NO: 7127539 - DNA, 22 bp, Homo sapiens
agaaagtgcctcccttgggagc

SEQ ID NO: 7127540 - DNA, 22 bp, Homo sapiens
agaaagtgcctcccttgggagc

SEQ ID NO: 7127541 - DNA, 22 bp, Homo sapiens
agaaagttagcagactcttggc

SEQ ID NO: 7127542 - DNA, 22 bp, Homo sapiens
agaaagttcactggtatatttt

SEQ ID NO: 7127543 - DNA, 22 bp, Homo sapiens
agaaagttatcacaaaattgag

SEQ ID NO: 7127544 - DNA, 22 bp, Homo sapiens
agaaagttctgtgagttgttca

SEQ ID NO: 7127545 - DNA, 22 bp, Homo sapiens
agaaagttctgtgagttgttca

SEQ ID NO: 7127546 - DNA, 22 bp, Homo sapiens
agaaagttgttttagccaaacc

SEQ ID NO: 7127547 - DNA, 22 bp, Homo sapiens
agaaagttgttggaggaaatga

SEQ ID NO: 7127548 - DNA, 23 bp, Homo sapiens
agaaagtttgtgccttgtgacac

SEQ ID NO: 7127549 - DNA, 23 bp, Homo sapiens
agaaagtttgtgccttgtgacac

SEQ ID NO: 7127550 - DNA, 22 bp, Homo sapiens
agaaagtttggggctgggcacg

SEQ ID NO: 7127551 - DNA, 22 bp, Homo sapiens
agaaagtttgagaactgtagat

SEQ ID NO: 7127552 - DNA, 22 bp, Homo sapiens
agaaagtttatttcttgatgga

SEQ ID NO: 7127553 - DNA, 22 bp, Homo sapiens
agaaagtttattcctatctagc

SEQ ID NO: 7127554 - DNA, 22 bp, Homo sapiens
agaaagtttattcctatctagc

SEQ ID NO: 7127555 - DNA, 22 bp, Homo sapiens
agaaattaggaaagtaacactt

SEQ ID NO: 7127556 - DNA, 22 bp, Homo sapiens
agaaattatgcagtagttttat

SEQ ID NO: 7127557 - DNA, 22 bp, Homo sapiens
agaaattatgcagtagttttat

SEQ ID NO: 7127558 - DNA, 22 bp, Homo sapiens
agaaattatgcagtagttttat

SEQ ID NO: 7127559 - DNA, 22 bp, Homo sapiens
agaaattatgcagtagttttat

SEQ ID NO: 7127560 - DNA, 22 bp, Homo sapiens
agaacacatagagaagttttat

SEQ ID NO: 7127561 - DNA, 22 bp, Homo sapiens
agaacacatagagaagttttat

SEQ ID NO: 7127562 - DNA, 22 bp, Homo sapiens
agaacactgatagctgagggga

SEQ ID NO: 7127563 - DNA, 22 bp, Homo sapiens
agaacactgctagtataatcac

SEQ ID NO: 7127564 - DNA, 22 bp, Homo sapiens
agaacactgtaaagtcattgaa

SEQ ID NO: 7127565 - DNA, 22 bp, Homo sapiens
agaacacttttaaatggcttgt

SEQ ID NO: 7127566 - DNA, 22 bp, Homo sapiens
agaacagaagggaggaaggcct

SEQ ID NO: 7127567 - DNA, 22 bp, Homo sapiens
agaacagaggccttatgtttca

SEQ ID NO: 7127568 - DNA, 22 bp, Homo sapiens
agaacagatgtgggcagacctg

SEQ ID NO: 7127569 - DNA, 22 bp, Homo sapiens
agaacagatgtgggcagacctg

SEQ ID NO: 7127570 - DNA, 22 bp, Homo sapiens
agaacagatgtgggcagacctg

SEQ ID NO: 7127571 - DNA, 22 bp, Homo sapiens
agaacagcacaggaagtgtatc

SEQ ID NO: 7127572 - DNA, 22 bp, Homo sapiens
agaacagcagcacgtcaagctg

SEQ ID NO: 7127573 - DNA, 22 bp, Homo sapiens
agaacagcaggaaggccaggta

SEQ ID NO: 7127574 - DNA, 22 bp, Homo sapiens
agaacagcagtagtatacagta

SEQ ID NO: 7127575 - DNA, 22 bp, Homo sapiens
agaacagcagtagtatacagta

SEQ ID NO: 7127576 - DNA, 22 bp, Homo sapiens
agaacagcagttatggttcatt

SEQ ID NO: 7127577 - DNA, 22 bp, Homo sapiens
agaacagccaactgtgtaggag

SEQ ID NO: 7127578 - DNA, 22 bp, Homo sapiens
agaacagctgattccatgtcaa

SEQ ID NO: 7127579 - DNA, 22 bp, Homo sapiens
agaacagctgatttacggggct

SEQ ID NO: 7127580 - DNA, 20 bp, Homo sapiens
actttctcggtttctcacct

SEQ ID NO: 7127581 - DNA, 20 bp, Homo sapiens
actttctcggtttctcacct

SEQ ID NO: 7127582 - DNA, 20 bp, Homo sapiens
actttctcggtttctcacct

SEQ ID NO: 7127583 - DNA, 22 bp, Homo sapiens
atatgcttacagcttaaaatcc

SEQ ID NO: 7127584 - DNA, 22 bp, Homo sapiens
atatgcttatgatggttaattt

SEQ ID NO: 7127585 - DNA, 22 bp, Homo sapiens
atatgcttccaagttattccac

SEQ ID NO: 7127586 - DNA, 22 bp, Homo sapiens
atatgcttgactctttcacatc

SEQ ID NO: 7127587 - DNA, 18 bp, Homo sapiens
atatgcttgagctaagga

SEQ ID NO: 7127588 - DNA, 18 bp, Homo sapiens
atatgcttgagctaagga

SEQ ID NO: 7127589 - DNA, 22 bp, Homo sapiens
atatgcttgggactgatacagt

SEQ ID NO: 7127590 - DNA, 22 bp, Homo sapiens
atatgcttgggactgatacagt

SEQ ID NO: 7127591 - DNA, 18 bp, Homo sapiens
atatggaatgcctggcta

SEQ ID NO: 7127592 - DNA, 18 bp, Homo sapiens
atatggaatgcctggcta

SEQ ID NO: 7127593 - DNA, 22 bp, Homo sapiens
atatggaagagcctgggaattt

SEQ ID NO: 7127594 - DNA, 22 bp, Homo sapiens
atatggaagttacctgacttca

SEQ ID NO: 7127595 - DNA, 22 bp, Homo sapiens
atatggaagttacctgacttca

SEQ ID NO: 7127596 - DNA, 22 bp, Homo sapiens
atatggaagttacctgacttca

SEQ ID NO: 7127597 - DNA, 22 bp, Homo sapiens
atatggaagagcctgggaattt

SEQ ID NO: 7127598 - DNA, 22 bp, Homo sapiens
atatggaactattctgtgtaga

SEQ ID NO: 7127599 - DNA, 22 bp, Homo sapiens
atatggaactattctgtgtaga

SEQ ID NO: 7127600 - DNA, 22 bp, Homo sapiens
atatggaagagcctgggaattt

SEQ ID NO: 7127601 - DNA, 22 bp, Homo sapiens
atatggaactattctgtgtaga

SEQ ID NO: 7127602 - DNA, 22 bp, Homo sapiens
atatggaaatagcaatatggtt

SEQ ID NO: 7127603 - DNA, 17 bp, Homo sapiens
atatgctttgtatttat

SEQ ID NO: 7127604 - DNA, 22 bp, Homo sapiens
atatggaaatagcaatatggtt

SEQ ID NO: 7127605 - DNA, 22 bp, Homo sapiens
atatgctttgggattagatcat

SEQ ID NO: 7127606 - DNA, 22 bp, Homo sapiens
atatggaatggtaatctacaat

SEQ ID NO: 7127607 - DNA, 22 bp, Homo sapiens
atatggaatggtaatctacaat

SEQ ID NO: 7127608 - DNA, 22 bp, Homo sapiens
atatggaatggtaatctacaat

SEQ ID NO: 7127609 - DNA, 22 bp, Homo sapiens
agaaaaggttgaaagtaggatt

SEQ ID NO: 7127610 - DNA, 22 bp, Homo sapiens
agaaaaggttgaaagtaggatt

SEQ ID NO: 7127611 - DNA, 22 bp, Homo sapiens
agaaaaggttgaaagtaggatt

SEQ ID NO: 7127612 - DNA, 22 bp, Homo sapiens
agaaaaggttgaaagtaggatt

SEQ ID NO: 7127613 - DNA, 22 bp, Homo sapiens
agaaaaggttgaaagtaggatt

SEQ ID NO: 7127614 - DNA, 22 bp, Homo sapiens
actttcaacttggtgggagagc

SEQ ID NO: 7127615 - DNA, 22 bp, Homo sapiens
actttcaagccctctagagaca

SEQ ID NO: 7127616 - DNA, 22 bp, Homo sapiens
actttcatgctctgagcactgg

SEQ ID NO: 7127617 - DNA, 22 bp, Homo sapiens
actttcatttgtaataaacttc

SEQ ID NO: 7127618 - DNA, 22 bp, Homo sapiens
actttcatttgtaataaacttc

SEQ ID NO: 7127619 - DNA, 22 bp, Homo sapiens
actttcatttgtaataaacttc

SEQ ID NO: 7127620 - DNA, 22 bp, Homo sapiens
actttcatttgtaataaacttc

SEQ ID NO: 7127621 - DNA, 22 bp, Homo sapiens
actttcatttgtaataaacttc

SEQ ID NO: 7127622 - DNA, 22 bp, Homo sapiens
actttcatttgtaataaacttc

SEQ ID NO: 7127623 - DNA, 22 bp, Homo sapiens
actttcatgctctgagcactgg

SEQ ID NO: 7127624 - DNA, 22 bp, Homo sapiens
actttcatggatctctgttcag

SEQ ID NO: 7127625 - DNA, 22 bp, Homo sapiens
actttccacaccattttgtggt

SEQ ID NO: 7127626 - DNA, 22 bp, Homo sapiens
actttccttatggatggggaaa

SEQ ID NO: 7127627 - DNA, 22 bp, Homo sapiens
actttctattcccacagagata

SEQ ID NO: 7127628 - DNA, 22 bp, Homo sapiens
actttctattcccacagagata

SEQ ID NO: 7127629 - DNA, 22 bp, Homo sapiens
actttctaggtctcagtccttt

SEQ ID NO: 7127630 - DNA, 22 bp, Homo sapiens
actttctattcccacagagata

SEQ ID NO: 7127631 - DNA, 22 bp, Homo sapiens
actttctattgtttagattctg

SEQ ID NO: 7127632 - DNA, 22 bp, Homo sapiens
actttctcaggaattcacagac

SEQ ID NO: 7127633 - DNA, 22 bp, Homo sapiens
actttctcaaatcagactttaa

SEQ ID NO: 7127634 - DNA, 22 bp, Homo sapiens
actttctcaaatcagactttaa

SEQ ID NO: 7127635 - DNA, 22 bp, Homo sapiens
agaaaataaattgatggtggaa

SEQ ID NO: 7127636 - DNA, 22 bp, Homo sapiens
agaaaataaattgatggtggaa

SEQ ID NO: 7127637 - DNA, 22 bp, Homo sapiens
agaaaagtttaaatcttggcac

SEQ ID NO: 7127638 - DNA, 21 bp, Homo sapiens
agaaaagtagagttttcagag

SEQ ID NO: 7127639 - DNA, 21 bp, Homo sapiens
agaaaagtatttgaatcaaga

SEQ ID NO: 7127640 - DNA, 22 bp, Homo sapiens
atattctgcttttgatgcattc

SEQ ID NO: 7127641 - DNA, 22 bp, Homo sapiens
atattctgcttttgatgcattc

SEQ ID NO: 7127642 - DNA, 22 bp, Homo sapiens
atattctgcctcactacagttg

SEQ ID NO: 7127643 - DNA, 22 bp, Homo sapiens
atattctctgctgcttttgtgt

SEQ ID NO: 7127644 - DNA, 22 bp, Homo sapiens
atattctagccaaagtgtgagc

SEQ ID NO: 7127645 - DNA, 22 bp, Homo sapiens
atattccagttatatcaaatca

SEQ ID NO: 7127646 - DNA, 22 bp, Homo sapiens
atattccagttatatcaaatca

SEQ ID NO: 7127647 - DNA, 22 bp, Homo sapiens
atattctagccaaagtgtgagc

SEQ ID NO: 7127648 - DNA, 22 bp, Homo sapiens
atattacataaacatgagtgaa

SEQ ID NO: 7127649 - DNA, 22 bp, Homo sapiens
atattacataaacatgagtgaa

SEQ ID NO: 7127650 - DNA, 22 bp, Homo sapiens
atattacataaacatgagtgaa

SEQ ID NO: 7127651 - DNA, 22 bp, Homo sapiens
atattacacacggtatcacggg

SEQ ID NO: 7127652 - DNA, 22 bp, Homo sapiens
atattcattgaacacctactac

SEQ ID NO: 7127653 - DNA, 22 bp, Homo sapiens
atattcatcgtgtagaaatact

SEQ ID NO: 7127654 - DNA, 22 bp, Homo sapiens
atattcatcgtgtagaaatact

SEQ ID NO: 7127655 - DNA, 22 bp, Homo sapiens
atattcttatccttttctctgt

SEQ ID NO: 7127656 - DNA, 22 bp, Homo sapiens
atattcttatccttttctctgt

SEQ ID NO: 7127657 - DNA, 22 bp, Homo sapiens
atattctgggttagatatgttt

SEQ ID NO: 7127658 - DNA, 22 bp, Homo sapiens
atattctgggttagatatgttt

SEQ ID NO: 7127659 - DNA, 22 bp, Homo sapiens
atattcttccaaaacatcattt

SEQ ID NO: 7127660 - DNA, 22 bp, Homo sapiens
atattcttatccttttctctgt

SEQ ID NO: 7127661 - DNA, 22 bp, Homo sapiens
atattcttccaaaacatcattt

SEQ ID NO: 7127662 - DNA, 22 bp, Homo sapiens
atattcttatccttttctctgt

SEQ ID NO: 7127663 - DNA, 22 bp, Homo sapiens
atattcttccaaaacatcattt

SEQ ID NO: 7127664 - DNA, 22 bp, Homo sapiens
atattcttccaaaacatcattt

SEQ ID NO: 7127665 - DNA, 22 bp, Homo sapiens
atatttataaggcaggcaagta

SEQ ID NO: 7127666 - DNA, 22 bp, Homo sapiens
atatttataaggcaggcaagta

SEQ ID NO: 7127667 - DNA, 22 bp, Homo sapiens
atatttataaggcaggcaagta

SEQ ID NO: 7127668 - DNA, 22 bp, Homo sapiens
atatttataagcaagcaggact

SEQ ID NO: 7127669 - DNA, 22 bp, Homo sapiens
atattcttccaaaacatcattt

SEQ ID NO: 7127670 - DNA, 22 bp, Homo sapiens
atattcttcttgttcagactat

SEQ ID NO: 7127671 - DNA, 22 bp, Homo sapiens
atattcttccaaaacatcattt

SEQ ID NO: 7127672 - DNA, 22 bp, Homo sapiens
atatttataagcaagcaggact

SEQ ID NO: 7127673 - DNA, 22 bp, Homo sapiens
atattcttcttgttcagactat

SEQ ID NO: 7127674 - DNA, 21 bp, Homo sapiens
atatttctcataaggttatgg

SEQ ID NO: 7127675 - DNA, 21 bp, Homo sapiens
atatttctcataaggttatgg

SEQ ID NO: 7127676 - DNA, 23 bp, Homo sapiens
atatttccaggttagtgaggtaa

SEQ ID NO: 7127677 - DNA, 22 bp, Homo sapiens
atatttcatggggttccatact

SEQ ID NO: 7127678 - DNA, 22 bp, Homo sapiens
atatttcatggggttccatact

SEQ ID NO: 7127679 - DNA, 22 bp, Homo sapiens
atatttcatggggttccatact

SEQ ID NO: 7127680 - DNA, 22 bp, Homo sapiens
atatttcatggggttccatact

SEQ ID NO: 7127681 - DNA, 22 bp, Homo sapiens
atatttataaggcaggcaagta

SEQ ID NO: 7127682 - DNA, 22 bp, Homo sapiens
atatttcacgtaggttgttttc

SEQ ID NO: 7127683 - DNA, 22 bp, Homo sapiens
atatttcacgtaggttgttttc

SEQ ID NO: 7127684 - DNA, 21 bp, Homo sapiens
atatttcagatttccgtaatc

SEQ ID NO: 7127685 - DNA, 21 bp, Homo sapiens
atatttcagatttccgtaatc

SEQ ID NO: 7127686 - DNA, 22 bp, Homo sapiens
atatttcagctttacttaggaa

SEQ ID NO: 7127687 - DNA, 22 bp, Homo sapiens
atatttcagctttacttaggaa

SEQ ID NO: 7127688 - DNA, 20 bp, Homo sapiens
atatttcaggtagtgtgccc

SEQ ID NO: 7127689 - DNA, 22 bp, Homo sapiens
atatttcaggttttgcaggccg

SEQ ID NO: 7127690 - DNA, 22 bp, Homo sapiens
acttctgtcctccaagccacgt

SEQ ID NO: 7127691 - DNA, 22 bp, Homo sapiens
acttctgtatgtcctgcattca

SEQ ID NO: 7127692 - DNA, 22 bp, Homo sapiens
acttctgtaaagggaagacagt

SEQ ID NO: 7127693 - DNA, 22 bp, Homo sapiens
atacatgttgagaaaatatctg

SEQ ID NO: 7127694 - DNA, 22 bp, Homo sapiens
atacatgttgagaaaatatctg

SEQ ID NO: 7127695 - DNA, 22 bp, Homo sapiens
acttcttcttcagctgggggat

SEQ ID NO: 7127696 - DNA, 22 bp, Homo sapiens
acttctttcacaatgtttctag

SEQ ID NO: 7127697 - DNA, 22 bp, Homo sapiens
acttctttcacaatgtttctag

SEQ ID NO: 7127698 - DNA, 22 bp, Homo sapiens
acttctttcacaatgtttctag

SEQ ID NO: 7127699 - DNA, 22 bp, Homo sapiens
atacatgttgtaccatatgttt

SEQ ID NO: 7127700 - DNA, 22 bp, Homo sapiens
atacattagaatctggtactca

SEQ ID NO: 7127701 - DNA, 22 bp, Homo sapiens
atacattagctcatatgattaa

SEQ ID NO: 7127702 - DNA, 22 bp, Homo sapiens
atacattagctcatatgattaa

SEQ ID NO: 7127703 - DNA, 22 bp, Homo sapiens
atacattagctcatatgattaa

SEQ ID NO: 7127704 - DNA, 22 bp, Homo sapiens
atacattagtgaacaaaagaga

SEQ ID NO: 7127705 - DNA, 22 bp, Homo sapiens
atacattagtgaacaaaagaga

SEQ ID NO: 7127706 - DNA, 22 bp, Homo sapiens
atacattagtgaacaaaagaga

SEQ ID NO: 7127707 - DNA, 22 bp, Homo sapiens
atacattagtgaacaaaagaga

SEQ ID NO: 7127708 - DNA, 22 bp, Homo sapiens
actttagtctgtttcattatct

SEQ ID NO: 7127709 - DNA, 22 bp, Homo sapiens
actttatcaggaatcacacagc

SEQ ID NO: 7127710 - DNA, 22 bp, Homo sapiens
actttatcaggaatcacacagc

SEQ ID NO: 7127711 - DNA, 22 bp, Homo sapiens
actttatttcctattgcatcca

SEQ ID NO: 7127712 - DNA, 22 bp, Homo sapiens
actttatttcctattgcatcca

SEQ ID NO: 7127713 - DNA, 22 bp, Homo sapiens
atactgtagaggcatagctagt

SEQ ID NO: 7127714 - DNA, 22 bp, Homo sapiens
atactgtagaggcatagctagt

SEQ ID NO: 7127715 - DNA, 22 bp, Homo sapiens
atactgtagaggcatagctagt

SEQ ID NO: 7127716 - DNA, 22 bp, Homo sapiens
atactgtagaggcatagctagt

SEQ ID NO: 7127717 - DNA, 22 bp, Homo sapiens
atactgtagttgtccaactatc

SEQ ID NO: 7127718 - DNA, 22 bp, Homo sapiens
atactgtatatctgagagccca

SEQ ID NO: 7127719 - DNA, 22 bp, Homo sapiens
atactgtatatttcacatcttg

SEQ ID NO: 7127720 - DNA, 22 bp, Homo sapiens
atactgtatcacttgtgagtga

SEQ ID NO: 7127721 - DNA, 22 bp, Homo sapiens
atactgtgtaaaatttgaacct

SEQ ID NO: 7127722 - DNA, 22 bp, Homo sapiens
atactgtgtgcagagtcctaat

SEQ ID NO: 7127723 - DNA, 22 bp, Homo sapiens
atactgtgtgtgctcaaggaat

SEQ ID NO: 7127724 - DNA, 22 bp, Homo sapiens
atactgattagttgagaaagca

SEQ ID NO: 7127725 - DNA, 22 bp, Homo sapiens
atactgctgctgctgaaatcac

SEQ ID NO: 7127726 - DNA, 22 bp, Homo sapiens
atactgctgctgctgaaatcac

SEQ ID NO: 7127727 - DNA, 22 bp, Homo sapiens
atactggatttgaaacatttca

SEQ ID NO: 7127728 - DNA, 22 bp, Homo sapiens
atactgtaatacctaaatgaac

SEQ ID NO: 7127729 - DNA, 22 bp, Homo sapiens
atactgtaatacctaaatgaac

SEQ ID NO: 7127730 - DNA, 22 bp, Homo sapiens
atactggttttctttcagcact

SEQ ID NO: 7127731 - DNA, 22 bp, Homo sapiens
atactgtaatacctaaatgaac

SEQ ID NO: 7127732 - DNA, 20 bp, Homo sapiens
atactgtacaactataggta

SEQ ID NO: 7127733 - DNA, 22 bp, Homo sapiens
atactgtacgctcctggcattt

SEQ ID NO: 7127734 - DNA, 22 bp, Homo sapiens
atactgtacgtcccagatagga

SEQ ID NO: 7127735 - DNA, 22 bp, Homo sapiens
atactgtacgtcccagatagga

SEQ ID NO: 7127736 - DNA, 22 bp, Homo sapiens
atactgtacgtcccagatagga

SEQ ID NO: 7127737 - DNA, 22 bp, Homo sapiens
atactgtacgtcccagatagga

SEQ ID NO: 7127738 - DNA, 22 bp, Homo sapiens
atactgaattaggtaaagcata

SEQ ID NO: 7127739 - DNA, 22 bp, Homo sapiens
atactgaaggcattcagataac

SEQ ID NO: 7127740 - DNA, 23 bp, Homo sapiens
atactgaaactgttgtttatctg

SEQ ID NO: 7127741 - DNA, 22 bp, Homo sapiens
ataatgcatttagaataattca

SEQ ID NO: 7127742 - DNA, 22 bp, Homo sapiens
ataatgctgggagaaattgtta

SEQ ID NO: 7127743 - DNA, 22 bp, Homo sapiens
ataatgctgggagaaattgtta

SEQ ID NO: 7127744 - DNA, 22 bp, Homo sapiens
ataatgcatttagaataattca

SEQ ID NO: 7127745 - DNA, 22 bp, Homo sapiens
ataatgcatttagaataattca

SEQ ID NO: 7127746 - DNA, 22 bp, Homo sapiens
acttaaatagaactcctcaata

SEQ ID NO: 7127747 - DNA, 21 bp, Homo sapiens
acttaaattccttgatattta

SEQ ID NO: 7127748 - DNA, 21 bp, Homo sapiens
acttaaattccttgatattta

SEQ ID NO: 7127749 - DNA, 21 bp, Homo sapiens
acttaaattccttgatattta

SEQ ID NO: 7127750 - DNA, 22 bp, Homo sapiens
acttaaatagaactcctcaata

SEQ ID NO: 7127751 - DNA, 22 bp, Homo sapiens
acttaaatagaactcctcaata

SEQ ID NO: 7127752 - DNA, 23 bp, Homo sapiens
acttaaatggttctttatctcag

SEQ ID NO: 7127753 - DNA, 23 bp, Homo sapiens
acttaaatggttctttatctcag

SEQ ID NO: 7127754 - DNA, 23 bp, Homo sapiens
acttaaatggttctttatctcag

SEQ ID NO: 7127755 - DNA, 23 bp, Homo sapiens
acttaaatggttctttatctcag

SEQ ID NO: 7127756 - DNA, 21 bp, Homo sapiens
acttaaattccttgatattta

SEQ ID NO: 7127757 - DNA, 22 bp, Homo sapiens
atacagatgttgaatgttatat

SEQ ID NO: 7127758 - DNA, 22 bp, Homo sapiens
atacacttgtacattttttaat

SEQ ID NO: 7127759 - DNA, 20 bp, Homo sapiens
atacacttgcccagcttgtg

SEQ ID NO: 7127760 - DNA, 22 bp, Homo sapiens
atacacttgtacattttttaat

SEQ ID NO: 7127761 - DNA, 22 bp, Homo sapiens
acttacaagctagggaagcttg

SEQ ID NO: 7127762 - DNA, 22 bp, Homo sapiens
acttaatggttcctaaaatgtg

SEQ ID NO: 7127763 - DNA, 22 bp, Homo sapiens
acttacaatcaaccaccttgga

SEQ ID NO: 7127764 - DNA, 22 bp, Homo sapiens
atacaggtaatttgaataatag

SEQ ID NO: 7127765 - DNA, 22 bp, Homo sapiens
atacaggatgctgaacatctct

SEQ ID NO: 7127766 - DNA, 22 bp, Homo sapiens
atacaggaactctctacacttt

SEQ ID NO: 7127767 - DNA, 22 bp, Homo sapiens
atacagggacatccagtttttc

SEQ ID NO: 7127768 - DNA, 22 bp, Homo sapiens
atacagggacatccagtttttc

SEQ ID NO: 7127769 - DNA, 22 bp, Homo sapiens
atacagctttctttcacatgag

SEQ ID NO: 7127770 - DNA, 22 bp, Homo sapiens
atacagctttctttcacatgag

SEQ ID NO: 7127771 - DNA, 22 bp, Homo sapiens
atacagctttctttcacatgag

SEQ ID NO: 7127772 - DNA, 22 bp, Homo sapiens
atacagcttatgcatatatctc

SEQ ID NO: 7127773 - DNA, 22 bp, Homo sapiens
atacagcttatgcatatatctc

SEQ ID NO: 7127774 - DNA, 22 bp, Homo sapiens
atacagcttatgcatatatctc

SEQ ID NO: 7127775 - DNA, 22 bp, Homo sapiens
atacagcttacagttctaatgc

SEQ ID NO: 7127776 - DNA, 22 bp, Homo sapiens
atacagctgccttctaactatg

SEQ ID NO: 7127777 - DNA, 22 bp, Homo sapiens
atacagctgccttctaactatg

SEQ ID NO: 7127778 - DNA, 22 bp, Homo sapiens
atacagcttacagttctaatgc

SEQ ID NO: 7127779 - DNA, 22 bp, Homo sapiens
atacagcttacagttctaatgc

SEQ ID NO: 7127780 - DNA, 22 bp, Homo sapiens
atacagcttacagttctaatgc

SEQ ID NO: 7127781 - DNA, 22 bp, Homo sapiens
atacagattgctatacttacaa

SEQ ID NO: 7127782 - DNA, 22 bp, Homo sapiens
atacagattgctatacttacaa

SEQ ID NO: 7127783 - DNA, 22 bp, Homo sapiens
atacagtaaccacattctatag

SEQ ID NO: 7127784 - DNA, 22 bp, Homo sapiens
atacagtaaccacattctatag

SEQ ID NO: 7127785 - DNA, 22 bp, Homo sapiens
atacaggttctctagggaacag

SEQ ID NO: 7127786 - DNA, 22 bp, Homo sapiens
atacaggttaagccaaggctgg

SEQ ID NO: 7127787 - DNA, 22 bp, Homo sapiens
atacagtaaccacattctatag

SEQ ID NO: 7127788 - DNA, 22 bp, Homo sapiens
atacaggtgtacacacatgcaa

SEQ ID NO: 7127789 - DNA, 22 bp, Homo sapiens
atacaggtgtgagggtctcttt

SEQ ID NO: 7127790 - DNA, 22 bp, Homo sapiens
atacaggttctctagggaacag

SEQ ID NO: 7127791 - DNA, 22 bp, Homo sapiens
atacaggttgaattttctttta

SEQ ID NO: 7127792 - DNA, 22 bp, Homo sapiens
atacaggttgaattttctttta

SEQ ID NO: 7127793 - DNA, 22 bp, Homo sapiens
atacaggtaggggacatacatc

SEQ ID NO: 7127794 - DNA, 22 bp, Homo sapiens
atacaggtggacttcagttagt

SEQ ID NO: 7127795 - DNA, 22 bp, Homo sapiens
atacaggtggaactaaataaat

SEQ ID NO: 7127796 - DNA, 22 bp, Homo sapiens
atacaggtggggtggtctatga

SEQ ID NO: 7127797 - DNA, 22 bp, Homo sapiens
acttctcttccccggaactcta

SEQ ID NO: 7127798 - DNA, 22 bp, Homo sapiens
acttctcttccccggaactcta

SEQ ID NO: 7127799 - DNA, 22 bp, Homo sapiens
acttctctttagtactaaatgt

SEQ ID NO: 7127800 - DNA, 22 bp, Homo sapiens
acttctgaagcagagatttggg

SEQ ID NO: 7127801 - DNA, 22 bp, Homo sapiens
acttctgaagcagagatttggg

SEQ ID NO: 7127802 - DNA, 22 bp, Homo sapiens
acttctgagaaatttaaggaca

SEQ ID NO: 7127803 - DNA, 19 bp, Homo sapiens
acttctgaggaactgcaca

SEQ ID NO: 7127804 - DNA, 19 bp, Homo sapiens
acttctgaggaactgcaca

SEQ ID NO: 7127805 - DNA, 22 bp, Homo sapiens
acttctgataaagagcatgtgc

SEQ ID NO: 7127806 - DNA, 22 bp, Homo sapiens
acttctgattaaggatgaatgc

SEQ ID NO: 7127807 - DNA, 22 bp, Homo sapiens
acttctgattacacatgggcct

SEQ ID NO: 7127808 - DNA, 22 bp, Homo sapiens
acttctgcaggtggtgactgaa

SEQ ID NO: 7127809 - DNA, 22 bp, Homo sapiens
acttctggaggcctagggaaga

SEQ ID NO: 7127810 - DNA, 22 bp, Homo sapiens
actgggaagactggaattgctc

SEQ ID NO: 7127811 - DNA, 22 bp, Homo sapiens
actgggaagagagaattctgtc

SEQ ID NO: 7127812 - DNA, 22 bp, Homo sapiens
actgggaagacaagaaagatag

SEQ ID NO: 7127813 - DNA, 22 bp, Homo sapiens
actgggaagacaagaaagatag

SEQ ID NO: 7127814 - DNA, 22 bp, Homo sapiens
actgggaagacaagaaagatag

SEQ ID NO: 7127815 - DNA, 22 bp, Homo sapiens
actgggaagatggaggcaagca

SEQ ID NO: 7127816 - DNA, 22 bp, Homo sapiens
actgggaagatggaggcaagca

SEQ ID NO: 7127817 - DNA, 22 bp, Homo sapiens
actgggaagctgttttgctttt

SEQ ID NO: 7127818 - DNA, 22 bp, Homo sapiens
actgggaagctgttttgctttt

SEQ ID NO: 7127819 - DNA, 22 bp, Homo sapiens
actgggaaggaaaggaatgtaa

SEQ ID NO: 7127820 - DNA, 22 bp, Homo sapiens
actgggaaggaaaggaatgtaa

SEQ ID NO: 7127821 - DNA, 19 bp, Homo sapiens
actgggaaaaaggcactgg

SEQ ID NO: 7127822 - DNA, 22 bp, Homo sapiens
actgggaaaagctatggcaaat

SEQ ID NO: 7127823 - DNA, 22 bp, Homo sapiens
actgggaaagtgctgcctgcag

SEQ ID NO: 7127824 - DNA, 22 bp, Homo sapiens
actgggaaatgaagtctggtgg

SEQ ID NO: 7127825 - DNA, 22 bp, Homo sapiens
actgggaaattgccctagttct

SEQ ID NO: 7127826 - DNA, 22 bp, Homo sapiens
actgggaaattgccctagttct

SEQ ID NO: 7127827 - DNA, 22 bp, Homo sapiens
actgggaacaaggtgctcagcg

SEQ ID NO: 7127828 - DNA, 22 bp, Homo sapiens
actgggaacaaggtgctcagcg

SEQ ID NO: 7127829 - DNA, 22 bp, Homo sapiens
actgggaacctgtgctaggagg

SEQ ID NO: 7127830 - DNA, 22 bp, Homo sapiens
actgggaacctgtgctaggagg

SEQ ID NO: 7127831 - DNA, 22 bp, Homo sapiens
actgggagagtttgcttataat

SEQ ID NO: 7127832 - DNA, 20 bp, Homo sapiens
actgggagctaacggagatt

SEQ ID NO: 7127833 - DNA, 20 bp, Homo sapiens
actgggagctaacggagatt

SEQ ID NO: 7127834 - DNA, 22 bp, Homo sapiens
actgggaaggaaaggaatgtaa

SEQ ID NO: 7127835 - DNA, 22 bp, Homo sapiens
actgggaaggagcaggatctgt

SEQ ID NO: 7127836 - DNA, 22 bp, Homo sapiens
actgggaaggagcaggatctgt

SEQ ID NO: 7127837 - DNA, 22 bp, Homo sapiens
actgggaagtcagagagaggct

SEQ ID NO: 7127838 - DNA, 22 bp, Homo sapiens
actgggaagtcagagagaggct

SEQ ID NO: 7127839 - DNA, 23 bp, Homo sapiens
actgggaagtttggagagacgca

SEQ ID NO: 7127840 - DNA, 23 bp, Homo sapiens
actgggaagtttggagagacgca

SEQ ID NO: 7127841 - DNA, 22 bp, Homo sapiens
actgggaatctcaggaacatgg

SEQ ID NO: 7127842 - DNA, 22 bp, Homo sapiens
actgggaatctcaggaacatgg

SEQ ID NO: 7127843 - DNA, 22 bp, Homo sapiens
actgggaatctcaggaacatgg

SEQ ID NO: 7127844 - DNA, 22 bp, Homo sapiens
actgggaatggagcctgggcct

SEQ ID NO: 7127845 - DNA, 22 bp, Homo sapiens
actgggaatggagcctgggcct

SEQ ID NO: 7127846 - DNA, 22 bp, Homo sapiens
actgggacagtcagaaacatga

SEQ ID NO: 7127847 - DNA, 19 bp, Homo sapiens
actgtagcactgcagtata

SEQ ID NO: 7127848 - DNA, 22 bp, Homo sapiens
actgtagagaatctgagaaaaa

SEQ ID NO: 7127849 - DNA, 22 bp, Homo sapiens
actgtagagaatctgagaaaaa

SEQ ID NO: 7127850 - DNA, 22 bp, Homo sapiens
actgtactcttatagccatctg

SEQ ID NO: 7127851 - DNA, 22 bp, Homo sapiens
actgtactcttctagccatctg

SEQ ID NO: 7127852 - DNA, 22 bp, Homo sapiens
actgtacttacgcatatacagg

SEQ ID NO: 7127853 - DNA, 22 bp, Homo sapiens
actgtactttagaaagtgtagt

SEQ ID NO: 7127854 - DNA, 22 bp, Homo sapiens
actgtaaattttggttgcaggt

SEQ ID NO: 7127855 - DNA, 22 bp, Homo sapiens
actgtacatgtaaacattgtca

SEQ ID NO: 7127856 - DNA, 22 bp, Homo sapiens
actgtacatgtaaacattgtca

SEQ ID NO: 7127857 - DNA, 22 bp, Homo sapiens
actgtacatgtaaacattgtca

SEQ ID NO: 7127858 - DNA, 22 bp, Homo sapiens
actgtattttgggtgtattttc

SEQ ID NO: 7127859 - DNA, 22 bp, Homo sapiens
actgtattttgtactttcgtgt

SEQ ID NO: 7127860 - DNA, 22 bp, Homo sapiens
actgtcaaatgcaatgaactca

SEQ ID NO: 7127861 - DNA, 22 bp, Homo sapiens
actgtattggttttctattgct

SEQ ID NO: 7127862 - DNA, 22 bp, Homo sapiens
actgtatttccaacagacaaat

SEQ ID NO: 7127863 - DNA, 22 bp, Homo sapiens
actgtatttccaacagacaaat

SEQ ID NO: 7127864 - DNA, 22 bp, Homo sapiens
actgtatttggatataagatct

SEQ ID NO: 7127865 - DNA, 22 bp, Homo sapiens
actgtatttggatataagatct

SEQ ID NO: 7127866 - DNA, 22 bp, Homo sapiens
actgtatttggatataagatct

SEQ ID NO: 7127867 - DNA, 22 bp, Homo sapiens
actgtattcctactagaatcta

SEQ ID NO: 7127868 - DNA, 22 bp, Homo sapiens
actgtattcctactagaatcta

SEQ ID NO: 7127869 - DNA, 22 bp, Homo sapiens
actgtataaggcataggtaagc

SEQ ID NO: 7127870 - DNA, 22 bp, Homo sapiens
actgtatacttctgtatacaat

SEQ ID NO: 7127871 - DNA, 22 bp, Homo sapiens
actgtagtctaaatatagtctt

SEQ ID NO: 7127872 - DNA, 22 bp, Homo sapiens
actgtagtgatgataattaagt

SEQ ID NO: 7127873 - DNA, 22 bp, Homo sapiens
actgtcacctaaattttcattg

SEQ ID NO: 7127874 - DNA, 22 bp, Homo sapiens
actgtcactgacagaatcaaca

SEQ ID NO: 7127875 - DNA, 22 bp, Homo sapiens
actgtcacttgcaactgtgagg

SEQ ID NO: 7127876 - DNA, 22 bp, Homo sapiens
actgtcagggatcatgaaagct

SEQ ID NO: 7127877 - DNA, 22 bp, Homo sapiens
actgtcatcagaagatgaaaat

SEQ ID NO: 7127878 - DNA, 22 bp, Homo sapiens
ataaaaactgacccatcctttg

SEQ ID NO: 7127879 - DNA, 22 bp, Homo sapiens
ataatgcacctttgagtatggc

SEQ ID NO: 7127880 - DNA, 22 bp, Homo sapiens
ataatgcagcttttcaatggcc

SEQ ID NO: 7127881 - DNA, 23 bp, Homo sapiens
ataatgcaagtggtggtaatctg

SEQ ID NO: 7127882 - DNA, 22 bp, Homo sapiens
ataatgcacctttgagtatggc

SEQ ID NO: 7127883 - DNA, 22 bp, Homo sapiens
ataatgagaatacagtaactat

SEQ ID NO: 7127884 - DNA, 22 bp, Homo sapiens
ataatgaaatatgaggaaggtc

SEQ ID NO: 7127885 - DNA, 22 bp, Homo sapiens
ataatgaatcagcatagggtga

SEQ ID NO: 7127886 - DNA, 22 bp, Homo sapiens
ataatgaatcagcatagggtga

SEQ ID NO: 7127887 - DNA, 22 bp, Homo sapiens
ataatgaatgcagagttatttt

SEQ ID NO: 7127888 - DNA, 22 bp, Homo sapiens
ataatgaatgcagagttatttt

SEQ ID NO: 7127889 - DNA, 22 bp, Homo sapiens
ataatcttgtatttcctaaagt

SEQ ID NO: 7127890 - DNA, 22 bp, Homo sapiens
ataatctgtggatggttttgag

SEQ ID NO: 7127891 - DNA, 22 bp, Homo sapiens
ataatcttgtatttcctaaagt

SEQ ID NO: 7127892 - DNA, 22 bp, Homo sapiens
ataatccattaattaatgacca

SEQ ID NO: 7127893 - DNA, 22 bp, Homo sapiens
ataatctgacaaagacttaagc

SEQ ID NO: 7127894 - DNA, 22 bp, Homo sapiens
ataatctggcttgtttgcttaa

SEQ ID NO: 7127895 - DNA, 22 bp, Homo sapiens
ataaggttggtcttaactacct

SEQ ID NO: 7127896 - DNA, 22 bp, Homo sapiens
ataatccatgtctagagtaaag

SEQ ID NO: 7127897 - DNA, 22 bp, Homo sapiens
ataaggtatgagcaatgagttt

SEQ ID NO: 7127898 - DNA, 22 bp, Homo sapiens
ataaggtctgctggggagagtg

SEQ ID NO: 7127899 - DNA, 22 bp, Homo sapiens
ataaggttaacatcatcagtga

SEQ ID NO: 7127900 - DNA, 22 bp, Homo sapiens
actgtgcacacaaaaatagatt

SEQ ID NO: 7127901 - DNA, 22 bp, Homo sapiens
actgtgcatctattgccattta

SEQ ID NO: 7127902 - DNA, 22 bp, Homo sapiens
actgtgcatgaaccgaaacaaa

SEQ ID NO: 7127903 - DNA, 22 bp, Homo sapiens
ataaaatttgctactgttaaat

SEQ ID NO: 7127904 - DNA, 22 bp, Homo sapiens
ataaaatggtaaacgaagctga

SEQ ID NO: 7127905 - DNA, 22 bp, Homo sapiens
ataaaatgtctccactgggctc

SEQ ID NO: 7127906 - DNA, 22 bp, Homo sapiens
ataaaatttgctactgttaaat

SEQ ID NO: 7127907 - DNA, 22 bp, Homo sapiens
ataaaatttgctactgttaaat

SEQ ID NO: 7127908 - DNA, 22 bp, Homo sapiens
ataaacaagactggccaacttt

SEQ ID NO: 7127909 - DNA, 22 bp, Homo sapiens
ataaacaagactggccaacttt

SEQ ID NO: 7127910 - DNA, 22 bp, Homo sapiens
ataaacaagactggccaacttt

SEQ ID NO: 7127911 - DNA, 22 bp, Homo sapiens
actgtgagggtactggaacaga

SEQ ID NO: 7127912 - DNA, 22 bp, Homo sapiens
actgtgagtgatttccttctgg

SEQ ID NO: 7127913 - DNA, 22 bp, Homo sapiens
actgtgagtttatttatctgat

SEQ ID NO: 7127914 - DNA, 22 bp, Homo sapiens
actgtgatgatgaagcatggtt

SEQ ID NO: 7127915 - DNA, 22 bp, Homo sapiens
actgtgcaatgagtaataaact

SEQ ID NO: 7127916 - DNA, 22 bp, Homo sapiens
ataaacagtagagaaaggtggt

SEQ ID NO: 7127917 - DNA, 22 bp, Homo sapiens
ataaacagtagagaaaggtggt

SEQ ID NO: 7127918 - DNA, 22 bp, Homo sapiens
ataaacagctccatttagtgcc

SEQ ID NO: 7127919 - DNA, 22 bp, Homo sapiens
ataaacagtaaatgtgagcagt

SEQ ID NO: 7127920 - DNA, 22 bp, Homo sapiens
ataaacagtaaatgtgagcagt

SEQ ID NO: 7127921 - DNA, 22 bp, Homo sapiens
ataaacacttctagggcacaca

SEQ ID NO: 7127922 - DNA, 22 bp, Homo sapiens
ataaacacttctagggcacaca

SEQ ID NO: 7127923 - DNA, 22 bp, Homo sapiens
ataaacagagtagttgctactg

SEQ ID NO: 7127924 - DNA, 22 bp, Homo sapiens
ataaacagcataaaatacgctt

SEQ ID NO: 7127925 - DNA, 21 bp, Homo sapiens
ataaacagcatgtgatccatg

SEQ ID NO: 7127926 - DNA, 22 bp, Homo sapiens
acctgcagctaaagatgtaggg

SEQ ID NO: 7127927 - DNA, 22 bp, Homo sapiens
acctgcaggggtgctctctggg

SEQ ID NO: 7127928 - DNA, 22 bp, Homo sapiens
acctgcagtggccactcctaat

SEQ ID NO: 7127929 - DNA, 22 bp, Homo sapiens
acctgccaagcatcagtggcag

SEQ ID NO: 7127930 - DNA, 22 bp, Homo sapiens
acctgccaagcatcagtggcag

SEQ ID NO: 7127931 - DNA, 21 bp, Homo sapiens
acctgccacattgcagacttg

SEQ ID NO: 7127932 - DNA, 22 bp, Homo sapiens
acctgccagaatccaagccaca

SEQ ID NO: 7127933 - DNA, 22 bp, Homo sapiens
acctgccagaatgctagtcctg

SEQ ID NO: 7127934 - DNA, 22 bp, Homo sapiens
acctgccagtgaatactatctt

SEQ ID NO: 7127935 - DNA, 19 bp, Homo sapiens
acctgccatgacagcctga

SEQ ID NO: 7127936 - DNA, 22 bp, Homo sapiens
acctgcccacacttccttccca

SEQ ID NO: 7127937 - DNA, 22 bp, Homo sapiens
aggtccagttgccagaatggcc

SEQ ID NO: 7127938 - DNA, 22 bp, Homo sapiens
aggtccagttgccagaatggcc

SEQ ID NO: 7127939 - DNA, 22 bp, Homo sapiens
acctgagggcccaaacttggta

SEQ ID NO: 7127940 - DNA, 20 bp, Homo sapiens
acctgaggtccctatggtct

SEQ ID NO: 7127941 - DNA, 18 bp, Homo sapiens
acctgattggcgcagccc

SEQ ID NO: 7127942 - DNA, 22 bp, Homo sapiens
acctgaggcctccccagcagac

SEQ ID NO: 7127943 - DNA, 22 bp, Homo sapiens
acctgaggctgttagtctaggt

SEQ ID NO: 7127944 - DNA, 22 bp, Homo sapiens
acctgaggctgttagtctaggt

SEQ ID NO: 7127945 - DNA, 22 bp, Homo sapiens
acctgagggagattaggcctga

SEQ ID NO: 7127946 - DNA, 22 bp, Homo sapiens
acctgagacctaatctgactgt

SEQ ID NO: 7127947 - DNA, 22 bp, Homo sapiens
acctgagacttgggatgggaat

SEQ ID NO: 7127948 - DNA, 22 bp, Homo sapiens
acctgagcatgccaggagagtg

SEQ ID NO: 7127949 - DNA, 22 bp, Homo sapiens
acctgaggaagggcgagaagct

SEQ ID NO: 7127950 - DNA, 22 bp, Homo sapiens
acctgaggactggatggtagaa

SEQ ID NO: 7127951 - DNA, 22 bp, Homo sapiens
acctgagcctagggaggttgag

SEQ ID NO: 7127952 - DNA, 21 bp, Homo sapiens
acctgagctccacctcctgcc

SEQ ID NO: 7127953 - DNA, 19 bp, Homo sapiens
accctctccccactgggtc

SEQ ID NO: 7127954 - DNA, 20 bp, Homo sapiens
accctctgaatagtatctgg

SEQ ID NO: 7127955 - DNA, 22 bp, Homo sapiens
accctcggatttggcctaggac

SEQ ID NO: 7127956 - DNA, 22 bp, Homo sapiens
accctccccaagaggtcgtgcc

SEQ ID NO: 7127957 - DNA, 22 bp, Homo sapiens
accctccccaagaggtcgtgcc

SEQ ID NO: 7127958 - DNA, 22 bp, Homo sapiens
accctcccatttccatgtagca

SEQ ID NO: 7127959 - DNA, 22 bp, Homo sapiens
accctcccatttccatgtagca

SEQ ID NO: 7127960 - DNA, 22 bp, Homo sapiens
accctccaggctgcagctcctg

SEQ ID NO: 7127961 - DNA, 22 bp, Homo sapiens
accctccaggctgcagctcctg

SEQ ID NO: 7127962 - DNA, 22 bp, Homo sapiens
accctcccatttccatgtagca

SEQ ID NO: 7127963 - DNA, 22 bp, Homo sapiens
acctgaaactcaactttatctc

SEQ ID NO: 7127964 - DNA, 22 bp, Homo sapiens
acctgaaaattattatttccgc

SEQ ID NO: 7127965 - DNA, 22 bp, Homo sapiens
acctgaaaccaacttgtgtact

SEQ ID NO: 7127966 - DNA, 22 bp, Homo sapiens
acctctttgaacctcagtgtga

SEQ ID NO: 7127967 - DNA, 22 bp, Homo sapiens
acctcctgatgagagtaaagga

SEQ ID NO: 7127968 - DNA, 22 bp, Homo sapiens
acctctggccttcaggcatcat

SEQ ID NO: 7127969 - DNA, 22 bp, Homo sapiens
aggtggcatgcctgagacataa

SEQ ID NO: 7127970 - DNA, 22 bp, Homo sapiens
aggtggcatttacaccatggga

SEQ ID NO: 7127971 - DNA, 22 bp, Homo sapiens
aggtggcatttacaccatggga

SEQ ID NO: 7127972 - DNA, 22 bp, Homo sapiens
aggtggccaagactgtttgaca

SEQ ID NO: 7127973 - DNA, 22 bp, Homo sapiens
aggtggccaagactgtttgaca

SEQ ID NO: 7127974 - DNA, 22 bp, Homo sapiens
aggtggccaataaatgttggag

SEQ ID NO: 7127975 - DNA, 22 bp, Homo sapiens
aggtggccccaggcctctgcca

SEQ ID NO: 7127976 - DNA, 22 bp, Homo sapiens
aggtggccggtgccagccgggc

SEQ ID NO: 7127977 - DNA, 22 bp, Homo sapiens
aggtggcccagctgacagatag

SEQ ID NO: 7127978 - DNA, 20 bp, Homo sapiens
aggtggcccattatagtgga

SEQ ID NO: 7127979 - DNA, 20 bp, Homo sapiens
aggtggcccattatagtgga

SEQ ID NO: 7127980 - DNA, 21 bp, Homo sapiens
aggtggccacaaatctgtttc

SEQ ID NO: 7127981 - DNA, 23 bp, Homo sapiens
aggtggccaccagaatgttaagg

SEQ ID NO: 7127982 - DNA, 19 bp, Homo sapiens
aggtggccatgtccagcct

SEQ ID NO: 7127983 - DNA, 19 bp, Homo sapiens
aggtggccatgtccagcct

SEQ ID NO: 7127984 - DNA, 22 bp, Homo sapiens
aggtggcccagctgacagatag

SEQ ID NO: 7127985 - DNA, 22 bp, Homo sapiens
aggtggcctaaggtggcactgg

SEQ ID NO: 7127986 - DNA, 22 bp, Homo sapiens
aggtggccggtgccagccgggc

SEQ ID NO: 7127987 - DNA, 22 bp, Homo sapiens
aggtggcctaaggtggcactgg

SEQ ID NO: 7127988 - DNA, 18 bp, Homo sapiens
aggtggcctgggagcttt

SEQ ID NO: 7127989 - DNA, 18 bp, Homo sapiens
aggtggcctgggagcttt

SEQ ID NO: 7127990 - DNA, 18 bp, Homo sapiens
aggtggcctgggagcttt

SEQ ID NO: 7127991 - DNA, 18 bp, Homo sapiens
aggtggcctgggagcttt

SEQ ID NO: 7127992 - DNA, 23 bp, Homo sapiens
aggtggcctttgcctctttctct

SEQ ID NO: 7127993 - DNA, 22 bp, Homo sapiens
aggtggctatgaggatgcagtc

SEQ ID NO: 7127994 - DNA, 22 bp, Homo sapiens
aggtggctatgaggatgcagtc

SEQ ID NO: 7127995 - DNA, 22 bp, Homo sapiens
aggtggctatgaggatgcagtc

SEQ ID NO: 7127996 - DNA, 22 bp, Homo sapiens
aggtggctatgaggatgcagtc

SEQ ID NO: 7127997 - DNA, 22 bp, Homo sapiens
aggtggctcctcccatggctgg

SEQ ID NO: 7127998 - DNA, 22 bp, Homo sapiens
acctggctgagaacgtgcagct

SEQ ID NO: 7127999 - DNA, 22 bp, Homo sapiens
aggtggagatcagggactaagg

SEQ ID NO: 7128000 - DNA, 22 bp, Homo sapiens
aggtggagatcagggactaagg

SEQ ID NO: 7128001 - DNA, 22 bp, Homo sapiens
aggtggagatcagggactaagg

SEQ ID NO: 7128002 - DNA, 22 bp, Homo sapiens
aggtggcatgcctgagacataa

SEQ ID NO: 7128003 - DNA, 22 bp, Homo sapiens
acctggccatccagctggcatc

SEQ ID NO: 7128004 - DNA, 20 bp, Homo sapiens
acctggctctcaggagcaac

SEQ ID NO: 7128005 - DNA, 22 bp, Homo sapiens
acctggcataagggcttgagtc

SEQ ID NO: 7128006 - DNA, 22 bp, Homo sapiens
acctggcaggaaggtgggtgat

SEQ ID NO: 7128007 - DNA, 22 bp, Homo sapiens
acctggcaggaaggtgggtgat

SEQ ID NO: 7128008 - DNA, 22 bp, Homo sapiens
acctggcactacaggcacctgt

SEQ ID NO: 7128009 - DNA, 22 bp, Homo sapiens
acctggcactacaggcacctgt

SEQ ID NO: 7128010 - DNA, 22 bp, Homo sapiens
acctggcactacaggcacctgt

SEQ ID NO: 7128011 - DNA, 22 bp, Homo sapiens
acctggcatgaagcatgcctta

SEQ ID NO: 7128012 - DNA, 22 bp, Homo sapiens
acctggccatccagctggcatc

SEQ ID NO: 7128013 - DNA, 22 bp, Homo sapiens
acctggaggcagaggttgcagt

SEQ ID NO: 7128014 - DNA, 22 bp, Homo sapiens
acctggaggcagaggttgcagt

SEQ ID NO: 7128015 - DNA, 22 bp, Homo sapiens
acctggaggcagaggttgcagt

SEQ ID NO: 7128016 - DNA, 22 bp, Homo sapiens
acctggagggaagttctgactt

SEQ ID NO: 7128017 - DNA, 22 bp, Homo sapiens
acctggagggaagttctgactt

SEQ ID NO: 7128018 - DNA, 22 bp, Homo sapiens
acctggagtcatttgaggagta

SEQ ID NO: 7128019 - DNA, 22 bp, Homo sapiens
acctggagtcatttgaggagta

SEQ ID NO: 7128020 - DNA, 22 bp, Homo sapiens
acctggagtcatttgaggagta

SEQ ID NO: 7128021 - DNA, 22 bp, Homo sapiens
acctggagtcatttgaggagta

SEQ ID NO: 7128022 - DNA, 22 bp, Homo sapiens
acctggagtcatttgaggagta

SEQ ID NO: 7128023 - DNA, 22 bp, Homo sapiens
acctggattttgcttagacatg

SEQ ID NO: 7128024 - DNA, 22 bp, Homo sapiens
acctggcacacactggggagtg

SEQ ID NO: 7128025 - DNA, 22 bp, Homo sapiens
acctggcacacactggggagtg

SEQ ID NO: 7128026 - DNA, 22 bp, Homo sapiens
acctggcacattctaccacagt

SEQ ID NO: 7128027 - DNA, 22 bp, Homo sapiens
acctggcacattctaccacagt

SEQ ID NO: 7128028 - DNA, 22 bp, Homo sapiens
aggtctcccaagggccagggag

SEQ ID NO: 7128029 - DNA, 22 bp, Homo sapiens
aggtctctcagccctgacattc

SEQ ID NO: 7128030 - DNA, 22 bp, Homo sapiens
aggtctctgagtactgctggac

SEQ ID NO: 7128031 - DNA, 22 bp, Homo sapiens
aggtctctgagtactgctggac

SEQ ID NO: 7128032 - DNA, 22 bp, Homo sapiens
aggtctcaagagaaaagtggtg

SEQ ID NO: 7128033 - DNA, 22 bp, Homo sapiens
aggtctcaatctcaggtggtca

SEQ ID NO: 7128034 - DNA, 22 bp, Homo sapiens
aggtctcaattcctgctcctgt

SEQ ID NO: 7128035 - DNA, 22 bp, Homo sapiens
aggtctcaaactggcaccctgt

SEQ ID NO: 7128036 - DNA, 22 bp, Homo sapiens
aggtctacatgcttaatatatc

SEQ ID NO: 7128037 - DNA, 22 bp, Homo sapiens
aggtccagttttcagttctcat

SEQ ID NO: 7128038 - DNA, 22 bp, Homo sapiens
aggtcctgtcttatctctgtaa

SEQ ID NO: 7128039 - DNA, 22 bp, Homo sapiens
aggtcctgtgtccaggggcctg

SEQ ID NO: 7128040 - DNA, 20 bp, Homo sapiens
aggtcctgttccttgtctcc

SEQ ID NO: 7128041 - DNA, 23 bp, Homo sapiens
actcagctttgggagatgactca

SEQ ID NO: 7128042 - DNA, 22 bp, Homo sapiens
actcagcttgcacacatcaatg

SEQ ID NO: 7128043 - DNA, 23 bp, Homo sapiens
actcagctttgggagatgactca

SEQ ID NO: 7128044 - DNA, 23 bp, Homo sapiens
actcagctttgggagatgactca

SEQ ID NO: 7128045 - DNA, 22 bp, Homo sapiens
actcaggaaatgaagactggtt

SEQ ID NO: 7128046 - DNA, 22 bp, Homo sapiens
actcaggaaatgagaggctctc

SEQ ID NO: 7128047 - DNA, 22 bp, Homo sapiens
actcaggaaatgagaggctctc

SEQ ID NO: 7128048 - DNA, 22 bp, Homo sapiens
actcaggaagaaagcagctggt

SEQ ID NO: 7128049 - DNA, 22 bp, Homo sapiens
actcaggaagaaagcagctggt

SEQ ID NO: 7128050 - DNA, 22 bp, Homo sapiens
actcaggaatggggctgggact

SEQ ID NO: 7128051 - DNA, 22 bp, Homo sapiens
agtcaacaaaaatgtggagcct

SEQ ID NO: 7128052 - DNA, 22 bp, Homo sapiens
agtcaacacattaaacctaggg

SEQ ID NO: 7128053 - DNA, 22 bp, Homo sapiens
agtcaaatgagtaaatatataa

SEQ ID NO: 7128054 - DNA, 22 bp, Homo sapiens
agtcaaataagagagagatgtt

SEQ ID NO: 7128055 - DNA, 22 bp, Homo sapiens
agtcaaataagagagagatgtt

SEQ ID NO: 7128056 - DNA, 22 bp, Homo sapiens
agtcaacacattaaacctaggg

SEQ ID NO: 7128057 - DNA, 22 bp, Homo sapiens
agtcaacacctggttctattac

SEQ ID NO: 7128058 - DNA, 22 bp, Homo sapiens
agtcaacacctggttctattac

SEQ ID NO: 7128059 - DNA, 22 bp, Homo sapiens
agtcaacatttgagatgcaatg

SEQ ID NO: 7128060 - DNA, 22 bp, Homo sapiens
agtcaacatttgagatgcaatg

SEQ ID NO: 7128061 - DNA, 22 bp, Homo sapiens
actcaggctgttttttccttgt

SEQ ID NO: 7128062 - DNA, 22 bp, Homo sapiens
actcaggcttcaggcacagctg

SEQ ID NO: 7128063 - DNA, 19 bp, Homo sapiens
actcaggcttcctctgagg

SEQ ID NO: 7128064 - DNA, 22 bp, Homo sapiens
agtccaggcgggtatagaggct

SEQ ID NO: 7128065 - DNA, 22 bp, Homo sapiens
agtcccagctcagaaccactag

SEQ ID NO: 7128066 - DNA, 22 bp, Homo sapiens
agtccaggcgggtatagaggct

SEQ ID NO: 7128067 - DNA, 22 bp, Homo sapiens
agtccaggctcttcctgaagaa

SEQ ID NO: 7128068 - DNA, 19 bp, Homo sapiens
actcaggcaatgagaaaca

SEQ ID NO: 7128069 - DNA, 21 bp, Homo sapiens
actcaggcaccaggggatggc

SEQ ID NO: 7128070 - DNA, 22 bp, Homo sapiens
actcaggcactcagccctcgcc

SEQ ID NO: 7128071 - DNA, 22 bp, Homo sapiens
actcaggccccatcgcccatct

SEQ ID NO: 7128072 - DNA, 22 bp, Homo sapiens
actcaggcctccttctgtcctt

SEQ ID NO: 7128073 - DNA, 22 bp, Homo sapiens
actcaggctacaacgcgtggct

SEQ ID NO: 7128074 - DNA, 22 bp, Homo sapiens
actcaggctacaggggcagaag

SEQ ID NO: 7128075 - DNA, 22 bp, Homo sapiens
actcaggctagggaaaaagtgg

SEQ ID NO: 7128076 - DNA, 22 bp, Homo sapiens
agtatttcttcatatgattact

SEQ ID NO: 7128077 - DNA, 22 bp, Homo sapiens
agtatttgttgaatgagtgaat

SEQ ID NO: 7128078 - DNA, 22 bp, Homo sapiens
agtatttgcatgttagggacct

SEQ ID NO: 7128079 - DNA, 22 bp, Homo sapiens
agtatttggcctctacagtctc

SEQ ID NO: 7128080 - DNA, 22 bp, Homo sapiens
agtcaaagatgaccgagttcct

SEQ ID NO: 7128081 - DNA, 22 bp, Homo sapiens
agtcaaagatgaccgagttcct

SEQ ID NO: 7128082 - DNA, 22 bp, Homo sapiens
agtcaaagctacaggcatttga

SEQ ID NO: 7128083 - DNA, 22 bp, Homo sapiens
agtcaaataagactgtcataag

SEQ ID NO: 7128084 - DNA, 22 bp, Homo sapiens
agtcaaataagactgtcataag

SEQ ID NO: 7128085 - DNA, 22 bp, Homo sapiens
agtcaaagatgaccgagttcct

SEQ ID NO: 7128086 - DNA, 22 bp, Homo sapiens
agtcaaagatgaccgagttcct

SEQ ID NO: 7128087 - DNA, 22 bp, Homo sapiens
agtcaaacaaatgtttattgag

SEQ ID NO: 7128088 - DNA, 22 bp, Homo sapiens
actaggggctcaggcccaggga

SEQ ID NO: 7128089 - DNA, 22 bp, Homo sapiens
actaggggctcaggcccaggga

SEQ ID NO: 7128090 - DNA, 22 bp, Homo sapiens
actaggggctcaggcccaggga

SEQ ID NO: 7128091 - DNA, 22 bp, Homo sapiens
actagggagatcaattgtgcag

SEQ ID NO: 7128092 - DNA, 22 bp, Homo sapiens
actaggaacggggtttgcactc

SEQ ID NO: 7128093 - DNA, 22 bp, Homo sapiens
actaggaaggcatatgggcaga

SEQ ID NO: 7128094 - DNA, 22 bp, Homo sapiens
actaggaagtggcaaaactgga

SEQ ID NO: 7128095 - DNA, 22 bp, Homo sapiens
actaggaagtggcaaaactgga

SEQ ID NO: 7128096 - DNA, 22 bp, Homo sapiens
actaggaattcaagtagacaga

SEQ ID NO: 7128097 - DNA, 22 bp, Homo sapiens
actaggaattcaagtagacaga

SEQ ID NO: 7128098 - DNA, 19 bp, Homo sapiens
agtatagagtattgaggag

SEQ ID NO: 7128099 - DNA, 22 bp, Homo sapiens
agtatatagtggcgctgtatgc

SEQ ID NO: 7128100 - DNA, 22 bp, Homo sapiens
agtatactgaaagtaaatatga

SEQ ID NO: 7128101 - DNA, 22 bp, Homo sapiens
agtatactgaaagtaaatatga

SEQ ID NO: 7128102 - DNA, 22 bp, Homo sapiens
actagtcatttaggtgatatta

SEQ ID NO: 7128103 - DNA, 22 bp, Homo sapiens
actagtctgcattacaaaatag

SEQ ID NO: 7128104 - DNA, 22 bp, Homo sapiens
actagtctgccagggagaggca

SEQ ID NO: 7128105 - DNA, 22 bp, Homo sapiens
actagtattcttggtcttgtat

SEQ ID NO: 7128106 - DNA, 23 bp, Homo sapiens
acgctgggtggccagaacgacag

SEQ ID NO: 7128107 - DNA, 21 bp, Homo sapiens
acgctggggatggggtctaga

SEQ ID NO: 7128108 - DNA, 18 bp, Homo sapiens
acggatccgcgggaccgc

SEQ ID NO: 7128109 - DNA, 22 bp, Homo sapiens
acggagcccgtgtcaggtggga

SEQ ID NO: 7128110 - DNA, 22 bp, Homo sapiens
acgcctgtaatcccagcacttt

SEQ ID NO: 7128111 - DNA, 22 bp, Homo sapiens
acgcctgtaatcccagcacttt

SEQ ID NO: 7128112 - DNA, 22 bp, Homo sapiens
acggcttcttgactgtgggttg

SEQ ID NO: 7128113 - DNA, 22 bp, Homo sapiens
acggcgggagggtcactggcca

SEQ ID NO: 7128114 - DNA, 22 bp, Homo sapiens
aggttgaaataggttatctaag

SEQ ID NO: 7128115 - DNA, 22 bp, Homo sapiens
aggttgaagagactttaaatta

SEQ ID NO: 7128116 - DNA, 22 bp, Homo sapiens
aggttgaagagactttaaatta

SEQ ID NO: 7128117 - DNA, 22 bp, Homo sapiens
acgcatggtaaatccactgact

SEQ ID NO: 7128118 - DNA, 22 bp, Homo sapiens
acgcctgtaatcccagcacttt

SEQ ID NO: 7128119 - DNA, 22 bp, Homo sapiens
acgcctgtaatcccagcacttt

SEQ ID NO: 7128120 - DNA, 22 bp, Homo sapiens
acgcctgtaatcccagcacttt

SEQ ID NO: 7128121 - DNA, 20 bp, Homo sapiens
aggtggctcctgctgggggt

SEQ ID NO: 7128122 - DNA, 22 bp, Homo sapiens
aggtggctcctcccatggctgg

SEQ ID NO: 7128123 - DNA, 22 bp, Homo sapiens
acgatgatgaaagagaacattc

SEQ ID NO: 7128124 - DNA, 20 bp, Homo sapiens
acgatgcaggggcttcacag

SEQ ID NO: 7128125 - DNA, 22 bp, Homo sapiens
acgcaggagtgggtggagtgga

SEQ ID NO: 7128126 - DNA, 22 bp, Homo sapiens
agtaaacagaaagcaagatgat

SEQ ID NO: 7128127 - DNA, 22 bp, Homo sapiens
agtaaacactgtctttatatat

SEQ ID NO: 7128128 - DNA, 22 bp, Homo sapiens
agtaaacactgtctttatatat

SEQ ID NO: 7128129 - DNA, 22 bp, Homo sapiens
agtaaacagaaagcaagatgat

SEQ ID NO: 7128130 - DNA, 22 bp, Homo sapiens
agtaaacagtaggaactgagaa

SEQ ID NO: 7128131 - DNA, 22 bp, Homo sapiens
actagaaattactcagaataaa

SEQ ID NO: 7128132 - DNA, 22 bp, Homo sapiens
agtaaacagtaggaactgagaa

SEQ ID NO: 7128133 - DNA, 22 bp, Homo sapiens
actagaaattactcagaataaa

SEQ ID NO: 7128134 - DNA, 22 bp, Homo sapiens
actagaaccagaggaggcaggt

SEQ ID NO: 7128135 - DNA, 22 bp, Homo sapiens
actagaacttctaactaaggtc

SEQ ID NO: 7128136 - DNA, 22 bp, Homo sapiens
actagaatgcaagctccacaag

SEQ ID NO: 7128137 - DNA, 22 bp, Homo sapiens
actagaatgcaggattggtctc

SEQ ID NO: 7128138 - DNA, 22 bp, Homo sapiens
actagacaggttgtactattgg

SEQ ID NO: 7128139 - DNA, 17 bp, Homo sapiens
actagaccttaatattt

SEQ ID NO: 7128140 - DNA, 23 bp, Homo sapiens
actagacttcatcgaaggttacc

SEQ ID NO: 7128141 - DNA, 22 bp, Homo sapiens
actagcagaaactgatcatggc

SEQ ID NO: 7128142 - DNA, 22 bp, Homo sapiens
actagcagggatattatataag

SEQ ID NO: 7128143 - DNA, 22 bp, Homo sapiens
agtaaaattgtattggaaaaca

SEQ ID NO: 7128144 - DNA, 22 bp, Homo sapiens
agtaaacaatgtatgaggacag

SEQ ID NO: 7128145 - DNA, 22 bp, Homo sapiens
agtaaacaatgtatgaggacag

SEQ ID NO: 7128146 - DNA, 22 bp, Homo sapiens
agtaaacactaaaatgactgcg

SEQ ID NO: 7128147 - DNA, 22 bp, Homo sapiens
agtaaacactgtctttatatat

SEQ ID NO: 7128148 - DNA, 22 bp, Homo sapiens
agtaaacactgtctttatatat

SEQ ID NO: 7128149 - DNA, 22 bp, Homo sapiens
agtaaaacagagaaatcactca

SEQ ID NO: 7128150 - DNA, 22 bp, Homo sapiens
agtaaaactcacaaaaggatgg

SEQ ID NO: 7128151 - DNA, 22 bp, Homo sapiens
agtaaaatcaccatctctttgt

SEQ ID NO: 7128152 - DNA, 22 bp, Homo sapiens
agtaaaatcaccatctctttgt

SEQ ID NO: 7128153 - DNA, 22 bp, Homo sapiens
agtaaaatcaccatctctttgt

SEQ ID NO: 7128154 - DNA, 22 bp, Homo sapiens
agtaaaattaatggatcagaag

SEQ ID NO: 7128155 - DNA, 22 bp, Homo sapiens
agtctttactaaacagaccacc

SEQ ID NO: 7128156 - DNA, 22 bp, Homo sapiens
actctgtactctagaggaagtg

SEQ ID NO: 7128157 - DNA, 20 bp, Homo sapiens
actctgtactgtcaatgttg

SEQ ID NO: 7128158 - DNA, 22 bp, Homo sapiens
agtctttaatgatcatgtattt

SEQ ID NO: 7128159 - DNA, 22 bp, Homo sapiens
agtctttaatgatcatgtattt

SEQ ID NO: 7128160 - DNA, 18 bp, Homo sapiens
agtctttaaagatgttac

SEQ ID NO: 7128161 - DNA, 22 bp, Homo sapiens
agtctttaacatttggagattg

SEQ ID NO: 7128162 - DNA, 22 bp, Homo sapiens
agtcttggctatgcatagagct

SEQ ID NO: 7128163 - DNA, 22 bp, Homo sapiens
agtcttgggttgcctgatattg

SEQ ID NO: 7128164 - DNA, 22 bp, Homo sapiens
agtcttgctcttgcatctgctt

SEQ ID NO: 7128165 - DNA, 22 bp, Homo sapiens
agtcttcttttattacttgggg

SEQ ID NO: 7128166 - DNA, 22 bp, Homo sapiens
agtcttctttgtgttctctcat

SEQ ID NO: 7128167 - DNA, 22 bp, Homo sapiens
agtcttctttcatttactcagt

SEQ ID NO: 7128168 - DNA, 22 bp, Homo sapiens
agtcttctttcatttactcagt

SEQ ID NO: 7128169 - DNA, 22 bp, Homo sapiens
agtcttcttgatcttttcagtg

SEQ ID NO: 7128170 - DNA, 22 bp, Homo sapiens
agtcttcttgatcttttcagtg

SEQ ID NO: 7128171 - DNA, 22 bp, Homo sapiens
agtcttctgggtgtttccagag

SEQ ID NO: 7128172 - DNA, 22 bp, Homo sapiens
agtcttctgggtgtttccagag

SEQ ID NO: 7128173 - DNA, 22 bp, Homo sapiens
agtcttcttgatcttttcagtg

SEQ ID NO: 7128174 - DNA, 23 bp, Homo sapiens
actcgtggaattctctgcgatcg

SEQ ID NO: 7128175 - DNA, 22 bp, Homo sapiens
actctaaaagtgaagtgtggtc

SEQ ID NO: 7128176 - DNA, 22 bp, Homo sapiens
actcggcagcctgagagttcac

SEQ ID NO: 7128177 - DNA, 22 bp, Homo sapiens
actcggccatggcgccccggcc

SEQ ID NO: 7128178 - DNA, 22 bp, Homo sapiens
actctaaaatgctatgagatct

SEQ ID NO: 7128179 - DNA, 22 bp, Homo sapiens
agtctgtcattaaacttcccaa

SEQ ID NO: 7128180 - DNA, 22 bp, Homo sapiens
agtcttctgggtgtttccagag

SEQ ID NO: 7128181 - DNA, 22 bp, Homo sapiens
agtcccagtgagatgagccacg

SEQ ID NO: 7128182 - DNA, 22 bp, Homo sapiens
agtcccagtgagatgagccacg

SEQ ID NO: 7128183 - DNA, 22 bp, Homo sapiens
agtcccagtgacttggccagaa

SEQ ID NO: 7128184 - DNA, 22 bp, Homo sapiens
agtcccagtgacttggccagaa

SEQ ID NO: 7128185 - DNA, 22 bp, Homo sapiens
agtcccatatccgggttcaggg

SEQ ID NO: 7128186 - DNA, 22 bp, Homo sapiens
agtcccatcagatgatatgaga

SEQ ID NO: 7128187 - DNA, 21 bp, Homo sapiens
agtcccaggggtgagtgatgt

SEQ ID NO: 7128188 - DNA, 19 bp, Homo sapiens
agtcccaggcccgaaagag

SEQ ID NO: 7128189 - DNA, 22 bp, Homo sapiens
agtcccagcttcccccatgcag

SEQ ID NO: 7128190 - DNA, 22 bp, Homo sapiens
agtcccaggcagccgagccggt

SEQ ID NO: 7128191 - DNA, 22 bp, Homo sapiens
agtcccagcttcccccatgcag

SEQ ID NO: 7128192 - DNA, 22 bp, Homo sapiens
agtcccatatccgggttcaggg

SEQ ID NO: 7128193 - DNA, 22 bp, Homo sapiens
agtcccatcagatgatatgaga

SEQ ID NO: 7128194 - DNA, 21 bp, Homo sapiens
agtcccatccggtaagcaagc

SEQ ID NO: 7128195 - DNA, 21 bp, Homo sapiens
agtcccatccggtaagcaagc

SEQ ID NO: 7128196 - DNA, 18 bp, Homo sapiens
agtcccatcttcagctct

SEQ ID NO: 7128197 - DNA, 18 bp, Homo sapiens
agtcccatcttcagctct

SEQ ID NO: 7128198 - DNA, 22 bp, Homo sapiens
agtcccatgaggaatggggacg

SEQ ID NO: 7128199 - DNA, 22 bp, Homo sapiens
agtcccatgccaaatgcatcct

SEQ ID NO: 7128200 - DNA, 22 bp, Homo sapiens
agtcccatgaggaatggggacg

SEQ ID NO: 7128201 - DNA, 22 bp, Homo sapiens
agtcccatgccaaatgcatcct

SEQ ID NO: 7128202 - DNA, 22 bp, Homo sapiens
actcctgggttgcagtcctcaa

SEQ ID NO: 7128203 - DNA, 22 bp, Homo sapiens
actcctgggttgcagtcctcaa

SEQ ID NO: 7128204 - DNA, 20 bp, Homo sapiens
actcctggtaacttttgtga

SEQ ID NO: 7128205 - DNA, 17 bp, Homo sapiens
actcctggtctgaaggg

SEQ ID NO: 7128206 - DNA, 17 bp, Homo sapiens
actcctggtctgaaggg

SEQ ID NO: 7128207 - DNA, 22 bp, Homo sapiens
actcctggtgctgatgaagaga

SEQ ID NO: 7128208 - DNA, 22 bp, Homo sapiens
actcctggtgctgatgaagaga

SEQ ID NO: 7128209 - DNA, 22 bp, Homo sapiens
actcctggttcccagttgagat

SEQ ID NO: 7128210 - DNA, 22 bp, Homo sapiens
actcctggttcccagttgagat

SEQ ID NO: 7128211 - DNA, 22 bp, Homo sapiens
actcctggtttgtgtcctggct

SEQ ID NO: 7128212 - DNA, 22 bp, Homo sapiens
actcctgtgggcatggcacccc

SEQ ID NO: 7128213 - DNA, 22 bp, Homo sapiens
actgaggcagaagggtaagtgg

SEQ ID NO: 7128214 - DNA, 22 bp, Homo sapiens
actgaggacagtgaggagggct

SEQ ID NO: 7128215 - DNA, 22 bp, Homo sapiens
actgaggacagtgaggagggct

SEQ ID NO: 7128216 - DNA, 22 bp, Homo sapiens
actgaggcgcagtccggctgtc

SEQ ID NO: 7128217 - DNA, 22 bp, Homo sapiens
actgaggcttaaagagattagg

SEQ ID NO: 7128218 - DNA, 22 bp, Homo sapiens
actgaggcttacaaaggtaaag

SEQ ID NO: 7128219 - DNA, 22 bp, Homo sapiens
actgagggagagtcttaggttg

SEQ ID NO: 7128220 - DNA, 22 bp, Homo sapiens
actgagggccaaaggcactgag

SEQ ID NO: 7128221 - DNA, 21 bp, Homo sapiens
actgagggccagagaggacct

SEQ ID NO: 7128222 - DNA, 22 bp, Homo sapiens
actgagctcttgactgggagtt

SEQ ID NO: 7128223 - DNA, 22 bp, Homo sapiens
agtgcatgtatctacagtcaca

SEQ ID NO: 7128224 - DNA, 22 bp, Homo sapiens
agtgcatgtccagtagtttatg

SEQ ID NO: 7128225 - DNA, 23 bp, Homo sapiens
agtgcatgcttgacttagcaagc

SEQ ID NO: 7128226 - DNA, 22 bp, Homo sapiens
agtgcatgccttcctgtggatg

SEQ ID NO: 7128227 - DNA, 22 bp, Homo sapiens
agtgcatatatgaagagtatga

SEQ ID NO: 7128228 - DNA, 22 bp, Homo sapiens
agtgcatgaaagcatacaaggc

SEQ ID NO: 7128229 - DNA, 22 bp, Homo sapiens
agtgcatgaaagcatacaaggc

SEQ ID NO: 7128230 - DNA, 22 bp, Homo sapiens
agtgcatatatgaagagtatga

SEQ ID NO: 7128231 - DNA, 22 bp, Homo sapiens
agtgcatagggggatgcacagc

SEQ ID NO: 7128232 - DNA, 22 bp, Homo sapiens
agtgcatagggggatgcacagc

SEQ ID NO: 7128233 - DNA, 22 bp, Homo sapiens
agtgcagtggttaggagccagg

SEQ ID NO: 7128234 - DNA, 22 bp, Homo sapiens
agtgcagttaggatggggaatt

SEQ ID NO: 7128235 - DNA, 22 bp, Homo sapiens
agtgcataaaggaaaaactgaa

SEQ ID NO: 7128236 - DNA, 22 bp, Homo sapiens
agtgcataatgaaggagcttga

SEQ ID NO: 7128237 - DNA, 22 bp, Homo sapiens
agtgcagtgatgaataatggtt

SEQ ID NO: 7128238 - DNA, 22 bp, Homo sapiens
agtgcagtgatgaataatggtt

SEQ ID NO: 7128239 - DNA, 22 bp, Homo sapiens
agtgcagtaaatgggcattatg

SEQ ID NO: 7128240 - DNA, 22 bp, Homo sapiens
agtgcaggttaaggaactggcc

SEQ ID NO: 7128241 - DNA, 22 bp, Homo sapiens
agtgcaggttaaggaactggcc

SEQ ID NO: 7128242 - DNA, 22 bp, Homo sapiens
agtgcaggttaaggaactggcc

SEQ ID NO: 7128243 - DNA, 22 bp, Homo sapiens
agtgcaattttgctttcccaat

SEQ ID NO: 7128244 - DNA, 22 bp, Homo sapiens
agtgcagggggaaagggtgtct

SEQ ID NO: 7128245 - DNA, 22 bp, Homo sapiens
agtgcagggggaaagggtgtct

SEQ ID NO: 7128246 - DNA, 22 bp, Homo sapiens
agtgcagggggaaagggtgtct

SEQ ID NO: 7128247 - DNA, 22 bp, Homo sapiens
agtgcagggggaaagggtgtct

SEQ ID NO: 7128248 - DNA, 22 bp, Homo sapiens
agtgcaggttaaggaactggcc

SEQ ID NO: 7128249 - DNA, 22 bp, Homo sapiens
agtgcaggttaaggaactggcc

SEQ ID NO: 7128250 - DNA, 22 bp, Homo sapiens
actcttattccctcagaaatat

SEQ ID NO: 7128251 - DNA, 22 bp, Homo sapiens
actcttattttgaagtaataat

SEQ ID NO: 7128252 - DNA, 22 bp, Homo sapiens
actcttcaagggcctagaggtg

SEQ ID NO: 7128253 - DNA, 22 bp, Homo sapiens
actcttcagtacaataatatct

SEQ ID NO: 7128254 - DNA, 21 bp, Homo sapiens
actctgtcttgagccatctgt

SEQ ID NO: 7128255 - DNA, 21 bp, Homo sapiens
actctgtcttgagccatctgt

SEQ ID NO: 7128256 - DNA, 22 bp, Homo sapiens
actctgtgaactctatcagata

SEQ ID NO: 7128257 - DNA, 22 bp, Homo sapiens
actctgtcttcatatttgcatt

SEQ ID NO: 7128258 - DNA, 22 bp, Homo sapiens
actctgtagagtataccaatgt

SEQ ID NO: 7128259 - DNA, 22 bp, Homo sapiens
actctgtagatgtggaaatgcg

SEQ ID NO: 7128260 - DNA, 20 bp, Homo sapiens
actctgtaggtaatgagact

SEQ ID NO: 7128261 - DNA, 22 bp, Homo sapiens
actctgtcacctactcactgta

SEQ ID NO: 7128262 - DNA, 22 bp, Homo sapiens
actctgtcacctactcactgta

SEQ ID NO: 7128263 - DNA, 22 bp, Homo sapiens
actctgtgttttggtggcagca

SEQ ID NO: 7128264 - DNA, 22 bp, Homo sapiens
actcttacagagtaaatggcca

SEQ ID NO: 7128265 - DNA, 22 bp, Homo sapiens
actcttatagtattggttatta

SEQ ID NO: 7128266 - DNA, 22 bp, Homo sapiens
actcttatgggaacaaggatta

SEQ ID NO: 7128267 - DNA, 22 bp, Homo sapiens
agtgtgtgaccttttaatttaa

SEQ ID NO: 7128268 - DNA, 21 bp, Homo sapiens
agtgtgtgataggcaggaaga

SEQ ID NO: 7128269 - DNA, 21 bp, Homo sapiens
agtgtgtgataggcaggaaga

SEQ ID NO: 7128270 - DNA, 21 bp, Homo sapiens
agtgtgtgataggcaggaaga

SEQ ID NO: 7128271 - DNA, 18 bp, Homo sapiens
actggaattaaacttttt

SEQ ID NO: 7128272 - DNA, 21 bp, Homo sapiens
actggaagtgggtcaggaagt

SEQ ID NO: 7128273 - DNA, 22 bp, Homo sapiens
actggaaatgagatgatatcag

SEQ ID NO: 7128274 - DNA, 22 bp, Homo sapiens
actggaaattgagaggtcactg

SEQ ID NO: 7128275 - DNA, 22 bp, Homo sapiens
actggaaattgagaggtcactg

SEQ ID NO: 7128276 - DNA, 22 bp, Homo sapiens
actggaaaacactactacatgc

SEQ ID NO: 7128277 - DNA, 22 bp, Homo sapiens
actgcttttgatctcttctgta

SEQ ID NO: 7128278 - DNA, 22 bp, Homo sapiens
actgcttttgatctcttctgta

SEQ ID NO: 7128279 - DNA, 22 bp, Homo sapiens
actgcttttgatctcttctgta

SEQ ID NO: 7128280 - DNA, 22 bp, Homo sapiens
actggaaaaccactgaaatgag

SEQ ID NO: 7128281 - DNA, 22 bp, Homo sapiens
actggaaaattcaaatggggtc

SEQ ID NO: 7128282 - DNA, 22 bp, Homo sapiens
actggaaaggctctgaatggga

SEQ ID NO: 7128283 - DNA, 22 bp, Homo sapiens
actggaaagtattctttcactg

SEQ ID NO: 7128284 - DNA, 22 bp, Homo sapiens
actggaaagtattctttcactg

SEQ ID NO: 7128285 - DNA, 22 bp, Homo sapiens
actggaaataaattttgaatgt

SEQ ID NO: 7128286 - DNA, 22 bp, Homo sapiens
actggaaataaattttgaatgt

SEQ ID NO: 7128287 - DNA, 22 bp, Homo sapiens
actggaaatgagatgatatcag

SEQ ID NO: 7128288 - DNA, 23 bp, Homo sapiens
actgctttattcatgaggctctc

SEQ ID NO: 7128289 - DNA, 22 bp, Homo sapiens
actgctttatctgagaagtcct

SEQ ID NO: 7128290 - DNA, 22 bp, Homo sapiens
actgctttatctgagaagtcct

SEQ ID NO: 7128291 - DNA, 22 bp, Homo sapiens
actgctttatctgagaagtcct

SEQ ID NO: 7128292 - DNA, 22 bp, Homo sapiens
actgctttgctctgcccccagg

SEQ ID NO: 7128293 - DNA, 22 bp, Homo sapiens
actgcttttagaaatctataga

SEQ ID NO: 7128294 - DNA, 22 bp, Homo sapiens
actgcttttagaaatctataga

SEQ ID NO: 7128295 - DNA, 22 bp, Homo sapiens
actgcttttagaaatctataga

SEQ ID NO: 7128296 - DNA, 22 bp, Homo sapiens
actgcttttcagagtctgcctg

SEQ ID NO: 7128297 - DNA, 22 bp, Homo sapiens
actgcttttcagagtctgcctg

SEQ ID NO: 7128298 - DNA, 16 bp, Homo sapiens
actgcttttcataaga

SEQ ID NO: 7128299 - DNA, 22 bp, Homo sapiens
actgcttttctaagattctgtg

SEQ ID NO: 7128300 - DNA, 22 bp, Homo sapiens
actgcttttctaagattctgtg

SEQ ID NO: 7128301 - DNA, 22 bp, Homo sapiens
actgcttttctaagattctgtg

SEQ ID NO: 7128302 - DNA, 22 bp, Homo sapiens
agtgtatcatggttggcagaca

SEQ ID NO: 7128303 - DNA, 22 bp, Homo sapiens
agtgtaggtgagggcctgggtt

SEQ ID NO: 7128304 - DNA, 22 bp, Homo sapiens
agtgtattacagaactgacatt

SEQ ID NO: 7128305 - DNA, 22 bp, Homo sapiens
agtgttggaccgaggtggagcc

SEQ ID NO: 7128306 - DNA, 22 bp, Homo sapiens
agtgttctttgcatgaggatag

SEQ ID NO: 7128307 - DNA, 22 bp, Homo sapiens
agtgttggaccgaggtggagcc

SEQ ID NO: 7128308 - DNA, 22 bp, Homo sapiens
agtgttggaccgaggtggagcc

SEQ ID NO: 7128309 - DNA, 21 bp, Homo sapiens
agtgtgtgataggcaggaaga

SEQ ID NO: 7128310 - DNA, 21 bp, Homo sapiens
agtgtgtgataggcaggaaga

SEQ ID NO: 7128311 - DNA, 22 bp, Homo sapiens
agtgtttaagttacacacatat

SEQ ID NO: 7128312 - DNA, 22 bp, Homo sapiens
agtgtttaaactgaagtgatga

SEQ ID NO: 7128313 - DNA, 22 bp, Homo sapiens
agtgtttaatgccttttccagc

SEQ ID NO: 7128314 - DNA, 22 bp, Homo sapiens
agtgtttacagagtagtggaaa

SEQ ID NO: 7128315 - DNA, 23 bp, Homo sapiens
agtgttggttgggaagccaagca

SEQ ID NO: 7128316 - DNA, 22 bp, Homo sapiens
agtgttgtaataaatatcatct

SEQ ID NO: 7128317 - DNA, 22 bp, Homo sapiens
agtgttgtaataaatatcatct

SEQ ID NO: 7128318 - DNA, 22 bp, Homo sapiens
agtgttgtatgggatgactgct

SEQ ID NO: 7128319 - DNA, 22 bp, Homo sapiens
agtgttgtatgggatgactgct

SEQ ID NO: 7128320 - DNA, 22 bp, Homo sapiens
agtgttgtctaaatgaatgcta

SEQ ID NO: 7128321 - DNA, 22 bp, Homo sapiens
actgggaaaaactgctttgagg

SEQ ID NO: 7128322 - DNA, 19 bp, Homo sapiens
actgggaaaaaggcactgg

SEQ ID NO: 7128323 - DNA, 22 bp, Homo sapiens
agtgtttatattatggaaatat

SEQ ID NO: 7128324 - DNA, 22 bp, Homo sapiens
agtgtttatggaaccctggtgg

SEQ ID NO: 7128325 - DNA, 21 bp, Homo sapiens
actggcttggctctggctgaa

SEQ ID NO: 7128326 - DNA, 22 bp, Homo sapiens
agtgtttagcatgaagttcatt

SEQ ID NO: 7128327 - DNA, 22 bp, Homo sapiens
agtgtttagttaagatttcaaa

SEQ ID NO: 7128328 - DNA, 22 bp, Homo sapiens
agtgtttacattgaagcttgta

SEQ ID NO: 7128329 - DNA, 22 bp, Homo sapiens
agtgtttaccccaatcagttta

SEQ ID NO: 7128330 - DNA, 22 bp, Homo sapiens
agtgtttaccccaatcagttta

SEQ ID NO: 7128331 - DNA, 20 bp, Homo sapiens
agtgtttagaatactattat

SEQ ID NO: 7128332 - DNA, 20 bp, Homo sapiens
agtgtttagaatactattat

SEQ ID NO: 7128333 - DNA, 20 bp, Homo sapiens
agtgtttagaatactattat

SEQ ID NO: 7128334 - DNA, 22 bp, Homo sapiens
agtggcagtagatgagctggtt

SEQ ID NO: 7128335 - DNA, 22 bp, Homo sapiens
agtggcagtagatgagctggtt

SEQ ID NO: 7128336 - DNA, 22 bp, Homo sapiens
agtggcagtagatgagctggtt

SEQ ID NO: 7128337 - DNA, 22 bp, Homo sapiens
agtggcaggtgtttcgtggtgc

SEQ ID NO: 7128338 - DNA, 22 bp, Homo sapiens
agtggcaggtgtttcgtggtgc

SEQ ID NO: 7128339 - DNA, 22 bp, Homo sapiens
agtggcaggtgtttcgtggtgc

SEQ ID NO: 7128340 - DNA, 21 bp, Homo sapiens
actgagggccagagaggacct

SEQ ID NO: 7128341 - DNA, 21 bp, Homo sapiens
actgagggccagagaggacct

SEQ ID NO: 7128342 - DNA, 22 bp, Homo sapiens
actgaggggctttcaggcccag

SEQ ID NO: 7128343 - DNA, 22 bp, Homo sapiens
actgaggggttggagagtgagg

SEQ ID NO: 7128344 - DNA, 22 bp, Homo sapiens
agtggcagagctgtgtcttgaa

SEQ ID NO: 7128345 - DNA, 22 bp, Homo sapiens
agtggcagggctggctgctgca

SEQ ID NO: 7128346 - DNA, 22 bp, Homo sapiens
agtggcagggctggctgctgca

SEQ ID NO: 7128347 - DNA, 22 bp, Homo sapiens
agtggcagggctggctgctgca

SEQ ID NO: 7128348 - DNA, 22 bp, Homo sapiens
agtggcagggctggctgctgca

SEQ ID NO: 7128349 - DNA, 22 bp, Homo sapiens
agtggcagtggctgggcagagc

SEQ ID NO: 7128350 - DNA, 22 bp, Homo sapiens
agtggcagtggctgggcagagc

SEQ ID NO: 7128351 - DNA, 22 bp, Homo sapiens
agtggcagtggctgggcagagc

SEQ ID NO: 7128352 - DNA, 22 bp, Homo sapiens
agtggcagtggaaagcacacgg

SEQ ID NO: 7128353 - DNA, 22 bp, Homo sapiens
agtggcagtggctgggcagagc

SEQ ID NO: 7128354 - DNA, 22 bp, Homo sapiens
agtggcagtggctgggcagagc

SEQ ID NO: 7128355 - DNA, 22 bp, Homo sapiens
agtggcagtagatgagctggtt

SEQ ID NO: 7128356 - DNA, 22 bp, Homo sapiens
agtggcagtggaaagcacacgg

SEQ ID NO: 7128357 - DNA, 22 bp, Homo sapiens
actgcacttcagcctgggtgtc

SEQ ID NO: 7128358 - DNA, 22 bp, Homo sapiens
actgcacttcagcctgggtgac

SEQ ID NO: 7128359 - DNA, 22 bp, Homo sapiens
actgcacttcagcctgggtgac

SEQ ID NO: 7128360 - DNA, 22 bp, Homo sapiens
actgcacttcagcctgggtgac

SEQ ID NO: 7128361 - DNA, 21 bp, Homo sapiens
agtggggtctctgtggaggcc

SEQ ID NO: 7128362 - DNA, 22 bp, Homo sapiens
actgcagaggtggggtgcagag

SEQ ID NO: 7128363 - DNA, 22 bp, Homo sapiens
actgcagaggtggggtgcagag

SEQ ID NO: 7128364 - DNA, 22 bp, Homo sapiens
actgcagactctacagttataa

SEQ ID NO: 7128365 - DNA, 22 bp, Homo sapiens
actgcagactctacagttataa

SEQ ID NO: 7128366 - DNA, 22 bp, Homo sapiens
actgcagagcttttcagttgag

SEQ ID NO: 7128367 - DNA, 22 bp, Homo sapiens
actgcagagcttttcagttgag

SEQ ID NO: 7128368 - DNA, 22 bp, Homo sapiens
actgcagaggtggggtgcagag

SEQ ID NO: 7128369 - DNA, 22 bp, Homo sapiens
actgcagaggtggggtgcagag

SEQ ID NO: 7128370 - DNA, 22 bp, Homo sapiens
actgcacttcagcctgggtgtc

SEQ ID NO: 7128371 - DNA, 22 bp, Homo sapiens
actgcacttcagcctgggtgtc

SEQ ID NO: 7128372 - DNA, 22 bp, Homo sapiens
actgcacttcagcctgggtgtc

SEQ ID NO: 7128373 - DNA, 22 bp, Homo sapiens
actgcacttcagcctgggtgtc

SEQ ID NO: 7128374 - DNA, 22 bp, Homo sapiens
actgcagactctacagttataa

SEQ ID NO: 7128375 - DNA, 22 bp, Homo sapiens
agtgtagacataggtctggtct

SEQ ID NO: 7128376 - DNA, 22 bp, Homo sapiens
agtgtactgctgcggccgggac

SEQ ID NO: 7128377 - DNA, 22 bp, Homo sapiens
agtgtagaaggagaaatggatc

SEQ ID NO: 7128378 - DNA, 22 bp, Homo sapiens
agtgtacatcagaacatatcaa

SEQ ID NO: 7128379 - DNA, 20 bp, Homo sapiens
agtgtacagacactagaaat

SEQ ID NO: 7128380 - DNA, 20 bp, Homo sapiens
agtgtacagacactagaaat

SEQ ID NO: 7128381 - DNA, 22 bp, Homo sapiens
agtgtacactaaatgaatacaa

SEQ ID NO: 7128382 - DNA, 22 bp, Homo sapiens
agtgtacagtttgtagtactac

SEQ ID NO: 7128383 - DNA, 20 bp, Homo sapiens
agtgtacagacactagaaat

SEQ ID NO: 7128384 - DNA, 22 bp, Homo sapiens
aaagaccatgtttacagctagg

SEQ ID NO: 7128385 - DNA, 22 bp, Homo sapiens
aaagacattgaagaaggactta

SEQ ID NO: 7128386 - DNA, 23 bp, Homo sapiens
aaagacctaggatgagggagacg

SEQ ID NO: 7128387 - DNA, 23 bp, Homo sapiens
aaagacctaggatgagggagacg

SEQ ID NO: 7128388 - DNA, 22 bp, Homo sapiens
aaagacctgaaatataatctag

SEQ ID NO: 7128389 - DNA, 22 bp, Homo sapiens
aaagacctgtggtagctctaaa

SEQ ID NO: 7128390 - DNA, 22 bp, Homo sapiens
aaagactaaacaaccaatatct

SEQ ID NO: 7128391 - DNA, 22 bp, Homo sapiens
aaagactaaacaaccaatatct

SEQ ID NO: 7128392 - DNA, 22 bp, Homo sapiens
aaagacattagcttagatgtca

SEQ ID NO: 7128393 - DNA, 22 bp, Homo sapiens
aaagacattagcttagatgtca

SEQ ID NO: 7128394 - DNA, 22 bp, Homo sapiens
aaagacattagattaacgtaca

SEQ ID NO: 7128395 - DNA, 22 bp, Homo sapiens
aaagacatggcaagagatgggg

SEQ ID NO: 7128396 - DNA, 22 bp, Homo sapiens
aaaatcagtacactttattttg

SEQ ID NO: 7128397 - DNA, 22 bp, Homo sapiens
aaaatcagtacactttattttg

SEQ ID NO: 7128398 - DNA, 22 bp, Homo sapiens
aaaatcagtacactttattttg

SEQ ID NO: 7128399 - DNA, 22 bp, Homo sapiens
aaaatcagtacactttattttg

SEQ ID NO: 7128400 - DNA, 22 bp, Homo sapiens
aaaatcagtacactttattttg

SEQ ID NO: 7128401 - DNA, 22 bp, Homo sapiens
aaaatcagtacactttattttg

SEQ ID NO: 7128402 - DNA, 22 bp, Homo sapiens
aaagactaagaagagtattatt

SEQ ID NO: 7128403 - DNA, 21 bp, Homo sapiens
aaaatcaccttaggtcactgg

SEQ ID NO: 7128404 - DNA, 23 bp, Homo sapiens
aaaatcattaatttaccctgaaa

SEQ ID NO: 7128405 - DNA, 22 bp, Homo sapiens
aaaatcctctaattctagaata

SEQ ID NO: 7128406 - DNA, 22 bp, Homo sapiens
aaaatcctctaattctagaata

SEQ ID NO: 7128407 - DNA, 22 bp, Homo sapiens
aaaatcctgctgactcgagatg

SEQ ID NO: 7128408 - DNA, 22 bp, Homo sapiens
aaaatcctgctgactcgagatg

SEQ ID NO: 7128409 - DNA, 22 bp, Homo sapiens
aaacaatgaaatatttttatgg

SEQ ID NO: 7128410 - DNA, 22 bp, Homo sapiens
aaacaatgaaatatttttatgg

SEQ ID NO: 7128411 - DNA, 22 bp, Homo sapiens
aaacaatgaaattcattcttca

SEQ ID NO: 7128412 - DNA, 22 bp, Homo sapiens
aaacaagtttgtagactagcca

SEQ ID NO: 7128413 - DNA, 22 bp, Homo sapiens
aaacaagtttgtagactagcca

SEQ ID NO: 7128414 - DNA, 22 bp, Homo sapiens
aaacaagtttgtagactagcca

SEQ ID NO: 7128415 - DNA, 22 bp, Homo sapiens
aaacaatccaggaacctgttta

SEQ ID NO: 7128416 - DNA, 22 bp, Homo sapiens
aaacaagtttgtagactagcca

SEQ ID NO: 7128417 - DNA, 22 bp, Homo sapiens
aaacaatccaggaacctgttta

SEQ ID NO: 7128418 - DNA, 22 bp, Homo sapiens
aaacaagtttagaataatgaat

SEQ ID NO: 7128419 - DNA, 22 bp, Homo sapiens
aaacaagtttagaataatgaat

SEQ ID NO: 7128420 - DNA, 22 bp, Homo sapiens
aaacaagtttagaataatgaat

SEQ ID NO: 7128421 - DNA, 22 bp, Homo sapiens
aaacaagtttagaataatgaat

SEQ ID NO: 7128422 - DNA, 22 bp, Homo sapiens
aaacaagtcactttatcttgaa

SEQ ID NO: 7128423 - DNA, 22 bp, Homo sapiens
aaacaagtcactttatcttgaa

SEQ ID NO: 7128424 - DNA, 22 bp, Homo sapiens
aaacaagtcactttatcttgaa

SEQ ID NO: 7128425 - DNA, 23 bp, Homo sapiens
aaacaagtctctcaatggcttgc

SEQ ID NO: 7128426 - DNA, 23 bp, Homo sapiens
aaacaagtctctcaatggcttgc

SEQ ID NO: 7128427 - DNA, 22 bp, Homo sapiens
aaacaagtgtaaactagtctgt

SEQ ID NO: 7128428 - DNA, 22 bp, Homo sapiens
aaacaagcaagcacataatttt

SEQ ID NO: 7128429 - DNA, 22 bp, Homo sapiens
aaacaagcaagcacataatttt

SEQ ID NO: 7128430 - DNA, 23 bp, Homo sapiens
aaacaagccctaatgaagagtcc

SEQ ID NO: 7128431 - DNA, 23 bp, Homo sapiens
aaacaagccctaatgaagagtcc

SEQ ID NO: 7128432 - DNA, 22 bp, Homo sapiens
aaacaaacaattagttgtgtgg

SEQ ID NO: 7128433 - DNA, 23 bp, Homo sapiens
aaacaagccctaatgaagagtcc

SEQ ID NO: 7128434 - DNA, 22 bp, Homo sapiens
aaacaaggtccttctgtgacat

SEQ ID NO: 7128435 - DNA, 22 bp, Homo sapiens
aaacaaggtccttctgtgacat

SEQ ID NO: 7128436 - DNA, 20 bp, Homo sapiens
aaacaaggttgctctgagga

SEQ ID NO: 7128437 - DNA, 22 bp, Homo sapiens
aaaatccttagccgagtgaggt

SEQ ID NO: 7128438 - DNA, 22 bp, Homo sapiens
aaaatctaagtagcgagtaagg

SEQ ID NO: 7128439 - DNA, 22 bp, Homo sapiens
aaaatctcattatcaggaaggg

SEQ ID NO: 7128440 - DNA, 20 bp, Homo sapiens
aaaatctcccagaaacttat

SEQ ID NO: 7128441 - DNA, 22 bp, Homo sapiens
aaaatctgcttccttttacaga

SEQ ID NO: 7128442 - DNA, 22 bp, Homo sapiens
aaacaaacaattagttgtgtgg

SEQ ID NO: 7128443 - DNA, 22 bp, Homo sapiens
aaactcatgccattaatccttt

SEQ ID NO: 7128444 - DNA, 19 bp, Homo sapiens
aaactcatagactcatatt

SEQ ID NO: 7128445 - DNA, 19 bp, Homo sapiens
aaactcatagactcatatt

SEQ ID NO: 7128446 - DNA, 22 bp, Homo sapiens
aaactcagatgtggtgaagacc

SEQ ID NO: 7128447 - DNA, 22 bp, Homo sapiens
aaactcaagtttcttaatgtca

SEQ ID NO: 7128448 - DNA, 22 bp, Homo sapiens
aaactcagaaggtacagaaggg

SEQ ID NO: 7128449 - DNA, 20 bp, Homo sapiens
aaactagattagcagggcag

SEQ ID NO: 7128450 - DNA, 21 bp, Homo sapiens
aaactagcagcaaccatgatc

SEQ ID NO: 7128451 - DNA, 22 bp, Homo sapiens
aaactagccaaggagagataga

SEQ ID NO: 7128452 - DNA, 22 bp, Homo sapiens
aaactagccacacagaatacac

SEQ ID NO: 7128453 - DNA, 22 bp, Homo sapiens
aaactaggaagttcatcttatt

SEQ ID NO: 7128454 - DNA, 22 bp, Homo sapiens
aaactaggttctgatttccaag

SEQ ID NO: 7128455 - DNA, 22 bp, Homo sapiens
aaactagtatgtatattaccaa

SEQ ID NO: 7128456 - DNA, 22 bp, Homo sapiens
aaactagtatgtatattaccaa

SEQ ID NO: 7128457 - DNA, 22 bp, Homo sapiens
aaactatccctgccataatttt

SEQ ID NO: 7128458 - DNA, 22 bp, Homo sapiens
aaactcaaagtcagatcagaga

SEQ ID NO: 7128459 - DNA, 22 bp, Homo sapiens
aaactcaaggatttagacgaag

SEQ ID NO: 7128460 - DNA, 22 bp, Homo sapiens
aaactcaagtctatgaacaagg

SEQ ID NO: 7128461 - DNA, 22 bp, Homo sapiens
aaactcaagtctatgaacaagg

SEQ ID NO: 7128462 - DNA, 18 bp, Homo sapiens
aaacccactcagcgctga

SEQ ID NO: 7128463 - DNA, 18 bp, Homo sapiens
aaacccactcagcgctga

SEQ ID NO: 7128464 - DNA, 22 bp, Homo sapiens
aaacccagggttttgtcttccc

SEQ ID NO: 7128465 - DNA, 22 bp, Homo sapiens
aaacccagggttttgtcttccc

SEQ ID NO: 7128466 - DNA, 22 bp, Homo sapiens
aaactagattaccactgctaga

SEQ ID NO: 7128467 - DNA, 22 bp, Homo sapiens
aaactagattaccactgctaga

SEQ ID NO: 7128468 - DNA, 22 bp, Homo sapiens
aaactagattaccactgctaga

SEQ ID NO: 7128469 - DNA, 22 bp, Homo sapiens
aaaagagagttgccagtctgta

SEQ ID NO: 7128470 - DNA, 22 bp, Homo sapiens
aaaagagaatcctgtacagaga

SEQ ID NO: 7128471 - DNA, 22 bp, Homo sapiens
aaaagagagctgaggagctcca

SEQ ID NO: 7128472 - DNA, 22 bp, Homo sapiens
aaaagagaaagtggcaggcttt

SEQ ID NO: 7128473 - DNA, 22 bp, Homo sapiens
aaaagagaatcctgtacagaga

SEQ ID NO: 7128474 - DNA, 22 bp, Homo sapiens
aaaagtactattttaacaaagt

SEQ ID NO: 7128475 - DNA, 22 bp, Homo sapiens
aaaagtactattttaacaaagt

SEQ ID NO: 7128476 - DNA, 22 bp, Homo sapiens
aaaagtactattttaacaaagt

SEQ ID NO: 7128477 - DNA, 22 bp, Homo sapiens
aaaagtactattttaacaaagt

SEQ ID NO: 7128478 - DNA, 22 bp, Homo sapiens
aaactctaggacgatgggatag

SEQ ID NO: 7128479 - DNA, 22 bp, Homo sapiens
aaaagtactattttaacaaagt

SEQ ID NO: 7128480 - DNA, 22 bp, Homo sapiens
aaaagtatagggtttggagtca

SEQ ID NO: 7128481 - DNA, 22 bp, Homo sapiens
aaactctagctactaggataac

SEQ ID NO: 7128482 - DNA, 22 bp, Homo sapiens
aaactctactgaggaaataaga

SEQ ID NO: 7128483 - DNA, 22 bp, Homo sapiens
aaactctagctactaggataac

SEQ ID NO: 7128484 - DNA, 20 bp, Homo sapiens
aaactctacctcaatcgtca

SEQ ID NO: 7128485 - DNA, 22 bp, Homo sapiens
aaactctaatcaaatatagcat

SEQ ID NO: 7128486 - DNA, 22 bp, Homo sapiens
aaactctaattatgcagttctt

SEQ ID NO: 7128487 - DNA, 22 bp, Homo sapiens
aaactctacatggtcgcaaaaa

SEQ ID NO: 7128488 - DNA, 22 bp, Homo sapiens
aaactccagtgaatactagaat

SEQ ID NO: 7128489 - DNA, 22 bp, Homo sapiens
aaactcctgcatactcagaagc

SEQ ID NO: 7128490 - DNA, 22 bp, Homo sapiens
aaactctaagacactgtacaat

SEQ ID NO: 7128491 - DNA, 22 bp, Homo sapiens
aaagacatggaactagagatgg

SEQ ID NO: 7128492 - DNA, 22 bp, Homo sapiens
aaagaaggtagggctggtgact

SEQ ID NO: 7128493 - DNA, 22 bp, Homo sapiens
aaagaaggggtctacatccaat

SEQ ID NO: 7128494 - DNA, 22 bp, Homo sapiens
aaagaaggggtctacatccaat

SEQ ID NO: 7128495 - DNA, 22 bp, Homo sapiens
aaaagtatttatggctatgtaa

SEQ ID NO: 7128496 - DNA, 22 bp, Homo sapiens
aaaagacaggtgtctgcggccc

SEQ ID NO: 7128497 - DNA, 22 bp, Homo sapiens
aaaagacatatgtgggcattct

SEQ ID NO: 7128498 - DNA, 22 bp, Homo sapiens
aaaagacatatgtgggcattct

SEQ ID NO: 7128499 - DNA, 22 bp, Homo sapiens
aaaagacatctatttcaggcag

SEQ ID NO: 7128500 - DNA, 22 bp, Homo sapiens
aaacagagggccactgaggctc

SEQ ID NO: 7128501 - DNA, 22 bp, Homo sapiens
aaaagacaggtgtctgcggccc

SEQ ID NO: 7128502 - DNA, 21 bp, Homo sapiens
aaacagagctgagtaatagat

SEQ ID NO: 7128503 - DNA, 21 bp, Homo sapiens
aaacagagctgagtaatagat

SEQ ID NO: 7128504 - DNA, 22 bp, Homo sapiens
aaacagaagggtaggtaaacat

SEQ ID NO: 7128505 - DNA, 22 bp, Homo sapiens
aaacagagagatgtatgtggag

SEQ ID NO: 7128506 - DNA, 22 bp, Homo sapiens
aaacagagagatgtatgtggag

SEQ ID NO: 7128507 - DNA, 22 bp, Homo sapiens
aaacagagagatgtatgtggag

SEQ ID NO: 7128508 - DNA, 22 bp, Homo sapiens
aaacacttgcaaaatggttcct

SEQ ID NO: 7128509 - DNA, 22 bp, Homo sapiens
aaacactttaagtgaggaggat

SEQ ID NO: 7128510 - DNA, 22 bp, Homo sapiens
aaacacttcttaggtcttaagt

SEQ ID NO: 7128511 - DNA, 22 bp, Homo sapiens
aaacacttgcaaaatggttcct

SEQ ID NO: 7128512 - DNA, 22 bp, Homo sapiens
aaacagaagggtaggtaaacat

SEQ ID NO: 7128513 - DNA, 22 bp, Homo sapiens
aaacagaagggtaggtaaacat

SEQ ID NO: 7128514 - DNA, 22 bp, Homo sapiens
aaacagaagggtaggtaaacat

SEQ ID NO: 7128515 - DNA, 22 bp, Homo sapiens
aaacagaaatttcctcatgctc

SEQ ID NO: 7128516 - DNA, 22 bp, Homo sapiens
aaacagaaatttcctcatgctc

SEQ ID NO: 7128517 - DNA, 22 bp, Homo sapiens
aaacagaaatttcctcatgctc

SEQ ID NO: 7128518 - DNA, 22 bp, Homo sapiens
aaacagaaatttcctcatgctc

SEQ ID NO: 7128519 - DNA, 22 bp, Homo sapiens
aaacacttcaaggacttctgtc

SEQ ID NO: 7128520 - DNA, 22 bp, Homo sapiens
aaacacttcctgtaacatgaca

SEQ ID NO: 7128521 - DNA, 22 bp, Homo sapiens
aaacacttcctgtaacatgaca

SEQ ID NO: 7128522 - DNA, 22 bp, Homo sapiens
aaacacttcctgtaacatgaca

SEQ ID NO: 7128523 - DNA, 22 bp, Homo sapiens
aaacacttcctgtaacatgaca

SEQ ID NO: 7128524 - DNA, 22 bp, Homo sapiens
aaacacttcctgtaacatgaca

SEQ ID NO: 7128525 - DNA, 22 bp, Homo sapiens
aaacactgtgggacatcttact

SEQ ID NO: 7128526 - DNA, 22 bp, Homo sapiens
aaacactgtgtcaaactggggc

SEQ ID NO: 7128527 - DNA, 22 bp, Homo sapiens
aaaaatctatgactgcttctcc

SEQ ID NO: 7128528 - DNA, 22 bp, Homo sapiens
aaacacaggtactgcagaagtg

SEQ ID NO: 7128529 - DNA, 22 bp, Homo sapiens
aaacacatcattcatgtcgtca

SEQ ID NO: 7128530 - DNA, 22 bp, Homo sapiens
aaacacatcattcatgtcgtca

SEQ ID NO: 7128531 - DNA, 22 bp, Homo sapiens
aaacacatcattcatgtcgtca

SEQ ID NO: 7128532 - DNA, 22 bp, Homo sapiens
aaaaataggtcaaccgtgtatg

SEQ ID NO: 7128533 - DNA, 22 bp, Homo sapiens
aaaaatcacttttataggcagc

SEQ ID NO: 7128534 - DNA, 22 bp, Homo sapiens
aaaaatcacttttataggcagc

SEQ ID NO: 7128535 - DNA, 22 bp, Homo sapiens
aaaaatcacttttataggcagc

SEQ ID NO: 7128536 - DNA, 22 bp, Homo sapiens
aaaaatcacttttataggcagc

SEQ ID NO: 7128537 - DNA, 22 bp, Homo sapiens
aaaaatcacttttataggcagc

SEQ ID NO: 7128538 - DNA, 22 bp, Homo sapiens
aaaaatagcttctcttgtccct

SEQ ID NO: 7128539 - DNA, 22 bp, Homo sapiens
aaaaatagcttctcttgtccct

SEQ ID NO: 7128540 - DNA, 22 bp, Homo sapiens
aaaaatagcttctcttgtccct

SEQ ID NO: 7128541 - DNA, 22 bp, Homo sapiens
aaaaatagaaggattgactgag

SEQ ID NO: 7128542 - DNA, 22 bp, Homo sapiens
aaaaatagaaggattgactgag

SEQ ID NO: 7128543 - DNA, 22 bp, Homo sapiens
aaaatgaataagttaacccagg

SEQ ID NO: 7128544 - DNA, 22 bp, Homo sapiens
aaaatgaataagttaacccagg

SEQ ID NO: 7128545 - DNA, 22 bp, Homo sapiens
aaaatgaataagttaacccagg

SEQ ID NO: 7128546 - DNA, 22 bp, Homo sapiens
aaaatgaataagttaacccagg

SEQ ID NO: 7128547 - DNA, 22 bp, Homo sapiens
aaaatgacattccagtgatatt

SEQ ID NO: 7128548 - DNA, 22 bp, Homo sapiens
aaaaatagaaggattgactgag

SEQ ID NO: 7128549 - DNA, 22 bp, Homo sapiens
aaaaaattatcatagttcctga

SEQ ID NO: 7128550 - DNA, 22 bp, Homo sapiens
aaaaaattccattctgtgcctt

SEQ ID NO: 7128551 - DNA, 22 bp, Homo sapiens
aaaaaattccattctgtgcctt

SEQ ID NO: 7128552 - DNA, 22 bp, Homo sapiens
aaaaaattatcatagttcctga

SEQ ID NO: 7128553 - DNA, 22 bp, Homo sapiens
aaaaaattatcatagttcctga

SEQ ID NO: 7128554 - DNA, 22 bp, Homo sapiens
aaaaaattatcatagttcctga

SEQ ID NO: 7128555 - DNA, 22 bp, Homo sapiens
aaaaaagattgatggtggatgc

SEQ ID NO: 7128556 - DNA, 22 bp, Homo sapiens
aaaaaagattgatggtggatgc

SEQ ID NO: 7128557 - DNA, 23 bp, Homo sapiens
aaaaaaccatgtaggcactcagt

SEQ ID NO: 7128558 - DNA, 23 bp, Homo sapiens
aaaaaaccatgtaggcactcagt

SEQ ID NO: 7128559 - DNA, 23 bp, Homo sapiens
aaaaaaccatgtaggcactcagt

SEQ ID NO: 7128560 - DNA, 23 bp, Homo sapiens
aaaaaaccatgtaggcactcagt

SEQ ID NO: 7128561 - DNA, 22 bp, Homo sapiens
aaaaaagattgatggtggatgc

SEQ ID NO: 7128562 - DNA, 20 bp, Homo sapiens
aaaaacagtaatgctgaaga

SEQ ID NO: 7128563 - DNA, 20 bp, Homo sapiens
aaaaacagtaatgctgaaga

SEQ ID NO: 7128564 - DNA, 22 bp, Homo sapiens
aaaaacacaagtggcttggtct

SEQ ID NO: 7128565 - DNA, 22 bp, Homo sapiens
aaaaacactgggctgggagtca

SEQ ID NO: 7128566 - DNA, 22 bp, Homo sapiens
aaaaacactgggctgggagtca

SEQ ID NO: 7128567 - DNA, 22 bp, Homo sapiens
aaaaacagaatgtgtctaactc

SEQ ID NO: 7128568 - DNA, 22 bp, Homo sapiens
aaaaacagaatgtgtctaactc

SEQ ID NO: 7128569 - DNA, 22 bp, Homo sapiens
aaaaacacaactgtctttctct

SEQ ID NO: 7128570 - DNA, 22 bp, Homo sapiens
aaaaaattccattctgtgcctt

SEQ ID NO: 7128571 - DNA, 22 bp, Homo sapiens
aaaaacacaactgtctttctct

SEQ ID NO: 7128572 - DNA, 22 bp, Homo sapiens
aaaaacacaactgtctttctct

SEQ ID NO: 7128573 - DNA, 22 bp, Homo sapiens
aaaaacacaactgtctttctct

SEQ ID NO: 7128574 - DNA, 22 bp, Homo sapiens
aaaaacacaagtggcttggtct

SEQ ID NO: 7128575 - DNA, 22 bp, Homo sapiens
aaaaacacaagtggcttggtct

SEQ ID NO: 7128576 - DNA, 22 bp, Homo sapiens
aaaatgaacagaacaatgggga

SEQ ID NO: 7128577 - DNA, 22 bp, Homo sapiens
aaaatgaacagaacaatgggga

SEQ ID NO: 7128578 - DNA, 22 bp, Homo sapiens
aaaatcttgtgacttaggaagg

SEQ ID NO: 7128579 - DNA, 22 bp, Homo sapiens
aaaatcttgtgacttaggaagg

SEQ ID NO: 7128580 - DNA, 22 bp, Homo sapiens
aaaatgaacagaacaatgggga

SEQ ID NO: 7128581 - DNA, 22 bp, Homo sapiens
aaaatgaagcaaaggcattcag

SEQ ID NO: 7128582 - DNA, 22 bp, Homo sapiens
aaaatgaagcaaaggcattcag

SEQ ID NO: 7128583 - DNA, 22 bp, Homo sapiens
aaaatgaataagttaacccagg

SEQ ID NO: 7128584 - DNA, 22 bp, Homo sapiens
aaaatgaataagttaacccagg

SEQ ID NO: 7128585 - DNA, 23 bp, Homo sapiens
aaaatcttctgcctatgaagaaa

SEQ ID NO: 7128586 - DNA, 20 bp, Homo sapiens
aaaaacagtaatgctgaaga

SEQ ID NO: 7128587 - DNA, 20 bp, Homo sapiens
aaaaacagtaatgctgaaga

SEQ ID NO: 7128588 - DNA, 20 bp, Homo sapiens
aaaaacagtaatgctgaaga

SEQ ID NO: 7128589 - DNA, 22 bp, Homo sapiens
aaaaaccattgtcttcagtctc

SEQ ID NO: 7128590 - DNA, 22 bp, Homo sapiens
aaaaaccattgtcttcagtctc

SEQ ID NO: 7128591 - DNA, 22 bp, Homo sapiens
aaaaaccattgtcttcagtctc

SEQ ID NO: 7128592 - DNA, 22 bp, Homo sapiens
aaaaacctttcccatactaaga

SEQ ID NO: 7128593 - DNA, 22 bp, Homo sapiens
aaaaacctttcccatactaaga

SEQ ID NO: 7128594 - DNA, 22 bp, Homo sapiens
aaaaactgcaattacttttgtc

SEQ ID NO: 7128595 - DNA, 22 bp, Homo sapiens
aaaatagttaacgttcagagta

SEQ ID NO: 7128596 - DNA, 22 bp, Homo sapiens
aaaatagttaacgttcagagta

SEQ ID NO: 7128597 - DNA, 22 bp, Homo sapiens
aaaatctggtaatttgaatgtg

SEQ ID NO: 7128598 - DNA, 22 bp, Homo sapiens
aaaatctggtaatttgaatgtg

SEQ ID NO: 7128599 - DNA, 22 bp, Homo sapiens
aaagaatagcctttgtccaaat

SEQ ID NO: 7128600 - DNA, 22 bp, Homo sapiens
aaagaatagcctttgtccaaat

SEQ ID NO: 7128601 - DNA, 22 bp, Homo sapiens
aaagaatagttaagtttagggc

SEQ ID NO: 7128602 - DNA, 22 bp, Homo sapiens
aaagaatagttaagtttagggc

SEQ ID NO: 7128603 - DNA, 22 bp, Homo sapiens
aaagaatactccttttgccttg

SEQ ID NO: 7128604 - DNA, 22 bp, Homo sapiens
aaagaatactccttttgccttg

SEQ ID NO: 7128605 - DNA, 22 bp, Homo sapiens
aaagaatactccttttgccttg

SEQ ID NO: 7128606 - DNA, 22 bp, Homo sapiens
aaagaatagcctttgtccaaat

SEQ ID NO: 7128607 - DNA, 22 bp, Homo sapiens
aaagaatagcctttgtccaaat

SEQ ID NO: 7128608 - DNA, 22 bp, Homo sapiens
aaagaatagcctttgtccaaat

SEQ ID NO: 7128609 - DNA, 22 bp, Homo sapiens
aaagaatagcctttgtccaaat

SEQ ID NO: 7128610 - DNA, 22 bp, Homo sapiens
aaagacacaaatgtagaccaaa

SEQ ID NO: 7128611 - DNA, 22 bp, Homo sapiens
aaagacacaaatgtagaccaaa

SEQ ID NO: 7128612 - DNA, 22 bp, Homo sapiens
aaagaatttgtacaccctacta

SEQ ID NO: 7128613 - DNA, 22 bp, Homo sapiens
aaagaatctatatatcaccacc

SEQ ID NO: 7128614 - DNA, 22 bp, Homo sapiens
aaagaatgtctgaacagctggc

SEQ ID NO: 7128615 - DNA, 22 bp, Homo sapiens
aaagaatgtctgaacagctggc

SEQ ID NO: 7128616 - DNA, 22 bp, Homo sapiens
aaagaatgtctgaacagctggc

SEQ ID NO: 7128617 - DNA, 22 bp, Homo sapiens
aaagaataccctgggtcataaa

SEQ ID NO: 7128618 - DNA, 22 bp, Homo sapiens
aaagaataccctgggtcataaa

SEQ ID NO: 7128619 - DNA, 22 bp, Homo sapiens
aaagaataccctgggtcataaa

SEQ ID NO: 7128620 - DNA, 22 bp, Homo sapiens
aaagaatactccttttgccttg

SEQ ID NO: 7128621 - DNA, 22 bp, Homo sapiens
aaagaataccctgggtcataaa

SEQ ID NO: 7128622 - DNA, 22 bp, Homo sapiens
aaagaataccctgggtcataaa

SEQ ID NO: 7128623 - DNA, 22 bp, Homo sapiens
aaagaataccctgggtcataaa

SEQ ID NO: 7128624 - DNA, 22 bp, Homo sapiens
aaagaagtgttgaatttgcaag

SEQ ID NO: 7128625 - DNA, 22 bp, Homo sapiens
aaagaactacctgtatgatatt

SEQ ID NO: 7128626 - DNA, 22 bp, Homo sapiens
aaagaactacctgtatgatatt

SEQ ID NO: 7128627 - DNA, 22 bp, Homo sapiens
aaagaactacctgtatgatatt

SEQ ID NO: 7128628 - DNA, 22 bp, Homo sapiens
aaagaactaatgtgcaaggttt

SEQ ID NO: 7128629 - DNA, 22 bp, Homo sapiens
aaagaaggtagggctggtgact

SEQ ID NO: 7128630 - DNA, 22 bp, Homo sapiens
aaactgataaaataagtacatt

SEQ ID NO: 7128631 - DNA, 22 bp, Homo sapiens
aaactgagtggcttataaacaa

SEQ ID NO: 7128632 - DNA, 22 bp, Homo sapiens
aaactgattttaacattgatat

SEQ ID NO: 7128633 - DNA, 21 bp, Homo sapiens
aaagaacaggcagatgttctt

SEQ ID NO: 7128634 - DNA, 22 bp, Homo sapiens
aaagaacatcggagtgggcggg

SEQ ID NO: 7128635 - DNA, 22 bp, Homo sapiens
aaagaactaatgtgcaaggttt

SEQ ID NO: 7128636 - DNA, 22 bp, Homo sapiens
aaagaactaatgtgcaaggttt

SEQ ID NO: 7128637 - DNA, 21 bp, Homo sapiens
aaactgaggcttcaagcagtg

SEQ ID NO: 7128638 - DNA, 22 bp, Homo sapiens
aaactgaggctcccgagggtgt

SEQ ID NO: 7128639 - DNA, 22 bp, Homo sapiens
aaactgaggcaggggatgatta

SEQ ID NO: 7128640 - DNA, 22 bp, Homo sapiens
aaactgaggagttagactaggg

SEQ ID NO: 7128641 - DNA, 22 bp, Homo sapiens
aaactgaggagttagactaggg

SEQ ID NO: 7128642 - DNA, 16 bp, Homo sapiens
aaactgacggcatctg

SEQ ID NO: 7128643 - DNA, 22 bp, Homo sapiens
aaactgagaccgaaaggggtag

SEQ ID NO: 7128644 - DNA, 22 bp, Homo sapiens
aaactgaggaacaaggaaggat

SEQ ID NO: 7128645 - DNA, 22 bp, Homo sapiens
aaactgaggaatgacagcatta

SEQ ID NO: 7128646 - DNA, 21 bp, Homo sapiens
aaactgaccttgcctgagaca

SEQ ID NO: 7128647 - DNA, 21 bp, Homo sapiens
aaactgaccttgcctgagaca

SEQ ID NO: 7128648 - DNA, 21 bp, Homo sapiens
aaactgaccttgcctgagaca

SEQ ID NO: 7128649 - DNA, 21 bp, Homo sapiens
aaactgaccttgcctgagaca

SEQ ID NO: 7128650 - DNA, 22 bp, Homo sapiens
aaactgaattcaagtatccagt

SEQ ID NO: 7128651 - DNA, 22 bp, Homo sapiens
aaactgaattcccaagggcatg

SEQ ID NO: 7128652 - DNA, 22 bp, Homo sapiens
aaactgaattcccaagggcatg

SEQ ID NO: 7128653 - DNA, 22 bp, Homo sapiens
aaactgaattcaagtatccagt

SEQ ID NO: 7128654 - DNA, 22 bp, Homo sapiens
aaactcttcatatacatatgct

SEQ ID NO: 7128655 - DNA, 22 bp, Homo sapiens
aaactctttccacgattacttt

SEQ ID NO: 7128656 - DNA, 17 bp, Homo sapiens
aaactgaaaaattcact

SEQ ID NO: 7128657 - DNA, 17 bp, Homo sapiens
aaactgaaaaattcact

SEQ ID NO: 7128658 - DNA, 22 bp, Homo sapiens
aaactgaaacatcatcatgttg

SEQ ID NO: 7128659 - DNA, 22 bp, Homo sapiens
aaactcttttgcatattagagg

SEQ ID NO: 7128660 - DNA, 21 bp, Homo sapiens
aaactgaagagacaggaactt

SEQ ID NO: 7128661 - DNA, 22 bp, Homo sapiens
aaagaggctcaaggtgggccag

SEQ ID NO: 7128662 - DNA, 22 bp, Homo sapiens
aaagaggctcaaggtgggccag

SEQ ID NO: 7128663 - DNA, 22 bp, Homo sapiens
aaagaggcaggtgttactggaa

SEQ ID NO: 7128664 - DNA, 22 bp, Homo sapiens
aaagaggcaatcaatgtagcaa

SEQ ID NO: 7128665 - DNA, 22 bp, Homo sapiens
aaagaggcaatcaatgtagcaa

SEQ ID NO: 7128666 - DNA, 22 bp, Homo sapiens
aaagaggatggagtagtcagct

SEQ ID NO: 7128667 - DNA, 22 bp, Homo sapiens
aaagaggatggagtagtcagct

SEQ ID NO: 7128668 - DNA, 22 bp, Homo sapiens
aaagaggaaccaagagcacgtg

SEQ ID NO: 7128669 - DNA, 22 bp, Homo sapiens
aaagaggaaccaagagcacgtg

SEQ ID NO: 7128670 - DNA, 22 bp, Homo sapiens
aaatgcagcagctaattgaaaa

SEQ ID NO: 7128671 - DNA, 22 bp, Homo sapiens
aaatgcagcagctaattgaaaa

SEQ ID NO: 7128672 - DNA, 22 bp, Homo sapiens
aaagagcaccctcaatgtctga

SEQ ID NO: 7128673 - DNA, 22 bp, Homo sapiens
aaagagcaccctcaatgtctga

SEQ ID NO: 7128674 - DNA, 22 bp, Homo sapiens
aaagagcaccctcaatgtctga

SEQ ID NO: 7128675 - DNA, 22 bp, Homo sapiens
aaagagcatggaaagttcagga

SEQ ID NO: 7128676 - DNA, 21 bp, Homo sapiens
aaagagcttttgtgctagtta

SEQ ID NO: 7128677 - DNA, 22 bp, Homo sapiens
aaagaggaaccaagagcacgtg

SEQ ID NO: 7128678 - DNA, 22 bp, Homo sapiens
aaatgcagattgtcattcagga

SEQ ID NO: 7128679 - DNA, 22 bp, Homo sapiens
aaatgcagcagctaattgaaaa

SEQ ID NO: 7128680 - DNA, 22 bp, Homo sapiens
aaatgcagatccctgaatctca

SEQ ID NO: 7128681 - DNA, 22 bp, Homo sapiens
aaatgcagaatgatttcatcta

SEQ ID NO: 7128682 - DNA, 22 bp, Homo sapiens
aaatgcagaatgatttcatcta

SEQ ID NO: 7128683 - DNA, 22 bp, Homo sapiens
aaatgcactgaatattccaaat

SEQ ID NO: 7128684 - DNA, 22 bp, Homo sapiens
aaatgcacgctacccagctaga

SEQ ID NO: 7128685 - DNA, 22 bp, Homo sapiens
aaatgcactctgcttctgtgac

SEQ ID NO: 7128686 - DNA, 22 bp, Homo sapiens
aaatgcactgaacacatgttgt

SEQ ID NO: 7128687 - DNA, 22 bp, Homo sapiens
aaatgcactgaacacatgttgt

SEQ ID NO: 7128688 - DNA, 22 bp, Homo sapiens
aaattaagagtaactctgtaga

SEQ ID NO: 7128689 - DNA, 22 bp, Homo sapiens
aaattaagagtaactctgtaga

SEQ ID NO: 7128690 - DNA, 22 bp, Homo sapiens
aaagagtttacaaattaggtaa

SEQ ID NO: 7128691 - DNA, 22 bp, Homo sapiens
aaagagttgttgtataacagga

SEQ ID NO: 7128692 - DNA, 22 bp, Homo sapiens
aaagagttgttgtataacagga

SEQ ID NO: 7128693 - DNA, 22 bp, Homo sapiens
aaagagtttacaaattaggtaa

SEQ ID NO: 7128694 - DNA, 22 bp, Homo sapiens
aaagagtttacaaattaggtaa

SEQ ID NO: 7128695 - DNA, 22 bp, Homo sapiens
aaagagttgaggcagttatcca

SEQ ID NO: 7128696 - DNA, 22 bp, Homo sapiens
aaagagttctgtttgagctgaa

SEQ ID NO: 7128697 - DNA, 22 bp, Homo sapiens
aaagagttgaaaactaacagtg

SEQ ID NO: 7128698 - DNA, 22 bp, Homo sapiens
aaagagttgaggcagttatcca

SEQ ID NO: 7128699 - DNA, 22 bp, Homo sapiens
aaagagtctggcactgtaccag

SEQ ID NO: 7128700 - DNA, 22 bp, Homo sapiens
aaagagttcacggaggccaaag

SEQ ID NO: 7128701 - DNA, 22 bp, Homo sapiens
aaagagggacaggcgcagacac

SEQ ID NO: 7128702 - DNA, 21 bp, Homo sapiens
aaagaggttaatattgtaagt

SEQ ID NO: 7128703 - DNA, 22 bp, Homo sapiens
aaagagtcaaaggcatgtctct

SEQ ID NO: 7128704 - DNA, 22 bp, Homo sapiens
aaagagtcgtgttccaggtttg

SEQ ID NO: 7128705 - DNA, 22 bp, Homo sapiens
aaattagaccagggctcctgga

SEQ ID NO: 7128706 - DNA, 22 bp, Homo sapiens
aaattagaagtgctcaggaata

SEQ ID NO: 7128707 - DNA, 22 bp, Homo sapiens
aaattagaaatactttcaaagc

SEQ ID NO: 7128708 - DNA, 22 bp, Homo sapiens
aaattagaaatactttcaaagc

SEQ ID NO: 7128709 - DNA, 22 bp, Homo sapiens
aaattagaaatactttcaaagc

SEQ ID NO: 7128710 - DNA, 22 bp, Homo sapiens
aaattactttacactttcatct

SEQ ID NO: 7128711 - DNA, 22 bp, Homo sapiens
aaattaagggtgagaagagttg

SEQ ID NO: 7128712 - DNA, 22 bp, Homo sapiens
aaattaagggtgagaagagttg

SEQ ID NO: 7128713 - DNA, 22 bp, Homo sapiens
aaattaagggtgagaagagttg

SEQ ID NO: 7128714 - DNA, 22 bp, Homo sapiens
aaattaagggtgagaagagttg

SEQ ID NO: 7128715 - DNA, 22 bp, Homo sapiens
aaattaagggtgagaagagttg

SEQ ID NO: 7128716 - DNA, 22 bp, Homo sapiens
aaaggtcttttttctaacacca

SEQ ID NO: 7128717 - DNA, 22 bp, Homo sapiens
aaaggtcttttttctaacacca

SEQ ID NO: 7128718 - DNA, 22 bp, Homo sapiens
aaaggtcttttttctaacacca

SEQ ID NO: 7128719 - DNA, 22 bp, Homo sapiens
aaaggtcttgtcttgacagagt

SEQ ID NO: 7128720 - DNA, 22 bp, Homo sapiens
aaaggtcttaaggttaagcagg

SEQ ID NO: 7128721 - DNA, 22 bp, Homo sapiens
aaaggtcttaatgttaacatac

SEQ ID NO: 7128722 - DNA, 22 bp, Homo sapiens
aaaggtcttaatgttaacatac

SEQ ID NO: 7128723 - DNA, 22 bp, Homo sapiens
aaaggtcttcagtgctttcact

SEQ ID NO: 7128724 - DNA, 22 bp, Homo sapiens
aaaggtcttctcaaacatccca

SEQ ID NO: 7128725 - DNA, 22 bp, Homo sapiens
aaaggttaaggtgttcaagaaa

SEQ ID NO: 7128726 - DNA, 22 bp, Homo sapiens
aaacattgtacattctgtagct

SEQ ID NO: 7128727 - DNA, 22 bp, Homo sapiens
aaacattgttatgataaattac

SEQ ID NO: 7128728 - DNA, 22 bp, Homo sapiens
aaacccagggttttgtcttccc

SEQ ID NO: 7128729 - DNA, 22 bp, Homo sapiens
aaacccatggctgatatcacta

SEQ ID NO: 7128730 - DNA, 22 bp, Homo sapiens
aaacctattggcaagaataata

SEQ ID NO: 7128731 - DNA, 22 bp, Homo sapiens
aaacctattggcaagaataata

SEQ ID NO: 7128732 - DNA, 22 bp, Homo sapiens
aaacctaggtttcctcattcag

SEQ ID NO: 7128733 - DNA, 22 bp, Homo sapiens
aaacctatatagtcttagaagc

SEQ ID NO: 7128734 - DNA, 22 bp, Homo sapiens
aaaccgcaattacttttgcgtc

SEQ ID NO: 7128735 - DNA, 22 bp, Homo sapiens
aaacctgtagcagtttgttaca

SEQ ID NO: 7128736 - DNA, 22 bp, Homo sapiens
aaacctgtagcagtttgttaca

SEQ ID NO: 7128737 - DNA, 22 bp, Homo sapiens
aaacctggtggaacggtgaata

SEQ ID NO: 7128738 - DNA, 22 bp, Homo sapiens
aaacctgaagtacgttacataa

SEQ ID NO: 7128739 - DNA, 22 bp, Homo sapiens
aaacctcttctcaagatttctg

SEQ ID NO: 7128740 - DNA, 22 bp, Homo sapiens
aaacctcttctcaagatttctg

SEQ ID NO: 7128741 - DNA, 22 bp, Homo sapiens
aaacctcttctcaagatttctg

SEQ ID NO: 7128742 - DNA, 22 bp, Homo sapiens
aaacctctttccattagaggaa

SEQ ID NO: 7128743 - DNA, 22 bp, Homo sapiens
aaacctcttttaaggagttgtt

SEQ ID NO: 7128744 - DNA, 22 bp, Homo sapiens
aaacctcttttaaggagttgtt

SEQ ID NO: 7128745 - DNA, 22 bp, Homo sapiens
aaacctctttccattagaggaa

SEQ ID NO: 7128746 - DNA, 22 bp, Homo sapiens
aaacctctccactacatgacag

SEQ ID NO: 7128747 - DNA, 22 bp, Homo sapiens
aaacctctccactacatgacag

SEQ ID NO: 7128748 - DNA, 22 bp, Homo sapiens
aaacctctgaatactgttggca

SEQ ID NO: 7128749 - DNA, 22 bp, Homo sapiens
aaacctctgaatactgttggca

SEQ ID NO: 7128750 - DNA, 22 bp, Homo sapiens
aaacctctgggttccgtggttt

SEQ ID NO: 7128751 - DNA, 22 bp, Homo sapiens
aaacctctgggttccgtggttt

SEQ ID NO: 7128752 - DNA, 22 bp, Homo sapiens
aaacctctgtgctatgacaccc

SEQ ID NO: 7128753 - DNA, 22 bp, Homo sapiens
aaacctctgtgctatgacaccc

SEQ ID NO: 7128754 - DNA, 22 bp, Homo sapiens
aaacctcttaatggcctgtaat

SEQ ID NO: 7128755 - DNA, 22 bp, Homo sapiens
aaacctcttaatggcctgtaat

SEQ ID NO: 7128756 - DNA, 22 bp, Homo sapiens
aaaccttagctagagtgtgtca

SEQ ID NO: 7128757 - DNA, 22 bp, Homo sapiens
aaacctgtctgattatggagac

SEQ ID NO: 7128758 - DNA, 22 bp, Homo sapiens
aaacctgtggccactaaatttg

SEQ ID NO: 7128759 - DNA, 22 bp, Homo sapiens
aaacctgtggccactaaatttg

SEQ ID NO: 7128760 - DNA, 22 bp, Homo sapiens
aaaccttcacatctactctaca

SEQ ID NO: 7128761 - DNA, 22 bp, Homo sapiens
aaacctttaccagactagcaag

SEQ ID NO: 7128762 - DNA, 22 bp, Homo sapiens
aaacctttaccagactagcaag

SEQ ID NO: 7128763 - DNA, 22 bp, Homo sapiens
aaacctttctcagtgctaaaat

SEQ ID NO: 7128764 - DNA, 22 bp, Homo sapiens
aaacctttctcagtgctaaaat

SEQ ID NO: 7128765 - DNA, 22 bp, Homo sapiens
aaacctttctgctctcagcgta

SEQ ID NO: 7128766 - DNA, 22 bp, Homo sapiens
aaacctttctgctctcagcgta

SEQ ID NO: 7128767 - DNA, 22 bp, Homo sapiens
aaacctttgcctggaagggagt

SEQ ID NO: 7128768 - DNA, 22 bp, Homo sapiens
aaacctttgcctggaagggagt

SEQ ID NO: 7128769 - DNA, 22 bp, Homo sapiens
aaacctttgtgtgtctgtgcct

SEQ ID NO: 7128770 - DNA, 22 bp, Homo sapiens
aaacctttgtgtgtctgtgcct

SEQ ID NO: 7128771 - DNA, 22 bp, Homo sapiens
aaagttcactgaccagcactgg

SEQ ID NO: 7128772 - DNA, 22 bp, Homo sapiens
aaagttcactgaccagcactgg

SEQ ID NO: 7128773 - DNA, 22 bp, Homo sapiens
aaagttcactgaccagcactgg

SEQ ID NO: 7128774 - DNA, 22 bp, Homo sapiens
aaagttcagattagactcaaga

SEQ ID NO: 7128775 - DNA, 22 bp, Homo sapiens
aaagttagtcagaaccagccat

SEQ ID NO: 7128776 - DNA, 22 bp, Homo sapiens
aaaccttttcagctgaatggag

SEQ ID NO: 7128777 - DNA, 22 bp, Homo sapiens
aaaccttttcagctgaatggag

SEQ ID NO: 7128778 - DNA, 22 bp, Homo sapiens
aaagttacagtaattcagtgta

SEQ ID NO: 7128779 - DNA, 21 bp, Homo sapiens
aaagttcatgctttaatattc

SEQ ID NO: 7128780 - DNA, 21 bp, Homo sapiens
aaagttcatgctttaatattc

SEQ ID NO: 7128781 - DNA, 21 bp, Homo sapiens
aaagttcatgctttaatattc

SEQ ID NO: 7128782 - DNA, 21 bp, Homo sapiens
aaagttcatgctttaatattc

SEQ ID NO: 7128783 - DNA, 22 bp, Homo sapiens
aaactagagatggcaggtggaa

SEQ ID NO: 7128784 - DNA, 22 bp, Homo sapiens
aaagttcatggtgttatagaaa

SEQ ID NO: 7128785 - DNA, 20 bp, Homo sapiens
aaagttcatgtttgcacttt

SEQ ID NO: 7128786 - DNA, 20 bp, Homo sapiens
aaagttcatgtttgcacttt

SEQ ID NO: 7128787 - DNA, 22 bp, Homo sapiens
aaactctagtaaaatgtattca

SEQ ID NO: 7128788 - DNA, 22 bp, Homo sapiens
aaactctagtaaaatgtattca

SEQ ID NO: 7128789 - DNA, 22 bp, Homo sapiens
aaactagatgaaacgagtaaag

SEQ ID NO: 7128790 - DNA, 22 bp, Homo sapiens
aaactagatgattatgaagcat

SEQ ID NO: 7128791 - DNA, 22 bp, Homo sapiens
aaactagatgattatgaagcat

SEQ ID NO: 7128792 - DNA, 22 bp, Homo sapiens
aaactagatgattatgaagcat

SEQ ID NO: 7128793 - DNA, 22 bp, Homo sapiens
aaactctagggctccacattcc

SEQ ID NO: 7128794 - DNA, 22 bp, Homo sapiens
aaactctagttatgaagtttgt

SEQ ID NO: 7128795 - DNA, 22 bp, Homo sapiens
aaactctataaataagggctat

SEQ ID NO: 7128796 - DNA, 22 bp, Homo sapiens
aaactctataggcagaagcaat

SEQ ID NO: 7128797 - DNA, 22 bp, Homo sapiens
aaactctatgaaccttctacca

SEQ ID NO: 7128798 - DNA, 22 bp, Homo sapiens
aaactctcattttagtgcactg

SEQ ID NO: 7128799 - DNA, 22 bp, Homo sapiens
aaactctatttctgttggctta

SEQ ID NO: 7128800 - DNA, 22 bp, Homo sapiens
aaacaatgtagattaccattta

SEQ ID NO: 7128801 - DNA, 22 bp, Homo sapiens
aaacaatgtacacatgaatgtt

SEQ ID NO: 7128802 - DNA, 22 bp, Homo sapiens
aaacaatgtacacatgaatgtt

SEQ ID NO: 7128803 - DNA, 22 bp, Homo sapiens
aaacaatgtacacatgaatgtt

SEQ ID NO: 7128804 - DNA, 22 bp, Homo sapiens
aaacaatgtacatttataatgc

SEQ ID NO: 7128805 - DNA, 22 bp, Homo sapiens
aaacaatgtacatttataatgc

SEQ ID NO: 7128806 - DNA, 22 bp, Homo sapiens
aaacaatgacaacacagctgcg

SEQ ID NO: 7128807 - DNA, 22 bp, Homo sapiens
aaacaatgacaacacagctgcg

SEQ ID NO: 7128808 - DNA, 22 bp, Homo sapiens
aaacaatgagcttttacacact

SEQ ID NO: 7128809 - DNA, 17 bp, Homo sapiens
aaacaatgcagacaagc

SEQ ID NO: 7128810 - DNA, 17 bp, Homo sapiens
aaacaatgcagacaagc

SEQ ID NO: 7128811 - DNA, 22 bp, Homo sapiens
aaacagtgactggtacataata

SEQ ID NO: 7128812 - DNA, 22 bp, Homo sapiens
aaacagcttgtttcaggaaagt

SEQ ID NO: 7128813 - DNA, 22 bp, Homo sapiens
aaacagtgactggtacataata

SEQ ID NO: 7128814 - DNA, 22 bp, Homo sapiens
aaacagcttgtaaggtgtaatt

SEQ ID NO: 7128815 - DNA, 22 bp, Homo sapiens
aaacagcttgtaaggtgtaatt

SEQ ID NO: 7128816 - DNA, 22 bp, Homo sapiens
aaacagtgcaggaagttaagca

SEQ ID NO: 7128817 - DNA, 22 bp, Homo sapiens
aaacaatgttcctatattagag

SEQ ID NO: 7128818 - DNA, 22 bp, Homo sapiens
aaacaatgtagattaccattta

SEQ ID NO: 7128819 - DNA, 23 bp, Homo sapiens
aaacaatgtcatcaggacttggt

SEQ ID NO: 7128820 - DNA, 22 bp, Homo sapiens
aaacaatgtctaaggtgcacag

SEQ ID NO: 7128821 - DNA, 22 bp, Homo sapiens
aaacaatttccacctctcctga

SEQ ID NO: 7128822 - DNA, 22 bp, Homo sapiens
aaacaatgttgctgggtgcggt

SEQ ID NO: 7128823 - DNA, 22 bp, Homo sapiens
aaacaatgttgtctccaagagg

SEQ ID NO: 7128824 - DNA, 22 bp, Homo sapiens
aaacaatgttgtctccaagagg

SEQ ID NO: 7128825 - DNA, 22 bp, Homo sapiens
aaacagtttataacatgatact

SEQ ID NO: 7128826 - DNA, 22 bp, Homo sapiens
aaacagtttcattttcatgacc

SEQ ID NO: 7128827 - DNA, 22 bp, Homo sapiens
aaacagtttcattttcatgacc

SEQ ID NO: 7128828 - DNA, 22 bp, Homo sapiens
aaacagtttcattttcatgacc

SEQ ID NO: 7128829 - DNA, 22 bp, Homo sapiens
aaacagtttcattttcatgacc

SEQ ID NO: 7128830 - DNA, 22 bp, Homo sapiens
aaacagttgttatttttatatg

SEQ ID NO: 7128831 - DNA, 22 bp, Homo sapiens
aaacagttctcatttgtttaga

SEQ ID NO: 7128832 - DNA, 22 bp, Homo sapiens
aaacagttgttatttttatatg

SEQ ID NO: 7128833 - DNA, 22 bp, Homo sapiens
aaacagtttataacatgatact

SEQ ID NO: 7128834 - DNA, 22 bp, Homo sapiens
aaacagtttataacatgatact

SEQ ID NO: 7128835 - DNA, 22 bp, Homo sapiens
aaacagttacgagcgcagacct

SEQ ID NO: 7128836 - DNA, 22 bp, Homo sapiens
aaacagttaattgctttcagtt

SEQ ID NO: 7128837 - DNA, 22 bp, Homo sapiens
aaacagtgtttttatgatttat

SEQ ID NO: 7128838 - DNA, 22 bp, Homo sapiens
aaagggctgtcaaataagcaac

SEQ ID NO: 7128839 - DNA, 22 bp, Homo sapiens
aaagggctgtcaaataagcaac

SEQ ID NO: 7128840 - DNA, 22 bp, Homo sapiens
aaacagtttctaatcatggaga

SEQ ID NO: 7128841 - DNA, 22 bp, Homo sapiens
aaacagtttctaatcatggaga

SEQ ID NO: 7128842 - DNA, 22 bp, Homo sapiens
aaacagttttcctagctgtctg

SEQ ID NO: 7128843 - DNA, 22 bp, Homo sapiens
aaagggctttgtaaacttcaag

SEQ ID NO: 7128844 - DNA, 22 bp, Homo sapiens
aaaggtaacagttataaccagg

SEQ ID NO: 7128845 - DNA, 22 bp, Homo sapiens
aaaggtaacagttataaccagg

SEQ ID NO: 7128846 - DNA, 22 bp, Homo sapiens
aaaggtagtacttctagaaggg

SEQ ID NO: 7128847 - DNA, 22 bp, Homo sapiens
aaaggtagtacttctagaaggg

SEQ ID NO: 7128848 - DNA, 22 bp, Homo sapiens
aaaggtcaaaatcgtgacattg

SEQ ID NO: 7128849 - DNA, 22 bp, Homo sapiens
aaaggtcaagctggactcaggt

SEQ ID NO: 7128850 - DNA, 22 bp, Homo sapiens
aaaggtcagacttaggctgggc

SEQ ID NO: 7128851 - DNA, 22 bp, Homo sapiens
aaaggtcagctgccatcgttct

SEQ ID NO: 7128852 - DNA, 22 bp, Homo sapiens
aaaggtcattgaaaaggaggaa

SEQ ID NO: 7128853 - DNA, 22 bp, Homo sapiens
aaaggtctacatcactgaaaga

SEQ ID NO: 7128854 - DNA, 22 bp, Homo sapiens
aaaggtcttaaggttaagcagg

SEQ ID NO: 7128855 - DNA, 22 bp, Homo sapiens
aaagtgggaacaatggagagtg

SEQ ID NO: 7128856 - DNA, 21 bp, Homo sapiens
aaagtggtaaggattattttg

SEQ ID NO: 7128857 - DNA, 21 bp, Homo sapiens
aaagtggtaaggattattttg

SEQ ID NO: 7128858 - DNA, 22 bp, Homo sapiens
aaagtgggaacaatggagagtg

SEQ ID NO: 7128859 - DNA, 22 bp, Homo sapiens
aaagtggcgaagctgagtttta

SEQ ID NO: 7128860 - DNA, 22 bp, Homo sapiens
aaagtggcttctctgtgctttt

SEQ ID NO: 7128861 - DNA, 22 bp, Homo sapiens
aaagtggtcaccttctcatttc

SEQ ID NO: 7128862 - DNA, 22 bp, Homo sapiens
aaagtggtctgcatcccttctg

SEQ ID NO: 7128863 - DNA, 22 bp, Homo sapiens
aaagtggtgggcgaactcatca

SEQ ID NO: 7128864 - DNA, 22 bp, Homo sapiens
aaagtggttcttacatccgtgg

SEQ ID NO: 7128865 - DNA, 22 bp, Homo sapiens
aaagtggttgctgtcagcctct

SEQ ID NO: 7128866 - DNA, 22 bp, Homo sapiens
aaagtggtttatgatattccaa

SEQ ID NO: 7128867 - DNA, 22 bp, Homo sapiens
aaagtggtttatgatattccaa

SEQ ID NO: 7128868 - DNA, 22 bp, Homo sapiens
aaagtggtttcccagttcagta

SEQ ID NO: 7128869 - DNA, 22 bp, Homo sapiens
aaagtggtttttcagactttga

SEQ ID NO: 7128870 - DNA, 22 bp, Homo sapiens
aaagtgtaaaagcatgttaggg

SEQ ID NO: 7128871 - DNA, 20 bp, Homo sapiens
aaagtgtaagcatataatta

SEQ ID NO: 7128872 - DNA, 20 bp, Homo sapiens
aaagtgtaagcatataatta

SEQ ID NO: 7128873 - DNA, 20 bp, Homo sapiens
aaagtgtaaggcaaagttgt

SEQ ID NO: 7128874 - DNA, 22 bp, Homo sapiens
aaagtgtactatgtcatgaaca

SEQ ID NO: 7128875 - DNA, 22 bp, Homo sapiens
aaagtgtactatgtcatgaaca

SEQ ID NO: 7128876 - DNA, 22 bp, Homo sapiens
aaagtgcttcctttttgagggt

SEQ ID NO: 7128877 - DNA, 22 bp, Homo sapiens
aaagtgctgtgggctgtaagtg

SEQ ID NO: 7128878 - DNA, 22 bp, Homo sapiens
aaagtgcagtaacttgcccaag

SEQ ID NO: 7128879 - DNA, 22 bp, Homo sapiens
aaagtgcagtccatgaaattaa

SEQ ID NO: 7128880 - DNA, 22 bp, Homo sapiens
aaagtgcttctctttggtgggt

SEQ ID NO: 7128881 - DNA, 22 bp, Homo sapiens
aaagtgctttaggatatttgga

SEQ ID NO: 7128882 - DNA, 22 bp, Homo sapiens
aaagtgctttaggatatttgga

SEQ ID NO: 7128883 - DNA, 22 bp, Homo sapiens
aaagtgctttcccacatttgtt

SEQ ID NO: 7128884 - DNA, 22 bp, Homo sapiens
aaagtcaatgatttctcctgga

SEQ ID NO: 7128885 - DNA, 22 bp, Homo sapiens
aaagtcaatgatttctcctgga

SEQ ID NO: 7128886 - DNA, 22 bp, Homo sapiens
aaagtcacaatattggaaggtg

SEQ ID NO: 7128887 - DNA, 22 bp, Homo sapiens
aaagtcacagtttaggggatat

SEQ ID NO: 7128888 - DNA, 22 bp, Homo sapiens
aaagtcacatagcatcacttct

SEQ ID NO: 7128889 - DNA, 22 bp, Homo sapiens
aaagtcacatagcatcacttct

SEQ ID NO: 7128890 - DNA, 22 bp, Homo sapiens
aaagtcacatagcatcacttct

SEQ ID NO: 7128891 - DNA, 22 bp, Homo sapiens
aaagtgcagggtgctctggtat

SEQ ID NO: 7128892 - DNA, 22 bp, Homo sapiens
aaagtgcagtaacttgcccaag

SEQ ID NO: 7128893 - DNA, 22 bp, Homo sapiens
aaagtatttttgacaggcatta

SEQ ID NO: 7128894 - DNA, 22 bp, Homo sapiens
aaagtcaaaatgctctcctgtc

SEQ ID NO: 7128895 - DNA, 22 bp, Homo sapiens
aaagtcaaaatgctctcctgtc

SEQ ID NO: 7128896 - DNA, 22 bp, Homo sapiens
aaagtcaaggtttagactagag

SEQ ID NO: 7128897 - DNA, 22 bp, Homo sapiens
aaagtcaaggtttagactagag

SEQ ID NO: 7128898 - DNA, 22 bp, Homo sapiens
aaagtatttgtgatttttacca

SEQ ID NO: 7128899 - DNA, 22 bp, Homo sapiens
aaagtattcttgactgtttttc

SEQ ID NO: 7128900 - DNA, 22 bp, Homo sapiens
aaagtattcttgactgtttttc

SEQ ID NO: 7128901 - DNA, 22 bp, Homo sapiens
aaagtatgttgtggcttttaaa

SEQ ID NO: 7128902 - DNA, 22 bp, Homo sapiens
aaagtagagttgtggaattact

SEQ ID NO: 7128903 - DNA, 22 bp, Homo sapiens
aaagtagatttctcatggcgaa

SEQ ID NO: 7128904 - DNA, 22 bp, Homo sapiens
aaagtagcagtaattatgaaat

SEQ ID NO: 7128905 - DNA, 22 bp, Homo sapiens
aaagtagcagtaattatgaaat

SEQ ID NO: 7128906 - DNA, 22 bp, Homo sapiens
aaagtagcagtaattatgaaat

SEQ ID NO: 7128907 - DNA, 22 bp, Homo sapiens
aaagtagcttagttgatatttc

SEQ ID NO: 7128908 - DNA, 22 bp, Homo sapiens
aaagtagttagtcatgtgaaaa

SEQ ID NO: 7128909 - DNA, 22 bp, Homo sapiens
aaagtatatatgcactttagaa

SEQ ID NO: 7128910 - DNA, 22 bp, Homo sapiens
aaagtatatttacttactgtga

SEQ ID NO: 7128911 - DNA, 22 bp, Homo sapiens
aaagtactaatgaatattttgc

SEQ ID NO: 7128912 - DNA, 22 bp, Homo sapiens
aaagtactcgaggaggaggagc

SEQ ID NO: 7128913 - DNA, 22 bp, Homo sapiens
aaagtactgatgccatcagcac

SEQ ID NO: 7128914 - DNA, 23 bp, Homo sapiens
aaagtacttaatctgcaaaccac

SEQ ID NO: 7128915 - DNA, 22 bp, Homo sapiens
aaagtacttacagtatgcttgg

SEQ ID NO: 7128916 - DNA, 22 bp, Homo sapiens
aaagtacttacagtatgcttgg

SEQ ID NO: 7128917 - DNA, 23 bp, Homo sapiens
aaagtacttccacagctatgatc

SEQ ID NO: 7128918 - DNA, 22 bp, Homo sapiens
aaagtactttgggctatgtttg

SEQ ID NO: 7128919 - DNA, 22 bp, Homo sapiens
aaagtactttgggctatgtttg

SEQ ID NO: 7128920 - DNA, 22 bp, Homo sapiens
aaagtagaacattttcttatct

SEQ ID NO: 7128921 - DNA, 22 bp, Homo sapiens
aaagtagaggcattgatcaggt

SEQ ID NO: 7128922 - DNA, 22 bp, Homo sapiens
aaagtagaggcattgatcaggt

SEQ ID NO: 7128923 - DNA, 22 bp, Homo sapiens
aaagtagaggcattgatcaggt

SEQ ID NO: 7128924 - DNA, 22 bp, Homo sapiens
aaagtagaggcattgatcaggt

SEQ ID NO: 7128925 - DNA, 22 bp, Homo sapiens
aaagtagaggcattgatcaggt

SEQ ID NO: 7128926 - DNA, 22 bp, Homo sapiens
aactaacagtcattaaaagaac

SEQ ID NO: 7128927 - DNA, 22 bp, Homo sapiens
aactaacagtcattaaaagaac

SEQ ID NO: 7128928 - DNA, 22 bp, Homo sapiens
aactaacagtcattaaaagaac

SEQ ID NO: 7128929 - DNA, 22 bp, Homo sapiens
aactaagtcatagagtccctca

SEQ ID NO: 7128930 - DNA, 22 bp, Homo sapiens
aactaagttgcccagtccctgg

SEQ ID NO: 7128931 - DNA, 22 bp, Homo sapiens
aaagtaattgtggttcttgcca

SEQ ID NO: 7128932 - DNA, 22 bp, Homo sapiens
aaagtaattgtggttcttgcca

SEQ ID NO: 7128933 - DNA, 22 bp, Homo sapiens
aaagtaattgtggtttctgtca

SEQ ID NO: 7128934 - DNA, 22 bp, Homo sapiens
aaagtacaaatgttctagccat

SEQ ID NO: 7128935 - DNA, 22 bp, Homo sapiens
aaagtacaaggaaaggatctga

SEQ ID NO: 7128936 - DNA, 22 bp, Homo sapiens
aaagtacaaggaaaggatctga

SEQ ID NO: 7128937 - DNA, 22 bp, Homo sapiens
aactaaatctggcatttagagc

SEQ ID NO: 7128938 - DNA, 22 bp, Homo sapiens
aactaaatctggcatttagagc

SEQ ID NO: 7128939 - DNA, 22 bp, Homo sapiens
aactaaagtaaccaaggatatc

SEQ ID NO: 7128940 - DNA, 22 bp, Homo sapiens
aactaaaccatgacattatatt

SEQ ID NO: 7128941 - DNA, 22 bp, Homo sapiens
aactaaatctggcatttagagc

SEQ ID NO: 7128942 - DNA, 18 bp, Homo sapiens
aactaaagatctttaagc

SEQ ID NO: 7128943 - DNA, 22 bp, Homo sapiens
aactaaaccatgacattatatt

SEQ ID NO: 7128944 - DNA, 22 bp, Homo sapiens
aactaaaccatgacattatatt

SEQ ID NO: 7128945 - DNA, 22 bp, Homo sapiens
aactaaaactggtttgttctct

SEQ ID NO: 7128946 - DNA, 22 bp, Homo sapiens
aactaaaagtgtgtctcttgta

SEQ ID NO: 7128947 - DNA, 22 bp, Homo sapiens
aactaaaagtgtgtctcttgta

SEQ ID NO: 7128948 - DNA, 22 bp, Homo sapiens
aaaggttttctagggttgaggg

SEQ ID NO: 7128949 - DNA, 22 bp, Homo sapiens
aaaggttttcatcacagcaaga

SEQ ID NO: 7128950 - DNA, 22 bp, Homo sapiens
aactaaaactggtttgttctct

SEQ ID NO: 7128951 - DNA, 22 bp, Homo sapiens
aactaaaactggtttgttctct

SEQ ID NO: 7128952 - DNA, 22 bp, Homo sapiens
aactaaaactggtttgttctct

SEQ ID NO: 7128953 - DNA, 22 bp, Homo sapiens
aaaggttttcatcacagcaaga

SEQ ID NO: 7128954 - DNA, 22 bp, Homo sapiens
aaaggttttattctgagctctg

SEQ ID NO: 7128955 - DNA, 22 bp, Homo sapiens
aaaggttttatgttttccactt

SEQ ID NO: 7128956 - DNA, 22 bp, Homo sapiens
aaaggtttgccgacctctgctt

SEQ ID NO: 7128957 - DNA, 22 bp, Homo sapiens
aaaggtttgcatggaatttacc

SEQ ID NO: 7128958 - DNA, 22 bp, Homo sapiens
aaaggtttgaggtgggaagagg

SEQ ID NO: 7128959 - DNA, 22 bp, Homo sapiens
aaaggtttccgagctttaattt

SEQ ID NO: 7128960 - DNA, 22 bp, Homo sapiens
aaaggtttccgagctttaattt

SEQ ID NO: 7128961 - DNA, 22 bp, Homo sapiens
aaaggtttccgagctttaattt

SEQ ID NO: 7128962 - DNA, 22 bp, Homo sapiens
aaaggtttatttgttgctcaca

SEQ ID NO: 7128963 - DNA, 22 bp, Homo sapiens
aaaggtttatttgttgctcaca

SEQ ID NO: 7128964 - DNA, 22 bp, Homo sapiens
aaaggtttatttaatcagggag

SEQ ID NO: 7128965 - DNA, 22 bp, Homo sapiens
aaaggtttattgctatggttgt

SEQ ID NO: 7128966 - DNA, 22 bp, Homo sapiens
aaaggtttattgattctgctct

SEQ ID NO: 7128967 - DNA, 22 bp, Homo sapiens
aaagcttttgttttcgtaactg

SEQ ID NO: 7128968 - DNA, 22 bp, Homo sapiens
aaagcttttcagtatgttcatg

SEQ ID NO: 7128969 - DNA, 22 bp, Homo sapiens
aaagcttttcagtatgttcatg

SEQ ID NO: 7128970 - DNA, 22 bp, Homo sapiens
aaaggaagatctatacacccca

SEQ ID NO: 7128971 - DNA, 22 bp, Homo sapiens
aaaggaaaataagtagttccat

SEQ ID NO: 7128972 - DNA, 22 bp, Homo sapiens
aaagggcagagttcactagaaa

SEQ ID NO: 7128973 - DNA, 22 bp, Homo sapiens
aaagggcctccgcctgggcagg

SEQ ID NO: 7128974 - DNA, 22 bp, Homo sapiens
aaagggctcccaggatcatctc

SEQ ID NO: 7128975 - DNA, 22 bp, Homo sapiens
aaagggctcccaggatcatctc

SEQ ID NO: 7128976 - DNA, 22 bp, Homo sapiens
aaagggctgaagtagtctctgt

SEQ ID NO: 7128977 - DNA, 22 bp, Homo sapiens
aaagggctgatgtgacatagct

SEQ ID NO: 7128978 - DNA, 22 bp, Homo sapiens
aaaggttattattactattgtc

SEQ ID NO: 7128979 - DNA, 22 bp, Homo sapiens
aaaggttattattactattgtc

SEQ ID NO: 7128980 - DNA, 22 bp, Homo sapiens
aaaggaagatgccaggactctg

SEQ ID NO: 7128981 - DNA, 22 bp, Homo sapiens
aaaggaagatgccaggactctg

SEQ ID NO: 7128982 - DNA, 22 bp, Homo sapiens
aaaggaagattgagcttttcca

SEQ ID NO: 7128983 - DNA, 22 bp, Homo sapiens
aaagatcacgtcccaggactcg

SEQ ID NO: 7128984 - DNA, 22 bp, Homo sapiens
aaagatcacgtcccaggactcg

SEQ ID NO: 7128985 - DNA, 22 bp, Homo sapiens
aaagatcacgtcccaggactcg

SEQ ID NO: 7128986 - DNA, 22 bp, Homo sapiens
aaagccacgtggcctggggagc

SEQ ID NO: 7128987 - DNA, 22 bp, Homo sapiens
aaagccaggggagggattccca

SEQ ID NO: 7128988 - DNA, 22 bp, Homo sapiens
aaagatcagaggatagctgagt

SEQ ID NO: 7128989 - DNA, 22 bp, Homo sapiens
aaagatcagaggatagctgagt

SEQ ID NO: 7128990 - DNA, 22 bp, Homo sapiens
aaagatcagaggatagctgagt

SEQ ID NO: 7128991 - DNA, 22 bp, Homo sapiens
aaagatcaatagataaagctac

SEQ ID NO: 7128992 - DNA, 22 bp, Homo sapiens
aaagatatgtctccaaagagat

SEQ ID NO: 7128993 - DNA, 20 bp, Homo sapiens
aaagatactttttgtaatgg

SEQ ID NO: 7128994 - DNA, 22 bp, Homo sapiens
aaagatatgtctccaaagagat

SEQ ID NO: 7128995 - DNA, 22 bp, Homo sapiens
aaagccatcagtaaaatgattt

SEQ ID NO: 7128996 - DNA, 22 bp, Homo sapiens
aaagccatcagtaaaatgattt

SEQ ID NO: 7128997 - DNA, 22 bp, Homo sapiens
aaagccatcagtaaaatgattt

SEQ ID NO: 7128998 - DNA, 22 bp, Homo sapiens
aaagccataagcctaatactaa

SEQ ID NO: 7128999 - DNA, 22 bp, Homo sapiens
aaagccatatctattctattct

SEQ ID NO: 7129000 - DNA, 22 bp, Homo sapiens
aaagccatcagtaaaatgattt

SEQ ID NO: 7129001 - DNA, 22 bp, Homo sapiens
aaagccagttcttttatattgg

SEQ ID NO: 7129002 - DNA, 22 bp, Homo sapiens
aaagccagttcttagagaaagc

SEQ ID NO: 7129003 - DNA, 22 bp, Homo sapiens
aaagccagtggtatgagagaaa

SEQ ID NO: 7129004 - DNA, 22 bp, Homo sapiens
aaagccaggttgtgtgcaggaa

SEQ ID NO: 7129005 - DNA, 22 bp, Homo sapiens
aaagccagggtccaggcctgcc

SEQ ID NO: 7129006 - DNA, 22 bp, Homo sapiens
aaagatacttaatagttgtctg

SEQ ID NO: 7129007 - DNA, 22 bp, Homo sapiens
aacaaacaaacattttgtcatc

SEQ ID NO: 7129008 - DNA, 22 bp, Homo sapiens
aacaaacaaacattttgtcatc

SEQ ID NO: 7129009 - DNA, 22 bp, Homo sapiens
aacaaacaaacattttgtcatc

SEQ ID NO: 7129010 - DNA, 22 bp, Homo sapiens
aacaaacaaacattttgtcatc

SEQ ID NO: 7129011 - DNA, 22 bp, Homo sapiens
aacaaacaaacattttgtcatc

SEQ ID NO: 7129012 - DNA, 22 bp, Homo sapiens
aacaaacaaacattttgtcatc

SEQ ID NO: 7129013 - DNA, 22 bp, Homo sapiens
aacaaacaaacattttgtcatc

SEQ ID NO: 7129014 - DNA, 22 bp, Homo sapiens
aaagagtttccattgacatttc

SEQ ID NO: 7129015 - DNA, 22 bp, Homo sapiens
aacaaaacatttgtcttgtttc

SEQ ID NO: 7129016 - DNA, 22 bp, Homo sapiens
aacaaaacatttgtcttgtttc

SEQ ID NO: 7129017 - DNA, 22 bp, Homo sapiens
aacaaaacatttgtcttgtttc

SEQ ID NO: 7129018 - DNA, 22 bp, Homo sapiens
aacaaaagccgaagtaggtgtc

SEQ ID NO: 7129019 - DNA, 22 bp, Homo sapiens
aacaaacaaacattttgtcatc

SEQ ID NO: 7129020 - DNA, 22 bp, Homo sapiens
aacaaacaaacattttgtcatc

SEQ ID NO: 7129021 - DNA, 22 bp, Homo sapiens
aacaaacaaacattttgtcatc

SEQ ID NO: 7129022 - DNA, 22 bp, Homo sapiens
aaattttagtaaggaagttgag

SEQ ID NO: 7129023 - DNA, 22 bp, Homo sapiens
aaattttagtaaggaagttgag

SEQ ID NO: 7129024 - DNA, 22 bp, Homo sapiens
aaattttcagagcactagagaa

SEQ ID NO: 7129025 - DNA, 22 bp, Homo sapiens
aaattttgtattctagttctag

SEQ ID NO: 7129026 - DNA, 22 bp, Homo sapiens
aaattttctctctaagacttaa

SEQ ID NO: 7129027 - DNA, 21 bp, Homo sapiens
aaattttcttggctgtagtgt

SEQ ID NO: 7129028 - DNA, 22 bp, Homo sapiens
aaattttgtattctagttctag

SEQ ID NO: 7129029 - DNA, 22 bp, Homo sapiens
aaagcgcttccctttggagcgt

SEQ ID NO: 7129030 - DNA, 22 bp, Homo sapiens
aaagcgcatagggggcagcaag

SEQ ID NO: 7129031 - DNA, 22 bp, Homo sapiens
aacagcagcatgacagctgggt

SEQ ID NO: 7129032 - DNA, 22 bp, Homo sapiens
aaagctagaaggaaattttatg

SEQ ID NO: 7129033 - DNA, 22 bp, Homo sapiens
aaagctcttggattttagactc

SEQ ID NO: 7129034 - DNA, 22 bp, Homo sapiens
aaagctcttggattttagactc

SEQ ID NO: 7129035 - DNA, 22 bp, Homo sapiens
aacagcagcaagtaagcaggtc

SEQ ID NO: 7129036 - DNA, 22 bp, Homo sapiens
aacagcagcaagtaagcaggtc

SEQ ID NO: 7129037 - DNA, 22 bp, Homo sapiens
aacagcagcaagtaagcaggtc

SEQ ID NO: 7129038 - DNA, 22 bp, Homo sapiens
aacagcagaaactgcaagctac

SEQ ID NO: 7129039 - DNA, 22 bp, Homo sapiens
aacagcagaggagcgatggctg

SEQ ID NO: 7129040 - DNA, 22 bp, Homo sapiens
aacagcaccgaagtcgtctaag

SEQ ID NO: 7129041 - DNA, 22 bp, Homo sapiens
aacagcaatagcactattcatt

SEQ ID NO: 7129042 - DNA, 22 bp, Homo sapiens
aacagcaatagcactattcatt

SEQ ID NO: 7129043 - DNA, 22 bp, Homo sapiens
aacagcaatagcactattcatt

SEQ ID NO: 7129044 - DNA, 22 bp, Homo sapiens
aaagccatgaatgttatagagg

SEQ ID NO: 7129045 - DNA, 22 bp, Homo sapiens
aaagccatgggtctttggcata

SEQ ID NO: 7129046 - DNA, 22 bp, Homo sapiens
aaagccatctgtattaagtgaa

SEQ ID NO: 7129047 - DNA, 22 bp, Homo sapiens
aacagataatttctaagttact

SEQ ID NO: 7129048 - DNA, 22 bp, Homo sapiens
aacagagtttcaaataacatct

SEQ ID NO: 7129049 - DNA, 22 bp, Homo sapiens
aacagagtttcaaataacatct

SEQ ID NO: 7129050 - DNA, 22 bp, Homo sapiens
aacagagtttcaaataacatct

SEQ ID NO: 7129051 - DNA, 22 bp, Homo sapiens
aacagataagtatatctatgta

SEQ ID NO: 7129052 - DNA, 22 bp, Homo sapiens
aacagataagtatatctatgta

SEQ ID NO: 7129053 - DNA, 22 bp, Homo sapiens
aacagatataggcagaactttg

SEQ ID NO: 7129054 - DNA, 22 bp, Homo sapiens
aacagatttgtgaagctactca

SEQ ID NO: 7129055 - DNA, 22 bp, Homo sapiens
aacagattgtaacctgatagcc

SEQ ID NO: 7129056 - DNA, 19 bp, Homo sapiens
aacagcaacttcctagtca

SEQ ID NO: 7129057 - DNA, 22 bp, Homo sapiens
aacagcaagggcggggtcaaga

SEQ ID NO: 7129058 - DNA, 22 bp, Homo sapiens
aacagcaagggcggggtcaaga

SEQ ID NO: 7129059 - DNA, 22 bp, Homo sapiens
aaagctttctagctatgttcta

SEQ ID NO: 7129060 - DNA, 22 bp, Homo sapiens
aaagcttgtgctgtagtattta

SEQ ID NO: 7129061 - DNA, 22 bp, Homo sapiens
aaagctttctagctatgttcta

SEQ ID NO: 7129062 - DNA, 22 bp, Homo sapiens
aaagcttaaggtaggtacagag

SEQ ID NO: 7129063 - DNA, 22 bp, Homo sapiens
aaagcttaccttttcagtcttt

SEQ ID NO: 7129064 - DNA, 22 bp, Homo sapiens
aaagcttaaggtaggtacagag

SEQ ID NO: 7129065 - DNA, 22 bp, Homo sapiens
aaagcttagaggccagtggagg

SEQ ID NO: 7129066 - DNA, 22 bp, Homo sapiens
aaagcttagcattttcaaaatg

SEQ ID NO: 7129067 - DNA, 22 bp, Homo sapiens
aaagcttaggatagggaatata

SEQ ID NO: 7129068 - DNA, 22 bp, Homo sapiens
aaagcttatttgtatgcatgtt

SEQ ID NO: 7129069 - DNA, 22 bp, Homo sapiens
aaagcttctaggcctattgctt

SEQ ID NO: 7129070 - DNA, 22 bp, Homo sapiens
aaagcttctattcacttacttg

SEQ ID NO: 7129071 - DNA, 22 bp, Homo sapiens
aaagctgggggccctggtctag

SEQ ID NO: 7129072 - DNA, 22 bp, Homo sapiens
aaagctggttattctgaggcag

SEQ ID NO: 7129073 - DNA, 22 bp, Homo sapiens
aaagctggttattctgaggcag

SEQ ID NO: 7129074 - DNA, 22 bp, Homo sapiens
aaagctgtaatgcatgctttct

SEQ ID NO: 7129075 - DNA, 22 bp, Homo sapiens
aaagctgtaatgcatgctttct

SEQ ID NO: 7129076 - DNA, 22 bp, Homo sapiens
aaagctgtagaatcatcttaat

SEQ ID NO: 7129077 - DNA, 18 bp, Homo sapiens
aaagctgttattccagaa

SEQ ID NO: 7129078 - DNA, 22 bp, Homo sapiens
aaagctgttgtatggcccttgg

SEQ ID NO: 7129079 - DNA, 23 bp, Homo sapiens
aaagcttaactgggtaataaagc

SEQ ID NO: 7129080 - DNA, 22 bp, Homo sapiens
aaagctgggctggccaacccag

SEQ ID NO: 7129081 - DNA, 22 bp, Homo sapiens
aaagctggcctctcaggcttta

SEQ ID NO: 7129082 - DNA, 22 bp, Homo sapiens
aaagctggcttttacaggggct

SEQ ID NO: 7129083 - DNA, 22 bp, Homo sapiens
aaagctgctttaaacatctatg

SEQ ID NO: 7129084 - DNA, 22 bp, Homo sapiens
aaagctgctttaaacatctatg

SEQ ID NO: 7129085 - DNA, 22 bp, Homo sapiens
aaagctgctttggtttctggaa

SEQ ID NO: 7129086 - DNA, 22 bp, Homo sapiens
aaagctgctgccaatcaggctt

SEQ ID NO: 7129087 - DNA, 22 bp, Homo sapiens
aaagctgctgccaatcaggctt

SEQ ID NO: 7129088 - DNA, 22 bp, Homo sapiens
aaagctgctgtgaatggtttgg

SEQ ID NO: 7129089 - DNA, 22 bp, Homo sapiens
aaagctgctatgaacattctat

SEQ ID NO: 7129090 - DNA, 22 bp, Homo sapiens
aaagctgcccttgtgaaacaag

SEQ ID NO: 7129091 - DNA, 22 bp, Homo sapiens
aaagctcttttccaagtattga

SEQ ID NO: 7129092 - DNA, 22 bp, Homo sapiens
aaagctgcaagctcctgaggaa

SEQ ID NO: 7129093 - DNA, 22 bp, Homo sapiens
aaagctgccaaggagaatacta

SEQ ID NO: 7129094 - DNA, 22 bp, Homo sapiens
aaagctgcccagctgcctgttt

SEQ ID NO: 7129095 - DNA, 22 bp, Homo sapiens
aaagctgcccagctgcctgttt

SEQ ID NO: 7129096 - DNA, 22 bp, Homo sapiens
aaagctgcccagctgcctgttt

SEQ ID NO: 7129097 - DNA, 22 bp, Homo sapiens
aaagctgccctacacggaagca

SEQ ID NO: 7129098 - DNA, 22 bp, Homo sapiens
aaagctgccctacacggaagca

SEQ ID NO: 7129099 - DNA, 22 bp, Homo sapiens
aaagtgttgggattacaggcat

SEQ ID NO: 7129100 - DNA, 22 bp, Homo sapiens
aaagtgttgggattacaggcat

SEQ ID NO: 7129101 - DNA, 22 bp, Homo sapiens
aaagtgttgggattacaggtgt

SEQ ID NO: 7129102 - DNA, 22 bp, Homo sapiens
aaagtgttgggattacaggtgt

SEQ ID NO: 7129103 - DNA, 22 bp, Homo sapiens
aaagtgttgggattacaggtgt

SEQ ID NO: 7129104 - DNA, 22 bp, Homo sapiens
aaagtgttgggattataggcgt

SEQ ID NO: 7129105 - DNA, 22 bp, Homo sapiens
aaagtgtttacattgctataag

SEQ ID NO: 7129106 - DNA, 22 bp, Homo sapiens
aaagtgttttctgatgtgttct

SEQ ID NO: 7129107 - DNA, 22 bp, Homo sapiens
aaagtgttttctgatgtgttct

SEQ ID NO: 7129108 - DNA, 22 bp, Homo sapiens
aaagtgttttccatgcaatgaa

SEQ ID NO: 7129109 - DNA, 22 bp, Homo sapiens
aaagtgtttacattgctataag

SEQ ID NO: 7129110 - DNA, 19 bp, Homo sapiens
aaagtgttttaaagaggat

SEQ ID NO: 7129111 - DNA, 22 bp, Homo sapiens
aaagtgtttttgagctgtagtt

SEQ ID NO: 7129112 - DNA, 22 bp, Homo sapiens
aaagttttatatgctgcagcga

SEQ ID NO: 7129113 - DNA, 22 bp, Homo sapiens
aaagtgttttgatttagtggta

SEQ ID NO: 7129114 - DNA, 22 bp, Homo sapiens
aaagtgttttgtgagcagtctg

SEQ ID NO: 7129115 - DNA, 19 bp, Homo sapiens
aaagtgttttcttttctgt

SEQ ID NO: 7129116 - DNA, 22 bp, Homo sapiens
aaagttttattcaagcattagt

SEQ ID NO: 7129117 - DNA, 22 bp, Homo sapiens
aaagttttatatgctgcagcga

SEQ ID NO: 7129118 - DNA, 22 bp, Homo sapiens
aaataacagtcagggacaacat

SEQ ID NO: 7129119 - DNA, 23 bp, Homo sapiens
aaagtgtagccaggttaagaacc

SEQ ID NO: 7129120 - DNA, 23 bp, Homo sapiens
aaagtgtagccaggttaagaacc

SEQ ID NO: 7129121 - DNA, 22 bp, Homo sapiens
aaagtgtggagattgaactaaa

SEQ ID NO: 7129122 - DNA, 22 bp, Homo sapiens
aaagtgttaacactggctactt

SEQ ID NO: 7129123 - DNA, 22 bp, Homo sapiens
aaagtgttaacactggctactt

SEQ ID NO: 7129124 - DNA, 22 bp, Homo sapiens
aaagtgttatgagaactaagtg

SEQ ID NO: 7129125 - DNA, 22 bp, Homo sapiens
aaagtgttatgagaactaagtg

SEQ ID NO: 7129126 - DNA, 22 bp, Homo sapiens
aaagtgttatgagaactaagtg

SEQ ID NO: 7129127 - DNA, 22 bp, Homo sapiens
aaagtgttatgagaactaagtg

SEQ ID NO: 7129128 - DNA, 22 bp, Homo sapiens
aaagtgttatgcaaaactctgt

SEQ ID NO: 7129129 - DNA, 22 bp, Homo sapiens
aaagtgttatgcaaaactctgt

SEQ ID NO: 7129130 - DNA, 21 bp, Homo sapiens
aaagtgttcagaccagttctg

SEQ ID NO: 7129131 - DNA, 22 bp, Homo sapiens
aaagtgttgaagaaaatgttca

SEQ ID NO: 7129132 - DNA, 22 bp, Homo sapiens
aaagtgttgaagaaaatgttca

SEQ ID NO: 7129133 - DNA, 22 bp, Homo sapiens
aaagtgttgatatgtgacatcc

SEQ ID NO: 7129134 - DNA, 22 bp, Homo sapiens
aaagtgttgatatgtgacatcc

SEQ ID NO: 7129135 - DNA, 22 bp, Homo sapiens
aaagtgttgatatgtgacatcc

SEQ ID NO: 7129136 - DNA, 22 bp, Homo sapiens
aaagtgttgatatgtgacatcc

SEQ ID NO: 7129137 - DNA, 22 bp, Homo sapiens
aaagtgttgattttatagtgca

SEQ ID NO: 7129138 - DNA, 22 bp, Homo sapiens
aaagtgttgattttatagtgca

SEQ ID NO: 7129139 - DNA, 22 bp, Homo sapiens
aaagtgttgattttatagtgca

SEQ ID NO: 7129140 - DNA, 22 bp, Homo sapiens
aaagtgttgggaagaaagtgca

SEQ ID NO: 7129141 - DNA, 22 bp, Homo sapiens
aaataagttaaactagaatgat

SEQ ID NO: 7129142 - DNA, 22 bp, Homo sapiens
aaataagttaaactagaatgat

SEQ ID NO: 7129143 - DNA, 22 bp, Homo sapiens
aaataagttaaactagaatgat

SEQ ID NO: 7129144 - DNA, 22 bp, Homo sapiens
aaataagtagtttagtgttgtg

SEQ ID NO: 7129145 - DNA, 22 bp, Homo sapiens
aaataagtgtgggccagtcaaa

SEQ ID NO: 7129146 - DNA, 22 bp, Homo sapiens
aaataatcaatttttgtagata

SEQ ID NO: 7129147 - DNA, 22 bp, Homo sapiens
aaataatgttaggcctttgctc

SEQ ID NO: 7129148 - DNA, 22 bp, Homo sapiens
aaataatgttaggcctttgctc

SEQ ID NO: 7129149 - DNA, 22 bp, Homo sapiens
aaataattatagcgagtctatc

SEQ ID NO: 7129150 - DNA, 22 bp, Homo sapiens
aaataattatagcgagtctatc

SEQ ID NO: 7129151 - DNA, 22 bp, Homo sapiens
aaataagttaaactagaatgat

SEQ ID NO: 7129152 - DNA, 22 bp, Homo sapiens
aaataagttagcagattccagt

SEQ ID NO: 7129153 - DNA, 22 bp, Homo sapiens
aaataagttagcagattccagt

SEQ ID NO: 7129154 - DNA, 22 bp, Homo sapiens
aaataagttagcagattccagt

SEQ ID NO: 7129155 - DNA, 22 bp, Homo sapiens
aaataatcaatttttgtagata

SEQ ID NO: 7129156 - DNA, 22 bp, Homo sapiens
aaataacttggtttcatcagag

SEQ ID NO: 7129157 - DNA, 22 bp, Homo sapiens
aaataactttctgtgtatagtc

SEQ ID NO: 7129158 - DNA, 22 bp, Homo sapiens
aaataagaaattcttctttgca

SEQ ID NO: 7129159 - DNA, 22 bp, Homo sapiens
aaataagaaattcttctttgca

SEQ ID NO: 7129160 - DNA, 22 bp, Homo sapiens
aaataagaggacagatgtttgg

SEQ ID NO: 7129161 - DNA, 22 bp, Homo sapiens
aaataagaggacagatgtttgg

SEQ ID NO: 7129162 - DNA, 22 bp, Homo sapiens
aaataagaggacagatgtttgg

SEQ ID NO: 7129163 - DNA, 22 bp, Homo sapiens
aaataagaggacagatgtttgg

SEQ ID NO: 7129164 - DNA, 22 bp, Homo sapiens
aaataagaggacagatgtttgg

SEQ ID NO: 7129165 - DNA, 22 bp, Homo sapiens
aaataagaggacagatgtttgg

SEQ ID NO: 7129166 - DNA, 22 bp, Homo sapiens
aaataagcacttaactgtatca

SEQ ID NO: 7129167 - DNA, 22 bp, Homo sapiens
aaataagcacttaactgtatca

SEQ ID NO: 7129168 - DNA, 22 bp, Homo sapiens
aaatccatcaaatcttctagaa

SEQ ID NO: 7129169 - DNA, 22 bp, Homo sapiens
aaatccatcaaatcttctagaa

SEQ ID NO: 7129170 - DNA, 22 bp, Homo sapiens
aaatccatcaaatcttctagaa

SEQ ID NO: 7129171 - DNA, 22 bp, Homo sapiens
aaatccatggtaatctgttaca

SEQ ID NO: 7129172 - DNA, 22 bp, Homo sapiens
aaatccattctgttttaaaagt

SEQ ID NO: 7129173 - DNA, 22 bp, Homo sapiens
aaatcccactcacgagttttgc

SEQ ID NO: 7129174 - DNA, 22 bp, Homo sapiens
aaatcccactcagaaactgcca

SEQ ID NO: 7129175 - DNA, 22 bp, Homo sapiens
aaatcccactcagaaactgcca

SEQ ID NO: 7129176 - DNA, 22 bp, Homo sapiens
aaataggagcttaagcacttct

SEQ ID NO: 7129177 - DNA, 22 bp, Homo sapiens
aaataggagcttaagcacttct

SEQ ID NO: 7129178 - DNA, 23 bp, Homo sapiens
aaataggagtatctggatcatga

SEQ ID NO: 7129179 - DNA, 23 bp, Homo sapiens
aaataggagtatctggatcatga

SEQ ID NO: 7129180 - DNA, 23 bp, Homo sapiens
aaataggagtatctggatcatga

SEQ ID NO: 7129181 - DNA, 22 bp, Homo sapiens
aaatcagagtggttggtcatcc

SEQ ID NO: 7129182 - DNA, 22 bp, Homo sapiens
aaatcagatcttacacaattgt

SEQ ID NO: 7129183 - DNA, 22 bp, Homo sapiens
aaatcagatgcttcctagttgg

SEQ ID NO: 7129184 - DNA, 22 bp, Homo sapiens
aaatcagatgcttcctagttgg

SEQ ID NO: 7129185 - DNA, 22 bp, Homo sapiens
aaatcagattatttgattggca

SEQ ID NO: 7129186 - DNA, 22 bp, Homo sapiens
aaataggaatgtggtcctggga

SEQ ID NO: 7129187 - DNA, 22 bp, Homo sapiens
aaatagcttttcataattctca

SEQ ID NO: 7129188 - DNA, 22 bp, Homo sapiens
aaatagctacatgatctctagg

SEQ ID NO: 7129189 - DNA, 22 bp, Homo sapiens
aaatagctacatgatctctagg

SEQ ID NO: 7129190 - DNA, 22 bp, Homo sapiens
aaatagcataaaataggaagct

SEQ ID NO: 7129191 - DNA, 22 bp, Homo sapiens
aaatagcattgtatttagctga

SEQ ID NO: 7129192 - DNA, 22 bp, Homo sapiens
aaatagcagctttgacagcaca

SEQ ID NO: 7129193 - DNA, 22 bp, Homo sapiens
aaatagcagctttgacagcaca

SEQ ID NO: 7129194 - DNA, 22 bp, Homo sapiens
aaatagcagctttgacagcaca

SEQ ID NO: 7129195 - DNA, 22 bp, Homo sapiens
aaatagcagcctttagttaaca

SEQ ID NO: 7129196 - DNA, 22 bp, Homo sapiens
aaatagcagcctttagttaaca

SEQ ID NO: 7129197 - DNA, 22 bp, Homo sapiens
aaatagcagcctttagttaaca

SEQ ID NO: 7129198 - DNA, 22 bp, Homo sapiens
aaatagatttcctagcattgga

SEQ ID NO: 7129199 - DNA, 22 bp, Homo sapiens
aaatagatttcctagcattgga

SEQ ID NO: 7129200 - DNA, 22 bp, Homo sapiens
aaatagatttctctgggtttgt

SEQ ID NO: 7129201 - DNA, 22 bp, Homo sapiens
aaatagatttctctgggtttgt

SEQ ID NO: 7129202 - DNA, 22 bp, Homo sapiens
aaatagcaatgtgaaaagagga

SEQ ID NO: 7129203 - DNA, 22 bp, Homo sapiens
aaatagcaatgtgaaaagagga

SEQ ID NO: 7129204 - DNA, 22 bp, Homo sapiens
aaatagatttcctagcattgga

SEQ ID NO: 7129205 - DNA, 22 bp, Homo sapiens
aaatagattgctgaggcattac

SEQ ID NO: 7129206 - DNA, 22 bp, Homo sapiens
aaatagatttaacatccatccc

SEQ ID NO: 7129207 - DNA, 22 bp, Homo sapiens
aaatagatttaacatccatccc

SEQ ID NO: 7129208 - DNA, 22 bp, Homo sapiens
aaatagagctgggttaaacttt

SEQ ID NO: 7129209 - DNA, 22 bp, Homo sapiens
aaatagagctgggttaaacttt

SEQ ID NO: 7129210 - DNA, 22 bp, Homo sapiens
aaatagagctgggttaaacttt

SEQ ID NO: 7129211 - DNA, 22 bp, Homo sapiens
aaatagacaggcttaaatagga

SEQ ID NO: 7129212 - DNA, 22 bp, Homo sapiens
aaatagacacttggacagacaa

SEQ ID NO: 7129213 - DNA, 22 bp, Homo sapiens
aaatagacaggcttaaatagga

SEQ ID NO: 7129214 - DNA, 22 bp, Homo sapiens
aaatagacaggcttaaatagga

SEQ ID NO: 7129215 - DNA, 22 bp, Homo sapiens
aaatactgtagataatagagtt

SEQ ID NO: 7129216 - DNA, 22 bp, Homo sapiens
aaatactgtagataatagagtt

SEQ ID NO: 7129217 - DNA, 22 bp, Homo sapiens
aaatacaaaaattagccaggca

SEQ ID NO: 7129218 - DNA, 22 bp, Homo sapiens
aaatactgtagataatagagtt

SEQ ID NO: 7129219 - DNA, 22 bp, Homo sapiens
aaatacaaaaattagccaggca

SEQ ID NO: 7129220 - DNA, 22 bp, Homo sapiens
aaatacaaaaattagccaggca

SEQ ID NO: 7129221 - DNA, 22 bp, Homo sapiens
aaatacaaaaattagccaggca

SEQ ID NO: 7129222 - DNA, 22 bp, Homo sapiens
aaataattgagttggtcaatat

SEQ ID NO: 7129223 - DNA, 22 bp, Homo sapiens
aaataattgagttggtcaatat

SEQ ID NO: 7129224 - DNA, 22 bp, Homo sapiens
aaataattatagcgagtctatc

SEQ ID NO: 7129225 - DNA, 22 bp, Homo sapiens
aaataattatagcgagtctatc

SEQ ID NO: 7129226 - DNA, 22 bp, Homo sapiens
aaataattatagcgagtctatc

SEQ ID NO: 7129227 - DNA, 22 bp, Homo sapiens
aagcacagagatgggcacgcct

SEQ ID NO: 7129228 - DNA, 22 bp, Homo sapiens
aagcacagagatgggcacgcct

SEQ ID NO: 7129229 - DNA, 22 bp, Homo sapiens
aagcacagataaaacaggattc

SEQ ID NO: 7129230 - DNA, 22 bp, Homo sapiens
aagcacagataaaacaggattc

SEQ ID NO: 7129231 - DNA, 22 bp, Homo sapiens
aagcacagataaaacaggattc

SEQ ID NO: 7129232 - DNA, 22 bp, Homo sapiens
aagcacagataaaacaggattc

SEQ ID NO: 7129233 - DNA, 22 bp, Homo sapiens
aagcacagagaggtaaagtaac

SEQ ID NO: 7129234 - DNA, 22 bp, Homo sapiens
aagcacagagaggtaaagtaac

SEQ ID NO: 7129235 - DNA, 22 bp, Homo sapiens
aagcacagactccctctgagtg

SEQ ID NO: 7129236 - DNA, 22 bp, Homo sapiens
aagcacagactccctctgagtg

SEQ ID NO: 7129237 - DNA, 22 bp, Homo sapiens
aagcacagactccctctgagtg

SEQ ID NO: 7129238 - DNA, 22 bp, Homo sapiens
aagcacagagaggtaaagtaac

SEQ ID NO: 7129239 - DNA, 22 bp, Homo sapiens
aagcacagagaggtaaagtaac

SEQ ID NO: 7129240 - DNA, 22 bp, Homo sapiens
aaatctcaaaggcttagcatct

SEQ ID NO: 7129241 - DNA, 22 bp, Homo sapiens
aaatctcaaaggcttagcatct

SEQ ID NO: 7129242 - DNA, 22 bp, Homo sapiens
aaatctcaatttgaattgtagc

SEQ ID NO: 7129243 - DNA, 22 bp, Homo sapiens
aaatctcaatttgaattgtagc

SEQ ID NO: 7129244 - DNA, 22 bp, Homo sapiens
aagcacagaaaaggagcatgga

SEQ ID NO: 7129245 - DNA, 23 bp, Homo sapiens
aagcacagaatggtttaggagtt

SEQ ID NO: 7129246 - DNA, 23 bp, Homo sapiens
aagcacagaatggtttaggagtt

SEQ ID NO: 7129247 - DNA, 23 bp, Homo sapiens
aagcacagaatggtttaggagtt

SEQ ID NO: 7129248 - DNA, 22 bp, Homo sapiens
aagcacagacacaaaaggcttt

SEQ ID NO: 7129249 - DNA, 22 bp, Homo sapiens
aagcacagacacaaaaggcttt

SEQ ID NO: 7129250 - DNA, 22 bp, Homo sapiens
aagcacagacacaaaaggcttt

SEQ ID NO: 7129251 - DNA, 22 bp, Homo sapiens
aagcacagaccagatctccagg

SEQ ID NO: 7129252 - DNA, 22 bp, Homo sapiens
aagcacagaccagatctccagg

SEQ ID NO: 7129253 - DNA, 22 bp, Homo sapiens
aagcacagactccctctgagtg

SEQ ID NO: 7129254 - DNA, 22 bp, Homo sapiens
aagcacagactccctctgagtg

SEQ ID NO: 7129255 - DNA, 22 bp, Homo sapiens
aagcacagactccctctgagtg

SEQ ID NO: 7129256 - DNA, 22 bp, Homo sapiens
aaatccctgataatgtaggtct

SEQ ID NO: 7129257 - DNA, 22 bp, Homo sapiens
aaatcccttgctctctcagacc

SEQ ID NO: 7129258 - DNA, 22 bp, Homo sapiens
aaatcccttgctctctcagacc

SEQ ID NO: 7129259 - DNA, 23 bp, Homo sapiens
aaatcctgcctcttgtatttatc

SEQ ID NO: 7129260 - DNA, 22 bp, Homo sapiens
aaatcctgtccatttaccagat

SEQ ID NO: 7129261 - DNA, 22 bp, Homo sapiens
aaatgcaggtagtatttatttt

SEQ ID NO: 7129262 - DNA, 21 bp, Homo sapiens
aaatgcaggctctttgttttc

SEQ ID NO: 7129263 - DNA, 22 bp, Homo sapiens
aaatgcaggtagtatttatttt

SEQ ID NO: 7129264 - DNA, 22 bp, Homo sapiens
aaatgcaggttcttgagccaag

SEQ ID NO: 7129265 - DNA, 22 bp, Homo sapiens
aaatgcaggttcttgagccaag

SEQ ID NO: 7129266 - DNA, 22 bp, Homo sapiens
aaatgcagtggttctacttctc

SEQ ID NO: 7129267 - DNA, 20 bp, Homo sapiens
aaatgcagttctgccttggc

SEQ ID NO: 7129268 - DNA, 22 bp, Homo sapiens
aaatgcatatcaaagacttgaa

SEQ ID NO: 7129269 - DNA, 22 bp, Homo sapiens
aaatgcatcagctcataagaga

SEQ ID NO: 7129270 - DNA, 22 bp, Homo sapiens
aaatgcatgagaaagtattctg

SEQ ID NO: 7129271 - DNA, 22 bp, Homo sapiens
aaatgcatgagaaagtattctg

SEQ ID NO: 7129272 - DNA, 22 bp, Homo sapiens
aaatgcatcagctcataagaga

SEQ ID NO: 7129273 - DNA, 22 bp, Homo sapiens
aaatgcatgagaaagtattctg

SEQ ID NO: 7129274 - DNA, 22 bp, Homo sapiens
aagcacagatgcaagggggacc

SEQ ID NO: 7129275 - DNA, 22 bp, Homo sapiens
aagcacagatgcaagggggacc

SEQ ID NO: 7129276 - DNA, 22 bp, Homo sapiens
aagcacagatgcaagggggacc

SEQ ID NO: 7129277 - DNA, 22 bp, Homo sapiens
aagcacagattgctgcatccat

SEQ ID NO: 7129278 - DNA, 22 bp, Homo sapiens
aagcacagattgctgcatccat

SEQ ID NO: 7129279 - DNA, 22 bp, Homo sapiens
aagcacagattgctgcatccat

SEQ ID NO: 7129280 - DNA, 22 bp, Homo sapiens
aagcacagcagagccttgcttg

SEQ ID NO: 7129281 - DNA, 22 bp, Homo sapiens
aagcacagcagagccttgcttg

SEQ ID NO: 7129282 - DNA, 22 bp, Homo sapiens
aagcacagccaggttaggggct

SEQ ID NO: 7129283 - DNA, 22 bp, Homo sapiens
aagcacagccaggttaggggct

SEQ ID NO: 7129284 - DNA, 22 bp, Homo sapiens
aagcacagccaggttaggggct

SEQ ID NO: 7129285 - DNA, 22 bp, Homo sapiens
aagcacagctggaacagcagga

SEQ ID NO: 7129286 - DNA, 22 bp, Homo sapiens
aagcacagctggaacagcagga

SEQ ID NO: 7129287 - DNA, 22 bp, Homo sapiens
aagcacagctggaacagcagga

SEQ ID NO: 7129288 - DNA, 22 bp, Homo sapiens
aaatgcacaggttttaaatcct

SEQ ID NO: 7129289 - DNA, 22 bp, Homo sapiens
aaatgcaggaaattatgctttt

SEQ ID NO: 7129290 - DNA, 22 bp, Homo sapiens
aaatgcaggaaattatgctttt

SEQ ID NO: 7129291 - DNA, 21 bp, Homo sapiens
aaatgcaggctctttgttttc

SEQ ID NO: 7129292 - DNA, 22 bp, Homo sapiens
aaatgcaggaaattatgctttt

SEQ ID NO: 7129293 - DNA, 22 bp, Homo sapiens
aaatgcagctgggcatgagagg

SEQ ID NO: 7129294 - DNA, 22 bp, Homo sapiens
aaatgcaccttgctgtgagact

SEQ ID NO: 7129295 - DNA, 22 bp, Homo sapiens
aaatgcaccttgctgtgagact

SEQ ID NO: 7129296 - DNA, 22 bp, Homo sapiens
aaatgcaccttgctgtgagact

SEQ ID NO: 7129297 - DNA, 22 bp, Homo sapiens
aagcatctctatgtggagagtg

SEQ ID NO: 7129298 - DNA, 22 bp, Homo sapiens
aagcatctctatgtggagagtg

SEQ ID NO: 7129299 - DNA, 22 bp, Homo sapiens
aagcatctcctcatcatttggg

SEQ ID NO: 7129300 - DNA, 20 bp, Homo sapiens
aagcatctggatgtagcaat

SEQ ID NO: 7129301 - DNA, 22 bp, Homo sapiens
aagcatctatattccactgtga

SEQ ID NO: 7129302 - DNA, 22 bp, Homo sapiens
aagcatctcacctgcccccacg

SEQ ID NO: 7129303 - DNA, 22 bp, Homo sapiens
aagcatctcattcttgcctgtc

SEQ ID NO: 7129304 - DNA, 22 bp, Homo sapiens
aagcatctcattcttgcctgtc

SEQ ID NO: 7129305 - DNA, 22 bp, Homo sapiens
aagcatcaacctgtatgctgca

SEQ ID NO: 7129306 - DNA, 22 bp, Homo sapiens
aagcatcattcacttccttctg

SEQ ID NO: 7129307 - DNA, 22 bp, Homo sapiens
aagcatcattcacttccttctg

SEQ ID NO: 7129308 - DNA, 22 bp, Homo sapiens
aagcatccggggctccaggtgc

SEQ ID NO: 7129309 - DNA, 22 bp, Homo sapiens
aagcatccgtatctctttttta

SEQ ID NO: 7129310 - DNA, 22 bp, Homo sapiens
aagcatcctatatgtaaactgt

SEQ ID NO: 7129311 - DNA, 21 bp, Homo sapiens
aagcatcctctcaggagctgt

SEQ ID NO: 7129312 - DNA, 22 bp, Homo sapiens
aagcatctaggtgactgacata

SEQ ID NO: 7129313 - DNA, 22 bp, Homo sapiens
aagcatctataggttctaggag

SEQ ID NO: 7129314 - DNA, 22 bp, Homo sapiens
aagcatctgtaaagacccttat

SEQ ID NO: 7129315 - DNA, 20 bp, Homo sapiens
aagcatctggatgtagcaat

SEQ ID NO: 7129316 - DNA, 22 bp, Homo sapiens
aagcatcttaaaaagtatcaga

SEQ ID NO: 7129317 - DNA, 22 bp, Homo sapiens
aagcatcttagacctgagttcc

SEQ ID NO: 7129318 - DNA, 22 bp, Homo sapiens
aagcatcttctatcagttagac

SEQ ID NO: 7129319 - DNA, 22 bp, Homo sapiens
aagcatgcaatctgtgataagg

SEQ ID NO: 7129320 - DNA, 22 bp, Homo sapiens
aagcatgagctttcaaaccaga

SEQ ID NO: 7129321 - DNA, 19 bp, Homo sapiens
aagcatctttgaaactggg

SEQ ID NO: 7129322 - DNA, 23 bp, Homo sapiens
aagcatcttttcctagctccatc

SEQ ID NO: 7129323 - DNA, 20 bp, Homo sapiens
aagcatggtcaaaacttatg

SEQ ID NO: 7129324 - DNA, 19 bp, Homo sapiens
aagcatggtgcctcacctc

SEQ ID NO: 7129325 - DNA, 19 bp, Homo sapiens
aagcatggtgcctcacctc

SEQ ID NO: 7129326 - DNA, 22 bp, Homo sapiens
aaatggcagcccagaggtaagg

SEQ ID NO: 7129327 - DNA, 22 bp, Homo sapiens
aaatggcagcccagaggtaagg

SEQ ID NO: 7129328 - DNA, 22 bp, Homo sapiens
aagcatgcagactacccctagg

SEQ ID NO: 7129329 - DNA, 22 bp, Homo sapiens
aagcatggagcaatagaatgac

SEQ ID NO: 7129330 - DNA, 22 bp, Homo sapiens
aagcatggcctctccgctcccc

SEQ ID NO: 7129331 - DNA, 22 bp, Homo sapiens
aagcatggctgagtgcaatggt

SEQ ID NO: 7129332 - DNA, 22 bp, Homo sapiens
aagcatggctgagtgcaatggt

SEQ ID NO: 7129333 - DNA, 22 bp, Homo sapiens
aagcatggctgttctagctata

SEQ ID NO: 7129334 - DNA, 22 bp, Homo sapiens
aagcatgggaatcccacagggt

SEQ ID NO: 7129335 - DNA, 22 bp, Homo sapiens
aagcatgggaggcctggaggag

SEQ ID NO: 7129336 - DNA, 22 bp, Homo sapiens
aaatgtaagtctttgtttctta

SEQ ID NO: 7129337 - DNA, 22 bp, Homo sapiens
aaatggcaggctctttgctagt

SEQ ID NO: 7129338 - DNA, 22 bp, Homo sapiens
aaatgtacaacatccatatata

SEQ ID NO: 7129339 - DNA, 22 bp, Homo sapiens
aaatgtacactttgcatcttga

SEQ ID NO: 7129340 - DNA, 22 bp, Homo sapiens
aaatgtacgggagtagaattag

SEQ ID NO: 7129341 - DNA, 22 bp, Homo sapiens
aaatgtagacctatagggacct

SEQ ID NO: 7129342 - DNA, 22 bp, Homo sapiens
aaatgtattgcataggatattt

SEQ ID NO: 7129343 - DNA, 22 bp, Homo sapiens
aaatgtatcctacttcctgagt

SEQ ID NO: 7129344 - DNA, 22 bp, Homo sapiens
aaatgtagttgaaaagttaagg

SEQ ID NO: 7129345 - DNA, 22 bp, Homo sapiens
aaatgtagttgaaaagttaagg

SEQ ID NO: 7129346 - DNA, 20 bp, Homo sapiens
aaatgtataggacccttcta

SEQ ID NO: 7129347 - DNA, 22 bp, Homo sapiens
aaatgtattgcataggatattt

SEQ ID NO: 7129348 - DNA, 22 bp, Homo sapiens
aaatgtattgcataggatattt

SEQ ID NO: 7129349 - DNA, 22 bp, Homo sapiens
aaatgtcaaagacgtgtttttg

SEQ ID NO: 7129350 - DNA, 22 bp, Homo sapiens
aagctctttaatagtctaaaaa

SEQ ID NO: 7129351 - DNA, 22 bp, Homo sapiens
aagctcttgttgaatcttgtca

SEQ ID NO: 7129352 - DNA, 22 bp, Homo sapiens
aagctctttccactaaaccact

SEQ ID NO: 7129353 - DNA, 22 bp, Homo sapiens
aagctctttccactaaaccact

SEQ ID NO: 7129354 - DNA, 22 bp, Homo sapiens
aagctcttttacaatcctaggc

SEQ ID NO: 7129355 - DNA, 22 bp, Homo sapiens
aagctcttttcaccattaaagt

SEQ ID NO: 7129356 - DNA, 20 bp, Homo sapiens
acaaagactggaaaagcaag

SEQ ID NO: 7129357 - DNA, 20 bp, Homo sapiens
acaaagactggaaaagcaag

SEQ ID NO: 7129358 - DNA, 20 bp, Homo sapiens
acaaagactggaaaagcaag

SEQ ID NO: 7129359 - DNA, 20 bp, Homo sapiens
acaaagactggaaaagcaag

SEQ ID NO: 7129360 - DNA, 20 bp, Homo sapiens
acaaagactggaaaagcaag

SEQ ID NO: 7129361 - DNA, 22 bp, Homo sapiens
acaaagagaccatgagccaaac

SEQ ID NO: 7129362 - DNA, 22 bp, Homo sapiens
acaaagagggaccagtgacttg

SEQ ID NO: 7129363 - DNA, 22 bp, Homo sapiens
acaaagagggaccagtgacttg

SEQ ID NO: 7129364 - DNA, 22 bp, Homo sapiens
acaaagagggaccagtgacttg

SEQ ID NO: 7129365 - DNA, 22 bp, Homo sapiens
acaaagagggaccagtgacttg

SEQ ID NO: 7129366 - DNA, 22 bp, Homo sapiens
aagacattactggaatctgact

SEQ ID NO: 7129367 - DNA, 22 bp, Homo sapiens
aagacattactggaatctgact

SEQ ID NO: 7129368 - DNA, 22 bp, Homo sapiens
aagacatacagacagtgagcca

SEQ ID NO: 7129369 - DNA, 22 bp, Homo sapiens
aagacatatagttctccccaag

SEQ ID NO: 7129370 - DNA, 22 bp, Homo sapiens
aagacatcagtgatgacatttg

SEQ ID NO: 7129371 - DNA, 20 bp, Homo sapiens
aagagaggaagttatactag

SEQ ID NO: 7129372 - DNA, 22 bp, Homo sapiens
aagagagaacacagcttgggca

SEQ ID NO: 7129373 - DNA, 22 bp, Homo sapiens
aagagagaacacagcttgggca

SEQ ID NO: 7129374 - DNA, 22 bp, Homo sapiens
aagagagaacacagcttgggca

SEQ ID NO: 7129375 - DNA, 22 bp, Homo sapiens
acaaagccagattctggagcac

SEQ ID NO: 7129376 - DNA, 22 bp, Homo sapiens
acaaagccagattctggagcac

SEQ ID NO: 7129377 - DNA, 22 bp, Homo sapiens
acaaagattcatttgcattatt

SEQ ID NO: 7129378 - DNA, 22 bp, Homo sapiens
acaaagattcatttgcattatt

SEQ ID NO: 7129379 - DNA, 22 bp, Homo sapiens
acaaagatgtttaaagcattta

SEQ ID NO: 7129380 - DNA, 22 bp, Homo sapiens
acaaagatgtttaaagcattta

SEQ ID NO: 7129381 - DNA, 22 bp, Homo sapiens
acaaagataagtcagaaagtca

SEQ ID NO: 7129382 - DNA, 22 bp, Homo sapiens
acaaagatcttgctttcctact

SEQ ID NO: 7129383 - DNA, 22 bp, Homo sapiens
aagagattggttataagagatt

SEQ ID NO: 7129384 - DNA, 22 bp, Homo sapiens
aagagattgtcagagatatgcc

SEQ ID NO: 7129385 - DNA, 22 bp, Homo sapiens
acaaggagaagaaattggtcat

SEQ ID NO: 7129386 - DNA, 22 bp, Homo sapiens
acaaggagagcacacatgggga

SEQ ID NO: 7129387 - DNA, 22 bp, Homo sapiens
aagagatgatggcagccagagg

SEQ ID NO: 7129388 - DNA, 22 bp, Homo sapiens
aagagatgctttacatcggatg

SEQ ID NO: 7129389 - DNA, 22 bp, Homo sapiens
aagagatgtggaatcatttaca

SEQ ID NO: 7129390 - DNA, 22 bp, Homo sapiens
aagagatgtggaatcatttaca

SEQ ID NO: 7129391 - DNA, 22 bp, Homo sapiens
aagagattaaagtaacttgcct

SEQ ID NO: 7129392 - DNA, 22 bp, Homo sapiens
aagagattcctcactcagaatg

SEQ ID NO: 7129393 - DNA, 22 bp, Homo sapiens
aagagattggttataagagatt

SEQ ID NO: 7129394 - DNA, 20 bp, Homo sapiens
aagagaggaagttatactag

SEQ ID NO: 7129395 - DNA, 22 bp, Homo sapiens
aagagaggacatggtgaacctg

SEQ ID NO: 7129396 - DNA, 22 bp, Homo sapiens
aagagaggacatggtgaacctg

SEQ ID NO: 7129397 - DNA, 17 bp, Homo sapiens
aagagaggctgagctgg

SEQ ID NO: 7129398 - DNA, 17 bp, Homo sapiens
aagagaggctgagctgg

SEQ ID NO: 7129399 - DNA, 17 bp, Homo sapiens
aagagaggctgagctgg

SEQ ID NO: 7129400 - DNA, 17 bp, Homo sapiens
aagagaggctgagctgg

SEQ ID NO: 7129401 - DNA, 22 bp, Homo sapiens
aagagagggacttattaaagtc

SEQ ID NO: 7129402 - DNA, 22 bp, Homo sapiens
aagagagggacttattaaagtc

SEQ ID NO: 7129403 - DNA, 22 bp, Homo sapiens
aagagagggacttattaaagtc

SEQ ID NO: 7129404 - DNA, 22 bp, Homo sapiens
aagagagggatttggtttattg

SEQ ID NO: 7129405 - DNA, 22 bp, Homo sapiens
aagagaggggttgcatggaaat

SEQ ID NO: 7129406 - DNA, 22 bp, Homo sapiens
aagagaggggttgcatggaaat

SEQ ID NO: 7129407 - DNA, 22 bp, Homo sapiens
aagagaggggttgcatggaaat

SEQ ID NO: 7129408 - DNA, 22 bp, Homo sapiens
aagagaggggttgcatggaaat

SEQ ID NO: 7129409 - DNA, 22 bp, Homo sapiens
aagagaggggttgcatggaaat

SEQ ID NO: 7129410 - DNA, 22 bp, Homo sapiens
aagagaggggttgcatggaaat

SEQ ID NO: 7129411 - DNA, 22 bp, Homo sapiens
aagagagtcagtctgagcacca

SEQ ID NO: 7129412 - DNA, 22 bp, Homo sapiens
aagagagtcagtctgagcacca

SEQ ID NO: 7129413 - DNA, 22 bp, Homo sapiens
aagagctgtgggtggtagtcct

SEQ ID NO: 7129414 - DNA, 22 bp, Homo sapiens
aagagctgtatgccatatgatt

SEQ ID NO: 7129415 - DNA, 22 bp, Homo sapiens
aagagctgtatgccatatgatt

SEQ ID NO: 7129416 - DNA, 22 bp, Homo sapiens
aagagctggctcttgcagcagc

SEQ ID NO: 7129417 - DNA, 22 bp, Homo sapiens
aagagctggcccaatctgagca

SEQ ID NO: 7129418 - DNA, 22 bp, Homo sapiens
aagagctggctcttgcagcagc

SEQ ID NO: 7129419 - DNA, 22 bp, Homo sapiens
aagagctgtgggtggtagtcct

SEQ ID NO: 7129420 - DNA, 22 bp, Homo sapiens
aagagctgttgtctgcttactg

SEQ ID NO: 7129421 - DNA, 22 bp, Homo sapiens
aagaggaactgggggctgagtc

SEQ ID NO: 7129422 - DNA, 22 bp, Homo sapiens
aagagctggagtttgcagccct

SEQ ID NO: 7129423 - DNA, 22 bp, Homo sapiens
aagagctggagctgctacagga

SEQ ID NO: 7129424 - DNA, 22 bp, Homo sapiens
aagagctggagtttgcagccct

SEQ ID NO: 7129425 - DNA, 22 bp, Homo sapiens
aagagctgcccaaggtgaacag

SEQ ID NO: 7129426 - DNA, 22 bp, Homo sapiens
aagagctggagctgctacagga

SEQ ID NO: 7129427 - DNA, 22 bp, Homo sapiens
aagagctggagctgctacagga

SEQ ID NO: 7129428 - DNA, 21 bp, Homo sapiens
aagagctggatcaaggataag

SEQ ID NO: 7129429 - DNA, 22 bp, Homo sapiens
aagagctggatggaatctggga

SEQ ID NO: 7129430 - DNA, 22 bp, Homo sapiens
aagagctggatggaatctggga

SEQ ID NO: 7129431 - DNA, 22 bp, Homo sapiens
aagagctggattgtgctgcaga

SEQ ID NO: 7129432 - DNA, 22 bp, Homo sapiens
aagagctggattgtgctgcaga

SEQ ID NO: 7129433 - DNA, 22 bp, Homo sapiens
aagagctggattgtgctgcaga

SEQ ID NO: 7129434 - DNA, 20 bp, Homo sapiens
aagagctgactcacagtggt

SEQ ID NO: 7129435 - DNA, 22 bp, Homo sapiens
aagagctcttcataaaggcata

SEQ ID NO: 7129436 - DNA, 21 bp, Homo sapiens
aagagctcttttgttatggtc

SEQ ID NO: 7129437 - DNA, 20 bp, Homo sapiens
aagagctgactcacagtggt

SEQ ID NO: 7129438 - DNA, 22 bp, Homo sapiens
aagagctccaggcaatgcggtc

SEQ ID NO: 7129439 - DNA, 19 bp, Homo sapiens
aagagcagggaaagaattg

SEQ ID NO: 7129440 - DNA, 22 bp, Homo sapiens
aagagcagtgttttactcagct

SEQ ID NO: 7129441 - DNA, 22 bp, Homo sapiens
aagagctgattaagtcatgagg

SEQ ID NO: 7129442 - DNA, 22 bp, Homo sapiens
aagagctgattaagtcatgagg

SEQ ID NO: 7129443 - DNA, 22 bp, Homo sapiens
aagagctgattaagtcatgagg

SEQ ID NO: 7129444 - DNA, 22 bp, Homo sapiens
aagagctgattaagtcatgagg

SEQ ID NO: 7129445 - DNA, 22 bp, Homo sapiens
aagagctgcacatatttatatc

SEQ ID NO: 7129446 - DNA, 22 bp, Homo sapiens
aagagctgcatctaagccatga

SEQ ID NO: 7129447 - DNA, 22 bp, Homo sapiens
acaaggctgtggggagaactga

SEQ ID NO: 7129448 - DNA, 19 bp, Homo sapiens
acaaggctgggagagcgcc

SEQ ID NO: 7129449 - DNA, 22 bp, Homo sapiens
acaaggctgaacagtgaagccg

SEQ ID NO: 7129450 - DNA, 22 bp, Homo sapiens
acaaggctgaacagtgaagccg

SEQ ID NO: 7129451 - DNA, 23 bp, Homo sapiens
acaaggctctgttctgcagtttc

SEQ ID NO: 7129452 - DNA, 22 bp, Homo sapiens
acaaggctaatttggaagatac

SEQ ID NO: 7129453 - DNA, 22 bp, Homo sapiens
acaaggctctaatttcattgaa

SEQ ID NO: 7129454 - DNA, 22 bp, Homo sapiens
acaaggctctggagaagcagaa

SEQ ID NO: 7129455 - DNA, 22 bp, Homo sapiens
acaaggcaattcctggtgaatt

SEQ ID NO: 7129456 - DNA, 22 bp, Homo sapiens
acaaggcactttatgaagagga

SEQ ID NO: 7129457 - DNA, 23 bp, Homo sapiens
acaaggcaacatagatcagggca

SEQ ID NO: 7129458 - DNA, 23 bp, Homo sapiens
acaaggcaacatagatcagggca

SEQ ID NO: 7129459 - DNA, 22 bp, Homo sapiens
acaaggcagtacaatgatgaca

SEQ ID NO: 7129460 - DNA, 22 bp, Homo sapiens
acaaggcagtacaatgatgaca

SEQ ID NO: 7129461 - DNA, 22 bp, Homo sapiens
acaaggcattccggaagtaacc

SEQ ID NO: 7129462 - DNA, 22 bp, Homo sapiens
acaaggccaagcattctagcaa

SEQ ID NO: 7129463 - DNA, 22 bp, Homo sapiens
aacttcattcctttttatgact

SEQ ID NO: 7129464 - DNA, 22 bp, Homo sapiens
aagaaagcattagacaggcatt

SEQ ID NO: 7129465 - DNA, 22 bp, Homo sapiens
aagaaagcattagacaggcatt

SEQ ID NO: 7129466 - DNA, 22 bp, Homo sapiens
aacttcatgtaatttaaaacag

SEQ ID NO: 7129467 - DNA, 22 bp, Homo sapiens
aacttcatgggttcaaagctgg

SEQ ID NO: 7129468 - DNA, 22 bp, Homo sapiens
aacttcagggggcacattcaag

SEQ ID NO: 7129469 - DNA, 22 bp, Homo sapiens
aacttcagggggcacattcaag

SEQ ID NO: 7129470 - DNA, 22 bp, Homo sapiens
aacttcagttgagaaaggcatg

SEQ ID NO: 7129471 - DNA, 22 bp, Homo sapiens
aacttcagttgagaaaggcatg

SEQ ID NO: 7129472 - DNA, 22 bp, Homo sapiens
aacttcagagctgtgtggtttg

SEQ ID NO: 7129473 - DNA, 22 bp, Homo sapiens
aacttcagagctgtgtggtttg

SEQ ID NO: 7129474 - DNA, 22 bp, Homo sapiens
aacttattgaacattctcgaat

SEQ ID NO: 7129475 - DNA, 22 bp, Homo sapiens
aacttattgaacattctcgaat

SEQ ID NO: 7129476 - DNA, 22 bp, Homo sapiens
aacttagtttagggtattgatt

SEQ ID NO: 7129477 - DNA, 22 bp, Homo sapiens
aacttatacccagggcagaaat

SEQ ID NO: 7129478 - DNA, 22 bp, Homo sapiens
aacttatacccagggcagaaat

SEQ ID NO: 7129479 - DNA, 22 bp, Homo sapiens
aacttatcagactgatgtatgg

SEQ ID NO: 7129480 - DNA, 22 bp, Homo sapiens
aagaaatcatatcatttcttgg

SEQ ID NO: 7129481 - DNA, 22 bp, Homo sapiens
aagaaatgcacacaactgctgg

SEQ ID NO: 7129482 - DNA, 22 bp, Homo sapiens
aagaaatgcacacaactgctgg

SEQ ID NO: 7129483 - DNA, 22 bp, Homo sapiens
aagaaatattgggccttataaa

SEQ ID NO: 7129484 - DNA, 22 bp, Homo sapiens
aagaaatattgggccttataaa

SEQ ID NO: 7129485 - DNA, 22 bp, Homo sapiens
aagaaatattgggccttataaa

SEQ ID NO: 7129486 - DNA, 22 bp, Homo sapiens
aagaaatattgggccttataaa

SEQ ID NO: 7129487 - DNA, 22 bp, Homo sapiens
aagaaatacatggtttttgagt

SEQ ID NO: 7129488 - DNA, 22 bp, Homo sapiens
aagaaatacatggtttttgagt

SEQ ID NO: 7129489 - DNA, 22 bp, Homo sapiens
aagaaatacatggtttttgagt

SEQ ID NO: 7129490 - DNA, 22 bp, Homo sapiens
aagaaatacatggtttttgagt

SEQ ID NO: 7129491 - DNA, 22 bp, Homo sapiens
aagaaatacatggtttttgagt

SEQ ID NO: 7129492 - DNA, 22 bp, Homo sapiens
aagaaagcattagacaggcatt

SEQ ID NO: 7129493 - DNA, 22 bp, Homo sapiens
aagaaagcattagacaggcatt

SEQ ID NO: 7129494 - DNA, 22 bp, Homo sapiens
aagaaagcattagacaggcatt

SEQ ID NO: 7129495 - DNA, 22 bp, Homo sapiens
aatgttttagattactgctggg

SEQ ID NO: 7129496 - DNA, 22 bp, Homo sapiens
aatgttttacagatcccattag

SEQ ID NO: 7129497 - DNA, 22 bp, Homo sapiens
aatgttttagattactgctggg

SEQ ID NO: 7129498 - DNA, 22 bp, Homo sapiens
aatgttttagattactgctggg

SEQ ID NO: 7129499 - DNA, 22 bp, Homo sapiens
aatgttttagattactgctggg

SEQ ID NO: 7129500 - DNA, 22 bp, Homo sapiens
aatgttttatagctcaagcaat

SEQ ID NO: 7129501 - DNA, 22 bp, Homo sapiens
aatgttttatagctcaagcaat

SEQ ID NO: 7129502 - DNA, 22 bp, Homo sapiens
aatgttttatagctcaagcaat

SEQ ID NO: 7129503 - DNA, 22 bp, Homo sapiens
aagaaatggcttcatctgagta

SEQ ID NO: 7129504 - DNA, 22 bp, Homo sapiens
aatgttttaaaagagattgaga

SEQ ID NO: 7129505 - DNA, 22 bp, Homo sapiens
aatgttttacagatcccattag

SEQ ID NO: 7129506 - DNA, 22 bp, Homo sapiens
aatgttttacagatcccattag

SEQ ID NO: 7129507 - DNA, 22 bp, Homo sapiens
aatgttttacagatcccattag

SEQ ID NO: 7129508 - DNA, 22 bp, Homo sapiens
aatgttttacagatcccattag

SEQ ID NO: 7129509 - DNA, 22 bp, Homo sapiens
aatgttttacagatcccattag

SEQ ID NO: 7129510 - DNA, 22 bp, Homo sapiens
aagaaatggaagatccatggtg

SEQ ID NO: 7129511 - DNA, 22 bp, Homo sapiens
aagaaatggaagatccatggtg

SEQ ID NO: 7129512 - DNA, 22 bp, Homo sapiens
aagaaatggcttcatctgagta

SEQ ID NO: 7129513 - DNA, 22 bp, Homo sapiens
aagaaatgcagaaatgtgctgg

SEQ ID NO: 7129514 - DNA, 22 bp, Homo sapiens
aagaaatgctgatgttggatgg

SEQ ID NO: 7129515 - DNA, 22 bp, Homo sapiens
aagaaatgctgatgttggatgg

SEQ ID NO: 7129516 - DNA, 22 bp, Homo sapiens
aagaaatgctgatgttggatgg

SEQ ID NO: 7129517 - DNA, 22 bp, Homo sapiens
aagaaatgctgatgttggatgg

SEQ ID NO: 7129518 - DNA, 22 bp, Homo sapiens
aagaaatgctgatgttggatgg

SEQ ID NO: 7129519 - DNA, 22 bp, Homo sapiens
aagaaatgcacacaactgctgg

SEQ ID NO: 7129520 - DNA, 22 bp, Homo sapiens
aagaaatgcacacaactgctgg

SEQ ID NO: 7129521 - DNA, 22 bp, Homo sapiens
aagaaatgcagaaatgtgctgg

SEQ ID NO: 7129522 - DNA, 22 bp, Homo sapiens
aagaaatgcagaaatgtgctgg

SEQ ID NO: 7129523 - DNA, 22 bp, Homo sapiens
aagaaatgcagaaatgtgctgg

SEQ ID NO: 7129524 - DNA, 22 bp, Homo sapiens
aatgttttcccagtgcagacga

SEQ ID NO: 7129525 - DNA, 22 bp, Homo sapiens
aatgttttcccagtgcagacga

SEQ ID NO: 7129526 - DNA, 22 bp, Homo sapiens
aatgttttcccagtgcagacga

SEQ ID NO: 7129527 - DNA, 22 bp, Homo sapiens
aatgttttcattatcctaactg

SEQ ID NO: 7129528 - DNA, 22 bp, Homo sapiens
aatgttttcccagtgcagacga

SEQ ID NO: 7129529 - DNA, 22 bp, Homo sapiens
aatgttttcccagtgcagacga

SEQ ID NO: 7129530 - DNA, 22 bp, Homo sapiens
aatgttttcccagtgcagacga

SEQ ID NO: 7129531 - DNA, 22 bp, Homo sapiens
aatgttttctctgtgaacacat

SEQ ID NO: 7129532 - DNA, 22 bp, Homo sapiens
aatgttttctctgtgaacacat

SEQ ID NO: 7129533 - DNA, 22 bp, Homo sapiens
aatgttttctctgtgaacacat

SEQ ID NO: 7129534 - DNA, 22 bp, Homo sapiens
aatgttttcattatcctaactg

SEQ ID NO: 7129535 - DNA, 22 bp, Homo sapiens
aatgttttcattatcctaactg

SEQ ID NO: 7129536 - DNA, 22 bp, Homo sapiens
aatgttttcattatcctaactg

SEQ ID NO: 7129537 - DNA, 22 bp, Homo sapiens
aatgttttcattatcctaactg

SEQ ID NO: 7129538 - DNA, 22 bp, Homo sapiens
aatgttttatagctcaagcaat

SEQ ID NO: 7129539 - DNA, 22 bp, Homo sapiens
aatgttttatagctcaagcaat

SEQ ID NO: 7129540 - DNA, 22 bp, Homo sapiens
aatgttttatagctcaagcaat

SEQ ID NO: 7129541 - DNA, 22 bp, Homo sapiens
aatgttttctgactgctaactt

SEQ ID NO: 7129542 - DNA, 22 bp, Homo sapiens
aatgttttctgactgctaactt

SEQ ID NO: 7129543 - DNA, 22 bp, Homo sapiens
aatgttttctgactgctaactt

SEQ ID NO: 7129544 - DNA, 22 bp, Homo sapiens
aatgttttctgactgctaactt

SEQ ID NO: 7129545 - DNA, 22 bp, Homo sapiens
aatgttttctgactgctaactt

SEQ ID NO: 7129546 - DNA, 22 bp, Homo sapiens
aatgttttctgactgctaactt

SEQ ID NO: 7129547 - DNA, 22 bp, Homo sapiens
aatgttttctgactgctaactt

SEQ ID NO: 7129548 - DNA, 22 bp, Homo sapiens
aatgttttgcattagttttcta

SEQ ID NO: 7129549 - DNA, 22 bp, Homo sapiens
aatgttttgcattagttttcta

SEQ ID NO: 7129550 - DNA, 22 bp, Homo sapiens
aatgttttgcattagttttcta

SEQ ID NO: 7129551 - DNA, 22 bp, Homo sapiens
aagaagcactttcctacatgtt

SEQ ID NO: 7129552 - DNA, 22 bp, Homo sapiens
aagaataaattaagatacttag

SEQ ID NO: 7129553 - DNA, 23 bp, Homo sapiens
aagaataaatgacattaaaggtg

SEQ ID NO: 7129554 - DNA, 23 bp, Homo sapiens
aagaataaatgacattaaaggtg

SEQ ID NO: 7129555 - DNA, 23 bp, Homo sapiens
aagaataaatgacattaaaggtg

SEQ ID NO: 7129556 - DNA, 23 bp, Homo sapiens
aagaataaatgacattaaaggtg

SEQ ID NO: 7129557 - DNA, 23 bp, Homo sapiens
aagaataaatgacattaaaggtg

SEQ ID NO: 7129558 - DNA, 18 bp, Homo sapiens
aagaagttggccaaagag

SEQ ID NO: 7129559 - DNA, 22 bp, Homo sapiens
aagaataaattaagatacttag

SEQ ID NO: 7129560 - DNA, 22 bp, Homo sapiens
aagaataaattaagatacttag

SEQ ID NO: 7129561 - DNA, 22 bp, Homo sapiens
aagaataaattaagatacttag

SEQ ID NO: 7129562 - DNA, 22 bp, Homo sapiens
aagaataaattaagatacttag

SEQ ID NO: 7129563 - DNA, 22 bp, Homo sapiens
aagaataacacttaggttttgc

SEQ ID NO: 7129564 - DNA, 22 bp, Homo sapiens
aagaataacacttaggttttgc

SEQ ID NO: 7129565 - DNA, 22 bp, Homo sapiens
aagaataacacttaggttttgc

SEQ ID NO: 7129566 - DNA, 22 bp, Homo sapiens
aagaataagaggatttagaaca

SEQ ID NO: 7129567 - DNA, 22 bp, Homo sapiens
aagaataagaggatttagaaca

SEQ ID NO: 7129568 - DNA, 22 bp, Homo sapiens
aagaataagaggatttagaaca

SEQ ID NO: 7129569 - DNA, 22 bp, Homo sapiens
aagaataagaggatttagaaca

SEQ ID NO: 7129570 - DNA, 22 bp, Homo sapiens
aagaataagaggatttagaaca

SEQ ID NO: 7129571 - DNA, 22 bp, Homo sapiens
aagaatacgtatcaacaatggt

SEQ ID NO: 7129572 - DNA, 22 bp, Homo sapiens
aagaatacgtatcaacaatggt

SEQ ID NO: 7129573 - DNA, 22 bp, Homo sapiens
aagaatacgtatcaacaatggt

SEQ ID NO: 7129574 - DNA, 22 bp, Homo sapiens
aagaataagtagatgggagaag

SEQ ID NO: 7129575 - DNA, 22 bp, Homo sapiens
aagaatacgtatcaacaatggt

SEQ ID NO: 7129576 - DNA, 22 bp, Homo sapiens
aagaataagtagatgggagaag

SEQ ID NO: 7129577 - DNA, 22 bp, Homo sapiens
aagaataagtagatgggagaag

SEQ ID NO: 7129578 - DNA, 22 bp, Homo sapiens
aagaataagaggatttagaaca

SEQ ID NO: 7129579 - DNA, 22 bp, Homo sapiens
aagaataagaggatttagaaca

SEQ ID NO: 7129580 - DNA, 22 bp, Homo sapiens
aagaatatagattttttgaagt

SEQ ID NO: 7129581 - DNA, 22 bp, Homo sapiens
aagaatacttcgtaagtaggat

SEQ ID NO: 7129582 - DNA, 22 bp, Homo sapiens
aattggcagtttcatcagacag

SEQ ID NO: 7129583 - DNA, 22 bp, Homo sapiens
aattggctatattatttagcct

SEQ ID NO: 7129584 - DNA, 22 bp, Homo sapiens
aattggctttgagaagtttgag

SEQ ID NO: 7129585 - DNA, 22 bp, Homo sapiens
aattggctttgtggtttctgca

SEQ ID NO: 7129586 - DNA, 22 bp, Homo sapiens
aattgggagagttagcaatgct

SEQ ID NO: 7129587 - DNA, 22 bp, Homo sapiens
aattgggcactttcttcttgca

SEQ ID NO: 7129588 - DNA, 22 bp, Homo sapiens
aattgggctatagggaggagcc

SEQ ID NO: 7129589 - DNA, 22 bp, Homo sapiens
aattggttattctgtccttttt

SEQ ID NO: 7129590 - DNA, 22 bp, Homo sapiens
aagacagcattttaccccaaca

SEQ ID NO: 7129591 - DNA, 22 bp, Homo sapiens
aagacagccagctccatgggat

SEQ ID NO: 7129592 - DNA, 22 bp, Homo sapiens
aagacagcctttccctggtgcc

SEQ ID NO: 7129593 - DNA, 20 bp, Homo sapiens
aagacaccagtggcagcccc

SEQ ID NO: 7129594 - DNA, 22 bp, Homo sapiens
aagacactaagctttcaggata

SEQ ID NO: 7129595 - DNA, 22 bp, Homo sapiens
aagacagcactggcattttcaa

SEQ ID NO: 7129596 - DNA, 22 bp, Homo sapiens
aatttaactgagagtactttta

SEQ ID NO: 7129597 - DNA, 22 bp, Homo sapiens
aagacaggaacatagcaaatcc

SEQ ID NO: 7129598 - DNA, 22 bp, Homo sapiens
aagacaggaaaagctccaggcc

SEQ ID NO: 7129599 - DNA, 22 bp, Homo sapiens
aagacagtgacagtcacaattg

SEQ ID NO: 7129600 - DNA, 22 bp, Homo sapiens
aagacaggaaaagctccaggcc

SEQ ID NO: 7129601 - DNA, 22 bp, Homo sapiens
aagacagctcaggacagattca

SEQ ID NO: 7129602 - DNA, 22 bp, Homo sapiens
aagacaggaaaagctccaggcc

SEQ ID NO: 7129603 - DNA, 22 bp, Homo sapiens
aagacaggaaaagctccaggcc

SEQ ID NO: 7129604 - DNA, 22 bp, Homo sapiens
aagacaggaacatagcaaatcc

SEQ ID NO: 7129605 - DNA, 22 bp, Homo sapiens
aagacaggaaaagctccaggcc

SEQ ID NO: 7129606 - DNA, 22 bp, Homo sapiens
aagacaggaaaagctccaggcc

SEQ ID NO: 7129607 - DNA, 17 bp, Homo sapiens
aattgtcagcagtagct

SEQ ID NO: 7129608 - DNA, 22 bp, Homo sapiens
aattgtcttgaaagcaacactt

SEQ ID NO: 7129609 - DNA, 22 bp, Homo sapiens
aattgtctttatcacagttcaa

SEQ ID NO: 7129610 - DNA, 22 bp, Homo sapiens
aattgtctttatcacagttcaa

SEQ ID NO: 7129611 - DNA, 22 bp, Homo sapiens
aattgtgaacctttacagttgt

SEQ ID NO: 7129612 - DNA, 22 bp, Homo sapiens
aattgtgatgacagctggtggt

SEQ ID NO: 7129613 - DNA, 22 bp, Homo sapiens
aattgtgcatttttaaatcacg

SEQ ID NO: 7129614 - DNA, 22 bp, Homo sapiens
aattgtgctatgattatgaaag

SEQ ID NO: 7129615 - DNA, 22 bp, Homo sapiens
aattgtgcccgtgacatttcat

SEQ ID NO: 7129616 - DNA, 22 bp, Homo sapiens
aattgtgctatgattatgaaag

SEQ ID NO: 7129617 - DNA, 21 bp, Homo sapiens
aattgtgctattctgctttta

SEQ ID NO: 7129618 - DNA, 22 bp, Homo sapiens
aattgtgctgctataggattaa

SEQ ID NO: 7129619 - DNA, 22 bp, Homo sapiens
aattgtgctgtaggctcgttaa

SEQ ID NO: 7129620 - DNA, 22 bp, Homo sapiens
aattgtgctgtgatcaattact

SEQ ID NO: 7129621 - DNA, 20 bp, Homo sapiens
aattgttgactccccagaga

SEQ ID NO: 7129622 - DNA, 23 bp, Homo sapiens
aattgtgcttcccaggggctatt

SEQ ID NO: 7129623 - DNA, 22 bp, Homo sapiens
aattgttgagcataaattatcg

SEQ ID NO: 7129624 - DNA, 22 bp, Homo sapiens
aattgttgggccctaccccaga

SEQ ID NO: 7129625 - DNA, 22 bp, Homo sapiens
aattgttgggtattcctgtgac

SEQ ID NO: 7129626 - DNA, 22 bp, Homo sapiens
aattgttgtacagaataaatga

SEQ ID NO: 7129627 - DNA, 22 bp, Homo sapiens
aatttaactgagagtactttta

SEQ ID NO: 7129628 - DNA, 22 bp, Homo sapiens
acagaattaggagatcctcttg

SEQ ID NO: 7129629 - DNA, 22 bp, Homo sapiens
acagaattaggagatcctcttg

SEQ ID NO: 7129630 - DNA, 22 bp, Homo sapiens
acagaattatcaggaaatgtta

SEQ ID NO: 7129631 - DNA, 22 bp, Homo sapiens
aagcacagtgggcagagcagcc

SEQ ID NO: 7129632 - DNA, 22 bp, Homo sapiens
aagcacagtgggcagagcagcc

SEQ ID NO: 7129633 - DNA, 22 bp, Homo sapiens
aagcacagtgggcagagcagcc

SEQ ID NO: 7129634 - DNA, 22 bp, Homo sapiens
aagcacaggttgaggattattc

SEQ ID NO: 7129635 - DNA, 22 bp, Homo sapiens
aagcacagtaaaagcagatttt

SEQ ID NO: 7129636 - DNA, 22 bp, Homo sapiens
aagcacagtaaaagcagatttt

SEQ ID NO: 7129637 - DNA, 22 bp, Homo sapiens
aagcacagtgccaagttctatt

SEQ ID NO: 7129638 - DNA, 22 bp, Homo sapiens
aagcacagtgccaagttctatt

SEQ ID NO: 7129639 - DNA, 22 bp, Homo sapiens
aagcacagggactcaggaccgg

SEQ ID NO: 7129640 - DNA, 22 bp, Homo sapiens
aagcacagggactttaggaata

SEQ ID NO: 7129641 - DNA, 22 bp, Homo sapiens
aagcacagggactttaggaata

SEQ ID NO: 7129642 - DNA, 22 bp, Homo sapiens
aagcacagggactttaggaata

SEQ ID NO: 7129643 - DNA, 22 bp, Homo sapiens
aagcacagggactttaggaata

SEQ ID NO: 7129644 - DNA, 22 bp, Homo sapiens
aagcacaggggaaataagttgt

SEQ ID NO: 7129645 - DNA, 22 bp, Homo sapiens
aagcacaggggaaataagttgt

SEQ ID NO: 7129646 - DNA, 22 bp, Homo sapiens
aagcacaggggaaataagttgt

SEQ ID NO: 7129647 - DNA, 22 bp, Homo sapiens
aagcacagggtgtctgcattca

SEQ ID NO: 7129648 - DNA, 22 bp, Homo sapiens
aagcacagggtgtctgcattca

SEQ ID NO: 7129649 - DNA, 22 bp, Homo sapiens
aagcacagggtgtctgcattca

SEQ ID NO: 7129650 - DNA, 18 bp, Homo sapiens
aagcacaggtgtttcagg

SEQ ID NO: 7129651 - DNA, 18 bp, Homo sapiens
aagcacaggtgtttcagg

SEQ ID NO: 7129652 - DNA, 18 bp, Homo sapiens
aagcacaggtgtttcagg

SEQ ID NO: 7129653 - DNA, 18 bp, Homo sapiens
aagcacaggtgtttcagg

SEQ ID NO: 7129654 - DNA, 22 bp, Homo sapiens
aagcacaggttgaggattattc

SEQ ID NO: 7129655 - DNA, 22 bp, Homo sapiens
aagcacaggttgaggattattc

SEQ ID NO: 7129656 - DNA, 22 bp, Homo sapiens
acactgggcttgttacgttgca

SEQ ID NO: 7129657 - DNA, 22 bp, Homo sapiens
acactgggtaacatatctgtta

SEQ ID NO: 7129658 - DNA, 22 bp, Homo sapiens
acactgggcttgttacgttgca

SEQ ID NO: 7129659 - DNA, 22 bp, Homo sapiens
acactgggttacctgtactatt

SEQ ID NO: 7129660 - DNA, 22 bp, Homo sapiens
acactgggttacctgtactatt

SEQ ID NO: 7129661 - DNA, 22 bp, Homo sapiens
aagcacagaaaaggagcatgga

SEQ ID NO: 7129662 - DNA, 22 bp, Homo sapiens
aagcacagaaaaggagcatgga

SEQ ID NO: 7129663 - DNA, 22 bp, Homo sapiens
aagcacagaaaaggagcatgga

SEQ ID NO: 7129664 - DNA, 22 bp, Homo sapiens
aagcacagaaaaggagcatgga

SEQ ID NO: 7129665 - DNA, 22 bp, Homo sapiens
aagcacagaaaaggagcatgga

SEQ ID NO: 7129666 - DNA, 22 bp, Homo sapiens
aagcacaggagacgcacagcca

SEQ ID NO: 7129667 - DNA, 22 bp, Homo sapiens
aagcacaggagacgcacagcca

SEQ ID NO: 7129668 - DNA, 22 bp, Homo sapiens
aagcacaggatcttgaggagcg

SEQ ID NO: 7129669 - DNA, 22 bp, Homo sapiens
aagcacaggatcttgaggagcg

SEQ ID NO: 7129670 - DNA, 22 bp, Homo sapiens
aagcacaggatcttgaggagcg

SEQ ID NO: 7129671 - DNA, 22 bp, Homo sapiens
aagcacaggatcttgaggagcg

SEQ ID NO: 7129672 - DNA, 22 bp, Homo sapiens
aagcacaggagacgcacagcca

SEQ ID NO: 7129673 - DNA, 22 bp, Homo sapiens
aagcacaggagacgcacagcca

SEQ ID NO: 7129674 - DNA, 22 bp, Homo sapiens
aagcacaggatcttgaggagcg

SEQ ID NO: 7129675 - DNA, 22 bp, Homo sapiens
aagcacagggactcaggaccgg

SEQ ID NO: 7129676 - DNA, 22 bp, Homo sapiens
aagcacagggactcaggaccgg

SEQ ID NO: 7129677 - DNA, 22 bp, Homo sapiens
aagcacagggactcaggaccgg

SEQ ID NO: 7129678 - DNA, 22 bp, Homo sapiens
aagcacagggactcaggaccgg

SEQ ID NO: 7129679 - DNA, 22 bp, Homo sapiens
aagcacaggatcttgaggagcg

SEQ ID NO: 7129680 - DNA, 18 bp, Homo sapiens
acactgcagcagtctgct

SEQ ID NO: 7129681 - DNA, 21 bp, Homo sapiens
acactgcaggtgaagtgcact

SEQ ID NO: 7129682 - DNA, 17 bp, Homo sapiens
aagatttcattagctga

SEQ ID NO: 7129683 - DNA, 22 bp, Homo sapiens
aagatttattagatgcttacct

SEQ ID NO: 7129684 - DNA, 22 bp, Homo sapiens
aagatttactttctttgtaata

SEQ ID NO: 7129685 - DNA, 22 bp, Homo sapiens
aagatttactagcataatagct

SEQ ID NO: 7129686 - DNA, 22 bp, Homo sapiens
aagatttactagcataatagct

SEQ ID NO: 7129687 - DNA, 22 bp, Homo sapiens
aagatttactagcataatagct

SEQ ID NO: 7129688 - DNA, 22 bp, Homo sapiens
aagatttactttctttgtaata

SEQ ID NO: 7129689 - DNA, 22 bp, Homo sapiens
aagatttactttctttgtaata

SEQ ID NO: 7129690 - DNA, 21 bp, Homo sapiens
acactgctgtagcatattggg

SEQ ID NO: 7129691 - DNA, 22 bp, Homo sapiens
acactgcttctctggcagagcc

SEQ ID NO: 7129692 - DNA, 22 bp, Homo sapiens
acactgctaaacagtaaagatg

SEQ ID NO: 7129693 - DNA, 22 bp, Homo sapiens
acactgctcacttcttcccttg

SEQ ID NO: 7129694 - DNA, 21 bp, Homo sapiens
acactgctgtagcatattggg

SEQ ID NO: 7129695 - DNA, 22 bp, Homo sapiens
acactgcatttcaacaaggccc

SEQ ID NO: 7129696 - DNA, 22 bp, Homo sapiens
acactgctaaacagtaaagatg

SEQ ID NO: 7129697 - DNA, 22 bp, Homo sapiens
acactggatgaagcaagctaaa

SEQ ID NO: 7129698 - DNA, 19 bp, Homo sapiens
acactgggagaagactgct

SEQ ID NO: 7129699 - DNA, 19 bp, Homo sapiens
acactgggagaagactgct

SEQ ID NO: 7129700 - DNA, 19 bp, Homo sapiens
acactgggagaagactgct

SEQ ID NO: 7129701 - DNA, 22 bp, Homo sapiens
acactggaggagagctgttgct

SEQ ID NO: 7129702 - DNA, 22 bp, Homo sapiens
acactggaggagagctgttgct

SEQ ID NO: 7129703 - DNA, 22 bp, Homo sapiens
acactggagggtccagggatgt

SEQ ID NO: 7129704 - DNA, 22 bp, Homo sapiens
acactggagggtccagggatgt

SEQ ID NO: 7129705 - DNA, 22 bp, Homo sapiens
acactggatgaagcaagctaaa

SEQ ID NO: 7129706 - DNA, 22 bp, Homo sapiens
acactggaaatagggaggtttt

SEQ ID NO: 7129707 - DNA, 22 bp, Homo sapiens
acactggacactgaactccctg

SEQ ID NO: 7129708 - DNA, 22 bp, Homo sapiens
acactggactcagaggccagaa

SEQ ID NO: 7129709 - DNA, 22 bp, Homo sapiens
acactggactcagaggccagaa

SEQ ID NO: 7129710 - DNA, 22 bp, Homo sapiens
acactggagcttctagcccacg

SEQ ID NO: 7129711 - DNA, 22 bp, Homo sapiens
acactggaggagagctgttgct

SEQ ID NO: 7129712 - DNA, 22 bp, Homo sapiens
aagaggccacagctgacagcac

SEQ ID NO: 7129713 - DNA, 22 bp, Homo sapiens
aagaggccacagctgacagcac

SEQ ID NO: 7129714 - DNA, 22 bp, Homo sapiens
aagaggccacagctgacagcac

SEQ ID NO: 7129715 - DNA, 22 bp, Homo sapiens
acacagtagtgtggaaaaacat

SEQ ID NO: 7129716 - DNA, 22 bp, Homo sapiens
acacagtagtttgtcattgcta

SEQ ID NO: 7129717 - DNA, 22 bp, Homo sapiens
acacagtagtttgtcattgcta

SEQ ID NO: 7129718 - DNA, 20 bp, Homo sapiens
acacagtagcaattagtgca

SEQ ID NO: 7129719 - DNA, 20 bp, Homo sapiens
acacagtagcaattagtgca

SEQ ID NO: 7129720 - DNA, 22 bp, Homo sapiens
acacagtaggatagtttgagga

SEQ ID NO: 7129721 - DNA, 22 bp, Homo sapiens
acacagtaggccaccatgtcat

SEQ ID NO: 7129722 - DNA, 22 bp, Homo sapiens
acacagtaggccaccatgtcat

SEQ ID NO: 7129723 - DNA, 22 bp, Homo sapiens
acacagtagtgtggaaaaacat

SEQ ID NO: 7129724 - DNA, 18 bp, Homo sapiens
acacaggttattctctcc

SEQ ID NO: 7129725 - DNA, 18 bp, Homo sapiens
acacaggttattctctcc

SEQ ID NO: 7129726 - DNA, 22 bp, Homo sapiens
acacagtaaatatgtattgaat

SEQ ID NO: 7129727 - DNA, 22 bp, Homo sapiens
acacagtaaatatgtattgaat

SEQ ID NO: 7129728 - DNA, 22 bp, Homo sapiens
acacagtaaatattgtctcctc

SEQ ID NO: 7129729 - DNA, 22 bp, Homo sapiens
acacagtaaatattgtctcctc

SEQ ID NO: 7129730 - DNA, 21 bp, Homo sapiens
acacagtaactgggcgcaggg

SEQ ID NO: 7129731 - DNA, 22 bp, Homo sapiens
acacagtaccccaaggctgggc

SEQ ID NO: 7129732 - DNA, 22 bp, Homo sapiens
acacagtaccccaaggctgggc

SEQ ID NO: 7129733 - DNA, 17 bp, Homo sapiens
acacagtacttttttgc

SEQ ID NO: 7129734 - DNA, 17 bp, Homo sapiens
acacagtacttttttgc

SEQ ID NO: 7129735 - DNA, 20 bp, Homo sapiens
acacagtagatgagtgactg

SEQ ID NO: 7129736 - DNA, 22 bp, Homo sapiens
acacaggaactcaagctcgctt

SEQ ID NO: 7129737 - DNA, 22 bp, Homo sapiens
acacaggaaatggtttagtttt

SEQ ID NO: 7129738 - DNA, 22 bp, Homo sapiens
acacaggaactcaagctcgctt

SEQ ID NO: 7129739 - DNA, 22 bp, Homo sapiens
acacaggaaatggtttagtttt

SEQ ID NO: 7129740 - DNA, 22 bp, Homo sapiens
acacaggaaatggtttagtttt

SEQ ID NO: 7129741 - DNA, 22 bp, Homo sapiens
aagaggaactgggggctgagtc

SEQ ID NO: 7129742 - DNA, 22 bp, Homo sapiens
acacagggctgcgcctgacccc

SEQ ID NO: 7129743 - DNA, 22 bp, Homo sapiens
acacaggggaaagtggagctga

SEQ ID NO: 7129744 - DNA, 22 bp, Homo sapiens
acacaggggaaagtggagctga

SEQ ID NO: 7129745 - DNA, 22 bp, Homo sapiens
acacaggggctcggctgggtgc

SEQ ID NO: 7129746 - DNA, 22 bp, Homo sapiens
acacagggggcattctaggagt

SEQ ID NO: 7129747 - DNA, 22 bp, Homo sapiens
acacagggtctagagttaggcc

SEQ ID NO: 7129748 - DNA, 22 bp, Homo sapiens
acacaggtaatggttttggaag

SEQ ID NO: 7129749 - DNA, 22 bp, Homo sapiens
acacaggtacacatatgtacct

SEQ ID NO: 7129750 - DNA, 22 bp, Homo sapiens
acacaggttaaaataattggga

SEQ ID NO: 7129751 - DNA, 22 bp, Homo sapiens
acacaggttaaaataattggga

SEQ ID NO: 7129752 - DNA, 18 bp, Homo sapiens
acacaggttattctctcc

SEQ ID NO: 7129753 - DNA, 22 bp, Homo sapiens
aagattgacggctttgagtgct

SEQ ID NO: 7129754 - DNA, 22 bp, Homo sapiens
aagattgtcaggcttgctgtat

SEQ ID NO: 7129755 - DNA, 22 bp, Homo sapiens
aagattctttgaggattttact

SEQ ID NO: 7129756 - DNA, 22 bp, Homo sapiens
aagattctttgaggattttact

SEQ ID NO: 7129757 - DNA, 22 bp, Homo sapiens
aagattcttgactagaatgatt

SEQ ID NO: 7129758 - DNA, 22 bp, Homo sapiens
aagatttaccactttattcaag

SEQ ID NO: 7129759 - DNA, 22 bp, Homo sapiens
aagatttactagcataatagct

SEQ ID NO: 7129760 - DNA, 22 bp, Homo sapiens
aagattcttaaatttgtttctc

SEQ ID NO: 7129761 - DNA, 22 bp, Homo sapiens
aagattctgtatttctaacaat

SEQ ID NO: 7129762 - DNA, 22 bp, Homo sapiens
aagatgttgcaagggactcttc

SEQ ID NO: 7129763 - DNA, 22 bp, Homo sapiens
aagatgttgactcctttgatgt

SEQ ID NO: 7129764 - DNA, 22 bp, Homo sapiens
aagatgttctattttcactttt

SEQ ID NO: 7129765 - DNA, 22 bp, Homo sapiens
aagatgttctattttcactttt

SEQ ID NO: 7129766 - DNA, 22 bp, Homo sapiens
aagatgttgactcctttgatgt

SEQ ID NO: 7129767 - DNA, 22 bp, Homo sapiens
aagaggctagccggctcactaa

SEQ ID NO: 7129768 - DNA, 22 bp, Homo sapiens
aagaggcctcacctcactgccc

SEQ ID NO: 7129769 - DNA, 22 bp, Homo sapiens
aagaggcctggaggcagaggtg

SEQ ID NO: 7129770 - DNA, 22 bp, Homo sapiens
aagaggctgaatgagaaagtac

SEQ ID NO: 7129771 - DNA, 22 bp, Homo sapiens
aagaggctagccggctcactaa

SEQ ID NO: 7129772 - DNA, 22 bp, Homo sapiens
aagaggctggaggatactgcgc

SEQ ID NO: 7129773 - DNA, 22 bp, Homo sapiens
aagaggctgaatgagaaagtac

SEQ ID NO: 7129774 - DNA, 22 bp, Homo sapiens
aagaggctgaatgagaaagtac

SEQ ID NO: 7129775 - DNA, 20 bp, Homo sapiens
aagaggctgtggatcctact

SEQ ID NO: 7129776 - DNA, 22 bp, Homo sapiens
aagaggctggcattgatggtag

SEQ ID NO: 7129777 - DNA, 18 bp, Homo sapiens
aagaggctgttctgtggg

SEQ ID NO: 7129778 - DNA, 22 bp, Homo sapiens
aagaggcttcagatccttcaga

SEQ ID NO: 7129779 - DNA, 22 bp, Homo sapiens
aagaggcttatagtcttcctgt

SEQ ID NO: 7129780 - DNA, 22 bp, Homo sapiens
acagagtaggtgctcagtaaat

SEQ ID NO: 7129781 - DNA, 22 bp, Homo sapiens
acagagtaggtgctcagtaaat

SEQ ID NO: 7129782 - DNA, 22 bp, Homo sapiens
acagagtaggtgctcagtaaat

SEQ ID NO: 7129783 - DNA, 22 bp, Homo sapiens
acagagtaggtgctcagtaaat

SEQ ID NO: 7129784 - DNA, 22 bp, Homo sapiens
acagagtaggtgctgtcgactg

SEQ ID NO: 7129785 - DNA, 22 bp, Homo sapiens
acagagtaggtgctgtcgactg

SEQ ID NO: 7129786 - DNA, 21 bp, Homo sapiens
acagagtagttgaaacagaga

SEQ ID NO: 7129787 - DNA, 21 bp, Homo sapiens
acagagtagttgaaacagaga

SEQ ID NO: 7129788 - DNA, 16 bp, Homo sapiens
acagagtatcaagcga

SEQ ID NO: 7129789 - DNA, 22 bp, Homo sapiens
acagagtatctatcaggagtat

SEQ ID NO: 7129790 - DNA, 22 bp, Homo sapiens
acagagtatctatcaggagtat

SEQ ID NO: 7129791 - DNA, 22 bp, Homo sapiens
acagagtattggaaaggcagtg

SEQ ID NO: 7129792 - DNA, 22 bp, Homo sapiens
aagcatagagacacaaatttgg

SEQ ID NO: 7129793 - DNA, 22 bp, Homo sapiens
acagagtaaatccaagaacgct

SEQ ID NO: 7129794 - DNA, 22 bp, Homo sapiens
acagaggtttccattgaggttt

SEQ ID NO: 7129795 - DNA, 22 bp, Homo sapiens
acagagtaaatccaagaacgct

SEQ ID NO: 7129796 - DNA, 22 bp, Homo sapiens
acagagtacagacaaaggtcag

SEQ ID NO: 7129797 - DNA, 22 bp, Homo sapiens
acagagtacagacaaaggtcag

SEQ ID NO: 7129798 - DNA, 23 bp, Homo sapiens
acagagtacagtgtgcttagtgg

SEQ ID NO: 7129799 - DNA, 22 bp, Homo sapiens
acagagtacattcagagactat

SEQ ID NO: 7129800 - DNA, 22 bp, Homo sapiens
acagagtacattcagagactat

SEQ ID NO: 7129801 - DNA, 22 bp, Homo sapiens
acagagtacattcagagactat

SEQ ID NO: 7129802 - DNA, 20 bp, Homo sapiens
acagagtagaacatatgcca

SEQ ID NO: 7129803 - DNA, 20 bp, Homo sapiens
acagagtagaacatatgcca

SEQ ID NO: 7129804 - DNA, 22 bp, Homo sapiens
acagagtagcagcactgtgctt

SEQ ID NO: 7129805 - DNA, 22 bp, Homo sapiens
acagagtagcagcactgtgctt

SEQ ID NO: 7129806 - DNA, 22 bp, Homo sapiens
acagagtagctcaagaagattg

SEQ ID NO: 7129807 - DNA, 22 bp, Homo sapiens
acagagtagctcaagaagattg

SEQ ID NO: 7129808 - DNA, 22 bp, Homo sapiens
acagagtagctcaagaagattg

SEQ ID NO: 7129809 - DNA, 22 bp, Homo sapiens
acagaggttaggatgggttgta

SEQ ID NO: 7129810 - DNA, 22 bp, Homo sapiens
acagaggtgtgtgtaggacagt

SEQ ID NO: 7129811 - DNA, 22 bp, Homo sapiens
acagaggtgttccagacctagg

SEQ ID NO: 7129812 - DNA, 22 bp, Homo sapiens
aagcagctgatttcacagctca

SEQ ID NO: 7129813 - DNA, 22 bp, Homo sapiens
aagcagctgatttcacagctca

SEQ ID NO: 7129814 - DNA, 22 bp, Homo sapiens
aagcagctgatttcacagctca

SEQ ID NO: 7129815 - DNA, 22 bp, Homo sapiens
aagcagcattgtggtaggggag

SEQ ID NO: 7129816 - DNA, 22 bp, Homo sapiens
aagcagcattgtggtaggggag

SEQ ID NO: 7129817 - DNA, 22 bp, Homo sapiens
aagcagccacctcatctccact

SEQ ID NO: 7129818 - DNA, 22 bp, Homo sapiens
aagcagccacctcatctccact

SEQ ID NO: 7129819 - DNA, 22 bp, Homo sapiens
aagcagccagccatcatgcccg

SEQ ID NO: 7129820 - DNA, 22 bp, Homo sapiens
aagcagcctggacttgggctgg

SEQ ID NO: 7129821 - DNA, 22 bp, Homo sapiens
aagcagcctggcatgatgcttt

SEQ ID NO: 7129822 - DNA, 22 bp, Homo sapiens
aagcagctgaaggattcagggt

SEQ ID NO: 7129823 - DNA, 18 bp, Homo sapiens
acagacaaaatggaaatg

SEQ ID NO: 7129824 - DNA, 22 bp, Homo sapiens
acagaatttacacatctctaaa

SEQ ID NO: 7129825 - DNA, 22 bp, Homo sapiens
acagaatttgcttgggcaatgg

SEQ ID NO: 7129826 - DNA, 22 bp, Homo sapiens
acagaatttttacacagggtaa

SEQ ID NO: 7129827 - DNA, 22 bp, Homo sapiens
acagaatttttacacagggtaa

SEQ ID NO: 7129828 - DNA, 22 bp, Homo sapiens
acagaattggggttcttgggga

SEQ ID NO: 7129829 - DNA, 22 bp, Homo sapiens
acagaatttaaagctctagact

SEQ ID NO: 7129830 - DNA, 22 bp, Homo sapiens
acagaatttaaagctctagact

SEQ ID NO: 7129831 - DNA, 22 bp, Homo sapiens
acagaatttaaagctctagact

SEQ ID NO: 7129832 - DNA, 22 bp, Homo sapiens
acagaatttacacatctctaaa

SEQ ID NO: 7129833 - DNA, 22 bp, Homo sapiens
acagaatttacacatctctaaa

SEQ ID NO: 7129834 - DNA, 22 bp, Homo sapiens
acagaatttacacatctctaaa

SEQ ID NO: 7129835 - DNA, 22 bp, Homo sapiens
acagaattatcaggaaatgtta

SEQ ID NO: 7129836 - DNA, 22 bp, Homo sapiens
acagaattctagtatgtggctt

SEQ ID NO: 7129837 - DNA, 22 bp, Homo sapiens
acagaattctctctgcagaggc

SEQ ID NO: 7129838 - DNA, 22 bp, Homo sapiens
acagaattctctctgcagaggc

SEQ ID NO: 7129839 - DNA, 22 bp, Homo sapiens
acagaattgaaagtataatctg

SEQ ID NO: 7129840 - DNA, 22 bp, Homo sapiens
acagaattgaaagtataatctg

SEQ ID NO: 7129841 - DNA, 22 bp, Homo sapiens
acagaattgaaagtataatctg

SEQ ID NO: 7129842 - DNA, 22 bp, Homo sapiens
acagaattgaagctgagtaaat

SEQ ID NO: 7129843 - DNA, 22 bp, Homo sapiens
acagaattgaagctgagtaaat

SEQ ID NO: 7129844 - DNA, 22 bp, Homo sapiens
acagaattgatggaaatctcag

SEQ ID NO: 7129845 - DNA, 22 bp, Homo sapiens
aagcagagtgatataaacatgg

SEQ ID NO: 7129846 - DNA, 22 bp, Homo sapiens
aagcagagtgatataaacatgg

SEQ ID NO: 7129847 - DNA, 22 bp, Homo sapiens
aagcagcatcctgggcagacct

SEQ ID NO: 7129848 - DNA, 22 bp, Homo sapiens
aagcagcatgattgtaatacta

SEQ ID NO: 7129849 - DNA, 18 bp, Homo sapiens
acagacaaaatggaaatg

SEQ ID NO: 7129850 - DNA, 18 bp, Homo sapiens
acagacaaaatggaaatg

SEQ ID NO: 7129851 - DNA, 23 bp, Homo sapiens
acagacaacactgatgagagaaa

SEQ ID NO: 7129852 - DNA, 22 bp, Homo sapiens
aagcagagtccccttcccatgg

SEQ ID NO: 7129853 - DNA, 22 bp, Homo sapiens
aagcagcattgtaaccaatgcc

SEQ ID NO: 7129854 - DNA, 22 bp, Homo sapiens
aagcagcattgtaaccaatgcc

SEQ ID NO: 7129855 - DNA, 22 bp, Homo sapiens
aagcagcattcagtgaaatgtg

SEQ ID NO: 7129856 - DNA, 22 bp, Homo sapiens
aagcagcattcagtgaaatgtg

SEQ ID NO: 7129857 - DNA, 22 bp, Homo sapiens
aagcagcattcagtgaaatgtg

SEQ ID NO: 7129858 - DNA, 22 bp, Homo sapiens
aagcagcattcagtgaaatgtg

SEQ ID NO: 7129859 - DNA, 22 bp, Homo sapiens
aagcagcatgattgtaatacta

SEQ ID NO: 7129860 - DNA, 22 bp, Homo sapiens
aagcagcatgattgtaatacta

SEQ ID NO: 7129861 - DNA, 22 bp, Homo sapiens
aagcagcatgctatgctggtgg

SEQ ID NO: 7129862 - DNA, 22 bp, Homo sapiens
aagcagcatgctatgctggtgg

SEQ ID NO: 7129863 - DNA, 22 bp, Homo sapiens
aagcagcatgctatgctggtgg

SEQ ID NO: 7129864 - DNA, 22 bp, Homo sapiens
aagcagcatgctatgctggtgg

SEQ ID NO: 7129865 - DNA, 22 bp, Homo sapiens
aagcagcatgtgggttatcggg

SEQ ID NO: 7129866 - DNA, 22 bp, Homo sapiens
aagcagcatgtgggttatcggg

SEQ ID NO: 7129867 - DNA, 22 bp, Homo sapiens
aagcagcatgtgggttatcggg

SEQ ID NO: 7129868 - DNA, 22 bp, Homo sapiens
aagccaatcgtgtgaacttagt

SEQ ID NO: 7129869 - DNA, 22 bp, Homo sapiens
aagccaatcgtgtgaacttagt

SEQ ID NO: 7129870 - DNA, 22 bp, Homo sapiens
aagccaatcgtgtgaacttagt

SEQ ID NO: 7129871 - DNA, 22 bp, Homo sapiens
aagccaagttggaagactgaat

SEQ ID NO: 7129872 - DNA, 22 bp, Homo sapiens
aagccaggaagagagccttcac

SEQ ID NO: 7129873 - DNA, 22 bp, Homo sapiens
aagccaggaagagagccttcac

SEQ ID NO: 7129874 - DNA, 22 bp, Homo sapiens
aagccaggaagagagccttcac

SEQ ID NO: 7129875 - DNA, 22 bp, Homo sapiens
aagccaggaagggagctgtccc

SEQ ID NO: 7129876 - DNA, 22 bp, Homo sapiens
aagccaggaagggagctgtccc

SEQ ID NO: 7129877 - DNA, 22 bp, Homo sapiens
aagccaggaagggagctgtccc

SEQ ID NO: 7129878 - DNA, 22 bp, Homo sapiens
aagccaggaatggagtcttcgc

SEQ ID NO: 7129879 - DNA, 22 bp, Homo sapiens
aagccaggaatggagtcttcgc

SEQ ID NO: 7129880 - DNA, 22 bp, Homo sapiens
aagccaggaatggagtcttcgc

SEQ ID NO: 7129881 - DNA, 22 bp, Homo sapiens
aagccaggaccaaactcatcct

SEQ ID NO: 7129882 - DNA, 22 bp, Homo sapiens
aagccaggaatggagtcttcgc

SEQ ID NO: 7129883 - DNA, 22 bp, Homo sapiens
aagccaggagcgaggcctcggc

SEQ ID NO: 7129884 - DNA, 22 bp, Homo sapiens
aagccaggagcgaggcctcggc

SEQ ID NO: 7129885 - DNA, 22 bp, Homo sapiens
aagccaggagcgaggcctcggc

SEQ ID NO: 7129886 - DNA, 22 bp, Homo sapiens
aagccaggagcgaggcctcggc

SEQ ID NO: 7129887 - DNA, 22 bp, Homo sapiens
aagccaggataaagttgtttta

SEQ ID NO: 7129888 - DNA, 22 bp, Homo sapiens
aagccaggataaagttgtttta

SEQ ID NO: 7129889 - DNA, 22 bp, Homo sapiens
aagccaggataaagttgtttta

SEQ ID NO: 7129890 - DNA, 22 bp, Homo sapiens
aagccaggcatgcttggacagt

SEQ ID NO: 7129891 - DNA, 22 bp, Homo sapiens
aagccaggcatgcttggacagt

SEQ ID NO: 7129892 - DNA, 22 bp, Homo sapiens
acagcagcttgtctgttcttta

SEQ ID NO: 7129893 - DNA, 22 bp, Homo sapiens
acagcagcttgtctgttcttta

SEQ ID NO: 7129894 - DNA, 22 bp, Homo sapiens
acagcagcttgtctgttcttta

SEQ ID NO: 7129895 - DNA, 22 bp, Homo sapiens
acagcagcttgtctgttcttta

SEQ ID NO: 7129896 - DNA, 22 bp, Homo sapiens
acagcagcttcctgactgtact

SEQ ID NO: 7129897 - DNA, 22 bp, Homo sapiens
acagcagcttgcgtgtctggtc

SEQ ID NO: 7129898 - DNA, 22 bp, Homo sapiens
acagcagcttgcgtgtctggtc

SEQ ID NO: 7129899 - DNA, 22 bp, Homo sapiens
acagcagcttgcgtgtctggtc

SEQ ID NO: 7129900 - DNA, 22 bp, Homo sapiens
acagcagcttgcgtgtctggtc

SEQ ID NO: 7129901 - DNA, 22 bp, Homo sapiens
acagcagctaacccctgggcca

SEQ ID NO: 7129902 - DNA, 22 bp, Homo sapiens
acagcagctgccttcaggctct

SEQ ID NO: 7129903 - DNA, 22 bp, Homo sapiens
acagcagctgccttcaggctct

SEQ ID NO: 7129904 - DNA, 22 bp, Homo sapiens
acagcagctgccttcaggctct

SEQ ID NO: 7129905 - DNA, 22 bp, Homo sapiens
acagcagctgggttcccaccat

SEQ ID NO: 7129906 - DNA, 22 bp, Homo sapiens
acagcagctgggttcccaccat

SEQ ID NO: 7129907 - DNA, 22 bp, Homo sapiens
acagcagcttcctgactgtact

SEQ ID NO: 7129908 - DNA, 22 bp, Homo sapiens
acagcagcttcctgactgtact

SEQ ID NO: 7129909 - DNA, 22 bp, Homo sapiens
aagcatttcaggtagagatatt

SEQ ID NO: 7129910 - DNA, 22 bp, Homo sapiens
aagcatttggcatgaaactctt

SEQ ID NO: 7129911 - DNA, 22 bp, Homo sapiens
aagcatttggcatgaaactctt

SEQ ID NO: 7129912 - DNA, 22 bp, Homo sapiens
aagcatttgtgaaattcagatg

SEQ ID NO: 7129913 - DNA, 22 bp, Homo sapiens
aagcatttgtgaaattcagatg

SEQ ID NO: 7129914 - DNA, 22 bp, Homo sapiens
aagcatttggttctgaagactc

SEQ ID NO: 7129915 - DNA, 22 bp, Homo sapiens
acagcagctaaaggtgtctcct

SEQ ID NO: 7129916 - DNA, 22 bp, Homo sapiens
acagcagctaacccctgggcca

SEQ ID NO: 7129917 - DNA, 22 bp, Homo sapiens
acagcagctaacccctgggcca

SEQ ID NO: 7129918 - DNA, 22 bp, Homo sapiens
aagcatttcaatataatattca

SEQ ID NO: 7129919 - DNA, 22 bp, Homo sapiens
aagcatttcaatataatattca

SEQ ID NO: 7129920 - DNA, 22 bp, Homo sapiens
aagcatttatagataagaattt

SEQ ID NO: 7129921 - DNA, 22 bp, Homo sapiens
aagcattgtaagcagaagatgc

SEQ ID NO: 7129922 - DNA, 22 bp, Homo sapiens
aagcattgtaagcagaagatgc

SEQ ID NO: 7129923 - DNA, 22 bp, Homo sapiens
aagcattgtaagcagaagatgc

SEQ ID NO: 7129924 - DNA, 22 bp, Homo sapiens
aagcatatattttatatgttgt

SEQ ID NO: 7129925 - DNA, 22 bp, Homo sapiens
aagcatattttaattagccaca

SEQ ID NO: 7129926 - DNA, 22 bp, Homo sapiens
aagcatatattttatatgttgt

SEQ ID NO: 7129927 - DNA, 22 bp, Homo sapiens
aagcatcaacactatattgatg

SEQ ID NO: 7129928 - DNA, 22 bp, Homo sapiens
aagcatggtttctgacgtcatg

SEQ ID NO: 7129929 - DNA, 22 bp, Homo sapiens
aagcatgtacaatgagtgtctc

SEQ ID NO: 7129930 - DNA, 22 bp, Homo sapiens
aagcatgtcccttgtgattcaa

SEQ ID NO: 7129931 - DNA, 22 bp, Homo sapiens
aagcatgtgtataagctgggca

SEQ ID NO: 7129932 - DNA, 22 bp, Homo sapiens
aagcatgtgtataagctgggca

SEQ ID NO: 7129933 - DNA, 19 bp, Homo sapiens
aagcattagccaaagcatt

SEQ ID NO: 7129934 - DNA, 19 bp, Homo sapiens
aagcattagccaaagcatt

SEQ ID NO: 7129935 - DNA, 19 bp, Homo sapiens
aagcattagccaaagcatt

SEQ ID NO: 7129936 - DNA, 22 bp, Homo sapiens
aacagcagtggcaggagaaggc

SEQ ID NO: 7129937 - DNA, 22 bp, Homo sapiens
aacagcataagtatttatttca

SEQ ID NO: 7129938 - DNA, 22 bp, Homo sapiens
aacagcataccaatgtacatat

SEQ ID NO: 7129939 - DNA, 22 bp, Homo sapiens
aacagcataccaatgtacatat

SEQ ID NO: 7129940 - DNA, 22 bp, Homo sapiens
aacagcatcaccccataacatt

SEQ ID NO: 7129941 - DNA, 22 bp, Homo sapiens
aacagcatcaccccataacatt

SEQ ID NO: 7129942 - DNA, 22 bp, Homo sapiens
aacagcatcaccccataacatt

SEQ ID NO: 7129943 - DNA, 22 bp, Homo sapiens
aacagcatcaccccataacatt

SEQ ID NO: 7129944 - DNA, 22 bp, Homo sapiens
aacagcatatttcatatattga

SEQ ID NO: 7129945 - DNA, 22 bp, Homo sapiens
aacagcaggtcctggcatgggt

SEQ ID NO: 7129946 - DNA, 22 bp, Homo sapiens
aacagcaggtcctggcatgggt

SEQ ID NO: 7129947 - DNA, 22 bp, Homo sapiens
aacagcaggtcctggcatgggt

SEQ ID NO: 7129948 - DNA, 22 bp, Homo sapiens
aacagcagggacttgaatggaa

SEQ ID NO: 7129949 - DNA, 22 bp, Homo sapiens
aacagcagggacttgaatggaa

SEQ ID NO: 7129950 - DNA, 22 bp, Homo sapiens
aacagcagggatgacatggcca

SEQ ID NO: 7129951 - DNA, 22 bp, Homo sapiens
aacagcagggatgacatggcca

SEQ ID NO: 7129952 - DNA, 22 bp, Homo sapiens
aacagcagggatgacatggcca

SEQ ID NO: 7129953 - DNA, 22 bp, Homo sapiens
aacagcagggacttgaatggaa

SEQ ID NO: 7129954 - DNA, 22 bp, Homo sapiens
aacagcagggaaattccaagtc

SEQ ID NO: 7129955 - DNA, 22 bp, Homo sapiens
aacagcagggaaattccaagtc

SEQ ID NO: 7129956 - DNA, 22 bp, Homo sapiens
aacagaggctccctgcacttgt

SEQ ID NO: 7129957 - DNA, 22 bp, Homo sapiens
aacagaggatgtttgaaattca

SEQ ID NO: 7129958 - DNA, 22 bp, Homo sapiens
aaggtccatgactcggcatagt

SEQ ID NO: 7129959 - DNA, 22 bp, Homo sapiens
aaggtcctgtagccacagagcc

SEQ ID NO: 7129960 - DNA, 22 bp, Homo sapiens
aaggtcctgtagccacagagcc

SEQ ID NO: 7129961 - DNA, 22 bp, Homo sapiens
aaggtccttttgcagtgtgatc

SEQ ID NO: 7129962 - DNA, 22 bp, Homo sapiens
aaggtctcaagttttccaaagt

SEQ ID NO: 7129963 - DNA, 22 bp, Homo sapiens
aacagcaggcaccaaggctatg

SEQ ID NO: 7129964 - DNA, 22 bp, Homo sapiens
aacagcaggcaccaaggctatg

SEQ ID NO: 7129965 - DNA, 23 bp, Homo sapiens
aacagcaggatgatagaggaggt

SEQ ID NO: 7129966 - DNA, 23 bp, Homo sapiens
aacagcaggatgatagaggaggt

SEQ ID NO: 7129967 - DNA, 22 bp, Homo sapiens
aacagcagctgcctgaatttgc

SEQ ID NO: 7129968 - DNA, 22 bp, Homo sapiens
aacagagtggagccaaactttg

SEQ ID NO: 7129969 - DNA, 22 bp, Homo sapiens
aacagcagctttcaggatcatc

SEQ ID NO: 7129970 - DNA, 22 bp, Homo sapiens
aacagcagctttcaggatcatc

SEQ ID NO: 7129971 - DNA, 22 bp, Homo sapiens
aacagcagctttcaggatcatc

SEQ ID NO: 7129972 - DNA, 22 bp, Homo sapiens
aacagcttgaggaatatcatca

SEQ ID NO: 7129973 - DNA, 22 bp, Homo sapiens
aagtccaggtcccgggctctgg

SEQ ID NO: 7129974 - DNA, 22 bp, Homo sapiens
aagtccagggatcaaagtaggc

SEQ ID NO: 7129975 - DNA, 22 bp, Homo sapiens
aagtccaggtccaggaggttcc

SEQ ID NO: 7129976 - DNA, 22 bp, Homo sapiens
aacagcttgaggaatatcatca

SEQ ID NO: 7129977 - DNA, 22 bp, Homo sapiens
aacaggaatgaggagaaaaggt

SEQ ID NO: 7129978 - DNA, 22 bp, Homo sapiens
aacaggaatgaggagaaaaggt

SEQ ID NO: 7129979 - DNA, 17 bp, Homo sapiens
aagtccagagttgagca

SEQ ID NO: 7129980 - DNA, 17 bp, Homo sapiens
aagtccagagttgagca

SEQ ID NO: 7129981 - DNA, 17 bp, Homo sapiens
aagtccagcctgcagct

SEQ ID NO: 7129982 - DNA, 22 bp, Homo sapiens
aagtccaaggctgggtgcagtg

SEQ ID NO: 7129983 - DNA, 22 bp, Homo sapiens
aagtcattggtagcttgatagg

SEQ ID NO: 7129984 - DNA, 22 bp, Homo sapiens
aagtccaccagtcagactagga

SEQ ID NO: 7129985 - DNA, 22 bp, Homo sapiens
aagtccagaactcctgtgatag

SEQ ID NO: 7129986 - DNA, 22 bp, Homo sapiens
aagtcattggtagcttgatagg

SEQ ID NO: 7129987 - DNA, 22 bp, Homo sapiens
aagtcattggtagcttgatagg

SEQ ID NO: 7129988 - DNA, 22 bp, Homo sapiens
aagtcattatctcttctaatct

SEQ ID NO: 7129989 - DNA, 22 bp, Homo sapiens
aagtcatcttgagtctaagatt

SEQ ID NO: 7129990 - DNA, 22 bp, Homo sapiens
aagtcatgagtcctcttctgtg

SEQ ID NO: 7129991 - DNA, 22 bp, Homo sapiens
aacagcatgctgggtaacattg

SEQ ID NO: 7129992 - DNA, 22 bp, Homo sapiens
aacagcatgctgggtaacattg

SEQ ID NO: 7129993 - DNA, 23 bp, Homo sapiens
aacagccacactgctgagattca

SEQ ID NO: 7129994 - DNA, 22 bp, Homo sapiens
aacagccactgatactgaatag

SEQ ID NO: 7129995 - DNA, 22 bp, Homo sapiens
aacagcctcagtgagattagga

SEQ ID NO: 7129996 - DNA, 22 bp, Homo sapiens
aaggtcagagcaggaaggagtc

SEQ ID NO: 7129997 - DNA, 22 bp, Homo sapiens
aaggtcagagcaggaaggagtc

SEQ ID NO: 7129998 - DNA, 22 bp, Homo sapiens
aaggtcagagtgagctgtggcc

SEQ ID NO: 7129999 - DNA, 20 bp, Homo sapiens
aaggtccaaactctgtgttc

SEQ ID NO: 7130000 - DNA, 20 bp, Homo sapiens
aaggtccaaactctgtgttc

SEQ ID NO: 7130001 - DNA, 22 bp, Homo sapiens
aaggtattatttgcaatcattt

SEQ ID NO: 7130002 - DNA, 22 bp, Homo sapiens
aaggtattgttccctagtttct

SEQ ID NO: 7130003 - DNA, 22 bp, Homo sapiens
aaggtcaaagacagtaactttt

SEQ ID NO: 7130004 - DNA, 22 bp, Homo sapiens
aaggtcaacactgattttagtc

SEQ ID NO: 7130005 - DNA, 22 bp, Homo sapiens
aaggtcaagacacaggaatcta

SEQ ID NO: 7130006 - DNA, 22 bp, Homo sapiens
aacactgagctattacggtgga

SEQ ID NO: 7130007 - DNA, 22 bp, Homo sapiens
aacactgacgacgtgaactaaa

SEQ ID NO: 7130008 - DNA, 22 bp, Homo sapiens
aacactgagaacaatacagagt

SEQ ID NO: 7130009 - DNA, 22 bp, Homo sapiens
aacactgagaacaatacagagt

SEQ ID NO: 7130010 - DNA, 22 bp, Homo sapiens
aacactgaaatgtcttaagatt

SEQ ID NO: 7130011 - DNA, 22 bp, Homo sapiens
aacactgaagaccaggtaattt

SEQ ID NO: 7130012 - DNA, 22 bp, Homo sapiens
aacactgaagccgttaaacctt

SEQ ID NO: 7130013 - DNA, 22 bp, Homo sapiens
aacactgaagtagtgaatactg

SEQ ID NO: 7130014 - DNA, 22 bp, Homo sapiens
aacaaatgataccagttctcaa

SEQ ID NO: 7130015 - DNA, 22 bp, Homo sapiens
aacaaatgacctgatttcttcc

SEQ ID NO: 7130016 - DNA, 22 bp, Homo sapiens
aacaaagtttcaggaagataga

SEQ ID NO: 7130017 - DNA, 22 bp, Homo sapiens
aacaaagtgtacttccatactg

SEQ ID NO: 7130018 - DNA, 22 bp, Homo sapiens
aacaaagtttcaggaagataga

SEQ ID NO: 7130019 - DNA, 22 bp, Homo sapiens
aacaaagtttcaggaagataga

SEQ ID NO: 7130020 - DNA, 22 bp, Homo sapiens
aacaaatgataccagttctcaa

SEQ ID NO: 7130021 - DNA, 22 bp, Homo sapiens
aacaaatgataccagttctcaa

SEQ ID NO: 7130022 - DNA, 22 bp, Homo sapiens
aacaaatgattgttggttggag

SEQ ID NO: 7130023 - DNA, 22 bp, Homo sapiens
aacaaatggaacacaaatcttt

SEQ ID NO: 7130024 - DNA, 22 bp, Homo sapiens
aacaaatggaacacaaatcttt

SEQ ID NO: 7130025 - DNA, 22 bp, Homo sapiens
aacaaatggaacacaaatcttt

SEQ ID NO: 7130026 - DNA, 22 bp, Homo sapiens
aacaaatggaacacaaatcttt

SEQ ID NO: 7130027 - DNA, 22 bp, Homo sapiens
aacaaatggaacacaaatcttt

SEQ ID NO: 7130028 - DNA, 22 bp, Homo sapiens
aacaaatggaacacaaatcttt

SEQ ID NO: 7130029 - DNA, 22 bp, Homo sapiens
aacaaatggggccttgtatgaa

SEQ ID NO: 7130030 - DNA, 22 bp, Homo sapiens
aacaaatggggccttgtatgaa

SEQ ID NO: 7130031 - DNA, 22 bp, Homo sapiens
aacactctctgttggtaaggct

SEQ ID NO: 7130032 - DNA, 22 bp, Homo sapiens
aacactctacgtgcagctccta

SEQ ID NO: 7130033 - DNA, 22 bp, Homo sapiens
aacactctacgtgcagctccta

SEQ ID NO: 7130034 - DNA, 22 bp, Homo sapiens
aacactgaaacattgattgaca

SEQ ID NO: 7130035 - DNA, 22 bp, Homo sapiens
aacactctacgtgcagctccta

SEQ ID NO: 7130036 - DNA, 22 bp, Homo sapiens
aacactaaaggtcagttagaag

SEQ ID NO: 7130037 - DNA, 22 bp, Homo sapiens
aacactaatgggagaacaaccc

SEQ ID NO: 7130038 - DNA, 22 bp, Homo sapiens
aacaaatgtaaaatgcagatgc

SEQ ID NO: 7130039 - DNA, 22 bp, Homo sapiens
aacaaatgtaaaatgcagatgc

SEQ ID NO: 7130040 - DNA, 22 bp, Homo sapiens
aacacatagacgtttgatatca

SEQ ID NO: 7130041 - DNA, 22 bp, Homo sapiens
aacacatagacgtttgatatca

SEQ ID NO: 7130042 - DNA, 22 bp, Homo sapiens
aacacatagacgtttgatatca

SEQ ID NO: 7130043 - DNA, 22 bp, Homo sapiens
aacacataggcagagcatgaca

SEQ ID NO: 7130044 - DNA, 22 bp, Homo sapiens
aacacataggcagagcatgaca

SEQ ID NO: 7130045 - DNA, 22 bp, Homo sapiens
aacaccttgcagggattatgac

SEQ ID NO: 7130046 - DNA, 22 bp, Homo sapiens
aaattcagatggctttcttttc

SEQ ID NO: 7130047 - DNA, 22 bp, Homo sapiens
aaattcacttgcctgcttagct

SEQ ID NO: 7130048 - DNA, 23 bp, Homo sapiens
aaattccttgcagataggtattg

SEQ ID NO: 7130049 - DNA, 22 bp, Homo sapiens
aaattctaaggtcacaatgttg

SEQ ID NO: 7130050 - DNA, 22 bp, Homo sapiens
aaattctaaggtcacaatgttg

SEQ ID NO: 7130051 - DNA, 22 bp, Homo sapiens
aaattctaaggtcacaatgttg

SEQ ID NO: 7130052 - DNA, 22 bp, Homo sapiens
aaatgtttctacttgtgagcat

SEQ ID NO: 7130053 - DNA, 22 bp, Homo sapiens
aaatgtttctacttgtgagcat

SEQ ID NO: 7130054 - DNA, 22 bp, Homo sapiens
aaatgtttaagtgtaggagcaa

SEQ ID NO: 7130055 - DNA, 22 bp, Homo sapiens
aaatgtttaagtgtaggagcaa

SEQ ID NO: 7130056 - DNA, 22 bp, Homo sapiens
aaatgtttaagtgtaggagcaa

SEQ ID NO: 7130057 - DNA, 22 bp, Homo sapiens
aaatgtttctacttgtgagcat

SEQ ID NO: 7130058 - DNA, 22 bp, Homo sapiens
aaatgttttgctcccatgtggt

SEQ ID NO: 7130059 - DNA, 22 bp, Homo sapiens
aaatgttttgctcccatgtggt

SEQ ID NO: 7130060 - DNA, 22 bp, Homo sapiens
aaatgttttgctcccatgtggt

SEQ ID NO: 7130061 - DNA, 22 bp, Homo sapiens
aaatgttttgctcccatgtggt

SEQ ID NO: 7130062 - DNA, 22 bp, Homo sapiens
aaatgttttgctcccatgtggt

SEQ ID NO: 7130063 - DNA, 22 bp, Homo sapiens
aaattcactctgttcctcatgg

SEQ ID NO: 7130064 - DNA, 22 bp, Homo sapiens
aaattcactctgttcctcatgg

SEQ ID NO: 7130065 - DNA, 22 bp, Homo sapiens
aaatgttctaaattacatgtga

SEQ ID NO: 7130066 - DNA, 22 bp, Homo sapiens
aaatgttccgggtaaggagaaa

SEQ ID NO: 7130067 - DNA, 22 bp, Homo sapiens
aaatgttcccaatatgaagctg

SEQ ID NO: 7130068 - DNA, 22 bp, Homo sapiens
aaatgttcatttctcactcaca

SEQ ID NO: 7130069 - DNA, 22 bp, Homo sapiens
aaatgttaggttgtactgagtc

SEQ ID NO: 7130070 - DNA, 22 bp, Homo sapiens
aaatgttaggttgtactgagtc

SEQ ID NO: 7130071 - DNA, 22 bp, Homo sapiens
aaatgtgttcctttgctacaga

SEQ ID NO: 7130072 - DNA, 22 bp, Homo sapiens
aaatgtgtttagatggtttatt

SEQ ID NO: 7130073 - DNA, 22 bp, Homo sapiens
aaatgttaggttgtactgagtc

SEQ ID NO: 7130074 - DNA, 22 bp, Homo sapiens
aagctgaggatacatgaagcct

SEQ ID NO: 7130075 - DNA, 22 bp, Homo sapiens
aagctgaggcccatggcaaggt

SEQ ID NO: 7130076 - DNA, 22 bp, Homo sapiens
aagctgaggatacatgaagcct

SEQ ID NO: 7130077 - DNA, 22 bp, Homo sapiens
aagctgaggcccatggcaaggt

SEQ ID NO: 7130078 - DNA, 22 bp, Homo sapiens
aagctgaggcccatggcaaggt

SEQ ID NO: 7130079 - DNA, 22 bp, Homo sapiens
aagctgagccagtggcaagtgc

SEQ ID NO: 7130080 - DNA, 22 bp, Homo sapiens
aagctgagccagtggcaagtgc

SEQ ID NO: 7130081 - DNA, 22 bp, Homo sapiens
aagctgagccagtggcaagtgc

SEQ ID NO: 7130082 - DNA, 22 bp, Homo sapiens
aagctgaggatacatgaagcct

SEQ ID NO: 7130083 - DNA, 22 bp, Homo sapiens
aagctgaggatacatgaagcct

SEQ ID NO: 7130084 - DNA, 22 bp, Homo sapiens
aaatgtctacttcccatctgta

SEQ ID NO: 7130085 - DNA, 22 bp, Homo sapiens
aagctgaggtcaagtagctagt

SEQ ID NO: 7130086 - DNA, 19 bp, Homo sapiens
aagctgagggctgtccacc

SEQ ID NO: 7130087 - DNA, 19 bp, Homo sapiens
aagctgagggctgtccacc

SEQ ID NO: 7130088 - DNA, 22 bp, Homo sapiens
aagctgaggctcccctgaggga

SEQ ID NO: 7130089 - DNA, 19 bp, Homo sapiens
aaatgtgatggtacaattc

SEQ ID NO: 7130090 - DNA, 19 bp, Homo sapiens
aaatgtgatggtacaattc

SEQ ID NO: 7130091 - DNA, 22 bp, Homo sapiens
aaatgtgcatgagtcagaagtg

SEQ ID NO: 7130092 - DNA, 22 bp, Homo sapiens
aaatgtgctcatttataaaagt

SEQ ID NO: 7130093 - DNA, 22 bp, Homo sapiens
aaatgtgcttcttactctcaat

SEQ ID NO: 7130094 - DNA, 22 bp, Homo sapiens
aaatgtctatctggcatattcc

SEQ ID NO: 7130095 - DNA, 22 bp, Homo sapiens
aaatgtctatctggcatattcc

SEQ ID NO: 7130096 - DNA, 22 bp, Homo sapiens
aaatgtgatactgttcttttta

SEQ ID NO: 7130097 - DNA, 22 bp, Homo sapiens
aaatgtgcttgtgatcagctgt

SEQ ID NO: 7130098 - DNA, 22 bp, Homo sapiens
aaatgtgggtaatgggactgga

SEQ ID NO: 7130099 - DNA, 22 bp, Homo sapiens
aaatgtgggtaatgggactgga

SEQ ID NO: 7130100 - DNA, 22 bp, Homo sapiens
aaatgtgtcagtttcattctct

SEQ ID NO: 7130101 - DNA, 22 bp, Homo sapiens
aaatgtgtatatgaaacatgat

SEQ ID NO: 7130102 - DNA, 22 bp, Homo sapiens
aaatgtgtcatattcaaagtca

SEQ ID NO: 7130103 - DNA, 22 bp, Homo sapiens
aaatgtgtgcacaaagacagct

SEQ ID NO: 7130104 - DNA, 22 bp, Homo sapiens
aaattctgcaatttgacaagat

SEQ ID NO: 7130105 - DNA, 22 bp, Homo sapiens
aaattctgtcctgaatgccatt

SEQ ID NO: 7130106 - DNA, 22 bp, Homo sapiens
aaattctgtcctgaatgccatt

SEQ ID NO: 7130107 - DNA, 22 bp, Homo sapiens
aaattcttcaggtaattttgat

SEQ ID NO: 7130108 - DNA, 22 bp, Homo sapiens
aaattctttcatggctaataag

SEQ ID NO: 7130109 - DNA, 22 bp, Homo sapiens
aaattctcaagtgatcctgttg

SEQ ID NO: 7130110 - DNA, 22 bp, Homo sapiens
aaattctctaaagaaaacatga

SEQ ID NO: 7130111 - DNA, 22 bp, Homo sapiens
aaattctatgtcaatgtttatt

SEQ ID NO: 7130112 - DNA, 22 bp, Homo sapiens
aaattctaaggtcacaatgttg

SEQ ID NO: 7130113 - DNA, 22 bp, Homo sapiens
aaattctatgtcaatgtttatt

SEQ ID NO: 7130114 - DNA, 22 bp, Homo sapiens
aaattctatgtcaatgtttatt

SEQ ID NO: 7130115 - DNA, 22 bp, Homo sapiens
aaattctatgtcaatgtttatt

SEQ ID NO: 7130116 - DNA, 22 bp, Homo sapiens
aaattgaatttgggaaacattg

SEQ ID NO: 7130117 - DNA, 22 bp, Homo sapiens
aaattgaatttgggaaacattg

SEQ ID NO: 7130118 - DNA, 22 bp, Homo sapiens
aaattgaatgattaagtggtga

SEQ ID NO: 7130119 - DNA, 22 bp, Homo sapiens
aaattgaatgattaagtggtga

SEQ ID NO: 7130120 - DNA, 22 bp, Homo sapiens
aaattctttcatggctaataag

SEQ ID NO: 7130121 - DNA, 22 bp, Homo sapiens
aaattctttcatggctaataag

SEQ ID NO: 7130122 - DNA, 22 bp, Homo sapiens
aaattctttcatggctaataag

SEQ ID NO: 7130123 - DNA, 22 bp, Homo sapiens
aaattctttggcctactttgaa

SEQ ID NO: 7130124 - DNA, 22 bp, Homo sapiens
aaattgatgttcccagttgaaa

SEQ ID NO: 7130125 - DNA, 22 bp, Homo sapiens
aaattgcaaaagtacttttagg

SEQ ID NO: 7130126 - DNA, 22 bp, Homo sapiens
aaattgcaaaagtacttttagg

SEQ ID NO: 7130127 - DNA, 22 bp, Homo sapiens
aaattgcagatgctaaatgact

SEQ ID NO: 7130128 - DNA, 22 bp, Homo sapiens
aaattgcagatgctaaatgact

SEQ ID NO: 7130129 - DNA, 22 bp, Homo sapiens
aaattgcacaatatagacatga

SEQ ID NO: 7130130 - DNA, 22 bp, Homo sapiens
aaattgcacaatatagacatga

SEQ ID NO: 7130131 - DNA, 22 bp, Homo sapiens
aaattgcattcaggatgcagga

SEQ ID NO: 7130132 - DNA, 22 bp, Homo sapiens
aaattgcaggtaggtgggtgat

SEQ ID NO: 7130133 - DNA, 22 bp, Homo sapiens
aaattgcattcaggatgcagga

SEQ ID NO: 7130134 - DNA, 22 bp, Homo sapiens
aaattgcattcttgtcttgata

SEQ ID NO: 7130135 - DNA, 22 bp, Homo sapiens
aaattgcattgagctgcttatt

SEQ ID NO: 7130136 - DNA, 22 bp, Homo sapiens
aaattgcattgagctgcttatt

SEQ ID NO: 7130137 - DNA, 22 bp, Homo sapiens
aaattttagaccaggcaaaact

SEQ ID NO: 7130138 - DNA, 22 bp, Homo sapiens
aacaaacagttaagtgtggatg

SEQ ID NO: 7130139 - DNA, 22 bp, Homo sapiens
aacaaacagttaagtgtggatg

SEQ ID NO: 7130140 - DNA, 22 bp, Homo sapiens
aacaaacagttaagtgtggatg

SEQ ID NO: 7130141 - DNA, 22 bp, Homo sapiens
aacaaacagttaagtgtggatg

SEQ ID NO: 7130142 - DNA, 22 bp, Homo sapiens
aacaaacagttaagtgtggatg

SEQ ID NO: 7130143 - DNA, 22 bp, Homo sapiens
aacaaacattacctggtgctgg

SEQ ID NO: 7130144 - DNA, 22 bp, Homo sapiens
aacaaacattacctggtgctgg

SEQ ID NO: 7130145 - DNA, 22 bp, Homo sapiens
aacaaacattacctggtgctgg

SEQ ID NO: 7130146 - DNA, 22 bp, Homo sapiens
aacaaacattacctggtgctgg

SEQ ID NO: 7130147 - DNA, 22 bp, Homo sapiens
aacaaacattacctggtgctgg

SEQ ID NO: 7130148 - DNA, 22 bp, Homo sapiens
aacaaacctgggtggagaaagg

SEQ ID NO: 7130149 - DNA, 22 bp, Homo sapiens
aacaaaccttccctatacgtct

SEQ ID NO: 7130150 - DNA, 22 bp, Homo sapiens
aacaaaccttccctatacgtct

SEQ ID NO: 7130151 - DNA, 20 bp, Homo sapiens
aacaaactacaaaattatgt

SEQ ID NO: 7130152 - DNA, 20 bp, Homo sapiens
aacaaactacaaaattatgt

SEQ ID NO: 7130153 - DNA, 21 bp, Homo sapiens
aacaaagggatgctcatcttt

SEQ ID NO: 7130154 - DNA, 22 bp, Homo sapiens
aacaaagtacttttcagtgctt

SEQ ID NO: 7130155 - DNA, 22 bp, Homo sapiens
aacaaaggccgttaataaccac

SEQ ID NO: 7130156 - DNA, 21 bp, Homo sapiens
aacaaagggatgctcatcttt

SEQ ID NO: 7130157 - DNA, 21 bp, Homo sapiens
aacaaagggatgctcatcttt

SEQ ID NO: 7130158 - DNA, 22 bp, Homo sapiens
aacaaagtacttttcagtgctt

SEQ ID NO: 7130159 - DNA, 22 bp, Homo sapiens
aacaaagtagctgctgttctta

SEQ ID NO: 7130160 - DNA, 20 bp, Homo sapiens
aacaaactacaaaattatgt

SEQ ID NO: 7130161 - DNA, 22 bp, Homo sapiens
aacaaagaagactggttatttt

SEQ ID NO: 7130162 - DNA, 22 bp, Homo sapiens
aacaaagaagactggttatttt

SEQ ID NO: 7130163 - DNA, 22 bp, Homo sapiens
aacaaagatgggtgggaaagag

SEQ ID NO: 7130164 - DNA, 22 bp, Homo sapiens
aacaaagatgggtgggaaagag

SEQ ID NO: 7130165 - DNA, 22 bp, Homo sapiens
aacaaagcaccactgagtcagt

SEQ ID NO: 7130166 - DNA, 22 bp, Homo sapiens
aacttaaacccactcatgtaga

SEQ ID NO: 7130167 - DNA, 22 bp, Homo sapiens
aacttaaacccactcatgtaga

SEQ ID NO: 7130168 - DNA, 22 bp, Homo sapiens
aacttaaacccactcatgtaga

SEQ ID NO: 7130169 - DNA, 22 bp, Homo sapiens
aacttaaacccactcatgtaga

SEQ ID NO: 7130170 - DNA, 22 bp, Homo sapiens
aacttaagaggttaagggcttg

SEQ ID NO: 7130171 - DNA, 23 bp, Homo sapiens
aacttaatactgggataagatgc

SEQ ID NO: 7130172 - DNA, 22 bp, Homo sapiens
aacttaaacaagctcccaagtt

SEQ ID NO: 7130173 - DNA, 22 bp, Homo sapiens
aacttaaacccactcatgtaga

SEQ ID NO: 7130174 - DNA, 22 bp, Homo sapiens
aacttagtacccaggcgttcgg

SEQ ID NO: 7130175 - DNA, 22 bp, Homo sapiens
aacttacaaggatgatagctgc

SEQ ID NO: 7130176 - DNA, 22 bp, Homo sapiens
aactgtttcagaaatattgttg

SEQ ID NO: 7130177 - DNA, 22 bp, Homo sapiens
aactgtttggaactcttccaca

SEQ ID NO: 7130178 - DNA, 22 bp, Homo sapiens
aactgtttttcacgtgtctcat

SEQ ID NO: 7130179 - DNA, 22 bp, Homo sapiens
aactgtttaccatacacagtga

SEQ ID NO: 7130180 - DNA, 22 bp, Homo sapiens
aactgtttaccatacacagtga

SEQ ID NO: 7130181 - DNA, 22 bp, Homo sapiens
aactgttcttcattttcagtat

SEQ ID NO: 7130182 - DNA, 22 bp, Homo sapiens
aactgttcttgtgtttgctatg

SEQ ID NO: 7130183 - DNA, 22 bp, Homo sapiens
aactggttctcttttgcttgtg

SEQ ID NO: 7130184 - DNA, 23 bp, Homo sapiens
aactggttgaaggctgttaattg

SEQ ID NO: 7130185 - DNA, 23 bp, Homo sapiens
aactggttgaaggctgttaattg

SEQ ID NO: 7130186 - DNA, 19 bp, Homo sapiens
aactgtaaagatctgtagc

SEQ ID NO: 7130187 - DNA, 19 bp, Homo sapiens
aactgtaaagatctgtagc

SEQ ID NO: 7130188 - DNA, 22 bp, Homo sapiens
aactgtgtgttttgctattagt

SEQ ID NO: 7130189 - DNA, 22 bp, Homo sapiens
aactgcttagtgatggatgacc

SEQ ID NO: 7130190 - DNA, 22 bp, Homo sapiens
aactgctctgcatgcaatggaa

SEQ ID NO: 7130191 - DNA, 22 bp, Homo sapiens
aactgctctgcatgcaatggaa

SEQ ID NO: 7130192 - DNA, 22 bp, Homo sapiens
aactgctgcatcttagaatgca

SEQ ID NO: 7130193 - DNA, 22 bp, Homo sapiens
aactgcctcaggtcatatatca

SEQ ID NO: 7130194 - DNA, 22 bp, Homo sapiens
aactgcctcaggtcatatatca

SEQ ID NO: 7130195 - DNA, 22 bp, Homo sapiens
aactgcttatctttggtagatg

SEQ ID NO: 7130196 - DNA, 22 bp, Homo sapiens
aactgcttcaagtctgtgggga

SEQ ID NO: 7130197 - DNA, 22 bp, Homo sapiens
aactgcttcacttggcatttgg

SEQ ID NO: 7130198 - DNA, 22 bp, Homo sapiens
aatgataagacatgagtagagg

SEQ ID NO: 7130199 - DNA, 21 bp, Homo sapiens
aactgcttcccatcttagggc

SEQ ID NO: 7130200 - DNA, 22 bp, Homo sapiens
aactgcttccttggcaggcatg

SEQ ID NO: 7130201 - DNA, 19 bp, Homo sapiens
aactgcttctgaaggagcc

SEQ ID NO: 7130202 - DNA, 22 bp, Homo sapiens
aactgcttcttactgctgggca

SEQ ID NO: 7130203 - DNA, 22 bp, Homo sapiens
aatgatatagcagacatagcct

SEQ ID NO: 7130204 - DNA, 22 bp, Homo sapiens
aatgatatagcagacatagcct

SEQ ID NO: 7130205 - DNA, 22 bp, Homo sapiens
aatgatatagcagacatagcct

SEQ ID NO: 7130206 - DNA, 22 bp, Homo sapiens
aatgatatagcagacatagcct

SEQ ID NO: 7130207 - DNA, 22 bp, Homo sapiens
aatgatacaaagggttttattt

SEQ ID NO: 7130208 - DNA, 22 bp, Homo sapiens
aatgataccgccaatattacca

SEQ ID NO: 7130209 - DNA, 22 bp, Homo sapiens
aatgataccaaacatgtagata

SEQ ID NO: 7130210 - DNA, 22 bp, Homo sapiens
aatgataccaaacatgtagata

SEQ ID NO: 7130211 - DNA, 22 bp, Homo sapiens
aatgatatagcagacatagcct

SEQ ID NO: 7130212 - DNA, 22 bp, Homo sapiens
aatgatatagcagacatagcct

SEQ ID NO: 7130213 - DNA, 22 bp, Homo sapiens
aatgatatgcaaattatcatca

SEQ ID NO: 7130214 - DNA, 22 bp, Homo sapiens
aatgatatgcaaattatcatca

SEQ ID NO: 7130215 - DNA, 22 bp, Homo sapiens
aatgatatgcaaattatcatca

SEQ ID NO: 7130216 - DNA, 22 bp, Homo sapiens
aatgatatgcaaattatcatca

SEQ ID NO: 7130217 - DNA, 22 bp, Homo sapiens
aatgatatgcaaattatcatca

SEQ ID NO: 7130218 - DNA, 22 bp, Homo sapiens
aatgatatgcaaattatcatca

SEQ ID NO: 7130219 - DNA, 22 bp, Homo sapiens
aatgatatttattgaatagatg

SEQ ID NO: 7130220 - DNA, 22 bp, Homo sapiens
aatgatatttattgaatagatg

SEQ ID NO: 7130221 - DNA, 22 bp, Homo sapiens
aatgatatttattgaatagatg

SEQ ID NO: 7130222 - DNA, 22 bp, Homo sapiens
aatgatcacctggtaaagagag

SEQ ID NO: 7130223 - DNA, 22 bp, Homo sapiens
aatgatctactctcattatctc

SEQ ID NO: 7130224 - DNA, 22 bp, Homo sapiens
aatgatctactctcattatctc

SEQ ID NO: 7130225 - DNA, 22 bp, Homo sapiens
aactacagcatctatacaaata

SEQ ID NO: 7130226 - DNA, 22 bp, Homo sapiens
aactacagaatcatagaaaata

SEQ ID NO: 7130227 - DNA, 22 bp, Homo sapiens
aactacagaatcatagaaaata

SEQ ID NO: 7130228 - DNA, 22 bp, Homo sapiens
aactacagaatcatagaaaata

SEQ ID NO: 7130229 - DNA, 22 bp, Homo sapiens
aactacagaaaaggtaagctct

SEQ ID NO: 7130230 - DNA, 22 bp, Homo sapiens
aactacagaaaaggtaagctct

SEQ ID NO: 7130231 - DNA, 22 bp, Homo sapiens
aacgcccgtggttgccaaggta

SEQ ID NO: 7130232 - DNA, 22 bp, Homo sapiens
aacggaattgtttcgtcaagca

SEQ ID NO: 7130233 - DNA, 22 bp, Homo sapiens
aacggctgtggctggcggcagc

SEQ ID NO: 7130234 - DNA, 22 bp, Homo sapiens
aacggctgtggctggcggcagc

SEQ ID NO: 7130235 - DNA, 22 bp, Homo sapiens
aacgtcttctctccaagtaaat

SEQ ID NO: 7130236 - DNA, 20 bp, Homo sapiens
aatataattctctgaattta

SEQ ID NO: 7130237 - DNA, 22 bp, Homo sapiens
aatataatgctgttttatgcca

SEQ ID NO: 7130238 - DNA, 22 bp, Homo sapiens
aatataaattcctgggcccagc

SEQ ID NO: 7130239 - DNA, 22 bp, Homo sapiens
aatataatgctgttttatgcca

SEQ ID NO: 7130240 - DNA, 22 bp, Homo sapiens
aatataatgctgttttatgcca

SEQ ID NO: 7130241 - DNA, 21 bp, Homo sapiens
aactacagttgttccttcatt

SEQ ID NO: 7130242 - DNA, 22 bp, Homo sapiens
aactacagtgggcagaggcaat

SEQ ID NO: 7130243 - DNA, 22 bp, Homo sapiens
aactacagtgggcagaggcaat

SEQ ID NO: 7130244 - DNA, 22 bp, Homo sapiens
aactacagtatgtccaaagaat

SEQ ID NO: 7130245 - DNA, 22 bp, Homo sapiens
aactacagtgggcagaggcaat

SEQ ID NO: 7130246 - DNA, 22 bp, Homo sapiens
aactacagtatgtccaaagaat

SEQ ID NO: 7130247 - DNA, 22 bp, Homo sapiens
aactacagtagtttgcccttct

SEQ ID NO: 7130248 - DNA, 22 bp, Homo sapiens
aactacagtagtttgcccttct

SEQ ID NO: 7130249 - DNA, 22 bp, Homo sapiens
aactacagggggtggcaggcgg

SEQ ID NO: 7130250 - DNA, 22 bp, Homo sapiens
aactacagctcttgtctttctg

SEQ ID NO: 7130251 - DNA, 19 bp, Homo sapiens
aactacagcgcactgtcct

SEQ ID NO: 7130252 - DNA, 19 bp, Homo sapiens
aactacagcgcactgtcct

SEQ ID NO: 7130253 - DNA, 22 bp, Homo sapiens
aactacagcatctatacaaata

SEQ ID NO: 7130254 - DNA, 22 bp, Homo sapiens
aactacagcatctatacaaata

SEQ ID NO: 7130255 - DNA, 22 bp, Homo sapiens
aactacattgtcctttctgaag

SEQ ID NO: 7130256 - DNA, 22 bp, Homo sapiens
aactacatagaaattagtattt

SEQ ID NO: 7130257 - DNA, 22 bp, Homo sapiens
aactacatagaaattagtattt

SEQ ID NO: 7130258 - DNA, 22 bp, Homo sapiens
aactacatagaaattagtattt

SEQ ID NO: 7130259 - DNA, 22 bp, Homo sapiens
aatccaatcctactcagaaagt

SEQ ID NO: 7130260 - DNA, 22 bp, Homo sapiens
aatcattgtaaatggttttgtt

SEQ ID NO: 7130261 - DNA, 22 bp, Homo sapiens
aatcattgttcttcagatttga

SEQ ID NO: 7130262 - DNA, 22 bp, Homo sapiens
aatcattgttcttcagatttga

SEQ ID NO: 7130263 - DNA, 22 bp, Homo sapiens
aatcattgttgtcgttcctaga

SEQ ID NO: 7130264 - DNA, 22 bp, Homo sapiens
aatcattgttgtcgttcctaga

SEQ ID NO: 7130265 - DNA, 22 bp, Homo sapiens
aatcattgagacaaattagctt

SEQ ID NO: 7130266 - DNA, 22 bp, Homo sapiens
aatcattgagacaaattagctt

SEQ ID NO: 7130267 - DNA, 22 bp, Homo sapiens
aatcattgagacaaattagctt

SEQ ID NO: 7130268 - DNA, 22 bp, Homo sapiens
aatcattgctcctttctctggt

SEQ ID NO: 7130269 - DNA, 22 bp, Homo sapiens
aatcattgctcctttctctggt

SEQ ID NO: 7130270 - DNA, 22 bp, Homo sapiens
aatcattgtaaatggttttgtt

SEQ ID NO: 7130271 - DNA, 22 bp, Homo sapiens
aatcattcttatttcacagcaa

SEQ ID NO: 7130272 - DNA, 22 bp, Homo sapiens
aatcattctcatgccagtttcc

SEQ ID NO: 7130273 - DNA, 22 bp, Homo sapiens
aatcatgtttcagatgagtttt

SEQ ID NO: 7130274 - DNA, 22 bp, Homo sapiens
aatcatgtttacgtgacatgtc

SEQ ID NO: 7130275 - DNA, 22 bp, Homo sapiens
aatcatctccgaaaaaagagta

SEQ ID NO: 7130276 - DNA, 22 bp, Homo sapiens
aatcatcctgaagtcaataaag

SEQ ID NO: 7130277 - DNA, 21 bp, Homo sapiens
aatcatacaaaacatgtcagg

SEQ ID NO: 7130278 - DNA, 22 bp, Homo sapiens
aatcatcacgaacacaacagcg

SEQ ID NO: 7130279 - DNA, 22 bp, Homo sapiens
aatcatcttcatcttacacaga

SEQ ID NO: 7130280 - DNA, 22 bp, Homo sapiens
aatcatgacaggaatagaaggg

SEQ ID NO: 7130281 - DNA, 22 bp, Homo sapiens
aatcatgtttacgtgacatgtc

SEQ ID NO: 7130282 - DNA, 22 bp, Homo sapiens
aactgaaacttaggaagtaatc

SEQ ID NO: 7130283 - DNA, 22 bp, Homo sapiens
aactgaaacttaggaagtaatc

SEQ ID NO: 7130284 - DNA, 22 bp, Homo sapiens
aactgaaacttaggaagtaatc

SEQ ID NO: 7130285 - DNA, 22 bp, Homo sapiens
aactgaaacttaggaagtaatc

SEQ ID NO: 7130286 - DNA, 22 bp, Homo sapiens
aactgaaacgtatttttgagat

SEQ ID NO: 7130287 - DNA, 22 bp, Homo sapiens
aactgcaatcacttttgcacca

SEQ ID NO: 7130288 - DNA, 22 bp, Homo sapiens
aactgcaattacttttgcacca

SEQ ID NO: 7130289 - DNA, 22 bp, Homo sapiens
aactgcaattacttttgcacta

SEQ ID NO: 7130290 - DNA, 22 bp, Homo sapiens
aactgcagagaacatctgggtt

SEQ ID NO: 7130291 - DNA, 22 bp, Homo sapiens
aactgcagagaacatctgggtt

SEQ ID NO: 7130292 - DNA, 22 bp, Homo sapiens
aatataaattcctgggcccagc

SEQ ID NO: 7130293 - DNA, 22 bp, Homo sapiens
aatataaattcctgggcccagc

SEQ ID NO: 7130294 - DNA, 22 bp, Homo sapiens
aatagttttataggtgggatta

SEQ ID NO: 7130295 - DNA, 22 bp, Homo sapiens
aatagttttataggtgggatta

SEQ ID NO: 7130296 - DNA, 22 bp, Homo sapiens
aatataaattcctgggcccagc

SEQ ID NO: 7130297 - DNA, 22 bp, Homo sapiens
aatataaattcctgggcccagc

SEQ ID NO: 7130298 - DNA, 22 bp, Homo sapiens
aatagtttgaatttatcagatg

SEQ ID NO: 7130299 - DNA, 22 bp, Homo sapiens
aatagtttgaatttatcagatg

SEQ ID NO: 7130300 - DNA, 22 bp, Homo sapiens
aatagtttgaatttatcagatg

SEQ ID NO: 7130301 - DNA, 22 bp, Homo sapiens
aatagtttgaatttatcagatg

SEQ ID NO: 7130302 - DNA, 22 bp, Homo sapiens
aatagtttgaatttatcagatg

SEQ ID NO: 7130303 - DNA, 21 bp, Homo sapiens
aaccagagccaggctctcagc

SEQ ID NO: 7130304 - DNA, 22 bp, Homo sapiens
aaccagaggggccctgcctggg

SEQ ID NO: 7130305 - DNA, 22 bp, Homo sapiens
aatagtgctgctgtggacatgg

SEQ ID NO: 7130306 - DNA, 17 bp, Homo sapiens
aatagtgtattatacat

SEQ ID NO: 7130307 - DNA, 22 bp, Homo sapiens
aatagtgtatttttcaaaatta

SEQ ID NO: 7130308 - DNA, 22 bp, Homo sapiens
aatagtgttgttcactcaggag

SEQ ID NO: 7130309 - DNA, 22 bp, Homo sapiens
aaccacaacactaaatgctggt

SEQ ID NO: 7130310 - DNA, 22 bp, Homo sapiens
aaccacaacactaaatgctggt

SEQ ID NO: 7130311 - DNA, 22 bp, Homo sapiens
aaccacagacccagactagaga

SEQ ID NO: 7130312 - DNA, 22 bp, Homo sapiens
aaccacagacccagactagaga

SEQ ID NO: 7130313 - DNA, 22 bp, Homo sapiens
aaccacatgaaaagagtaatat

SEQ ID NO: 7130314 - DNA, 22 bp, Homo sapiens
aaccaagagggttttccttgaa

SEQ ID NO: 7130315 - DNA, 22 bp, Homo sapiens
aaccaaggacagctagtgatgc

SEQ ID NO: 7130316 - DNA, 22 bp, Homo sapiens
aaccaacataggaatgcagaga

SEQ ID NO: 7130317 - DNA, 22 bp, Homo sapiens
aaccaagagggttttccttgaa

SEQ ID NO: 7130318 - DNA, 22 bp, Homo sapiens
aaccaagagggttttccttgaa

SEQ ID NO: 7130319 - DNA, 21 bp, Homo sapiens
aaccaagccagccagcctctc

SEQ ID NO: 7130320 - DNA, 22 bp, Homo sapiens
aaccaccaccatctagttccaa

SEQ ID NO: 7130321 - DNA, 22 bp, Homo sapiens
aaccacatggctcagtggacat

SEQ ID NO: 7130322 - DNA, 22 bp, Homo sapiens
aaccaccattctctcctcttcc

SEQ ID NO: 7130323 - DNA, 22 bp, Homo sapiens
aaccaccattctctcctcttcc

SEQ ID NO: 7130324 - DNA, 22 bp, Homo sapiens
aaccaccattctctcctcttcc

SEQ ID NO: 7130325 - DNA, 22 bp, Homo sapiens
aaccacttatttaagctctgat

SEQ ID NO: 7130326 - DNA, 22 bp, Homo sapiens
aaccagaaggaatctgagctga

SEQ ID NO: 7130327 - DNA, 22 bp, Homo sapiens
aacatttcataacttgactttt

SEQ ID NO: 7130328 - DNA, 22 bp, Homo sapiens
aacatttttaagaccaagtgct

SEQ ID NO: 7130329 - DNA, 22 bp, Homo sapiens
aaccaaagaaaactgtggtgag

SEQ ID NO: 7130330 - DNA, 20 bp, Homo sapiens
aaccaacagaatcatgtctc

SEQ ID NO: 7130331 - DNA, 20 bp, Homo sapiens
aaccaacagaatcatgtctc

SEQ ID NO: 7130332 - DNA, 22 bp, Homo sapiens
aaccaacaggagtggggattgg

SEQ ID NO: 7130333 - DNA, 22 bp, Homo sapiens
aataagaaagagtcagcttcag

SEQ ID NO: 7130334 - DNA, 22 bp, Homo sapiens
aataagaacaactaaggtttat

SEQ ID NO: 7130335 - DNA, 22 bp, Homo sapiens
aacatgtaaatatcattgtact

SEQ ID NO: 7130336 - DNA, 22 bp, Homo sapiens
aataacttcagttcttacatta

SEQ ID NO: 7130337 - DNA, 22 bp, Homo sapiens
aataacttcagttcttacatta

SEQ ID NO: 7130338 - DNA, 22 bp, Homo sapiens
aacatgctttgataaataaaag

SEQ ID NO: 7130339 - DNA, 22 bp, Homo sapiens
aacatgctttgataaataaaag

SEQ ID NO: 7130340 - DNA, 22 bp, Homo sapiens
aacatgctttgataaataaaag

SEQ ID NO: 7130341 - DNA, 22 bp, Homo sapiens
aacatgctttgataaataaaag

SEQ ID NO: 7130342 - DNA, 19 bp, Homo sapiens
aacatggaactggagaggg

SEQ ID NO: 7130343 - DNA, 19 bp, Homo sapiens
aacatggaactggagaggg

SEQ ID NO: 7130344 - DNA, 22 bp, Homo sapiens
aacatggaggcagacagacgtg

SEQ ID NO: 7130345 - DNA, 22 bp, Homo sapiens
aacatggctgcaatcctagagg

SEQ ID NO: 7130346 - DNA, 22 bp, Homo sapiens
aacatgtaaatatcattgtact

SEQ ID NO: 7130347 - DNA, 22 bp, Homo sapiens
aacatgtaaatatcattgtact

SEQ ID NO: 7130348 - DNA, 22 bp, Homo sapiens
aataacttcatgtaacatttaa

SEQ ID NO: 7130349 - DNA, 22 bp, Homo sapiens
aataacttgtatggttattcca

SEQ ID NO: 7130350 - DNA, 22 bp, Homo sapiens
aataacttgaagatctcttcca

SEQ ID NO: 7130351 - DNA, 22 bp, Homo sapiens
aacatgctgcctttctacgagt

SEQ ID NO: 7130352 - DNA, 22 bp, Homo sapiens
aacatgctgcctttctacgagt

SEQ ID NO: 7130353 - DNA, 22 bp, Homo sapiens
aacatgctcttcctggctagtc

SEQ ID NO: 7130354 - DNA, 22 bp, Homo sapiens
aacatgctgcctttctacgagt

SEQ ID NO: 7130355 - DNA, 22 bp, Homo sapiens
aacatgctgcctttctacgagt

SEQ ID NO: 7130356 - DNA, 22 bp, Homo sapiens
aacatgctgggtgtttttgatg

SEQ ID NO: 7130357 - DNA, 22 bp, Homo sapiens
aacatgctgggtgtttttgatg

SEQ ID NO: 7130358 - DNA, 22 bp, Homo sapiens
aacatgctgggtgtttttgatg

SEQ ID NO: 7130359 - DNA, 22 bp, Homo sapiens
aacatgctgggtgtttttgatg

SEQ ID NO: 7130360 - DNA, 22 bp, Homo sapiens
aacatgcttgcttagaatcagc

SEQ ID NO: 7130361 - DNA, 22 bp, Homo sapiens
aacatgcttgcttagaatcagc

SEQ ID NO: 7130362 - DNA, 22 bp, Homo sapiens
aacatgcttgcttagaatcagc

SEQ ID NO: 7130363 - DNA, 22 bp, Homo sapiens
aacatgctctgtttcttggatg

SEQ ID NO: 7130364 - DNA, 22 bp, Homo sapiens
aacatgctcttcctggctagtc

SEQ ID NO: 7130365 - DNA, 22 bp, Homo sapiens
aacatgctcttcctggctagtc

SEQ ID NO: 7130366 - DNA, 22 bp, Homo sapiens
aacatgctcttcctggctagtc

SEQ ID NO: 7130367 - DNA, 22 bp, Homo sapiens
aacatgctctggattgctgtga

SEQ ID NO: 7130368 - DNA, 22 bp, Homo sapiens
aacatgctctggattgctgtga

SEQ ID NO: 7130369 - DNA, 22 bp, Homo sapiens
aacatgctctgtttcttggatg

SEQ ID NO: 7130370 - DNA, 22 bp, Homo sapiens
aacatgctctgtttcttggatg

SEQ ID NO: 7130371 - DNA, 22 bp, Homo sapiens
aacatgcatgttatttatcagt

SEQ ID NO: 7130372 - DNA, 22 bp, Homo sapiens
aacatgcatgttatttatcagt

SEQ ID NO: 7130373 - DNA, 18 bp, Homo sapiens
aacatgcattagaactgc

SEQ ID NO: 7130374 - DNA, 18 bp, Homo sapiens
aacatgcattagaactgc

SEQ ID NO: 7130375 - DNA, 18 bp, Homo sapiens
aacatgcattagaactgc

SEQ ID NO: 7130376 - DNA, 22 bp, Homo sapiens
aacatgcatttgtgggatggaa

SEQ ID NO: 7130377 - DNA, 22 bp, Homo sapiens
aacatgcatttgtgggatggaa

SEQ ID NO: 7130378 - DNA, 22 bp, Homo sapiens
aacatgcccgctgtatgccatt

SEQ ID NO: 7130379 - DNA, 22 bp, Homo sapiens
aacatgctatgtgtctgaatca

SEQ ID NO: 7130380 - DNA, 22 bp, Homo sapiens
aacatgctatgtgtctgaatca

SEQ ID NO: 7130381 - DNA, 22 bp, Homo sapiens
aacatgctatgtgtctgaatca

SEQ ID NO: 7130382 - DNA, 22 bp, Homo sapiens
aacagtaaaaatcatttagttg

SEQ ID NO: 7130383 - DNA, 22 bp, Homo sapiens
aacagtaaaaatcatttagttg

SEQ ID NO: 7130384 - DNA, 22 bp, Homo sapiens
aacagtaaaaatcatttagttg

SEQ ID NO: 7130385 - DNA, 22 bp, Homo sapiens
aacaggtagggttttccttaga

SEQ ID NO: 7130386 - DNA, 22 bp, Homo sapiens
aacagtaaaaatcatttagttg

SEQ ID NO: 7130387 - DNA, 22 bp, Homo sapiens
aacaggtacagtttccctctgg

SEQ ID NO: 7130388 - DNA, 22 bp, Homo sapiens
aacaggtagggactctaacttg

SEQ ID NO: 7130389 - DNA, 22 bp, Homo sapiens
aacaggtagggactctaacttg

SEQ ID NO: 7130390 - DNA, 22 bp, Homo sapiens
aacaggtagggttttccttaga

SEQ ID NO: 7130391 - DNA, 22 bp, Homo sapiens
aacagggctttggaagtctccg

SEQ ID NO: 7130392 - DNA, 22 bp, Homo sapiens
aacagtaaagacagaatttatc

SEQ ID NO: 7130393 - DNA, 22 bp, Homo sapiens
aacatgaaacccaaacagaata

SEQ ID NO: 7130394 - DNA, 22 bp, Homo sapiens
aacatgaaacccaaacagaata

SEQ ID NO: 7130395 - DNA, 22 bp, Homo sapiens
aacatgaaacccaaacagaata

SEQ ID NO: 7130396 - DNA, 22 bp, Homo sapiens
aacatgaaacccaaacagaata

SEQ ID NO: 7130397 - DNA, 22 bp, Homo sapiens
aacatgcagattccccgggccc

SEQ ID NO: 7130398 - DNA, 22 bp, Homo sapiens
aacatgcaggttttagggttgc

SEQ ID NO: 7130399 - DNA, 22 bp, Homo sapiens
aacatgcagtgagccgatgagg

SEQ ID NO: 7130400 - DNA, 22 bp, Homo sapiens
aacatgcagtgagccgatgagg

SEQ ID NO: 7130401 - DNA, 22 bp, Homo sapiens
aacatgcatataggtaaatgga

SEQ ID NO: 7130402 - DNA, 22 bp, Homo sapiens
aacatgcatataggtaaatgga

SEQ ID NO: 7130403 - DNA, 22 bp, Homo sapiens
aacatgcatgaagaagttatat

SEQ ID NO: 7130404 - DNA, 22 bp, Homo sapiens
aacaggcactaagcatgtgggg

SEQ ID NO: 7130405 - DNA, 22 bp, Homo sapiens
aacaggcactaagcatgtgggg

SEQ ID NO: 7130406 - DNA, 22 bp, Homo sapiens
aacaggcaaactgtgggatccc

SEQ ID NO: 7130407 - DNA, 22 bp, Homo sapiens
aacaggcaatttaggactcttt

SEQ ID NO: 7130408 - DNA, 22 bp, Homo sapiens
aacaggcaatttaggactcttt

SEQ ID NO: 7130409 - DNA, 22 bp, Homo sapiens
aacaggcaacagttgactctga

SEQ ID NO: 7130410 - DNA, 22 bp, Homo sapiens
aacaggcaacagttgactctga

SEQ ID NO: 7130411 - DNA, 22 bp, Homo sapiens
aacaggcaacagttgactctga

SEQ ID NO: 7130412 - DNA, 22 bp, Homo sapiens
aacaggcaaactgtgggatccc

SEQ ID NO: 7130413 - DNA, 22 bp, Homo sapiens
aacaggcaacagttgactctga

SEQ ID NO: 7130414 - DNA, 22 bp, Homo sapiens
aacaggcaaactgtgggatccc

SEQ ID NO: 7130415 - DNA, 22 bp, Homo sapiens
aacaggagtcattgtcattatt

SEQ ID NO: 7130416 - DNA, 22 bp, Homo sapiens
aacaggagagtaaatatatgat

SEQ ID NO: 7130417 - DNA, 22 bp, Homo sapiens
aacaggagaggggaatgtagag

SEQ ID NO: 7130418 - DNA, 22 bp, Homo sapiens
aacaggagagtaaatatatgat

SEQ ID NO: 7130419 - DNA, 22 bp, Homo sapiens
aacaggaggccttccagtccag

SEQ ID NO: 7130420 - DNA, 22 bp, Homo sapiens
aacaggaattgatgggagtcct

SEQ ID NO: 7130421 - DNA, 22 bp, Homo sapiens
aacaggaattgcaggcagatct

SEQ ID NO: 7130422 - DNA, 22 bp, Homo sapiens
aacaggaattgcaggcagatct

SEQ ID NO: 7130423 - DNA, 22 bp, Homo sapiens
aacaggacatttcagaagcagg

SEQ ID NO: 7130424 - DNA, 22 bp, Homo sapiens
aacaggacatttcagaagcagg

SEQ ID NO: 7130425 - DNA, 22 bp, Homo sapiens
aacaggagaggggaatgtagag

SEQ ID NO: 7130426 - DNA, 22 bp, Homo sapiens
aacaggccctgccatttatcca

SEQ ID NO: 7130427 - DNA, 22 bp, Homo sapiens
aacaggcctatagggaaggcgc

SEQ ID NO: 7130428 - DNA, 22 bp, Homo sapiens
aacaggcaggagaattctgcct

SEQ ID NO: 7130429 - DNA, 22 bp, Homo sapiens
aacaggcactaagcatgtgggg

SEQ ID NO: 7130430 - DNA, 22 bp, Homo sapiens
aacaggcagcagactgaatctg

SEQ ID NO: 7130431 - DNA, 22 bp, Homo sapiens
aacaggctagttttaaagcata

SEQ ID NO: 7130432 - DNA, 22 bp, Homo sapiens
aacaggctcactctgacttcta

SEQ ID NO: 7130433 - DNA, 22 bp, Homo sapiens
aacaggcctcattccagctctc

SEQ ID NO: 7130434 - DNA, 22 bp, Homo sapiens
aacaggcttttggaaagttaca

SEQ ID NO: 7130435 - DNA, 22 bp, Homo sapiens
aacaggcttttggaaagttaca

SEQ ID NO: 7130436 - DNA, 20 bp, Homo sapiens
aacagggcagaagcggagac

SEQ ID NO: 7130437 - DNA, 20 bp, Homo sapiens
aacagggcagaagcggagac

SEQ ID NO: 7130438 - DNA, 20 bp, Homo sapiens
aacagggcagaagcggagac

SEQ ID NO: 7130439 - DNA, 20 bp, Homo sapiens
aacagggcagaagcggagac

SEQ ID NO: 7130440 - DNA, 22 bp, Homo sapiens
aacagggctttggaagtctccg

SEQ ID NO: 7130441 - DNA, 22 bp, Homo sapiens
aacaggctcttcatttccagag

SEQ ID NO: 7130442 - DNA, 22 bp, Homo sapiens
aacaggctcttcatttccagag

SEQ ID NO: 7130443 - DNA, 22 bp, Homo sapiens
aacaggctggccttgaagcagt

SEQ ID NO: 7130444 - DNA, 22 bp, Homo sapiens
aacaggctggccttgaagcagt

SEQ ID NO: 7130445 - DNA, 22 bp, Homo sapiens
aacaggctggccttgaagcagt

SEQ ID NO: 7130446 - DNA, 22 bp, Homo sapiens
aacaggctggccttgaagcagt

SEQ ID NO: 7130447 - DNA, 22 bp, Homo sapiens
aacaggcttccaggagggacga

SEQ ID NO: 7130448 - DNA, 22 bp, Homo sapiens
aagggagaaaacttgtggctta

SEQ ID NO: 7130449 - DNA, 22 bp, Homo sapiens
aagggagaaaacttgtggctta

SEQ ID NO: 7130450 - DNA, 22 bp, Homo sapiens
aagggagaaaacttgtggctta

SEQ ID NO: 7130451 - DNA, 22 bp, Homo sapiens
aagggagaaaacttgtggctta

SEQ ID NO: 7130452 - DNA, 22 bp, Homo sapiens
aagggagaaagaatgagtttag

SEQ ID NO: 7130453 - DNA, 22 bp, Homo sapiens
aagggcaggaaaagatggatgt

SEQ ID NO: 7130454 - DNA, 22 bp, Homo sapiens
aagggcaggaaaagatggatgt

SEQ ID NO: 7130455 - DNA, 22 bp, Homo sapiens
aagggacatagactgtacatct

SEQ ID NO: 7130456 - DNA, 22 bp, Homo sapiens
aagggactttgtcagctttcca

SEQ ID NO: 7130457 - DNA, 22 bp, Homo sapiens
aagggaaaatagttgatgacca

SEQ ID NO: 7130458 - DNA, 22 bp, Homo sapiens
aagggaaactttcacaatgtcc

SEQ ID NO: 7130459 - DNA, 22 bp, Homo sapiens
aagggaaactttcacaatgtcc

SEQ ID NO: 7130460 - DNA, 22 bp, Homo sapiens
aagggaaatcatatggtgcagt

SEQ ID NO: 7130461 - DNA, 22 bp, Homo sapiens
aagggaaatcatatggtgcagt

SEQ ID NO: 7130462 - DNA, 22 bp, Homo sapiens
aagggaaatcctcagcccagga

SEQ ID NO: 7130463 - DNA, 22 bp, Homo sapiens
aagggaaatcctcagcccagga

SEQ ID NO: 7130464 - DNA, 22 bp, Homo sapiens
aagggaaatggccaggcagaga

SEQ ID NO: 7130465 - DNA, 22 bp, Homo sapiens
aagggaaatggccaggcagaga

SEQ ID NO: 7130466 - DNA, 22 bp, Homo sapiens
aaggctttcagctaacttgatt

SEQ ID NO: 7130467 - DNA, 22 bp, Homo sapiens
aaggctttcctgtaggaagaca

SEQ ID NO: 7130468 - DNA, 22 bp, Homo sapiens
aaggctttcctgtaggaagaca

SEQ ID NO: 7130469 - DNA, 22 bp, Homo sapiens
aaggctttgaaaaccaaaaggt

SEQ ID NO: 7130470 - DNA, 22 bp, Homo sapiens
aaggctttgaaaaccaaaaggt

SEQ ID NO: 7130471 - DNA, 22 bp, Homo sapiens
aaggctttgtgggctgcaggca

SEQ ID NO: 7130472 - DNA, 22 bp, Homo sapiens
aaggcttttaatgagttagaga

SEQ ID NO: 7130473 - DNA, 22 bp, Homo sapiens
aaggcttttgggaattttcaac

SEQ ID NO: 7130474 - DNA, 22 bp, Homo sapiens
aaggcttttgttcctatttagt

SEQ ID NO: 7130475 - DNA, 22 bp, Homo sapiens
aaggctttttcactggtgactc

SEQ ID NO: 7130476 - DNA, 22 bp, Homo sapiens
aagggaaaatagttgatgacca

SEQ ID NO: 7130477 - DNA, 22 bp, Homo sapiens
aagggaaaatagttgatgacca

SEQ ID NO: 7130478 - DNA, 22 bp, Homo sapiens
aagggccattgctgagagcagt

SEQ ID NO: 7130479 - DNA, 22 bp, Homo sapiens
aagggccattgctgagagcagt

SEQ ID NO: 7130480 - DNA, 22 bp, Homo sapiens
aagggccattgctgagagcagt

SEQ ID NO: 7130481 - DNA, 22 bp, Homo sapiens
aagggcccagccaagctatgct

SEQ ID NO: 7130482 - DNA, 22 bp, Homo sapiens
aagggccataacttgcagtgtt

SEQ ID NO: 7130483 - DNA, 22 bp, Homo sapiens
aagggccataacttgcagtgtt

SEQ ID NO: 7130484 - DNA, 22 bp, Homo sapiens
aagggccatcccagaacagaaa

SEQ ID NO: 7130485 - DNA, 22 bp, Homo sapiens
aagggccatcccagaacagaaa

SEQ ID NO: 7130486 - DNA, 22 bp, Homo sapiens
aagggccacttactcctgctgt

SEQ ID NO: 7130487 - DNA, 22 bp, Homo sapiens
aagggcatgggatgaaaagtag

SEQ ID NO: 7130488 - DNA, 20 bp, Homo sapiens
aagggagaataatgattgta

SEQ ID NO: 7130489 - DNA, 22 bp, Homo sapiens
aagggcccattctctcagaaaa

SEQ ID NO: 7130490 - DNA, 22 bp, Homo sapiens
aagggcccttctgttagtggca

SEQ ID NO: 7130491 - DNA, 22 bp, Homo sapiens
aagggcccggctgtgggcagag

SEQ ID NO: 7130492 - DNA, 22 bp, Homo sapiens
aagggcctcctggggagcctgg

SEQ ID NO: 7130493 - DNA, 19 bp, Homo sapiens
aagggcctctgctgtcttc

SEQ ID NO: 7130494 - DNA, 22 bp, Homo sapiens
aagggccttgccaggtgaagag

SEQ ID NO: 7130495 - DNA, 22 bp, Homo sapiens
aagggccttgccaggtgaagag

SEQ ID NO: 7130496 - DNA, 22 bp, Homo sapiens
aagggcctttcaaaggtgatta

SEQ ID NO: 7130497 - DNA, 22 bp, Homo sapiens
aagggctcacccaactcacttc

SEQ ID NO: 7130498 - DNA, 22 bp, Homo sapiens
aagggctcacccaactcacttc

SEQ ID NO: 7130499 - DNA, 22 bp, Homo sapiens
aagggctccaagaggtagctgg

SEQ ID NO: 7130500 - DNA, 22 bp, Homo sapiens
aagggctctgttgccatttcag

SEQ ID NO: 7130501 - DNA, 22 bp, Homo sapiens
aagggctctgtgtgcctcccca

SEQ ID NO: 7130502 - DNA, 22 bp, Homo sapiens
aagggctctgtgtgcctcccca

SEQ ID NO: 7130503 - DNA, 22 bp, Homo sapiens
aagggctctgtgcttgtcccat

SEQ ID NO: 7130504 - DNA, 22 bp, Homo sapiens
aagggctctgggctacgcactg

SEQ ID NO: 7130505 - DNA, 22 bp, Homo sapiens
aagggctctgggctacgcactg

SEQ ID NO: 7130506 - DNA, 22 bp, Homo sapiens
aagggctccaagaggtagctgg

SEQ ID NO: 7130507 - DNA, 22 bp, Homo sapiens
aagggctccacttgaatcacac

SEQ ID NO: 7130508 - DNA, 22 bp, Homo sapiens
aagggctccatccttataaatg

SEQ ID NO: 7130509 - DNA, 22 bp, Homo sapiens
aagggctcccaactcatctttt

SEQ ID NO: 7130510 - DNA, 22 bp, Homo sapiens
aagggctccctgcctgaggtgg

SEQ ID NO: 7130511 - DNA, 22 bp, Homo sapiens
aagggctcggtagcagtcctga

SEQ ID NO: 7130512 - DNA, 22 bp, Homo sapiens
aagggctctctgcattgaaatt

SEQ ID NO: 7130513 - DNA, 22 bp, Homo sapiens
aagggctctgctgtctctcccc

SEQ ID NO: 7130514 - DNA, 22 bp, Homo sapiens
aaggctgcctctgccagaggag

SEQ ID NO: 7130515 - DNA, 22 bp, Homo sapiens
aaggctgattagactgatagct

SEQ ID NO: 7130516 - DNA, 16 bp, Homo sapiens
aaggctgattttccct

SEQ ID NO: 7130517 - DNA, 22 bp, Homo sapiens
acatgtgtacttttaaggatgt

SEQ ID NO: 7130518 - DNA, 22 bp, Homo sapiens
aaggctgcttttaacatgcata

SEQ ID NO: 7130519 - DNA, 22 bp, Homo sapiens
acatgtgtacatatatatgtgc

SEQ ID NO: 7130520 - DNA, 22 bp, Homo sapiens
aaggctgagtaaaacagagaac

SEQ ID NO: 7130521 - DNA, 22 bp, Homo sapiens
aaggctgagtaaaacagagaac

SEQ ID NO: 7130522 - DNA, 22 bp, Homo sapiens
aaggctgattagactgatagct

SEQ ID NO: 7130523 - DNA, 22 bp, Homo sapiens
aaggctgagggctgtacctggc

SEQ ID NO: 7130524 - DNA, 22 bp, Homo sapiens
aaggctgaggtagggcctaaaa

SEQ ID NO: 7130525 - DNA, 22 bp, Homo sapiens
aaggctgagggctgtacctggc

SEQ ID NO: 7130526 - DNA, 22 bp, Homo sapiens
aaggctgaggcagtgaggcaga

SEQ ID NO: 7130527 - DNA, 22 bp, Homo sapiens
aaggctgaggagggcctgcagg

SEQ ID NO: 7130528 - DNA, 22 bp, Homo sapiens
aaggctgaggcagtgaggcaga

SEQ ID NO: 7130529 - DNA, 22 bp, Homo sapiens
aaggctgaaagaccttgaacct

SEQ ID NO: 7130530 - DNA, 22 bp, Homo sapiens
aaggctgaggagggcctgcagg

SEQ ID NO: 7130531 - DNA, 22 bp, Homo sapiens
aaggcatgatgtaatcaatgat

SEQ ID NO: 7130532 - DNA, 22 bp, Homo sapiens
aaggcatctggatggaggagga

SEQ ID NO: 7130533 - DNA, 22 bp, Homo sapiens
aaggcatctggatggaggagga

SEQ ID NO: 7130534 - DNA, 22 bp, Homo sapiens
aaggcatggcagggtttacaca

SEQ ID NO: 7130535 - DNA, 22 bp, Homo sapiens
aaggcttggtctagtcatgcca

SEQ ID NO: 7130536 - DNA, 22 bp, Homo sapiens
aaggcttgtgtgttcagtgagg

SEQ ID NO: 7130537 - DNA, 22 bp, Homo sapiens
aaggctttaaataaccgtaaag

SEQ ID NO: 7130538 - DNA, 22 bp, Homo sapiens
aaggctttatgactccagtgga

SEQ ID NO: 7130539 - DNA, 22 bp, Homo sapiens
aaggctttatgtgaccaaaaga

SEQ ID NO: 7130540 - DNA, 22 bp, Homo sapiens
aaggctttatgtgaccaaaaga

SEQ ID NO: 7130541 - DNA, 22 bp, Homo sapiens
aaggctgtgtcagaagctccct

SEQ ID NO: 7130542 - DNA, 22 bp, Homo sapiens
aaggctgtcttttcctcttccc

SEQ ID NO: 7130543 - DNA, 22 bp, Homo sapiens
aaggctgtgtcagaagctccct

SEQ ID NO: 7130544 - DNA, 22 bp, Homo sapiens
aaggctgtccaggagaaaatag

SEQ ID NO: 7130545 - DNA, 22 bp, Homo sapiens
aaggctgtcttttcctcttccc

SEQ ID NO: 7130546 - DNA, 18 bp, Homo sapiens
aaggcttcaaagagtaga

SEQ ID NO: 7130547 - DNA, 22 bp, Homo sapiens
aaggctggtttccttgatgttt

SEQ ID NO: 7130548 - DNA, 22 bp, Homo sapiens
aaggctggggtgcagacggcct

SEQ ID NO: 7130549 - DNA, 22 bp, Homo sapiens
aaggctggtttccttgatgttt

SEQ ID NO: 7130550 - DNA, 22 bp, Homo sapiens
aaggctgggaaacatgcaggcc

SEQ ID NO: 7130551 - DNA, 22 bp, Homo sapiens
acatgtgtgtatacgtatttat

SEQ ID NO: 7130552 - DNA, 22 bp, Homo sapiens
acatgtgtggacatgaatctac

SEQ ID NO: 7130553 - DNA, 22 bp, Homo sapiens
acatgtgtggacatgaatctac

SEQ ID NO: 7130554 - DNA, 22 bp, Homo sapiens
acatgtgtggacatgaatctac

SEQ ID NO: 7130555 - DNA, 22 bp, Homo sapiens
acatgtgtggccgctgtagaca

SEQ ID NO: 7130556 - DNA, 22 bp, Homo sapiens
acatgtgtgacaacagaggtga

SEQ ID NO: 7130557 - DNA, 22 bp, Homo sapiens
acatgtgtctaagaatgaaaga

SEQ ID NO: 7130558 - DNA, 22 bp, Homo sapiens
acatgtgtatagcctgtataga

SEQ ID NO: 7130559 - DNA, 22 bp, Homo sapiens
aaggtagggatgtattcagctt

SEQ ID NO: 7130560 - DNA, 22 bp, Homo sapiens
aaggtagattctggatcgaagg

SEQ ID NO: 7130561 - DNA, 22 bp, Homo sapiens
aagggctgatctcactttcttt

SEQ ID NO: 7130562 - DNA, 22 bp, Homo sapiens
aagggctgatctcactttcttt

SEQ ID NO: 7130563 - DNA, 22 bp, Homo sapiens
aagggctgagcacagtgagcca

SEQ ID NO: 7130564 - DNA, 22 bp, Homo sapiens
aaggtagattctggatcgaagg

SEQ ID NO: 7130565 - DNA, 22 bp, Homo sapiens
aagggctgagcacagtgagcca

SEQ ID NO: 7130566 - DNA, 22 bp, Homo sapiens
aagggctgagcacagtgagcca

SEQ ID NO: 7130567 - DNA, 22 bp, Homo sapiens
aagggctgagcacagtgagcca

SEQ ID NO: 7130568 - DNA, 22 bp, Homo sapiens
aagggctgagaagtggggctgg

SEQ ID NO: 7130569 - DNA, 22 bp, Homo sapiens
aagggctgagcacagtgagcca

SEQ ID NO: 7130570 - DNA, 22 bp, Homo sapiens
aagggctgagaagtggggctgg

SEQ ID NO: 7130571 - DNA, 22 bp, Homo sapiens
aagggctgagaagtggggctgg

SEQ ID NO: 7130572 - DNA, 22 bp, Homo sapiens
aagggctgaatgaagggttgaa

SEQ ID NO: 7130573 - DNA, 22 bp, Homo sapiens
aagggctgaatgaagggttgaa

SEQ ID NO: 7130574 - DNA, 22 bp, Homo sapiens
aagggctgaatgaagggttgaa

SEQ ID NO: 7130575 - DNA, 22 bp, Homo sapiens
aagggctgaaagaccttgggca

SEQ ID NO: 7130576 - DNA, 22 bp, Homo sapiens
aagggctgaaagaccttgggca

SEQ ID NO: 7130577 - DNA, 22 bp, Homo sapiens
aagggctcttctatttatggcc

SEQ ID NO: 7130578 - DNA, 18 bp, Homo sapiens
aaggtctgtctggtaggt

SEQ ID NO: 7130579 - DNA, 22 bp, Homo sapiens
aaggtaggttaacctgcaggag

SEQ ID NO: 7130580 - DNA, 22 bp, Homo sapiens
aaggtcttatctccaaatacag

SEQ ID NO: 7130581 - DNA, 22 bp, Homo sapiens
aaggtgaaactggaagctggcc

SEQ ID NO: 7130582 - DNA, 22 bp, Homo sapiens
aaggtgaaactggaagctggcc

SEQ ID NO: 7130583 - DNA, 22 bp, Homo sapiens
aaggtgaactggtaatgacaga

SEQ ID NO: 7130584 - DNA, 22 bp, Homo sapiens
aaggtgaagctcccgatgagaa

SEQ ID NO: 7130585 - DNA, 22 bp, Homo sapiens
aaggtgaagctcccgatgagaa

SEQ ID NO: 7130586 - DNA, 17 bp, Homo sapiens
aaggtgagagctgttct

SEQ ID NO: 7130587 - DNA, 22 bp, Homo sapiens
aaggtgagagggaaattttcca

SEQ ID NO: 7130588 - DNA, 22 bp, Homo sapiens
aaggtgaggattttgttctgct

SEQ ID NO: 7130589 - DNA, 22 bp, Homo sapiens
aaggtggaggttgcagtgagct

SEQ ID NO: 7130590 - DNA, 22 bp, Homo sapiens
accatgttggccaagctggtct

SEQ ID NO: 7130591 - DNA, 22 bp, Homo sapiens
accatgttggccaagctggtct

SEQ ID NO: 7130592 - DNA, 23 bp, Homo sapiens
aagtaacagggataatagcagtt

SEQ ID NO: 7130593 - DNA, 23 bp, Homo sapiens
aagtaacagggataatagcagtt

SEQ ID NO: 7130594 - DNA, 23 bp, Homo sapiens
aagtaacagggataatagcagtt

SEQ ID NO: 7130595 - DNA, 22 bp, Homo sapiens
aagtacagaatcattggaagca

SEQ ID NO: 7130596 - DNA, 22 bp, Homo sapiens
accatgccagtggcagccagac

SEQ ID NO: 7130597 - DNA, 22 bp, Homo sapiens
accatgcatcagttaaaaggag

SEQ ID NO: 7130598 - DNA, 22 bp, Homo sapiens
accatgccagtggcagccagac

SEQ ID NO: 7130599 - DNA, 22 bp, Homo sapiens
accatgctaaaacatgctgcta

SEQ ID NO: 7130600 - DNA, 22 bp, Homo sapiens
accatgggtcagccacctcagc

SEQ ID NO: 7130601 - DNA, 22 bp, Homo sapiens
accatggaccatagttcctatt

SEQ ID NO: 7130602 - DNA, 22 bp, Homo sapiens
accatgaggaaatacatttgtg

SEQ ID NO: 7130603 - DNA, 22 bp, Homo sapiens
accatgagttatttgacaggcc

SEQ ID NO: 7130604 - DNA, 22 bp, Homo sapiens
accatgcacagctgttctatta

SEQ ID NO: 7130605 - DNA, 22 bp, Homo sapiens
accatgcaggctattttcaaat

SEQ ID NO: 7130606 - DNA, 22 bp, Homo sapiens
accatgcaggctattttcaaat

SEQ ID NO: 7130607 - DNA, 22 bp, Homo sapiens
accatgcaggctattttcaaat

SEQ ID NO: 7130608 - DNA, 22 bp, Homo sapiens
accatgcatcaaagctaatata

SEQ ID NO: 7130609 - DNA, 22 bp, Homo sapiens
aaggtgggcagatcacaaggtc

SEQ ID NO: 7130610 - DNA, 22 bp, Homo sapiens
aaggtggcgctggagctggtcc

SEQ ID NO: 7130611 - DNA, 22 bp, Homo sapiens
aaggtggcatgtcccctggcca

SEQ ID NO: 7130612 - DNA, 22 bp, Homo sapiens
aaggtggcatgtcccctggcca

SEQ ID NO: 7130613 - DNA, 22 bp, Homo sapiens
aaggtggggtcctgtcatctga

SEQ ID NO: 7130614 - DNA, 22 bp, Homo sapiens
aaggtggggtcctgtcatctga

SEQ ID NO: 7130615 - DNA, 22 bp, Homo sapiens
aaggtggggtcctgtcatctga

SEQ ID NO: 7130616 - DNA, 22 bp, Homo sapiens
aaggtgggtggatcacgaggtc

SEQ ID NO: 7130617 - DNA, 22 bp, Homo sapiens
aaggtgggtggatcacgaggtc

SEQ ID NO: 7130618 - DNA, 22 bp, Homo sapiens
aaggtggtaatagtgcaggatt

SEQ ID NO: 7130619 - DNA, 22 bp, Homo sapiens
aaggtggtaggctatatcagta

SEQ ID NO: 7130620 - DNA, 22 bp, Homo sapiens
accatcttagtggccagctctc

SEQ ID NO: 7130621 - DNA, 21 bp, Homo sapiens
accatcttccatgcattatat

SEQ ID NO: 7130622 - DNA, 22 bp, Homo sapiens
accatcttttcctctgcctcct

SEQ ID NO: 7130623 - DNA, 22 bp, Homo sapiens
aaggtggtcttactgatggtat

SEQ ID NO: 7130624 - DNA, 22 bp, Homo sapiens
accatccaaactgctttctgtg

SEQ ID NO: 7130625 - DNA, 22 bp, Homo sapiens
accatctgagtagagagaagta

SEQ ID NO: 7130626 - DNA, 22 bp, Homo sapiens
aagtatgacatttaagacaatt

SEQ ID NO: 7130627 - DNA, 22 bp, Homo sapiens
aagtcaatcacatgcacactga

SEQ ID NO: 7130628 - DNA, 22 bp, Homo sapiens
aagtatgaatcaaagactatct

SEQ ID NO: 7130629 - DNA, 22 bp, Homo sapiens
aagtatgaatcaaagactatct

SEQ ID NO: 7130630 - DNA, 22 bp, Homo sapiens
aagtatgaatcaaagactatct

SEQ ID NO: 7130631 - DNA, 22 bp, Homo sapiens
acccccacggaaggccgtacgc

SEQ ID NO: 7130632 - DNA, 22 bp, Homo sapiens
accccccagataatcccttgag

SEQ ID NO: 7130633 - DNA, 22 bp, Homo sapiens
acccccttcgcacactctttca

SEQ ID NO: 7130634 - DNA, 22 bp, Homo sapiens
aagtatcttggaaaactcttct

SEQ ID NO: 7130635 - DNA, 22 bp, Homo sapiens
aagtcacaaagtgctgtacatg

SEQ ID NO: 7130636 - DNA, 22 bp, Homo sapiens
aagtcacaaagtgctgtacatg

SEQ ID NO: 7130637 - DNA, 22 bp, Homo sapiens
aagtcacaagcatatatgcatt

SEQ ID NO: 7130638 - DNA, 22 bp, Homo sapiens
aagtcacaagcatatatgcatt

SEQ ID NO: 7130639 - DNA, 22 bp, Homo sapiens
aagtcacaagcatatatgcatt

SEQ ID NO: 7130640 - DNA, 22 bp, Homo sapiens
aagtcacacagttaacatgagg

SEQ ID NO: 7130641 - DNA, 22 bp, Homo sapiens
aagtcacactagacaactgagg

SEQ ID NO: 7130642 - DNA, 22 bp, Homo sapiens
aagtcacactagacaactgagg

SEQ ID NO: 7130643 - DNA, 20 bp, Homo sapiens
accccagtgtgtgcctcaag

SEQ ID NO: 7130644 - DNA, 22 bp, Homo sapiens
acccccaaacatcaagggctga

SEQ ID NO: 7130645 - DNA, 22 bp, Homo sapiens
acccccaaacatgatcatggtg

SEQ ID NO: 7130646 - DNA, 22 bp, Homo sapiens
acccccaaacatgatcatggtg

SEQ ID NO: 7130647 - DNA, 22 bp, Homo sapiens
acccccaaacatgatcatggtg

SEQ ID NO: 7130648 - DNA, 22 bp, Homo sapiens
acccccaagaggggccttcagc

SEQ ID NO: 7130649 - DNA, 22 bp, Homo sapiens
acccccaagaggggccttcagc

SEQ ID NO: 7130650 - DNA, 21 bp, Homo sapiens
acccccacacctccttagttc

SEQ ID NO: 7130651 - DNA, 22 bp, Homo sapiens
accccaggtctccaggctctgg

SEQ ID NO: 7130652 - DNA, 22 bp, Homo sapiens
accccaggtccaggttacagag

SEQ ID NO: 7130653 - DNA, 22 bp, Homo sapiens
accccaggtcatctgagagtcc

SEQ ID NO: 7130654 - DNA, 22 bp, Homo sapiens
accccaggtcatctgagagtcc

SEQ ID NO: 7130655 - DNA, 22 bp, Homo sapiens
accccagggctgccagcctcct

SEQ ID NO: 7130656 - DNA, 22 bp, Homo sapiens
accccagggctgccagcctcct

SEQ ID NO: 7130657 - DNA, 22 bp, Homo sapiens
accccaggcccagggaagaggc

SEQ ID NO: 7130658 - DNA, 22 bp, Homo sapiens
accccaggcccagggaagaggc

SEQ ID NO: 7130659 - DNA, 22 bp, Homo sapiens
accccaggcccagggaagaggc

SEQ ID NO: 7130660 - DNA, 23 bp, Homo sapiens
accccaggcatcgcattcctctt

SEQ ID NO: 7130661 - DNA, 23 bp, Homo sapiens
accccaggcatcgcattcctctt

SEQ ID NO: 7130662 - DNA, 22 bp, Homo sapiens
aagtagaatctcaggtaggcta

SEQ ID NO: 7130663 - DNA, 22 bp, Homo sapiens
accccaggaagtggaggtcatg

SEQ ID NO: 7130664 - DNA, 22 bp, Homo sapiens
accccaggagctgtgcctagtc

SEQ ID NO: 7130665 - DNA, 22 bp, Homo sapiens
aagtagaaaaccgcactggact

SEQ ID NO: 7130666 - DNA, 22 bp, Homo sapiens
aagtacttgatagattaactgt

SEQ ID NO: 7130667 - DNA, 22 bp, Homo sapiens
aagtacttgatagattaactgt

SEQ ID NO: 7130668 - DNA, 22 bp, Homo sapiens
aagtacttgatagattaactgt

SEQ ID NO: 7130669 - DNA, 22 bp, Homo sapiens
aagtactttaggatatgtaact

SEQ ID NO: 7130670 - DNA, 22 bp, Homo sapiens
aagtacatttttaacttacagc

SEQ ID NO: 7130671 - DNA, 22 bp, Homo sapiens
aagtacatttttaacttacagc

SEQ ID NO: 7130672 - DNA, 22 bp, Homo sapiens
aagtacatttttaacttacagc

SEQ ID NO: 7130673 - DNA, 22 bp, Homo sapiens
aagtaccattcaaatgcaaata

SEQ ID NO: 7130674 - DNA, 22 bp, Homo sapiens
aagtacttaaatggccatgtca

SEQ ID NO: 7130675 - DNA, 22 bp, Homo sapiens
aagtacttaaatggccatgtca

SEQ ID NO: 7130676 - DNA, 22 bp, Homo sapiens
aagtacttctagatggataatc

SEQ ID NO: 7130677 - DNA, 22 bp, Homo sapiens
aagtacttctagatggataatc

SEQ ID NO: 7130678 - DNA, 22 bp, Homo sapiens
aagtacatatatttatgattct

SEQ ID NO: 7130679 - DNA, 22 bp, Homo sapiens
aagtacatatatttatgattct

SEQ ID NO: 7130680 - DNA, 22 bp, Homo sapiens
aagtacatcaaatgtttggcta

SEQ ID NO: 7130681 - DNA, 22 bp, Homo sapiens
aagtacatcctagtctctttca

SEQ ID NO: 7130682 - DNA, 22 bp, Homo sapiens
aagtacagattcctagtgagat

SEQ ID NO: 7130683 - DNA, 22 bp, Homo sapiens
aagtacagccagcacccagact

SEQ ID NO: 7130684 - DNA, 22 bp, Homo sapiens
aagtacagattcctagtgagat

SEQ ID NO: 7130685 - DNA, 22 bp, Homo sapiens
aagtacagccagcacccagact

SEQ ID NO: 7130686 - DNA, 22 bp, Homo sapiens
aagtacagccttcattctcatg

SEQ ID NO: 7130687 - DNA, 22 bp, Homo sapiens
aagtacataaaggaattagcca

SEQ ID NO: 7130688 - DNA, 22 bp, Homo sapiens
aagtacataaaggaattagcca

SEQ ID NO: 7130689 - DNA, 23 bp, Homo sapiens
aagtacatatatttagatagtga

SEQ ID NO: 7130690 - DNA, 23 bp, Homo sapiens
aagtacatatatttagatagtga

SEQ ID NO: 7130691 - DNA, 22 bp, Homo sapiens
aagtacatgctgtaatgattgg

SEQ ID NO: 7130692 - DNA, 22 bp, Homo sapiens
aagtacatgctgtaatgattgg

SEQ ID NO: 7130693 - DNA, 22 bp, Homo sapiens
aagtacatgctgtaatgattgg

SEQ ID NO: 7130694 - DNA, 22 bp, Homo sapiens
aagtacatgctttattcagagt

SEQ ID NO: 7130695 - DNA, 22 bp, Homo sapiens
aagtacatgctttattcagagt

SEQ ID NO: 7130696 - DNA, 22 bp, Homo sapiens
aagtacatgctttattcagagt

SEQ ID NO: 7130697 - DNA, 22 bp, Homo sapiens
aagtacatggaggatagctgct

SEQ ID NO: 7130698 - DNA, 22 bp, Homo sapiens
aagtacatggaggatagctgct

SEQ ID NO: 7130699 - DNA, 22 bp, Homo sapiens
aagtacatgttgctcaacagcc

SEQ ID NO: 7130700 - DNA, 22 bp, Homo sapiens
aagtacatgttgctcaacagcc

SEQ ID NO: 7130701 - DNA, 22 bp, Homo sapiens
aagtacatgttgctcaacagcc

SEQ ID NO: 7130702 - DNA, 22 bp, Homo sapiens
aagtacatgttgctcaacagcc

SEQ ID NO: 7130703 - DNA, 22 bp, Homo sapiens
aagtacatgttgttcaaaagcc

SEQ ID NO: 7130704 - DNA, 22 bp, Homo sapiens
aagtacatgttgttcaaaagcc

SEQ ID NO: 7130705 - DNA, 22 bp, Homo sapiens
aagtacatgttgttcaaaagcc

SEQ ID NO: 7130706 - DNA, 22 bp, Homo sapiens
aagtacattatatgagcagaat

SEQ ID NO: 7130707 - DNA, 22 bp, Homo sapiens
acaggtgttgaatgatgtcaca

SEQ ID NO: 7130708 - DNA, 22 bp, Homo sapiens
acagtacagctaatgtcattag

SEQ ID NO: 7130709 - DNA, 22 bp, Homo sapiens
acaggtgtgttcccggaaagcc

SEQ ID NO: 7130710 - DNA, 22 bp, Homo sapiens
acagggcttagtggaaattttt

SEQ ID NO: 7130711 - DNA, 22 bp, Homo sapiens
acagggcttagaaatctgttgc

SEQ ID NO: 7130712 - DNA, 23 bp, Homo sapiens
acagggctgtccagggctaggtc

SEQ ID NO: 7130713 - DNA, 23 bp, Homo sapiens
acagggctgtccagggctaggtc

SEQ ID NO: 7130714 - DNA, 23 bp, Homo sapiens
acagggctgtccagggctaggtc

SEQ ID NO: 7130715 - DNA, 22 bp, Homo sapiens
acagtacagctgaaactttagt

SEQ ID NO: 7130716 - DNA, 22 bp, Homo sapiens
acagtacataatcctgagtctg

SEQ ID NO: 7130717 - DNA, 22 bp, Homo sapiens
acagtacataatcctgagtctg

SEQ ID NO: 7130718 - DNA, 22 bp, Homo sapiens
acagtacatagatctctaccct

SEQ ID NO: 7130719 - DNA, 22 bp, Homo sapiens
acagtacatagatctctaccct

SEQ ID NO: 7130720 - DNA, 22 bp, Homo sapiens
acagtactaagtgctcacatga

SEQ ID NO: 7130721 - DNA, 22 bp, Homo sapiens
acagggctggcgttgggacaga

SEQ ID NO: 7130722 - DNA, 22 bp, Homo sapiens
acagggctggggaaagaggcta

SEQ ID NO: 7130723 - DNA, 22 bp, Homo sapiens
acagggctggggcacttggctg

SEQ ID NO: 7130724 - DNA, 22 bp, Homo sapiens
acagggctggggaaagaggcta

SEQ ID NO: 7130725 - DNA, 22 bp, Homo sapiens
acagggctggggaaagaggcta

SEQ ID NO: 7130726 - DNA, 23 bp, Homo sapiens
acagggctggcagctgcaagacc

SEQ ID NO: 7130727 - DNA, 23 bp, Homo sapiens
acagggctggcagctgcaagacc

SEQ ID NO: 7130728 - DNA, 23 bp, Homo sapiens
acagggctggcagctgcaagacc

SEQ ID NO: 7130729 - DNA, 23 bp, Homo sapiens
acagggctggcagctgcaagacc

SEQ ID NO: 7130730 - DNA, 22 bp, Homo sapiens
acagggctgaggctggcttctt

SEQ ID NO: 7130731 - DNA, 22 bp, Homo sapiens
acagggctctgacaccaaggta

SEQ ID NO: 7130732 - DNA, 19 bp, Homo sapiens
acagggctctggacgccat

SEQ ID NO: 7130733 - DNA, 22 bp, Homo sapiens
acagggctccttgggctgacac

SEQ ID NO: 7130734 - DNA, 22 bp, Homo sapiens
acagggctcctaggtggtgtgc

SEQ ID NO: 7130735 - DNA, 22 bp, Homo sapiens
acagggctccttgggctgacac

SEQ ID NO: 7130736 - DNA, 22 bp, Homo sapiens
acagggctcctaggtggtgtgc

SEQ ID NO: 7130737 - DNA, 22 bp, Homo sapiens
acagggctcccagcaggtctgt

SEQ ID NO: 7130738 - DNA, 22 bp, Homo sapiens
aaggaaagacatataaatgact

SEQ ID NO: 7130739 - DNA, 22 bp, Homo sapiens
aaggaaagacatataaatgact

SEQ ID NO: 7130740 - DNA, 22 bp, Homo sapiens
aaggaaagacatataaatgact

SEQ ID NO: 7130741 - DNA, 22 bp, Homo sapiens
acaggccagaggtggggcagcc

SEQ ID NO: 7130742 - DNA, 22 bp, Homo sapiens
aagctttaagtgtcagtcagcc

SEQ ID NO: 7130743 - DNA, 22 bp, Homo sapiens
acaggcatccaggactaggcct

SEQ ID NO: 7130744 - DNA, 22 bp, Homo sapiens
acaggccacagtggagtctctg

SEQ ID NO: 7130745 - DNA, 22 bp, Homo sapiens
aaggaaaggatgagcatgcatt

SEQ ID NO: 7130746 - DNA, 22 bp, Homo sapiens
aaggaaagctgtggttctgaga

SEQ ID NO: 7130747 - DNA, 22 bp, Homo sapiens
aaggaaagctgtggttctgaga

SEQ ID NO: 7130748 - DNA, 22 bp, Homo sapiens
aaggaaagattctctctctaga

SEQ ID NO: 7130749 - DNA, 22 bp, Homo sapiens
aaggaaagattctctctctaga

SEQ ID NO: 7130750 - DNA, 22 bp, Homo sapiens
aaggaaagagtatgcaccttgt

SEQ ID NO: 7130751 - DNA, 22 bp, Homo sapiens
aaggaaagattctctctctaga

SEQ ID NO: 7130752 - DNA, 22 bp, Homo sapiens
aaggaaagattctctctctaga

SEQ ID NO: 7130753 - DNA, 22 bp, Homo sapiens
aaggaaagattctctctctaga

SEQ ID NO: 7130754 - DNA, 22 bp, Homo sapiens
aaggaaaggatgagcatgcatt

SEQ ID NO: 7130755 - DNA, 22 bp, Homo sapiens
aaggaaaggatgagcatgcatt

SEQ ID NO: 7130756 - DNA, 22 bp, Homo sapiens
aaggaaatacttctgcagagca

SEQ ID NO: 7130757 - DNA, 22 bp, Homo sapiens
aaggaaatagatgcagatggta

SEQ ID NO: 7130758 - DNA, 22 bp, Homo sapiens
aagccagggtcaggggcctcct

SEQ ID NO: 7130759 - DNA, 22 bp, Homo sapiens
aagccagggtcaggggcctcct

SEQ ID NO: 7130760 - DNA, 22 bp, Homo sapiens
aagccagggtcagaatttgggc

SEQ ID NO: 7130761 - DNA, 22 bp, Homo sapiens
aagccagggtcaggggcctcct

SEQ ID NO: 7130762 - DNA, 22 bp, Homo sapiens
aagccagggtcaggggcctcct

SEQ ID NO: 7130763 - DNA, 22 bp, Homo sapiens
aagccagggtcaggggcctcct

SEQ ID NO: 7130764 - DNA, 22 bp, Homo sapiens
aagccagggattcctgagggag

SEQ ID NO: 7130765 - DNA, 22 bp, Homo sapiens
aagccagggattcctgagggag

SEQ ID NO: 7130766 - DNA, 22 bp, Homo sapiens
aagccaggggctgcttaggaga

SEQ ID NO: 7130767 - DNA, 22 bp, Homo sapiens
aagccaggggttggtatgctat

SEQ ID NO: 7130768 - DNA, 22 bp, Homo sapiens
aagccaggggttggtatgctat

SEQ ID NO: 7130769 - DNA, 22 bp, Homo sapiens
aagccaggctgcacttgctggg

SEQ ID NO: 7130770 - DNA, 22 bp, Homo sapiens
aagccaggccattctctggttc

SEQ ID NO: 7130771 - DNA, 22 bp, Homo sapiens
aagccaggccattctctggttc

SEQ ID NO: 7130772 - DNA, 22 bp, Homo sapiens
aagccaggctgcacttgctggg

SEQ ID NO: 7130773 - DNA, 22 bp, Homo sapiens
aagccaggctgcacttgctggg

SEQ ID NO: 7130774 - DNA, 22 bp, Homo sapiens
aagccaggccattctctggttc

SEQ ID NO: 7130775 - DNA, 22 bp, Homo sapiens
aagccaggctgcacttgctggg

SEQ ID NO: 7130776 - DNA, 22 bp, Homo sapiens
aagccaggctgcacttgctggg

SEQ ID NO: 7130777 - DNA, 22 bp, Homo sapiens
aagccagggatggaatgatagg

SEQ ID NO: 7130778 - DNA, 22 bp, Homo sapiens
aagccagggatggaatgatagg

SEQ ID NO: 7130779 - DNA, 22 bp, Homo sapiens
aagccagggatggaatgatagg

SEQ ID NO: 7130780 - DNA, 22 bp, Homo sapiens
aagccagggattcctgagggag

SEQ ID NO: 7130781 - DNA, 22 bp, Homo sapiens
aagccagggattcctgagggag

SEQ ID NO: 7130782 - DNA, 22 bp, Homo sapiens
aagccagggattcctgagggag

SEQ ID NO: 7130783 - DNA, 22 bp, Homo sapiens
aagccagggattcctgagggag

SEQ ID NO: 7130784 - DNA, 22 bp, Homo sapiens
aagccagggtttgtggatctat

SEQ ID NO: 7130785 - DNA, 22 bp, Homo sapiens
aagccagggtttgtggatctat

SEQ ID NO: 7130786 - DNA, 18 bp, Homo sapiens
aagccaggtcaagataag

SEQ ID NO: 7130787 - DNA, 18 bp, Homo sapiens
aagccaggtcaagataag

SEQ ID NO: 7130788 - DNA, 18 bp, Homo sapiens
aagccaggtcaagataag

SEQ ID NO: 7130789 - DNA, 18 bp, Homo sapiens
aagccaggtcaagataag

SEQ ID NO: 7130790 - DNA, 22 bp, Homo sapiens
aagccaggtgtgcccaggatcc

SEQ ID NO: 7130791 - DNA, 22 bp, Homo sapiens
aagccaggtgtgcccaggatcc

SEQ ID NO: 7130792 - DNA, 22 bp, Homo sapiens
aagccaggtgttgtggtaagag

SEQ ID NO: 7130793 - DNA, 22 bp, Homo sapiens
aagccaggtgttgtggtaagag

SEQ ID NO: 7130794 - DNA, 22 bp, Homo sapiens
aagccaggtgttgtggtaagag

SEQ ID NO: 7130795 - DNA, 22 bp, Homo sapiens
aagccaggtgtttaggccagcg

SEQ ID NO: 7130796 - DNA, 22 bp, Homo sapiens
aagccaggtgtttaggccagcg

SEQ ID NO: 7130797 - DNA, 22 bp, Homo sapiens
aagccaggtgtttaggccagcg

SEQ ID NO: 7130798 - DNA, 22 bp, Homo sapiens
aagccaggtgtttaggccagcg

SEQ ID NO: 7130799 - DNA, 22 bp, Homo sapiens
aagccaggtgtttaggccagcg

SEQ ID NO: 7130800 - DNA, 22 bp, Homo sapiens
aagccaggttccatggaggagc

SEQ ID NO: 7130801 - DNA, 22 bp, Homo sapiens
aagccaggttccatggaggagc

SEQ ID NO: 7130802 - DNA, 22 bp, Homo sapiens
aagccaggttccatggaggagc

SEQ ID NO: 7130803 - DNA, 22 bp, Homo sapiens
aagctcttctgtggatttgagt

SEQ ID NO: 7130804 - DNA, 22 bp, Homo sapiens
aagctcttctgtggatttgagt

SEQ ID NO: 7130805 - DNA, 22 bp, Homo sapiens
aagctcttcttgccaccattca

SEQ ID NO: 7130806 - DNA, 22 bp, Homo sapiens
aagctcttgaatgggatcaagg

SEQ ID NO: 7130807 - DNA, 22 bp, Homo sapiens
aagctgcaaaaaatttctgtct

SEQ ID NO: 7130808 - DNA, 22 bp, Homo sapiens
aagctgcaaggaagtgtgccag

SEQ ID NO: 7130809 - DNA, 22 bp, Homo sapiens
acaggcaggttgagaaacattt

SEQ ID NO: 7130810 - DNA, 22 bp, Homo sapiens
acaggcaggttgagaaacattt

SEQ ID NO: 7130811 - DNA, 22 bp, Homo sapiens
acaggcagtgatttcctctggt

SEQ ID NO: 7130812 - DNA, 22 bp, Homo sapiens
acaggcagtgatttcctctggt

SEQ ID NO: 7130813 - DNA, 22 bp, Homo sapiens
acaggcagtgatttcctctggt

SEQ ID NO: 7130814 - DNA, 22 bp, Homo sapiens
acaggcagtgatttcctctggt

SEQ ID NO: 7130815 - DNA, 22 bp, Homo sapiens
acaggcagtgatttcctctggt

SEQ ID NO: 7130816 - DNA, 22 bp, Homo sapiens
acaggcaggttgagaaacattt

SEQ ID NO: 7130817 - DNA, 22 bp, Homo sapiens
acaggcaggttgagaaacattt

SEQ ID NO: 7130818 - DNA, 22 bp, Homo sapiens
acaggcagtgatttcctctggt

SEQ ID NO: 7130819 - DNA, 22 bp, Homo sapiens
acaggcagtgatttcctctggt

SEQ ID NO: 7130820 - DNA, 22 bp, Homo sapiens
acaggcagtgggccagatttgt

SEQ ID NO: 7130821 - DNA, 22 bp, Homo sapiens
acaggcaggtcctgtcccagct

SEQ ID NO: 7130822 - DNA, 22 bp, Homo sapiens
acaggcaggttgagaaacattt

SEQ ID NO: 7130823 - DNA, 22 bp, Homo sapiens
acaggcaggtcctgtcccagct

SEQ ID NO: 7130824 - DNA, 18 bp, Homo sapiens
aagctgccctcaggcagg

SEQ ID NO: 7130825 - DNA, 22 bp, Homo sapiens
aagctgcccaagactgaagcat

SEQ ID NO: 7130826 - DNA, 22 bp, Homo sapiens
aagctgcccaagactgaagcat

SEQ ID NO: 7130827 - DNA, 23 bp, Homo sapiens
aagctgccagtctgaagcctggg

SEQ ID NO: 7130828 - DNA, 23 bp, Homo sapiens
aagctgccagtctgaagcctggg

SEQ ID NO: 7130829 - DNA, 22 bp, Homo sapiens
aagctgccagctgagctgaggc

SEQ ID NO: 7130830 - DNA, 22 bp, Homo sapiens
aagctgccagctgagctgaggc

SEQ ID NO: 7130831 - DNA, 22 bp, Homo sapiens
aagctgccagattcagtctgct

SEQ ID NO: 7130832 - DNA, 22 bp, Homo sapiens
aagctgccacacggtgagtact

SEQ ID NO: 7130833 - DNA, 22 bp, Homo sapiens
aagctgccaatggtaagctgct

SEQ ID NO: 7130834 - DNA, 22 bp, Homo sapiens
aagctgccaatggtaagctgct

SEQ ID NO: 7130835 - DNA, 22 bp, Homo sapiens
aagctgccaccagcccagggca

SEQ ID NO: 7130836 - DNA, 22 bp, Homo sapiens
aagctgcagaccccctgtctca

SEQ ID NO: 7130837 - DNA, 22 bp, Homo sapiens
aagctgcactacttgagggacc

SEQ ID NO: 7130838 - DNA, 22 bp, Homo sapiens
aagctgcagatgtgcctgtgga

SEQ ID NO: 7130839 - DNA, 22 bp, Homo sapiens
aagctgcagatgtgcctgtgga

SEQ ID NO: 7130840 - DNA, 22 bp, Homo sapiens
aagctgcagaccccctgtctca

SEQ ID NO: 7130841 - DNA, 22 bp, Homo sapiens
aagctgcagcacagagaggtgg

SEQ ID NO: 7130842 - DNA, 22 bp, Homo sapiens
aagctgcaggttgaatccaggt

SEQ ID NO: 7130843 - DNA, 22 bp, Homo sapiens
aagctgcaggttgaatccaggt

SEQ ID NO: 7130844 - DNA, 22 bp, Homo sapiens
aagctgcatgaagttgagtaga

SEQ ID NO: 7130845 - DNA, 19 bp, Homo sapiens
aaggcagaagttggatatg

SEQ ID NO: 7130846 - DNA, 22 bp, Homo sapiens
aaggcagagatattcttgatct

SEQ ID NO: 7130847 - DNA, 19 bp, Homo sapiens
aaggcagaagttggatatg

SEQ ID NO: 7130848 - DNA, 21 bp, Homo sapiens
aaggcagaagcatggaatgag

SEQ ID NO: 7130849 - DNA, 21 bp, Homo sapiens
aaggcagaagcatggaatgag

SEQ ID NO: 7130850 - DNA, 19 bp, Homo sapiens
aaggcagaagttggatatg

SEQ ID NO: 7130851 - DNA, 22 bp, Homo sapiens
aaggcagaaattcaactactgg

SEQ ID NO: 7130852 - DNA, 22 bp, Homo sapiens
aaggcagaaattcaactactgg

SEQ ID NO: 7130853 - DNA, 22 bp, Homo sapiens
aaggcagaaattcaactactgg

SEQ ID NO: 7130854 - DNA, 21 bp, Homo sapiens
aaggcagaagcatggaatgag

SEQ ID NO: 7130855 - DNA, 22 bp, Homo sapiens
aaggcagaaagggatgtgagtg

SEQ ID NO: 7130856 - DNA, 22 bp, Homo sapiens
aaggcagaaagggatgtgagtg

SEQ ID NO: 7130857 - DNA, 22 bp, Homo sapiens
aaggcagaaagggatgtgagtg

SEQ ID NO: 7130858 - DNA, 22 bp, Homo sapiens
aaggcagaaagggatgtgagtg

SEQ ID NO: 7130859 - DNA, 22 bp, Homo sapiens
aaggcagaaagggatgtgagtg

SEQ ID NO: 7130860 - DNA, 22 bp, Homo sapiens
aaggcacttttcctgagatgat

SEQ ID NO: 7130861 - DNA, 22 bp, Homo sapiens
aaggcacttttctaaagacctt

SEQ ID NO: 7130862 - DNA, 22 bp, Homo sapiens
aaggcacttttctaaagacctt

SEQ ID NO: 7130863 - DNA, 22 bp, Homo sapiens
aaggaagaagactctttactcc

SEQ ID NO: 7130864 - DNA, 22 bp, Homo sapiens
aaggaagaagactctttactcc

SEQ ID NO: 7130865 - DNA, 22 bp, Homo sapiens
aaggcactacgctgctggggcg

SEQ ID NO: 7130866 - DNA, 22 bp, Homo sapiens
aaggcacttaacgtgggaggat

SEQ ID NO: 7130867 - DNA, 22 bp, Homo sapiens
aaggcacttgcccagagctgca

SEQ ID NO: 7130868 - DNA, 22 bp, Homo sapiens
aaggcacttgcccagagctgca

SEQ ID NO: 7130869 - DNA, 22 bp, Homo sapiens
aaggcacttgcccagagctgca

SEQ ID NO: 7130870 - DNA, 22 bp, Homo sapiens
aaggcacttttcctgagatgat

SEQ ID NO: 7130871 - DNA, 22 bp, Homo sapiens
aaggaactaaatagttctggaa

SEQ ID NO: 7130872 - DNA, 20 bp, Homo sapiens
aaggaactcacccatgggct

SEQ ID NO: 7130873 - DNA, 22 bp, Homo sapiens
aaggaactctagagccttgaac

SEQ ID NO: 7130874 - DNA, 22 bp, Homo sapiens
aaggaactgatgctcaaagaat

SEQ ID NO: 7130875 - DNA, 22 bp, Homo sapiens
aaggaactgctgatgtggtgac

SEQ ID NO: 7130876 - DNA, 22 bp, Homo sapiens
aaggaacttgccacagaaaaga

SEQ ID NO: 7130877 - DNA, 22 bp, Homo sapiens
aaggaacttggtgcccgtgccc

SEQ ID NO: 7130878 - DNA, 22 bp, Homo sapiens
aaggaagaaatgaataggtgga

SEQ ID NO: 7130879 - DNA, 22 bp, Homo sapiens
aaggaagaaatgaataggtgga

SEQ ID NO: 7130880 - DNA, 22 bp, Homo sapiens
aaggaagaaatgaataggtgga

SEQ ID NO: 7130881 - DNA, 22 bp, Homo sapiens
aaggaagaaatgaataggtgga

SEQ ID NO: 7130882 - DNA, 22 bp, Homo sapiens
aaggaaatgtgcctgacactgc

SEQ ID NO: 7130883 - DNA, 22 bp, Homo sapiens
acagtataccattgtgactttg

SEQ ID NO: 7130884 - DNA, 22 bp, Homo sapiens
acagtataactccatgccaccc

SEQ ID NO: 7130885 - DNA, 21 bp, Homo sapiens
acagtacttgagatcttttga

SEQ ID NO: 7130886 - DNA, 22 bp, Homo sapiens
acagtagaaacaggcaggcaga

SEQ ID NO: 7130887 - DNA, 22 bp, Homo sapiens
acagtagaccctggataaacat

SEQ ID NO: 7130888 - DNA, 22 bp, Homo sapiens
acagtagaccctggataaacat

SEQ ID NO: 7130889 - DNA, 22 bp, Homo sapiens
acagtagaccctggataaacat

SEQ ID NO: 7130890 - DNA, 22 bp, Homo sapiens
acagtagaccctggataaacat

SEQ ID NO: 7130891 - DNA, 22 bp, Homo sapiens
acagtagagtaaaagggagcct

SEQ ID NO: 7130892 - DNA, 22 bp, Homo sapiens
acagtagagtaaatggttagat

SEQ ID NO: 7130893 - DNA, 22 bp, Homo sapiens
acagtagagtaaatggttagat

SEQ ID NO: 7130894 - DNA, 22 bp, Homo sapiens
acagtagatggctcagagacag

SEQ ID NO: 7130895 - DNA, 22 bp, Homo sapiens
acagtagattggtatgatgtca

SEQ ID NO: 7130896 - DNA, 22 bp, Homo sapiens
acagtagattggtatgatgtca

SEQ ID NO: 7130897 - DNA, 22 bp, Homo sapiens
acagtagctaatattgcattat

SEQ ID NO: 7130898 - DNA, 22 bp, Homo sapiens
acagtaggaatagatgtagata

SEQ ID NO: 7130899 - DNA, 22 bp, Homo sapiens
acagtagtacacatctatgtcc

SEQ ID NO: 7130900 - DNA, 22 bp, Homo sapiens
acagtagtacacatctatgtcc

SEQ ID NO: 7130901 - DNA, 22 bp, Homo sapiens
acagtagtcctttattttggtt

SEQ ID NO: 7130902 - DNA, 22 bp, Homo sapiens
acagtagtctcaggaataggca

SEQ ID NO: 7130903 - DNA, 22 bp, Homo sapiens
acagtagtcttaatttcatgta

SEQ ID NO: 7130904 - DNA, 22 bp, Homo sapiens
acagtagtgccatgacctacag

SEQ ID NO: 7130905 - DNA, 22 bp, Homo sapiens
acagtagtgccatgacctacag

SEQ ID NO: 7130906 - DNA, 22 bp, Homo sapiens
acagtagtgctcaatcagtgtt

SEQ ID NO: 7130907 - DNA, 22 bp, Homo sapiens
acagtagtgtgtgaaacttgcc

SEQ ID NO: 7130908 - DNA, 22 bp, Homo sapiens
acagtagtgtgtgaaacttgcc

SEQ ID NO: 7130909 - DNA, 22 bp, Homo sapiens
acagtagttatctaacttattt

SEQ ID NO: 7130910 - DNA, 22 bp, Homo sapiens
acagtagttggttgttttggga

SEQ ID NO: 7130911 - DNA, 22 bp, Homo sapiens
acagtagtttataaaaatgttg

SEQ ID NO: 7130912 - DNA, 22 bp, Homo sapiens
aaggcagtttgggccaccatct

SEQ ID NO: 7130913 - DNA, 22 bp, Homo sapiens
aaggcagtttgggccaccatct

SEQ ID NO: 7130914 - DNA, 22 bp, Homo sapiens
aaggcagttcactcacgcagcc

SEQ ID NO: 7130915 - DNA, 22 bp, Homo sapiens
aaggcagttcactcacgcagcc

SEQ ID NO: 7130916 - DNA, 22 bp, Homo sapiens
aaggcagttaccgcaatggagg

SEQ ID NO: 7130917 - DNA, 22 bp, Homo sapiens
aaggcagtggctggaaaacctg

SEQ ID NO: 7130918 - DNA, 22 bp, Homo sapiens
aaggcagtggctggaaaacctg

SEQ ID NO: 7130919 - DNA, 22 bp, Homo sapiens
aaggcagtggttgggtggagga

SEQ ID NO: 7130920 - DNA, 22 bp, Homo sapiens
aaggcagtggttgtgatactgt

SEQ ID NO: 7130921 - DNA, 22 bp, Homo sapiens
aaggcagtggttgtgatactgt

SEQ ID NO: 7130922 - DNA, 22 bp, Homo sapiens
aaggcagtctggtttcaaagca

SEQ ID NO: 7130923 - DNA, 22 bp, Homo sapiens
aaggcaggtattgatgccacag

SEQ ID NO: 7130924 - DNA, 22 bp, Homo sapiens
aaggcaggtattgatgccacag

SEQ ID NO: 7130925 - DNA, 22 bp, Homo sapiens
aaggcagtaaaatctaccttgc

SEQ ID NO: 7130926 - DNA, 22 bp, Homo sapiens
aaggcagtaaaatctaccttgc

SEQ ID NO: 7130927 - DNA, 22 bp, Homo sapiens
aaggcagtaggatcttccacag

SEQ ID NO: 7130928 - DNA, 22 bp, Homo sapiens
aaggcagtaggatcttccacag

SEQ ID NO: 7130929 - DNA, 18 bp, Homo sapiens
aaggcagtatgattgcac

SEQ ID NO: 7130930 - DNA, 22 bp, Homo sapiens
aaggcagtcaaagcagacttct

SEQ ID NO: 7130931 - DNA, 22 bp, Homo sapiens
aaggcaggatgggaaaagattt

SEQ ID NO: 7130932 - DNA, 22 bp, Homo sapiens
aaggcaggatgggaaaagattt

SEQ ID NO: 7130933 - DNA, 22 bp, Homo sapiens
aaggcaggatgggaaaagattt

SEQ ID NO: 7130934 - DNA, 22 bp, Homo sapiens
aaggcaggatgcggacccatct

SEQ ID NO: 7130935 - DNA, 22 bp, Homo sapiens
aaggcaggatgggaaaagattt

SEQ ID NO: 7130936 - DNA, 22 bp, Homo sapiens
aaggcagggaaagtggattagg

SEQ ID NO: 7130937 - DNA, 22 bp, Homo sapiens
aaggcagggaaagtggattagg

SEQ ID NO: 7130938 - DNA, 22 bp, Homo sapiens
aaggcagggaaagtggattagg

SEQ ID NO: 7130939 - DNA, 22 bp, Homo sapiens
aaggcagggaaagtggattagg

SEQ ID NO: 7130940 - DNA, 22 bp, Homo sapiens
aaggcagctcagctcatggcag

SEQ ID NO: 7130941 - DNA, 22 bp, Homo sapiens
aaggcagcttcaccacagcatt

SEQ ID NO: 7130942 - DNA, 22 bp, Homo sapiens
aaggcagcttcaccacagcatt

SEQ ID NO: 7130943 - DNA, 22 bp, Homo sapiens
aaggcagctttaaaaaagatgc

SEQ ID NO: 7130944 - DNA, 22 bp, Homo sapiens
aaggcaggagctgtatcttatt

SEQ ID NO: 7130945 - DNA, 22 bp, Homo sapiens
aaggcaggagctgtatcttatt

SEQ ID NO: 7130946 - DNA, 22 bp, Homo sapiens
aaggcaggagctgtatcttatt

SEQ ID NO: 7130947 - DNA, 22 bp, Homo sapiens
aaggcaggatgcggacccatct

SEQ ID NO: 7130948 - DNA, 22 bp, Homo sapiens
aaggcaggatgcggacccatct

SEQ ID NO: 7130949 - DNA, 22 bp, Homo sapiens
aaggcaggatgcggacccatct

SEQ ID NO: 7130950 - DNA, 22 bp, Homo sapiens
aaggcagctcagctcatggcag

SEQ ID NO: 7130951 - DNA, 22 bp, Homo sapiens
aaggcagcctctgccagccggg

SEQ ID NO: 7130952 - DNA, 22 bp, Homo sapiens
aaggcagatataaagactagag

SEQ ID NO: 7130953 - DNA, 22 bp, Homo sapiens
aaggcagatataaagactagag

SEQ ID NO: 7130954 - DNA, 22 bp, Homo sapiens
acagttgttttccagatatgtt

SEQ ID NO: 7130955 - DNA, 22 bp, Homo sapiens
acagtttacagggatttgagct

SEQ ID NO: 7130956 - DNA, 22 bp, Homo sapiens
acagttggttaacacaaatatt

SEQ ID NO: 7130957 - DNA, 22 bp, Homo sapiens
acagtttacagggatttgagct

SEQ ID NO: 7130958 - DNA, 22 bp, Homo sapiens
acagttgggctgtagcatgctt

SEQ ID NO: 7130959 - DNA, 22 bp, Homo sapiens
acagttgttttccagatatgtt

SEQ ID NO: 7130960 - DNA, 22 bp, Homo sapiens
acagttgttttccagatatgtt

SEQ ID NO: 7130961 - DNA, 22 bp, Homo sapiens
acagttctttgtttatagcttg

SEQ ID NO: 7130962 - DNA, 22 bp, Homo sapiens
acagttctgagctataattgct

SEQ ID NO: 7130963 - DNA, 21 bp, Homo sapiens
acagttctgccggcatctttc

SEQ ID NO: 7130964 - DNA, 21 bp, Homo sapiens
acagttctgccggcatctttc

SEQ ID NO: 7130965 - DNA, 22 bp, Homo sapiens
acagttctgcctgtttgagaag

SEQ ID NO: 7130966 - DNA, 22 bp, Homo sapiens
acagttctgcctgtttgagaag

SEQ ID NO: 7130967 - DNA, 22 bp, Homo sapiens
acagttctgtcctagacttcgt

SEQ ID NO: 7130968 - DNA, 22 bp, Homo sapiens
acagttctgagctataattgct

SEQ ID NO: 7130969 - DNA, 23 bp, Homo sapiens
acagttctctgatgggtttaaca

SEQ ID NO: 7130970 - DNA, 22 bp, Homo sapiens
acagttctgaagactagagcct

SEQ ID NO: 7130971 - DNA, 22 bp, Homo sapiens
acagttctagcttttacatttt

SEQ ID NO: 7130972 - DNA, 22 bp, Homo sapiens
acagttctagcttttacatttt

SEQ ID NO: 7130973 - DNA, 22 bp, Homo sapiens
acagttctccagtgcctttgag

SEQ ID NO: 7130974 - DNA, 23 bp, Homo sapiens
acagttctctgatgggtttaaca

SEQ ID NO: 7130975 - DNA, 22 bp, Homo sapiens
acagttctaaatcttggataat

SEQ ID NO: 7130976 - DNA, 22 bp, Homo sapiens
acagttctaaatcttggataat

SEQ ID NO: 7130977 - DNA, 22 bp, Homo sapiens
acagttctaaatcttggataat

SEQ ID NO: 7130978 - DNA, 19 bp, Homo sapiens
acagttctaatttctgtgg

SEQ ID NO: 7130979 - DNA, 19 bp, Homo sapiens
acagttctaatttctgtgg

SEQ ID NO: 7130980 - DNA, 18 bp, Homo sapiens
agaaggagctatgggcag

SEQ ID NO: 7130981 - DNA, 22 bp, Homo sapiens
agaagggaactcagagatgatt

SEQ ID NO: 7130982 - DNA, 22 bp, Homo sapiens
agaagggaactcagagatgatt

SEQ ID NO: 7130983 - DNA, 22 bp, Homo sapiens
agaagggaactcagagatgatt

SEQ ID NO: 7130984 - DNA, 22 bp, Homo sapiens
agaagggaactcagagatgatt

SEQ ID NO: 7130985 - DNA, 21 bp, Homo sapiens
agaagggattgtggtaaagat

SEQ ID NO: 7130986 - DNA, 21 bp, Homo sapiens
agaagggattgtggtaaagat

SEQ ID NO: 7130987 - DNA, 21 bp, Homo sapiens
agaagggattgtggtaaagat

SEQ ID NO: 7130988 - DNA, 18 bp, Homo sapiens
agaaggagctatgggcag

SEQ ID NO: 7130989 - DNA, 18 bp, Homo sapiens
agaaggagctatgggcag

SEQ ID NO: 7130990 - DNA, 18 bp, Homo sapiens
agaaggagctatgggcag

SEQ ID NO: 7130991 - DNA, 18 bp, Homo sapiens
agaaggagctatgggcag

SEQ ID NO: 7130992 - DNA, 22 bp, Homo sapiens
aatgagttctgacacttcacga

SEQ ID NO: 7130993 - DNA, 20 bp, Homo sapiens
aatgagttattttgtatatg

SEQ ID NO: 7130994 - DNA, 19 bp, Homo sapiens
aatgagttccatgaaaaga

SEQ ID NO: 7130995 - DNA, 19 bp, Homo sapiens
aatgagttccatgaaaaga

SEQ ID NO: 7130996 - DNA, 22 bp, Homo sapiens
aatgagttctgacacttcacga

SEQ ID NO: 7130997 - DNA, 22 bp, Homo sapiens
aatgaggttttttaaagccaga

SEQ ID NO: 7130998 - DNA, 22 bp, Homo sapiens
aatgagtcatgaagattagcaa

SEQ ID NO: 7130999 - DNA, 22 bp, Homo sapiens
aatgagttagatgagaaaataa

SEQ ID NO: 7131000 - DNA, 22 bp, Homo sapiens
aatgagttagatgagaaaataa

SEQ ID NO: 7131001 - DNA, 22 bp, Homo sapiens
aatgagttagatgagaaaataa

SEQ ID NO: 7131002 - DNA, 22 bp, Homo sapiens
aatgagttatttaatagaaagg

SEQ ID NO: 7131003 - DNA, 22 bp, Homo sapiens
aatgagttatttaatagaaagg

SEQ ID NO: 7131004 - DNA, 22 bp, Homo sapiens
aatgagatggaggactcttaat

SEQ ID NO: 7131005 - DNA, 22 bp, Homo sapiens
aatgagatggcaatgacttaaa

SEQ ID NO: 7131006 - DNA, 22 bp, Homo sapiens
aatgagatgttgaattattgtt

SEQ ID NO: 7131007 - DNA, 22 bp, Homo sapiens
aatgagattccaatagctcctg

SEQ ID NO: 7131008 - DNA, 22 bp, Homo sapiens
aatgagattccaatagctcctg

SEQ ID NO: 7131009 - DNA, 22 bp, Homo sapiens
aatgagcaaatgaagacgctgt

SEQ ID NO: 7131010 - DNA, 22 bp, Homo sapiens
aatgagcaaatgaagacgctgt

SEQ ID NO: 7131011 - DNA, 22 bp, Homo sapiens
aatgagccaatgtttatgaagt

SEQ ID NO: 7131012 - DNA, 22 bp, Homo sapiens
aatgagggggatgggaaagtgt

SEQ ID NO: 7131013 - DNA, 22 bp, Homo sapiens
aatgagggggatgggaaagtgt

SEQ ID NO: 7131014 - DNA, 22 bp, Homo sapiens
aatgaggtgaggaaggcctcag

SEQ ID NO: 7131015 - DNA, 22 bp, Homo sapiens
aatgaggtgttgagaccagcac

SEQ ID NO: 7131016 - DNA, 22 bp, Homo sapiens
aatgaggttggcataattaaat

SEQ ID NO: 7131017 - DNA, 22 bp, Homo sapiens
aatgaggttggcataattaaat

SEQ ID NO: 7131018 - DNA, 22 bp, Homo sapiens
aatgaggttttttaaagccaga

SEQ ID NO: 7131019 - DNA, 22 bp, Homo sapiens
aatgactgtagtcatattaagg

SEQ ID NO: 7131020 - DNA, 19 bp, Homo sapiens
aatgactgagtacattgtc

SEQ ID NO: 7131021 - DNA, 19 bp, Homo sapiens
aatgactgagtacattgtc

SEQ ID NO: 7131022 - DNA, 22 bp, Homo sapiens
aatgactgtagtcatattaagg

SEQ ID NO: 7131023 - DNA, 22 bp, Homo sapiens
aatgactttgaaatatttgagt

SEQ ID NO: 7131024 - DNA, 22 bp, Homo sapiens
aatgagaaaacacagaggaggt

SEQ ID NO: 7131025 - DNA, 22 bp, Homo sapiens
aatgagaaccttgaaaggaact

SEQ ID NO: 7131026 - DNA, 22 bp, Homo sapiens
aatgagaatgtaagtgaagaga

SEQ ID NO: 7131027 - DNA, 22 bp, Homo sapiens
aatgagagaagacaggcaagtg

SEQ ID NO: 7131028 - DNA, 23 bp, Homo sapiens
aatgagagaccatgtggagcaga

SEQ ID NO: 7131029 - DNA, 22 bp, Homo sapiens
aatgagatcagagataactcaa

SEQ ID NO: 7131030 - DNA, 22 bp, Homo sapiens
aatgagacacgtgaagcagatg

SEQ ID NO: 7131031 - DNA, 22 bp, Homo sapiens
aatgagacacgtgaagcagatg

SEQ ID NO: 7131032 - DNA, 22 bp, Homo sapiens
aatgactctgctgcagagacac

SEQ ID NO: 7131033 - DNA, 22 bp, Homo sapiens
aatgactaataagttttactgt

SEQ ID NO: 7131034 - DNA, 20 bp, Homo sapiens
aatgactactatatccatgg

SEQ ID NO: 7131035 - DNA, 22 bp, Homo sapiens
aatgactctgctgcagagacac

SEQ ID NO: 7131036 - DNA, 19 bp, Homo sapiens
aatgactgagtacattgtc

SEQ ID NO: 7131037 - DNA, 19 bp, Homo sapiens
aatgactgagtacattgtc

SEQ ID NO: 7131038 - DNA, 22 bp, Homo sapiens
aatgacatggagcatcttttca

SEQ ID NO: 7131039 - DNA, 22 bp, Homo sapiens
aatgacatggagcatcttttca

SEQ ID NO: 7131040 - DNA, 22 bp, Homo sapiens
aatgacatggagcatcttttca

SEQ ID NO: 7131041 - DNA, 22 bp, Homo sapiens
aatgaccagcgcctgcagaggg

SEQ ID NO: 7131042 - DNA, 22 bp, Homo sapiens
aatgaccagcgcctgcagaggg

SEQ ID NO: 7131043 - DNA, 22 bp, Homo sapiens
aatgacctcagagcacccagaa

SEQ ID NO: 7131044 - DNA, 22 bp, Homo sapiens
agaaatactgcctaagactgta

SEQ ID NO: 7131045 - DNA, 22 bp, Homo sapiens
agaaatactgcctaagactgta

SEQ ID NO: 7131046 - DNA, 22 bp, Homo sapiens
agaaatactgcctaagactgta

SEQ ID NO: 7131047 - DNA, 22 bp, Homo sapiens
agaaatactgtgagagcagcct

SEQ ID NO: 7131048 - DNA, 22 bp, Homo sapiens
agaaatactgtgagagcagcct

SEQ ID NO: 7131049 - DNA, 22 bp, Homo sapiens
agaaatacttaatctttgcagg

SEQ ID NO: 7131050 - DNA, 20 bp, Homo sapiens
agaaatactttggtataatg

SEQ ID NO: 7131051 - DNA, 22 bp, Homo sapiens
agaaatactttgtaaatctcac

SEQ ID NO: 7131052 - DNA, 22 bp, Homo sapiens
aatgaatgtgattaacttcaag

SEQ ID NO: 7131053 - DNA, 22 bp, Homo sapiens
aatgaatgtgattaacttcaag

SEQ ID NO: 7131054 - DNA, 22 bp, Homo sapiens
agaaatactttgtaaatctcac

SEQ ID NO: 7131055 - DNA, 22 bp, Homo sapiens
aatgaatgtttgttgagtgaag

SEQ ID NO: 7131056 - DNA, 22 bp, Homo sapiens
agaaaacactgccccctctctc

SEQ ID NO: 7131057 - DNA, 22 bp, Homo sapiens
agaaaacactgccccctctctc

SEQ ID NO: 7131058 - DNA, 22 bp, Homo sapiens
aatcctggaatgagtttgctga

SEQ ID NO: 7131059 - DNA, 22 bp, Homo sapiens
aatcctggcatgtgccttggga

SEQ ID NO: 7131060 - DNA, 22 bp, Homo sapiens
agaaaacattacataggtgtgt

SEQ ID NO: 7131061 - DNA, 22 bp, Homo sapiens
agaaaacataggagacaggaaa

SEQ ID NO: 7131062 - DNA, 22 bp, Homo sapiens
agaaaacataggagacaggaaa

SEQ ID NO: 7131063 - DNA, 22 bp, Homo sapiens
agaaaacataggagacaggaaa

SEQ ID NO: 7131064 - DNA, 22 bp, Homo sapiens
agaaaacataggagacaggaaa

SEQ ID NO: 7131065 - DNA, 22 bp, Homo sapiens
agaaaacataggagacaggaaa

SEQ ID NO: 7131066 - DNA, 22 bp, Homo sapiens
agaaaacataggagacaggaaa

SEQ ID NO: 7131067 - DNA, 22 bp, Homo sapiens
agaaaacataggagacaggaaa

SEQ ID NO: 7131068 - DNA, 22 bp, Homo sapiens
agaaaacataggagacaggaaa

SEQ ID NO: 7131069 - DNA, 22 bp, Homo sapiens
aatgaacacatgtggtcagttt

SEQ ID NO: 7131070 - DNA, 22 bp, Homo sapiens
aatgaacacatgtggtcagttt

SEQ ID NO: 7131071 - DNA, 22 bp, Homo sapiens
aatgaacacatgtggtcagttt

SEQ ID NO: 7131072 - DNA, 22 bp, Homo sapiens
aatgaacacatgtggtcagttt

SEQ ID NO: 7131073 - DNA, 22 bp, Homo sapiens
aatgaacacatgtggtcagttt

SEQ ID NO: 7131074 - DNA, 22 bp, Homo sapiens
aatgaacacgctggtggtgcaa

SEQ ID NO: 7131075 - DNA, 22 bp, Homo sapiens
aatgaacacttagcctttctat

SEQ ID NO: 7131076 - DNA, 22 bp, Homo sapiens
aatgaacacagccctctacttt

SEQ ID NO: 7131077 - DNA, 22 bp, Homo sapiens
aatgaacaagagagagaacttt

SEQ ID NO: 7131078 - DNA, 22 bp, Homo sapiens
aatgaacaagagagagaacttt

SEQ ID NO: 7131079 - DNA, 22 bp, Homo sapiens
aatgaacaagagagagaacttt

SEQ ID NO: 7131080 - DNA, 22 bp, Homo sapiens
aatgaaactatatttagagagg

SEQ ID NO: 7131081 - DNA, 22 bp, Homo sapiens
aatgaacaagaaagactttgag

SEQ ID NO: 7131082 - DNA, 22 bp, Homo sapiens
agaaaactgcagagtagcctca

SEQ ID NO: 7131083 - DNA, 22 bp, Homo sapiens
agaaaactgcagagtagcctca

SEQ ID NO: 7131084 - DNA, 22 bp, Homo sapiens
agaaaactctacatctgtatgt

SEQ ID NO: 7131085 - DNA, 22 bp, Homo sapiens
aatgaaactatatttagagagg

SEQ ID NO: 7131086 - DNA, 22 bp, Homo sapiens
agaaaactggagcctggggttg

SEQ ID NO: 7131087 - DNA, 22 bp, Homo sapiens
agaaaacattacataggtgtgt

SEQ ID NO: 7131088 - DNA, 22 bp, Homo sapiens
agaaaactctacatctgtatgt

SEQ ID NO: 7131089 - DNA, 22 bp, Homo sapiens
agaaatactaggaatattcata

SEQ ID NO: 7131090 - DNA, 22 bp, Homo sapiens
agaaatacattctctggtgtgt

SEQ ID NO: 7131091 - DNA, 20 bp, Homo sapiens
agaaataccacatttggcaa

SEQ ID NO: 7131092 - DNA, 18 bp, Homo sapiens
agaaataccagtattgga

SEQ ID NO: 7131093 - DNA, 18 bp, Homo sapiens
agaaataccagtattgga

SEQ ID NO: 7131094 - DNA, 23 bp, Homo sapiens
aatgaactgagaatctgtacagt

SEQ ID NO: 7131095 - DNA, 22 bp, Homo sapiens
agaaataagagctttccttggg

SEQ ID NO: 7131096 - DNA, 22 bp, Homo sapiens
agaaataagagctttccttggg

SEQ ID NO: 7131097 - DNA, 22 bp, Homo sapiens
agaaataagagctttccttggg

SEQ ID NO: 7131098 - DNA, 22 bp, Homo sapiens
agaaataagagctttccttggg

SEQ ID NO: 7131099 - DNA, 22 bp, Homo sapiens
agaaatacaaagtactaagata

SEQ ID NO: 7131100 - DNA, 22 bp, Homo sapiens
agaaatacaaagtactaagata

SEQ ID NO: 7131101 - DNA, 22 bp, Homo sapiens
agaaatacaaagtactaagata

SEQ ID NO: 7131102 - DNA, 21 bp, Homo sapiens
agaaatacagcagggatgatc

SEQ ID NO: 7131103 - DNA, 20 bp, Homo sapiens
agaaatacatgcatgcatga

SEQ ID NO: 7131104 - DNA, 22 bp, Homo sapiens
aatgaacatataaagagatctt

SEQ ID NO: 7131105 - DNA, 22 bp, Homo sapiens
aatgaacatataaagagatctt

SEQ ID NO: 7131106 - DNA, 22 bp, Homo sapiens
aatgaacagtgggtgaggtacc

SEQ ID NO: 7131107 - DNA, 22 bp, Homo sapiens
aatgaacatataaagagatctt

SEQ ID NO: 7131108 - DNA, 22 bp, Homo sapiens
aatgaacatataaagagatctt

SEQ ID NO: 7131109 - DNA, 22 bp, Homo sapiens
aatgaacagtgggtgaggtacc

SEQ ID NO: 7131110 - DNA, 22 bp, Homo sapiens
aatgaacagtgggtgaggtacc

SEQ ID NO: 7131111 - DNA, 22 bp, Homo sapiens
aatgaacagtgggtgaggtacc

SEQ ID NO: 7131112 - DNA, 22 bp, Homo sapiens
aatgaacacttagcctttctat

SEQ ID NO: 7131113 - DNA, 22 bp, Homo sapiens
aatgaacagatacacataggca

SEQ ID NO: 7131114 - DNA, 22 bp, Homo sapiens
aatgaacagatacacataggca

SEQ ID NO: 7131115 - DNA, 22 bp, Homo sapiens
aatgaacaggtgaatgtcagat

SEQ ID NO: 7131116 - DNA, 22 bp, Homo sapiens
aatgaacaggtgaatgtcagat

SEQ ID NO: 7131117 - DNA, 22 bp, Homo sapiens
aatgaacaggtgaatgtcagat

SEQ ID NO: 7131118 - DNA, 22 bp, Homo sapiens
aatgaacaggtgaatgtcagat

SEQ ID NO: 7131119 - DNA, 22 bp, Homo sapiens
aatgaacatcaaatgcctacca

SEQ ID NO: 7131120 - DNA, 22 bp, Homo sapiens
aatgaacatcaaatgcctacca

SEQ ID NO: 7131121 - DNA, 22 bp, Homo sapiens
aatgaacatggacaagttaata

SEQ ID NO: 7131122 - DNA, 22 bp, Homo sapiens
aatgaacatggacaagttaata

SEQ ID NO: 7131123 - DNA, 22 bp, Homo sapiens
aatgaacatggacaagttaata

SEQ ID NO: 7131124 - DNA, 22 bp, Homo sapiens
aatgaacatgggagtactaata

SEQ ID NO: 7131125 - DNA, 22 bp, Homo sapiens
aatgaacatgggagtactaata

SEQ ID NO: 7131126 - DNA, 22 bp, Homo sapiens
aatgaacatgggagtactaata

SEQ ID NO: 7131127 - DNA, 22 bp, Homo sapiens
aatgaacccttcaagctctgat

SEQ ID NO: 7131128 - DNA, 22 bp, Homo sapiens
aatgaactccgaacatttacat

SEQ ID NO: 7131129 - DNA, 22 bp, Homo sapiens
aatcccttcccttctctgggac

SEQ ID NO: 7131130 - DNA, 22 bp, Homo sapiens
aatccccatcaaattaatacgt

SEQ ID NO: 7131131 - DNA, 22 bp, Homo sapiens
aatccccatcaaattaatacgt

SEQ ID NO: 7131132 - DNA, 22 bp, Homo sapiens
aatccctgaggcatcaagtaca

SEQ ID NO: 7131133 - DNA, 20 bp, Homo sapiens
aatcccttctctggactctt

SEQ ID NO: 7131134 - DNA, 22 bp, Homo sapiens
aatccctttttcatttaataga

SEQ ID NO: 7131135 - DNA, 22 bp, Homo sapiens
aatccctttttcatttaataga

SEQ ID NO: 7131136 - DNA, 22 bp, Homo sapiens
aatcctgaggcaaagagatgag

SEQ ID NO: 7131137 - DNA, 22 bp, Homo sapiens
aatcctgaggcaaagagatgag

SEQ ID NO: 7131138 - DNA, 22 bp, Homo sapiens
aatcctggaatacaagagtgaa

SEQ ID NO: 7131139 - DNA, 22 bp, Homo sapiens
aatcccagctactcaggaagtt

SEQ ID NO: 7131140 - DNA, 22 bp, Homo sapiens
aatcccagctactcaggaagtt

SEQ ID NO: 7131141 - DNA, 22 bp, Homo sapiens
aatccatttactctttacaaga

SEQ ID NO: 7131142 - DNA, 22 bp, Homo sapiens
aatcccaagtccaggccattcc

SEQ ID NO: 7131143 - DNA, 22 bp, Homo sapiens
aatcccagctactcaggaagtt

SEQ ID NO: 7131144 - DNA, 22 bp, Homo sapiens
aatcccattgtggaattaagga

SEQ ID NO: 7131145 - DNA, 22 bp, Homo sapiens
aatccatttactctttacaaga

SEQ ID NO: 7131146 - DNA, 22 bp, Homo sapiens
aatccatctctccgagaagttt

SEQ ID NO: 7131147 - DNA, 22 bp, Homo sapiens
aatccatgcatgcaaggaaagg

SEQ ID NO: 7131148 - DNA, 22 bp, Homo sapiens
aatccatgttgatgtatatttt

SEQ ID NO: 7131149 - DNA, 22 bp, Homo sapiens
aatccatgttgatgtatatttt

SEQ ID NO: 7131150 - DNA, 22 bp, Homo sapiens
aatccattaaaaacaagcgcat

SEQ ID NO: 7131151 - DNA, 20 bp, Homo sapiens
aatccattggtctatatgtc

SEQ ID NO: 7131152 - DNA, 22 bp, Homo sapiens
aatccagggtgtggcctttcca

SEQ ID NO: 7131153 - DNA, 22 bp, Homo sapiens
aatccagctgtgtcacaggtga

SEQ ID NO: 7131154 - DNA, 22 bp, Homo sapiens
aatccataatgttgtggggttt

SEQ ID NO: 7131155 - DNA, 22 bp, Homo sapiens
aatcataattgtatacattcat

SEQ ID NO: 7131156 - DNA, 22 bp, Homo sapiens
aatcataattgtatacattcat

SEQ ID NO: 7131157 - DNA, 22 bp, Homo sapiens
actttaaaaagagccttctaac

SEQ ID NO: 7131158 - DNA, 22 bp, Homo sapiens
acttgttttatctgtcaataga

SEQ ID NO: 7131159 - DNA, 22 bp, Homo sapiens
acttgttttatctgtcaataga

SEQ ID NO: 7131160 - DNA, 19 bp, Homo sapiens
acttgttttggaggtgatg

SEQ ID NO: 7131161 - DNA, 22 bp, Homo sapiens
acttgtttggagccagctgtaa

SEQ ID NO: 7131162 - DNA, 22 bp, Homo sapiens
acttgtttggtctcatgtttaa

SEQ ID NO: 7131163 - DNA, 22 bp, Homo sapiens
acttgtttacaagcagttctga

SEQ ID NO: 7131164 - DNA, 22 bp, Homo sapiens
acttgtttcaactgtactctca

SEQ ID NO: 7131165 - DNA, 22 bp, Homo sapiens
acttgtttcaactgtactctcc

SEQ ID NO: 7131166 - DNA, 22 bp, Homo sapiens
aatattttaggctttccaggct

SEQ ID NO: 7131167 - DNA, 22 bp, Homo sapiens
aatattttaggctttccaggct

SEQ ID NO: 7131168 - DNA, 22 bp, Homo sapiens
aatattttaggctttccaggct

SEQ ID NO: 7131169 - DNA, 22 bp, Homo sapiens
aatcaacattgttttaagtcaa

SEQ ID NO: 7131170 - DNA, 22 bp, Homo sapiens
aatcaactgtttccacagggag

SEQ ID NO: 7131171 - DNA, 22 bp, Homo sapiens
aatcaacaggatgtgcattgta

SEQ ID NO: 7131172 - DNA, 22 bp, Homo sapiens
aatcaacaggatgtgcattgta

SEQ ID NO: 7131173 - DNA, 22 bp, Homo sapiens
aatatttttgaggccctgttat

SEQ ID NO: 7131174 - DNA, 22 bp, Homo sapiens
aatcaaaacctacagaggtaat

SEQ ID NO: 7131175 - DNA, 22 bp, Homo sapiens
aatcaaaacctacagaggtaat

SEQ ID NO: 7131176 - DNA, 22 bp, Homo sapiens
aatcaaaacctacagaggtaat

SEQ ID NO: 7131177 - DNA, 22 bp, Homo sapiens
aatcaaaacctacagaggtaat

SEQ ID NO: 7131178 - DNA, 22 bp, Homo sapiens
aatcaaagaatgggctagttgg

SEQ ID NO: 7131179 - DNA, 22 bp, Homo sapiens
acttgtttacaagcagttctga

SEQ ID NO: 7131180 - DNA, 22 bp, Homo sapiens
acttgtttacaagcagttctga

SEQ ID NO: 7131181 - DNA, 22 bp, Homo sapiens
acttgttcattgagtacatatg

SEQ ID NO: 7131182 - DNA, 22 bp, Homo sapiens
acttgttagttttatctgcatg

SEQ ID NO: 7131183 - DNA, 22 bp, Homo sapiens
acttgtgtaacacagaaagaac

SEQ ID NO: 7131184 - DNA, 22 bp, Homo sapiens
acttgtgtaacacagaaagaac

SEQ ID NO: 7131185 - DNA, 22 bp, Homo sapiens
acttgtgtcaaagctatacagg

SEQ ID NO: 7131186 - DNA, 22 bp, Homo sapiens
acttgtataccgtaaagggaga

SEQ ID NO: 7131187 - DNA, 22 bp, Homo sapiens
acttgtaattcctggcccaggt

SEQ ID NO: 7131188 - DNA, 22 bp, Homo sapiens
acttgtaagtaacaagtgagaa

SEQ ID NO: 7131189 - DNA, 22 bp, Homo sapiens
acttgtaagctctgtatttgag

SEQ ID NO: 7131190 - DNA, 21 bp, Homo sapiens
acttgtaacttgaaggggcat

SEQ ID NO: 7131191 - DNA, 22 bp, Homo sapiens
acttgtaaacaaatctaatgta

SEQ ID NO: 7131192 - DNA, 22 bp, Homo sapiens
aatcaagaggcgatggatggaa

SEQ ID NO: 7131193 - DNA, 22 bp, Homo sapiens
aatcaagaaaatgaggattctt

SEQ ID NO: 7131194 - DNA, 22 bp, Homo sapiens
aatcaagaataagttgtaaagc

SEQ ID NO: 7131195 - DNA, 22 bp, Homo sapiens
aatcaagagctgactatatttt

SEQ ID NO: 7131196 - DNA, 22 bp, Homo sapiens
aatcaagaggcgatggatggaa

SEQ ID NO: 7131197 - DNA, 22 bp, Homo sapiens
acttcctggcgtagctgacatt

SEQ ID NO: 7131198 - DNA, 22 bp, Homo sapiens
acttcctggcgtagctgacatt

SEQ ID NO: 7131199 - DNA, 22 bp, Homo sapiens
acttcctggcgtagctgacatt

SEQ ID NO: 7131200 - DNA, 22 bp, Homo sapiens
acttcttttcaaatcatgcaaa

SEQ ID NO: 7131201 - DNA, 22 bp, Homo sapiens
acttcctggcgtagctgacatt

SEQ ID NO: 7131202 - DNA, 22 bp, Homo sapiens
acttcctggcgtagctgacatt

SEQ ID NO: 7131203 - DNA, 22 bp, Homo sapiens
acttcctggattcccaagggct

SEQ ID NO: 7131204 - DNA, 22 bp, Homo sapiens
acttcctggattcccaagggct

SEQ ID NO: 7131205 - DNA, 22 bp, Homo sapiens
acttcctggattcccaagggct

SEQ ID NO: 7131206 - DNA, 22 bp, Homo sapiens
acttcctggattcccaagggct

SEQ ID NO: 7131207 - DNA, 22 bp, Homo sapiens
acttcctgctatgagcttctgt

SEQ ID NO: 7131208 - DNA, 22 bp, Homo sapiens
acttcctgctatgagcttctgt

SEQ ID NO: 7131209 - DNA, 22 bp, Homo sapiens
acttcctgctatgagcttctgt

SEQ ID NO: 7131210 - DNA, 22 bp, Homo sapiens
acttcctgctatgagcttctgt

SEQ ID NO: 7131211 - DNA, 22 bp, Homo sapiens
acttcctgctatgagcttctgt

SEQ ID NO: 7131212 - DNA, 22 bp, Homo sapiens
acttcctgctatgagcttctgt

SEQ ID NO: 7131213 - DNA, 22 bp, Homo sapiens
aatacagagaatgttatttgga

SEQ ID NO: 7131214 - DNA, 22 bp, Homo sapiens
aatacagagaatgttatttgga

SEQ ID NO: 7131215 - DNA, 21 bp, Homo sapiens
aatacagaaatgagtagttgc

SEQ ID NO: 7131216 - DNA, 21 bp, Homo sapiens
aatacagaaatgagtagttgc

SEQ ID NO: 7131217 - DNA, 21 bp, Homo sapiens
aatacagaaatgagtagttgc

SEQ ID NO: 7131218 - DNA, 22 bp, Homo sapiens
aatacaatcaaattcactagca

SEQ ID NO: 7131219 - DNA, 22 bp, Homo sapiens
acttgaaaccctgagatgataa

SEQ ID NO: 7131220 - DNA, 22 bp, Homo sapiens
acttgaaaccctgagatgataa

SEQ ID NO: 7131221 - DNA, 22 bp, Homo sapiens
acttgaaaagctcagcagtagt

SEQ ID NO: 7131222 - DNA, 22 bp, Homo sapiens
acttgaaaagctcagcagtagt

SEQ ID NO: 7131223 - DNA, 22 bp, Homo sapiens
acttgaaacatctttaaatgta

SEQ ID NO: 7131224 - DNA, 22 bp, Homo sapiens
acttgaaagaagtttccttaaa

SEQ ID NO: 7131225 - DNA, 19 bp, Homo sapiens
acttgaaagcagagagttt

SEQ ID NO: 7131226 - DNA, 19 bp, Homo sapiens
acttgaaagcagagagttt

SEQ ID NO: 7131227 - DNA, 22 bp, Homo sapiens
acttgaaaggaagctctaaaac

SEQ ID NO: 7131228 - DNA, 21 bp, Homo sapiens
acttgaagttggagtttctgt

SEQ ID NO: 7131229 - DNA, 21 bp, Homo sapiens
acttgaagttggagtttctgt

SEQ ID NO: 7131230 - DNA, 22 bp, Homo sapiens
aatatatagaagtacccgttgt

SEQ ID NO: 7131231 - DNA, 22 bp, Homo sapiens
aatatatagaagtacccgttgt

SEQ ID NO: 7131232 - DNA, 22 bp, Homo sapiens
aatatatgactccactgcatga

SEQ ID NO: 7131233 - DNA, 22 bp, Homo sapiens
aatatatgactccactgcatga

SEQ ID NO: 7131234 - DNA, 22 bp, Homo sapiens
aatatatgagggagctatttga

SEQ ID NO: 7131235 - DNA, 22 bp, Homo sapiens
aatatatagaagtacccgttgt

SEQ ID NO: 7131236 - DNA, 22 bp, Homo sapiens
aatatatagaagtacccgttgt

SEQ ID NO: 7131237 - DNA, 22 bp, Homo sapiens
aatatatagaagtacccgttgt

SEQ ID NO: 7131238 - DNA, 22 bp, Homo sapiens
aatatatagaagtacccgttgt

SEQ ID NO: 7131239 - DNA, 22 bp, Homo sapiens
acttgaggaagcagcaagggat

SEQ ID NO: 7131240 - DNA, 22 bp, Homo sapiens
acttgacacctaattagtcatc

SEQ ID NO: 7131241 - DNA, 22 bp, Homo sapiens
acttgacagaagtcagtacttt

SEQ ID NO: 7131242 - DNA, 22 bp, Homo sapiens
acttgagaaaccaagtagaaag

SEQ ID NO: 7131243 - DNA, 22 bp, Homo sapiens
acttgagaaaccaagtagaaag

SEQ ID NO: 7131244 - DNA, 22 bp, Homo sapiens
acttgagagaatcggaggagtc

SEQ ID NO: 7131245 - DNA, 22 bp, Homo sapiens
aatatatttgaatcaggaacaa

SEQ ID NO: 7131246 - DNA, 22 bp, Homo sapiens
aatatatgtggtattgaccagc

SEQ ID NO: 7131247 - DNA, 22 bp, Homo sapiens
aatatatttgaatcaggaacaa

SEQ ID NO: 7131248 - DNA, 18 bp, Homo sapiens
aatatcaataagggggag

SEQ ID NO: 7131249 - DNA, 22 bp, Homo sapiens
aatatcaacagtgtccttctaa

SEQ ID NO: 7131250 - DNA, 22 bp, Homo sapiens
aatatcacaggaggagaccaag

SEQ ID NO: 7131251 - DNA, 22 bp, Homo sapiens
aatattctaataaatgcccatc

SEQ ID NO: 7131252 - DNA, 22 bp, Homo sapiens
aatattctaataaatgcccatc

SEQ ID NO: 7131253 - DNA, 22 bp, Homo sapiens
aatattctaataaatgcccatc

SEQ ID NO: 7131254 - DNA, 19 bp, Homo sapiens
aatattttagcctcttcct

SEQ ID NO: 7131255 - DNA, 19 bp, Homo sapiens
aatattttagcctcttcct

SEQ ID NO: 7131256 - DNA, 22 bp, Homo sapiens
aagtcagcactccaggaagcca

SEQ ID NO: 7131257 - DNA, 23 bp, Homo sapiens
aagtcagagccaagtcaatgaga

SEQ ID NO: 7131258 - DNA, 22 bp, Homo sapiens
aagtcagagcaactgagacatt

SEQ ID NO: 7131259 - DNA, 22 bp, Homo sapiens
aagtcagagatcaaggtgtcta

SEQ ID NO: 7131260 - DNA, 22 bp, Homo sapiens
aagtcagagatgccaaagatta

SEQ ID NO: 7131261 - DNA, 22 bp, Homo sapiens
aagtcagagcaactgagacatt

SEQ ID NO: 7131262 - DNA, 22 bp, Homo sapiens
aagtcagaaatcatctagtgta

SEQ ID NO: 7131263 - DNA, 22 bp, Homo sapiens
aagtcagaaaacagagcaatta

SEQ ID NO: 7131264 - DNA, 22 bp, Homo sapiens
aagtcagaaaacagagcaatta

SEQ ID NO: 7131265 - DNA, 22 bp, Homo sapiens
aagtcagacagctgagctgcct

SEQ ID NO: 7131266 - DNA, 22 bp, Homo sapiens
aagtcagaccttgttgatagct

SEQ ID NO: 7131267 - DNA, 22 bp, Homo sapiens
aagtcacttgattgttgacaga

SEQ ID NO: 7131268 - DNA, 22 bp, Homo sapiens
aagtcacttcttaggaaaggag

SEQ ID NO: 7131269 - DNA, 22 bp, Homo sapiens
aagtcactggcaaaagctgcag

SEQ ID NO: 7131270 - DNA, 22 bp, Homo sapiens
aagtcacccacaggcagcagaa

SEQ ID NO: 7131271 - DNA, 22 bp, Homo sapiens
aagtcaccccacactcttggga

SEQ ID NO: 7131272 - DNA, 18 bp, Homo sapiens
aagtcacccctgctccct

SEQ ID NO: 7131273 - DNA, 22 bp, Homo sapiens
aagtcaccctagggcctggact

SEQ ID NO: 7131274 - DNA, 22 bp, Homo sapiens
aagtcactaagtgaaccactgg

SEQ ID NO: 7131275 - DNA, 22 bp, Homo sapiens
aagtcactcatattcctcaagc

SEQ ID NO: 7131276 - DNA, 22 bp, Homo sapiens
aagtcactgaaagggcagaaag

SEQ ID NO: 7131277 - DNA, 22 bp, Homo sapiens
aagtcactgaaggccatgaaca

SEQ ID NO: 7131278 - DNA, 22 bp, Homo sapiens
aagtcactgaaggccatgaaca

SEQ ID NO: 7131279 - DNA, 22 bp, Homo sapiens
aagtcacagaacccattgtaac

SEQ ID NO: 7131280 - DNA, 22 bp, Homo sapiens
aagtcacagaacccattgtaac

SEQ ID NO: 7131281 - DNA, 22 bp, Homo sapiens
aagtcacagagttggaagtcag

SEQ ID NO: 7131282 - DNA, 22 bp, Homo sapiens
aagtcacactgctgggaactct

SEQ ID NO: 7131283 - DNA, 22 bp, Homo sapiens
aagtcacagaacccattgtaac

SEQ ID NO: 7131284 - DNA, 22 bp, Homo sapiens
aagtcacagaacccattgtaac

SEQ ID NO: 7131285 - DNA, 22 bp, Homo sapiens
aagtcacagaacccattgtaac

SEQ ID NO: 7131286 - DNA, 22 bp, Homo sapiens
aagtcacattctgaggtattgg

SEQ ID NO: 7131287 - DNA, 22 bp, Homo sapiens
actaacatgttaatcaaaagaa

SEQ ID NO: 7131288 - DNA, 22 bp, Homo sapiens
aagtggagccagggaaactgaa

SEQ ID NO: 7131289 - DNA, 22 bp, Homo sapiens
actaaatgctgcataaatgctt

SEQ ID NO: 7131290 - DNA, 22 bp, Homo sapiens
actaaatggaatgattactata

SEQ ID NO: 7131291 - DNA, 22 bp, Homo sapiens
aagtggagctataggctcagat

SEQ ID NO: 7131292 - DNA, 22 bp, Homo sapiens
aagtggagagccctggaggtct

SEQ ID NO: 7131293 - DNA, 22 bp, Homo sapiens
aagtggagccagggaaactgaa

SEQ ID NO: 7131294 - DNA, 22 bp, Homo sapiens
aagtggagccagggaaactgaa

SEQ ID NO: 7131295 - DNA, 22 bp, Homo sapiens
aagtggagagccctggaggtct

SEQ ID NO: 7131296 - DNA, 22 bp, Homo sapiens
aagtggagagccctggaggtct

SEQ ID NO: 7131297 - DNA, 21 bp, Homo sapiens
aagtggagaagaaaagctgga

SEQ ID NO: 7131298 - DNA, 22 bp, Homo sapiens
aagtggagagccctggaggtct

SEQ ID NO: 7131299 - DNA, 21 bp, Homo sapiens
aagtggagaagaaaagctgga

SEQ ID NO: 7131300 - DNA, 21 bp, Homo sapiens
aagtggagaagaaaagctgga

SEQ ID NO: 7131301 - DNA, 22 bp, Homo sapiens
aagtggactaatacaaggacta

SEQ ID NO: 7131302 - DNA, 22 bp, Homo sapiens
aagtcagtgaaaaggcatcatc

SEQ ID NO: 7131303 - DNA, 21 bp, Homo sapiens
aagtcagtcagttctatacta

SEQ ID NO: 7131304 - DNA, 22 bp, Homo sapiens
aagtgcataataactcccaagt

SEQ ID NO: 7131305 - DNA, 22 bp, Homo sapiens
aagtcaggacttatgctacctg

SEQ ID NO: 7131306 - DNA, 22 bp, Homo sapiens
aagtcaggctggggtctggcag

SEQ ID NO: 7131307 - DNA, 22 bp, Homo sapiens
aagtcaggcttctcccagagcc

SEQ ID NO: 7131308 - DNA, 22 bp, Homo sapiens
aagtgcatacactagttaattg

SEQ ID NO: 7131309 - DNA, 22 bp, Homo sapiens
aagtgcatacactagttaattg

SEQ ID NO: 7131310 - DNA, 22 bp, Homo sapiens
aagtgcatacactagttaattg

SEQ ID NO: 7131311 - DNA, 22 bp, Homo sapiens
aagtgcatatttttgttgtaga

SEQ ID NO: 7131312 - DNA, 22 bp, Homo sapiens
aagtggactaatacaaggacta

SEQ ID NO: 7131313 - DNA, 22 bp, Homo sapiens
aagtggactaatacaaggacta

SEQ ID NO: 7131314 - DNA, 22 bp, Homo sapiens
aagtgctttttcttgagctgct

SEQ ID NO: 7131315 - DNA, 22 bp, Homo sapiens
aagtgcttttttcttgaggcca

SEQ ID NO: 7131316 - DNA, 22 bp, Homo sapiens
aagtgctttacaaatgtctgtt

SEQ ID NO: 7131317 - DNA, 22 bp, Homo sapiens
aagtgctttacaaatgtctgtt

SEQ ID NO: 7131318 - DNA, 22 bp, Homo sapiens
aagtgctttataaacaatgaag

SEQ ID NO: 7131319 - DNA, 22 bp, Homo sapiens
actacaatactcttagtaaaag

SEQ ID NO: 7131320 - DNA, 22 bp, Homo sapiens
actacacagggatgtgactacc

SEQ ID NO: 7131321 - DNA, 22 bp, Homo sapiens
actacacagggatgtgactacc

SEQ ID NO: 7131322 - DNA, 20 bp, Homo sapiens
aagtgttttgacttctgacc

SEQ ID NO: 7131323 - DNA, 22 bp, Homo sapiens
aagtgttttggcttctgtacac

SEQ ID NO: 7131324 - DNA, 22 bp, Homo sapiens
aagtgttttgtaaacagaaaag

SEQ ID NO: 7131325 - DNA, 22 bp, Homo sapiens
actacaaaagcactgggtatta

SEQ ID NO: 7131326 - DNA, 22 bp, Homo sapiens
actaagacctagatactagggg

SEQ ID NO: 7131327 - DNA, 21 bp, Homo sapiens
actaagagatctctgtctcat

SEQ ID NO: 7131328 - DNA, 22 bp, Homo sapiens
actaagatgcaggaaatgctag

SEQ ID NO: 7131329 - DNA, 22 bp, Homo sapiens
actaaggactgtggcgcctgcc

SEQ ID NO: 7131330 - DNA, 22 bp, Homo sapiens
actaagtagtttcacatataat

SEQ ID NO: 7131331 - DNA, 22 bp, Homo sapiens
actaagtagtttcacatataat

SEQ ID NO: 7131332 - DNA, 22 bp, Homo sapiens
actaatagagacaaacatagat

SEQ ID NO: 7131333 - DNA, 22 bp, Homo sapiens
actaatagagacaaacatagat

SEQ ID NO: 7131334 - DNA, 22 bp, Homo sapiens
actaatagagacaaacatagat

SEQ ID NO: 7131335 - DNA, 22 bp, Homo sapiens
aagttatatcatctcattgacg

SEQ ID NO: 7131336 - DNA, 22 bp, Homo sapiens
aagttatgaaatttggacagct

SEQ ID NO: 7131337 - DNA, 22 bp, Homo sapiens
aagttatgctgaagaatatgag

SEQ ID NO: 7131338 - DNA, 22 bp, Homo sapiens
aagttaggagagtaaagtggta

SEQ ID NO: 7131339 - DNA, 22 bp, Homo sapiens
aagttaggagagtaaagtggta

SEQ ID NO: 7131340 - DNA, 22 bp, Homo sapiens
aagttaggatgaatgccttagc

SEQ ID NO: 7131341 - DNA, 22 bp, Homo sapiens
aagttaggttgcattggtcatc

SEQ ID NO: 7131342 - DNA, 22 bp, Homo sapiens
aagttaggcttagttgagattt

SEQ ID NO: 7131343 - DNA, 22 bp, Homo sapiens
aagttaggttgcattggtcatc

SEQ ID NO: 7131344 - DNA, 22 bp, Homo sapiens
aagttatatcatctcattgacg

SEQ ID NO: 7131345 - DNA, 22 bp, Homo sapiens
aagttactttacctctttagct

SEQ ID NO: 7131346 - DNA, 22 bp, Homo sapiens
aagttagagattccatcatgct

SEQ ID NO: 7131347 - DNA, 22 bp, Homo sapiens
aagtgttttgtaaacagaaaag

SEQ ID NO: 7131348 - DNA, 22 bp, Homo sapiens
aagttacattttggtctaattg

SEQ ID NO: 7131349 - DNA, 22 bp, Homo sapiens
aagttactatgactcttctttt

SEQ ID NO: 7131350 - DNA, 22 bp, Homo sapiens
actcccaggttgcctggcaggc

SEQ ID NO: 7131351 - DNA, 22 bp, Homo sapiens
actccaggttttctctcaagtt

SEQ ID NO: 7131352 - DNA, 22 bp, Homo sapiens
actccaggttttttcactgaag

SEQ ID NO: 7131353 - DNA, 22 bp, Homo sapiens
actccaggttttttcactgaag

SEQ ID NO: 7131354 - DNA, 22 bp, Homo sapiens
actccaggttttttcactgaag

SEQ ID NO: 7131355 - DNA, 22 bp, Homo sapiens
actccaggttttttcactgaag

SEQ ID NO: 7131356 - DNA, 22 bp, Homo sapiens
actccagttctcttgtttataa

SEQ ID NO: 7131357 - DNA, 22 bp, Homo sapiens
actcccaggttgcctggcaggc

SEQ ID NO: 7131358 - DNA, 22 bp, Homo sapiens
actccccaaaactaaccatgca

SEQ ID NO: 7131359 - DNA, 22 bp, Homo sapiens
actccccaaaactaaccatgca

SEQ ID NO: 7131360 - DNA, 18 bp, Homo sapiens
actccccacaggctctgt

SEQ ID NO: 7131361 - DNA, 18 bp, Homo sapiens
actccccacaggctctgt

SEQ ID NO: 7131362 - DNA, 18 bp, Homo sapiens
actccccacaggctctgt

SEQ ID NO: 7131363 - DNA, 18 bp, Homo sapiens
actccccacaggctctgt

SEQ ID NO: 7131364 - DNA, 22 bp, Homo sapiens
actccccagactgccatgctgg

SEQ ID NO: 7131365 - DNA, 22 bp, Homo sapiens
actccccagactgccatgctgg

SEQ ID NO: 7131366 - DNA, 22 bp, Homo sapiens
aagttctaattttgcattcagg

SEQ ID NO: 7131367 - DNA, 22 bp, Homo sapiens
actccaggtaggcacattgaca

SEQ ID NO: 7131368 - DNA, 20 bp, Homo sapiens
actccaggtggcatgaggac

SEQ ID NO: 7131369 - DNA, 20 bp, Homo sapiens
actccaggtggcatgaggac

SEQ ID NO: 7131370 - DNA, 22 bp, Homo sapiens
actccaggtaggcacattgaca

SEQ ID NO: 7131371 - DNA, 20 bp, Homo sapiens
actccaggtggcatgaggac

SEQ ID NO: 7131372 - DNA, 22 bp, Homo sapiens
actccaggtgtgttggactcta

SEQ ID NO: 7131373 - DNA, 22 bp, Homo sapiens
actccaggtgtgttggactcta

SEQ ID NO: 7131374 - DNA, 22 bp, Homo sapiens
actccaggtgtgttggactcta

SEQ ID NO: 7131375 - DNA, 22 bp, Homo sapiens
actccaggttttctctcaagtt

SEQ ID NO: 7131376 - DNA, 22 bp, Homo sapiens
actccaggttttctctcaagtt

SEQ ID NO: 7131377 - DNA, 22 bp, Homo sapiens
aagttcaagagtgacatattag

SEQ ID NO: 7131378 - DNA, 22 bp, Homo sapiens
aagttcaaaaatgtaatcagtg

SEQ ID NO: 7131379 - DNA, 22 bp, Homo sapiens
aagttatttcctcgtgactgaa

SEQ ID NO: 7131380 - DNA, 22 bp, Homo sapiens
aagtttacataagtgatgatga

SEQ ID NO: 7131381 - DNA, 22 bp, Homo sapiens
aagtttaaggtggaagtggtgg

SEQ ID NO: 7131382 - DNA, 22 bp, Homo sapiens
aagtttaacttgaattctttct

SEQ ID NO: 7131383 - DNA, 22 bp, Homo sapiens
aagtttaacttgaattctttct

SEQ ID NO: 7131384 - DNA, 22 bp, Homo sapiens
aagtttaacttgaattctttct

SEQ ID NO: 7131385 - DNA, 22 bp, Homo sapiens
aagtttaacttgaattctttct

SEQ ID NO: 7131386 - DNA, 23 bp, Homo sapiens
aagttgtttttggccagggaaag

SEQ ID NO: 7131387 - DNA, 22 bp, Homo sapiens
aagtttaacttgaattctttct

SEQ ID NO: 7131388 - DNA, 23 bp, Homo sapiens
aagttgtttttggccagggaaag

SEQ ID NO: 7131389 - DNA, 22 bp, Homo sapiens
aagttgttgttgaggtgggtaa

SEQ ID NO: 7131390 - DNA, 22 bp, Homo sapiens
aagttgtatgtcttagaaagta

SEQ ID NO: 7131391 - DNA, 22 bp, Homo sapiens
aagttgttgttgaggtgggtaa

SEQ ID NO: 7131392 - DNA, 22 bp, Homo sapiens
aagttgttgttgaggtgggtaa

SEQ ID NO: 7131393 - DNA, 22 bp, Homo sapiens
aagttggtgtatgagacagaag

SEQ ID NO: 7131394 - DNA, 22 bp, Homo sapiens
aagttggtgtatgagacagaag

SEQ ID NO: 7131395 - DNA, 22 bp, Homo sapiens
aagttggttctgtgacatgttg

SEQ ID NO: 7131396 - DNA, 22 bp, Homo sapiens
aagttggtaggagacagaaggt

SEQ ID NO: 7131397 - DNA, 22 bp, Homo sapiens
aagttgtaacagaaatttaatg

SEQ ID NO: 7131398 - DNA, 22 bp, Homo sapiens
aagttgtagatgaagtaattca

SEQ ID NO: 7131399 - DNA, 22 bp, Homo sapiens
aagttggagctggagctatgga

SEQ ID NO: 7131400 - DNA, 22 bp, Homo sapiens
aagttggtaggagacagaaggt

SEQ ID NO: 7131401 - DNA, 22 bp, Homo sapiens
aagttctactgtgggtaaaatg

SEQ ID NO: 7131402 - DNA, 22 bp, Homo sapiens
aagttctagaggttgatttggt

SEQ ID NO: 7131403 - DNA, 22 bp, Homo sapiens
aagtttactgtccctggaaact

SEQ ID NO: 7131404 - DNA, 22 bp, Homo sapiens
aagtttacataagtgatgatga

SEQ ID NO: 7131405 - DNA, 22 bp, Homo sapiens
aagtttagtgaaactctagggg

SEQ ID NO: 7131406 - DNA, 22 bp, Homo sapiens
aagtttatgttctttgaaggca

SEQ ID NO: 7131407 - DNA, 22 bp, Homo sapiens
aagtttatgttctttgaaggca

SEQ ID NO: 7131408 - DNA, 22 bp, Homo sapiens
aagtttatgttggtaagatatc

SEQ ID NO: 7131409 - DNA, 22 bp, Homo sapiens
aagtttatgttggtaagatatc

SEQ ID NO: 7131410 - DNA, 22 bp, Homo sapiens
aagtttatgttggtaagatatc

SEQ ID NO: 7131411 - DNA, 22 bp, Homo sapiens
aagtttatccctctcacagtta

SEQ ID NO: 7131412 - DNA, 22 bp, Homo sapiens
aagtttatctttgctgggtact

SEQ ID NO: 7131413 - DNA, 22 bp, Homo sapiens
aagtttcatgatgtaattattg

SEQ ID NO: 7131414 - DNA, 22 bp, Homo sapiens
aagtttcatgatgtaattattg

SEQ ID NO: 7131415 - DNA, 22 bp, Homo sapiens
aagtttcatgtggaggtagact

SEQ ID NO: 7131416 - DNA, 22 bp, Homo sapiens
aagtttcattgttcatgtaaca

SEQ ID NO: 7131417 - DNA, 22 bp, Homo sapiens
aagtttcaaatgttgattatgc

SEQ ID NO: 7131418 - DNA, 22 bp, Homo sapiens
aagtttattaattgacttgtgc

SEQ ID NO: 7131419 - DNA, 22 bp, Homo sapiens
aagtttatgttggtaagatatc

SEQ ID NO: 7131420 - DNA, 22 bp, Homo sapiens
aataagatcctgaagatatgtt

SEQ ID NO: 7131421 - DNA, 22 bp, Homo sapiens
aataagatcctgaagatatgtt

SEQ ID NO: 7131422 - DNA, 22 bp, Homo sapiens
aataagatcctgaagatatgtt

SEQ ID NO: 7131423 - DNA, 22 bp, Homo sapiens
aataagataagatttctgctct

SEQ ID NO: 7131424 - DNA, 22 bp, Homo sapiens
aataagataagatttctgctct

SEQ ID NO: 7131425 - DNA, 22 bp, Homo sapiens
aataagatcctgaagatatgtt

SEQ ID NO: 7131426 - DNA, 22 bp, Homo sapiens
aataagatcctgaagatatgtt

SEQ ID NO: 7131427 - DNA, 22 bp, Homo sapiens
aataagacacacaactgtcaag

SEQ ID NO: 7131428 - DNA, 22 bp, Homo sapiens
aataacttcagttcttacatta

SEQ ID NO: 7131429 - DNA, 22 bp, Homo sapiens
aataagaatttacttgtcaaga

SEQ ID NO: 7131430 - DNA, 22 bp, Homo sapiens
aataatattcctctgtgtgcgt

SEQ ID NO: 7131431 - DNA, 20 bp, Homo sapiens
actgccttggttcagtaggt

SEQ ID NO: 7131432 - DNA, 20 bp, Homo sapiens
actgccttggttcagtaggt

SEQ ID NO: 7131433 - DNA, 22 bp, Homo sapiens
actgccttgtctcttgcctgtt

SEQ ID NO: 7131434 - DNA, 22 bp, Homo sapiens
actgccttgtctcttgcctgtt

SEQ ID NO: 7131435 - DNA, 22 bp, Homo sapiens
actgcgctccagcctgggtgac

SEQ ID NO: 7131436 - DNA, 22 bp, Homo sapiens
actgcgctccagcctgggtgac

SEQ ID NO: 7131437 - DNA, 22 bp, Homo sapiens
actgccttatatgctgtgtgtg

SEQ ID NO: 7131438 - DNA, 22 bp, Homo sapiens
actgccttatatgctgtgtgtg

SEQ ID NO: 7131439 - DNA, 22 bp, Homo sapiens
actgccttatatgctgtgtgtg

SEQ ID NO: 7131440 - DNA, 22 bp, Homo sapiens
actgccttctgctcagggttca

SEQ ID NO: 7131441 - DNA, 22 bp, Homo sapiens
actgccttgaaagattgttgag

SEQ ID NO: 7131442 - DNA, 22 bp, Homo sapiens
actgccttgattgccagtttcc

SEQ ID NO: 7131443 - DNA, 22 bp, Homo sapiens
aataagattactggttgtctga

SEQ ID NO: 7131444 - DNA, 22 bp, Homo sapiens
aataagattgacacaagtacct

SEQ ID NO: 7131445 - DNA, 22 bp, Homo sapiens
aataagattgacacaagtacct

SEQ ID NO: 7131446 - DNA, 22 bp, Homo sapiens
aataagatcttaaaggttatat

SEQ ID NO: 7131447 - DNA, 22 bp, Homo sapiens
aataagatcttaaaggttatat

SEQ ID NO: 7131448 - DNA, 22 bp, Homo sapiens
aataagatcttaaaggttatat

SEQ ID NO: 7131449 - DNA, 22 bp, Homo sapiens
aataagatcctgaagatatgtt

SEQ ID NO: 7131450 - DNA, 22 bp, Homo sapiens
aataagatgtgcttgagtttgg

SEQ ID NO: 7131451 - DNA, 22 bp, Homo sapiens
actgcctgtgtcccttcagtgc

SEQ ID NO: 7131452 - DNA, 22 bp, Homo sapiens
actgcctgtttggcatggcccc

SEQ ID NO: 7131453 - DNA, 22 bp, Homo sapiens
actgccttagaacaaagcagga

SEQ ID NO: 7131454 - DNA, 22 bp, Homo sapiens
actgccttataatatgtcaaca

SEQ ID NO: 7131455 - DNA, 22 bp, Homo sapiens
aataattagtgggacagagaac

SEQ ID NO: 7131456 - DNA, 22 bp, Homo sapiens
aataattagtgggacagagaac

SEQ ID NO: 7131457 - DNA, 22 bp, Homo sapiens
aataattacccatctttttgta

SEQ ID NO: 7131458 - DNA, 22 bp, Homo sapiens
aataatgtttatttgtattctc

SEQ ID NO: 7131459 - DNA, 22 bp, Homo sapiens
aataattacccatctttttgta

SEQ ID NO: 7131460 - DNA, 22 bp, Homo sapiens
aataattagtgggacagagaac

SEQ ID NO: 7131461 - DNA, 19 bp, Homo sapiens
aataatgttcatgagattg

SEQ ID NO: 7131462 - DNA, 19 bp, Homo sapiens
aataatgttcatgagattg

SEQ ID NO: 7131463 - DNA, 19 bp, Homo sapiens
aataatgttcatgagattg

SEQ ID NO: 7131464 - DNA, 22 bp, Homo sapiens
aataatgtgtgctgcagtctta

SEQ ID NO: 7131465 - DNA, 22 bp, Homo sapiens
aataatgttatgtcattcttct

SEQ ID NO: 7131466 - DNA, 19 bp, Homo sapiens
aataatgttcatgagattg

SEQ ID NO: 7131467 - DNA, 22 bp, Homo sapiens
aataatgtttatttgtattctc

SEQ ID NO: 7131468 - DNA, 22 bp, Homo sapiens
aataatttccagccaactggaa

SEQ ID NO: 7131469 - DNA, 22 bp, Homo sapiens
aataatttccagccaactggaa

SEQ ID NO: 7131470 - DNA, 22 bp, Homo sapiens
aataatttccagccaactggaa

SEQ ID NO: 7131471 - DNA, 22 bp, Homo sapiens
aataatttccagccaactggaa

SEQ ID NO: 7131472 - DNA, 21 bp, Homo sapiens
aataattcagacattgttgtt

SEQ ID NO: 7131473 - DNA, 21 bp, Homo sapiens
aataattcagacattgttgtt

SEQ ID NO: 7131474 - DNA, 22 bp, Homo sapiens
aataatttccagccaactggaa

SEQ ID NO: 7131475 - DNA, 22 bp, Homo sapiens
aataattatttgagagcagacc

SEQ ID NO: 7131476 - DNA, 22 bp, Homo sapiens
aataattagtgggacagagaac

SEQ ID NO: 7131477 - DNA, 22 bp, Homo sapiens
aataattagtgggacagagaac

SEQ ID NO: 7131478 - DNA, 22 bp, Homo sapiens
aataattatttgagagcagacc

SEQ ID NO: 7131479 - DNA, 22 bp, Homo sapiens
aataattttgagagcctggaaa

SEQ ID NO: 7131480 - DNA, 22 bp, Homo sapiens
aataattttgagagcctggaaa

SEQ ID NO: 7131481 - DNA, 22 bp, Homo sapiens
aataattttgagagcctggaaa

SEQ ID NO: 7131482 - DNA, 22 bp, Homo sapiens
aatacaatcaaattcactagca

SEQ ID NO: 7131483 - DNA, 22 bp, Homo sapiens
aatacaatcaaattcactagca

SEQ ID NO: 7131484 - DNA, 22 bp, Homo sapiens
aatacaatcaaattcactagca

SEQ ID NO: 7131485 - DNA, 22 bp, Homo sapiens
aatacaatcaaattcactagca

SEQ ID NO: 7131486 - DNA, 22 bp, Homo sapiens
aataattttagctcagagttgt

SEQ ID NO: 7131487 - DNA, 22 bp, Homo sapiens
aataattttgagagcctggaaa

SEQ ID NO: 7131488 - DNA, 22 bp, Homo sapiens
aataattttagctcagagttgt

SEQ ID NO: 7131489 - DNA, 22 bp, Homo sapiens
aataattttagctcagagttgt

SEQ ID NO: 7131490 - DNA, 22 bp, Homo sapiens
aataattttagctcagagttgt

SEQ ID NO: 7131491 - DNA, 22 bp, Homo sapiens
agaagtatgtgagaaattatcc

SEQ ID NO: 7131492 - DNA, 22 bp, Homo sapiens
agaagtatgtgagaaattatcc

SEQ ID NO: 7131493 - DNA, 22 bp, Homo sapiens
agaagtagtccagtggaaagta

SEQ ID NO: 7131494 - DNA, 23 bp, Homo sapiens
agaagggtccttggcagcgacag

SEQ ID NO: 7131495 - DNA, 22 bp, Homo sapiens
agaaggtggctactcagtcatc

SEQ ID NO: 7131496 - DNA, 22 bp, Homo sapiens
agaagtaggcagggctgtatca

SEQ ID NO: 7131497 - DNA, 22 bp, Homo sapiens
agaagggccagctggacacctg

SEQ ID NO: 7131498 - DNA, 21 bp, Homo sapiens
agaagggattgtggtaaagat

SEQ ID NO: 7131499 - DNA, 22 bp, Homo sapiens
agaaggggagaagctaccagga

SEQ ID NO: 7131500 - DNA, 22 bp, Homo sapiens
agaaggggagaagctaccagga

SEQ ID NO: 7131501 - DNA, 22 bp, Homo sapiens
agaaggggagaagctaccagga

SEQ ID NO: 7131502 - DNA, 22 bp, Homo sapiens
agaaggggcccaaggatgtcag

SEQ ID NO: 7131503 - DNA, 22 bp, Homo sapiens
agaaggggcccaaggatgtcag

SEQ ID NO: 7131504 - DNA, 22 bp, Homo sapiens
aatgcaaacttcttgttacttg

SEQ ID NO: 7131505 - DNA, 22 bp, Homo sapiens
aatgcaaacttcttgttacttg

SEQ ID NO: 7131506 - DNA, 22 bp, Homo sapiens
aatgcaaagagttgcttatcaa

SEQ ID NO: 7131507 - DNA, 22 bp, Homo sapiens
aatgcaaagcaagcagagattt

SEQ ID NO: 7131508 - DNA, 22 bp, Homo sapiens
aatgcaaacagcccagaatcca

SEQ ID NO: 7131509 - DNA, 22 bp, Homo sapiens
agaagtattctgcatgtactga

SEQ ID NO: 7131510 - DNA, 22 bp, Homo sapiens
aatgcaaactccactggagcag

SEQ ID NO: 7131511 - DNA, 22 bp, Homo sapiens
aatgcaaacttcttgttacttg

SEQ ID NO: 7131512 - DNA, 22 bp, Homo sapiens
aatgcaaagcaagcagagattt

SEQ ID NO: 7131513 - DNA, 22 bp, Homo sapiens
aatgcaaagctctttaatcctt

SEQ ID NO: 7131514 - DNA, 22 bp, Homo sapiens
aatgcaaagtgaggtgagtggc

SEQ ID NO: 7131515 - DNA, 22 bp, Homo sapiens
aatgcaaagtgaggtgagtggc

SEQ ID NO: 7131516 - DNA, 22 bp, Homo sapiens
aatgcaaatgtaagggtgggat

SEQ ID NO: 7131517 - DNA, 22 bp, Homo sapiens
aatgcaaattatcaggcttctc

SEQ ID NO: 7131518 - DNA, 22 bp, Homo sapiens
aatgcaaattctagggccctat

SEQ ID NO: 7131519 - DNA, 22 bp, Homo sapiens
aatgcaacctgctgatctgaca

SEQ ID NO: 7131520 - DNA, 22 bp, Homo sapiens
aatgcaagatcaaatctaacac

SEQ ID NO: 7131521 - DNA, 22 bp, Homo sapiens
agacaggctgctgtctgctagg

SEQ ID NO: 7131522 - DNA, 22 bp, Homo sapiens
agacaggccactctggtctggt

SEQ ID NO: 7131523 - DNA, 22 bp, Homo sapiens
agacaggccactctggtctggt

SEQ ID NO: 7131524 - DNA, 22 bp, Homo sapiens
agacagcacttttgtatggggg

SEQ ID NO: 7131525 - DNA, 22 bp, Homo sapiens
agacagcacttttgtatggggg

SEQ ID NO: 7131526 - DNA, 22 bp, Homo sapiens
agacagcagaaactagagcact

SEQ ID NO: 7131527 - DNA, 22 bp, Homo sapiens
agacagcagaaactagagcact

SEQ ID NO: 7131528 - DNA, 22 bp, Homo sapiens
agacagcagaaactagagcact

SEQ ID NO: 7131529 - DNA, 22 bp, Homo sapiens
agacagcagaaactagagcact

SEQ ID NO: 7131530 - DNA, 21 bp, Homo sapiens
agacagagtgcagtctacata

SEQ ID NO: 7131531 - DNA, 21 bp, Homo sapiens
agacagagtgcagtctacata

SEQ ID NO: 7131532 - DNA, 21 bp, Homo sapiens
agacagagtgcagtctacata

SEQ ID NO: 7131533 - DNA, 21 bp, Homo sapiens
agacagagtgcagtctacata

SEQ ID NO: 7131534 - DNA, 21 bp, Homo sapiens
agacagagtgcagtctacata

SEQ ID NO: 7131535 - DNA, 21 bp, Homo sapiens
agacagagtgcagtctacata

SEQ ID NO: 7131536 - DNA, 19 bp, Homo sapiens
agacagagctcagtgggtt

SEQ ID NO: 7131537 - DNA, 23 bp, Homo sapiens
agacagaggctgaggctggccgc

SEQ ID NO: 7131538 - DNA, 19 bp, Homo sapiens
agacagagctcagtgggtt

SEQ ID NO: 7131539 - DNA, 19 bp, Homo sapiens
agacagagctcagtgggtt

SEQ ID NO: 7131540 - DNA, 19 bp, Homo sapiens
agacagagctcagtgggtt

SEQ ID NO: 7131541 - DNA, 19 bp, Homo sapiens
agacagagactgaaataga

SEQ ID NO: 7131542 - DNA, 22 bp, Homo sapiens
agacagagatactatgttgtca

SEQ ID NO: 7131543 - DNA, 22 bp, Homo sapiens
agacagagatactatgttgtca

SEQ ID NO: 7131544 - DNA, 19 bp, Homo sapiens
agacagagactgaaataga

SEQ ID NO: 7131545 - DNA, 22 bp, Homo sapiens
aatgcaatgcagcacctccttg

SEQ ID NO: 7131546 - DNA, 18 bp, Homo sapiens
aatgcaatgtatttgcag

SEQ ID NO: 7131547 - DNA, 23 bp, Homo sapiens
agacactgtaaagaattgcagtt

SEQ ID NO: 7131548 - DNA, 23 bp, Homo sapiens
agacactgtaaagaattgcagtt

SEQ ID NO: 7131549 - DNA, 22 bp, Homo sapiens
agacagactttgatctggatgt

SEQ ID NO: 7131550 - DNA, 22 bp, Homo sapiens
aatgcaatacctttttatgctg

SEQ ID NO: 7131551 - DNA, 22 bp, Homo sapiens
aatgcaatgcagcacctccttg

SEQ ID NO: 7131552 - DNA, 22 bp, Homo sapiens
aatgtctctatatctcataaga

SEQ ID NO: 7131553 - DNA, 22 bp, Homo sapiens
aatgtctcttgagaggcgaaac

SEQ ID NO: 7131554 - DNA, 22 bp, Homo sapiens
aatgtctgaggctcatctgagg

SEQ ID NO: 7131555 - DNA, 22 bp, Homo sapiens
aatgtcttacatttactgagca

SEQ ID NO: 7131556 - DNA, 22 bp, Homo sapiens
aatgtcttcagtgtatacatgg

SEQ ID NO: 7131557 - DNA, 22 bp, Homo sapiens
aatgtcttcagtgtatacatgg

SEQ ID NO: 7131558 - DNA, 22 bp, Homo sapiens
aatgtgttcacaggaaatacag

SEQ ID NO: 7131559 - DNA, 22 bp, Homo sapiens
aatgtcatttaaaataattctg

SEQ ID NO: 7131560 - DNA, 22 bp, Homo sapiens
aatgtcattgtgagttaggctt

SEQ ID NO: 7131561 - DNA, 22 bp, Homo sapiens
aatgtcatttaaaataattctg

SEQ ID NO: 7131562 - DNA, 22 bp, Homo sapiens
aatgtcattggtaaagattagg

SEQ ID NO: 7131563 - DNA, 22 bp, Homo sapiens
aatgtcattggtaaagattagg

SEQ ID NO: 7131564 - DNA, 22 bp, Homo sapiens
aatgtcatttaaagacaaagaa

SEQ ID NO: 7131565 - DNA, 22 bp, Homo sapiens
aatgtcatttaggattatgttt

SEQ ID NO: 7131566 - DNA, 18 bp, Homo sapiens
aatgtccagtgttcatat

SEQ ID NO: 7131567 - DNA, 22 bp, Homo sapiens
aatgtcctaggcatgattttgt

SEQ ID NO: 7131568 - DNA, 22 bp, Homo sapiens
aatgtcctcagaggtgtgtaga

SEQ ID NO: 7131569 - DNA, 19 bp, Homo sapiens
aatgtcctcctctcttttc

SEQ ID NO: 7131570 - DNA, 22 bp, Homo sapiens
aatgtcctctttagagggttac

SEQ ID NO: 7131571 - DNA, 22 bp, Homo sapiens
aatgtcctggagggcggccgct

SEQ ID NO: 7131572 - DNA, 22 bp, Homo sapiens
aatgtcctgttaaattttccca

SEQ ID NO: 7131573 - DNA, 17 bp, Homo sapiens
aatgtccttggaccaca

SEQ ID NO: 7131574 - DNA, 17 bp, Homo sapiens
aatgtccttggaccaca

SEQ ID NO: 7131575 - DNA, 22 bp, Homo sapiens
aatgtctacagcaaaccccaca

SEQ ID NO: 7131576 - DNA, 22 bp, Homo sapiens
aatgtctagacatgttaatgca

SEQ ID NO: 7131577 - DNA, 22 bp, Homo sapiens
aatgtctagacatgttaatgca

SEQ ID NO: 7131578 - DNA, 22 bp, Homo sapiens
aatgtctagacatgttaatgca

SEQ ID NO: 7131579 - DNA, 22 bp, Homo sapiens
aatgtctagagttttaagctta

SEQ ID NO: 7131580 - DNA, 22 bp, Homo sapiens
aatgtctatgatcctttaagtt

SEQ ID NO: 7131581 - DNA, 22 bp, Homo sapiens
aatgtctatttgctacaaagcc

SEQ ID NO: 7131582 - DNA, 22 bp, Homo sapiens
aatgtattcctcatgcaagagt

SEQ ID NO: 7131583 - DNA, 22 bp, Homo sapiens
aatgtattctctttataagata

SEQ ID NO: 7131584 - DNA, 22 bp, Homo sapiens
aatgtattcctcatgcaagagt

SEQ ID NO: 7131585 - DNA, 22 bp, Homo sapiens
agacagggtgatcgcttgagcc

SEQ ID NO: 7131586 - DNA, 22 bp, Homo sapiens
agacagggtgatcgcttgagcc

SEQ ID NO: 7131587 - DNA, 22 bp, Homo sapiens
aatgtattcctcatgcaagagt

SEQ ID NO: 7131588 - DNA, 22 bp, Homo sapiens
agacagggtgatcgcttgagcc

SEQ ID NO: 7131589 - DNA, 22 bp, Homo sapiens
agacagggtgatcgcttgagcc

SEQ ID NO: 7131590 - DNA, 22 bp, Homo sapiens
agacagggtgatcgcttgagcc

SEQ ID NO: 7131591 - DNA, 22 bp, Homo sapiens
agacagggtgatcgcttgagcc

SEQ ID NO: 7131592 - DNA, 22 bp, Homo sapiens
agacagggtcttgatcagagct

SEQ ID NO: 7131593 - DNA, 22 bp, Homo sapiens
agacagggtcttgatcagagct

SEQ ID NO: 7131594 - DNA, 22 bp, Homo sapiens
agacagggtcttgatcagagct

SEQ ID NO: 7131595 - DNA, 22 bp, Homo sapiens
agacagggagggagcgcggctg

SEQ ID NO: 7131596 - DNA, 22 bp, Homo sapiens
agacagggccactcatcctcac

SEQ ID NO: 7131597 - DNA, 22 bp, Homo sapiens
agacagggagggagcgcggctg

SEQ ID NO: 7131598 - DNA, 22 bp, Homo sapiens
agacagggagggagcgcggctg

SEQ ID NO: 7131599 - DNA, 22 bp, Homo sapiens
agacagggagggagcgcggctg

SEQ ID NO: 7131600 - DNA, 22 bp, Homo sapiens
agacagggagggagcgcggctg

SEQ ID NO: 7131601 - DNA, 22 bp, Homo sapiens
agacagggtcttgatcagagct

SEQ ID NO: 7131602 - DNA, 22 bp, Homo sapiens
agacagggtcttgatcagagct

SEQ ID NO: 7131603 - DNA, 22 bp, Homo sapiens
agacagggccactcatcctcac

SEQ ID NO: 7131604 - DNA, 22 bp, Homo sapiens
agacagggccactcatcctcac

SEQ ID NO: 7131605 - DNA, 22 bp, Homo sapiens
agacagggccactcatcctcac

SEQ ID NO: 7131606 - DNA, 22 bp, Homo sapiens
aatgtcatagcaaagagagtga

SEQ ID NO: 7131607 - DNA, 22 bp, Homo sapiens
aatgtcatagcatttcttcaat

SEQ ID NO: 7131608 - DNA, 22 bp, Homo sapiens
aatgtattctctttataagata

SEQ ID NO: 7131609 - DNA, 22 bp, Homo sapiens
aatgtattctctttataagata

SEQ ID NO: 7131610 - DNA, 22 bp, Homo sapiens
aatgtcaatctcagagaacaca

SEQ ID NO: 7131611 - DNA, 22 bp, Homo sapiens
aatgtcaattaccagaacagaa

SEQ ID NO: 7131612 - DNA, 21 bp, Homo sapiens
aatgtcattgaatggtgagac

SEQ ID NO: 7131613 - DNA, 22 bp, Homo sapiens
aatgtcatgggaatttattcat

SEQ ID NO: 7131614 - DNA, 22 bp, Homo sapiens
aatgtcattgagctccaatcct

SEQ ID NO: 7131615 - DNA, 22 bp, Homo sapiens
aatgtcattggtaaagattagg

SEQ ID NO: 7131616 - DNA, 22 bp, Homo sapiens
aatgtcattggtaaagattagg

SEQ ID NO: 7131617 - DNA, 22 bp, Homo sapiens
aatgtcatgggaatttattcat

SEQ ID NO: 7131618 - DNA, 22 bp, Homo sapiens
aatgtcatgagcctgctcttgt

SEQ ID NO: 7131619 - DNA, 22 bp, Homo sapiens
aatgtcatgagcctgctcttgt

SEQ ID NO: 7131620 - DNA, 22 bp, Homo sapiens
aatgtcatagcatttcttcaat

SEQ ID NO: 7131621 - DNA, 22 bp, Homo sapiens
agagctggggccagagtcaagg

SEQ ID NO: 7131622 - DNA, 22 bp, Homo sapiens
agagctggggcataaatgccac

SEQ ID NO: 7131623 - DNA, 22 bp, Homo sapiens
aatttatatgtaattaggcaca

SEQ ID NO: 7131624 - DNA, 22 bp, Homo sapiens
aatttatatgtaattaggcaca

SEQ ID NO: 7131625 - DNA, 22 bp, Homo sapiens
aatttatatgtaattaggcaca

SEQ ID NO: 7131626 - DNA, 22 bp, Homo sapiens
aatttatatgtaattaggcaca

SEQ ID NO: 7131627 - DNA, 22 bp, Homo sapiens
aatttataataaatagggcttt

SEQ ID NO: 7131628 - DNA, 22 bp, Homo sapiens
aatttataataaatagggcttt

SEQ ID NO: 7131629 - DNA, 23 bp, Homo sapiens
aatttagtttgagacattagcct

SEQ ID NO: 7131630 - DNA, 22 bp, Homo sapiens
aatttataataaatagggcttt

SEQ ID NO: 7131631 - DNA, 22 bp, Homo sapiens
aatttagattgataaacatgga

SEQ ID NO: 7131632 - DNA, 22 bp, Homo sapiens
aatttagtccttacagtgcaga

SEQ ID NO: 7131633 - DNA, 22 bp, Homo sapiens
aatttagtgtaaagctactgga

SEQ ID NO: 7131634 - DNA, 22 bp, Homo sapiens
aatttacaggtgcactcgccat

SEQ ID NO: 7131635 - DNA, 22 bp, Homo sapiens
aatttacaggtgcactcgccat

SEQ ID NO: 7131636 - DNA, 22 bp, Homo sapiens
aatttacagttgctgatggtac

SEQ ID NO: 7131637 - DNA, 22 bp, Homo sapiens
aatttacaggtgcactcgccat

SEQ ID NO: 7131638 - DNA, 22 bp, Homo sapiens
aatttacacttcatttggaggg

SEQ ID NO: 7131639 - DNA, 22 bp, Homo sapiens
aatttacaggtgcactcgccat

SEQ ID NO: 7131640 - DNA, 22 bp, Homo sapiens
aatttacacttcatttggaggg

SEQ ID NO: 7131641 - DNA, 22 bp, Homo sapiens
aatttacacttcatttggaggg

SEQ ID NO: 7131642 - DNA, 22 bp, Homo sapiens
aatttacagttgctgatggtac

SEQ ID NO: 7131643 - DNA, 22 bp, Homo sapiens
aatttacagttgctgatggtac

SEQ ID NO: 7131644 - DNA, 22 bp, Homo sapiens
aatttacagttgctgatggtac

SEQ ID NO: 7131645 - DNA, 22 bp, Homo sapiens
aatttacagttgctgatggtac

SEQ ID NO: 7131646 - DNA, 20 bp, Homo sapiens
aatttactcacagaatgaat

SEQ ID NO: 7131647 - DNA, 22 bp, Homo sapiens
aatttacctctaaacaggagcc

SEQ ID NO: 7131648 - DNA, 20 bp, Homo sapiens
aattatataactccaacatt

SEQ ID NO: 7131649 - DNA, 20 bp, Homo sapiens
aattatataactccaacatt

SEQ ID NO: 7131650 - DNA, 20 bp, Homo sapiens
aattatataactccaacatt

SEQ ID NO: 7131651 - DNA, 21 bp, Homo sapiens
aattagtgctccttgtttcaa

SEQ ID NO: 7131652 - DNA, 22 bp, Homo sapiens
aattagttcaatggatgataga

SEQ ID NO: 7131653 - DNA, 22 bp, Homo sapiens
aattatatgttaatcttcaatt

SEQ ID NO: 7131654 - DNA, 22 bp, Homo sapiens
aattatatgttaatcttcaatt

SEQ ID NO: 7131655 - DNA, 22 bp, Homo sapiens
aattatattgaagttgaatgtc

SEQ ID NO: 7131656 - DNA, 20 bp, Homo sapiens
aattatataactccaacatt

SEQ ID NO: 7131657 - DNA, 22 bp, Homo sapiens
aattatatgttaatcttcaatt

SEQ ID NO: 7131658 - DNA, 22 bp, Homo sapiens
aattatatgttaatcttcaatt

SEQ ID NO: 7131659 - DNA, 22 bp, Homo sapiens
aattatggtggatcccagtggg

SEQ ID NO: 7131660 - DNA, 22 bp, Homo sapiens
aattatggtgtgtggttaaggg

SEQ ID NO: 7131661 - DNA, 22 bp, Homo sapiens
aattatgtagccatatgaaaca

SEQ ID NO: 7131662 - DNA, 22 bp, Homo sapiens
aattatggaatttttagagaag

SEQ ID NO: 7131663 - DNA, 22 bp, Homo sapiens
aattatggaatttttagagaag

SEQ ID NO: 7131664 - DNA, 22 bp, Homo sapiens
aattatggtatgttcaacaact

SEQ ID NO: 7131665 - DNA, 22 bp, Homo sapiens
aattatggtcactgttcctggg

SEQ ID NO: 7131666 - DNA, 22 bp, Homo sapiens
aattatattgtggtgtgaatgt

SEQ ID NO: 7131667 - DNA, 22 bp, Homo sapiens
aattatattgtggtgtgaatgt

SEQ ID NO: 7131668 - DNA, 22 bp, Homo sapiens
aattatattgtggtgtgaatgt

SEQ ID NO: 7131669 - DNA, 22 bp, Homo sapiens
aattatattgtggtgtgaatgt

SEQ ID NO: 7131670 - DNA, 22 bp, Homo sapiens
aattatattgtggtgtgaatgt

SEQ ID NO: 7131671 - DNA, 22 bp, Homo sapiens
aattatcagatataaaactgca

SEQ ID NO: 7131672 - DNA, 22 bp, Homo sapiens
aattatcagatataaaactgca

SEQ ID NO: 7131673 - DNA, 23 bp, Homo sapiens
aattatctatttcaaatttagca

SEQ ID NO: 7131674 - DNA, 22 bp, Homo sapiens
aattatctgtaaatggcaattt

SEQ ID NO: 7131675 - DNA, 22 bp, Homo sapiens
aatgttatttctgcatagtagt

SEQ ID NO: 7131676 - DNA, 22 bp, Homo sapiens
aatgttattgtcctttccaaaa

SEQ ID NO: 7131677 - DNA, 22 bp, Homo sapiens
aatgtgtttatttagtgattta

SEQ ID NO: 7131678 - DNA, 22 bp, Homo sapiens
aatgttatttctgcatagtagt

SEQ ID NO: 7131679 - DNA, 22 bp, Homo sapiens
aatgttcaaacagatcacttag

SEQ ID NO: 7131680 - DNA, 22 bp, Homo sapiens
aatgttcaaacagatcacttag

SEQ ID NO: 7131681 - DNA, 20 bp, Homo sapiens
aatgttcaaaggtgatggca

SEQ ID NO: 7131682 - DNA, 22 bp, Homo sapiens
aatgttcaacagatggatattt

SEQ ID NO: 7131683 - DNA, 22 bp, Homo sapiens
aatgttcagaggacaatataaa

SEQ ID NO: 7131684 - DNA, 20 bp, Homo sapiens
aatgttcagtaattgtttta

SEQ ID NO: 7131685 - DNA, 22 bp, Homo sapiens
aatgttctgcaactgttttcat

SEQ ID NO: 7131686 - DNA, 22 bp, Homo sapiens
aatgttgcagagtgattgtcca

SEQ ID NO: 7131687 - DNA, 22 bp, Homo sapiens
aatgttgcagagtgattgtcca

SEQ ID NO: 7131688 - DNA, 22 bp, Homo sapiens
aatgttgcagagtgattgtcca

SEQ ID NO: 7131689 - DNA, 22 bp, Homo sapiens
aatgttcctatttaccccctaa

SEQ ID NO: 7131690 - DNA, 22 bp, Homo sapiens
aatgttcattgattaaatgaat

SEQ ID NO: 7131691 - DNA, 22 bp, Homo sapiens
aatgttcattgttttccatatg

SEQ ID NO: 7131692 - DNA, 22 bp, Homo sapiens
aatgttcagtatctggtccacc

SEQ ID NO: 7131693 - DNA, 22 bp, Homo sapiens
aattagtattgcgattcattag

SEQ ID NO: 7131694 - DNA, 22 bp, Homo sapiens
aattagtaacctaattccatct

SEQ ID NO: 7131695 - DNA, 22 bp, Homo sapiens
aattagtattgcgattcattag

SEQ ID NO: 7131696 - DNA, 22 bp, Homo sapiens
aattagggaggacaaaggtaca

SEQ ID NO: 7131697 - DNA, 22 bp, Homo sapiens
aattagtaacctaattccatct

SEQ ID NO: 7131698 - DNA, 22 bp, Homo sapiens
aattagctttacctaggattgt

SEQ ID NO: 7131699 - DNA, 22 bp, Homo sapiens
aattagctttccgccatcacac

SEQ ID NO: 7131700 - DNA, 22 bp, Homo sapiens
aattaggaaattcagccatttt

SEQ ID NO: 7131701 - DNA, 22 bp, Homo sapiens
aattaggcaaattaatttctct

SEQ ID NO: 7131702 - DNA, 22 bp, Homo sapiens
aattaggcaaattaatttctct

SEQ ID NO: 7131703 - DNA, 22 bp, Homo sapiens
aattaggcatattataaggcat

SEQ ID NO: 7131704 - DNA, 20 bp, Homo sapiens
aattaggctgtgtaagtctt

SEQ ID NO: 7131705 - DNA, 22 bp, Homo sapiens
aattaccaggatttttcagtat

SEQ ID NO: 7131706 - DNA, 22 bp, Homo sapiens
aatgtttggctagatagatgga

SEQ ID NO: 7131707 - DNA, 22 bp, Homo sapiens
aatgtttggctagatagatgga

SEQ ID NO: 7131708 - DNA, 22 bp, Homo sapiens
aattacctgtcatacatcaagc

SEQ ID NO: 7131709 - DNA, 22 bp, Homo sapiens
aattagctgtcaatgaggatct

SEQ ID NO: 7131710 - DNA, 20 bp, Homo sapiens
aattagcttaagtcaatcag

SEQ ID NO: 7131711 - DNA, 22 bp, Homo sapiens
aattagcttatgtgtacttttc

SEQ ID NO: 7131712 - DNA, 22 bp, Homo sapiens
aattagcttcagcttgtggggc

SEQ ID NO: 7131713 - DNA, 22 bp, Homo sapiens
aatgttgtatggtgccttcaga

SEQ ID NO: 7131714 - DNA, 22 bp, Homo sapiens
aatgttgtgcatgtattttgta

SEQ ID NO: 7131715 - DNA, 22 bp, Homo sapiens
aatgttgttctctgcaaacaca

SEQ ID NO: 7131716 - DNA, 19 bp, Homo sapiens
aatgtttaagagaaaaagg

SEQ ID NO: 7131717 - DNA, 22 bp, Homo sapiens
aatgtttcaattaagtctttta

SEQ ID NO: 7131718 - DNA, 22 bp, Homo sapiens
aatgtttcaattaagtctttta

SEQ ID NO: 7131719 - DNA, 22 bp, Homo sapiens
aatgtttgaccaaaaaactgca

SEQ ID NO: 7131720 - DNA, 22 bp, Homo sapiens
aatgtttgagcatctacatgct

SEQ ID NO: 7131721 - DNA, 22 bp, Homo sapiens
aatgtttgcatctattcacatg

SEQ ID NO: 7131722 - DNA, 22 bp, Homo sapiens
aatgtttgcatctattcacatg

SEQ ID NO: 7131723 - DNA, 22 bp, Homo sapiens
agcacaggtacggagatgctac

SEQ ID NO: 7131724 - DNA, 22 bp, Homo sapiens
agcaaggcagtcagctggctgg

SEQ ID NO: 7131725 - DNA, 22 bp, Homo sapiens
agcacaggtaatacagagtaac

SEQ ID NO: 7131726 - DNA, 22 bp, Homo sapiens
agcaaggcagctttcactgctt

SEQ ID NO: 7131727 - DNA, 22 bp, Homo sapiens
agcaaggcagctttcactgctt

SEQ ID NO: 7131728 - DNA, 22 bp, Homo sapiens
agcaaggattatcctgggaagg

SEQ ID NO: 7131729 - DNA, 22 bp, Homo sapiens
agcaaggattatcctgggaagg

SEQ ID NO: 7131730 - DNA, 21 bp, Homo sapiens
agcaaggcagcctctcagcct

SEQ ID NO: 7131731 - DNA, 22 bp, Homo sapiens
agcaaggaaagtaggcacggaa

SEQ ID NO: 7131732 - DNA, 22 bp, Homo sapiens
agcaaggaaagtaggcacggaa

SEQ ID NO: 7131733 - DNA, 22 bp, Homo sapiens
agcaaggagtagaacaagagtg

SEQ ID NO: 7131734 - DNA, 22 bp, Homo sapiens
agcaaggagtagaacaagagtg

SEQ ID NO: 7131735 - DNA, 22 bp, Homo sapiens
agcacaggtacggagatgctac

SEQ ID NO: 7131736 - DNA, 20 bp, Homo sapiens
agcaccagtgggggcagccc

SEQ ID NO: 7131737 - DNA, 20 bp, Homo sapiens
agcaccagtgggggcagccc

SEQ ID NO: 7131738 - DNA, 20 bp, Homo sapiens
agcaccagtgggggcagccc

SEQ ID NO: 7131739 - DNA, 22 bp, Homo sapiens
agcaccagtttcgtcgtgacaa

SEQ ID NO: 7131740 - DNA, 21 bp, Homo sapiens
agcaccagttttatgccaggc

SEQ ID NO: 7131741 - DNA, 21 bp, Homo sapiens
agcaccagttttatgccaggc

SEQ ID NO: 7131742 - DNA, 21 bp, Homo sapiens
agcaccagttttatgccaggc

SEQ ID NO: 7131743 - DNA, 19 bp, Homo sapiens
agcaccatagccctgaaag

SEQ ID NO: 7131744 - DNA, 22 bp, Homo sapiens
agcaccatcagatgcaatatct

SEQ ID NO: 7131745 - DNA, 22 bp, Homo sapiens
agcaagctcttggaaatgagct

SEQ ID NO: 7131746 - DNA, 22 bp, Homo sapiens
agcaagctggaggggctcatga

SEQ ID NO: 7131747 - DNA, 22 bp, Homo sapiens
agcaagctgtcaagagagctga

SEQ ID NO: 7131748 - DNA, 22 bp, Homo sapiens
agcaaggaaactatggagagat

SEQ ID NO: 7131749 - DNA, 22 bp, Homo sapiens
agcaaggaaactatggagagat

SEQ ID NO: 7131750 - DNA, 22 bp, Homo sapiens
agcaaggaaactatggagagat

SEQ ID NO: 7131751 - DNA, 22 bp, Homo sapiens
agcaaggaaactatggagagat

SEQ ID NO: 7131752 - DNA, 22 bp, Homo sapiens
agcaagctaacataggagattg

SEQ ID NO: 7131753 - DNA, 22 bp, Homo sapiens
agcaagctacctagatagtcta

SEQ ID NO: 7131754 - DNA, 21 bp, Homo sapiens
agcaagcagaatccatctaga

SEQ ID NO: 7131755 - DNA, 22 bp, Homo sapiens
agcaagcagaattctgtcctct

SEQ ID NO: 7131756 - DNA, 22 bp, Homo sapiens
agcaagcagaattctgtcctct

SEQ ID NO: 7131757 - DNA, 22 bp, Homo sapiens
agcaagatttaaacccaggtca

SEQ ID NO: 7131758 - DNA, 22 bp, Homo sapiens
acaatgtttttgttcaaagagt

SEQ ID NO: 7131759 - DNA, 22 bp, Homo sapiens
acaatgtagagtaaaatatgtt

SEQ ID NO: 7131760 - DNA, 22 bp, Homo sapiens
acaatgtagagtaaaatatgtt

SEQ ID NO: 7131761 - DNA, 22 bp, Homo sapiens
acaatgttttgaaacatctagg

SEQ ID NO: 7131762 - DNA, 22 bp, Homo sapiens
acaatgttttgaaacatctagg

SEQ ID NO: 7131763 - DNA, 22 bp, Homo sapiens
acaatgctgttgagacattctt

SEQ ID NO: 7131764 - DNA, 22 bp, Homo sapiens
acaatgctgttgagacattctt

SEQ ID NO: 7131765 - DNA, 22 bp, Homo sapiens
acaatgcttggtttttctagaa

SEQ ID NO: 7131766 - DNA, 22 bp, Homo sapiens
acaatggcatgctagcaaatgg

SEQ ID NO: 7131767 - DNA, 22 bp, Homo sapiens
acaatgtagaggctgaaagcaa

SEQ ID NO: 7131768 - DNA, 22 bp, Homo sapiens
acaatgcttggtttttctagaa

SEQ ID NO: 7131769 - DNA, 22 bp, Homo sapiens
agatggggctcagtgtggaggc

SEQ ID NO: 7131770 - DNA, 22 bp, Homo sapiens
agatggggctgaaagttccaat

SEQ ID NO: 7131771 - DNA, 22 bp, Homo sapiens
agatggggctcagtgtggaggc

SEQ ID NO: 7131772 - DNA, 22 bp, Homo sapiens
agatggggctcagtgtggaggc

SEQ ID NO: 7131773 - DNA, 22 bp, Homo sapiens
agatggggctcagtgtggaggc

SEQ ID NO: 7131774 - DNA, 22 bp, Homo sapiens
agatggggctcagtgtggaggc

SEQ ID NO: 7131775 - DNA, 22 bp, Homo sapiens
agatggggctgaaagttccaat

SEQ ID NO: 7131776 - DNA, 22 bp, Homo sapiens
agatggggctgaaagttccaat

SEQ ID NO: 7131777 - DNA, 22 bp, Homo sapiens
agatgggtaactggagtctgct

SEQ ID NO: 7131778 - DNA, 22 bp, Homo sapiens
acaattcaagatgagattcagg

SEQ ID NO: 7131779 - DNA, 22 bp, Homo sapiens
acaattcaagaagagagatgaa

SEQ ID NO: 7131780 - DNA, 22 bp, Homo sapiens
acaattcaagatgagattcagg

SEQ ID NO: 7131781 - DNA, 22 bp, Homo sapiens
acaattagtgatcagtgatgcc

SEQ ID NO: 7131782 - DNA, 22 bp, Homo sapiens
acaattagctgtgtgtctatct

SEQ ID NO: 7131783 - DNA, 22 bp, Homo sapiens
acaattactcaactttgctgct

SEQ ID NO: 7131784 - DNA, 22 bp, Homo sapiens
acaattcattaatgtgaggtag

SEQ ID NO: 7131785 - DNA, 22 bp, Homo sapiens
acaattctctcatatcttatta

SEQ ID NO: 7131786 - DNA, 22 bp, Homo sapiens
acaattctgatggtttcccagt

SEQ ID NO: 7131787 - DNA, 22 bp, Homo sapiens
acaattctgatggtttcccagt

SEQ ID NO: 7131788 - DNA, 22 bp, Homo sapiens
acaattctgatggtttcccagt

SEQ ID NO: 7131789 - DNA, 22 bp, Homo sapiens
acaattctgatggtttcccagt

SEQ ID NO: 7131790 - DNA, 22 bp, Homo sapiens
agcaagattgaggcttcctcag

SEQ ID NO: 7131791 - DNA, 18 bp, Homo sapiens
acaaatgtgtcacaggaa

SEQ ID NO: 7131792 - DNA, 22 bp, Homo sapiens
acaaatgtgtctaattgtgcct

SEQ ID NO: 7131793 - DNA, 18 bp, Homo sapiens
acaaatgtgtcacaggaa

SEQ ID NO: 7131794 - DNA, 22 bp, Homo sapiens
acaaatggaacaatgaagactg

SEQ ID NO: 7131795 - DNA, 22 bp, Homo sapiens
acaaatggaaggtgttctcttc

SEQ ID NO: 7131796 - DNA, 22 bp, Homo sapiens
acaaatggactctcatcttttg

SEQ ID NO: 7131797 - DNA, 22 bp, Homo sapiens
acaaatgtctacattgagaata

SEQ ID NO: 7131798 - DNA, 22 bp, Homo sapiens
acaaattatagaaaattgagct

SEQ ID NO: 7131799 - DNA, 22 bp, Homo sapiens
acaaatgttacataagtttgga

SEQ ID NO: 7131800 - DNA, 22 bp, Homo sapiens
acaaatgttacataagtttgga

SEQ ID NO: 7131801 - DNA, 22 bp, Homo sapiens
acaaatgttggatttgtcttcc

SEQ ID NO: 7131802 - DNA, 22 bp, Homo sapiens
acaaggaacaagcatgtagttt

SEQ ID NO: 7131803 - DNA, 22 bp, Homo sapiens
acaaggaacaagcatgtagttt

SEQ ID NO: 7131804 - DNA, 22 bp, Homo sapiens
acaaggctttggagggttctta

SEQ ID NO: 7131805 - DNA, 22 bp, Homo sapiens
acaagggattgttgagtagtct

SEQ ID NO: 7131806 - DNA, 19 bp, Homo sapiens
acaagggcaggcaaggtga

SEQ ID NO: 7131807 - DNA, 22 bp, Homo sapiens
acaaattgaccgcaagattcat

SEQ ID NO: 7131808 - DNA, 22 bp, Homo sapiens
acaaattgaccgcaagattcat

SEQ ID NO: 7131809 - DNA, 22 bp, Homo sapiens
acaagtgggtcctacataaagc

SEQ ID NO: 7131810 - DNA, 22 bp, Homo sapiens
acaagtgtgtgcagtttgtaaa

SEQ ID NO: 7131811 - DNA, 22 bp, Homo sapiens
acaagtgttgcattttgccatt

SEQ ID NO: 7131812 - DNA, 22 bp, Homo sapiens
acaagtgttgcattttgccatt

SEQ ID NO: 7131813 - DNA, 23 bp, Homo sapiens
acaagtgtttccaatatggctgg

SEQ ID NO: 7131814 - DNA, 22 bp, Homo sapiens
acaagtctttttcatgtcttct

SEQ ID NO: 7131815 - DNA, 22 bp, Homo sapiens
acaagtctttttcatgtcttct

SEQ ID NO: 7131816 - DNA, 22 bp, Homo sapiens
acaagtctttttcatgtcttct

SEQ ID NO: 7131817 - DNA, 22 bp, Homo sapiens
acaagtctcaacagcagccagc

SEQ ID NO: 7131818 - DNA, 22 bp, Homo sapiens
acaagtctcaacagcagccagc

SEQ ID NO: 7131819 - DNA, 22 bp, Homo sapiens
acaagtctgttatgcacctgga

SEQ ID NO: 7131820 - DNA, 22 bp, Homo sapiens
acaagtctttttcatgtcttct

SEQ ID NO: 7131821 - DNA, 22 bp, Homo sapiens
acaagtaccaaatgctcaagta

SEQ ID NO: 7131822 - DNA, 22 bp, Homo sapiens
acaagtcactctatcattttca

SEQ ID NO: 7131823 - DNA, 22 bp, Homo sapiens
agatggggcagaatggagccat

SEQ ID NO: 7131824 - DNA, 22 bp, Homo sapiens
agatggggcagaatggagccat

SEQ ID NO: 7131825 - DNA, 22 bp, Homo sapiens
agatggggcagaatggagccat

SEQ ID NO: 7131826 - DNA, 22 bp, Homo sapiens
agatggggcagaatggagccat

SEQ ID NO: 7131827 - DNA, 19 bp, Homo sapiens
agatggggaagagtgtgag

SEQ ID NO: 7131828 - DNA, 19 bp, Homo sapiens
agatggggaagagtgtgag

SEQ ID NO: 7131829 - DNA, 22 bp, Homo sapiens
agatggggctcagtgtggaggc

SEQ ID NO: 7131830 - DNA, 22 bp, Homo sapiens
agatggggctcagtgtggaggc

SEQ ID NO: 7131831 - DNA, 22 bp, Homo sapiens
agatggggctcagtgtggaggc

SEQ ID NO: 7131832 - DNA, 22 bp, Homo sapiens
agatggggctcagtgtggaggc

SEQ ID NO: 7131833 - DNA, 22 bp, Homo sapiens
agatggggctcagtgtggaggc

SEQ ID NO: 7131834 - DNA, 22 bp, Homo sapiens
agatggggcagaatggagccat

SEQ ID NO: 7131835 - DNA, 22 bp, Homo sapiens
agatggggcagaatggagccat

SEQ ID NO: 7131836 - DNA, 22 bp, Homo sapiens
agatggggcagaatggagccat

SEQ ID NO: 7131837 - DNA, 22 bp, Homo sapiens
acaagttaccaaaaaagattca

SEQ ID NO: 7131838 - DNA, 22 bp, Homo sapiens
acaagttaccaaaaaagattca

SEQ ID NO: 7131839 - DNA, 22 bp, Homo sapiens
acaagttaggttttaatccaaa

SEQ ID NO: 7131840 - DNA, 22 bp, Homo sapiens
acaagtttatttgattagaaca

SEQ ID NO: 7131841 - DNA, 19 bp, Homo sapiens
agatggggaagagtgtgag

SEQ ID NO: 7131842 - DNA, 22 bp, Homo sapiens
agagctggggctctgggtttaa

SEQ ID NO: 7131843 - DNA, 22 bp, Homo sapiens
agagctgggtgaagtgccatca

SEQ ID NO: 7131844 - DNA, 22 bp, Homo sapiens
agagctggggcccgtaaagcca

SEQ ID NO: 7131845 - DNA, 22 bp, Homo sapiens
agagctggggcccgtaaagcca

SEQ ID NO: 7131846 - DNA, 22 bp, Homo sapiens
agagctggggccagagtcaagg

SEQ ID NO: 7131847 - DNA, 22 bp, Homo sapiens
agagctgggtggacttgtagtt

SEQ ID NO: 7131848 - DNA, 22 bp, Homo sapiens
agagctgggtggacttgtagtt

SEQ ID NO: 7131849 - DNA, 22 bp, Homo sapiens
agagctgggtggtggtgactca

SEQ ID NO: 7131850 - DNA, 22 bp, Homo sapiens
agagctgggtggtggtgactca

SEQ ID NO: 7131851 - DNA, 22 bp, Homo sapiens
aatttgtatacatgttacattt

SEQ ID NO: 7131852 - DNA, 22 bp, Homo sapiens
aattttcacagtgctgtgagat

SEQ ID NO: 7131853 - DNA, 22 bp, Homo sapiens
aattttattagaaggcaagggg

SEQ ID NO: 7131854 - DNA, 22 bp, Homo sapiens
aattttattagaaggcaagggg

SEQ ID NO: 7131855 - DNA, 22 bp, Homo sapiens
aattttattagaaggcaagggg

SEQ ID NO: 7131856 - DNA, 22 bp, Homo sapiens
aattttattagaaggcaagggg

SEQ ID NO: 7131857 - DNA, 22 bp, Homo sapiens
aattttattagaaggcaagggg

SEQ ID NO: 7131858 - DNA, 22 bp, Homo sapiens
aattttattagaaggcaagggg

SEQ ID NO: 7131859 - DNA, 22 bp, Homo sapiens
aattttatgccttgcacgttgg

SEQ ID NO: 7131860 - DNA, 22 bp, Homo sapiens
aattttatgccttgcacgttgg

SEQ ID NO: 7131861 - DNA, 22 bp, Homo sapiens
aattttatgccttgcacgttgg

SEQ ID NO: 7131862 - DNA, 22 bp, Homo sapiens
aattttatgccttgcacgttgg

SEQ ID NO: 7131863 - DNA, 22 bp, Homo sapiens
aattttatgccttgcacgttgg

SEQ ID NO: 7131864 - DNA, 22 bp, Homo sapiens
aattttatgccttgcacgttgg

SEQ ID NO: 7131865 - DNA, 22 bp, Homo sapiens
aattttattaactggatgtagc

SEQ ID NO: 7131866 - DNA, 22 bp, Homo sapiens
aattttattaactggatgtagc

SEQ ID NO: 7131867 - DNA, 22 bp, Homo sapiens
aattttattaactggatgtagc

SEQ ID NO: 7131868 - DNA, 22 bp, Homo sapiens
aattttattaactggatgtagc

SEQ ID NO: 7131869 - DNA, 22 bp, Homo sapiens
aattttattaactggatgtagc

SEQ ID NO: 7131870 - DNA, 22 bp, Homo sapiens
aattttattaactggatgtagc

SEQ ID NO: 7131871 - DNA, 22 bp, Homo sapiens
aattttattaactggatgtagc

SEQ ID NO: 7131872 - DNA, 22 bp, Homo sapiens
aattttatgccttgcacgttgg

SEQ ID NO: 7131873 - DNA, 22 bp, Homo sapiens
aattttctgatgatgaagcacg

SEQ ID NO: 7131874 - DNA, 22 bp, Homo sapiens
aattttctgcctagcaaaaact

SEQ ID NO: 7131875 - DNA, 22 bp, Homo sapiens
aattttctaaggtgatgatctg

SEQ ID NO: 7131876 - DNA, 22 bp, Homo sapiens
aattttctgatgatgaagcacg

SEQ ID NO: 7131877 - DNA, 22 bp, Homo sapiens
aattttctgcctagcaaaaact

SEQ ID NO: 7131878 - DNA, 22 bp, Homo sapiens
agaggccagtggctgtgctgtc

SEQ ID NO: 7131879 - DNA, 20 bp, Homo sapiens
agaggccagttaggagtcta

SEQ ID NO: 7131880 - DNA, 22 bp, Homo sapiens
agaggccatgctagaggcctgg

SEQ ID NO: 7131881 - DNA, 22 bp, Homo sapiens
agaggccatctgctctgtgggg

SEQ ID NO: 7131882 - DNA, 22 bp, Homo sapiens
agaggccatctgctctgtgggg

SEQ ID NO: 7131883 - DNA, 22 bp, Homo sapiens
acaaaaagggagatgaggtaga

SEQ ID NO: 7131884 - DNA, 22 bp, Homo sapiens
acaaaaagggagatgaggtaga

SEQ ID NO: 7131885 - DNA, 20 bp, Homo sapiens
acaaaataggtactgggtag

SEQ ID NO: 7131886 - DNA, 20 bp, Homo sapiens
acaaaataggtactgggtag

SEQ ID NO: 7131887 - DNA, 20 bp, Homo sapiens
acaaaataggtactgggtag

SEQ ID NO: 7131888 - DNA, 20 bp, Homo sapiens
acaaaataggtactgggtag

SEQ ID NO: 7131889 - DNA, 21 bp, Homo sapiens
agaggccctcggactgggcgt

SEQ ID NO: 7131890 - DNA, 21 bp, Homo sapiens
agaggccctcggactgggcgt

SEQ ID NO: 7131891 - DNA, 21 bp, Homo sapiens
agaggccctcggactgggcgt

SEQ ID NO: 7131892 - DNA, 22 bp, Homo sapiens
agaggccccatgggatggcggt

SEQ ID NO: 7131893 - DNA, 22 bp, Homo sapiens
agaggccccaggtgagcatgcc

SEQ ID NO: 7131894 - DNA, 22 bp, Homo sapiens
agaggccatgctagaggcctgg

SEQ ID NO: 7131895 - DNA, 22 bp, Homo sapiens
agaggccatggggcatttttca

SEQ ID NO: 7131896 - DNA, 22 bp, Homo sapiens
agaggccatgctagaggcctgg

SEQ ID NO: 7131897 - DNA, 22 bp, Homo sapiens
agaggccatgctagaggcctgg

SEQ ID NO: 7131898 - DNA, 22 bp, Homo sapiens
agaggccatgctagaggcctgg

SEQ ID NO: 7131899 - DNA, 22 bp, Homo sapiens
acaaacatcttgacctcagatt

SEQ ID NO: 7131900 - DNA, 22 bp, Homo sapiens
acaaaccagcttaagcaagatg

SEQ ID NO: 7131901 - DNA, 22 bp, Homo sapiens
acaaacagctaacatatgttaa

SEQ ID NO: 7131902 - DNA, 22 bp, Homo sapiens
acaaacagctaacatatgttaa

SEQ ID NO: 7131903 - DNA, 22 bp, Homo sapiens
acaaaccagcttaagcaagatg

SEQ ID NO: 7131904 - DNA, 22 bp, Homo sapiens
acaaactaaaattctttattga

SEQ ID NO: 7131905 - DNA, 22 bp, Homo sapiens
acaaactaaaattctttattga

SEQ ID NO: 7131906 - DNA, 22 bp, Homo sapiens
acaaactaaaattctttattga

SEQ ID NO: 7131907 - DNA, 22 bp, Homo sapiens
acaaacagagttgaaaaatagg

SEQ ID NO: 7131908 - DNA, 22 bp, Homo sapiens
acaaacagagttgaaaaatagg

SEQ ID NO: 7131909 - DNA, 22 bp, Homo sapiens
acaaacagagttgaaaaatagg

SEQ ID NO: 7131910 - DNA, 22 bp, Homo sapiens
acaaacagctaacatatgttaa

SEQ ID NO: 7131911 - DNA, 22 bp, Homo sapiens
acaaaattgtgttaaactttat

SEQ ID NO: 7131912 - DNA, 22 bp, Homo sapiens
acaaaatttttagacaaggctt

SEQ ID NO: 7131913 - DNA, 22 bp, Homo sapiens
acaaaatttttagacaaggctt

SEQ ID NO: 7131914 - DNA, 22 bp, Homo sapiens
acaaacacgagacgccactgtg

SEQ ID NO: 7131915 - DNA, 22 bp, Homo sapiens
acaaacacgagacgccactgtg

SEQ ID NO: 7131916 - DNA, 22 bp, Homo sapiens
acaaaattatgaagaggccttg

SEQ ID NO: 7131917 - DNA, 22 bp, Homo sapiens
acaaaattatgaagaggccttg

SEQ ID NO: 7131918 - DNA, 22 bp, Homo sapiens
acaaaatcaaaggagtgattca

SEQ ID NO: 7131919 - DNA, 23 bp, Homo sapiens
acaaaatgttctgctgggaggtg

SEQ ID NO: 7131920 - DNA, 22 bp, Homo sapiens
acaaaattacctagttattttc

SEQ ID NO: 7131921 - DNA, 22 bp, Homo sapiens
acaaaattacctagttattttc

SEQ ID NO: 7131922 - DNA, 22 bp, Homo sapiens
acaaacttcccagacaagctcc

SEQ ID NO: 7131923 - DNA, 22 bp, Homo sapiens
acaaacttcccagacaagctcc

SEQ ID NO: 7131924 - DNA, 22 bp, Homo sapiens
acaaacttatgtttcatatgta

SEQ ID NO: 7131925 - DNA, 22 bp, Homo sapiens
acaaacttatgtttcatatgta

SEQ ID NO: 7131926 - DNA, 22 bp, Homo sapiens
acaaacttccatcatgaatttt

SEQ ID NO: 7131927 - DNA, 22 bp, Homo sapiens
acaaacttccatcatgaatttt

SEQ ID NO: 7131928 - DNA, 19 bp, Homo sapiens
acaaactgagtacacttgt

SEQ ID NO: 7131929 - DNA, 19 bp, Homo sapiens
acaaatagttacatatcct

SEQ ID NO: 7131930 - DNA, 22 bp, Homo sapiens
acaaagaaggaattggtcttta

SEQ ID NO: 7131931 - DNA, 22 bp, Homo sapiens
acaaatatggtactcggagaaa

SEQ ID NO: 7131932 - DNA, 22 bp, Homo sapiens
acaaatatttactgaatccact

SEQ ID NO: 7131933 - DNA, 22 bp, Homo sapiens
acaaatgactatttggtacagg

SEQ ID NO: 7131934 - DNA, 22 bp, Homo sapiens
acaaatgactatttggtacagg

SEQ ID NO: 7131935 - DNA, 22 bp, Homo sapiens
acaaatgactcaaacaccactt

SEQ ID NO: 7131936 - DNA, 22 bp, Homo sapiens
acaaatgactcaaacaccactt

SEQ ID NO: 7131937 - DNA, 22 bp, Homo sapiens
acaaatgagaatgtagacagag

SEQ ID NO: 7131938 - DNA, 22 bp, Homo sapiens
acaaatgagaatgtagacagag

SEQ ID NO: 7131939 - DNA, 22 bp, Homo sapiens
acaaatgagaatgtagacagag

SEQ ID NO: 7131940 - DNA, 19 bp, Homo sapiens
acaaatgatgttgcactga

SEQ ID NO: 7131941 - DNA, 19 bp, Homo sapiens
acaaatgatgttgcactga

SEQ ID NO: 7131942 - DNA, 22 bp, Homo sapiens
acaaatgattatcacagaggag

SEQ ID NO: 7131943 - DNA, 22 bp, Homo sapiens
acaaatgattatcacagaggag

SEQ ID NO: 7131944 - DNA, 22 bp, Homo sapiens
acaaatgattatcacagaggag

SEQ ID NO: 7131945 - DNA, 22 bp, Homo sapiens
acaaatgattatcacagaggag

SEQ ID NO: 7131946 - DNA, 22 bp, Homo sapiens
acaaatgattttccaagccagt

SEQ ID NO: 7131947 - DNA, 22 bp, Homo sapiens
acaaatgattttccaagccagt

SEQ ID NO: 7131948 - DNA, 22 bp, Homo sapiens
acaaatgcttagttcaccaaaa

SEQ ID NO: 7131949 - DNA, 22 bp, Homo sapiens
acaaatgccatatataaattct

SEQ ID NO: 7131950 - DNA, 22 bp, Homo sapiens
acaaatgccatgtgacctacca

SEQ ID NO: 7131951 - DNA, 23 bp, Homo sapiens
acaaatgcccatacatctagttc

SEQ ID NO: 7131952 - DNA, 23 bp, Homo sapiens
acaaatgcccatacatctagttc

SEQ ID NO: 7131953 - DNA, 22 bp, Homo sapiens
acaaatgcagcataaagtgaac

SEQ ID NO: 7131954 - DNA, 22 bp, Homo sapiens
acaaatgcagcataaagtgaac

SEQ ID NO: 7131955 - DNA, 22 bp, Homo sapiens
agcagggcagttaaagggtcct

SEQ ID NO: 7131956 - DNA, 22 bp, Homo sapiens
agcagggcatgaataagggttt

SEQ ID NO: 7131957 - DNA, 22 bp, Homo sapiens
agcagggcatgaataagggttt

SEQ ID NO: 7131958 - DNA, 22 bp, Homo sapiens
agcagggcagttaaagggtcct

SEQ ID NO: 7131959 - DNA, 22 bp, Homo sapiens
agcagggcatgaataagggttt

SEQ ID NO: 7131960 - DNA, 22 bp, Homo sapiens
agcagggcatgaataagggttt

SEQ ID NO: 7131961 - DNA, 22 bp, Homo sapiens
agcagggcatgaataagggttt

SEQ ID NO: 7131962 - DNA, 18 bp, Homo sapiens
agcagggcattttgccat

SEQ ID NO: 7131963 - DNA, 22 bp, Homo sapiens
agcagggcatgaataagggttt

SEQ ID NO: 7131964 - DNA, 22 bp, Homo sapiens
agcagggccaacagtaaacacc

SEQ ID NO: 7131965 - DNA, 22 bp, Homo sapiens
agcagggccaacagtaaacacc

SEQ ID NO: 7131966 - DNA, 22 bp, Homo sapiens
agcagggcccactaggggagat

SEQ ID NO: 7131967 - DNA, 22 bp, Homo sapiens
agcagggcccactaggggagat

SEQ ID NO: 7131968 - DNA, 22 bp, Homo sapiens
agcagggcccactaggggagat

SEQ ID NO: 7131969 - DNA, 22 bp, Homo sapiens
agcagggcccactaggggagat

SEQ ID NO: 7131970 - DNA, 23 bp, Homo sapiens
agcagggccagaatacttgctgt

SEQ ID NO: 7131971 - DNA, 18 bp, Homo sapiens
agcagggcattttgccat

SEQ ID NO: 7131972 - DNA, 22 bp, Homo sapiens
agcagggccaacagtaaacacc

SEQ ID NO: 7131973 - DNA, 23 bp, Homo sapiens
agcagggccagaatacttgctgt

SEQ ID NO: 7131974 - DNA, 23 bp, Homo sapiens
agcagggccagaatacttgctgt

SEQ ID NO: 7131975 - DNA, 22 bp, Homo sapiens
agcagggcccactaggggagat

SEQ ID NO: 7131976 - DNA, 22 bp, Homo sapiens
acactgcagatgaaagcataag

SEQ ID NO: 7131977 - DNA, 22 bp, Homo sapiens
acactgcagatgtaatttgagt

SEQ ID NO: 7131978 - DNA, 22 bp, Homo sapiens
acactgcagatgaaagcataag

SEQ ID NO: 7131979 - DNA, 18 bp, Homo sapiens
acactgcagcagtctgct

SEQ ID NO: 7131980 - DNA, 22 bp, Homo sapiens
acactgcagatgtaatttgagt

SEQ ID NO: 7131981 - DNA, 23 bp, Homo sapiens
acactgtctcatggatagactgc

SEQ ID NO: 7131982 - DNA, 22 bp, Homo sapiens
acactgtgacggaaataaagaa

SEQ ID NO: 7131983 - DNA, 22 bp, Homo sapiens
agcagggcagttaaagggtcct

SEQ ID NO: 7131984 - DNA, 22 bp, Homo sapiens
agcagggcagttaaagggtcct

SEQ ID NO: 7131985 - DNA, 22 bp, Homo sapiens
acaccacaagtaactcttttcc

SEQ ID NO: 7131986 - DNA, 22 bp, Homo sapiens
acaccaccgtcccagcctcctg

SEQ ID NO: 7131987 - DNA, 23 bp, Homo sapiens
acacatttttcccgttctgaggt

SEQ ID NO: 7131988 - DNA, 22 bp, Homo sapiens
acaccaaagtagaattaatgta

SEQ ID NO: 7131989 - DNA, 22 bp, Homo sapiens
acaccaaagtagaattaatgta

SEQ ID NO: 7131990 - DNA, 22 bp, Homo sapiens
acacattttggctaggtggaga

SEQ ID NO: 7131991 - DNA, 22 bp, Homo sapiens
acacattttctaacagggatca

SEQ ID NO: 7131992 - DNA, 22 bp, Homo sapiens
acacattttcaacactgtcaag

SEQ ID NO: 7131993 - DNA, 22 bp, Homo sapiens
acacatttctctttttgtaagt

SEQ ID NO: 7131994 - DNA, 22 bp, Homo sapiens
acacattatctcattaaatact

SEQ ID NO: 7131995 - DNA, 22 bp, Homo sapiens
acacattatctcattaaatact

SEQ ID NO: 7131996 - DNA, 22 bp, Homo sapiens
acacattatctcattaaatact

SEQ ID NO: 7131997 - DNA, 23 bp, Homo sapiens
agcaggaaaccgagggtgatgtt

SEQ ID NO: 7131998 - DNA, 23 bp, Homo sapiens
agcaggaaaccgagggtgatgtt

SEQ ID NO: 7131999 - DNA, 22 bp, Homo sapiens
acacatttgggctcctacataa

SEQ ID NO: 7132000 - DNA, 22 bp, Homo sapiens
acacatttgggctcctacataa

SEQ ID NO: 7132001 - DNA, 22 bp, Homo sapiens
acacatttgggctcctacataa

SEQ ID NO: 7132002 - DNA, 19 bp, Homo sapiens
acacatttgcacaatccac

SEQ ID NO: 7132003 - DNA, 22 bp, Homo sapiens
acactgtgcatgcatatacaca

SEQ ID NO: 7132004 - DNA, 22 bp, Homo sapiens
acactgtgcttagatgctgaac

SEQ ID NO: 7132005 - DNA, 22 bp, Homo sapiens
acactgtgcttagatgctgaac

SEQ ID NO: 7132006 - DNA, 21 bp, Homo sapiens
acactgtgtcataatgcttaa

SEQ ID NO: 7132007 - DNA, 22 bp, Homo sapiens
agcagtggtgtgaggagggctc

SEQ ID NO: 7132008 - DNA, 22 bp, Homo sapiens
agcagtggtccccaacctttct

SEQ ID NO: 7132009 - DNA, 22 bp, Homo sapiens
agcagtggctgacagacttacc

SEQ ID NO: 7132010 - DNA, 22 bp, Homo sapiens
agcagtggctggatggtgtgct

SEQ ID NO: 7132011 - DNA, 22 bp, Homo sapiens
agcagtgggtgacagagctgag

SEQ ID NO: 7132012 - DNA, 22 bp, Homo sapiens
agcagtgggggagtgttagttt

SEQ ID NO: 7132013 - DNA, 22 bp, Homo sapiens
acagaaagataggcacaaggtc

SEQ ID NO: 7132014 - DNA, 22 bp, Homo sapiens
agcagttactagttaaatgcat

SEQ ID NO: 7132015 - DNA, 22 bp, Homo sapiens
acagaaagataggcacaaggtc

SEQ ID NO: 7132016 - DNA, 22 bp, Homo sapiens
acagaaagataggcacaaggtc

SEQ ID NO: 7132017 - DNA, 22 bp, Homo sapiens
acagaaagatgatttgaaatgg

SEQ ID NO: 7132018 - DNA, 22 bp, Homo sapiens
acagaaagatgatttgaaatgg

SEQ ID NO: 7132019 - DNA, 22 bp, Homo sapiens
agcagtgttggtgggagcatct

SEQ ID NO: 7132020 - DNA, 22 bp, Homo sapiens
agcagtgttttagccatttctg

SEQ ID NO: 7132021 - DNA, 22 bp, Homo sapiens
agcagttaccaaggaacctggt

SEQ ID NO: 7132022 - DNA, 22 bp, Homo sapiens
agcagttacgggcctatctagg

SEQ ID NO: 7132023 - DNA, 22 bp, Homo sapiens
agcagtggtgtgaggagggctc

SEQ ID NO: 7132024 - DNA, 22 bp, Homo sapiens
agcagtggtgtgaggagggctc

SEQ ID NO: 7132025 - DNA, 22 bp, Homo sapiens
agcagtggtgtgaggagggctc

SEQ ID NO: 7132026 - DNA, 22 bp, Homo sapiens
agcagtggtgtgaggagggctc

SEQ ID NO: 7132027 - DNA, 22 bp, Homo sapiens
agcagtggtgtgaggagggctc

SEQ ID NO: 7132028 - DNA, 18 bp, Homo sapiens
agcagtgtgacctgaaga

SEQ ID NO: 7132029 - DNA, 22 bp, Homo sapiens
agcagtgtgcttcgtttcatga

SEQ ID NO: 7132030 - DNA, 22 bp, Homo sapiens
agcagtgtgcttcgtttcatga

SEQ ID NO: 7132031 - DNA, 20 bp, Homo sapiens
agcagtgtggggagactgtg

SEQ ID NO: 7132032 - DNA, 22 bp, Homo sapiens
agccacaggtgttggccagtgt

SEQ ID NO: 7132033 - DNA, 22 bp, Homo sapiens
agccacaggtgttggccagtgt

SEQ ID NO: 7132034 - DNA, 22 bp, Homo sapiens
agccacagggggtgagggacaa

SEQ ID NO: 7132035 - DNA, 22 bp, Homo sapiens
agccacagggggtgagggacaa

SEQ ID NO: 7132036 - DNA, 22 bp, Homo sapiens
agccacagggggtgagggacaa

SEQ ID NO: 7132037 - DNA, 22 bp, Homo sapiens
agccacagggggtgagggacaa

SEQ ID NO: 7132038 - DNA, 22 bp, Homo sapiens
agccacaggaaacagagacagc

SEQ ID NO: 7132039 - DNA, 22 bp, Homo sapiens
agccacaggaaacagagacagc

SEQ ID NO: 7132040 - DNA, 22 bp, Homo sapiens
agccacaggccatgagatacca

SEQ ID NO: 7132041 - DNA, 22 bp, Homo sapiens
acagaacaacaaggtggaccag

SEQ ID NO: 7132042 - DNA, 22 bp, Homo sapiens
acagaacaagacctgcttattg

SEQ ID NO: 7132043 - DNA, 22 bp, Homo sapiens
acagaacaagacctgcttattg

SEQ ID NO: 7132044 - DNA, 22 bp, Homo sapiens
acagaacaagacctgcttattg

SEQ ID NO: 7132045 - DNA, 22 bp, Homo sapiens
acagaacaacaaggtggaccag

SEQ ID NO: 7132046 - DNA, 22 bp, Homo sapiens
acagaacaacaaggtggaccag

SEQ ID NO: 7132047 - DNA, 22 bp, Homo sapiens
acagaaattgggcaaatggaag

SEQ ID NO: 7132048 - DNA, 22 bp, Homo sapiens
acagaaattgggcaaatggaag

SEQ ID NO: 7132049 - DNA, 22 bp, Homo sapiens
acagaaattgggcaaatggaag

SEQ ID NO: 7132050 - DNA, 22 bp, Homo sapiens
acagaaattagcagtgagttta

SEQ ID NO: 7132051 - DNA, 22 bp, Homo sapiens
acagaaattagcagtgagttta

SEQ ID NO: 7132052 - DNA, 22 bp, Homo sapiens
acagaaattagcagtgagttta

SEQ ID NO: 7132053 - DNA, 19 bp, Homo sapiens
acagaaattagttattttc

SEQ ID NO: 7132054 - DNA, 22 bp, Homo sapiens
acagaaattcaaactggaattt

SEQ ID NO: 7132055 - DNA, 22 bp, Homo sapiens
acagaaattcaaactggaattt

SEQ ID NO: 7132056 - DNA, 22 bp, Homo sapiens
acagaaattcaaactggaattt

SEQ ID NO: 7132057 - DNA, 22 bp, Homo sapiens
acagaaattctgggacagaaaa

SEQ ID NO: 7132058 - DNA, 22 bp, Homo sapiens
acagaaattctgggacagaaaa

SEQ ID NO: 7132059 - DNA, 22 bp, Homo sapiens
acagaaattctgggacagaaaa

SEQ ID NO: 7132060 - DNA, 22 bp, Homo sapiens
acagaaattctgggacagaaaa

SEQ ID NO: 7132061 - DNA, 22 bp, Homo sapiens
acagaaattgctaatagctcat

SEQ ID NO: 7132062 - DNA, 22 bp, Homo sapiens
acagaaattgctaatagctcat

SEQ ID NO: 7132063 - DNA, 22 bp, Homo sapiens
acagaaattgctaatagctcat

SEQ ID NO: 7132064 - DNA, 22 bp, Homo sapiens
acagaaattgggcaaatggaag

SEQ ID NO: 7132065 - DNA, 22 bp, Homo sapiens
acagaaattgggcaaatggaag

SEQ ID NO: 7132066 - DNA, 22 bp, Homo sapiens
acagaaattgggcaaatggaag

SEQ ID NO: 7132067 - DNA, 22 bp, Homo sapiens
acaattctgggtatttatatag

SEQ ID NO: 7132068 - DNA, 22 bp, Homo sapiens
acaattctgggtatttatatag

SEQ ID NO: 7132069 - DNA, 22 bp, Homo sapiens
agcacctgctatgtgtcaggga

SEQ ID NO: 7132070 - DNA, 22 bp, Homo sapiens
agcacctgcttaatgtgcagtg

SEQ ID NO: 7132071 - DNA, 22 bp, Homo sapiens
acaatttatccattgtatagtt

SEQ ID NO: 7132072 - DNA, 22 bp, Homo sapiens
acaatttatccattgtatagtt

SEQ ID NO: 7132073 - DNA, 22 bp, Homo sapiens
acaatttatccattgtatagtt

SEQ ID NO: 7132074 - DNA, 22 bp, Homo sapiens
acaatttatccattgtatagtt

SEQ ID NO: 7132075 - DNA, 20 bp, Homo sapiens
acaatttcctcactatatgc

SEQ ID NO: 7132076 - DNA, 22 bp, Homo sapiens
agcacctccttagctatgacca

SEQ ID NO: 7132077 - DNA, 22 bp, Homo sapiens
agcacctgcacagtggaggaaa

SEQ ID NO: 7132078 - DNA, 22 bp, Homo sapiens
agcacctccgtgcagcgtggcc

SEQ ID NO: 7132079 - DNA, 22 bp, Homo sapiens
agcacctccttagctatgacca

SEQ ID NO: 7132080 - DNA, 22 bp, Homo sapiens
agcaccgtcatagccaggtaag

SEQ ID NO: 7132081 - DNA, 23 bp, Homo sapiens
agcacctactccataccaggcac

SEQ ID NO: 7132082 - DNA, 22 bp, Homo sapiens
agcacctactgaatgctaggct

SEQ ID NO: 7132083 - DNA, 19 bp, Homo sapiens
agcacctatctggataagg

SEQ ID NO: 7132084 - DNA, 22 bp, Homo sapiens
agcacctccagagcttgaagct

SEQ ID NO: 7132085 - DNA, 22 bp, Homo sapiens
agcacctattatgtgccaggaa

SEQ ID NO: 7132086 - DNA, 22 bp, Homo sapiens
agcaccccatagtcagtcacgt

SEQ ID NO: 7132087 - DNA, 22 bp, Homo sapiens
agcaccctccaacttccctgta

SEQ ID NO: 7132088 - DNA, 21 bp, Homo sapiens
agcaccctcccttctggaggg

SEQ ID NO: 7132089 - DNA, 22 bp, Homo sapiens
agcaccctggggaagcacaaag

SEQ ID NO: 7132090 - DNA, 22 bp, Homo sapiens
agcacccttcagcccagcctgg

SEQ ID NO: 7132091 - DNA, 22 bp, Homo sapiens
agcacccttcagcccagcctgg

SEQ ID NO: 7132092 - DNA, 22 bp, Homo sapiens
acaattttccccataggttatc

SEQ ID NO: 7132093 - DNA, 22 bp, Homo sapiens
acaatttgaggctactcaattg

SEQ ID NO: 7132094 - DNA, 22 bp, Homo sapiens
acacagcaacttgcagtatgga

SEQ ID NO: 7132095 - DNA, 22 bp, Homo sapiens
acacagcaacttgcagtatgga

SEQ ID NO: 7132096 - DNA, 22 bp, Homo sapiens
acacaggaactctgagaggtgg

SEQ ID NO: 7132097 - DNA, 22 bp, Homo sapiens
acacaggaactctgagaggtgg

SEQ ID NO: 7132098 - DNA, 22 bp, Homo sapiens
acacagattttacatgttatgc

SEQ ID NO: 7132099 - DNA, 22 bp, Homo sapiens
acacaggaagagagataataat

SEQ ID NO: 7132100 - DNA, 22 bp, Homo sapiens
acacaggaagcaatttcagagc

SEQ ID NO: 7132101 - DNA, 22 bp, Homo sapiens
acacaggaagagagataataat

SEQ ID NO: 7132102 - DNA, 22 bp, Homo sapiens
acacaggaagcaatttcagagc

SEQ ID NO: 7132103 - DNA, 22 bp, Homo sapiens
acacaggaagagagataataat

SEQ ID NO: 7132104 - DNA, 22 bp, Homo sapiens
acacaggaagagagataataat

SEQ ID NO: 7132105 - DNA, 22 bp, Homo sapiens
acacaggaactctgagaggtgg

SEQ ID NO: 7132106 - DNA, 22 bp, Homo sapiens
acacaggaactctgagaggtgg

SEQ ID NO: 7132107 - DNA, 22 bp, Homo sapiens
acacaggaagtcagcactgatg

SEQ ID NO: 7132108 - DNA, 22 bp, Homo sapiens
acacaggaagtcagcactgatg

SEQ ID NO: 7132109 - DNA, 22 bp, Homo sapiens
acacaggaagcaatttcagagc

SEQ ID NO: 7132110 - DNA, 22 bp, Homo sapiens
acacaggaagtcagcactgatg

SEQ ID NO: 7132111 - DNA, 22 bp, Homo sapiens
acacaggaagtcagcactgatg

SEQ ID NO: 7132112 - DNA, 22 bp, Homo sapiens
acacaggacagggatgtgtttt

SEQ ID NO: 7132113 - DNA, 22 bp, Homo sapiens
acacaggacagggatgtgtttt

SEQ ID NO: 7132114 - DNA, 22 bp, Homo sapiens
acacaggacagggatgtgtttt

SEQ ID NO: 7132115 - DNA, 22 bp, Homo sapiens
acacaggacggccctgtggctt

SEQ ID NO: 7132116 - DNA, 22 bp, Homo sapiens
acacaggagaaaagatctccca

SEQ ID NO: 7132117 - DNA, 22 bp, Homo sapiens
acacaggagagagttgggaagg

SEQ ID NO: 7132118 - DNA, 22 bp, Homo sapiens
acacaggagatatgtaatggct

SEQ ID NO: 7132119 - DNA, 22 bp, Homo sapiens
acacaggagatatgtaatggct

SEQ ID NO: 7132120 - DNA, 22 bp, Homo sapiens
acacaggagatatgtaatggct

SEQ ID NO: 7132121 - DNA, 23 bp, Homo sapiens
acacaggatacatacggaagcaa

SEQ ID NO: 7132122 - DNA, 21 bp, Homo sapiens
acacaggagtttcttctttct

SEQ ID NO: 7132123 - DNA, 21 bp, Homo sapiens
acacaggagtttcttctttct

SEQ ID NO: 7132124 - DNA, 21 bp, Homo sapiens
acacaggagtttcttctttct

SEQ ID NO: 7132125 - DNA, 22 bp, Homo sapiens
acacaggaggaggatggtggtc

SEQ ID NO: 7132126 - DNA, 22 bp, Homo sapiens
acacaggaggaggatggtggtc

SEQ ID NO: 7132127 - DNA, 22 bp, Homo sapiens
agcagcagtgtgtggtcatgtt

SEQ ID NO: 7132128 - DNA, 22 bp, Homo sapiens
agcagcagttgctgacgttcta

SEQ ID NO: 7132129 - DNA, 22 bp, Homo sapiens
acacataagaaactacaaagag

SEQ ID NO: 7132130 - DNA, 22 bp, Homo sapiens
acacatatatgtgcgtgtatat

SEQ ID NO: 7132131 - DNA, 22 bp, Homo sapiens
acacatatatgtgcgtgtatat

SEQ ID NO: 7132132 - DNA, 22 bp, Homo sapiens
acacatatattatttgtggctc

SEQ ID NO: 7132133 - DNA, 22 bp, Homo sapiens
acacatatattatttgtggctc

SEQ ID NO: 7132134 - DNA, 22 bp, Homo sapiens
agcagcagtgacagccgaaagc

SEQ ID NO: 7132135 - DNA, 23 bp, Homo sapiens
agcagcagtgagaggtgtcttac

SEQ ID NO: 7132136 - DNA, 23 bp, Homo sapiens
agcagcagtgagaggtgtcttac

SEQ ID NO: 7132137 - DNA, 22 bp, Homo sapiens
agcagcagtgtgtggtcatgtt

SEQ ID NO: 7132138 - DNA, 22 bp, Homo sapiens
agcagcagtgtgtggtcatgtt

SEQ ID NO: 7132139 - DNA, 22 bp, Homo sapiens
agcagcagtgtgtggtcatgtt

SEQ ID NO: 7132140 - DNA, 22 bp, Homo sapiens
agcagcagtcctttgtgtaatt

SEQ ID NO: 7132141 - DNA, 22 bp, Homo sapiens
agcagcagtcatgcctatgctc

SEQ ID NO: 7132142 - DNA, 22 bp, Homo sapiens
agcagcagtcatgcctatgctc

SEQ ID NO: 7132143 - DNA, 22 bp, Homo sapiens
agcagcagtcatgcctatgctc

SEQ ID NO: 7132144 - DNA, 22 bp, Homo sapiens
agcagcagtcatgcctatgctc

SEQ ID NO: 7132145 - DNA, 22 bp, Homo sapiens
agcagcagtacatataagacta

SEQ ID NO: 7132146 - DNA, 22 bp, Homo sapiens
agcagcagtacatataagacta

SEQ ID NO: 7132147 - DNA, 22 bp, Homo sapiens
agcagcagtatccttccccggc

SEQ ID NO: 7132148 - DNA, 22 bp, Homo sapiens
agcagcaggtgcttctggatct

SEQ ID NO: 7132149 - DNA, 22 bp, Homo sapiens
agcagcaggtgcttctggatct

SEQ ID NO: 7132150 - DNA, 22 bp, Homo sapiens
agcagcaggtgacctcgatgcc

SEQ ID NO: 7132151 - DNA, 22 bp, Homo sapiens
agcagcaggtgacctcgatgcc

SEQ ID NO: 7132152 - DNA, 22 bp, Homo sapiens
agcagcaggtgacctcgatgcc

SEQ ID NO: 7132153 - DNA, 22 bp, Homo sapiens
acacaggcaatgtgagtgggag

SEQ ID NO: 7132154 - DNA, 22 bp, Homo sapiens
acacaggcaatgtgagtgggag

SEQ ID NO: 7132155 - DNA, 22 bp, Homo sapiens
acacaggcaatgtgagtgggag

SEQ ID NO: 7132156 - DNA, 22 bp, Homo sapiens
acacaggcaatgtgagtgggag

SEQ ID NO: 7132157 - DNA, 21 bp, Homo sapiens
acacaggcagtgtcccgaggt

SEQ ID NO: 7132158 - DNA, 23 bp, Homo sapiens
agcaggaaaccgagggtgatgtt

SEQ ID NO: 7132159 - DNA, 20 bp, Homo sapiens
agcaggaaaagtgccagtct

SEQ ID NO: 7132160 - DNA, 20 bp, Homo sapiens
agcaggaaaagtgccagtct

SEQ ID NO: 7132161 - DNA, 18 bp, Homo sapiens
agcagctttgacaggaaa

SEQ ID NO: 7132162 - DNA, 21 bp, Homo sapiens
agcagctttggttgaagcaga

SEQ ID NO: 7132163 - DNA, 18 bp, Homo sapiens
agcagctttgtgcttgat

SEQ ID NO: 7132164 - DNA, 22 bp, Homo sapiens
agcagcttggttttaggcatgg

SEQ ID NO: 7132165 - DNA, 22 bp, Homo sapiens
agcagcttggttttaggcatgg

SEQ ID NO: 7132166 - DNA, 22 bp, Homo sapiens
agcagcttgttaaaaagttcca

SEQ ID NO: 7132167 - DNA, 22 bp, Homo sapiens
agcagctttaagtcactggtta

SEQ ID NO: 7132168 - DNA, 22 bp, Homo sapiens
agcagctttcacctccccgcct

SEQ ID NO: 7132169 - DNA, 22 bp, Homo sapiens
agcagctttcctctggggtcag

SEQ ID NO: 7132170 - DNA, 22 bp, Homo sapiens
agcagctttcctctggggtcag

SEQ ID NO: 7132171 - DNA, 22 bp, Homo sapiens
acacatatgtatgcatcatgtg

SEQ ID NO: 7132172 - DNA, 22 bp, Homo sapiens
acacatatgtcattgaaaaatc

SEQ ID NO: 7132173 - DNA, 22 bp, Homo sapiens
acacatatggttggtaggagtt

SEQ ID NO: 7132174 - DNA, 22 bp, Homo sapiens
acacatatgtatgcatcatgtg

SEQ ID NO: 7132175 - DNA, 22 bp, Homo sapiens
acacatatgtatgcatcatgtg

SEQ ID NO: 7132176 - DNA, 22 bp, Homo sapiens
acacatatgtatgcatcatgtg

SEQ ID NO: 7132177 - DNA, 22 bp, Homo sapiens
acacatatgtatgcatcatgtg

SEQ ID NO: 7132178 - DNA, 21 bp, Homo sapiens
agcagcttgagtctggagctc

SEQ ID NO: 7132179 - DNA, 21 bp, Homo sapiens
agcagcttgagtctggagctc

SEQ ID NO: 7132180 - DNA, 22 bp, Homo sapiens
agcagcttggggccgagataga

SEQ ID NO: 7132181 - DNA, 22 bp, Homo sapiens
agcagcttggggccgagataga

SEQ ID NO: 7132182 - DNA, 22 bp, Homo sapiens
agcagcttggggccgagataga

SEQ ID NO: 7132183 - DNA, 22 bp, Homo sapiens
agcagcttgggtctctcctgct

SEQ ID NO: 7132184 - DNA, 22 bp, Homo sapiens
agcagcttgggtctctcctgct

SEQ ID NO: 7132185 - DNA, 22 bp, Homo sapiens
agcagcttgggtctctcctgct

SEQ ID NO: 7132186 - DNA, 22 bp, Homo sapiens
agcagcttgggtctctcctgct

SEQ ID NO: 7132187 - DNA, 22 bp, Homo sapiens
acacatatggttgctgcagtga

SEQ ID NO: 7132188 - DNA, 22 bp, Homo sapiens
acacatatggttgctgcagtga

SEQ ID NO: 7132189 - DNA, 22 bp, Homo sapiens
acacatatggttgctgcagtga

SEQ ID NO: 7132190 - DNA, 22 bp, Homo sapiens
acacatatgccattacagcaaa

SEQ ID NO: 7132191 - DNA, 22 bp, Homo sapiens
acacatatgccattacagcaaa

SEQ ID NO: 7132192 - DNA, 22 bp, Homo sapiens
acacatatgccattacagcaaa

SEQ ID NO: 7132193 - DNA, 22 bp, Homo sapiens
acacatatctaagatagatgac

SEQ ID NO: 7132194 - DNA, 22 bp, Homo sapiens
acacatatctaagatagatgac

SEQ ID NO: 7132195 - DNA, 22 bp, Homo sapiens
acacatatctaagatagatgac

SEQ ID NO: 7132196 - DNA, 22 bp, Homo sapiens
acacatatgcagatcccccaca

SEQ ID NO: 7132197 - DNA, 22 bp, Homo sapiens
acacatatatttgcatatacac

SEQ ID NO: 7132198 - DNA, 22 bp, Homo sapiens
acacatatatttgcatatacac

SEQ ID NO: 7132199 - DNA, 22 bp, Homo sapiens
acacatatctaagatagatgac

SEQ ID NO: 7132200 - DNA, 23 bp, Homo sapiens
acacatatattcagatacagatg

SEQ ID NO: 7132201 - DNA, 23 bp, Homo sapiens
acacatatattcagatacagatg

SEQ ID NO: 7132202 - DNA, 23 bp, Homo sapiens
acacatatattcagatacagatg

SEQ ID NO: 7132203 - DNA, 22 bp, Homo sapiens
acacatatatttgcatatacac

SEQ ID NO: 7132204 - DNA, 22 bp, Homo sapiens
acacatatatttgcatatacac

SEQ ID NO: 7132205 - DNA, 22 bp, Homo sapiens
acagagtggagttcagtaaata

SEQ ID NO: 7132206 - DNA, 22 bp, Homo sapiens
acagagttaatggataggcagg

SEQ ID NO: 7132207 - DNA, 22 bp, Homo sapiens
acagagttacataacttgtcca

SEQ ID NO: 7132208 - DNA, 22 bp, Homo sapiens
acagagttagcagaaagttgga

SEQ ID NO: 7132209 - DNA, 22 bp, Homo sapiens
acagagttgtaaacatttacca

SEQ ID NO: 7132210 - DNA, 22 bp, Homo sapiens
acagagttgtgtttgtacaacg

SEQ ID NO: 7132211 - DNA, 22 bp, Homo sapiens
acagagttgtgtttgtacaacg

SEQ ID NO: 7132212 - DNA, 22 bp, Homo sapiens
acagagttgtgtttgtacaacg

SEQ ID NO: 7132213 - DNA, 22 bp, Homo sapiens
acagagttgtgtttgtacaacg

SEQ ID NO: 7132214 - DNA, 22 bp, Homo sapiens
acagataatacattgtgctaca

SEQ ID NO: 7132215 - DNA, 22 bp, Homo sapiens
acagataatacattgtgctaca

SEQ ID NO: 7132216 - DNA, 22 bp, Homo sapiens
acagagtttatgtgtgtacaaa

SEQ ID NO: 7132217 - DNA, 22 bp, Homo sapiens
acagagtttatgtgtgtacaaa

SEQ ID NO: 7132218 - DNA, 22 bp, Homo sapiens
acagagtttatgtgtgtacaaa

SEQ ID NO: 7132219 - DNA, 22 bp, Homo sapiens
acagataaaagttgtttaaaat

SEQ ID NO: 7132220 - DNA, 22 bp, Homo sapiens
acagataaaagttgtttaaaat

SEQ ID NO: 7132221 - DNA, 22 bp, Homo sapiens
acagaggtggacctcagcaggc

SEQ ID NO: 7132222 - DNA, 22 bp, Homo sapiens
acagagtcattcattgtccagt

SEQ ID NO: 7132223 - DNA, 22 bp, Homo sapiens
acagagtcgccttgtagctggc

SEQ ID NO: 7132224 - DNA, 19 bp, Homo sapiens
acagagtgatgaggataga

SEQ ID NO: 7132225 - DNA, 19 bp, Homo sapiens
acagagtgatgaggataga

SEQ ID NO: 7132226 - DNA, 23 bp, Homo sapiens
acagaggtccaaacagtataagc

SEQ ID NO: 7132227 - DNA, 22 bp, Homo sapiens
agcccctgtaccctgagtgctt

SEQ ID NO: 7132228 - DNA, 22 bp, Homo sapiens
agcccctgtaccctgagtgctt

SEQ ID NO: 7132229 - DNA, 22 bp, Homo sapiens
agcccctgggagtagctgctgc

SEQ ID NO: 7132230 - DNA, 22 bp, Homo sapiens
agcccctgggagtagctgctgc

SEQ ID NO: 7132231 - DNA, 22 bp, Homo sapiens
agcccctgctgggtgtagctca

SEQ ID NO: 7132232 - DNA, 22 bp, Homo sapiens
agcccctctgtggctctgcctc

SEQ ID NO: 7132233 - DNA, 22 bp, Homo sapiens
acagagcagttctggagctggc

SEQ ID NO: 7132234 - DNA, 22 bp, Homo sapiens
acagagcagttctggagctggc

SEQ ID NO: 7132235 - DNA, 22 bp, Homo sapiens
acagagcagtaagaacacagct

SEQ ID NO: 7132236 - DNA, 22 bp, Homo sapiens
acagagcagtaagaacacagct

SEQ ID NO: 7132237 - DNA, 22 bp, Homo sapiens
acagagcagtaagaacacagct

SEQ ID NO: 7132238 - DNA, 22 bp, Homo sapiens
acagagcagtaagaacacagct

SEQ ID NO: 7132239 - DNA, 22 bp, Homo sapiens
acagagcagttctggagctggc

SEQ ID NO: 7132240 - DNA, 22 bp, Homo sapiens
acagagcataatgtctagcaca

SEQ ID NO: 7132241 - DNA, 22 bp, Homo sapiens
acagagcataatgtctagcaca

SEQ ID NO: 7132242 - DNA, 22 bp, Homo sapiens
acagagcataatgtctagcaca

SEQ ID NO: 7132243 - DNA, 22 bp, Homo sapiens
acagagcataatgtctagcaca

SEQ ID NO: 7132244 - DNA, 22 bp, Homo sapiens
acagagcatataaagtgctttg

SEQ ID NO: 7132245 - DNA, 22 bp, Homo sapiens
acagagcatataaagtgctttg

SEQ ID NO: 7132246 - DNA, 22 bp, Homo sapiens
acagagcatataaagtgctttg

SEQ ID NO: 7132247 - DNA, 22 bp, Homo sapiens
acagagcatataaagtgctttg

SEQ ID NO: 7132248 - DNA, 22 bp, Homo sapiens
acagagcatcagatgaaatcaa

SEQ ID NO: 7132249 - DNA, 22 bp, Homo sapiens
acagagcatgatggaagatcga

SEQ ID NO: 7132250 - DNA, 22 bp, Homo sapiens
acagagcatgatggaagatcga

SEQ ID NO: 7132251 - DNA, 22 bp, Homo sapiens
acagagcatgatggaagatcga

SEQ ID NO: 7132252 - DNA, 22 bp, Homo sapiens
acagagcatgctcagtgtgtga

SEQ ID NO: 7132253 - DNA, 22 bp, Homo sapiens
acagagcatttgggacagagag

SEQ ID NO: 7132254 - DNA, 22 bp, Homo sapiens
acagagcatttgggacagagag

SEQ ID NO: 7132255 - DNA, 17 bp, Homo sapiens
agcccctcagcgtcacc

SEQ ID NO: 7132256 - DNA, 23 bp, Homo sapiens
agcccctcatatctgctttctct

SEQ ID NO: 7132257 - DNA, 23 bp, Homo sapiens
agcccctcatggtgtctagacag

SEQ ID NO: 7132258 - DNA, 23 bp, Homo sapiens
agcccctcatggtgtctagacag

SEQ ID NO: 7132259 - DNA, 22 bp, Homo sapiens
agcccctccagtggcataaaat

SEQ ID NO: 7132260 - DNA, 22 bp, Homo sapiens
agcccctccagtggcataaaat

SEQ ID NO: 7132261 - DNA, 22 bp, Homo sapiens
agcccctctccgccctgagtcg

SEQ ID NO: 7132262 - DNA, 22 bp, Homo sapiens
agcccctctgtagctaatagta

SEQ ID NO: 7132263 - DNA, 22 bp, Homo sapiens
agcccctctgtagctaatagta

SEQ ID NO: 7132264 - DNA, 22 bp, Homo sapiens
agcccccaggagtctccacgcc

SEQ ID NO: 7132265 - DNA, 22 bp, Homo sapiens
acagagcatttgggacagagag

SEQ ID NO: 7132266 - DNA, 22 bp, Homo sapiens
acagagcatttgggacagagag

SEQ ID NO: 7132267 - DNA, 22 bp, Homo sapiens
agcccccaggagtctccacgcc

SEQ ID NO: 7132268 - DNA, 22 bp, Homo sapiens
agccacagtctgatgcctgaga

SEQ ID NO: 7132269 - DNA, 22 bp, Homo sapiens
agccacagtctgatgcctgaga

SEQ ID NO: 7132270 - DNA, 22 bp, Homo sapiens
agccagggtgggtgaatgctat

SEQ ID NO: 7132271 - DNA, 22 bp, Homo sapiens
agccagggtgggtgaatgctat

SEQ ID NO: 7132272 - DNA, 22 bp, Homo sapiens
agccagggtgggtgaatgctat

SEQ ID NO: 7132273 - DNA, 22 bp, Homo sapiens
agccagggtgggtgaatgctat

SEQ ID NO: 7132274 - DNA, 22 bp, Homo sapiens
agccatcctcccacctcagcct

SEQ ID NO: 7132275 - DNA, 22 bp, Homo sapiens
agccacagtcaacctgtccata

SEQ ID NO: 7132276 - DNA, 22 bp, Homo sapiens
agccacagtcaacctgtccata

SEQ ID NO: 7132277 - DNA, 22 bp, Homo sapiens
agccacagtcaacctgtccata

SEQ ID NO: 7132278 - DNA, 22 bp, Homo sapiens
agccacagtcaacctgtccata

SEQ ID NO: 7132279 - DNA, 22 bp, Homo sapiens
agccacagtcaacctgtccata

SEQ ID NO: 7132280 - DNA, 22 bp, Homo sapiens
agccacagtcaacctgtccata

SEQ ID NO: 7132281 - DNA, 22 bp, Homo sapiens
agccacagtctgatgcctgaga

SEQ ID NO: 7132282 - DNA, 22 bp, Homo sapiens
agccacagtctgatgcctgaga

SEQ ID NO: 7132283 - DNA, 22 bp, Homo sapiens
agccatctctgaaatcaaagct

SEQ ID NO: 7132284 - DNA, 22 bp, Homo sapiens
agccatctaagaaatacaaaat

SEQ ID NO: 7132285 - DNA, 22 bp, Homo sapiens
agccatgcaccttactcttgct

SEQ ID NO: 7132286 - DNA, 22 bp, Homo sapiens
agccatgcaccttactcttgct

SEQ ID NO: 7132287 - DNA, 22 bp, Homo sapiens
agccatgattttctcattttca

SEQ ID NO: 7132288 - DNA, 22 bp, Homo sapiens
agccatgctcagttcctggagc

SEQ ID NO: 7132289 - DNA, 22 bp, Homo sapiens
agccatgctcagttcctggagc

SEQ ID NO: 7132290 - DNA, 22 bp, Homo sapiens
agccatgctccttcccctctgg

SEQ ID NO: 7132291 - DNA, 22 bp, Homo sapiens
agccatggcgccactagaggga

SEQ ID NO: 7132292 - DNA, 22 bp, Homo sapiens
agccatggcgccactagaggga

SEQ ID NO: 7132293 - DNA, 22 bp, Homo sapiens
agccatggcgccactagaggga

SEQ ID NO: 7132294 - DNA, 22 bp, Homo sapiens
agccatggcgccactagaggga

SEQ ID NO: 7132295 - DNA, 22 bp, Homo sapiens
agccatggcgccactagaggga

SEQ ID NO: 7132296 - DNA, 22 bp, Homo sapiens
agccatggcgccactagaggga

SEQ ID NO: 7132297 - DNA, 22 bp, Homo sapiens
agccatgggagactgtgggaga

SEQ ID NO: 7132298 - DNA, 22 bp, Homo sapiens
agccatgggctcccagtccttt

SEQ ID NO: 7132299 - DNA, 22 bp, Homo sapiens
agccatgggctcccagtccttt

SEQ ID NO: 7132300 - DNA, 22 bp, Homo sapiens
agccatggtctcagggccataa

SEQ ID NO: 7132301 - DNA, 22 bp, Homo sapiens
agccatggtctcagggccataa

SEQ ID NO: 7132302 - DNA, 22 bp, Homo sapiens
agccatggtctcagggccataa

SEQ ID NO: 7132303 - DNA, 22 bp, Homo sapiens
agccattcattgtgctctcaga

SEQ ID NO: 7132304 - DNA, 22 bp, Homo sapiens
agccattgaatttagtgccttt

SEQ ID NO: 7132305 - DNA, 22 bp, Homo sapiens
agccattgaatttagtgccttt

SEQ ID NO: 7132306 - DNA, 22 bp, Homo sapiens
agccattgagttttatgtgcta

SEQ ID NO: 7132307 - DNA, 22 bp, Homo sapiens
agccattggctgcctggtgcgt

SEQ ID NO: 7132308 - DNA, 22 bp, Homo sapiens
agccatttcaacaaccggctgc

SEQ ID NO: 7132309 - DNA, 22 bp, Homo sapiens
agccatttcatacacctgcagc

SEQ ID NO: 7132310 - DNA, 22 bp, Homo sapiens
agcccagctgcctgcctgctgt

SEQ ID NO: 7132311 - DNA, 22 bp, Homo sapiens
agcccagctgcctgcctgctgt

SEQ ID NO: 7132312 - DNA, 22 bp, Homo sapiens
agcccagctgctatgtacctgg

SEQ ID NO: 7132313 - DNA, 18 bp, Homo sapiens
agcccagcggagtgaatc

SEQ ID NO: 7132314 - DNA, 18 bp, Homo sapiens
agcccagcggagtgaatc

SEQ ID NO: 7132315 - DNA, 18 bp, Homo sapiens
agcccagcggagtgaatc

SEQ ID NO: 7132316 - DNA, 22 bp, Homo sapiens
agcccagctcctccacagaata

SEQ ID NO: 7132317 - DNA, 22 bp, Homo sapiens
agcccagctcctccacagaata

SEQ ID NO: 7132318 - DNA, 22 bp, Homo sapiens
agcccagctcctccacagaata

SEQ ID NO: 7132319 - DNA, 22 bp, Homo sapiens
agcccagctgcctgcctgctgt

SEQ ID NO: 7132320 - DNA, 22 bp, Homo sapiens
agccatttcctgaactctggac

SEQ ID NO: 7132321 - DNA, 22 bp, Homo sapiens
agccatttggacttctggtagg

SEQ ID NO: 7132322 - DNA, 22 bp, Homo sapiens
agccattttcctgaaatataac

SEQ ID NO: 7132323 - DNA, 22 bp, Homo sapiens
agccattttggtaatgataaca

SEQ ID NO: 7132324 - DNA, 22 bp, Homo sapiens
agcccaaacctgcgagcagagc

SEQ ID NO: 7132325 - DNA, 22 bp, Homo sapiens
agcccaaactcatggtcctttg

SEQ ID NO: 7132326 - DNA, 22 bp, Homo sapiens
agcccagcggagcgggcccggg

SEQ ID NO: 7132327 - DNA, 22 bp, Homo sapiens
agcccagcggagcgggcccggg

SEQ ID NO: 7132328 - DNA, 22 bp, Homo sapiens
acagagcactgccctgtgccgc

SEQ ID NO: 7132329 - DNA, 22 bp, Homo sapiens
acagagcactgccctgtgccgc

SEQ ID NO: 7132330 - DNA, 22 bp, Homo sapiens
acagagaggtaaaatatatagt

SEQ ID NO: 7132331 - DNA, 22 bp, Homo sapiens
acagagaggtaaaatatatagt

SEQ ID NO: 7132332 - DNA, 22 bp, Homo sapiens
acagagatcagaggcataagca

SEQ ID NO: 7132333 - DNA, 17 bp, Homo sapiens
acagagcacatcaagat

SEQ ID NO: 7132334 - DNA, 17 bp, Homo sapiens
acagagcacatcaagat

SEQ ID NO: 7132335 - DNA, 22 bp, Homo sapiens
acagagcactgccctgtgccgc

SEQ ID NO: 7132336 - DNA, 22 bp, Homo sapiens
acagagcaggtccagaagtgcc

SEQ ID NO: 7132337 - DNA, 22 bp, Homo sapiens
acagagcaggtccagaagtgcc

SEQ ID NO: 7132338 - DNA, 22 bp, Homo sapiens
acagagcaggtccagaagtgcc

SEQ ID NO: 7132339 - DNA, 22 bp, Homo sapiens
agcccagctgctatgtacctgg

SEQ ID NO: 7132340 - DNA, 19 bp, Homo sapiens
agcccagcttatttgtcag

SEQ ID NO: 7132341 - DNA, 22 bp, Homo sapiens
agcccagcttccttctgtctct

SEQ ID NO: 7132342 - DNA, 22 bp, Homo sapiens
agcccagctttcacccctctgg

SEQ ID NO: 7132343 - DNA, 22 bp, Homo sapiens
acagagagggagtgataaatcc

SEQ ID NO: 7132344 - DNA, 22 bp, Homo sapiens
acagagagggagtgataaatcc

SEQ ID NO: 7132345 - DNA, 22 bp, Homo sapiens
acagagagggagtgataaatcc

SEQ ID NO: 7132346 - DNA, 22 bp, Homo sapiens
acagagaggtaaaatatatagt

SEQ ID NO: 7132347 - DNA, 22 bp, Homo sapiens
acagagaggtaaaatatatagt

SEQ ID NO: 7132348 - DNA, 22 bp, Homo sapiens
agctaggggaccaaggtggccc

SEQ ID NO: 7132349 - DNA, 22 bp, Homo sapiens
agctagggctttcgtagacagt

SEQ ID NO: 7132350 - DNA, 22 bp, Homo sapiens
agctagggctttcgtagacagt

SEQ ID NO: 7132351 - DNA, 22 bp, Homo sapiens
agctagggacagataccagcca

SEQ ID NO: 7132352 - DNA, 22 bp, Homo sapiens
agctagggacagataccagcca

SEQ ID NO: 7132353 - DNA, 22 bp, Homo sapiens
agctaggggaccaaggtggccc

SEQ ID NO: 7132354 - DNA, 22 bp, Homo sapiens
agctaggggaccaaggtggccc

SEQ ID NO: 7132355 - DNA, 22 bp, Homo sapiens
agctaggggaccaaggtggccc

SEQ ID NO: 7132356 - DNA, 22 bp, Homo sapiens
agctagtgggctgggagaggaa

SEQ ID NO: 7132357 - DNA, 22 bp, Homo sapiens
agctagttaaactatgaataca

SEQ ID NO: 7132358 - DNA, 22 bp, Homo sapiens
agctatcaccttaataaactga

SEQ ID NO: 7132359 - DNA, 22 bp, Homo sapiens
agctatgctgcagttgtggagt

SEQ ID NO: 7132360 - DNA, 21 bp, Homo sapiens
acagcaagccttcacatgagt

SEQ ID NO: 7132361 - DNA, 21 bp, Homo sapiens
acagcaagccttcacatgagt

SEQ ID NO: 7132362 - DNA, 21 bp, Homo sapiens
acagcaagccttcctttcagg

SEQ ID NO: 7132363 - DNA, 22 bp, Homo sapiens
acagcaataggaaatacttgca

SEQ ID NO: 7132364 - DNA, 22 bp, Homo sapiens
acagcaatcaatatggcattct

SEQ ID NO: 7132365 - DNA, 22 bp, Homo sapiens
acagcaatcaatatggcattct

SEQ ID NO: 7132366 - DNA, 22 bp, Homo sapiens
acagcaatctgagagacatagt

SEQ ID NO: 7132367 - DNA, 23 bp, Homo sapiens
acagcaagaggaccagatgtgag

SEQ ID NO: 7132368 - DNA, 23 bp, Homo sapiens
acagcaagaggaccagatgtgag

SEQ ID NO: 7132369 - DNA, 23 bp, Homo sapiens
acagcaagaggaccagatgtgag

SEQ ID NO: 7132370 - DNA, 22 bp, Homo sapiens
acagcaagacccctagcatggt

SEQ ID NO: 7132371 - DNA, 22 bp, Homo sapiens
acagcaagacccctagcatggt

SEQ ID NO: 7132372 - DNA, 22 bp, Homo sapiens
acagcaagacccctagcatggt

SEQ ID NO: 7132373 - DNA, 23 bp, Homo sapiens
acagcaagaggaccagatgtgag

SEQ ID NO: 7132374 - DNA, 23 bp, Homo sapiens
acagcaagaggaccagatgtgag

SEQ ID NO: 7132375 - DNA, 22 bp, Homo sapiens
acagcaagccagcttgtcactg

SEQ ID NO: 7132376 - DNA, 22 bp, Homo sapiens
acagcaagccagcttgtcactg

SEQ ID NO: 7132377 - DNA, 22 bp, Homo sapiens
acagcaagacccctagcatggt

SEQ ID NO: 7132378 - DNA, 22 bp, Homo sapiens
acagcaactcctgcttctgagt

SEQ ID NO: 7132379 - DNA, 22 bp, Homo sapiens
acagcaactcctgcttctgagt

SEQ ID NO: 7132380 - DNA, 22 bp, Homo sapiens
acagcaaatggttttctgtctg

SEQ ID NO: 7132381 - DNA, 22 bp, Homo sapiens
acagcaaatggttttctgtctg

SEQ ID NO: 7132382 - DNA, 22 bp, Homo sapiens
acagcaaatggttttctgtctg

SEQ ID NO: 7132383 - DNA, 22 bp, Homo sapiens
acagattgggaactgtctcctt

SEQ ID NO: 7132384 - DNA, 22 bp, Homo sapiens
acagcaaaggacgaacactctg

SEQ ID NO: 7132385 - DNA, 22 bp, Homo sapiens
acagcaaaggacgaacactctg

SEQ ID NO: 7132386 - DNA, 22 bp, Homo sapiens
acagcaaaggacgaacactctg

SEQ ID NO: 7132387 - DNA, 22 bp, Homo sapiens
agcctgccttgggctgcttgag

SEQ ID NO: 7132388 - DNA, 22 bp, Homo sapiens
agcctgcgatcccacctggcct

SEQ ID NO: 7132389 - DNA, 17 bp, Homo sapiens
agcctgctgatctcaca

SEQ ID NO: 7132390 - DNA, 17 bp, Homo sapiens
agcctgctgatctcaca

SEQ ID NO: 7132391 - DNA, 22 bp, Homo sapiens
agcctgctggaccaagctcatg

SEQ ID NO: 7132392 - DNA, 22 bp, Homo sapiens
acagattgaagtccagaatggc

SEQ ID NO: 7132393 - DNA, 21 bp, Homo sapiens
acagattgctgagctctacct

SEQ ID NO: 7132394 - DNA, 22 bp, Homo sapiens
acagatttaggactgtagcgat

SEQ ID NO: 7132395 - DNA, 21 bp, Homo sapiens
agcctgcaatgtaggtaccgg

SEQ ID NO: 7132396 - DNA, 22 bp, Homo sapiens
agcctgcacctgaccaacctgc

SEQ ID NO: 7132397 - DNA, 22 bp, Homo sapiens
agcctgcacctgaccaacctgc

SEQ ID NO: 7132398 - DNA, 22 bp, Homo sapiens
agcctgcacctgaccaacctgc

SEQ ID NO: 7132399 - DNA, 22 bp, Homo sapiens
agcctgcaggatgggcagcacc

SEQ ID NO: 7132400 - DNA, 22 bp, Homo sapiens
agcctgcaggatgggcagcacc

SEQ ID NO: 7132401 - DNA, 20 bp, Homo sapiens
agcctgccagctggcccaga

SEQ ID NO: 7132402 - DNA, 20 bp, Homo sapiens
agcctgccagctggcccaga

SEQ ID NO: 7132403 - DNA, 20 bp, Homo sapiens
agcctgccagctggcccaga

SEQ ID NO: 7132404 - DNA, 22 bp, Homo sapiens
agcctgccaggcgctgcctgga

SEQ ID NO: 7132405 - DNA, 22 bp, Homo sapiens
agcctgccaggcgctgcctgga

SEQ ID NO: 7132406 - DNA, 22 bp, Homo sapiens
agcctgccaggcgctgcctgga

SEQ ID NO: 7132407 - DNA, 17 bp, Homo sapiens
agcctgccccatgctgc

SEQ ID NO: 7132408 - DNA, 17 bp, Homo sapiens
agcctgccccatgctgc

SEQ ID NO: 7132409 - DNA, 22 bp, Homo sapiens
agcctgcctcagactcaggata

SEQ ID NO: 7132410 - DNA, 22 bp, Homo sapiens
agcctgcctcagactcaggata

SEQ ID NO: 7132411 - DNA, 22 bp, Homo sapiens
agcctgcctgtgaggctttgag

SEQ ID NO: 7132412 - DNA, 22 bp, Homo sapiens
agctctcaagataagaaagaac

SEQ ID NO: 7132413 - DNA, 20 bp, Homo sapiens
agctctcagcatgctgcctg

SEQ ID NO: 7132414 - DNA, 22 bp, Homo sapiens
agctctcattactttacagatg

SEQ ID NO: 7132415 - DNA, 22 bp, Homo sapiens
agctctccacacataggactag

SEQ ID NO: 7132416 - DNA, 22 bp, Homo sapiens
agctccttgaagggctctggga

SEQ ID NO: 7132417 - DNA, 20 bp, Homo sapiens
agctcctttgtgtccaggat

SEQ ID NO: 7132418 - DNA, 20 bp, Homo sapiens
agctcctttgtgtccaggat

SEQ ID NO: 7132419 - DNA, 22 bp, Homo sapiens
agctctaaatggaattttgcct

SEQ ID NO: 7132420 - DNA, 22 bp, Homo sapiens
agctctatcacctgtcagttgc

SEQ ID NO: 7132421 - DNA, 22 bp, Homo sapiens
agctcctgttctgagagcagga

SEQ ID NO: 7132422 - DNA, 19 bp, Homo sapiens
agctcctgttcagcagctc

SEQ ID NO: 7132423 - DNA, 19 bp, Homo sapiens
agctcctgttcagcagctc

SEQ ID NO: 7132424 - DNA, 22 bp, Homo sapiens
agctcctgttctgagagcagga

SEQ ID NO: 7132425 - DNA, 22 bp, Homo sapiens
agctcctgttctgagagcagga

SEQ ID NO: 7132426 - DNA, 22 bp, Homo sapiens
agctcctgttctgagagcagga

SEQ ID NO: 7132427 - DNA, 22 bp, Homo sapiens
agctccttgaaggcagtagctg

SEQ ID NO: 7132428 - DNA, 22 bp, Homo sapiens
agctccttgaaggcagtagctg

SEQ ID NO: 7132429 - DNA, 22 bp, Homo sapiens
agctccttgaaggcagtagctg

SEQ ID NO: 7132430 - DNA, 22 bp, Homo sapiens
agctctggggtagggcccaaca

SEQ ID NO: 7132431 - DNA, 22 bp, Homo sapiens
agctctgggggaaagtctgctc

SEQ ID NO: 7132432 - DNA, 22 bp, Homo sapiens
agctctggggtagggcccaaca

SEQ ID NO: 7132433 - DNA, 22 bp, Homo sapiens
agctctggggtagggcccaaca

SEQ ID NO: 7132434 - DNA, 22 bp, Homo sapiens
agctctggggtggagcccagga

SEQ ID NO: 7132435 - DNA, 22 bp, Homo sapiens
agctctggggtggagcccagga

SEQ ID NO: 7132436 - DNA, 22 bp, Homo sapiens
agctctgggggaaagtctgctc

SEQ ID NO: 7132437 - DNA, 22 bp, Homo sapiens
agctctggggcctgtcccacat

SEQ ID NO: 7132438 - DNA, 22 bp, Homo sapiens
agctctggggcctgtcccacat

SEQ ID NO: 7132439 - DNA, 22 bp, Homo sapiens
agctctgggggaaagtctgctc

SEQ ID NO: 7132440 - DNA, 22 bp, Homo sapiens
agctctgggggaaagtctgctc

SEQ ID NO: 7132441 - DNA, 18 bp, Homo sapiens
agctctggggagatgggc

SEQ ID NO: 7132442 - DNA, 22 bp, Homo sapiens
agctctggggcctgtcccacat

SEQ ID NO: 7132443 - DNA, 22 bp, Homo sapiens
agctctggggcctgtcccacat

SEQ ID NO: 7132444 - DNA, 22 bp, Homo sapiens
agctctccacacataggactag

SEQ ID NO: 7132445 - DNA, 22 bp, Homo sapiens
agctctccacacataggactag

SEQ ID NO: 7132446 - DNA, 22 bp, Homo sapiens
agctctccatctatctgtgatg

SEQ ID NO: 7132447 - DNA, 22 bp, Homo sapiens
agctctccatctatctgtgatg

SEQ ID NO: 7132448 - DNA, 22 bp, Homo sapiens
agctctcccaccttcttcttac

SEQ ID NO: 7132449 - DNA, 22 bp, Homo sapiens
agctctgggccaggaaccctaa

SEQ ID NO: 7132450 - DNA, 22 bp, Homo sapiens
agctctgggctgacatgctccc

SEQ ID NO: 7132451 - DNA, 22 bp, Homo sapiens
agctctgggctgacatgctccc

SEQ ID NO: 7132452 - DNA, 22 bp, Homo sapiens
agctctgggctgacatgctccc

SEQ ID NO: 7132453 - DNA, 22 bp, Homo sapiens
agctctgggctgacatgctccc

SEQ ID NO: 7132454 - DNA, 22 bp, Homo sapiens
agctctgggctgacatgctccc

SEQ ID NO: 7132455 - DNA, 22 bp, Homo sapiens
agctctgggctgacatgctccc

SEQ ID NO: 7132456 - DNA, 18 bp, Homo sapiens
agctctggggagatgggc

SEQ ID NO: 7132457 - DNA, 18 bp, Homo sapiens
agctctggggagatgggc

SEQ ID NO: 7132458 - DNA, 22 bp, Homo sapiens
acagcaggagccttcatatgct

SEQ ID NO: 7132459 - DNA, 22 bp, Homo sapiens
acagcaggagccttcatatgct

SEQ ID NO: 7132460 - DNA, 22 bp, Homo sapiens
acagcaggaattaacatataag

SEQ ID NO: 7132461 - DNA, 22 bp, Homo sapiens
acagcaggaattaacatataag

SEQ ID NO: 7132462 - DNA, 22 bp, Homo sapiens
acagcaggagccttcatatgct

SEQ ID NO: 7132463 - DNA, 22 bp, Homo sapiens
acagcaggagccttcatatgct

SEQ ID NO: 7132464 - DNA, 22 bp, Homo sapiens
acagcagctaaaggtgtctcct

SEQ ID NO: 7132465 - DNA, 22 bp, Homo sapiens
acagcaggaagctggagggaaa

SEQ ID NO: 7132466 - DNA, 22 bp, Homo sapiens
acagcagcgtgaagtgtgttat

SEQ ID NO: 7132467 - DNA, 22 bp, Homo sapiens
acagcagcgtgaagtgtgttat

SEQ ID NO: 7132468 - DNA, 22 bp, Homo sapiens
acagcagcgtgaagtgtgttat

SEQ ID NO: 7132469 - DNA, 22 bp, Homo sapiens
acagcagctaaaggtgtctcct

SEQ ID NO: 7132470 - DNA, 22 bp, Homo sapiens
acagcagctaaaggtgtctcct

SEQ ID NO: 7132471 - DNA, 22 bp, Homo sapiens
agctcaaagctgttacattgta

SEQ ID NO: 7132472 - DNA, 22 bp, Homo sapiens
agctcaagagtagttcgagggg

SEQ ID NO: 7132473 - DNA, 22 bp, Homo sapiens
agctcaagcgtgggctgggcgc

SEQ ID NO: 7132474 - DNA, 22 bp, Homo sapiens
agctcaagcgtgggctgggcgc

SEQ ID NO: 7132475 - DNA, 22 bp, Homo sapiens
agctcaagcgtgggctgggcgc

SEQ ID NO: 7132476 - DNA, 22 bp, Homo sapiens
agctcaagcgtgggctgggcgc

SEQ ID NO: 7132477 - DNA, 22 bp, Homo sapiens
agctattgtgtgcccagcagga

SEQ ID NO: 7132478 - DNA, 22 bp, Homo sapiens
agctatttctcttattatatcc

SEQ ID NO: 7132479 - DNA, 22 bp, Homo sapiens
agctcctgtgtgcccacctgct

SEQ ID NO: 7132480 - DNA, 22 bp, Homo sapiens
agctcctgtgtgcccacctgct

SEQ ID NO: 7132481 - DNA, 22 bp, Homo sapiens
agctcctgtgtgcccacctgct

SEQ ID NO: 7132482 - DNA, 22 bp, Homo sapiens
agctcctgtgtgcccacctgct

SEQ ID NO: 7132483 - DNA, 22 bp, Homo sapiens
acagcaggcatgaatgacactg

SEQ ID NO: 7132484 - DNA, 22 bp, Homo sapiens
acagcaggcatgaagaaatgtt

SEQ ID NO: 7132485 - DNA, 22 bp, Homo sapiens
acagcaggcatgaagaaatgtt

SEQ ID NO: 7132486 - DNA, 22 bp, Homo sapiens
acagcaggcatgaagaaatgtt

SEQ ID NO: 7132487 - DNA, 22 bp, Homo sapiens
acagcaggatttggcgatgttg

SEQ ID NO: 7132488 - DNA, 22 bp, Homo sapiens
acagcaggatttggcgatgttg

SEQ ID NO: 7132489 - DNA, 22 bp, Homo sapiens
acagcaggcacacaaggataga

SEQ ID NO: 7132490 - DNA, 22 bp, Homo sapiens
acagcaggcacacaaggataga

SEQ ID NO: 7132491 - DNA, 22 bp, Homo sapiens
acagcaggcatgaagaaatgtt

SEQ ID NO: 7132492 - DNA, 22 bp, Homo sapiens
acagcaggcatgaagaaatgtt

SEQ ID NO: 7132493 - DNA, 20 bp, Homo sapiens
tccaagggcagcagaatcag

SEQ ID NO: 7132494 - DNA, 22 bp, Homo sapiens
tccaagggcagcagccatagcc

SEQ ID NO: 7132495 - DNA, 22 bp, Homo sapiens
tccaaggctccggccctggcgt

SEQ ID NO: 7132496 - DNA, 22 bp, Homo sapiens
tccaagggaaactgcacttcta

SEQ ID NO: 7132497 - DNA, 22 bp, Homo sapiens
tccaaggctccggccctggcgt

SEQ ID NO: 7132498 - DNA, 22 bp, Homo sapiens
tccaaggccgcaggctgggcct

SEQ ID NO: 7132499 - DNA, 22 bp, Homo sapiens
tccaaggcctggcagcacaaag

SEQ ID NO: 7132500 - DNA, 22 bp, Homo sapiens
tccaaggctccggccctggcgt

SEQ ID NO: 7132501 - DNA, 22 bp, Homo sapiens
tccaagggcatgctgaaataag

SEQ ID NO: 7132502 - DNA, 23 bp, Homo sapiens
tccaagggctacaaacacagacc

SEQ ID NO: 7132503 - DNA, 22 bp, Homo sapiens
tccaagggctttggcgtgaagt

SEQ ID NO: 7132504 - DNA, 22 bp, Homo sapiens
tccaaggtcagcgagagtcact

SEQ ID NO: 7132505 - DNA, 23 bp, Homo sapiens
tccaaggttgttgtggaaggggc

SEQ ID NO: 7132506 - DNA, 22 bp, Homo sapiens
tccaagggttcatgtgcattca

SEQ ID NO: 7132507 - DNA, 20 bp, Homo sapiens
tccaatttaagaatttagag

SEQ ID NO: 7132508 - DNA, 20 bp, Homo sapiens
tccaattaaaaattgtatgc

SEQ ID NO: 7132509 - DNA, 19 bp, Homo sapiens
tccaatttctattcatgtt

SEQ ID NO: 7132510 - DNA, 19 bp, Homo sapiens
tccaatttctattcatgtt

SEQ ID NO: 7132511 - DNA, 22 bp, Homo sapiens
tccaatttgaaatggtatatgt

SEQ ID NO: 7132512 - DNA, 19 bp, Homo sapiens
tccaatttctattcatgtt

SEQ ID NO: 7132513 - DNA, 19 bp, Homo sapiens
tccaatttgtatgttttca

SEQ ID NO: 7132514 - DNA, 19 bp, Homo sapiens
tccaatttgtatgttttca

SEQ ID NO: 7132515 - DNA, 22 bp, Homo sapiens
tccaatttgtttgatgatggaa

SEQ ID NO: 7132516 - DNA, 22 bp, Homo sapiens
tccaattttacgtctgtataaa

SEQ ID NO: 7132517 - DNA, 19 bp, Homo sapiens
tccaatttgtatgttttca

SEQ ID NO: 7132518 - DNA, 22 bp, Homo sapiens
tccaattttacgtctgtataaa

SEQ ID NO: 7132519 - DNA, 22 bp, Homo sapiens
tccaattttctgatttcacttg

SEQ ID NO: 7132520 - DNA, 22 bp, Homo sapiens
tccaatcagctcctatgagaat

SEQ ID NO: 7132521 - DNA, 22 bp, Homo sapiens
tccaataaccacaatcagatag

SEQ ID NO: 7132522 - DNA, 22 bp, Homo sapiens
tccaatatttctcacatatgga

SEQ ID NO: 7132523 - DNA, 20 bp, Homo sapiens
tccaagttataaagtgccaa

SEQ ID NO: 7132524 - DNA, 22 bp, Homo sapiens
tccaataacatctaaaaactta

SEQ ID NO: 7132525 - DNA, 22 bp, Homo sapiens
tccaataaccacaatcagatag

SEQ ID NO: 7132526 - DNA, 22 bp, Homo sapiens
tccaaggacattgttctagttg

SEQ ID NO: 7132527 - DNA, 22 bp, Homo sapiens
tccaaggacgctggacccctgc

SEQ ID NO: 7132528 - DNA, 22 bp, Homo sapiens
tccaagaagcttacaatctaat

SEQ ID NO: 7132529 - DNA, 22 bp, Homo sapiens
tccaagaagcttacaatctaat

SEQ ID NO: 7132530 - DNA, 22 bp, Homo sapiens
tccaagctactgaaggtttggg

SEQ ID NO: 7132531 - DNA, 22 bp, Homo sapiens
tccaagctgtatgttcctagag

SEQ ID NO: 7132532 - DNA, 22 bp, Homo sapiens
tccaagcttgctttagccacag

SEQ ID NO: 7132533 - DNA, 22 bp, Homo sapiens
tccaaggactcttgtcagctgt

SEQ ID NO: 7132534 - DNA, 22 bp, Homo sapiens
tccaaggagcagtcttcaacct

SEQ ID NO: 7132535 - DNA, 22 bp, Homo sapiens
tccaaggaggctttgacgtcca

SEQ ID NO: 7132536 - DNA, 22 bp, Homo sapiens
tccaaggaggctttgacgtcca

SEQ ID NO: 7132537 - DNA, 22 bp, Homo sapiens
tccaaggcatagacacagtgcc

SEQ ID NO: 7132538 - DNA, 19 bp, Homo sapiens
tccaaggcatggcccagtg

SEQ ID NO: 7132539 - DNA, 19 bp, Homo sapiens
tccaaggcatggcccagtg

SEQ ID NO: 7132540 - DNA, 22 bp, Homo sapiens
tccaaggcatggtgggagagag

SEQ ID NO: 7132541 - DNA, 22 bp, Homo sapiens
tccaaggcatggtgggagagag

SEQ ID NO: 7132542 - DNA, 22 bp, Homo sapiens
tccaaggccgcaggctgggcct

SEQ ID NO: 7132543 - DNA, 22 bp, Homo sapiens
tccaactttctcctccggcttg

SEQ ID NO: 7132544 - DNA, 22 bp, Homo sapiens
tccaagaacccaagcgaatgcc

SEQ ID NO: 7132545 - DNA, 22 bp, Homo sapiens
tccaagaacccaagcgaatgcc

SEQ ID NO: 7132546 - DNA, 22 bp, Homo sapiens
tccaagaagagcctttctcctc

SEQ ID NO: 7132547 - DNA, 22 bp, Homo sapiens
tccaagaagagcctttctcctc

SEQ ID NO: 7132548 - DNA, 22 bp, Homo sapiens
tccaagaagctcagcaaacatc

SEQ ID NO: 7132549 - DNA, 22 bp, Homo sapiens
tccaagaagctcagcaaacatc

SEQ ID NO: 7132550 - DNA, 22 bp, Homo sapiens
tccaaatttaccttacagatat

SEQ ID NO: 7132551 - DNA, 22 bp, Homo sapiens
tccaacatgcagtcaggcctag

SEQ ID NO: 7132552 - DNA, 22 bp, Homo sapiens
tccaacatttatcaaggttgtt

SEQ ID NO: 7132553 - DNA, 22 bp, Homo sapiens
tccaactccacctttgtctccc

SEQ ID NO: 7132554 - DNA, 22 bp, Homo sapiens
tccaaatattcatctacttctg

SEQ ID NO: 7132555 - DNA, 22 bp, Homo sapiens
tccaaatatattcacgtcctag

SEQ ID NO: 7132556 - DNA, 22 bp, Homo sapiens
tccaaatatcttggtggttagg

SEQ ID NO: 7132557 - DNA, 22 bp, Homo sapiens
tccaaatattatgattatagga

SEQ ID NO: 7132558 - DNA, 22 bp, Homo sapiens
tccaaatattcggtctttctga

SEQ ID NO: 7132559 - DNA, 21 bp, Homo sapiens
tccaaatcccattctgtagtc

SEQ ID NO: 7132560 - DNA, 22 bp, Homo sapiens
tccaaagaatagaggtgacatt

SEQ ID NO: 7132561 - DNA, 22 bp, Homo sapiens
tccaaagaatagaggtgacatt

SEQ ID NO: 7132562 - DNA, 22 bp, Homo sapiens
tccaaagaagtcacaaacgaag

SEQ ID NO: 7132563 - DNA, 19 bp, Homo sapiens
tccaaagaagttcacattt

SEQ ID NO: 7132564 - DNA, 22 bp, Homo sapiens
tccaaagcatctgagtgtgcat

SEQ ID NO: 7132565 - DNA, 22 bp, Homo sapiens
tccaaagcatttggctcccacc

SEQ ID NO: 7132566 - DNA, 22 bp, Homo sapiens
tccaaagcatttggctcccacc

SEQ ID NO: 7132567 - DNA, 22 bp, Homo sapiens
tccaaagaacctggctactgtc

SEQ ID NO: 7132568 - DNA, 22 bp, Homo sapiens
tccaaagaacattgctgagacc

SEQ ID NO: 7132569 - DNA, 18 bp, Homo sapiens
tccaaaatcatgtatttt

SEQ ID NO: 7132570 - DNA, 22 bp, Homo sapiens
tccaaacaccctccatgctgca

SEQ ID NO: 7132571 - DNA, 21 bp, Homo sapiens
tccaaacctgtctctggctct

SEQ ID NO: 7132572 - DNA, 22 bp, Homo sapiens
tccaaaggaagaggctgtcagt

SEQ ID NO: 7132573 - DNA, 22 bp, Homo sapiens
tccaaaggacatttctgcttct

SEQ ID NO: 7132574 - DNA, 19 bp, Homo sapiens
tccaaaggacccacctcca

SEQ ID NO: 7132575 - DNA, 21 bp, Homo sapiens
tccaaaggagactgagtgtgt

SEQ ID NO: 7132576 - DNA, 21 bp, Homo sapiens
tccaaaggagactgagtgtgt

SEQ ID NO: 7132577 - DNA, 22 bp, Homo sapiens
tccaaaggaggctgccaagttc

SEQ ID NO: 7132578 - DNA, 21 bp, Homo sapiens
tccaaaggagactgagtgtgt

SEQ ID NO: 7132579 - DNA, 22 bp, Homo sapiens
tccaaaggcaaaactgtggtgt

SEQ ID NO: 7132580 - DNA, 22 bp, Homo sapiens
tccaaaggcaaaactgtggtgt

SEQ ID NO: 7132581 - DNA, 22 bp, Homo sapiens
tccaaaggccctaataagcttg

SEQ ID NO: 7132582 - DNA, 22 bp, Homo sapiens
tccaaaggccctgagttcactt

SEQ ID NO: 7132583 - DNA, 22 bp, Homo sapiens
tccaaaggggcagtgtccagcc

SEQ ID NO: 7132584 - DNA, 18 bp, Homo sapiens
tccaaaggtcccctccca

SEQ ID NO: 7132585 - DNA, 18 bp, Homo sapiens
tccaaaggtcccctccca

SEQ ID NO: 7132586 - DNA, 22 bp, Homo sapiens
tccaaatacatttactgtattt

SEQ ID NO: 7132587 - DNA, 22 bp, Homo sapiens
tccaaataccagatgggctaat

SEQ ID NO: 7132588 - DNA, 23 bp, Homo sapiens
tccaaatacctgtcaccttgtct

SEQ ID NO: 7132589 - DNA, 22 bp, Homo sapiens
tccaaatagctggatgatggtg

SEQ ID NO: 7132590 - DNA, 22 bp, Homo sapiens
tccaaatagttctggaagactg

SEQ ID NO: 7132591 - DNA, 22 bp, Homo sapiens
tccaaatatacagaatctcctc

SEQ ID NO: 7132592 - DNA, 22 bp, Homo sapiens
tccaaatatagatgagttgtaa

SEQ ID NO: 7132593 - DNA, 22 bp, Homo sapiens
tccaaatataggatgtgatata

SEQ ID NO: 7132594 - DNA, 22 bp, Homo sapiens
tcatttgttcatctgctcttct

SEQ ID NO: 7132595 - DNA, 22 bp, Homo sapiens
tcatttgttcatctgctcttct

SEQ ID NO: 7132596 - DNA, 22 bp, Homo sapiens
tcatttgtaccattttttaaga

SEQ ID NO: 7132597 - DNA, 22 bp, Homo sapiens
tcatttgtaccattttttaaga

SEQ ID NO: 7132598 - DNA, 22 bp, Homo sapiens
tcatttgtaccattttttaaga

SEQ ID NO: 7132599 - DNA, 22 bp, Homo sapiens
tcatttgtgcaatgtagatgaa

SEQ ID NO: 7132600 - DNA, 19 bp, Homo sapiens
tcatttgttagtagaagtt

SEQ ID NO: 7132601 - DNA, 22 bp, Homo sapiens
tcatttttgaccatgggtagga

SEQ ID NO: 7132602 - DNA, 22 bp, Homo sapiens
tcatttttctcttacacgtaga

SEQ ID NO: 7132603 - DNA, 22 bp, Homo sapiens
tcatttttgaccatgggtagga

SEQ ID NO: 7132604 - DNA, 22 bp, Homo sapiens
tcatttttctcttacacgtaga

SEQ ID NO: 7132605 - DNA, 22 bp, Homo sapiens
tcatttttttccggtaggaata

SEQ ID NO: 7132606 - DNA, 22 bp, Homo sapiens
tcatttttttccggtaggaata

SEQ ID NO: 7132607 - DNA, 22 bp, Homo sapiens
tccaaaaaacgtttgaatagtt

SEQ ID NO: 7132608 - DNA, 22 bp, Homo sapiens
tccaaaacagaactctgtgaat

SEQ ID NO: 7132609 - DNA, 22 bp, Homo sapiens
tccaaaacagaactctgtgaat

SEQ ID NO: 7132610 - DNA, 22 bp, Homo sapiens
tccaaaacagaactctgtgaat

SEQ ID NO: 7132611 - DNA, 22 bp, Homo sapiens
tcattgttatgttttgctgtct

SEQ ID NO: 7132612 - DNA, 22 bp, Homo sapiens
tcattgttcctatttggcaaga

SEQ ID NO: 7132613 - DNA, 22 bp, Homo sapiens
tcattgttcctatttggcaaga

SEQ ID NO: 7132614 - DNA, 22 bp, Homo sapiens
tcattgttaattcctgccggcc

SEQ ID NO: 7132615 - DNA, 22 bp, Homo sapiens
tcattgttaattgtatgatctg

SEQ ID NO: 7132616 - DNA, 22 bp, Homo sapiens
tcattgttaattgtatgatctg

SEQ ID NO: 7132617 - DNA, 22 bp, Homo sapiens
tcattgttactgtttagttgcc

SEQ ID NO: 7132618 - DNA, 22 bp, Homo sapiens
tcattgttactgtttagttgcc

SEQ ID NO: 7132619 - DNA, 22 bp, Homo sapiens
tcattgttaactcccagattca

SEQ ID NO: 7132620 - DNA, 22 bp, Homo sapiens
tcattgtcttgatatgattgtc

SEQ ID NO: 7132621 - DNA, 22 bp, Homo sapiens
tcattgtattcagaactgaaga

SEQ ID NO: 7132622 - DNA, 22 bp, Homo sapiens
tcattgtcagctcttgacttct

SEQ ID NO: 7132623 - DNA, 22 bp, Homo sapiens
tcattgtctctcttttcatata

SEQ ID NO: 7132624 - DNA, 22 bp, Homo sapiens
tcattgtcgctctgcggtgttc

SEQ ID NO: 7132625 - DNA, 21 bp, Homo sapiens
tcatgcatgagtttatatata

SEQ ID NO: 7132626 - DNA, 22 bp, Homo sapiens
tcattgccatggcatttgcaga

SEQ ID NO: 7132627 - DNA, 22 bp, Homo sapiens
tcattgctctaggttccttgga

SEQ ID NO: 7132628 - DNA, 16 bp, Homo sapiens
tcattgctcatgggtc

SEQ ID NO: 7132629 - DNA, 21 bp, Homo sapiens
tcattggtaagttttgtttgc

SEQ ID NO: 7132630 - DNA, 22 bp, Homo sapiens
tcattggtaattatttttgaca

SEQ ID NO: 7132631 - DNA, 22 bp, Homo sapiens
tcattggttgtcacacagggag

SEQ ID NO: 7132632 - DNA, 21 bp, Homo sapiens
tcattggtcattaagctctgt

SEQ ID NO: 7132633 - DNA, 22 bp, Homo sapiens
tcattgtacaattgcatgtgcg

SEQ ID NO: 7132634 - DNA, 23 bp, Homo sapiens
tcattgtacatgttccagtggat

SEQ ID NO: 7132635 - DNA, 22 bp, Homo sapiens
tcatgcagataagaataagtaa

SEQ ID NO: 7132636 - DNA, 22 bp, Homo sapiens
tcatgcagatttggaggtattt

SEQ ID NO: 7132637 - DNA, 22 bp, Homo sapiens
tcatgcagcaatatgcattagg

SEQ ID NO: 7132638 - DNA, 22 bp, Homo sapiens
tcatgcagcttttccattcagc

SEQ ID NO: 7132639 - DNA, 22 bp, Homo sapiens
tcatgcaggacttacaagagat

SEQ ID NO: 7132640 - DNA, 22 bp, Homo sapiens
tcatgcaggcagcctttagtaa

SEQ ID NO: 7132641 - DNA, 22 bp, Homo sapiens
tcatgcaggtttccagccagat

SEQ ID NO: 7132642 - DNA, 22 bp, Homo sapiens
tcatgcataaccttgactttgt

SEQ ID NO: 7132643 - DNA, 22 bp, Homo sapiens
tcatgcataaccttgactttgt

SEQ ID NO: 7132644 - DNA, 22 bp, Homo sapiens
tcatgcataatggtgacaacct

SEQ ID NO: 7132645 - DNA, 22 bp, Homo sapiens
tcatgcatatttgtagtagttc

SEQ ID NO: 7132646 - DNA, 22 bp, Homo sapiens
tcatgcatatttgtagtagttc

SEQ ID NO: 7132647 - DNA, 22 bp, Homo sapiens
tcatgcatatggggtcagccca

SEQ ID NO: 7132648 - DNA, 22 bp, Homo sapiens
tcatgcatcaatttctctttag

SEQ ID NO: 7132649 - DNA, 22 bp, Homo sapiens
tcatgcatcaatttctctttag

SEQ ID NO: 7132650 - DNA, 22 bp, Homo sapiens
tcatgcatcaatttctctttag

SEQ ID NO: 7132651 - DNA, 22 bp, Homo sapiens
tcatgcatctgggctggctggt

SEQ ID NO: 7132652 - DNA, 22 bp, Homo sapiens
tcatgcatctgggctggctggt

SEQ ID NO: 7132653 - DNA, 22 bp, Homo sapiens
tcatttaatagcttttgtcttt

SEQ ID NO: 7132654 - DNA, 22 bp, Homo sapiens
tcatttaataatttttgagtag

SEQ ID NO: 7132655 - DNA, 22 bp, Homo sapiens
tcatttacacttcacaaatgga

SEQ ID NO: 7132656 - DNA, 22 bp, Homo sapiens
tcatttacacttcacaaatgga

SEQ ID NO: 7132657 - DNA, 22 bp, Homo sapiens
tcatttacaggtgaagcaacta

SEQ ID NO: 7132658 - DNA, 22 bp, Homo sapiens
tcatttacatagaaacaatata

SEQ ID NO: 7132659 - DNA, 22 bp, Homo sapiens
tcatttacatagaaacaatata

SEQ ID NO: 7132660 - DNA, 22 bp, Homo sapiens
tcatttaataatttttgagtag

SEQ ID NO: 7132661 - DNA, 22 bp, Homo sapiens
tcatttaataatttttgagtag

SEQ ID NO: 7132662 - DNA, 22 bp, Homo sapiens
tcattgtttctgcttttcatga

SEQ ID NO: 7132663 - DNA, 22 bp, Homo sapiens
tcattgtttctgcttttcatga

SEQ ID NO: 7132664 - DNA, 22 bp, Homo sapiens
tcattgttttgattccttcatg

SEQ ID NO: 7132665 - DNA, 22 bp, Homo sapiens
tcattgtttctgcttttcatga

SEQ ID NO: 7132666 - DNA, 22 bp, Homo sapiens
tcattgttttgattccttcatg

SEQ ID NO: 7132667 - DNA, 22 bp, Homo sapiens
tcattgttgcgttaatgtcttc

SEQ ID NO: 7132668 - DNA, 19 bp, Homo sapiens
tcattgttggtttgtcggg

SEQ ID NO: 7132669 - DNA, 22 bp, Homo sapiens
tcattgttgacataccaagagc

SEQ ID NO: 7132670 - DNA, 21 bp, Homo sapiens
tcattgttgcatggtaggggg

SEQ ID NO: 7132671 - DNA, 22 bp, Homo sapiens
tcatttactggatccataagca

SEQ ID NO: 7132672 - DNA, 22 bp, Homo sapiens
tcatttactgtaggagtgaacc

SEQ ID NO: 7132673 - DNA, 19 bp, Homo sapiens
tcatttactttctgggtga

SEQ ID NO: 7132674 - DNA, 22 bp, Homo sapiens
tcatttacgcgcctccttcctt

SEQ ID NO: 7132675 - DNA, 22 bp, Homo sapiens
tcatttacatgtctttctctga

SEQ ID NO: 7132676 - DNA, 22 bp, Homo sapiens
tcatttataaggatgcaattaa

SEQ ID NO: 7132677 - DNA, 22 bp, Homo sapiens
tcatttataaggatgcaattaa

SEQ ID NO: 7132678 - DNA, 22 bp, Homo sapiens
tcatttataaggatgcaattaa

SEQ ID NO: 7132679 - DNA, 22 bp, Homo sapiens
tcatttatagaagtgggcagta

SEQ ID NO: 7132680 - DNA, 22 bp, Homo sapiens
tcatttatagaagtgggcagta

SEQ ID NO: 7132681 - DNA, 22 bp, Homo sapiens
tcatttatagctaaccttgaat

SEQ ID NO: 7132682 - DNA, 22 bp, Homo sapiens
tcatttatattgtattctgtag

SEQ ID NO: 7132683 - DNA, 22 bp, Homo sapiens
tcatttatattgtattctgtag

SEQ ID NO: 7132684 - DNA, 22 bp, Homo sapiens
tcatttatattgtattctgtag

SEQ ID NO: 7132685 - DNA, 22 bp, Homo sapiens
tcatttctatctatgcagcttc

SEQ ID NO: 7132686 - DNA, 22 bp, Homo sapiens
tcatttctatctatgcagcttc

SEQ ID NO: 7132687 - DNA, 22 bp, Homo sapiens
tcatttcctcaaattcaaggtt

SEQ ID NO: 7132688 - DNA, 17 bp, Homo sapiens
tcatttctaggcactcc

SEQ ID NO: 7132689 - DNA, 17 bp, Homo sapiens
tcatttctaggcactcc

SEQ ID NO: 7132690 - DNA, 22 bp, Homo sapiens
tcatttcatgtctcaggcactg

SEQ ID NO: 7132691 - DNA, 22 bp, Homo sapiens
tcatttccctcctacaaagagg

SEQ ID NO: 7132692 - DNA, 23 bp, Homo sapiens
tcatttcaggttgcatggtacca

SEQ ID NO: 7132693 - DNA, 17 bp, Homo sapiens
tcatttcagtaaatcca

SEQ ID NO: 7132694 - DNA, 22 bp, Homo sapiens
tcatttcagtcctctgtgtgag

SEQ ID NO: 7132695 - DNA, 22 bp, Homo sapiens
tcatttcagtcctctgtgtgag

SEQ ID NO: 7132696 - DNA, 22 bp, Homo sapiens
tcatttcagtggcacagaagat

SEQ ID NO: 7132697 - DNA, 22 bp, Homo sapiens
tcatttcagtggcacagaagat

SEQ ID NO: 7132698 - DNA, 23 bp, Homo sapiens
tcatttcatccagccttgagagt

SEQ ID NO: 7132699 - DNA, 23 bp, Homo sapiens
tcatttcatccagccttgagagt

SEQ ID NO: 7132700 - DNA, 22 bp, Homo sapiens
tcatttcagccatttttaaatg

SEQ ID NO: 7132701 - DNA, 23 bp, Homo sapiens
tcatttcaggttgcatggtacca

SEQ ID NO: 7132702 - DNA, 23 bp, Homo sapiens
tcatttcaggttgcatggtacca

SEQ ID NO: 7132703 - DNA, 22 bp, Homo sapiens
tcatttcacttctctagggaga

SEQ ID NO: 7132704 - DNA, 22 bp, Homo sapiens
tcatttcagatgcatttagaat

SEQ ID NO: 7132705 - DNA, 22 bp, Homo sapiens
tcatttcagatgcatttagaat

SEQ ID NO: 7132706 - DNA, 22 bp, Homo sapiens
tcatttcagatgcatttagaat

SEQ ID NO: 7132707 - DNA, 22 bp, Homo sapiens
tcatttatattgtattctgtag

SEQ ID NO: 7132708 - DNA, 22 bp, Homo sapiens
tcatttatcatttgtgctgtag

SEQ ID NO: 7132709 - DNA, 22 bp, Homo sapiens
tcatttatcatttgtgctgtag

SEQ ID NO: 7132710 - DNA, 22 bp, Homo sapiens
tcatttcaatgatactactaag

SEQ ID NO: 7132711 - DNA, 22 bp, Homo sapiens
tcatttcaatgatactactaag

SEQ ID NO: 7132712 - DNA, 23 bp, Homo sapiens
tcatttcacagtgagcttcctag

SEQ ID NO: 7132713 - DNA, 22 bp, Homo sapiens
tcatttcacttctctagggaga

SEQ ID NO: 7132714 - DNA, 20 bp, Homo sapiens
tcatttcttggggttccaag

SEQ ID NO: 7132715 - DNA, 20 bp, Homo sapiens
tcatttcttggggttccaag

SEQ ID NO: 7132716 - DNA, 22 bp, Homo sapiens
tcatttcttaactagagtgaac

SEQ ID NO: 7132717 - DNA, 22 bp, Homo sapiens
tcatttcttaactagagtgaac

SEQ ID NO: 7132718 - DNA, 22 bp, Homo sapiens
tcatttctgagccttccatgat

SEQ ID NO: 7132719 - DNA, 22 bp, Homo sapiens
tcatttctctgagtctgataat

SEQ ID NO: 7132720 - DNA, 22 bp, Homo sapiens
tcatttctgttgtgcatcactg

SEQ ID NO: 7132721 - DNA, 22 bp, Homo sapiens
tcatttctgttgtgcatcactg

SEQ ID NO: 7132722 - DNA, 22 bp, Homo sapiens
tcatttctccgacctgctgtcc

SEQ ID NO: 7132723 - DNA, 22 bp, Homo sapiens
tcatttctccgacctgctgtcc

SEQ ID NO: 7132724 - DNA, 22 bp, Homo sapiens
tcatttctattgctactgtctg

SEQ ID NO: 7132725 - DNA, 22 bp, Homo sapiens
tcatttctcctaagtgaaatat

SEQ ID NO: 7132726 - DNA, 22 bp, Homo sapiens
tcatttctcctaagtgaaatat

SEQ ID NO: 7132727 - DNA, 22 bp, Homo sapiens
tcatttctcctaagtgaaatat

SEQ ID NO: 7132728 - DNA, 22 bp, Homo sapiens
tcatttctcctaagtgaaatat

SEQ ID NO: 7132729 - DNA, 21 bp, Homo sapiens
tcatttctctatgtatttcac

SEQ ID NO: 7132730 - DNA, 21 bp, Homo sapiens
tcatttctctatgtatttcac

SEQ ID NO: 7132731 - DNA, 22 bp, Homo sapiens
tcatttctctgagtctgataat

SEQ ID NO: 7132732 - DNA, 22 bp, Homo sapiens
tcatttctctgagtctgataat

SEQ ID NO: 7132733 - DNA, 22 bp, Homo sapiens
tcatttctctgagtctgataat

SEQ ID NO: 7132734 - DNA, 22 bp, Homo sapiens
tcaggctttgggtcaggctctg

SEQ ID NO: 7132735 - DNA, 21 bp, Homo sapiens
tcagggcagctgctcttcaga

SEQ ID NO: 7132736 - DNA, 22 bp, Homo sapiens
tcagggcaggcgagcagctgct

SEQ ID NO: 7132737 - DNA, 22 bp, Homo sapiens
tcagggcaggacagtgtaggcc

SEQ ID NO: 7132738 - DNA, 22 bp, Homo sapiens
tcagggcaggacagtgtaggcc

SEQ ID NO: 7132739 - DNA, 22 bp, Homo sapiens
tcagggcaggttaacttgggtg

SEQ ID NO: 7132740 - DNA, 22 bp, Homo sapiens
tcagggcaggttaacttgggtg

SEQ ID NO: 7132741 - DNA, 22 bp, Homo sapiens
tcagggcaggcgagcagctgct

SEQ ID NO: 7132742 - DNA, 22 bp, Homo sapiens
tcagggcaggcgagcagctgct

SEQ ID NO: 7132743 - DNA, 22 bp, Homo sapiens
tcagggcaggcgagcagctgct

SEQ ID NO: 7132744 - DNA, 19 bp, Homo sapiens
tcagggcagtccggtcccc

SEQ ID NO: 7132745 - DNA, 21 bp, Homo sapiens
tcagggcagtgggaggttcct

SEQ ID NO: 7132746 - DNA, 19 bp, Homo sapiens
tcagggcagtccggtcccc

SEQ ID NO: 7132747 - DNA, 21 bp, Homo sapiens
tcagggcagtgggaggttcct

SEQ ID NO: 7132748 - DNA, 22 bp, Homo sapiens
tcaggctttccgaagcgcgcgg

SEQ ID NO: 7132749 - DNA, 18 bp, Homo sapiens
tcaggctttgagagaatc

SEQ ID NO: 7132750 - DNA, 22 bp, Homo sapiens
tcaggcttgggaggcccagggc

SEQ ID NO: 7132751 - DNA, 22 bp, Homo sapiens
tcaggcttcttctgagcaggga

SEQ ID NO: 7132752 - DNA, 22 bp, Homo sapiens
tcaggcttgcgatggaagtcac

SEQ ID NO: 7132753 - DNA, 22 bp, Homo sapiens
tcaggcttcttctgagcaggga

SEQ ID NO: 7132754 - DNA, 22 bp, Homo sapiens
tcaggctgttcctgtccaaaat

SEQ ID NO: 7132755 - DNA, 22 bp, Homo sapiens
tcaggctgttcctgtccaaaat

SEQ ID NO: 7132756 - DNA, 22 bp, Homo sapiens
tcaggctgtatatcttgcactc

SEQ ID NO: 7132757 - DNA, 22 bp, Homo sapiens
tcaggctgttagccacctcctc

SEQ ID NO: 7132758 - DNA, 22 bp, Homo sapiens
tcaggctgtatatcttgcactc

SEQ ID NO: 7132759 - DNA, 22 bp, Homo sapiens
tcaggctgtatatcttgcactc

SEQ ID NO: 7132760 - DNA, 22 bp, Homo sapiens
tcaggctgtagggcccctggag

SEQ ID NO: 7132761 - DNA, 22 bp, Homo sapiens
tcaggctgtagggcccctggag

SEQ ID NO: 7132762 - DNA, 22 bp, Homo sapiens
tcaggctgtagggcccctggag

SEQ ID NO: 7132763 - DNA, 22 bp, Homo sapiens
tcaggctgtagggcccctggag

SEQ ID NO: 7132764 - DNA, 22 bp, Homo sapiens
tcaggctgtaaatggtgtgggt

SEQ ID NO: 7132765 - DNA, 22 bp, Homo sapiens
tcaggctgtaaatggtgtgggt

SEQ ID NO: 7132766 - DNA, 22 bp, Homo sapiens
tcaggctgtaaatggtgtgggt

SEQ ID NO: 7132767 - DNA, 22 bp, Homo sapiens
tcaggctggtggtcagatggct

SEQ ID NO: 7132768 - DNA, 22 bp, Homo sapiens
tcaggctggtggtcagatggct

SEQ ID NO: 7132769 - DNA, 22 bp, Homo sapiens
tcaggctggtggtcagatggct

SEQ ID NO: 7132770 - DNA, 22 bp, Homo sapiens
tcaggctggtggtcagatggct

SEQ ID NO: 7132771 - DNA, 22 bp, Homo sapiens
tcaggctggtggtcagatggct

SEQ ID NO: 7132772 - DNA, 22 bp, Homo sapiens
tcaggctggtccccacagtgga

SEQ ID NO: 7132773 - DNA, 20 bp, Homo sapiens
tcaggctggtgggctttccc

SEQ ID NO: 7132774 - DNA, 20 bp, Homo sapiens
tcaggctggtgggctttccc

SEQ ID NO: 7132775 - DNA, 22 bp, Homo sapiens
tcaggctggtccccacagtgga

SEQ ID NO: 7132776 - DNA, 22 bp, Homo sapiens
tcaggctggtccccacagtgga

SEQ ID NO: 7132777 - DNA, 22 bp, Homo sapiens
tcaggctggtccccacagtgga

SEQ ID NO: 7132778 - DNA, 22 bp, Homo sapiens
tcaggctggtccccacagtgga

SEQ ID NO: 7132779 - DNA, 22 bp, Homo sapiens
tcaggctggtccccacagtgga

SEQ ID NO: 7132780 - DNA, 22 bp, Homo sapiens
tcaggctggtccccacagtgga

SEQ ID NO: 7132781 - DNA, 22 bp, Homo sapiens
tcaggagagaaagaatacaatt

SEQ ID NO: 7132782 - DNA, 22 bp, Homo sapiens
tcaggagacttatgtcacagtg

SEQ ID NO: 7132783 - DNA, 22 bp, Homo sapiens
tcaggagacttatgtcacagtg

SEQ ID NO: 7132784 - DNA, 22 bp, Homo sapiens
tcaggagagagaaattggggct

SEQ ID NO: 7132785 - DNA, 22 bp, Homo sapiens
tcaggagagagaaattggggct

SEQ ID NO: 7132786 - DNA, 22 bp, Homo sapiens
tcaggagagagaaattggggct

SEQ ID NO: 7132787 - DNA, 22 bp, Homo sapiens
tcaggagagagttgggtaggct

SEQ ID NO: 7132788 - DNA, 22 bp, Homo sapiens
tcaggagagagttgggtaggct

SEQ ID NO: 7132789 - DNA, 22 bp, Homo sapiens
tcaggagagagttgggtaggct

SEQ ID NO: 7132790 - DNA, 17 bp, Homo sapiens
tcaggctgggtgcagtg

SEQ ID NO: 7132791 - DNA, 17 bp, Homo sapiens
tcaggctgggtgcagtg

SEQ ID NO: 7132792 - DNA, 17 bp, Homo sapiens
tcaggctgggtgcagtg

SEQ ID NO: 7132793 - DNA, 17 bp, Homo sapiens
tcaggctgggtgcagtg

SEQ ID NO: 7132794 - DNA, 21 bp, Homo sapiens
tcaggagagcccatctacaaa

SEQ ID NO: 7132795 - DNA, 21 bp, Homo sapiens
tcaggagagcccatctacaaa

SEQ ID NO: 7132796 - DNA, 17 bp, Homo sapiens
tcaggctgggtgcagtg

SEQ ID NO: 7132797 - DNA, 17 bp, Homo sapiens
tcaggctgggtgcagtg

SEQ ID NO: 7132798 - DNA, 22 bp, Homo sapiens
tcagtagtcttgggccgacttg

SEQ ID NO: 7132799 - DNA, 23 bp, Homo sapiens
tcagtagtgcaactttaaggcag

SEQ ID NO: 7132800 - DNA, 23 bp, Homo sapiens
tcagtagtgcattgaataagtgc

SEQ ID NO: 7132801 - DNA, 22 bp, Homo sapiens
tcagtagtggctgtagccaaat

SEQ ID NO: 7132802 - DNA, 22 bp, Homo sapiens
tcagtagtggcttagaagaagg

SEQ ID NO: 7132803 - DNA, 22 bp, Homo sapiens
tcagtagtgtgccagtgggcat

SEQ ID NO: 7132804 - DNA, 22 bp, Homo sapiens
tcagtagtgttagcaatgttaa

SEQ ID NO: 7132805 - DNA, 22 bp, Homo sapiens
tcagtagtgttagcaatgttaa

SEQ ID NO: 7132806 - DNA, 22 bp, Homo sapiens
tcagtagttcagcaaatatttt

SEQ ID NO: 7132807 - DNA, 21 bp, Homo sapiens
tcagtagttcggttttctcac

SEQ ID NO: 7132808 - DNA, 22 bp, Homo sapiens
tcagtagttttaagtctgttaa

SEQ ID NO: 7132809 - DNA, 22 bp, Homo sapiens
tcagtatcaatagcgtcacaat

SEQ ID NO: 7132810 - DNA, 22 bp, Homo sapiens
tcagtatcatgcggtagccatg

SEQ ID NO: 7132811 - DNA, 22 bp, Homo sapiens
tcagtatccacaaatgctcaaa

SEQ ID NO: 7132812 - DNA, 22 bp, Homo sapiens
tcagtatagcttctaaactaac

SEQ ID NO: 7132813 - DNA, 22 bp, Homo sapiens
tcagtatagcttctaaactaac

SEQ ID NO: 7132814 - DNA, 22 bp, Homo sapiens
tcagtagtttctgctttgtgtt

SEQ ID NO: 7132815 - DNA, 22 bp, Homo sapiens
tcagtagttttgatctgagcag

SEQ ID NO: 7132816 - DNA, 22 bp, Homo sapiens
tcagtagcagaaagcaatgagt

SEQ ID NO: 7132817 - DNA, 22 bp, Homo sapiens
tcagtagcccttgagttcatgt

SEQ ID NO: 7132818 - DNA, 22 bp, Homo sapiens
tcagtagtaaatggatttggaa

SEQ ID NO: 7132819 - DNA, 22 bp, Homo sapiens
tcagtagtatggctttgttgat

SEQ ID NO: 7132820 - DNA, 23 bp, Homo sapiens
tcagtagtcattgggaaagtgtg

SEQ ID NO: 7132821 - DNA, 22 bp, Homo sapiens
tcagtagtctaggatttcacct

SEQ ID NO: 7132822 - DNA, 22 bp, Homo sapiens
tcagtaattacctatgactcga

SEQ ID NO: 7132823 - DNA, 22 bp, Homo sapiens
tcagtaatattctttaaaatac

SEQ ID NO: 7132824 - DNA, 22 bp, Homo sapiens
tcagtacaaaggtgctctcaag

SEQ ID NO: 7132825 - DNA, 22 bp, Homo sapiens
tcagtacacttcagtatttgtg

SEQ ID NO: 7132826 - DNA, 22 bp, Homo sapiens
tcagtacacttcagtatttgtg

SEQ ID NO: 7132827 - DNA, 22 bp, Homo sapiens
tcagtacagcttagtcttctca

SEQ ID NO: 7132828 - DNA, 22 bp, Homo sapiens
tcagtaaatctctaattggcat

SEQ ID NO: 7132829 - DNA, 22 bp, Homo sapiens
tcagtaaataactcagatgctc

SEQ ID NO: 7132830 - DNA, 22 bp, Homo sapiens
tcagtaaaggctaggttatgct

SEQ ID NO: 7132831 - DNA, 22 bp, Homo sapiens
tcagtaaaggggaggtgatggg

SEQ ID NO: 7132832 - DNA, 22 bp, Homo sapiens
tcagtaaagtctctagagggta

SEQ ID NO: 7132833 - DNA, 22 bp, Homo sapiens
tcagtaaagttctttcttgctg

SEQ ID NO: 7132834 - DNA, 22 bp, Homo sapiens
tcagtaaaataaaacatgggac

SEQ ID NO: 7132835 - DNA, 22 bp, Homo sapiens
tcagtaaaattacagatctaca

SEQ ID NO: 7132836 - DNA, 22 bp, Homo sapiens
tcagtaaaattacagatctaca

SEQ ID NO: 7132837 - DNA, 22 bp, Homo sapiens
tcagtaaacaggtttaagtcct

SEQ ID NO: 7132838 - DNA, 22 bp, Homo sapiens
tcagtaaacaggtttaagtcct

SEQ ID NO: 7132839 - DNA, 21 bp, Homo sapiens
tcagtaaacctaaagattgta

SEQ ID NO: 7132840 - DNA, 22 bp, Homo sapiens
tcagtaaatgaatgaatatatg

SEQ ID NO: 7132841 - DNA, 22 bp, Homo sapiens
tcagtaaatgaatgaatatatg

SEQ ID NO: 7132842 - DNA, 22 bp, Homo sapiens
tcagtaaatgagcaaaaatttc

SEQ ID NO: 7132843 - DNA, 22 bp, Homo sapiens
tcagtaaatgagcaaaaatttc

SEQ ID NO: 7132844 - DNA, 22 bp, Homo sapiens
tcagtaaatgagcaaaaatttc

SEQ ID NO: 7132845 - DNA, 22 bp, Homo sapiens
tcagtaaatgcctttctgtgaa

SEQ ID NO: 7132846 - DNA, 22 bp, Homo sapiens
tcagtaaatgcttgcaggccga

SEQ ID NO: 7132847 - DNA, 23 bp, Homo sapiens
tcagtaaatggtaaagtctcttc

SEQ ID NO: 7132848 - DNA, 22 bp, Homo sapiens
tcagtaaatggttgctgttatt

SEQ ID NO: 7132849 - DNA, 22 bp, Homo sapiens
tcagtaaccctgctgttcagag

SEQ ID NO: 7132850 - DNA, 22 bp, Homo sapiens
tcagtaaccctgctgttcagag

SEQ ID NO: 7132851 - DNA, 22 bp, Homo sapiens
tcagtaacctttagcacagttg

SEQ ID NO: 7132852 - DNA, 22 bp, Homo sapiens
tcagtaacttacttattcacct

SEQ ID NO: 7132853 - DNA, 22 bp, Homo sapiens
tcagtaacttacttattcacct

SEQ ID NO: 7132854 - DNA, 22 bp, Homo sapiens
tcagtaacttacttattcacct

SEQ ID NO: 7132855 - DNA, 22 bp, Homo sapiens
tcagtaacttcatgaccaagca

SEQ ID NO: 7132856 - DNA, 19 bp, Homo sapiens
tcagtaacttttaagagga

SEQ ID NO: 7132857 - DNA, 22 bp, Homo sapiens
tcagggctccggaagtggcctc

SEQ ID NO: 7132858 - DNA, 22 bp, Homo sapiens
tcagggctgactgctactctcc

SEQ ID NO: 7132859 - DNA, 22 bp, Homo sapiens
tcagggctcagcatctggcatt

SEQ ID NO: 7132860 - DNA, 22 bp, Homo sapiens
tcagggctcagcatctggcatt

SEQ ID NO: 7132861 - DNA, 22 bp, Homo sapiens
tcagggcctttgcagttgtttt

SEQ ID NO: 7132862 - DNA, 22 bp, Homo sapiens
tcagggctgcagaagaggcagg

SEQ ID NO: 7132863 - DNA, 22 bp, Homo sapiens
tcagggctgcatacaggagata

SEQ ID NO: 7132864 - DNA, 22 bp, Homo sapiens
tcagggctgcagaagaggcagg

SEQ ID NO: 7132865 - DNA, 22 bp, Homo sapiens
tcagggctgcatacaggagata

SEQ ID NO: 7132866 - DNA, 21 bp, Homo sapiens
tcagtaaaaaaactacctaga

SEQ ID NO: 7132867 - DNA, 22 bp, Homo sapiens
tcagtaaaacctgcttttagtg

SEQ ID NO: 7132868 - DNA, 22 bp, Homo sapiens
tcagtaaaagggtgctttactc

SEQ ID NO: 7132869 - DNA, 22 bp, Homo sapiens
tcagggcatactcttcaaggtc

SEQ ID NO: 7132870 - DNA, 22 bp, Homo sapiens
tcagggcatactcttcaaggtc

SEQ ID NO: 7132871 - DNA, 22 bp, Homo sapiens
tcagggcatactcttcaaggtc

SEQ ID NO: 7132872 - DNA, 22 bp, Homo sapiens
tcagggcatactcttcaaggtc

SEQ ID NO: 7132873 - DNA, 22 bp, Homo sapiens
tcagggcatcatcatgaatata

SEQ ID NO: 7132874 - DNA, 22 bp, Homo sapiens
tcagggcatcatcatgaatata

SEQ ID NO: 7132875 - DNA, 22 bp, Homo sapiens
tcagggcatcatcatgaatata

SEQ ID NO: 7132876 - DNA, 22 bp, Homo sapiens
tcagggcatcatcatgaatata

SEQ ID NO: 7132877 - DNA, 22 bp, Homo sapiens
tcagggcatccattgcctgttg

SEQ ID NO: 7132878 - DNA, 22 bp, Homo sapiens
tcagggcatccattgcctgttg

SEQ ID NO: 7132879 - DNA, 22 bp, Homo sapiens
tcagggcatctcttaagtggtg

SEQ ID NO: 7132880 - DNA, 22 bp, Homo sapiens
tcagggcatctcttaagtggtg

SEQ ID NO: 7132881 - DNA, 22 bp, Homo sapiens
tcagggcatctcttaagtggtg

SEQ ID NO: 7132882 - DNA, 22 bp, Homo sapiens
tcagggcatggctgcacttggc

SEQ ID NO: 7132883 - DNA, 22 bp, Homo sapiens
tcagggccctggacaaccctcc

SEQ ID NO: 7132884 - DNA, 22 bp, Homo sapiens
tcagggccctggacaaccctcc

SEQ ID NO: 7132885 - DNA, 22 bp, Homo sapiens
tcagggccctggcaggaaacag

SEQ ID NO: 7132886 - DNA, 22 bp, Homo sapiens
tcagggccctggcaggaaacag

SEQ ID NO: 7132887 - DNA, 19 bp, Homo sapiens
tcagggccgcagagggtac

SEQ ID NO: 7132888 - DNA, 22 bp, Homo sapiens
tcagggccgccggggatctcgc

SEQ ID NO: 7132889 - DNA, 22 bp, Homo sapiens
tcagggccgccggggatctcgc

SEQ ID NO: 7132890 - DNA, 22 bp, Homo sapiens
tcagggccggggctgtggcgag

SEQ ID NO: 7132891 - DNA, 22 bp, Homo sapiens
tcagggccggggctgtggcgag

SEQ ID NO: 7132892 - DNA, 22 bp, Homo sapiens
tcagggcctgagcttttaatta

SEQ ID NO: 7132893 - DNA, 22 bp, Homo sapiens
tcataaattgattatgtgcttt

SEQ ID NO: 7132894 - DNA, 22 bp, Homo sapiens
tcataaattgattatgtgcttt

SEQ ID NO: 7132895 - DNA, 22 bp, Homo sapiens
tcataaatgcagtgtcataaat

SEQ ID NO: 7132896 - DNA, 22 bp, Homo sapiens
tcataaatgcagtgtcataaat

SEQ ID NO: 7132897 - DNA, 22 bp, Homo sapiens
tcataaattagctgtctttgaa

SEQ ID NO: 7132898 - DNA, 22 bp, Homo sapiens
tcataaatgcagtgtcataaat

SEQ ID NO: 7132899 - DNA, 22 bp, Homo sapiens
tcataaattgattatgtgcttt

SEQ ID NO: 7132900 - DNA, 22 bp, Homo sapiens
tcataaattgattatgtgcttt

SEQ ID NO: 7132901 - DNA, 22 bp, Homo sapiens
tcatacatctgtcctggagctc

SEQ ID NO: 7132902 - DNA, 22 bp, Homo sapiens
tcatacatcttgtatatctatc

SEQ ID NO: 7132903 - DNA, 22 bp, Homo sapiens
tcatacattcagcagatatttg

SEQ ID NO: 7132904 - DNA, 22 bp, Homo sapiens
tcatacatgttgtgttcaaatg

SEQ ID NO: 7132905 - DNA, 22 bp, Homo sapiens
tcatacatcttgtatatctatc

SEQ ID NO: 7132906 - DNA, 22 bp, Homo sapiens
tcatacatcttgtatatctatc

SEQ ID NO: 7132907 - DNA, 22 bp, Homo sapiens
tcatagaaatggaaagtatatt

SEQ ID NO: 7132908 - DNA, 22 bp, Homo sapiens
tcatagaaatatcacgtctttt

SEQ ID NO: 7132909 - DNA, 22 bp, Homo sapiens
tcatacattcagcagatatttg

SEQ ID NO: 7132910 - DNA, 22 bp, Homo sapiens
tcatacattcagcagatatttg

SEQ ID NO: 7132911 - DNA, 22 bp, Homo sapiens
tcatagaaatggaaagtatatt

SEQ ID NO: 7132912 - DNA, 22 bp, Homo sapiens
tcatagaaatgtggccagaaac

SEQ ID NO: 7132913 - DNA, 22 bp, Homo sapiens
tcatagaagcaccagaagatat

SEQ ID NO: 7132914 - DNA, 22 bp, Homo sapiens
tcatagaagcaccagaagatat

SEQ ID NO: 7132915 - DNA, 22 bp, Homo sapiens
tcatagaagcaccagaagatat

SEQ ID NO: 7132916 - DNA, 22 bp, Homo sapiens
tcatagaatgagttaatgaact

SEQ ID NO: 7132917 - DNA, 22 bp, Homo sapiens
tcatctgaaattgtatatgtag

SEQ ID NO: 7132918 - DNA, 22 bp, Homo sapiens
tcatctgaacatgcagcctgtg

SEQ ID NO: 7132919 - DNA, 22 bp, Homo sapiens
tcatctgaagattgctgttcaa

SEQ ID NO: 7132920 - DNA, 22 bp, Homo sapiens
tcatctgaagattgctgttcaa

SEQ ID NO: 7132921 - DNA, 22 bp, Homo sapiens
tcatctgaccactttatctctc

SEQ ID NO: 7132922 - DNA, 22 bp, Homo sapiens
tcatctgaccactttatctctc

SEQ ID NO: 7132923 - DNA, 22 bp, Homo sapiens
tcatagaaggaactgggagata

SEQ ID NO: 7132924 - DNA, 22 bp, Homo sapiens
tcatagaagtagtatccacatt

SEQ ID NO: 7132925 - DNA, 18 bp, Homo sapiens
tcatagaagtgaatcaga

SEQ ID NO: 7132926 - DNA, 22 bp, Homo sapiens
tcatagaatgagttaatgaact

SEQ ID NO: 7132927 - DNA, 22 bp, Homo sapiens
tcatctgtctgagagacttctg

SEQ ID NO: 7132928 - DNA, 22 bp, Homo sapiens
tcatctgtctgttcaacagcct

SEQ ID NO: 7132929 - DNA, 22 bp, Homo sapiens
tcatctgtcatccacaaagctg

SEQ ID NO: 7132930 - DNA, 22 bp, Homo sapiens
tcatctgaccccatctattctc

SEQ ID NO: 7132931 - DNA, 22 bp, Homo sapiens
tcatctgaccccatctattctc

SEQ ID NO: 7132932 - DNA, 22 bp, Homo sapiens
tcatctgaggcaccagagcata

SEQ ID NO: 7132933 - DNA, 22 bp, Homo sapiens
tcatctgaggtttgaggcagtt

SEQ ID NO: 7132934 - DNA, 22 bp, Homo sapiens
tcatctgaggtttgaggcagtt

SEQ ID NO: 7132935 - DNA, 20 bp, Homo sapiens
tcatctgattaacctcgaag

SEQ ID NO: 7132936 - DNA, 20 bp, Homo sapiens
tcatctgattaacctcgaag

SEQ ID NO: 7132937 - DNA, 22 bp, Homo sapiens
tcatctgttgattttaagtctt

SEQ ID NO: 7132938 - DNA, 23 bp, Homo sapiens
tcatcttcctcatttctccaggg

SEQ ID NO: 7132939 - DNA, 22 bp, Homo sapiens
tcatctgtgcaggactcagaag

SEQ ID NO: 7132940 - DNA, 22 bp, Homo sapiens
tcatctgttcatacacatgcgt

SEQ ID NO: 7132941 - DNA, 22 bp, Homo sapiens
tcatctgttcatacacatgcgt

SEQ ID NO: 7132942 - DNA, 22 bp, Homo sapiens
tcatctgttcatacacatgcgt

SEQ ID NO: 7132943 - DNA, 22 bp, Homo sapiens
tcatctttaccccttgcttcaa

SEQ ID NO: 7132944 - DNA, 22 bp, Homo sapiens
tcatctttaccccttgcttcaa

SEQ ID NO: 7132945 - DNA, 22 bp, Homo sapiens
tcatctttcctcaaaagatcca

SEQ ID NO: 7132946 - DNA, 22 bp, Homo sapiens
tcatgaaaatagatcagaaatt

SEQ ID NO: 7132947 - DNA, 22 bp, Homo sapiens
tcatgaaaaattttccatgtca

SEQ ID NO: 7132948 - DNA, 22 bp, Homo sapiens
tcatgaaaatagatcagaaatt

SEQ ID NO: 7132949 - DNA, 22 bp, Homo sapiens
tcatgaaaatagatcagaaatt

SEQ ID NO: 7132950 - DNA, 22 bp, Homo sapiens
tcatgaaaatagatcagaaatt

SEQ ID NO: 7132951 - DNA, 19 bp, Homo sapiens
tcatgcactttgatgtaac

SEQ ID NO: 7132952 - DNA, 22 bp, Homo sapiens
tcataaatcatactccatttgc

SEQ ID NO: 7132953 - DNA, 22 bp, Homo sapiens
tcataaatcatactccatttgc

SEQ ID NO: 7132954 - DNA, 22 bp, Homo sapiens
tcataaatcatactccatttgc

SEQ ID NO: 7132955 - DNA, 22 bp, Homo sapiens
tcataaatcatactccatttgc

SEQ ID NO: 7132956 - DNA, 23 bp, Homo sapiens
tcataaatattagcacagtagga

SEQ ID NO: 7132957 - DNA, 23 bp, Homo sapiens
tcataaatattagcacagtagga

SEQ ID NO: 7132958 - DNA, 23 bp, Homo sapiens
tcataaatattagcacagtagga

SEQ ID NO: 7132959 - DNA, 23 bp, Homo sapiens
tcataaatattagcacagtagga

SEQ ID NO: 7132960 - DNA, 22 bp, Homo sapiens
tcataaatagttgtgcctgaat

SEQ ID NO: 7132961 - DNA, 22 bp, Homo sapiens
tcagttaatggtaagggtgaaa

SEQ ID NO: 7132962 - DNA, 22 bp, Homo sapiens
tcataaagcttgcctgcagtgt

SEQ ID NO: 7132963 - DNA, 22 bp, Homo sapiens
tcataaagtgaaggatgatggg

SEQ ID NO: 7132964 - DNA, 22 bp, Homo sapiens
tcataaagttacccaaatttta

SEQ ID NO: 7132965 - DNA, 22 bp, Homo sapiens
tcagttaacaactatttattga

SEQ ID NO: 7132966 - DNA, 22 bp, Homo sapiens
tcagttaacggaaaggggtgtg

SEQ ID NO: 7132967 - DNA, 22 bp, Homo sapiens
tcagttaacggaaaggggtgtg

SEQ ID NO: 7132968 - DNA, 23 bp, Homo sapiens
tcagttaactgtgttacctgtgc

SEQ ID NO: 7132969 - DNA, 22 bp, Homo sapiens
tcagttaagactgcactggact

SEQ ID NO: 7132970 - DNA, 22 bp, Homo sapiens
tcagttaacaactatttattga

SEQ ID NO: 7132971 - DNA, 22 bp, Homo sapiens
tcagttaagaggccacggcagt

SEQ ID NO: 7132972 - DNA, 22 bp, Homo sapiens
tcagttaagcactataccctaa

SEQ ID NO: 7132973 - DNA, 20 bp, Homo sapiens
tcagttaagttgctgaatct

SEQ ID NO: 7132974 - DNA, 22 bp, Homo sapiens
tcagttaatatgggtaaagcat

SEQ ID NO: 7132975 - DNA, 22 bp, Homo sapiens
tcagttaatcaatgtggtctaa

SEQ ID NO: 7132976 - DNA, 22 bp, Homo sapiens
tcagttaatcaatgtggtctaa

SEQ ID NO: 7132977 - DNA, 22 bp, Homo sapiens
tcagttaatggattctgtcaga

SEQ ID NO: 7132978 - DNA, 22 bp, Homo sapiens
tcagtgtttcagtttggaaatg

SEQ ID NO: 7132979 - DNA, 22 bp, Homo sapiens
tcagtctccatctgcttgtctt

SEQ ID NO: 7132980 - DNA, 22 bp, Homo sapiens
tcagtctcctttcctctagaca

SEQ ID NO: 7132981 - DNA, 22 bp, Homo sapiens
tcagtctcctttcctctagaca

SEQ ID NO: 7132982 - DNA, 22 bp, Homo sapiens
tcagtgtttacatgcatccttg

SEQ ID NO: 7132983 - DNA, 22 bp, Homo sapiens
tcagtatgatgagagggaaatt

SEQ ID NO: 7132984 - DNA, 22 bp, Homo sapiens
tcagtattgctagagttcactg

SEQ ID NO: 7132985 - DNA, 22 bp, Homo sapiens
tcagtcctacacgctcagggac

SEQ ID NO: 7132986 - DNA, 22 bp, Homo sapiens
tcagtcctacacgctcagggac

SEQ ID NO: 7132987 - DNA, 22 bp, Homo sapiens
tcagtcctatccaaactatata

SEQ ID NO: 7132988 - DNA, 22 bp, Homo sapiens
tcagtcctccacacaggcaccc

SEQ ID NO: 7132989 - DNA, 22 bp, Homo sapiens
tcagtcctccacacaggcaccc

SEQ ID NO: 7132990 - DNA, 22 bp, Homo sapiens
tcagtcctgatgacaggcccaa

SEQ ID NO: 7132991 - DNA, 22 bp, Homo sapiens
tcagtcctgatgacaggcccaa

SEQ ID NO: 7132992 - DNA, 22 bp, Homo sapiens
tcagtcctgggccggcatcctc

SEQ ID NO: 7132993 - DNA, 22 bp, Homo sapiens
tcagtcctgggccggcatcctc

SEQ ID NO: 7132994 - DNA, 23 bp, Homo sapiens
tcagtcctgtaggggctccaggt

SEQ ID NO: 7132995 - DNA, 23 bp, Homo sapiens
tcagtcctgtaggggctccaggt

SEQ ID NO: 7132996 - DNA, 22 bp, Homo sapiens
tcagtccttggcatttaggagc

SEQ ID NO: 7132997 - DNA, 22 bp, Homo sapiens
tcagtccttggcatttaggagc

SEQ ID NO: 7132998 - DNA, 22 bp, Homo sapiens
tcaacagattgtattaaggtta

SEQ ID NO: 7132999 - DNA, 23 bp, Homo sapiens
tcaacagagcagagggaggcttt

SEQ ID NO: 7133000 - DNA, 22 bp, Homo sapiens
tcaacagacatttttaagcact

SEQ ID NO: 7133001 - DNA, 22 bp, Homo sapiens
tcaacagaagtgatagctatta

SEQ ID NO: 7133002 - DNA, 22 bp, Homo sapiens
tcaacactatccaggcaatctt

SEQ ID NO: 7133003 - DNA, 22 bp, Homo sapiens
tcaacactctttggcacagtta

SEQ ID NO: 7133004 - DNA, 22 bp, Homo sapiens
tcaacactctttggcacagtta

SEQ ID NO: 7133005 - DNA, 22 bp, Homo sapiens
tcaacactggctacagttatgc

SEQ ID NO: 7133006 - DNA, 22 bp, Homo sapiens
tcaacacttgctggtttcctct

SEQ ID NO: 7133007 - DNA, 22 bp, Homo sapiens
tcaacacttttgtctttgtccc

SEQ ID NO: 7133008 - DNA, 22 bp, Homo sapiens
tcaacacttttgtctttgtccc

SEQ ID NO: 7133009 - DNA, 22 bp, Homo sapiens
tcaaccacagtcccatgtctcc

SEQ ID NO: 7133010 - DNA, 22 bp, Homo sapiens
tcaaccaggaaactattttgct

SEQ ID NO: 7133011 - DNA, 22 bp, Homo sapiens
tcaacatataggcaacctgtaa

SEQ ID NO: 7133012 - DNA, 22 bp, Homo sapiens
tcaacatatcatatctatcggt

SEQ ID NO: 7133013 - DNA, 22 bp, Homo sapiens
tcaacattcatatatagccaca

SEQ ID NO: 7133014 - DNA, 22 bp, Homo sapiens
tcaacagctagaaatatagaga

SEQ ID NO: 7133015 - DNA, 22 bp, Homo sapiens
tcaacagtggcaaagaggcacg

SEQ ID NO: 7133016 - DNA, 22 bp, Homo sapiens
tcaacatacatacatggtcagg

SEQ ID NO: 7133017 - DNA, 22 bp, Homo sapiens
tcaacatacatacatggtcagg

SEQ ID NO: 7133018 - DNA, 22 bp, Homo sapiens
tcaaatgaggctgatgaatgtg

SEQ ID NO: 7133019 - DNA, 22 bp, Homo sapiens
tcaaatgagtgactcacacagg

SEQ ID NO: 7133020 - DNA, 22 bp, Homo sapiens
tcaaatgagtgactcacacagg

SEQ ID NO: 7133021 - DNA, 22 bp, Homo sapiens
tcaaatgagtgactcacacagg

SEQ ID NO: 7133022 - DNA, 22 bp, Homo sapiens
tcaaatgagtgactcacacagg

SEQ ID NO: 7133023 - DNA, 22 bp, Homo sapiens
tcaaatgcacctctcatttgtt

SEQ ID NO: 7133024 - DNA, 22 bp, Homo sapiens
tcaaatgcacgtagagaaaata

SEQ ID NO: 7133025 - DNA, 22 bp, Homo sapiens
tcaacaagcattggtggtaaaa

SEQ ID NO: 7133026 - DNA, 22 bp, Homo sapiens
tcaacaataggatatagcaggt

SEQ ID NO: 7133027 - DNA, 22 bp, Homo sapiens
tcaacaataggatatagcaggt

SEQ ID NO: 7133028 - DNA, 22 bp, Homo sapiens
tcaacaattttgagatgagaca

SEQ ID NO: 7133029 - DNA, 22 bp, Homo sapiens
tcaacacaacagagaaatgctg

SEQ ID NO: 7133030 - DNA, 22 bp, Homo sapiens
tcaacactatccaggcaatctt

SEQ ID NO: 7133031 - DNA, 22 bp, Homo sapiens
tcaagaagataatgtctagggt

SEQ ID NO: 7133032 - DNA, 22 bp, Homo sapiens
tcaagaactgtgaagagtctga

SEQ ID NO: 7133033 - DNA, 22 bp, Homo sapiens
tcaagaacttaggagcaagcca

SEQ ID NO: 7133034 - DNA, 22 bp, Homo sapiens
tcaagaaggagactccactgtg

SEQ ID NO: 7133035 - DNA, 22 bp, Homo sapiens
tcacagtatcacacaaggatta

SEQ ID NO: 7133036 - DNA, 22 bp, Homo sapiens
tcacagtatcacacaaggatta

SEQ ID NO: 7133037 - DNA, 22 bp, Homo sapiens
tcaagaactggaaattgatatg

SEQ ID NO: 7133038 - DNA, 22 bp, Homo sapiens
tcacagtatcaggtggagtgga

SEQ ID NO: 7133039 - DNA, 22 bp, Homo sapiens
tcacagtatcaggtggagtgga

SEQ ID NO: 7133040 - DNA, 22 bp, Homo sapiens
tcacagtatctagaaatgaggg

SEQ ID NO: 7133041 - DNA, 22 bp, Homo sapiens
tcacagtatctagaaatgaggg

SEQ ID NO: 7133042 - DNA, 22 bp, Homo sapiens
tcacagtattgggggtggagga

SEQ ID NO: 7133043 - DNA, 23 bp, Homo sapiens
tcacagtatctctggagccatag

SEQ ID NO: 7133044 - DNA, 23 bp, Homo sapiens
tcacagtatctctggagccatag

SEQ ID NO: 7133045 - DNA, 22 bp, Homo sapiens
tcacagtattcatgaacatgga

SEQ ID NO: 7133046 - DNA, 22 bp, Homo sapiens
tcacagtcggtgacttcttgct

SEQ ID NO: 7133047 - DNA, 22 bp, Homo sapiens
tcacagtcggtgacttcttgct

SEQ ID NO: 7133048 - DNA, 22 bp, Homo sapiens
tcacagtgacttacagagattg

SEQ ID NO: 7133049 - DNA, 22 bp, Homo sapiens
tcacagtgacttacagagattg

SEQ ID NO: 7133050 - DNA, 22 bp, Homo sapiens
tcacagtgacttacagagattg

SEQ ID NO: 7133051 - DNA, 22 bp, Homo sapiens
tcacagtgagaaatttgttggc

SEQ ID NO: 7133052 - DNA, 22 bp, Homo sapiens
tcaagaaactgtgctacagagt

SEQ ID NO: 7133053 - DNA, 22 bp, Homo sapiens
tcaactggttcttgaatgtata

SEQ ID NO: 7133054 - DNA, 22 bp, Homo sapiens
tcaactaactctattatttgaa

SEQ ID NO: 7133055 - DNA, 22 bp, Homo sapiens
tcaactaaggcacaatctctaa

SEQ ID NO: 7133056 - DNA, 22 bp, Homo sapiens
tcaactcacaagaatgagcaag

SEQ ID NO: 7133057 - DNA, 22 bp, Homo sapiens
tcaacctctggagaaatcagga

SEQ ID NO: 7133058 - DNA, 18 bp, Homo sapiens
tcacagtgctcttgccta

SEQ ID NO: 7133059 - DNA, 22 bp, Homo sapiens
tcacagtgctctgggtggcaga

SEQ ID NO: 7133060 - DNA, 18 bp, Homo sapiens
tcacagtgctcttgccta

SEQ ID NO: 7133061 - DNA, 22 bp, Homo sapiens
tcacagtggagccaccaaggta

SEQ ID NO: 7133062 - DNA, 22 bp, Homo sapiens
tcacagtgcacccctcacaggg

SEQ ID NO: 7133063 - DNA, 22 bp, Homo sapiens
tcacagtgcacccctcacaggg

SEQ ID NO: 7133064 - DNA, 22 bp, Homo sapiens
tcacagtgcacccctcacaggg

SEQ ID NO: 7133065 - DNA, 22 bp, Homo sapiens
tcacagtgctctgggtggcaga

SEQ ID NO: 7133066 - DNA, 22 bp, Homo sapiens
tcacagtgaggagttacagttt

SEQ ID NO: 7133067 - DNA, 22 bp, Homo sapiens
tcacagtgaggagttacagttt

SEQ ID NO: 7133068 - DNA, 22 bp, Homo sapiens
tcacagtgaggcagttcttgta

SEQ ID NO: 7133069 - DNA, 22 bp, Homo sapiens
tcacagtgatgacgtgggagca

SEQ ID NO: 7133070 - DNA, 22 bp, Homo sapiens
tcacagtgatgacgtgggagca

SEQ ID NO: 7133071 - DNA, 22 bp, Homo sapiens
tcacagtgcacagcaggcgtgg

SEQ ID NO: 7133072 - DNA, 22 bp, Homo sapiens
tcacagtgcacagcaggcgtgg

SEQ ID NO: 7133073 - DNA, 22 bp, Homo sapiens
tcacagttttagctgttaaata

SEQ ID NO: 7133074 - DNA, 22 bp, Homo sapiens
tcacataaattatacaatttca

SEQ ID NO: 7133075 - DNA, 23 bp, Homo sapiens
tcacataatccttcatccacagg

SEQ ID NO: 7133076 - DNA, 23 bp, Homo sapiens
tcacataatccttcatccacagg

SEQ ID NO: 7133077 - DNA, 22 bp, Homo sapiens
tcacatacactaggatattttt

SEQ ID NO: 7133078 - DNA, 22 bp, Homo sapiens
tcacatacactaggatattttt

SEQ ID NO: 7133079 - DNA, 22 bp, Homo sapiens
tcacagttttaagtgtgatcca

SEQ ID NO: 7133080 - DNA, 22 bp, Homo sapiens
tcacagttttaagtgtgatcca

SEQ ID NO: 7133081 - DNA, 22 bp, Homo sapiens
tcacagttttagaaaatagata

SEQ ID NO: 7133082 - DNA, 22 bp, Homo sapiens
tcacagtttcttttctgataaa

SEQ ID NO: 7133083 - DNA, 22 bp, Homo sapiens
tcacagtgtcacaatgcctgga

SEQ ID NO: 7133084 - DNA, 22 bp, Homo sapiens
tcacagtgtcgtccttgggtgt

SEQ ID NO: 7133085 - DNA, 22 bp, Homo sapiens
tcacagtgtgaaggtcagtcac

SEQ ID NO: 7133086 - DNA, 22 bp, Homo sapiens
tcacagtttccataggtcagca

SEQ ID NO: 7133087 - DNA, 22 bp, Homo sapiens
tcacatgctgtgtgtggagatc

SEQ ID NO: 7133088 - DNA, 22 bp, Homo sapiens
tcacatgctgtgtgtggagatc

SEQ ID NO: 7133089 - DNA, 22 bp, Homo sapiens
tcacatgctgtgggatctgtat

SEQ ID NO: 7133090 - DNA, 22 bp, Homo sapiens
tcacatgctgtgggatctgtat

SEQ ID NO: 7133091 - DNA, 22 bp, Homo sapiens
tcacatgctgtgggatctgtat

SEQ ID NO: 7133092 - DNA, 22 bp, Homo sapiens
tcacatgctgtgggatctgtat

SEQ ID NO: 7133093 - DNA, 21 bp, Homo sapiens
tcacatgcttattcctggaat

SEQ ID NO: 7133094 - DNA, 21 bp, Homo sapiens
tcacatgcttattcctggaat

SEQ ID NO: 7133095 - DNA, 21 bp, Homo sapiens
tcacatgcttattcctggaat

SEQ ID NO: 7133096 - DNA, 22 bp, Homo sapiens
tcacatgcttgaggaaagaaaa

SEQ ID NO: 7133097 - DNA, 22 bp, Homo sapiens
tcacattgccattagttcagtt

SEQ ID NO: 7133098 - DNA, 22 bp, Homo sapiens
tcacatactgaaagtccagtga

SEQ ID NO: 7133099 - DNA, 16 bp, Homo sapiens
tcacatacttccttgc

SEQ ID NO: 7133100 - DNA, 18 bp, Homo sapiens
tcacatacttaggccctc

SEQ ID NO: 7133101 - DNA, 22 bp, Homo sapiens
tcacatgctaaaggttgtaaac

SEQ ID NO: 7133102 - DNA, 22 bp, Homo sapiens
tcacatgctactgagccagacc

SEQ ID NO: 7133103 - DNA, 22 bp, Homo sapiens
tcacatgctactgagccagacc

SEQ ID NO: 7133104 - DNA, 22 bp, Homo sapiens
tcacatgctcacctaagccaca

SEQ ID NO: 7133105 - DNA, 22 bp, Homo sapiens
tcacattgccgtctgtgcactt

SEQ ID NO: 7133106 - DNA, 22 bp, Homo sapiens
tcacattgccgtctgtgcactt

SEQ ID NO: 7133107 - DNA, 22 bp, Homo sapiens
tcacattgctcccatagtggat

SEQ ID NO: 7133108 - DNA, 22 bp, Homo sapiens
tcacattggaccttcctgacaa

SEQ ID NO: 7133109 - DNA, 22 bp, Homo sapiens
tcacattgtaggatagcagaga

SEQ ID NO: 7133110 - DNA, 22 bp, Homo sapiens
tcacattggaccttcctgacaa

SEQ ID NO: 7133111 - DNA, 22 bp, Homo sapiens
tcacattgtaggatagcagaga

SEQ ID NO: 7133112 - DNA, 22 bp, Homo sapiens
tcacattgtaggtcatttgcaa

SEQ ID NO: 7133113 - DNA, 22 bp, Homo sapiens
tcacattgttatgtaaatgttt

SEQ ID NO: 7133114 - DNA, 22 bp, Homo sapiens
tcacattgttatgtaaatgttt

SEQ ID NO: 7133115 - DNA, 22 bp, Homo sapiens
tcacattgttcttagtttacct

SEQ ID NO: 7133116 - DNA, 23 bp, Homo sapiens
tcacatttaacccctcagacctc

SEQ ID NO: 7133117 - DNA, 22 bp, Homo sapiens
tcacatttatttcaaagttact

SEQ ID NO: 7133118 - DNA, 22 bp, Homo sapiens
tcacatttatttcaaagttact

SEQ ID NO: 7133119 - DNA, 22 bp, Homo sapiens
tcacatttatttcaaagttact

SEQ ID NO: 7133120 - DNA, 22 bp, Homo sapiens
tcacatttctgattataccaaa

SEQ ID NO: 7133121 - DNA, 22 bp, Homo sapiens
tcacatttctgattataccaaa

SEQ ID NO: 7133122 - DNA, 22 bp, Homo sapiens
tcacatttctgattataccaaa

SEQ ID NO: 7133123 - DNA, 22 bp, Homo sapiens
tcacatttgataatgcccattg

SEQ ID NO: 7133124 - DNA, 22 bp, Homo sapiens
tcacatttctcagcactgatga

SEQ ID NO: 7133125 - DNA, 22 bp, Homo sapiens
tcacatttctcagcactgatga

SEQ ID NO: 7133126 - DNA, 22 bp, Homo sapiens
tcacatttctgattataccaaa

SEQ ID NO: 7133127 - DNA, 22 bp, Homo sapiens
tcacatttctgattataccaaa

SEQ ID NO: 7133128 - DNA, 22 bp, Homo sapiens
tcacatttcgcatcagtccgat

SEQ ID NO: 7133129 - DNA, 22 bp, Homo sapiens
tcacatttctcagcactgatga

SEQ ID NO: 7133130 - DNA, 22 bp, Homo sapiens
tcacatttctcagcactgatga

SEQ ID NO: 7133131 - DNA, 22 bp, Homo sapiens
tcacatttctcagcactgatga

SEQ ID NO: 7133132 - DNA, 22 bp, Homo sapiens
tcacatttctcagcactgatga

SEQ ID NO: 7133133 - DNA, 22 bp, Homo sapiens
tcacattttagtaccatgattt

SEQ ID NO: 7133134 - DNA, 22 bp, Homo sapiens
tcacattttagtaccatgattt

SEQ ID NO: 7133135 - DNA, 22 bp, Homo sapiens
tcacattttagtaccatgattt

SEQ ID NO: 7133136 - DNA, 22 bp, Homo sapiens
tcacattttatatctctggttt

SEQ ID NO: 7133137 - DNA, 22 bp, Homo sapiens
tcacatttgttcctctgcactt

SEQ ID NO: 7133138 - DNA, 22 bp, Homo sapiens
tcacatttgttcctctgcactt

SEQ ID NO: 7133139 - DNA, 22 bp, Homo sapiens
tcacatttgttcctctgcactt

SEQ ID NO: 7133140 - DNA, 22 bp, Homo sapiens
tcacatttgtgttttattagag

SEQ ID NO: 7133141 - DNA, 22 bp, Homo sapiens
tcacatttgtgttttattagag

SEQ ID NO: 7133142 - DNA, 22 bp, Homo sapiens
tcacatttgtgttttattagag

SEQ ID NO: 7133143 - DNA, 22 bp, Homo sapiens
tcacatttggagaaagcctgcc

SEQ ID NO: 7133144 - DNA, 22 bp, Homo sapiens
tcacatttgctatcccactcct

SEQ ID NO: 7133145 - DNA, 22 bp, Homo sapiens
tcacatttgataatgcccattg

SEQ ID NO: 7133146 - DNA, 22 bp, Homo sapiens
tcacatttgcaattgcattgtt

SEQ ID NO: 7133147 - DNA, 22 bp, Homo sapiens
tcacatttgcaattgcattgtt

SEQ ID NO: 7133148 - DNA, 22 bp, Homo sapiens
tcactgcaacctccacctcccg

SEQ ID NO: 7133149 - DNA, 22 bp, Homo sapiens
tcactgcaacctccacctcccg

SEQ ID NO: 7133150 - DNA, 22 bp, Homo sapiens
tcactgcaacctccacctcccg

SEQ ID NO: 7133151 - DNA, 22 bp, Homo sapiens
tcactgatttgcccttatcctg

SEQ ID NO: 7133152 - DNA, 22 bp, Homo sapiens
tcactgattatgaaaatgaagg

SEQ ID NO: 7133153 - DNA, 22 bp, Homo sapiens
tcacattttatctattttaagt

SEQ ID NO: 7133154 - DNA, 22 bp, Homo sapiens
tcacattttatctattttaagt

SEQ ID NO: 7133155 - DNA, 22 bp, Homo sapiens
tcacattttatatctctggttt

SEQ ID NO: 7133156 - DNA, 22 bp, Homo sapiens
tcacattttatatctctggttt

SEQ ID NO: 7133157 - DNA, 22 bp, Homo sapiens
tcacattttatctattttaagt

SEQ ID NO: 7133158 - DNA, 22 bp, Homo sapiens
tcacattttatctattttaagt

SEQ ID NO: 7133159 - DNA, 22 bp, Homo sapiens
tcactgcaacctccacctcccg

SEQ ID NO: 7133160 - DNA, 22 bp, Homo sapiens
tcactgcaacctccacctcccg

SEQ ID NO: 7133161 - DNA, 22 bp, Homo sapiens
tcactgcaacctccacctcccg

SEQ ID NO: 7133162 - DNA, 22 bp, Homo sapiens
tcactgcaacctccacctcccg

SEQ ID NO: 7133163 - DNA, 22 bp, Homo sapiens
tcagaaaatgaaatggactctc

SEQ ID NO: 7133164 - DNA, 22 bp, Homo sapiens
tcagaaaatgaaatggactctc

SEQ ID NO: 7133165 - DNA, 22 bp, Homo sapiens
tcactgcttaactcaagatctc

SEQ ID NO: 7133166 - DNA, 22 bp, Homo sapiens
tcactgctctgaaagtacaggg

SEQ ID NO: 7133167 - DNA, 22 bp, Homo sapiens
tcactgctctccaatgtggagt

SEQ ID NO: 7133168 - DNA, 22 bp, Homo sapiens
tcactgctcgataacatgatta

SEQ ID NO: 7133169 - DNA, 22 bp, Homo sapiens
tcactgctcgataacatgatta

SEQ ID NO: 7133170 - DNA, 22 bp, Homo sapiens
tcactgctatattggatactga

SEQ ID NO: 7133171 - DNA, 22 bp, Homo sapiens
tcactgctatattggatactga

SEQ ID NO: 7133172 - DNA, 23 bp, Homo sapiens
tcactgctactcagcctgagatt

SEQ ID NO: 7133173 - DNA, 22 bp, Homo sapiens
tcactgcaacctccacctcctg

SEQ ID NO: 7133174 - DNA, 22 bp, Homo sapiens
tcactgcaacctccacctcctg

SEQ ID NO: 7133175 - DNA, 22 bp, Homo sapiens
tcactgcaacctccacctcctg

SEQ ID NO: 7133176 - DNA, 22 bp, Homo sapiens
tcactgcaacctccacctcctg

SEQ ID NO: 7133177 - DNA, 22 bp, Homo sapiens
tcactgcaacctccacctcctg

SEQ ID NO: 7133178 - DNA, 22 bp, Homo sapiens
tcactgcaacctccacctcctg

SEQ ID NO: 7133179 - DNA, 22 bp, Homo sapiens
tcactgcaacctccacctcccg

SEQ ID NO: 7133180 - DNA, 22 bp, Homo sapiens
tcactgcaacctccacctcctg

SEQ ID NO: 7133181 - DNA, 22 bp, Homo sapiens
tcactgccattagttggttaat

SEQ ID NO: 7133182 - DNA, 22 bp, Homo sapiens
tcactgcgcttcagcctgggtg

SEQ ID NO: 7133183 - DNA, 22 bp, Homo sapiens
tcactgcgcttcagcctgggtg

SEQ ID NO: 7133184 - DNA, 23 bp, Homo sapiens
tcagaataataacctagtaactg

SEQ ID NO: 7133185 - DNA, 22 bp, Homo sapiens
tcagaatatattcatgttgtca

SEQ ID NO: 7133186 - DNA, 22 bp, Homo sapiens
tcagaatatgctaatgacattt

SEQ ID NO: 7133187 - DNA, 22 bp, Homo sapiens
tcagaagttgataaagtagttg

SEQ ID NO: 7133188 - DNA, 20 bp, Homo sapiens
tcagaagtttcctggagcat

SEQ ID NO: 7133189 - DNA, 23 bp, Homo sapiens
tcagaagtttggttgtaacatgg

SEQ ID NO: 7133190 - DNA, 22 bp, Homo sapiens
tcagaatatgctaatgacattt

SEQ ID NO: 7133191 - DNA, 22 bp, Homo sapiens
tcagaatctttctagagtctag

SEQ ID NO: 7133192 - DNA, 22 bp, Homo sapiens
tcagaatgaaatttctttcaga

SEQ ID NO: 7133193 - DNA, 20 bp, Homo sapiens
tcagaacagtagaggagcta

SEQ ID NO: 7133194 - DNA, 22 bp, Homo sapiens
tcagaagccttgattatctaga

SEQ ID NO: 7133195 - DNA, 22 bp, Homo sapiens
tcagaagttaatatataaattt

SEQ ID NO: 7133196 - DNA, 22 bp, Homo sapiens
tcagaacagcagggtgtggctg

SEQ ID NO: 7133197 - DNA, 22 bp, Homo sapiens
tcagaacagcgagaatattcac

SEQ ID NO: 7133198 - DNA, 22 bp, Homo sapiens
tcagaacagcgagaatattcac

SEQ ID NO: 7133199 - DNA, 22 bp, Homo sapiens
tcagaacagcgagaatattcac

SEQ ID NO: 7133200 - DNA, 22 bp, Homo sapiens
tcagaacagctctcagatatcc

SEQ ID NO: 7133201 - DNA, 22 bp, Homo sapiens
tcagaacaggactggctgccat

SEQ ID NO: 7133202 - DNA, 22 bp, Homo sapiens
tcagaacaggactggctgccat

SEQ ID NO: 7133203 - DNA, 22 bp, Homo sapiens
tcagaacaggttgtactatgtc

SEQ ID NO: 7133204 - DNA, 22 bp, Homo sapiens
tcagaacaggttgtactatgtc

SEQ ID NO: 7133205 - DNA, 22 bp, Homo sapiens
tcagaacaggttgtactatgtc

SEQ ID NO: 7133206 - DNA, 22 bp, Homo sapiens
tcagaacaggttgtactatgtc

SEQ ID NO: 7133207 - DNA, 22 bp, Homo sapiens
tcagaacaggttgtactatgtc

SEQ ID NO: 7133208 - DNA, 22 bp, Homo sapiens
tcagaaaggttgagtcatgtgc

SEQ ID NO: 7133209 - DNA, 22 bp, Homo sapiens
tcagaacaattcctttataaca

SEQ ID NO: 7133210 - DNA, 22 bp, Homo sapiens
tcagaaaggttctatgttttac

SEQ ID NO: 7133211 - DNA, 22 bp, Homo sapiens
tcagaaaggccacatggtgcag

SEQ ID NO: 7133212 - DNA, 22 bp, Homo sapiens
tcagaaaggccacatggtgcag

SEQ ID NO: 7133213 - DNA, 22 bp, Homo sapiens
tcagaaaggagttagaggtctc

SEQ ID NO: 7133214 - DNA, 22 bp, Homo sapiens
tcagaaaggagttagaggtctc

SEQ ID NO: 7133215 - DNA, 22 bp, Homo sapiens
tcagaaaggagttagaggtctc

SEQ ID NO: 7133216 - DNA, 22 bp, Homo sapiens
tcagaaagcttttacttaaaca

SEQ ID NO: 7133217 - DNA, 22 bp, Homo sapiens
tcagaacaattgggaaccatta

SEQ ID NO: 7133218 - DNA, 22 bp, Homo sapiens
tcagaacaattgggaaccatta

SEQ ID NO: 7133219 - DNA, 22 bp, Homo sapiens
tcagaacaattgggaaccatta

SEQ ID NO: 7133220 - DNA, 22 bp, Homo sapiens
tcagaacactttctctactgac

SEQ ID NO: 7133221 - DNA, 22 bp, Homo sapiens
tcagaacactttctctactgac

SEQ ID NO: 7133222 - DNA, 22 bp, Homo sapiens
tcagaacagaagaaggaacacg

SEQ ID NO: 7133223 - DNA, 22 bp, Homo sapiens
tcagaacagaagaaggaacacg

SEQ ID NO: 7133224 - DNA, 22 bp, Homo sapiens
tcagaacagaagaaggaacacg

SEQ ID NO: 7133225 - DNA, 22 bp, Homo sapiens
tcagaacagaagaaggaacacg

SEQ ID NO: 7133226 - DNA, 22 bp, Homo sapiens
tcagaacagaagaaggaacacg

SEQ ID NO: 7133227 - DNA, 22 bp, Homo sapiens
tcagaacagaagctggctataa

SEQ ID NO: 7133228 - DNA, 22 bp, Homo sapiens
tcagaacagaagctggctataa

SEQ ID NO: 7133229 - DNA, 22 bp, Homo sapiens
tcagaacagcacagggtgattt

SEQ ID NO: 7133230 - DNA, 22 bp, Homo sapiens
tcagaaagcttttacttaaaca

SEQ ID NO: 7133231 - DNA, 22 bp, Homo sapiens
tcagaaagcttttacttaaaca

SEQ ID NO: 7133232 - DNA, 22 bp, Homo sapiens
tcagaaagcttagtgtcttgca

SEQ ID NO: 7133233 - DNA, 22 bp, Homo sapiens
tcagaaagctgattcttgatac

SEQ ID NO: 7133234 - DNA, 22 bp, Homo sapiens
tcagaaagctatatggtgtgtc

SEQ ID NO: 7133235 - DNA, 22 bp, Homo sapiens
tcagaaagctatatggtgtgtc

SEQ ID NO: 7133236 - DNA, 22 bp, Homo sapiens
tcagaaagctatatggtgtgtc

SEQ ID NO: 7133237 - DNA, 22 bp, Homo sapiens
tcagaaagacgaaacagatggg

SEQ ID NO: 7133238 - DNA, 22 bp, Homo sapiens
tcagaaagacgaaacagatggg

SEQ ID NO: 7133239 - DNA, 22 bp, Homo sapiens
tcagaaagaacacaggcagtag

SEQ ID NO: 7133240 - DNA, 22 bp, Homo sapiens
tcagaaagacgaaacagatggg

SEQ ID NO: 7133241 - DNA, 22 bp, Homo sapiens
tcagaaagaacacaggcagtag

SEQ ID NO: 7133242 - DNA, 22 bp, Homo sapiens
tcagaaacagaaactaagaacc

SEQ ID NO: 7133243 - DNA, 22 bp, Homo sapiens
tcagaaacagaaactaagaacc

SEQ ID NO: 7133244 - DNA, 22 bp, Homo sapiens
tcagcaggcccatcctccaggc

SEQ ID NO: 7133245 - DNA, 22 bp, Homo sapiens
tcagcaggcccatcctccaggc

SEQ ID NO: 7133246 - DNA, 22 bp, Homo sapiens
tcagcaggcggttccttgtggg

SEQ ID NO: 7133247 - DNA, 22 bp, Homo sapiens
tcagcaggcggttccttgtggg

SEQ ID NO: 7133248 - DNA, 22 bp, Homo sapiens
tcagcaggcccatcctccaggc

SEQ ID NO: 7133249 - DNA, 22 bp, Homo sapiens
tcagcaggcaggaggcatgcca

SEQ ID NO: 7133250 - DNA, 22 bp, Homo sapiens
tcagcaggcagtgggtcacaat

SEQ ID NO: 7133251 - DNA, 22 bp, Homo sapiens
tcagcaggcagtgggtcacaat

SEQ ID NO: 7133252 - DNA, 22 bp, Homo sapiens
tcagcaggctctggttgaccat

SEQ ID NO: 7133253 - DNA, 22 bp, Homo sapiens
tcagcaggctgtcagcaggggc

SEQ ID NO: 7133254 - DNA, 22 bp, Homo sapiens
tcagcaggctgtcagcaggggc

SEQ ID NO: 7133255 - DNA, 22 bp, Homo sapiens
tcagcaggcggttccttgtggg

SEQ ID NO: 7133256 - DNA, 22 bp, Homo sapiens
tcagcaggcggttccttgtggg

SEQ ID NO: 7133257 - DNA, 22 bp, Homo sapiens
tcagcaggcggttccttgtggg

SEQ ID NO: 7133258 - DNA, 22 bp, Homo sapiens
tcagcaggctctggttgaccat

SEQ ID NO: 7133259 - DNA, 22 bp, Homo sapiens
tcagcaggctctggttgaccat

SEQ ID NO: 7133260 - DNA, 22 bp, Homo sapiens
tcagcaggcagaaatctgcaga

SEQ ID NO: 7133261 - DNA, 22 bp, Homo sapiens
tcagcaagaagctgtgggcttc

SEQ ID NO: 7133262 - DNA, 22 bp, Homo sapiens
tcagcaggcagaaatctgcaga

SEQ ID NO: 7133263 - DNA, 22 bp, Homo sapiens
tcagcaggcaggaggcatgcca

SEQ ID NO: 7133264 - DNA, 22 bp, Homo sapiens
tcagcaactctcattccgcttt

SEQ ID NO: 7133265 - DNA, 22 bp, Homo sapiens
tcagcaacctgcttgaggaggc

SEQ ID NO: 7133266 - DNA, 22 bp, Homo sapiens
tcagcaactatttatcaaattc

SEQ ID NO: 7133267 - DNA, 22 bp, Homo sapiens
tcagcaaaggcaattcattatt

SEQ ID NO: 7133268 - DNA, 22 bp, Homo sapiens
tcagcaaaggcaattcattatt

SEQ ID NO: 7133269 - DNA, 22 bp, Homo sapiens
tcagcaaatacttattgagcgc

SEQ ID NO: 7133270 - DNA, 22 bp, Homo sapiens
tcagcaaatacttattgagcgc

SEQ ID NO: 7133271 - DNA, 22 bp, Homo sapiens
tcagatttttgagatgtctgtt

SEQ ID NO: 7133272 - DNA, 21 bp, Homo sapiens
tcagcaaaataagcaaatgga

SEQ ID NO: 7133273 - DNA, 22 bp, Homo sapiens
tcagcaaaatgtggctagtgct

SEQ ID NO: 7133274 - DNA, 22 bp, Homo sapiens
tcagcaaacattgattggactt

SEQ ID NO: 7133275 - DNA, 17 bp, Homo sapiens
tcagcaaagacaaagga

SEQ ID NO: 7133276 - DNA, 17 bp, Homo sapiens
tcagcaaagacaaagga

SEQ ID NO: 7133277 - DNA, 17 bp, Homo sapiens
tcagcaaagacaaagga

SEQ ID NO: 7133278 - DNA, 22 bp, Homo sapiens
tcagcaaaggaccagcacaggc

SEQ ID NO: 7133279 - DNA, 22 bp, Homo sapiens
tcagcaaaggaccagcacaggc

SEQ ID NO: 7133280 - DNA, 22 bp, Homo sapiens
tcagcaaaggcaattcattatt

SEQ ID NO: 7133281 - DNA, 22 bp, Homo sapiens
tcagcaaaggcaattcattatt

SEQ ID NO: 7133282 - DNA, 17 bp, Homo sapiens
tcagcaggggccaagct

SEQ ID NO: 7133283 - DNA, 17 bp, Homo sapiens
tcagcaggggccaagct

SEQ ID NO: 7133284 - DNA, 17 bp, Homo sapiens
tcagcaggggccaagct

SEQ ID NO: 7133285 - DNA, 22 bp, Homo sapiens
tcagcaggggccgttgggtgga

SEQ ID NO: 7133286 - DNA, 22 bp, Homo sapiens
tcagcagtgtagtttatcattc

SEQ ID NO: 7133287 - DNA, 22 bp, Homo sapiens
tcagcagtgtcagttcccagag

SEQ ID NO: 7133288 - DNA, 22 bp, Homo sapiens
tcagcagggcctccttgtgcag

SEQ ID NO: 7133289 - DNA, 22 bp, Homo sapiens
tcagcagggctgggagctgtga

SEQ ID NO: 7133290 - DNA, 22 bp, Homo sapiens
tcagcagggctgggagctgtga

SEQ ID NO: 7133291 - DNA, 22 bp, Homo sapiens
tcagcagggctgggagctgtga

SEQ ID NO: 7133292 - DNA, 22 bp, Homo sapiens
tcagcagggctgtggtgtggct

SEQ ID NO: 7133293 - DNA, 22 bp, Homo sapiens
tcagcaggctgtcagcaggggc

SEQ ID NO: 7133294 - DNA, 22 bp, Homo sapiens
tcagcagggagaggagaatgca

SEQ ID NO: 7133295 - DNA, 22 bp, Homo sapiens
tcagcagggagaggagaatgca

SEQ ID NO: 7133296 - DNA, 22 bp, Homo sapiens
tcagcagggagaggagaatgca

SEQ ID NO: 7133297 - DNA, 22 bp, Homo sapiens
tcagcagggaggctctgtgccc

SEQ ID NO: 7133298 - DNA, 22 bp, Homo sapiens
tcagcagggaggctctgtgccc

SEQ ID NO: 7133299 - DNA, 22 bp, Homo sapiens
tcagcagggcatactgagccta

SEQ ID NO: 7133300 - DNA, 22 bp, Homo sapiens
tcagcagggcatactgagccta

SEQ ID NO: 7133301 - DNA, 22 bp, Homo sapiens
tcagcagggcatactgagccta

SEQ ID NO: 7133302 - DNA, 22 bp, Homo sapiens
tcagcagggcatactgagccta

SEQ ID NO: 7133303 - DNA, 22 bp, Homo sapiens
tcagcagggccatgctctctct

SEQ ID NO: 7133304 - DNA, 22 bp, Homo sapiens
tcagcagggccatgctctctct

SEQ ID NO: 7133305 - DNA, 22 bp, Homo sapiens
tcagcagggcctccttgtgcag

SEQ ID NO: 7133306 - DNA, 22 bp, Homo sapiens
tcagcagggcctccttgtgcag

SEQ ID NO: 7133307 - DNA, 22 bp, Homo sapiens
tcagcagggcctccttgtgcag

SEQ ID NO: 7133308 - DNA, 22 bp, Homo sapiens
tcagcagggcctccttgtgcag

SEQ ID NO: 7133309 - DNA, 22 bp, Homo sapiens
tcagaattctacaatagatcag

SEQ ID NO: 7133310 - DNA, 23 bp, Homo sapiens
tcagaattccagtttctttgaag

SEQ ID NO: 7133311 - DNA, 22 bp, Homo sapiens
tcagaatgtgcagaggaacagt

SEQ ID NO: 7133312 - DNA, 22 bp, Homo sapiens
tcagaattgattttcaaaacag

SEQ ID NO: 7133313 - DNA, 22 bp, Homo sapiens
tcagaattggacaatagaagca

SEQ ID NO: 7133314 - DNA, 18 bp, Homo sapiens
tcagacaagttagacagg

SEQ ID NO: 7133315 - DNA, 22 bp, Homo sapiens
tcagacacagatgagacaagga

SEQ ID NO: 7133316 - DNA, 22 bp, Homo sapiens
tcagacacagatgagacaagga

SEQ ID NO: 7133317 - DNA, 22 bp, Homo sapiens
tcagacaccgtctattttgcct

SEQ ID NO: 7133318 - DNA, 22 bp, Homo sapiens
tcagacagaaagatgagtatgg

SEQ ID NO: 7133319 - DNA, 22 bp, Homo sapiens
tcagacagaaagatgagtatgg

SEQ ID NO: 7133320 - DNA, 22 bp, Homo sapiens
tcagacacagatgagacaagga

SEQ ID NO: 7133321 - DNA, 22 bp, Homo sapiens
tcagacagaaagatgagtatgg

SEQ ID NO: 7133322 - DNA, 22 bp, Homo sapiens
tcagacagaaggactatttgaa

SEQ ID NO: 7133323 - DNA, 22 bp, Homo sapiens
tcagacagagaagtacaatgag

SEQ ID NO: 7133324 - DNA, 22 bp, Homo sapiens
tcagacagaggagctcgtgcag

SEQ ID NO: 7133325 - DNA, 22 bp, Homo sapiens
tcagacagagaagtacaatgag

SEQ ID NO: 7133326 - DNA, 22 bp, Homo sapiens
tcagacagattttgacacttgc

SEQ ID NO: 7133327 - DNA, 22 bp, Homo sapiens
tcagagtgcagggagtagcagc

SEQ ID NO: 7133328 - DNA, 21 bp, Homo sapiens
tcagagtggaagacagtttga

SEQ ID NO: 7133329 - DNA, 22 bp, Homo sapiens
tcagagtgggagaatgtgccaa

SEQ ID NO: 7133330 - DNA, 22 bp, Homo sapiens
tcagagtggtagcctattttct

SEQ ID NO: 7133331 - DNA, 22 bp, Homo sapiens
tcagagtggtggttttgccttc

SEQ ID NO: 7133332 - DNA, 22 bp, Homo sapiens
tcagagtgtgacttggtcatga

SEQ ID NO: 7133333 - DNA, 22 bp, Homo sapiens
tcagagtgtgacttggtcatga

SEQ ID NO: 7133334 - DNA, 22 bp, Homo sapiens
tcagagtgtgagacatattgga

SEQ ID NO: 7133335 - DNA, 22 bp, Homo sapiens
tcagagtgtggtgagatgtgca

SEQ ID NO: 7133336 - DNA, 18 bp, Homo sapiens
tcagatttaactgtatcc

SEQ ID NO: 7133337 - DNA, 22 bp, Homo sapiens
tcagattctggatagatcttca

SEQ ID NO: 7133338 - DNA, 20 bp, Homo sapiens
tcagattaaatgttctgtct

SEQ ID NO: 7133339 - DNA, 22 bp, Homo sapiens
tcagatttactgcagagcagat

SEQ ID NO: 7133340 - DNA, 22 bp, Homo sapiens
tcagatttactgcagagcagat

SEQ ID NO: 7133341 - DNA, 22 bp, Homo sapiens
tcagatggtcattcactagggt

SEQ ID NO: 7133342 - DNA, 22 bp, Homo sapiens
tcagatgtccttccagagattt

SEQ ID NO: 7133343 - DNA, 22 bp, Homo sapiens
tcagatgttgaaaaggaaaagt

SEQ ID NO: 7133344 - DNA, 22 bp, Homo sapiens
tcagagttctctgtccagatga

SEQ ID NO: 7133345 - DNA, 22 bp, Homo sapiens
tcagatgcttagagattagact

SEQ ID NO: 7133346 - DNA, 22 bp, Homo sapiens
tcagatgcttagtgactacaca

SEQ ID NO: 7133347 - DNA, 20 bp, Homo sapiens
tcagatgggagtgagccatc

SEQ ID NO: 7133348 - DNA, 22 bp, Homo sapiens
tcagattttgcacgaggttttg

SEQ ID NO: 7133349 - DNA, 20 bp, Homo sapiens
tcagatttttctaactttga

SEQ ID NO: 7133350 - DNA, 22 bp, Homo sapiens
tcagattttattttcctgttac

SEQ ID NO: 7133351 - DNA, 22 bp, Homo sapiens
tcagatttctagcgtttggcca

SEQ ID NO: 7133352 - DNA, 22 bp, Homo sapiens
tcagatttcttcttgcaacggc

SEQ ID NO: 7133353 - DNA, 22 bp, Homo sapiens
tcagatttccttgcagtttgga

SEQ ID NO: 7133354 - DNA, 22 bp, Homo sapiens
tcagatttctagcgtttggcca

SEQ ID NO: 7133355 - DNA, 22 bp, Homo sapiens
tcagatttatgaatatactatg

SEQ ID NO: 7133356 - DNA, 22 bp, Homo sapiens
tcagatttatgaatatactatg

SEQ ID NO: 7133357 - DNA, 22 bp, Homo sapiens
tcagatttatgtggctaggctc

SEQ ID NO: 7133358 - DNA, 22 bp, Homo sapiens
tcagatttcagctaaagggatg

SEQ ID NO: 7133359 - DNA, 22 bp, Homo sapiens
tcagatttcctgttgaagaagt

SEQ ID NO: 7133360 - DNA, 22 bp, Homo sapiens
tcagatttcctgttgaagaagt

SEQ ID NO: 7133361 - DNA, 22 bp, Homo sapiens
tcagctgctgtggtatgtacat

SEQ ID NO: 7133362 - DNA, 22 bp, Homo sapiens
tcagctgctgtggtatgtacat

SEQ ID NO: 7133363 - DNA, 22 bp, Homo sapiens
tcagctgctctgttgagctgaa

SEQ ID NO: 7133364 - DNA, 22 bp, Homo sapiens
tcagctgctctgttgagctgaa

SEQ ID NO: 7133365 - DNA, 22 bp, Homo sapiens
tcagctgcttcatgttctgaat

SEQ ID NO: 7133366 - DNA, 23 bp, Homo sapiens
tcagctgcttcctcctgcctgcc

SEQ ID NO: 7133367 - DNA, 22 bp, Homo sapiens
tcagctgctcaaatttatgtca

SEQ ID NO: 7133368 - DNA, 22 bp, Homo sapiens
tcagctgctctgttgagctgaa

SEQ ID NO: 7133369 - DNA, 22 bp, Homo sapiens
tcagctgctcaaatttatgtca

SEQ ID NO: 7133370 - DNA, 22 bp, Homo sapiens
tcagctgctcaaatttatgtca

SEQ ID NO: 7133371 - DNA, 22 bp, Homo sapiens
tcagctgcgacaggggcctgag

SEQ ID NO: 7133372 - DNA, 22 bp, Homo sapiens
tcagctgcgacaggggcctgag

SEQ ID NO: 7133373 - DNA, 22 bp, Homo sapiens
tcagctctgcctgtggaggcac

SEQ ID NO: 7133374 - DNA, 19 bp, Homo sapiens
tcagctctggggtcagtgg

SEQ ID NO: 7133375 - DNA, 22 bp, Homo sapiens
tcagctgccccatgtgttcact

SEQ ID NO: 7133376 - DNA, 22 bp, Homo sapiens
tcagctgccccgggcactgccc

SEQ ID NO: 7133377 - DNA, 22 bp, Homo sapiens
tcagctgccccgggcactgccc

SEQ ID NO: 7133378 - DNA, 22 bp, Homo sapiens
tcagctgccccgggcactgccc

SEQ ID NO: 7133379 - DNA, 22 bp, Homo sapiens
tcagctgcctctccctggaaga

SEQ ID NO: 7133380 - DNA, 22 bp, Homo sapiens
tcagctgcctttcccatgctag

SEQ ID NO: 7133381 - DNA, 22 bp, Homo sapiens
tcagctgcctttcccatgctag

SEQ ID NO: 7133382 - DNA, 22 bp, Homo sapiens
tcagctgcgacaggggcctgag

SEQ ID NO: 7133383 - DNA, 22 bp, Homo sapiens
tcagctctgcctgtggaggcac

SEQ ID NO: 7133384 - DNA, 22 bp, Homo sapiens
tcagctctgcctgtggaggcac

SEQ ID NO: 7133385 - DNA, 22 bp, Homo sapiens
tcagccaggccaggcattcaca

SEQ ID NO: 7133386 - DNA, 22 bp, Homo sapiens
tcagctctgcactccactgtgg

SEQ ID NO: 7133387 - DNA, 22 bp, Homo sapiens
tcagctctgcctgtggaggcac

SEQ ID NO: 7133388 - DNA, 22 bp, Homo sapiens
tcagctctgcctgtggaggcac

SEQ ID NO: 7133389 - DNA, 19 bp, Homo sapiens
tcagctctggggtcagtgg

SEQ ID NO: 7133390 - DNA, 19 bp, Homo sapiens
tcagctctggggtcagtgg

SEQ ID NO: 7133391 - DNA, 22 bp, Homo sapiens
tcagccaggcacaatggcagct

SEQ ID NO: 7133392 - DNA, 22 bp, Homo sapiens
tcagccaggcacaatggcagct

SEQ ID NO: 7133393 - DNA, 22 bp, Homo sapiens
tcagccaggcagccccctggtc

SEQ ID NO: 7133394 - DNA, 22 bp, Homo sapiens
tcagccaggcagccccctggtc

SEQ ID NO: 7133395 - DNA, 22 bp, Homo sapiens
tcagccaggcagccccctggtc

SEQ ID NO: 7133396 - DNA, 22 bp, Homo sapiens
tcagccaggcagccccctggtc

SEQ ID NO: 7133397 - DNA, 22 bp, Homo sapiens
tcagccaggccaccttcagctt

SEQ ID NO: 7133398 - DNA, 22 bp, Homo sapiens
tcagccaggccaccttcagctt

SEQ ID NO: 7133399 - DNA, 20 bp, Homo sapiens
tcagccagctaacatgggga

SEQ ID NO: 7133400 - DNA, 20 bp, Homo sapiens
tcagccagctaacatgggga

SEQ ID NO: 7133401 - DNA, 20 bp, Homo sapiens
tcagccagctaacatgggga

SEQ ID NO: 7133402 - DNA, 20 bp, Homo sapiens
tcagccagctaacatgggga

SEQ ID NO: 7133403 - DNA, 22 bp, Homo sapiens
tcagccagctcttggactctga

SEQ ID NO: 7133404 - DNA, 22 bp, Homo sapiens
tcagccagctcttggactctga

SEQ ID NO: 7133405 - DNA, 22 bp, Homo sapiens
tcagccagctcttggactctga

SEQ ID NO: 7133406 - DNA, 22 bp, Homo sapiens
tcagccagctgtgtgcttctgc

SEQ ID NO: 7133407 - DNA, 22 bp, Homo sapiens
tcagccagctgtgtgcttctgc

SEQ ID NO: 7133408 - DNA, 22 bp, Homo sapiens
tcagccagctgtgtgcttctgc

SEQ ID NO: 7133409 - DNA, 22 bp, Homo sapiens
tcagccagctgtgtgcttctgc

SEQ ID NO: 7133410 - DNA, 22 bp, Homo sapiens
tcagccaggcacaatggcagct

SEQ ID NO: 7133411 - DNA, 22 bp, Homo sapiens
tcagccaggcacaatggcagct

SEQ ID NO: 7133412 - DNA, 22 bp, Homo sapiens
tcagccaggcacaatggcagct

SEQ ID NO: 7133413 - DNA, 22 bp, Homo sapiens
tcagcagtgtcagttcccagag

SEQ ID NO: 7133414 - DNA, 17 bp, Homo sapiens
tcagcatacacagagaa

SEQ ID NO: 7133415 - DNA, 17 bp, Homo sapiens
tcagcatacacagagaa

SEQ ID NO: 7133416 - DNA, 19 bp, Homo sapiens
tcagcatcaatttggtcct

SEQ ID NO: 7133417 - DNA, 22 bp, Homo sapiens
tcagcatcaggttgtctgaatt

SEQ ID NO: 7133418 - DNA, 22 bp, Homo sapiens
tcagcatcagtattgtttagga

SEQ ID NO: 7133419 - DNA, 22 bp, Homo sapiens
tcagcatcttcagcatggggaa

SEQ ID NO: 7133420 - DNA, 20 bp, Homo sapiens
tcagcatgctcctcagacat

SEQ ID NO: 7133421 - DNA, 20 bp, Homo sapiens
tcagcatgctcctcagacat

SEQ ID NO: 7133422 - DNA, 22 bp, Homo sapiens
tcagcattttttgggtgtaact

SEQ ID NO: 7133423 - DNA, 22 bp, Homo sapiens
tcagccaagcagccatcatctg

SEQ ID NO: 7133424 - DNA, 19 bp, Homo sapiens
tcagccaccagaagagata

SEQ ID NO: 7133425 - DNA, 22 bp, Homo sapiens
tcagccactacccaccttaaca

SEQ ID NO: 7133426 - DNA, 22 bp, Homo sapiens
tcagccactacccaccttaaca

SEQ ID NO: 7133427 - DNA, 22 bp, Homo sapiens
tcagccacttccctctggtcag

SEQ ID NO: 7133428 - DNA, 22 bp, Homo sapiens
tcagccacttccctctggtcag

SEQ ID NO: 7133429 - DNA, 22 bp, Homo sapiens
tcagccagaaagtgattttcag

SEQ ID NO: 7133430 - DNA, 22 bp, Homo sapiens
tcagccacttccctctggtcag

SEQ ID NO: 7133431 - DNA, 22 bp, Homo sapiens
tcagccagaaagtgattttcag

SEQ ID NO: 7133432 - DNA, 22 bp, Homo sapiens
tcagccagaggcttcttggttt

SEQ ID NO: 7133433 - DNA, 22 bp, Homo sapiens
tcagccagaggcttcttggttt

SEQ ID NO: 7133434 - DNA, 22 bp, Homo sapiens
tcagccagaggcttcttggttt

SEQ ID NO: 7133435 - DNA, 22 bp, Homo sapiens
tcagccagagggggcaaaggaa

SEQ ID NO: 7133436 - DNA, 22 bp, Homo sapiens
tcagccagagggggcaaaggaa

SEQ ID NO: 7133437 - DNA, 22 bp, Homo sapiens
tcagccagagggggcaaaggaa

SEQ ID NO: 7133438 - DNA, 22 bp, Homo sapiens
tcagccagaggtggatgagtca

SEQ ID NO: 7133439 - DNA, 22 bp, Homo sapiens
tcagccagaggtggatgagtca

SEQ ID NO: 7133440 - DNA, 22 bp, Homo sapiens
tcagccagaggtggatgagtca

SEQ ID NO: 7133441 - DNA, 22 bp, Homo sapiens
tcagccagcatcagctaagtgc

SEQ ID NO: 7133442 - DNA, 22 bp, Homo sapiens
tcagccagcatcagctaagtgc

SEQ ID NO: 7133443 - DNA, 22 bp, Homo sapiens
tcagccagcatcagctaagtgc

SEQ ID NO: 7133444 - DNA, 22 bp, Homo sapiens
tcagccagcattacccctgact

SEQ ID NO: 7133445 - DNA, 22 bp, Homo sapiens
tcagccagcattacccctgact

SEQ ID NO: 7133446 - DNA, 22 bp, Homo sapiens
tcagccagccagctacaggctt

SEQ ID NO: 7133447 - DNA, 22 bp, Homo sapiens
tcagccagccagctacaggctt

SEQ ID NO: 7133448 - DNA, 22 bp, Homo sapiens
tcagctggtgaatggactcatc

SEQ ID NO: 7133449 - DNA, 22 bp, Homo sapiens
tcaggaattttgttctgtatcc

SEQ ID NO: 7133450 - DNA, 22 bp, Homo sapiens
tcaggacaacaagacttgttta

SEQ ID NO: 7133451 - DNA, 22 bp, Homo sapiens
tcaggacaacaagacttgttta

SEQ ID NO: 7133452 - DNA, 23 bp, Homo sapiens
tcagctgcttcctcctgcctgcc

SEQ ID NO: 7133453 - DNA, 22 bp, Homo sapiens
tcagctggcagttcagaggctg

SEQ ID NO: 7133454 - DNA, 22 bp, Homo sapiens
tcaggacacttggcacaaggtc

SEQ ID NO: 7133455 - DNA, 22 bp, Homo sapiens
tcaggacagaaggctgccaggg

SEQ ID NO: 7133456 - DNA, 22 bp, Homo sapiens
tcaggacagaaggctgccaggg

SEQ ID NO: 7133457 - DNA, 22 bp, Homo sapiens
tcaggacaacctgttttcagac

SEQ ID NO: 7133458 - DNA, 22 bp, Homo sapiens
tcaggacacttggcacaaggtc

SEQ ID NO: 7133459 - DNA, 22 bp, Homo sapiens
tcaggacacttggcacaaggtc

SEQ ID NO: 7133460 - DNA, 22 bp, Homo sapiens
tcaggacagagatcagaacttc

SEQ ID NO: 7133461 - DNA, 22 bp, Homo sapiens
tcaggacagccagggtgcagac

SEQ ID NO: 7133462 - DNA, 22 bp, Homo sapiens
tcaggacagccagggtgcagac

SEQ ID NO: 7133463 - DNA, 22 bp, Homo sapiens
tcaggacagccagggtgcagac

SEQ ID NO: 7133464 - DNA, 22 bp, Homo sapiens
tcaggacagggatcacatcatc

SEQ ID NO: 7133465 - DNA, 22 bp, Homo sapiens
tcaggacaggttcgggtgggta

SEQ ID NO: 7133466 - DNA, 22 bp, Homo sapiens
tcaggacatttgtcagcaggag

SEQ ID NO: 7133467 - DNA, 22 bp, Homo sapiens
tcaggacatttgtcagcaggag

SEQ ID NO: 7133468 - DNA, 22 bp, Homo sapiens
tcaggacatttgtcagcaggag

SEQ ID NO: 7133469 - DNA, 22 bp, Homo sapiens
tcaggacatttgtcagcaggag

SEQ ID NO: 7133470 - DNA, 22 bp, Homo sapiens
tcaggagaaagccaattagagt

SEQ ID NO: 7133471 - DNA, 22 bp, Homo sapiens
tcaggagaaggcaatgtggaaa

SEQ ID NO: 7133472 - DNA, 22 bp, Homo sapiens
tcaggagaaggcaatgtggaaa

SEQ ID NO: 7133473 - DNA, 22 bp, Homo sapiens
tcaggagaaggcaatgtggaaa

SEQ ID NO: 7133474 - DNA, 22 bp, Homo sapiens
tcaggagaaagccaattagagt

SEQ ID NO: 7133475 - DNA, 22 bp, Homo sapiens
tcaggagaaaatatcaggaagt

SEQ ID NO: 7133476 - DNA, 22 bp, Homo sapiens
tcaggagacaaagggtgcggag

SEQ ID NO: 7133477 - DNA, 22 bp, Homo sapiens
tcaggagacaaagggtgcggag

SEQ ID NO: 7133478 - DNA, 22 bp, Homo sapiens
tcaggagacaaagggtgcggag

SEQ ID NO: 7133479 - DNA, 22 bp, Homo sapiens
tcaggagaatcagggctgtcct

SEQ ID NO: 7133480 - DNA, 22 bp, Homo sapiens
tcaggagactggcagtgcccac

SEQ ID NO: 7133481 - DNA, 22 bp, Homo sapiens
tcctgaggcacaatcctagaat

SEQ ID NO: 7133482 - DNA, 22 bp, Homo sapiens
tcctgaggcacaatcctagaat

SEQ ID NO: 7133483 - DNA, 22 bp, Homo sapiens
tcctgaggccctgttagggtct

SEQ ID NO: 7133484 - DNA, 22 bp, Homo sapiens
tcctgaggatggttgaagtgca

SEQ ID NO: 7133485 - DNA, 22 bp, Homo sapiens
tcctgaggagaagagtgctagg

SEQ ID NO: 7133486 - DNA, 22 bp, Homo sapiens
tcctgaggccctgttagggtct

SEQ ID NO: 7133487 - DNA, 22 bp, Homo sapiens
tcctgaggcctctgtgatgtga

SEQ ID NO: 7133488 - DNA, 22 bp, Homo sapiens
tcctgaggcctctgtgatgtga

SEQ ID NO: 7133489 - DNA, 22 bp, Homo sapiens
tcctgaggctaaagtgcagtgg

SEQ ID NO: 7133490 - DNA, 22 bp, Homo sapiens
tcctgaggctaaagtgcagtgg

SEQ ID NO: 7133491 - DNA, 22 bp, Homo sapiens
tcctgaggttttaaaactattc

SEQ ID NO: 7133492 - DNA, 22 bp, Homo sapiens
tcctgaggttttaaaactattc

SEQ ID NO: 7133493 - DNA, 20 bp, Homo sapiens
tcctgagtgcagttggcttg

SEQ ID NO: 7133494 - DNA, 22 bp, Homo sapiens
tcctgagtgtttggccaggcca

SEQ ID NO: 7133495 - DNA, 22 bp, Homo sapiens
tcctgatggaggggtcatcttt

SEQ ID NO: 7133496 - DNA, 22 bp, Homo sapiens
tcctgaggactaacaggaagga

SEQ ID NO: 7133497 - DNA, 22 bp, Homo sapiens
tcctgaggactaacaggaagga

SEQ ID NO: 7133498 - DNA, 22 bp, Homo sapiens
tcctgaggaccctgtcaggggc

SEQ ID NO: 7133499 - DNA, 22 bp, Homo sapiens
tcctgaggactaacaggaagga

SEQ ID NO: 7133500 - DNA, 22 bp, Homo sapiens
tcctgaggaccctgtcaggggc

SEQ ID NO: 7133501 - DNA, 22 bp, Homo sapiens
tcctgaggaatgtgaagagaac

SEQ ID NO: 7133502 - DNA, 23 bp, Homo sapiens
tcctgaggaatggcatctcacat

SEQ ID NO: 7133503 - DNA, 22 bp, Homo sapiens
tcctgaggaatgtgaagagaac

SEQ ID NO: 7133504 - DNA, 22 bp, Homo sapiens
tcctgagctgacacttggggag

SEQ ID NO: 7133505 - DNA, 22 bp, Homo sapiens
tcctgagctgacacttggggag

SEQ ID NO: 7133506 - DNA, 22 bp, Homo sapiens
tcctgaggaaagttcatgaatg

SEQ ID NO: 7133507 - DNA, 22 bp, Homo sapiens
tcctgagcttcagtttcttcat

SEQ ID NO: 7133508 - DNA, 22 bp, Homo sapiens
tcctgagctttacagtaaggac

SEQ ID NO: 7133509 - DNA, 22 bp, Homo sapiens
tcctgaggaaagttcatgaatg

SEQ ID NO: 7133510 - DNA, 22 bp, Homo sapiens
tcctgagccctgtaggaccctg

SEQ ID NO: 7133511 - DNA, 22 bp, Homo sapiens
tcctgagccctggggtcagtgt

SEQ ID NO: 7133512 - DNA, 22 bp, Homo sapiens
tcctgagctacagtagtatgat

SEQ ID NO: 7133513 - DNA, 22 bp, Homo sapiens
tcctgagccccagggaggttgg

SEQ ID NO: 7133514 - DNA, 22 bp, Homo sapiens
tcctgagccctactctagacga

SEQ ID NO: 7133515 - DNA, 22 bp, Homo sapiens
tcctgagccctactctagacga

SEQ ID NO: 7133516 - DNA, 22 bp, Homo sapiens
tcctgagccctggggtcagtgt

SEQ ID NO: 7133517 - DNA, 22 bp, Homo sapiens
tcctgagcaacacagctaagtg

SEQ ID NO: 7133518 - DNA, 22 bp, Homo sapiens
tcctgagattctgcatttctaa

SEQ ID NO: 7133519 - DNA, 22 bp, Homo sapiens
tcctgagatgtggagctccatg

SEQ ID NO: 7133520 - DNA, 22 bp, Homo sapiens
tcctgagatccttttagggatc

SEQ ID NO: 7133521 - DNA, 22 bp, Homo sapiens
tcctgagatccttttagggatc

SEQ ID NO: 7133522 - DNA, 22 bp, Homo sapiens
tcctgagatgagacagtgctgc

SEQ ID NO: 7133523 - DNA, 22 bp, Homo sapiens
tcctgagatgagacagtgctgc

SEQ ID NO: 7133524 - DNA, 22 bp, Homo sapiens
tcctgagatgagacagtgctgc

SEQ ID NO: 7133525 - DNA, 22 bp, Homo sapiens
tcctgagatgagacagtgctgc

SEQ ID NO: 7133526 - DNA, 23 bp, Homo sapiens
tcctgagatgagacagtgctgcc

SEQ ID NO: 7133527 - DNA, 22 bp, Homo sapiens
tcctgagataaatctcatgtga

SEQ ID NO: 7133528 - DNA, 22 bp, Homo sapiens
tcctgagataaatctcatgtga

SEQ ID NO: 7133529 - DNA, 22 bp, Homo sapiens
tcctgagataggagttgaaggc

SEQ ID NO: 7133530 - DNA, 22 bp, Homo sapiens
tcctgagaggggtgggtttccc

SEQ ID NO: 7133531 - DNA, 22 bp, Homo sapiens
tcctgagaggtgtgaggtgcag

SEQ ID NO: 7133532 - DNA, 22 bp, Homo sapiens
tcctgagaggtgtgaggtgcag

SEQ ID NO: 7133533 - DNA, 22 bp, Homo sapiens
tcctgagagccttggcttcaga

SEQ ID NO: 7133534 - DNA, 22 bp, Homo sapiens
tcctgagagcagctgctttgga

SEQ ID NO: 7133535 - DNA, 22 bp, Homo sapiens
tcctgagagcagctgctttgga

SEQ ID NO: 7133536 - DNA, 20 bp, Homo sapiens
tcctgagaggctcttggaga

SEQ ID NO: 7133537 - DNA, 22 bp, Homo sapiens
tcctgagacatctctgctggtc

SEQ ID NO: 7133538 - DNA, 22 bp, Homo sapiens
tcctgagagcagagtccaggtg

SEQ ID NO: 7133539 - DNA, 22 bp, Homo sapiens
tcctgagagcagagtccaggtg

SEQ ID NO: 7133540 - DNA, 22 bp, Homo sapiens
tcctgagacatctctgctggtc

SEQ ID NO: 7133541 - DNA, 22 bp, Homo sapiens
tcctgaaggcctgagttccacc

SEQ ID NO: 7133542 - DNA, 22 bp, Homo sapiens
tcctgaaggcagatggggatca

SEQ ID NO: 7133543 - DNA, 22 bp, Homo sapiens
tcctgaaggagcagttgctggg

SEQ ID NO: 7133544 - DNA, 22 bp, Homo sapiens
tcctgaagctctcttaaggaaa

SEQ ID NO: 7133545 - DNA, 22 bp, Homo sapiens
tcctgaagcctgagtgatgact

SEQ ID NO: 7133546 - DNA, 22 bp, Homo sapiens
tcctgaagcagttagcatgagc

SEQ ID NO: 7133547 - DNA, 22 bp, Homo sapiens
tcctgaagatgaaaagagaggt

SEQ ID NO: 7133548 - DNA, 22 bp, Homo sapiens
tcctgaagaggctacactgctt

SEQ ID NO: 7133549 - DNA, 22 bp, Homo sapiens
tcctgaagagccctgctctgtg

SEQ ID NO: 7133550 - DNA, 22 bp, Homo sapiens
tcctgaagagccctgctctgtg

SEQ ID NO: 7133551 - DNA, 22 bp, Homo sapiens
tcctgaagaaggcagatatttg

SEQ ID NO: 7133552 - DNA, 22 bp, Homo sapiens
tcctgaagaacgaagtcatgta

SEQ ID NO: 7133553 - DNA, 22 bp, Homo sapiens
tcctgaacattatgcaagcttc

SEQ ID NO: 7133554 - DNA, 19 bp, Homo sapiens
tcctgaaaacttctggaat

SEQ ID NO: 7133555 - DNA, 22 bp, Homo sapiens
tcctgaaaaattacatgttcag

SEQ ID NO: 7133556 - DNA, 22 bp, Homo sapiens
tcctcttctgcctatatctgcc

SEQ ID NO: 7133557 - DNA, 22 bp, Homo sapiens
tcctcttcagagggacctcggg

SEQ ID NO: 7133558 - DNA, 22 bp, Homo sapiens
tcctcttcagagggacctcggg

SEQ ID NO: 7133559 - DNA, 22 bp, Homo sapiens
tcctcttccttctgtccaaatg

SEQ ID NO: 7133560 - DNA, 22 bp, Homo sapiens
tcctcttcaaaaggatttcctt

SEQ ID NO: 7133561 - DNA, 22 bp, Homo sapiens
tcctctggttatacttgcaccc

SEQ ID NO: 7133562 - DNA, 22 bp, Homo sapiens
tcctctggttatacttgcaccc

SEQ ID NO: 7133563 - DNA, 22 bp, Homo sapiens
tcctctggggcgtggtcctgga

SEQ ID NO: 7133564 - DNA, 22 bp, Homo sapiens
tcctcaggtgactaggtatctt

SEQ ID NO: 7133565 - DNA, 22 bp, Homo sapiens
tcctcagtaaggcatggctttg

SEQ ID NO: 7133566 - DNA, 22 bp, Homo sapiens
tcctctggtcctgcagcagatc

SEQ ID NO: 7133567 - DNA, 22 bp, Homo sapiens
tcctctggggtcagggcactac

SEQ ID NO: 7133568 - DNA, 19 bp, Homo sapiens
tcctctggtaccacccttg

SEQ ID NO: 7133569 - DNA, 19 bp, Homo sapiens
tcctctggtaccacccttg

SEQ ID NO: 7133570 - DNA, 19 bp, Homo sapiens
tcctctggtaccacccttg

SEQ ID NO: 7133571 - DNA, 22 bp, Homo sapiens
tcctgcctgcaatcccagcact

SEQ ID NO: 7133572 - DNA, 22 bp, Homo sapiens
tcctgcctgcaatcccagcact

SEQ ID NO: 7133573 - DNA, 22 bp, Homo sapiens
tcctgcctcttttcttattcca

SEQ ID NO: 7133574 - DNA, 22 bp, Homo sapiens
tcctgcctcttttcttattcca

SEQ ID NO: 7133575 - DNA, 22 bp, Homo sapiens
tcctgcctgagcgtggaggagg

SEQ ID NO: 7133576 - DNA, 22 bp, Homo sapiens
tcctgcctgagcgtggaggagg

SEQ ID NO: 7133577 - DNA, 22 bp, Homo sapiens
tcctgcctcttttcttattcca

SEQ ID NO: 7133578 - DNA, 22 bp, Homo sapiens
tcctgcctctccatgctaacta

SEQ ID NO: 7133579 - DNA, 22 bp, Homo sapiens
tcctgcctctccatgctaacta

SEQ ID NO: 7133580 - DNA, 22 bp, Homo sapiens
tcctgcctctccatgctaacta

SEQ ID NO: 7133581 - DNA, 22 bp, Homo sapiens
tcctgcctctccatgctaacta

SEQ ID NO: 7133582 - DNA, 22 bp, Homo sapiens
tcctgcctcaggctctggagta

SEQ ID NO: 7133583 - DNA, 22 bp, Homo sapiens
tcctgcctcacagttgaagttt

SEQ ID NO: 7133584 - DNA, 22 bp, Homo sapiens
tcctgcctcaggctctggagta

SEQ ID NO: 7133585 - DNA, 22 bp, Homo sapiens
tcctgcctagcaggtgacctat

SEQ ID NO: 7133586 - DNA, 22 bp, Homo sapiens
tcctgcctagcaggtgacctat

SEQ ID NO: 7133587 - DNA, 22 bp, Homo sapiens
tcctgcctaccttgcggaggtg

SEQ ID NO: 7133588 - DNA, 22 bp, Homo sapiens
tcctgcccagagctctccactc

SEQ ID NO: 7133589 - DNA, 22 bp, Homo sapiens
tcctgcagtctgcactctgcct

SEQ ID NO: 7133590 - DNA, 22 bp, Homo sapiens
tcctgcagtctgcactctgcct

SEQ ID NO: 7133591 - DNA, 22 bp, Homo sapiens
tcctgcagtctgcactctgcct

SEQ ID NO: 7133592 - DNA, 22 bp, Homo sapiens
tcctgccctaagatgttatatt

SEQ ID NO: 7133593 - DNA, 22 bp, Homo sapiens
tcctgccctcgggggtgttcca

SEQ ID NO: 7133594 - DNA, 22 bp, Homo sapiens
tcctgccctcgggggtgttcca

SEQ ID NO: 7133595 - DNA, 22 bp, Homo sapiens
tcctgccctgaaaagtcagtct

SEQ ID NO: 7133596 - DNA, 22 bp, Homo sapiens
tcctgccctgaaaagtcagtct

SEQ ID NO: 7133597 - DNA, 22 bp, Homo sapiens
tcctgccgtcctccggggcctc

SEQ ID NO: 7133598 - DNA, 22 bp, Homo sapiens
tcctgccgtcctccggggcctc

SEQ ID NO: 7133599 - DNA, 20 bp, Homo sapiens
tcctgcagtcgctagcgccc

SEQ ID NO: 7133600 - DNA, 20 bp, Homo sapiens
tcctgcagtcgctagcgccc

SEQ ID NO: 7133601 - DNA, 22 bp, Homo sapiens
tcctgcaggtggatgattctct

SEQ ID NO: 7133602 - DNA, 22 bp, Homo sapiens
tcctgcaggggctgaggaacca

SEQ ID NO: 7133603 - DNA, 19 bp, Homo sapiens
tcctgcaggtggcttgcag

SEQ ID NO: 7133604 - DNA, 19 bp, Homo sapiens
tcctgcaggtggcttgcag

SEQ ID NO: 7133605 - DNA, 21 bp, Homo sapiens
tcctgcagggcagcagagtgg

SEQ ID NO: 7133606 - DNA, 21 bp, Homo sapiens
tcctgcagggcagcagagtgg

SEQ ID NO: 7133607 - DNA, 22 bp, Homo sapiens
tcctgcaggcttgagtcctcag

SEQ ID NO: 7133608 - DNA, 21 bp, Homo sapiens
tcctgcagggcagcagagtgg

SEQ ID NO: 7133609 - DNA, 22 bp, Homo sapiens
tcctgcaggcttgagtcctcag

SEQ ID NO: 7133610 - DNA, 22 bp, Homo sapiens
tcctgcaggccagaggggtgag

SEQ ID NO: 7133611 - DNA, 18 bp, Homo sapiens
tcctgcagcttctatgta

SEQ ID NO: 7133612 - DNA, 21 bp, Homo sapiens
tcctgcaggaggcctgagagg

SEQ ID NO: 7133613 - DNA, 22 bp, Homo sapiens
tcctgcagctgaagctcatgtg

SEQ ID NO: 7133614 - DNA, 22 bp, Homo sapiens
tcctgcagctgaagctcatgtg

SEQ ID NO: 7133615 - DNA, 22 bp, Homo sapiens
tcctgcagctgaagctcatgtg

SEQ ID NO: 7133616 - DNA, 22 bp, Homo sapiens
tcctgcagctctgagaagcatc

SEQ ID NO: 7133617 - DNA, 22 bp, Homo sapiens
tcctgcagctgaagctcatgtg

SEQ ID NO: 7133618 - DNA, 22 bp, Homo sapiens
tcctgcagctgcagacctgggg

SEQ ID NO: 7133619 - DNA, 22 bp, Homo sapiens
tcctgcagatcaaagcctttga

SEQ ID NO: 7133620 - DNA, 22 bp, Homo sapiens
tcctgcagagtcccactgattt

SEQ ID NO: 7133621 - DNA, 22 bp, Homo sapiens
tcctgcagagtcccactgattt

SEQ ID NO: 7133622 - DNA, 22 bp, Homo sapiens
tcctgcagagtcccactgattt

SEQ ID NO: 7133623 - DNA, 23 bp, Homo sapiens
tcctgcagataagctggttgaca

SEQ ID NO: 7133624 - DNA, 23 bp, Homo sapiens
tcctgcagataagctggttgaca

SEQ ID NO: 7133625 - DNA, 22 bp, Homo sapiens
tcctgcagagccgccctcaggt

SEQ ID NO: 7133626 - DNA, 22 bp, Homo sapiens
tcctgcagagccgccctcaggt

SEQ ID NO: 7133627 - DNA, 22 bp, Homo sapiens
tcctgcagagccgccctcaggt

SEQ ID NO: 7133628 - DNA, 22 bp, Homo sapiens
tcctgcagccattagaggtcaa

SEQ ID NO: 7133629 - DNA, 22 bp, Homo sapiens
tcctgcagccttgggctggagc

SEQ ID NO: 7133630 - DNA, 22 bp, Homo sapiens
tcctgcagccactgcaggcaga

SEQ ID NO: 7133631 - DNA, 22 bp, Homo sapiens
tcctgcagcatccgtcgtctgt

SEQ ID NO: 7133632 - DNA, 22 bp, Homo sapiens
tcctgcagagacagaggcctca

SEQ ID NO: 7133633 - DNA, 22 bp, Homo sapiens
tcctgcagacctcagtcaggtc

SEQ ID NO: 7133634 - DNA, 22 bp, Homo sapiens
tcctgcagagacagaggcctca

SEQ ID NO: 7133635 - DNA, 22 bp, Homo sapiens
tcctgcagagacagaggcctca

SEQ ID NO: 7133636 - DNA, 19 bp, Homo sapiens
tcctgcagaccagacctgt

SEQ ID NO: 7133637 - DNA, 22 bp, Homo sapiens
tcctgcagacctcagtcaggtc

SEQ ID NO: 7133638 - DNA, 22 bp, Homo sapiens
tcctgcacaccttgagcttgga

SEQ ID NO: 7133639 - DNA, 21 bp, Homo sapiens
tcctgcaccctccctgtggct

SEQ ID NO: 7133640 - DNA, 21 bp, Homo sapiens
tcctgcagaatgccttcctac

SEQ ID NO: 7133641 - DNA, 22 bp, Homo sapiens
tcctgcagacatttacaccttt

SEQ ID NO: 7133642 - DNA, 19 bp, Homo sapiens
tcctgcagaccagacctgt

SEQ ID NO: 7133643 - DNA, 22 bp, Homo sapiens
tccagggaagagcagaggctac

SEQ ID NO: 7133644 - DNA, 21 bp, Homo sapiens
tccagggaacttctcaggaat

SEQ ID NO: 7133645 - DNA, 21 bp, Homo sapiens
tccagggaacttctcaggaat

SEQ ID NO: 7133646 - DNA, 22 bp, Homo sapiens
tccaggctgggctgaagggtgc

SEQ ID NO: 7133647 - DNA, 23 bp, Homo sapiens
tccaggctgggacttcaactggc

SEQ ID NO: 7133648 - DNA, 22 bp, Homo sapiens
tccagggaaggtgtgaggctgg

SEQ ID NO: 7133649 - DNA, 22 bp, Homo sapiens
tccagggaagagcagaggctac

SEQ ID NO: 7133650 - DNA, 21 bp, Homo sapiens
tccagggaatttcaactttta

SEQ ID NO: 7133651 - DNA, 22 bp, Homo sapiens
tccagggaaggtgtgaggctgg

SEQ ID NO: 7133652 - DNA, 22 bp, Homo sapiens
tccagggaaggtgtgaggctgg

SEQ ID NO: 7133653 - DNA, 18 bp, Homo sapiens
tccagggcttcctcctct

SEQ ID NO: 7133654 - DNA, 22 bp, Homo sapiens
tccagggctgttactttacata

SEQ ID NO: 7133655 - DNA, 22 bp, Homo sapiens
tccagggctgggttggctcagc

SEQ ID NO: 7133656 - DNA, 22 bp, Homo sapiens
tccagggctgggttggctcagc

SEQ ID NO: 7133657 - DNA, 22 bp, Homo sapiens
tccagggctgacttgggagagg

SEQ ID NO: 7133658 - DNA, 22 bp, Homo sapiens
tccagggctgacttgggagagg

SEQ ID NO: 7133659 - DNA, 22 bp, Homo sapiens
tccagggacagcgctggagcta

SEQ ID NO: 7133660 - DNA, 22 bp, Homo sapiens
tccagggacagcgctggagcta

SEQ ID NO: 7133661 - DNA, 22 bp, Homo sapiens
tccagggacacagagtccttct

SEQ ID NO: 7133662 - DNA, 22 bp, Homo sapiens
tccagggacacagagtccttct

SEQ ID NO: 7133663 - DNA, 19 bp, Homo sapiens
tccaggtggagagacaccc

SEQ ID NO: 7133664 - DNA, 19 bp, Homo sapiens
tccaggtggagagacaccc

SEQ ID NO: 7133665 - DNA, 19 bp, Homo sapiens
tccaggtggagagacaccc

SEQ ID NO: 7133666 - DNA, 22 bp, Homo sapiens
tccaggtgccggggactgaggc

SEQ ID NO: 7133667 - DNA, 22 bp, Homo sapiens
tccaggtgagtgcaggtgcaga

SEQ ID NO: 7133668 - DNA, 22 bp, Homo sapiens
tccaggtgggctgcacccaggc

SEQ ID NO: 7133669 - DNA, 22 bp, Homo sapiens
tccaggtgtatttactgaagta

SEQ ID NO: 7133670 - DNA, 22 bp, Homo sapiens
tccaggtgtatttactgaagta

SEQ ID NO: 7133671 - DNA, 22 bp, Homo sapiens
tccaggtgtgctctgtgccctg

SEQ ID NO: 7133672 - DNA, 22 bp, Homo sapiens
tccagtacaggtctctcatttc

SEQ ID NO: 7133673 - DNA, 22 bp, Homo sapiens
tccagtagaattttattcaaca

SEQ ID NO: 7133674 - DNA, 21 bp, Homo sapiens
tccagtcaacttggcttggct

SEQ ID NO: 7133675 - DNA, 22 bp, Homo sapiens
tccagtcaagcttgagaatttc

SEQ ID NO: 7133676 - DNA, 22 bp, Homo sapiens
tccagtcaagcttgagaatttc

SEQ ID NO: 7133677 - DNA, 22 bp, Homo sapiens
tccagtcaggctgaattcaagg

SEQ ID NO: 7133678 - DNA, 22 bp, Homo sapiens
tccatgctcttgtctagcctcc

SEQ ID NO: 7133679 - DNA, 22 bp, Homo sapiens
tccatggagatggatgactgta

SEQ ID NO: 7133680 - DNA, 21 bp, Homo sapiens
tccagggctttgattctctca

SEQ ID NO: 7133681 - DNA, 21 bp, Homo sapiens
tccagggctttgattctctca

SEQ ID NO: 7133682 - DNA, 21 bp, Homo sapiens
tccagggctttgattctctca

SEQ ID NO: 7133683 - DNA, 22 bp, Homo sapiens
tccagggcttggctgggacggt

SEQ ID NO: 7133684 - DNA, 19 bp, Homo sapiens
tccagggctttatggcttt

SEQ ID NO: 7133685 - DNA, 22 bp, Homo sapiens
tccagggcttgacagggtgcct

SEQ ID NO: 7133686 - DNA, 18 bp, Homo sapiens
tccagggcttcctcctct

SEQ ID NO: 7133687 - DNA, 18 bp, Homo sapiens
tccagggcttcctcctct

SEQ ID NO: 7133688 - DNA, 22 bp, Homo sapiens
tccaggctggcctcgcgtgaca

SEQ ID NO: 7133689 - DNA, 18 bp, Homo sapiens
tccaggctggattgatga

SEQ ID NO: 7133690 - DNA, 22 bp, Homo sapiens
tccaggctggagtgcagtggcg

SEQ ID NO: 7133691 - DNA, 22 bp, Homo sapiens
tccaggctggagtgcagtggcg

SEQ ID NO: 7133692 - DNA, 18 bp, Homo sapiens
tccaggctggattgatga

SEQ ID NO: 7133693 - DNA, 22 bp, Homo sapiens
tccaggctggcctcgcgtgaca

SEQ ID NO: 7133694 - DNA, 22 bp, Homo sapiens
tccaggctggctcttcaaaatt

SEQ ID NO: 7133695 - DNA, 22 bp, Homo sapiens
tccaggctggacatgaggcggg

SEQ ID NO: 7133696 - DNA, 22 bp, Homo sapiens
tccaggctggagtgcagtggca

SEQ ID NO: 7133697 - DNA, 22 bp, Homo sapiens
tccaggctggagtgcagtggca

SEQ ID NO: 7133698 - DNA, 22 bp, Homo sapiens
tccaggctggagtgcagtggca

SEQ ID NO: 7133699 - DNA, 22 bp, Homo sapiens
tccaggctggagtgcagtggca

SEQ ID NO: 7133700 - DNA, 22 bp, Homo sapiens
tccaggctggagtgcagtggca

SEQ ID NO: 7133701 - DNA, 22 bp, Homo sapiens
tccaggctggagtgcagtggcg

SEQ ID NO: 7133702 - DNA, 22 bp, Homo sapiens
tccaggctggagtgcagtggcg

SEQ ID NO: 7133703 - DNA, 22 bp, Homo sapiens
tccaggctggagtgcagtggcg

SEQ ID NO: 7133704 - DNA, 22 bp, Homo sapiens
tccaggctaggtttacaggaca

SEQ ID NO: 7133705 - DNA, 21 bp, Homo sapiens
tccaggctggaaggggcgttg

SEQ ID NO: 7133706 - DNA, 22 bp, Homo sapiens
tccaggctagcctggtagagaa

SEQ ID NO: 7133707 - DNA, 22 bp, Homo sapiens
tccaggctagcctggtagagaa

SEQ ID NO: 7133708 - DNA, 22 bp, Homo sapiens
tccaggctagagtgcagtggcc

SEQ ID NO: 7133709 - DNA, 22 bp, Homo sapiens
tccaggctagaagtcacaggcc

SEQ ID NO: 7133710 - DNA, 22 bp, Homo sapiens
tccaggctacttggattcctgg

SEQ ID NO: 7133711 - DNA, 22 bp, Homo sapiens
tccaggctagaagtcacaggcc

SEQ ID NO: 7133712 - DNA, 22 bp, Homo sapiens
tccaggctagaagtcacaggcc

SEQ ID NO: 7133713 - DNA, 22 bp, Homo sapiens
tccaggctagaagtcacaggcc

SEQ ID NO: 7133714 - DNA, 22 bp, Homo sapiens
tccaggctagagtgcagtggcc

SEQ ID NO: 7133715 - DNA, 22 bp, Homo sapiens
tccaggctagagtgcagtggcc

SEQ ID NO: 7133716 - DNA, 22 bp, Homo sapiens
tccaggctagagtgcagtggcc

SEQ ID NO: 7133717 - DNA, 22 bp, Homo sapiens
tccaggctagagtgcagtggcc

SEQ ID NO: 7133718 - DNA, 22 bp, Homo sapiens
tccaggctaattttgcattgtt

SEQ ID NO: 7133719 - DNA, 22 bp, Homo sapiens
tccaggcctttgcacatgttgt

SEQ ID NO: 7133720 - DNA, 22 bp, Homo sapiens
tccaggcctttgcacatgttgt

SEQ ID NO: 7133721 - DNA, 22 bp, Homo sapiens
tccaggcctttgcacatgttgt

SEQ ID NO: 7133722 - DNA, 20 bp, Homo sapiens
tccaggccttgttctcagat

SEQ ID NO: 7133723 - DNA, 20 bp, Homo sapiens
tccaggccttgttctcagat

SEQ ID NO: 7133724 - DNA, 22 bp, Homo sapiens
tccaggcctttgcacatgttgt

SEQ ID NO: 7133725 - DNA, 22 bp, Homo sapiens
tccaggcctttgcacatgttgt

SEQ ID NO: 7133726 - DNA, 22 bp, Homo sapiens
tccaggctaattttgcattgtt

SEQ ID NO: 7133727 - DNA, 22 bp, Homo sapiens
tccaggctaattttgcattgtt

SEQ ID NO: 7133728 - DNA, 20 bp, Homo sapiens
tccaggccttgttctcagat

SEQ ID NO: 7133729 - DNA, 20 bp, Homo sapiens
tccaggccttgttctcagat

SEQ ID NO: 7133730 - DNA, 22 bp, Homo sapiens
tccaggccttgacaggtcagtt

SEQ ID NO: 7133731 - DNA, 20 bp, Homo sapiens
tccaggccttgttctcagat

SEQ ID NO: 7133732 - DNA, 22 bp, Homo sapiens
tccaggccttgacaggtcagtt

SEQ ID NO: 7133733 - DNA, 22 bp, Homo sapiens
tccaggccttgacaggtcagtt

SEQ ID NO: 7133734 - DNA, 22 bp, Homo sapiens
tccaggccttgacaggtcagtt

SEQ ID NO: 7133735 - DNA, 22 bp, Homo sapiens
tccaggcctgcctggtgtttgc

SEQ ID NO: 7133736 - DNA, 22 bp, Homo sapiens
tccaggcctgcctggtgtttgc

SEQ ID NO: 7133737 - DNA, 22 bp, Homo sapiens
tccaggcctggctccattcagt

SEQ ID NO: 7133738 - DNA, 22 bp, Homo sapiens
tccaggcctggctccattcagt

SEQ ID NO: 7133739 - DNA, 22 bp, Homo sapiens
tccaggcctggctccattcagt

SEQ ID NO: 7133740 - DNA, 22 bp, Homo sapiens
tccaggcctggctccattcagt

SEQ ID NO: 7133741 - DNA, 22 bp, Homo sapiens
tccaggccttgacaggtcagtt

SEQ ID NO: 7133742 - DNA, 22 bp, Homo sapiens
tccaggccttgacaggtcagtt

SEQ ID NO: 7133743 - DNA, 22 bp, Homo sapiens
tccaggcctgcaatgacaaagc

SEQ ID NO: 7133744 - DNA, 22 bp, Homo sapiens
tccaggcctgcctggtgtttgc

SEQ ID NO: 7133745 - DNA, 22 bp, Homo sapiens
tccaggcctgcaatgacaaagc

SEQ ID NO: 7133746 - DNA, 22 bp, Homo sapiens
tccaggcctgactataaatgta

SEQ ID NO: 7133747 - DNA, 22 bp, Homo sapiens
tccaggcctgactataaatgta

SEQ ID NO: 7133748 - DNA, 22 bp, Homo sapiens
tccaggcctgcaatgacaaagc

SEQ ID NO: 7133749 - DNA, 22 bp, Homo sapiens
tccaggcctgcaatgacaaagc

SEQ ID NO: 7133750 - DNA, 18 bp, Homo sapiens
tccaggcctgaagtgtcc

SEQ ID NO: 7133751 - DNA, 22 bp, Homo sapiens
tccaggcctctagccctctctt

SEQ ID NO: 7133752 - DNA, 18 bp, Homo sapiens
tccaggcctgaagtgtcc

SEQ ID NO: 7133753 - DNA, 18 bp, Homo sapiens
tccaggcctgaagtgtcc

SEQ ID NO: 7133754 - DNA, 18 bp, Homo sapiens
tccaggcctgaagtgtcc

SEQ ID NO: 7133755 - DNA, 22 bp, Homo sapiens
tccaggcctgactataaatgta

SEQ ID NO: 7133756 - DNA, 22 bp, Homo sapiens
tccaggcctgactataaatgta

SEQ ID NO: 7133757 - DNA, 22 bp, Homo sapiens
tccaattttctgatttcacttg

SEQ ID NO: 7133758 - DNA, 21 bp, Homo sapiens
tccaatttttaagactatggc

SEQ ID NO: 7133759 - DNA, 21 bp, Homo sapiens
tccaatttttaagactatggc

SEQ ID NO: 7133760 - DNA, 22 bp, Homo sapiens
tccacaaggcagctcctccagg

SEQ ID NO: 7133761 - DNA, 22 bp, Homo sapiens
tccaggcctctagcccctatct

SEQ ID NO: 7133762 - DNA, 22 bp, Homo sapiens
tccaggcctctagcccctatct

SEQ ID NO: 7133763 - DNA, 22 bp, Homo sapiens
tccaggcctctagcccctatct

SEQ ID NO: 7133764 - DNA, 22 bp, Homo sapiens
tccaggcctctagcccctatct

SEQ ID NO: 7133765 - DNA, 22 bp, Homo sapiens
tccaggcctctagccctctctt

SEQ ID NO: 7133766 - DNA, 22 bp, Homo sapiens
tccaggcctctagccctctctt

SEQ ID NO: 7133767 - DNA, 22 bp, Homo sapiens
tccaggcctctagccctctctt

SEQ ID NO: 7133768 - DNA, 22 bp, Homo sapiens
tccatgggaagattttgagtgg

SEQ ID NO: 7133769 - DNA, 18 bp, Homo sapiens
tccatggcttaacctcag

SEQ ID NO: 7133770 - DNA, 22 bp, Homo sapiens
tccatggagatggatgactgta

SEQ ID NO: 7133771 - DNA, 22 bp, Homo sapiens
tccatggagtttttatttggta

SEQ ID NO: 7133772 - DNA, 19 bp, Homo sapiens
tccatggctcttcatcctt

SEQ ID NO: 7133773 - DNA, 22 bp, Homo sapiens
tccattatacttctgattcaaa

SEQ ID NO: 7133774 - DNA, 22 bp, Homo sapiens
tccatgttgagaatgctataat

SEQ ID NO: 7133775 - DNA, 22 bp, Homo sapiens
tccatgttggtgattctaatgt

SEQ ID NO: 7133776 - DNA, 22 bp, Homo sapiens
tccattcaggccagtgcaaagt

SEQ ID NO: 7133777 - DNA, 22 bp, Homo sapiens
tccattatacttctgattcaaa

SEQ ID NO: 7133778 - DNA, 22 bp, Homo sapiens
tccattcagaaatctggctaca

SEQ ID NO: 7133779 - DNA, 22 bp, Homo sapiens
tccattcttttgctgtcttcct

SEQ ID NO: 7133780 - DNA, 22 bp, Homo sapiens
tccattgtctttggtcctagcc

SEQ ID NO: 7133781 - DNA, 22 bp, Homo sapiens
tccattgtgttacagagcattc

SEQ ID NO: 7133782 - DNA, 18 bp, Homo sapiens
tccattgttctactgtga

SEQ ID NO: 7133783 - DNA, 21 bp, Homo sapiens
tccattgttttcccagggttt

SEQ ID NO: 7133784 - DNA, 22 bp, Homo sapiens
tccatttaactgtccccagcac

SEQ ID NO: 7133785 - DNA, 22 bp, Homo sapiens
tccatttactattctcatatcg

SEQ ID NO: 7133786 - DNA, 22 bp, Homo sapiens
tcccaaagctactcttctgact

SEQ ID NO: 7133787 - DNA, 22 bp, Homo sapiens
tcccaaagaactgaatagtaat

SEQ ID NO: 7133788 - DNA, 22 bp, Homo sapiens
tcccaaaggtccgagcgggaat

SEQ ID NO: 7133789 - DNA, 22 bp, Homo sapiens
tcccaagagctctgggataagg

SEQ ID NO: 7133790 - DNA, 22 bp, Homo sapiens
tcccaagatgacacagtggacg

SEQ ID NO: 7133791 - DNA, 22 bp, Homo sapiens
tcccaagattattgagggaggg

SEQ ID NO: 7133792 - DNA, 22 bp, Homo sapiens
tcccagagaagagctggatgga

SEQ ID NO: 7133793 - DNA, 19 bp, Homo sapiens
tcccaagatttctgtatca

SEQ ID NO: 7133794 - DNA, 22 bp, Homo sapiens
tcccaagattattgagggaggg

SEQ ID NO: 7133795 - DNA, 22 bp, Homo sapiens
tcccaaagtattagcatttcaa

SEQ ID NO: 7133796 - DNA, 22 bp, Homo sapiens
tcccaaagtattagcatttcaa

SEQ ID NO: 7133797 - DNA, 22 bp, Homo sapiens
tcccaaagtcaagctgtgtctt

SEQ ID NO: 7133798 - DNA, 22 bp, Homo sapiens
tcccaaagtattagcatttcaa

SEQ ID NO: 7133799 - DNA, 22 bp, Homo sapiens
tcccaaatataatgcaagagac

SEQ ID NO: 7133800 - DNA, 22 bp, Homo sapiens
tcccaagacctggcatccaagt

SEQ ID NO: 7133801 - DNA, 22 bp, Homo sapiens
tcccagagcagatgtgctaaag

SEQ ID NO: 7133802 - DNA, 22 bp, Homo sapiens
tcccagagcagtactccaggag

SEQ ID NO: 7133803 - DNA, 22 bp, Homo sapiens
tcccagagcagatgtgctaaag

SEQ ID NO: 7133804 - DNA, 22 bp, Homo sapiens
tcccagagcagatgtgctaaag

SEQ ID NO: 7133805 - DNA, 22 bp, Homo sapiens
tcccagagccaagctatggatg

SEQ ID NO: 7133806 - DNA, 22 bp, Homo sapiens
tcccagagccaagctatggatg

SEQ ID NO: 7133807 - DNA, 22 bp, Homo sapiens
tcccagagcagtactccaggag

SEQ ID NO: 7133808 - DNA, 22 bp, Homo sapiens
tcccagagatttcctctccttc

SEQ ID NO: 7133809 - DNA, 22 bp, Homo sapiens
tcccagagatttcctctccttc

SEQ ID NO: 7133810 - DNA, 22 bp, Homo sapiens
tcccagagatttcctctccttc

SEQ ID NO: 7133811 - DNA, 22 bp, Homo sapiens
tcccagagacatcatttctccg

SEQ ID NO: 7133812 - DNA, 22 bp, Homo sapiens
tcccagagacagagcctcctcc

SEQ ID NO: 7133813 - DNA, 22 bp, Homo sapiens
tcccagccggtgcctgggtccc

SEQ ID NO: 7133814 - DNA, 22 bp, Homo sapiens
tcccagcctcctgacagttttg

SEQ ID NO: 7133815 - DNA, 22 bp, Homo sapiens
tcccagcctcctgacagttttg

SEQ ID NO: 7133816 - DNA, 22 bp, Homo sapiens
tcccagcctcctgacagttttg

SEQ ID NO: 7133817 - DNA, 23 bp, Homo sapiens
tcccagcctcttctcttgcatac

SEQ ID NO: 7133818 - DNA, 23 bp, Homo sapiens
tcccagcctcttctcttgcatac

SEQ ID NO: 7133819 - DNA, 22 bp, Homo sapiens
tcccagcctgacagtgcatcaa

SEQ ID NO: 7133820 - DNA, 22 bp, Homo sapiens
tcccagcataacaaactgcccg

SEQ ID NO: 7133821 - DNA, 22 bp, Homo sapiens
tcccagcataacaaactgcccg

SEQ ID NO: 7133822 - DNA, 22 bp, Homo sapiens
tcccagcattaatgcctgtcag

SEQ ID NO: 7133823 - DNA, 22 bp, Homo sapiens
tcccagcattaatgcctgtcag

SEQ ID NO: 7133824 - DNA, 22 bp, Homo sapiens
tcccagcattaatgcctgtcag

SEQ ID NO: 7133825 - DNA, 22 bp, Homo sapiens
tcccagccacaggtgtagccct

SEQ ID NO: 7133826 - DNA, 22 bp, Homo sapiens
tcccagccacaggtgtagccct

SEQ ID NO: 7133827 - DNA, 22 bp, Homo sapiens
tcccagccacaggtgtagccct

SEQ ID NO: 7133828 - DNA, 22 bp, Homo sapiens
tcccagccggtgcctgggtccc

SEQ ID NO: 7133829 - DNA, 22 bp, Homo sapiens
tcccagccggtgcctgggtccc

SEQ ID NO: 7133830 - DNA, 22 bp, Homo sapiens
tcccagccggtgcctgggtccc

SEQ ID NO: 7133831 - DNA, 22 bp, Homo sapiens
tcccagccggtgcctgggtccc

SEQ ID NO: 7133832 - DNA, 22 bp, Homo sapiens
tcccagccggtgcctgggtccc

SEQ ID NO: 7133833 - DNA, 22 bp, Homo sapiens
tcccagcataacaaactgcccg

SEQ ID NO: 7133834 - DNA, 22 bp, Homo sapiens
tcccagagtattagcaattgct

SEQ ID NO: 7133835 - DNA, 22 bp, Homo sapiens
tcccagagtattagcaattgct

SEQ ID NO: 7133836 - DNA, 22 bp, Homo sapiens
tcccagaggttgagtcacttat

SEQ ID NO: 7133837 - DNA, 22 bp, Homo sapiens
tcccagaggtctctgctggttc

SEQ ID NO: 7133838 - DNA, 22 bp, Homo sapiens
tcccagaggtctctgctggttc

SEQ ID NO: 7133839 - DNA, 22 bp, Homo sapiens
tcccagaggctccagtctctat

SEQ ID NO: 7133840 - DNA, 22 bp, Homo sapiens
tcccagaggctccagtctctat

SEQ ID NO: 7133841 - DNA, 22 bp, Homo sapiens
tcccagaggcagttggtaactt

SEQ ID NO: 7133842 - DNA, 22 bp, Homo sapiens
tcccagaggctccagtctctat

SEQ ID NO: 7133843 - DNA, 22 bp, Homo sapiens
tcccagagccaagctatggatg

SEQ ID NO: 7133844 - DNA, 22 bp, Homo sapiens
tcccagagccaagctatggatg

SEQ ID NO: 7133845 - DNA, 22 bp, Homo sapiens
tcccagagccaagctatggatg

SEQ ID NO: 7133846 - DNA, 22 bp, Homo sapiens
tcccaggccataaaactcagag

SEQ ID NO: 7133847 - DNA, 22 bp, Homo sapiens
tcccagccttccttgtggtgaa

SEQ ID NO: 7133848 - DNA, 22 bp, Homo sapiens
tcccagccttccttgtggtgaa

SEQ ID NO: 7133849 - DNA, 22 bp, Homo sapiens
tcccagcctttctttctccagc

SEQ ID NO: 7133850 - DNA, 22 bp, Homo sapiens
tcccagcctttctttctccagc

SEQ ID NO: 7133851 - DNA, 22 bp, Homo sapiens
tcccagcctttctttctccagc

SEQ ID NO: 7133852 - DNA, 22 bp, Homo sapiens
tcccagcctggaccctgccagt

SEQ ID NO: 7133853 - DNA, 22 bp, Homo sapiens
tcccagcctggaccctgccagt

SEQ ID NO: 7133854 - DNA, 22 bp, Homo sapiens
tcccagcctggaccctgccagt

SEQ ID NO: 7133855 - DNA, 22 bp, Homo sapiens
tcccagcctgacagtgcatcaa

SEQ ID NO: 7133856 - DNA, 22 bp, Homo sapiens
tcccagcctgacagtgcatcaa

SEQ ID NO: 7133857 - DNA, 22 bp, Homo sapiens
tcccagcctggaccctgccagt

SEQ ID NO: 7133858 - DNA, 22 bp, Homo sapiens
tcccagcctggaccctgccagt

SEQ ID NO: 7133859 - DNA, 22 bp, Homo sapiens
tcccagcctggaccctgccagt

SEQ ID NO: 7133860 - DNA, 22 bp, Homo sapiens
tcccagcctggaccctgccagt

SEQ ID NO: 7133861 - DNA, 22 bp, Homo sapiens
tcccagccttccagtctggttt

SEQ ID NO: 7133862 - DNA, 22 bp, Homo sapiens
tcccagccttccttgtggtgaa

SEQ ID NO: 7133863 - DNA, 22 bp, Homo sapiens
tcccagccttccagtctggttt

SEQ ID NO: 7133864 - DNA, 22 bp, Homo sapiens
tcccagccttccagtctggttt

SEQ ID NO: 7133865 - DNA, 22 bp, Homo sapiens
tcccagccttccagtctggttt

SEQ ID NO: 7133866 - DNA, 22 bp, Homo sapiens
tcccagccttatctcccctggc

SEQ ID NO: 7133867 - DNA, 22 bp, Homo sapiens
tcccagccttatctcccctggc

SEQ ID NO: 7133868 - DNA, 22 bp, Homo sapiens
tcccagccttatctcccctggc

SEQ ID NO: 7133869 - DNA, 22 bp, Homo sapiens
tcccagccttatctcccctggc

SEQ ID NO: 7133870 - DNA, 22 bp, Homo sapiens
tcccagccttatctcccctggc

SEQ ID NO: 7133871 - DNA, 22 bp, Homo sapiens
tccctctgctagtgcttgagct

SEQ ID NO: 7133872 - DNA, 22 bp, Homo sapiens
tccctctcttgggcgtggctca

SEQ ID NO: 7133873 - DNA, 22 bp, Homo sapiens
tccctctggaggctctagggga

SEQ ID NO: 7133874 - DNA, 22 bp, Homo sapiens
tccctctgggctccagcacgga

SEQ ID NO: 7133875 - DNA, 22 bp, Homo sapiens
tccctctgggctccagcacgga

SEQ ID NO: 7133876 - DNA, 22 bp, Homo sapiens
tccctctgggctggagcagggt

SEQ ID NO: 7133877 - DNA, 22 bp, Homo sapiens
tccctctgggctggagcagggt

SEQ ID NO: 7133878 - DNA, 22 bp, Homo sapiens
tccctctggtcctcggtggaga

SEQ ID NO: 7133879 - DNA, 22 bp, Homo sapiens
tccctctggtctggacgccata

SEQ ID NO: 7133880 - DNA, 22 bp, Homo sapiens
tccctctggtctggacgccata

SEQ ID NO: 7133881 - DNA, 22 bp, Homo sapiens
tccctctggtctggacgccata

SEQ ID NO: 7133882 - DNA, 22 bp, Homo sapiens
tccctctgtggttggttctgtc

SEQ ID NO: 7133883 - DNA, 19 bp, Homo sapiens
tccctccctgtaatctcac

SEQ ID NO: 7133884 - DNA, 19 bp, Homo sapiens
tccctccctgtaatctcac

SEQ ID NO: 7133885 - DNA, 19 bp, Homo sapiens
tccctccctgtaatctcac

SEQ ID NO: 7133886 - DNA, 19 bp, Homo sapiens
tccctccctgtaatctcac

SEQ ID NO: 7133887 - DNA, 18 bp, Homo sapiens
tccctccctgctgtggcc

SEQ ID NO: 7133888 - DNA, 18 bp, Homo sapiens
tccctccctgctgtggcc

SEQ ID NO: 7133889 - DNA, 18 bp, Homo sapiens
tccctccctgctgtggcc

SEQ ID NO: 7133890 - DNA, 20 bp, Homo sapiens
tccctccctccagctctggg

SEQ ID NO: 7133891 - DNA, 20 bp, Homo sapiens
tccctccctccagctctggg

SEQ ID NO: 7133892 - DNA, 20 bp, Homo sapiens
tccctccctccagctctggg

SEQ ID NO: 7133893 - DNA, 18 bp, Homo sapiens
tccctccctgctgtggcc

SEQ ID NO: 7133894 - DNA, 22 bp, Homo sapiens
tccctgcctcctggcagtgcca

SEQ ID NO: 7133895 - DNA, 22 bp, Homo sapiens
tccctgccctgccttcatggtt

SEQ ID NO: 7133896 - DNA, 22 bp, Homo sapiens
tccctgccctgccttcatggtt

SEQ ID NO: 7133897 - DNA, 22 bp, Homo sapiens
tccctgccctgccttcatggtt

SEQ ID NO: 7133898 - DNA, 22 bp, Homo sapiens
tccctgagaaagcccaggaggt

SEQ ID NO: 7133899 - DNA, 22 bp, Homo sapiens
tccctgagaaagcccaggaggt

SEQ ID NO: 7133900 - DNA, 22 bp, Homo sapiens
tccctgagaaagcccaggaggt

SEQ ID NO: 7133901 - DNA, 22 bp, Homo sapiens
tccctgagactctggagtgtaa

SEQ ID NO: 7133902 - DNA, 22 bp, Homo sapiens
tccctgagactctggagtgtaa

SEQ ID NO: 7133903 - DNA, 22 bp, Homo sapiens
tccctgagagcactggggagcc

SEQ ID NO: 7133904 - DNA, 22 bp, Homo sapiens
tccctgaaccactagtgatgag

SEQ ID NO: 7133905 - DNA, 22 bp, Homo sapiens
tccctgaaccactagtgatgag

SEQ ID NO: 7133906 - DNA, 22 bp, Homo sapiens
tccctgaaccactagtgatgag

SEQ ID NO: 7133907 - DNA, 22 bp, Homo sapiens
tccctgaagccagggaaggaag

SEQ ID NO: 7133908 - DNA, 22 bp, Homo sapiens
tccctgaatctcgaactagcct

SEQ ID NO: 7133909 - DNA, 22 bp, Homo sapiens
tccctctgtgttgggcatgcct

SEQ ID NO: 7133910 - DNA, 22 bp, Homo sapiens
tccctctgtgttgggcatgcct

SEQ ID NO: 7133911 - DNA, 22 bp, Homo sapiens
tccctctgttctgttccaagtg

SEQ ID NO: 7133912 - DNA, 22 bp, Homo sapiens
tccctgaaacatctctgtggat

SEQ ID NO: 7133913 - DNA, 22 bp, Homo sapiens
tccctgaaacatctctgtggat

SEQ ID NO: 7133914 - DNA, 22 bp, Homo sapiens
tccctccccacttctgagcttt

SEQ ID NO: 7133915 - DNA, 22 bp, Homo sapiens
tccctccccacttctgagcttt

SEQ ID NO: 7133916 - DNA, 22 bp, Homo sapiens
tccctccccacttctgagcttt

SEQ ID NO: 7133917 - DNA, 22 bp, Homo sapiens
tccctccaggcagctgggtact

SEQ ID NO: 7133918 - DNA, 22 bp, Homo sapiens
tccctccataacagaggtgagc

SEQ ID NO: 7133919 - DNA, 22 bp, Homo sapiens
tccctccccacttctgagcttt

SEQ ID NO: 7133920 - DNA, 20 bp, Homo sapiens
tccctccctccagctctggg

SEQ ID NO: 7133921 - DNA, 20 bp, Homo sapiens
tccctcagtttccagccctg

SEQ ID NO: 7133922 - DNA, 22 bp, Homo sapiens
tccctccacacctgctggtacc

SEQ ID NO: 7133923 - DNA, 22 bp, Homo sapiens
tccctccagaatggtgaggaag

SEQ ID NO: 7133924 - DNA, 22 bp, Homo sapiens
tccctccagaatggtgaggaag

SEQ ID NO: 7133925 - DNA, 20 bp, Homo sapiens
tccctcagtcctggctttgt

SEQ ID NO: 7133926 - DNA, 19 bp, Homo sapiens
tccctcagtctgccaggcc

SEQ ID NO: 7133927 - DNA, 19 bp, Homo sapiens
tccctcagtctgccaggcc

SEQ ID NO: 7133928 - DNA, 22 bp, Homo sapiens
tccctcagtccctggacaggca

SEQ ID NO: 7133929 - DNA, 22 bp, Homo sapiens
tccctcaggtggttcttgtttc

SEQ ID NO: 7133930 - DNA, 20 bp, Homo sapiens
tccctcaggtcattgggctg

SEQ ID NO: 7133931 - DNA, 22 bp, Homo sapiens
tccctcaggtggttcttgtttc

SEQ ID NO: 7133932 - DNA, 22 bp, Homo sapiens
tccctcagggtgcagttgcttt

SEQ ID NO: 7133933 - DNA, 22 bp, Homo sapiens
tccctcaggacccaacttgtaa

SEQ ID NO: 7133934 - DNA, 23 bp, Homo sapiens
tccctcaggccttatctccatct

SEQ ID NO: 7133935 - DNA, 23 bp, Homo sapiens
tccctcaggccttatctccatct

SEQ ID NO: 7133936 - DNA, 22 bp, Homo sapiens
tccctcagcttgtctccatgca

SEQ ID NO: 7133937 - DNA, 22 bp, Homo sapiens
tccctcagcttgtctccatgca

SEQ ID NO: 7133938 - DNA, 15 bp, Homo sapiens
tccctcagctaaaga

SEQ ID NO: 7133939 - DNA, 22 bp, Homo sapiens
tccctcagctcatatttatgcc

SEQ ID NO: 7133940 - DNA, 22 bp, Homo sapiens
tcccgataggcagggctctggc

SEQ ID NO: 7133941 - DNA, 21 bp, Homo sapiens
tccctcagaaggtagccaagc

SEQ ID NO: 7133942 - DNA, 18 bp, Homo sapiens
tccctcagaattatagaa

SEQ ID NO: 7133943 - DNA, 22 bp, Homo sapiens
tccctcagacagatgtgttcct

SEQ ID NO: 7133944 - DNA, 22 bp, Homo sapiens
tcccagggactggatgatgcag

SEQ ID NO: 7133945 - DNA, 22 bp, Homo sapiens
tcccagggactctctgccttcc

SEQ ID NO: 7133946 - DNA, 22 bp, Homo sapiens
tcccagggactctctgccttcc

SEQ ID NO: 7133947 - DNA, 22 bp, Homo sapiens
tcccagggacccagcctgatac

SEQ ID NO: 7133948 - DNA, 20 bp, Homo sapiens
tccctcagcacttctacctc

SEQ ID NO: 7133949 - DNA, 22 bp, Homo sapiens
tccctcagattggcaattagat

SEQ ID NO: 7133950 - DNA, 22 bp, Homo sapiens
tccctcagcaggaactggcctg

SEQ ID NO: 7133951 - DNA, 22 bp, Homo sapiens
tccctcagcaggaactggcctg

SEQ ID NO: 7133952 - DNA, 22 bp, Homo sapiens
tccctcagcaggaatgtggcag

SEQ ID NO: 7133953 - DNA, 22 bp, Homo sapiens
tccctcagagggcaagcgcaga

SEQ ID NO: 7133954 - DNA, 22 bp, Homo sapiens
tccctcagatgagctcctagca

SEQ ID NO: 7133955 - DNA, 22 bp, Homo sapiens
tccctcagatgagctcctagca

SEQ ID NO: 7133956 - DNA, 22 bp, Homo sapiens
tccctcagagggcaagcgcaga

SEQ ID NO: 7133957 - DNA, 22 bp, Homo sapiens
tccctcagagaccgtggtgcag

SEQ ID NO: 7133958 - DNA, 21 bp, Homo sapiens
tccctcagacagggtgcctat

SEQ ID NO: 7133959 - DNA, 22 bp, Homo sapiens
tcccaggctggcaggcagcagt

SEQ ID NO: 7133960 - DNA, 22 bp, Homo sapiens
tcccaggctggcaggcagcagt

SEQ ID NO: 7133961 - DNA, 20 bp, Homo sapiens
tcccaggctgggctccagct

SEQ ID NO: 7133962 - DNA, 20 bp, Homo sapiens
tcccaggctgggctccagct

SEQ ID NO: 7133963 - DNA, 20 bp, Homo sapiens
tcccaggctccaccctagac

SEQ ID NO: 7133964 - DNA, 22 bp, Homo sapiens
tcccaggctggcaggcagcagt

SEQ ID NO: 7133965 - DNA, 22 bp, Homo sapiens
tcccaggctaggcctctgcgtt

SEQ ID NO: 7133966 - DNA, 22 bp, Homo sapiens
tcccaggctaggcctctgcgtt

SEQ ID NO: 7133967 - DNA, 22 bp, Homo sapiens
tcccaggctaggcctctgcgtt

SEQ ID NO: 7133968 - DNA, 20 bp, Homo sapiens
tcccaggctccaccctagac

SEQ ID NO: 7133969 - DNA, 20 bp, Homo sapiens
tcccaggctccaccctagac

SEQ ID NO: 7133970 - DNA, 20 bp, Homo sapiens
tcccaggctccaccctagac

SEQ ID NO: 7133971 - DNA, 22 bp, Homo sapiens
tcccagggacaccaagctgttt

SEQ ID NO: 7133972 - DNA, 22 bp, Homo sapiens
tcccaggctgggggcctgaagt

SEQ ID NO: 7133973 - DNA, 22 bp, Homo sapiens
tcccaggctgggggcctgaagt

SEQ ID NO: 7133974 - DNA, 23 bp, Homo sapiens
tcccagggaaggtgagcgaggct

SEQ ID NO: 7133975 - DNA, 23 bp, Homo sapiens
tcccagggaaggtgagcgaggct

SEQ ID NO: 7133976 - DNA, 22 bp, Homo sapiens
tcccaggctgggggcctgaagt

SEQ ID NO: 7133977 - DNA, 22 bp, Homo sapiens
tcccaggctgggggcctgaagt

SEQ ID NO: 7133978 - DNA, 22 bp, Homo sapiens
tcccaggctggggccaggtgac

SEQ ID NO: 7133979 - DNA, 22 bp, Homo sapiens
tcccaggctggggccaggtgac

SEQ ID NO: 7133980 - DNA, 20 bp, Homo sapiens
tcccaggctgggctccagct

SEQ ID NO: 7133981 - DNA, 20 bp, Homo sapiens
tcccaggctgggctccagct

SEQ ID NO: 7133982 - DNA, 22 bp, Homo sapiens
tccctggcagctgtcctttcag

SEQ ID NO: 7133983 - DNA, 22 bp, Homo sapiens
tccctggcagctaagggtggtc

SEQ ID NO: 7133984 - DNA, 22 bp, Homo sapiens
tccctggcagctaagggtggtc

SEQ ID NO: 7133985 - DNA, 22 bp, Homo sapiens
tccctggcagctaagggtggtc

SEQ ID NO: 7133986 - DNA, 22 bp, Homo sapiens
tccctggcactgctgtgattag

SEQ ID NO: 7133987 - DNA, 22 bp, Homo sapiens
tccctggcacaagaaggctgtc

SEQ ID NO: 7133988 - DNA, 22 bp, Homo sapiens
tccctggcactgctgtgattag

SEQ ID NO: 7133989 - DNA, 22 bp, Homo sapiens
tccctggcactgctgtgattag

SEQ ID NO: 7133990 - DNA, 23 bp, Homo sapiens
tccctggaggcaggtccagggcc

SEQ ID NO: 7133991 - DNA, 22 bp, Homo sapiens
tccctggcacaagaaggctgtc

SEQ ID NO: 7133992 - DNA, 22 bp, Homo sapiens
tccctggcacaagaaggctgtc

SEQ ID NO: 7133993 - DNA, 22 bp, Homo sapiens
tccctggcacaagaaggctgtc

SEQ ID NO: 7133994 - DNA, 22 bp, Homo sapiens
tccctgcctcctggcagtgcca

SEQ ID NO: 7133995 - DNA, 22 bp, Homo sapiens
tccctggacaacagacttcact

SEQ ID NO: 7133996 - DNA, 22 bp, Homo sapiens
tccctggacagccttgcctggg

SEQ ID NO: 7133997 - DNA, 22 bp, Homo sapiens
tccctggctgggggctgccttg

SEQ ID NO: 7133998 - DNA, 22 bp, Homo sapiens
tccctggctggtgtagagggat

SEQ ID NO: 7133999 - DNA, 23 bp, Homo sapiens
tccctggccgcaatggccgcctt

SEQ ID NO: 7134000 - DNA, 22 bp, Homo sapiens
tccctggcctggaaggatatca

SEQ ID NO: 7134001 - DNA, 19 bp, Homo sapiens
tccctggcgcctctcgggc

SEQ ID NO: 7134002 - DNA, 19 bp, Homo sapiens
tccctggcgcctctcgggc

SEQ ID NO: 7134003 - DNA, 19 bp, Homo sapiens
tccctggcgcctctcgggc

SEQ ID NO: 7134004 - DNA, 22 bp, Homo sapiens
tccctggctgggggctgccttg

SEQ ID NO: 7134005 - DNA, 22 bp, Homo sapiens
tccctggcagctgtcctttcag

SEQ ID NO: 7134006 - DNA, 22 bp, Homo sapiens
tccctggccattcctctaggcc

SEQ ID NO: 7134007 - DNA, 22 bp, Homo sapiens
tccctggccattcctctaggcc

SEQ ID NO: 7134008 - DNA, 22 bp, Homo sapiens
tccctggccattcctctaggcc

SEQ ID NO: 7134009 - DNA, 23 bp, Homo sapiens
tccctggccgcaatggccgcctt

SEQ ID NO: 7134010 - DNA, 22 bp, Homo sapiens
tccctggcctggaaggatatca

SEQ ID NO: 7134011 - DNA, 22 bp, Homo sapiens
tccctgggaaatgtcagtttca

SEQ ID NO: 7134012 - DNA, 22 bp, Homo sapiens
tccctggctgtgttcaggtgcg

SEQ ID NO: 7134013 - DNA, 22 bp, Homo sapiens
tccctggctggtgtagagggat

SEQ ID NO: 7134014 - DNA, 22 bp, Homo sapiens
tccctggctgtgttcaggtgcg

SEQ ID NO: 7134015 - DNA, 22 bp, Homo sapiens
tccctggctgtgttcaggtgcg

SEQ ID NO: 7134016 - DNA, 22 bp, Homo sapiens
tccctgggaacaaaggatgaga

SEQ ID NO: 7134017 - DNA, 22 bp, Homo sapiens
tccctgggaattaatatttgga

SEQ ID NO: 7134018 - DNA, 22 bp, Homo sapiens
tccctgggaccggcagctcaca

SEQ ID NO: 7134019 - DNA, 22 bp, Homo sapiens
tcctagaatgcacctctgctgt

SEQ ID NO: 7134020 - DNA, 22 bp, Homo sapiens
tcctagaatctttgtaagattg

SEQ ID NO: 7134021 - DNA, 19 bp, Homo sapiens
tcctagaatgagggtgttg

SEQ ID NO: 7134022 - DNA, 22 bp, Homo sapiens
tcctagaatgcacctctgctgt

SEQ ID NO: 7134023 - DNA, 22 bp, Homo sapiens
tcctagagcctccagagggaga

SEQ ID NO: 7134024 - DNA, 22 bp, Homo sapiens
tcctagaatagtgtgtctggag

SEQ ID NO: 7134025 - DNA, 22 bp, Homo sapiens
tcctagaatagtgtgtctggag

SEQ ID NO: 7134026 - DNA, 22 bp, Homo sapiens
tcctagaatatttgtggaggtt

SEQ ID NO: 7134027 - DNA, 22 bp, Homo sapiens
tcctagaataatctttgactgc

SEQ ID NO: 7134028 - DNA, 22 bp, Homo sapiens
tcctaacgtataatttcaggtt

SEQ ID NO: 7134029 - DNA, 22 bp, Homo sapiens
tcctagctggcctctcaccagc

SEQ ID NO: 7134030 - DNA, 22 bp, Homo sapiens
tcctagggatgccatcgtgtaa

SEQ ID NO: 7134031 - DNA, 22 bp, Homo sapiens
tccctgggaccggcagctcaca

SEQ ID NO: 7134032 - DNA, 22 bp, Homo sapiens
tccctgggaccggcagctcaca

SEQ ID NO: 7134033 - DNA, 22 bp, Homo sapiens
tccctgggacggccttttggag

SEQ ID NO: 7134034 - DNA, 22 bp, Homo sapiens
tccctgggactcagacatggaa

SEQ ID NO: 7134035 - DNA, 22 bp, Homo sapiens
tccctgggactcagacatggaa

SEQ ID NO: 7134036 - DNA, 15 bp, Homo sapiens
tccctgggagatggt

SEQ ID NO: 7134037 - DNA, 22 bp, Homo sapiens
tccctgggagatgatgatgagg

SEQ ID NO: 7134038 - DNA, 22 bp, Homo sapiens
tccctgggagatgatgatgagg

SEQ ID NO: 7134039 - DNA, 22 bp, Homo sapiens
tccctgggactcagacatggaa

SEQ ID NO: 7134040 - DNA, 20 bp, Homo sapiens
tcctaacgaggcccattgca

SEQ ID NO: 7134041 - DNA, 22 bp, Homo sapiens
tcctaacgctggttctatcaac

SEQ ID NO: 7134042 - DNA, 22 bp, Homo sapiens
tccgtggagattttgtgcaggg

SEQ ID NO: 7134043 - DNA, 22 bp, Homo sapiens
tccgtggggcctgtggcttccg

SEQ ID NO: 7134044 - DNA, 22 bp, Homo sapiens
tccgtgttccaagacagggtgg

SEQ ID NO: 7134045 - DNA, 18 bp, Homo sapiens
tccctgggatataattac

SEQ ID NO: 7134046 - DNA, 16 bp, Homo sapiens
tccctgggagtggtgg

SEQ ID NO: 7134047 - DNA, 22 bp, Homo sapiens
tccggtgctgaaggcccaggtg

SEQ ID NO: 7134048 - DNA, 22 bp, Homo sapiens
tccgtacagctacaaaacctta

SEQ ID NO: 7134049 - DNA, 22 bp, Homo sapiens
tccgtgagattaagcagaattc

SEQ ID NO: 7134050 - DNA, 22 bp, Homo sapiens
tcctcagaatcacctggcagct

SEQ ID NO: 7134051 - DNA, 22 bp, Homo sapiens
tcctcagaatcacctggcagct

SEQ ID NO: 7134052 - DNA, 22 bp, Homo sapiens
tcctcagaatcacctggcagct

SEQ ID NO: 7134053 - DNA, 22 bp, Homo sapiens
tcctcagaatggatggcagggg

SEQ ID NO: 7134054 - DNA, 22 bp, Homo sapiens
tcctcagaatggatggcagggg

SEQ ID NO: 7134055 - DNA, 22 bp, Homo sapiens
tcctcacatggtgagccacaca

SEQ ID NO: 7134056 - DNA, 22 bp, Homo sapiens
tcctcacagtcaacactttgag

SEQ ID NO: 7134057 - DNA, 22 bp, Homo sapiens
tcctcacagggcaggaaggagg

SEQ ID NO: 7134058 - DNA, 22 bp, Homo sapiens
tcctcacagtcaacactttgag

SEQ ID NO: 7134059 - DNA, 22 bp, Homo sapiens
tcctcacatggtgagccacaca

SEQ ID NO: 7134060 - DNA, 22 bp, Homo sapiens
tcctcactgcagtgctccgagc

SEQ ID NO: 7134061 - DNA, 22 bp, Homo sapiens
tcctcactgcagtgctccgagc

SEQ ID NO: 7134062 - DNA, 22 bp, Homo sapiens
tcctcacagctggttcattcag

SEQ ID NO: 7134063 - DNA, 22 bp, Homo sapiens
tcctcacagcatgaccaggcag

SEQ ID NO: 7134064 - DNA, 22 bp, Homo sapiens
tcctcacagcatgaccaggcag

SEQ ID NO: 7134065 - DNA, 22 bp, Homo sapiens
tcctcacagcatgaccaggcag

SEQ ID NO: 7134066 - DNA, 22 bp, Homo sapiens
tcctcacagatgggtgcatagc

SEQ ID NO: 7134067 - DNA, 22 bp, Homo sapiens
tcctcacagagtggcaggcaat

SEQ ID NO: 7134068 - DNA, 22 bp, Homo sapiens
tcctcacaagcatcctgtctca

SEQ ID NO: 7134069 - DNA, 22 bp, Homo sapiens
tcctcacacccataccactgac

SEQ ID NO: 7134070 - DNA, 22 bp, Homo sapiens
tcctcacactatagatgaggat

SEQ ID NO: 7134071 - DNA, 22 bp, Homo sapiens
tcctcacactatagatgaggat

SEQ ID NO: 7134072 - DNA, 22 bp, Homo sapiens
tcctcacagagtggcaggcaat

SEQ ID NO: 7134073 - DNA, 22 bp, Homo sapiens
tcctcacagagtggcaggcaat

SEQ ID NO: 7134074 - DNA, 22 bp, Homo sapiens
tcctagttctctgccagtcgct

SEQ ID NO: 7134075 - DNA, 22 bp, Homo sapiens
tcctatgttttcccctagagaa

SEQ ID NO: 7134076 - DNA, 22 bp, Homo sapiens
tcctattagaatgattaaattc

SEQ ID NO: 7134077 - DNA, 22 bp, Homo sapiens
tcctcaaagttgtataaatatt

SEQ ID NO: 7134078 - DNA, 22 bp, Homo sapiens
tcctcaaatatttacttactga

SEQ ID NO: 7134079 - DNA, 22 bp, Homo sapiens
tcctcaaattagcagatcatag

SEQ ID NO: 7134080 - DNA, 22 bp, Homo sapiens
tcctcacaagcaagcacaggta

SEQ ID NO: 7134081 - DNA, 22 bp, Homo sapiens
tcctcacaagcaagcacaggta

SEQ ID NO: 7134082 - DNA, 22 bp, Homo sapiens
tcctcacaagcaagcacaggta

SEQ ID NO: 7134083 - DNA, 22 bp, Homo sapiens
tcctcacaagcaagcacaggta

SEQ ID NO: 7134084 - DNA, 21 bp, Homo sapiens
tcctcagggccccagagcact

SEQ ID NO: 7134085 - DNA, 21 bp, Homo sapiens
tcctcagggccccagagcact

SEQ ID NO: 7134086 - DNA, 21 bp, Homo sapiens
tcctcagggccccagagcact

SEQ ID NO: 7134087 - DNA, 21 bp, Homo sapiens
tcctcagggccccagagcact

SEQ ID NO: 7134088 - DNA, 22 bp, Homo sapiens
tcctcagggcggcctccgtctt

SEQ ID NO: 7134089 - DNA, 22 bp, Homo sapiens
tcctcagggcggcctccgtctt

SEQ ID NO: 7134090 - DNA, 19 bp, Homo sapiens
tcctcaggggctcacagac

SEQ ID NO: 7134091 - DNA, 19 bp, Homo sapiens
tcctcaggggctcacagac

SEQ ID NO: 7134092 - DNA, 19 bp, Homo sapiens
tcctcaggggctcacagac

SEQ ID NO: 7134093 - DNA, 19 bp, Homo sapiens
tcctcaggggctcacagac

SEQ ID NO: 7134094 - DNA, 19 bp, Homo sapiens
tcctcaggggctcacagac

SEQ ID NO: 7134095 - DNA, 22 bp, Homo sapiens
tcctcagggggccaacccagcc

SEQ ID NO: 7134096 - DNA, 22 bp, Homo sapiens
tcctcagggggccaacccagcc

SEQ ID NO: 7134097 - DNA, 22 bp, Homo sapiens
tcctcaggggtttcaggtgtac

SEQ ID NO: 7134098 - DNA, 22 bp, Homo sapiens
tcctcaggggtttcaggtgtac

SEQ ID NO: 7134099 - DNA, 22 bp, Homo sapiens
tcctcaggtcaaagcaggagaa

SEQ ID NO: 7134100 - DNA, 22 bp, Homo sapiens
tcctcaggtcaaagcaggagaa

SEQ ID NO: 7134101 - DNA, 22 bp, Homo sapiens
tcctcaggtcaaagcaggagaa

SEQ ID NO: 7134102 - DNA, 22 bp, Homo sapiens
tcctcaggtcaaagcaggagaa

SEQ ID NO: 7134103 - DNA, 22 bp, Homo sapiens
tcctcaggtcaaagcaggagaa

SEQ ID NO: 7134104 - DNA, 22 bp, Homo sapiens
tcctcagacaccctgctggctt

SEQ ID NO: 7134105 - DNA, 22 bp, Homo sapiens
tcctcagcattagcacagacat

SEQ ID NO: 7134106 - DNA, 23 bp, Homo sapiens
tcctcagcatgttttgtcatgta

SEQ ID NO: 7134107 - DNA, 22 bp, Homo sapiens
tcctcagcatggaatctggact

SEQ ID NO: 7134108 - DNA, 21 bp, Homo sapiens
tatggtaaccagacaagaatg

SEQ ID NO: 7134109 - DNA, 21 bp, Homo sapiens
tatggtaaccagacaagaatg

SEQ ID NO: 7134110 - DNA, 22 bp, Homo sapiens
tatggtagaaaaactgagtccc

SEQ ID NO: 7134111 - DNA, 22 bp, Homo sapiens
tatgggcatataaagaagtatg

SEQ ID NO: 7134112 - DNA, 22 bp, Homo sapiens
tatgggctgggtatgagctggt

SEQ ID NO: 7134113 - DNA, 22 bp, Homo sapiens
tatgggctgggtatgagctggt

SEQ ID NO: 7134114 - DNA, 22 bp, Homo sapiens
tatggcttgtccctggtcagtc

SEQ ID NO: 7134115 - DNA, 22 bp, Homo sapiens
tatggctttaaattgaaggagt

SEQ ID NO: 7134116 - DNA, 22 bp, Homo sapiens
tatggctttaaattgaaggagt

SEQ ID NO: 7134117 - DNA, 21 bp, Homo sapiens
tatggctttactaagctgcac

SEQ ID NO: 7134118 - DNA, 21 bp, Homo sapiens
tatggctttactaagctgcac

SEQ ID NO: 7134119 - DNA, 22 bp, Homo sapiens
tatggctttctccatagggcag

SEQ ID NO: 7134120 - DNA, 22 bp, Homo sapiens
tatggcttttcattcctatgtg

SEQ ID NO: 7134121 - DNA, 22 bp, Homo sapiens
tatgtaaaaattcatcaggctg

SEQ ID NO: 7134122 - DNA, 22 bp, Homo sapiens
tatgtaaaggattgagatgaat

SEQ ID NO: 7134123 - DNA, 22 bp, Homo sapiens
tatgtaaaggattgagatgaat

SEQ ID NO: 7134124 - DNA, 22 bp, Homo sapiens
tatgtaaaaattcatcaggctg

SEQ ID NO: 7134125 - DNA, 22 bp, Homo sapiens
tatgtaagttgcaaatgaagga

SEQ ID NO: 7134126 - DNA, 22 bp, Homo sapiens
tatgtacaagcacacatgtgac

SEQ ID NO: 7134127 - DNA, 22 bp, Homo sapiens
tatgtacaagcacacatgtgac

SEQ ID NO: 7134128 - DNA, 22 bp, Homo sapiens
tatgtacatacatgtgcatacg

SEQ ID NO: 7134129 - DNA, 22 bp, Homo sapiens
tatgtagacaggctgcttttcc

SEQ ID NO: 7134130 - DNA, 22 bp, Homo sapiens
tatgtactcatcaactattgaa

SEQ ID NO: 7134131 - DNA, 22 bp, Homo sapiens
tatgtactctaatttgtctcat

SEQ ID NO: 7134132 - DNA, 22 bp, Homo sapiens
tatgtacatatacacgtgtgtg

SEQ ID NO: 7134133 - DNA, 22 bp, Homo sapiens
tatgtacatatacacgtgtgtg

SEQ ID NO: 7134134 - DNA, 22 bp, Homo sapiens
tatgtacatcgttgaattcaaa

SEQ ID NO: 7134135 - DNA, 22 bp, Homo sapiens
tatgtacatcgttgaattcaaa

SEQ ID NO: 7134136 - DNA, 19 bp, Homo sapiens
tatgacaagtactagttct

SEQ ID NO: 7134137 - DNA, 22 bp, Homo sapiens
tatgctttaacattaaacaaca

SEQ ID NO: 7134138 - DNA, 22 bp, Homo sapiens
tatgctttaaccctcttatatt

SEQ ID NO: 7134139 - DNA, 22 bp, Homo sapiens
tatgctttcattcatatgtgag

SEQ ID NO: 7134140 - DNA, 22 bp, Homo sapiens
tatgctttcattcatatgtgag

SEQ ID NO: 7134141 - DNA, 22 bp, Homo sapiens
tatgctttacttttcattgtga

SEQ ID NO: 7134142 - DNA, 22 bp, Homo sapiens
tatgctttacttttcattgtga

SEQ ID NO: 7134143 - DNA, 20 bp, Homo sapiens
tatgctttttataagattga

SEQ ID NO: 7134144 - DNA, 20 bp, Homo sapiens
tatgctttttataagattga

SEQ ID NO: 7134145 - DNA, 22 bp, Homo sapiens
tatgctttgatttcctcagctg

SEQ ID NO: 7134146 - DNA, 22 bp, Homo sapiens
tatgcttttaacctgtaactga

SEQ ID NO: 7134147 - DNA, 22 bp, Homo sapiens
tatgctttgcaattggaaaagg

SEQ ID NO: 7134148 - DNA, 22 bp, Homo sapiens
tatgctttgcaattggaaaagg

SEQ ID NO: 7134149 - DNA, 22 bp, Homo sapiens
tatggaaagctctttttgattg

SEQ ID NO: 7134150 - DNA, 22 bp, Homo sapiens
tatggaaagctctttttgattg

SEQ ID NO: 7134151 - DNA, 22 bp, Homo sapiens
tatggaaactaattcatttttc

SEQ ID NO: 7134152 - DNA, 22 bp, Homo sapiens
tatggaaagctctttttgattg

SEQ ID NO: 7134153 - DNA, 22 bp, Homo sapiens
tatggaaagtgttttcttctgt

SEQ ID NO: 7134154 - DNA, 22 bp, Homo sapiens
tatggaaaaatgtatcttgtca

SEQ ID NO: 7134155 - DNA, 22 bp, Homo sapiens
tatggaaaaatgtatcttgtca

SEQ ID NO: 7134156 - DNA, 22 bp, Homo sapiens
tatggaaaaatgtatcttgtca

SEQ ID NO: 7134157 - DNA, 22 bp, Homo sapiens
tatggaatggctattttctagg

SEQ ID NO: 7134158 - DNA, 22 bp, Homo sapiens
tatggaatggctattttctagg

SEQ ID NO: 7134159 - DNA, 22 bp, Homo sapiens
tatggacatctgaagttgcaga

SEQ ID NO: 7134160 - DNA, 22 bp, Homo sapiens
tatggaaataattagacaagtg

SEQ ID NO: 7134161 - DNA, 22 bp, Homo sapiens
tatggaaataattagacaagtg

SEQ ID NO: 7134162 - DNA, 22 bp, Homo sapiens
tatggaaataattagacaagtg

SEQ ID NO: 7134163 - DNA, 22 bp, Homo sapiens
tatggaaataattagacaagtg

SEQ ID NO: 7134164 - DNA, 22 bp, Homo sapiens
tatggaaataattagacaagtg

SEQ ID NO: 7134165 - DNA, 22 bp, Homo sapiens
tatggacatgagtcaaggtgct

SEQ ID NO: 7134166 - DNA, 22 bp, Homo sapiens
tatggacatgctgggctggata

SEQ ID NO: 7134167 - DNA, 22 bp, Homo sapiens
tatggcttgagtttcagactat

SEQ ID NO: 7134168 - DNA, 20 bp, Homo sapiens
tatggcttggcaaagcttca

SEQ ID NO: 7134169 - DNA, 22 bp, Homo sapiens
tattaagatacgtagttgtaaa

SEQ ID NO: 7134170 - DNA, 22 bp, Homo sapiens
tattaagatacgtagttgtaaa

SEQ ID NO: 7134171 - DNA, 22 bp, Homo sapiens
tattaagtggtgagtactgcca

SEQ ID NO: 7134172 - DNA, 22 bp, Homo sapiens
tattaataagtgactactagct

SEQ ID NO: 7134173 - DNA, 22 bp, Homo sapiens
tattaacatgaactgacttttc

SEQ ID NO: 7134174 - DNA, 22 bp, Homo sapiens
tattaacatgaactgacttttc

SEQ ID NO: 7134175 - DNA, 22 bp, Homo sapiens
tattaacattttatgaaaataa

SEQ ID NO: 7134176 - DNA, 22 bp, Homo sapiens
tattaacattttatgaaaataa

SEQ ID NO: 7134177 - DNA, 22 bp, Homo sapiens
tattaagagatgtatgaagaga

SEQ ID NO: 7134178 - DNA, 22 bp, Homo sapiens
tattaagagatgtatgaagaga

SEQ ID NO: 7134179 - DNA, 22 bp, Homo sapiens
tattaataagtgactactagct

SEQ ID NO: 7134180 - DNA, 21 bp, Homo sapiens
tattaatatgtctaagctgat

SEQ ID NO: 7134181 - DNA, 21 bp, Homo sapiens
tattaatatgtctaagctgat

SEQ ID NO: 7134182 - DNA, 19 bp, Homo sapiens
tatgtccctttcccccatt

SEQ ID NO: 7134183 - DNA, 22 bp, Homo sapiens
tatgtcctgctactctctcatg

SEQ ID NO: 7134184 - DNA, 22 bp, Homo sapiens
tattaaattatggatttaggag

SEQ ID NO: 7134185 - DNA, 22 bp, Homo sapiens
tattaaattatggatttaggag

SEQ ID NO: 7134186 - DNA, 22 bp, Homo sapiens
tattaacacgtataaagtgttt

SEQ ID NO: 7134187 - DNA, 22 bp, Homo sapiens
tattaacacgtataaagtgttt

SEQ ID NO: 7134188 - DNA, 22 bp, Homo sapiens
tatgtatagagtcttttaaatt

SEQ ID NO: 7134189 - DNA, 22 bp, Homo sapiens
tatgtatagagtcttttaaatt

SEQ ID NO: 7134190 - DNA, 18 bp, Homo sapiens
tatgtataacatagttca

SEQ ID NO: 7134191 - DNA, 22 bp, Homo sapiens
tatgtagtgttgagaatgcttg

SEQ ID NO: 7134192 - DNA, 17 bp, Homo sapiens
tatgtagtacttataaa

SEQ ID NO: 7134193 - DNA, 17 bp, Homo sapiens
tatgtagtacttataaa

SEQ ID NO: 7134194 - DNA, 18 bp, Homo sapiens
tatgtagtatatgtgtat

SEQ ID NO: 7134195 - DNA, 18 bp, Homo sapiens
tatgtagtatatgtgtat

SEQ ID NO: 7134196 - DNA, 22 bp, Homo sapiens
tatgtagtacttagtgcataca

SEQ ID NO: 7134197 - DNA, 22 bp, Homo sapiens
tatgtagtacttagtgcataca

SEQ ID NO: 7134198 - DNA, 22 bp, Homo sapiens
tatgtagatttctctgtttttc

SEQ ID NO: 7134199 - DNA, 22 bp, Homo sapiens
tatgtagcaatagcatcatact

SEQ ID NO: 7134200 - DNA, 22 bp, Homo sapiens
tatgtagagataaaatccaaat

SEQ ID NO: 7134201 - DNA, 22 bp, Homo sapiens
tatgtattctcagatttactaa

SEQ ID NO: 7134202 - DNA, 22 bp, Homo sapiens
tatgtattatctgtgactgctt

SEQ ID NO: 7134203 - DNA, 22 bp, Homo sapiens
tatgtcaaaaaagattatgttt

SEQ ID NO: 7134204 - DNA, 22 bp, Homo sapiens
tatgtattctgagtacaagttc

SEQ ID NO: 7134205 - DNA, 22 bp, Homo sapiens
tatgtattctgagtacaagttc

SEQ ID NO: 7134206 - DNA, 22 bp, Homo sapiens
tatgtatatggtagaagtatgt

SEQ ID NO: 7134207 - DNA, 22 bp, Homo sapiens
tatgtatatgtatacacacaca

SEQ ID NO: 7134208 - DNA, 22 bp, Homo sapiens
tatgtatccgtgtgtgtacaga

SEQ ID NO: 7134209 - DNA, 22 bp, Homo sapiens
tatgtatccgtgtgtgtacaga

SEQ ID NO: 7134210 - DNA, 22 bp, Homo sapiens
tatgtatcatggacatgagact

SEQ ID NO: 7134211 - DNA, 22 bp, Homo sapiens
tatgtatctagaagggaaatta

SEQ ID NO: 7134212 - DNA, 21 bp, Homo sapiens
tatgtatctgcttggttcctc

SEQ ID NO: 7134213 - DNA, 22 bp, Homo sapiens
tatgtatctgttcatcagttaa

SEQ ID NO: 7134214 - DNA, 22 bp, Homo sapiens
tatgtatctggatacatcagtg

SEQ ID NO: 7134215 - DNA, 22 bp, Homo sapiens
tatgtatcttttgttttccctg

SEQ ID NO: 7134216 - DNA, 22 bp, Homo sapiens
tatcagaaggaagtgcctttaa

SEQ ID NO: 7134217 - DNA, 22 bp, Homo sapiens
tatcagaaggcacatggagtct

SEQ ID NO: 7134218 - DNA, 17 bp, Homo sapiens
tatcagaatgtgtttac

SEQ ID NO: 7134219 - DNA, 17 bp, Homo sapiens
tatcagaatgtgtttac

SEQ ID NO: 7134220 - DNA, 21 bp, Homo sapiens
tatcagactcctagtaaccac

SEQ ID NO: 7134221 - DNA, 22 bp, Homo sapiens
tatcagcaagatggcagtatag

SEQ ID NO: 7134222 - DNA, 22 bp, Homo sapiens
tatcagcaccgcggacagcatc

SEQ ID NO: 7134223 - DNA, 22 bp, Homo sapiens
tatcagcatctcctcaaagata

SEQ ID NO: 7134224 - DNA, 22 bp, Homo sapiens
tatcagcatctcctcaaagata

SEQ ID NO: 7134225 - DNA, 22 bp, Homo sapiens
tatcagctcggaatctgttgaa

SEQ ID NO: 7134226 - DNA, 22 bp, Homo sapiens
tatcacttgcgttttggcagag

SEQ ID NO: 7134227 - DNA, 22 bp, Homo sapiens
tatcagaaactctggggcaggg

SEQ ID NO: 7134228 - DNA, 22 bp, Homo sapiens
tatcagaaatcaacacacagtg

SEQ ID NO: 7134229 - DNA, 19 bp, Homo sapiens
tatcactgggcactgagga

SEQ ID NO: 7134230 - DNA, 19 bp, Homo sapiens
tatcactgggcactgagga

SEQ ID NO: 7134231 - DNA, 18 bp, Homo sapiens
tatcactgctgaacaaga

SEQ ID NO: 7134232 - DNA, 18 bp, Homo sapiens
tatcactgctgaacaaga

SEQ ID NO: 7134233 - DNA, 22 bp, Homo sapiens
tatcagaaatgccttaaattgg

SEQ ID NO: 7134234 - DNA, 22 bp, Homo sapiens
tatcagaagacttacagtatcg

SEQ ID NO: 7134235 - DNA, 22 bp, Homo sapiens
tatcacagtaaatctgggtgca

SEQ ID NO: 7134236 - DNA, 22 bp, Homo sapiens
tatcacatacttctcatccagg

SEQ ID NO: 7134237 - DNA, 22 bp, Homo sapiens
tatcaccagagggatagtctct

SEQ ID NO: 7134238 - DNA, 22 bp, Homo sapiens
tatcactacacctggctaatta

SEQ ID NO: 7134239 - DNA, 22 bp, Homo sapiens
tataaagagtctcaaagaagtt

SEQ ID NO: 7134240 - DNA, 22 bp, Homo sapiens
tataaagtgtgaactgtgagta

SEQ ID NO: 7134241 - DNA, 22 bp, Homo sapiens
tataaagtgtgaactgtgagta

SEQ ID NO: 7134242 - DNA, 22 bp, Homo sapiens
tataaagtttcgaaagatgtat

SEQ ID NO: 7134243 - DNA, 22 bp, Homo sapiens
tataaagtttcgaaagatgtat

SEQ ID NO: 7134244 - DNA, 22 bp, Homo sapiens
tataaagtttcgaaagatgtat

SEQ ID NO: 7134245 - DNA, 22 bp, Homo sapiens
tatcacaggtgtgatttacatt

SEQ ID NO: 7134246 - DNA, 22 bp, Homo sapiens
tataaagttggggctgaagtaa

SEQ ID NO: 7134247 - DNA, 22 bp, Homo sapiens
tataaagttggggctgaagtaa

SEQ ID NO: 7134248 - DNA, 22 bp, Homo sapiens
tataaagaaggcacagcaagac

SEQ ID NO: 7134249 - DNA, 22 bp, Homo sapiens
tataaagaagtgtaaacaggaa

SEQ ID NO: 7134250 - DNA, 22 bp, Homo sapiens
tataaagaagtgtaaacaggaa

SEQ ID NO: 7134251 - DNA, 22 bp, Homo sapiens
tataaagaagtgtaaacaggaa

SEQ ID NO: 7134252 - DNA, 22 bp, Homo sapiens
tataaagaatccagaagagaca

SEQ ID NO: 7134253 - DNA, 22 bp, Homo sapiens
tataaagagtctatctggtggc

SEQ ID NO: 7134254 - DNA, 22 bp, Homo sapiens
tataaagagtctcaaagaagtt

SEQ ID NO: 7134255 - DNA, 22 bp, Homo sapiens
tataaagagtctcaaagaagtt

SEQ ID NO: 7134256 - DNA, 22 bp, Homo sapiens
tataaagagtctcaaagaagtt

SEQ ID NO: 7134257 - DNA, 18 bp, Homo sapiens
tataaacacacttaggtt

SEQ ID NO: 7134258 - DNA, 18 bp, Homo sapiens
tataaacacacttaggtt

SEQ ID NO: 7134259 - DNA, 22 bp, Homo sapiens
tataaactatatgttagccaga

SEQ ID NO: 7134260 - DNA, 22 bp, Homo sapiens
tataaactcctcttgcattcct

SEQ ID NO: 7134261 - DNA, 22 bp, Homo sapiens
tataaactttaaccaggatgtc

SEQ ID NO: 7134262 - DNA, 22 bp, Homo sapiens
tataaagaaatgatttccagaa

SEQ ID NO: 7134263 - DNA, 22 bp, Homo sapiens
tataaaacagaaagcactacct

SEQ ID NO: 7134264 - DNA, 22 bp, Homo sapiens
tataaaacagaaagcactacct

SEQ ID NO: 7134265 - DNA, 22 bp, Homo sapiens
tataaaacagaaagcactacct

SEQ ID NO: 7134266 - DNA, 22 bp, Homo sapiens
tataaaacagaaagcactacct

SEQ ID NO: 7134267 - DNA, 22 bp, Homo sapiens
tataaaatggcatcagctccaa

SEQ ID NO: 7134268 - DNA, 22 bp, Homo sapiens
tataaaatggcatcagctccaa

SEQ ID NO: 7134269 - DNA, 22 bp, Homo sapiens
tataaaatggcatcagctccaa

SEQ ID NO: 7134270 - DNA, 22 bp, Homo sapiens
tataaaatggcatcagctccaa

SEQ ID NO: 7134271 - DNA, 22 bp, Homo sapiens
tataaaatggcatcagctccaa

SEQ ID NO: 7134272 - DNA, 22 bp, Homo sapiens
tataaaattctcagtttggggt

SEQ ID NO: 7134273 - DNA, 22 bp, Homo sapiens
tataaaattctcagtttggggt

SEQ ID NO: 7134274 - DNA, 22 bp, Homo sapiens
tataaaattctcagtttggggt

SEQ ID NO: 7134275 - DNA, 22 bp, Homo sapiens
tataaaattctcagtttggggt

SEQ ID NO: 7134276 - DNA, 22 bp, Homo sapiens
tataaaattctcagtttggggt

SEQ ID NO: 7134277 - DNA, 18 bp, Homo sapiens
tataaacacacttaggtt

SEQ ID NO: 7134278 - DNA, 22 bp, Homo sapiens
tatgaatataccacaatttagg

SEQ ID NO: 7134279 - DNA, 22 bp, Homo sapiens
tatgaatataccacaatttagg

SEQ ID NO: 7134280 - DNA, 22 bp, Homo sapiens
tatgaatggctcatggtgagtg

SEQ ID NO: 7134281 - DNA, 19 bp, Homo sapiens
tatgaagttgataaaagtt

SEQ ID NO: 7134282 - DNA, 22 bp, Homo sapiens
tatgaatataccacaatttagg

SEQ ID NO: 7134283 - DNA, 22 bp, Homo sapiens
tatgaagattgcggtctggaat

SEQ ID NO: 7134284 - DNA, 22 bp, Homo sapiens
tatgaagctctcactgtgtgtc

SEQ ID NO: 7134285 - DNA, 22 bp, Homo sapiens
tatgaagctttgaaaagcttac

SEQ ID NO: 7134286 - DNA, 22 bp, Homo sapiens
tatgaattctcttgtgtatagt

SEQ ID NO: 7134287 - DNA, 22 bp, Homo sapiens
tatgaattctgttcattgatga

SEQ ID NO: 7134288 - DNA, 20 bp, Homo sapiens
tatgacaacgcagcaaggca

SEQ ID NO: 7134289 - DNA, 22 bp, Homo sapiens
tatgacaagaaatacagaggta

SEQ ID NO: 7134290 - DNA, 22 bp, Homo sapiens
tatgacaagaaatacagaggta

SEQ ID NO: 7134291 - DNA, 22 bp, Homo sapiens
tatgacaaggtggagtatgagt

SEQ ID NO: 7134292 - DNA, 22 bp, Homo sapiens
tatgacaaggtggagtatgagt

SEQ ID NO: 7134293 - DNA, 22 bp, Homo sapiens
tatgacaaggtggagtatgagt

SEQ ID NO: 7134294 - DNA, 22 bp, Homo sapiens
tatgaaattgccatttttatgg

SEQ ID NO: 7134295 - DNA, 22 bp, Homo sapiens
tatgaaattgccatttttatgg

SEQ ID NO: 7134296 - DNA, 22 bp, Homo sapiens
tatgaaattgccatttttatgg

SEQ ID NO: 7134297 - DNA, 22 bp, Homo sapiens
tatgaaatggtagtaggaaggg

SEQ ID NO: 7134298 - DNA, 22 bp, Homo sapiens
tatgaaattgccatttttatgg

SEQ ID NO: 7134299 - DNA, 22 bp, Homo sapiens
tatgaaatgatggggaaaatag

SEQ ID NO: 7134300 - DNA, 22 bp, Homo sapiens
tatgaaatggtagtaggaaggg

SEQ ID NO: 7134301 - DNA, 22 bp, Homo sapiens
tatgaaatggtagtaggaaggg

SEQ ID NO: 7134302 - DNA, 22 bp, Homo sapiens
tatgaaatgatggggaaaatag

SEQ ID NO: 7134303 - DNA, 22 bp, Homo sapiens
tatgaaatgatggggaaaatag

SEQ ID NO: 7134304 - DNA, 22 bp, Homo sapiens
tatgaaatgatggggaaaatag

SEQ ID NO: 7134305 - DNA, 22 bp, Homo sapiens
tatgaaatttaaacacagatca

SEQ ID NO: 7134306 - DNA, 22 bp, Homo sapiens
tatgaaatttaaacacagatca

SEQ ID NO: 7134307 - DNA, 22 bp, Homo sapiens
tatgaaatttaaacacagatca

SEQ ID NO: 7134308 - DNA, 22 bp, Homo sapiens
tatgaaatttaaacacagatca

SEQ ID NO: 7134309 - DNA, 22 bp, Homo sapiens
tatgaaatttaaacacagatca

SEQ ID NO: 7134310 - DNA, 22 bp, Homo sapiens
tatgaaatttctagttctgctt

SEQ ID NO: 7134311 - DNA, 22 bp, Homo sapiens
tatgaaatttctagttctgctt

SEQ ID NO: 7134312 - DNA, 20 bp, Homo sapiens
tatgaagatatgtgaacagc

SEQ ID NO: 7134313 - DNA, 22 bp, Homo sapiens
tatgaacacactttggaagtga

SEQ ID NO: 7134314 - DNA, 20 bp, Homo sapiens
tatgaagatatgtgaacagc

SEQ ID NO: 7134315 - DNA, 22 bp, Homo sapiens
tatgaagattgcggtctggaat

SEQ ID NO: 7134316 - DNA, 22 bp, Homo sapiens
tatcatttgttattattagtgg

SEQ ID NO: 7134317 - DNA, 23 bp, Homo sapiens
tatcatttcagctctctgcctgg

SEQ ID NO: 7134318 - DNA, 22 bp, Homo sapiens
tatcatttgttattattagtgg

SEQ ID NO: 7134319 - DNA, 22 bp, Homo sapiens
tatcatttgttattattagtgg

SEQ ID NO: 7134320 - DNA, 22 bp, Homo sapiens
tatcatttagagtatttcttca

SEQ ID NO: 7134321 - DNA, 22 bp, Homo sapiens
tatcatttagagtatttcttca

SEQ ID NO: 7134322 - DNA, 23 bp, Homo sapiens
tatcatttcagctctctgcctgg

SEQ ID NO: 7134323 - DNA, 22 bp, Homo sapiens
tatcaggaattgaatggcttca

SEQ ID NO: 7134324 - DNA, 22 bp, Homo sapiens
tatcatttagagtatttcttca

SEQ ID NO: 7134325 - DNA, 22 bp, Homo sapiens
tatcatttagagtatttcttca

SEQ ID NO: 7134326 - DNA, 22 bp, Homo sapiens
tatcattttactgtgacatttt

SEQ ID NO: 7134327 - DNA, 22 bp, Homo sapiens
tatcattttactgtgacatttt

SEQ ID NO: 7134328 - DNA, 22 bp, Homo sapiens
tatcatttgttattattagtgg

SEQ ID NO: 7134329 - DNA, 22 bp, Homo sapiens
tatcattttactgtgacatttt

SEQ ID NO: 7134330 - DNA, 22 bp, Homo sapiens
tatcattttactgtgacatttt

SEQ ID NO: 7134331 - DNA, 22 bp, Homo sapiens
tatcattttactgtgacatttt

SEQ ID NO: 7134332 - DNA, 22 bp, Homo sapiens
tatcattttactgtgacatttt

SEQ ID NO: 7134333 - DNA, 22 bp, Homo sapiens
tatccaaaggaacaatcacagc

SEQ ID NO: 7134334 - DNA, 22 bp, Homo sapiens
tatccaaacatatagtctctct

SEQ ID NO: 7134335 - DNA, 18 bp, Homo sapiens
tatcttttccagtggtat

SEQ ID NO: 7134336 - DNA, 18 bp, Homo sapiens
tatcttttccagtggtat

SEQ ID NO: 7134337 - DNA, 22 bp, Homo sapiens
tatcttttgagttctcaagatg

SEQ ID NO: 7134338 - DNA, 23 bp, Homo sapiens
tatctttttcaatgttggaaata

SEQ ID NO: 7134339 - DNA, 22 bp, Homo sapiens
tatgaaaaggtggccaatgtag

SEQ ID NO: 7134340 - DNA, 22 bp, Homo sapiens
tatcttttgagttctcaagatg

SEQ ID NO: 7134341 - DNA, 22 bp, Homo sapiens
tatcttttgagttctcaagatg

SEQ ID NO: 7134342 - DNA, 23 bp, Homo sapiens
tatctttttcaatgttggaaata

SEQ ID NO: 7134343 - DNA, 22 bp, Homo sapiens
tatgaaaatttagctgaagcat

SEQ ID NO: 7134344 - DNA, 22 bp, Homo sapiens
tatgaaaaggtggccaatgtag

SEQ ID NO: 7134345 - DNA, 22 bp, Homo sapiens
tatgaaaatttagctgaagcat

SEQ ID NO: 7134346 - DNA, 22 bp, Homo sapiens
tatgaaacattcatacaaataa

SEQ ID NO: 7134347 - DNA, 22 bp, Homo sapiens
tatgaaagcaatcattatgtac

SEQ ID NO: 7134348 - DNA, 19 bp, Homo sapiens
tcaaaggcttttaggagac

SEQ ID NO: 7134349 - DNA, 22 bp, Homo sapiens
tcaaaggctgcttgtcttctgg

SEQ ID NO: 7134350 - DNA, 22 bp, Homo sapiens
tcaaaggcttgtggttctggga

SEQ ID NO: 7134351 - DNA, 22 bp, Homo sapiens
tcaaagggtaatgtaatagtct

SEQ ID NO: 7134352 - DNA, 19 bp, Homo sapiens
tcaaaggcttttaggagac

SEQ ID NO: 7134353 - DNA, 22 bp, Homo sapiens
tcaaagtaaaagtatagagttt

SEQ ID NO: 7134354 - DNA, 22 bp, Homo sapiens
tcaaaggttaactctgttgttc

SEQ ID NO: 7134355 - DNA, 22 bp, Homo sapiens
tcaaagggtccttaacatgaga

SEQ ID NO: 7134356 - DNA, 22 bp, Homo sapiens
tcaaagtaggggtaagccaggc

SEQ ID NO: 7134357 - DNA, 22 bp, Homo sapiens
tcaaataatgccattcatcatc

SEQ ID NO: 7134358 - DNA, 22 bp, Homo sapiens
tcaaagttggaaaagctggccc

SEQ ID NO: 7134359 - DNA, 22 bp, Homo sapiens
tcaaagtatatcccttcgaaac

SEQ ID NO: 7134360 - DNA, 17 bp, Homo sapiens
tcaaagtattctgatgc

SEQ ID NO: 7134361 - DNA, 22 bp, Homo sapiens
tcaaagtattttaactgtatcc

SEQ ID NO: 7134362 - DNA, 22 bp, Homo sapiens
tcaaagtcatggcaggctcaga

SEQ ID NO: 7134363 - DNA, 22 bp, Homo sapiens
tcaaatatgtgatagaagctaa

SEQ ID NO: 7134364 - DNA, 22 bp, Homo sapiens
tcaaatatgtgatagaagctaa

SEQ ID NO: 7134365 - DNA, 22 bp, Homo sapiens
tcaaatatgtgatagaagctaa

SEQ ID NO: 7134366 - DNA, 22 bp, Homo sapiens
tcaaataggcttgtagtgactg

SEQ ID NO: 7134367 - DNA, 22 bp, Homo sapiens
tcaaatatgtgatagaagctaa

SEQ ID NO: 7134368 - DNA, 22 bp, Homo sapiens
tcaaatattggctatttcacat

SEQ ID NO: 7134369 - DNA, 22 bp, Homo sapiens
tcaaatattggctatttcacat

SEQ ID NO: 7134370 - DNA, 22 bp, Homo sapiens
tcaaataccagcaatttcatgt

SEQ ID NO: 7134371 - DNA, 22 bp, Homo sapiens
tcaaataccagcaatttcatgt

SEQ ID NO: 7134372 - DNA, 22 bp, Homo sapiens
tcaaatacagaagatcctttcc

SEQ ID NO: 7134373 - DNA, 22 bp, Homo sapiens
tcaaatacatggtcaatcaact

SEQ ID NO: 7134374 - DNA, 21 bp, Homo sapiens
tcaaatcctgctgttaccact

SEQ ID NO: 7134375 - DNA, 22 bp, Homo sapiens
tcaaatctcattgcctaaaact

SEQ ID NO: 7134376 - DNA, 21 bp, Homo sapiens
tcaaatcatgtactgaccaca

SEQ ID NO: 7134377 - DNA, 22 bp, Homo sapiens
tcaaatcccagctcagcctctc

SEQ ID NO: 7134378 - DNA, 22 bp, Homo sapiens
tcaaatctcattgcctaaaact

SEQ ID NO: 7134379 - DNA, 22 bp, Homo sapiens
tcaaatgaagacagttgacttg

SEQ ID NO: 7134380 - DNA, 22 bp, Homo sapiens
tcaaatgaagacagttgacttg

SEQ ID NO: 7134381 - DNA, 22 bp, Homo sapiens
tcaaatgaagacagttgacttg

SEQ ID NO: 7134382 - DNA, 21 bp, Homo sapiens
tcaaatcaggtatcactattg

SEQ ID NO: 7134383 - DNA, 21 bp, Homo sapiens
tcaaatcatgtactgaccaca

SEQ ID NO: 7134384 - DNA, 21 bp, Homo sapiens
tcaaatcaggtatcactattg

SEQ ID NO: 7134385 - DNA, 21 bp, Homo sapiens
tcaaatcaggtatcactattg

SEQ ID NO: 7134386 - DNA, 21 bp, Homo sapiens
tcaaatcaggtatcactattg

SEQ ID NO: 7134387 - DNA, 22 bp, Homo sapiens
tcaaatcaccaaactcactggc

SEQ ID NO: 7134388 - DNA, 22 bp, Homo sapiens
tcaaatcaccaaactcactggc

SEQ ID NO: 7134389 - DNA, 22 bp, Homo sapiens
tcaaagatcagatggttgtagg

SEQ ID NO: 7134390 - DNA, 22 bp, Homo sapiens
tcaaagatgataggaaatcata

SEQ ID NO: 7134391 - DNA, 22 bp, Homo sapiens
tcaaagatgatgctgaagttat

SEQ ID NO: 7134392 - DNA, 22 bp, Homo sapiens
tcaaagatgggttttgtttgat

SEQ ID NO: 7134393 - DNA, 22 bp, Homo sapiens
tcaaagattgaaactaaggaga

SEQ ID NO: 7134394 - DNA, 20 bp, Homo sapiens
tcaaagcaaagggagatgat

SEQ ID NO: 7134395 - DNA, 20 bp, Homo sapiens
tcaaagcaaagggagatgat

SEQ ID NO: 7134396 - DNA, 22 bp, Homo sapiens
tcaaagagctattcagttgtgg

SEQ ID NO: 7134397 - DNA, 22 bp, Homo sapiens
tcaaagactatatattttattt

SEQ ID NO: 7134398 - DNA, 22 bp, Homo sapiens
tcaaagagctctatcttcaaaa

SEQ ID NO: 7134399 - DNA, 22 bp, Homo sapiens
tcaaagatagatgttgagaaat

SEQ ID NO: 7134400 - DNA, 22 bp, Homo sapiens
tcaaagatagatgttgagaaat

SEQ ID NO: 7134401 - DNA, 22 bp, Homo sapiens
tcaaagatagatgttgagaaat

SEQ ID NO: 7134402 - DNA, 22 bp, Homo sapiens
tcaaagaatgttatgagggtag

SEQ ID NO: 7134403 - DNA, 22 bp, Homo sapiens
tcaaagaatgttatgagggtag

SEQ ID NO: 7134404 - DNA, 22 bp, Homo sapiens
tcaaagaagtgcaaacctcatc

SEQ ID NO: 7134405 - DNA, 17 bp, Homo sapiens
tcaaagaatgcatgcag

SEQ ID NO: 7134406 - DNA, 20 bp, Homo sapiens
tcaaagaagattcagctcaa

SEQ ID NO: 7134407 - DNA, 22 bp, Homo sapiens
tcaaagaacatcatctgaaatg

SEQ ID NO: 7134408 - DNA, 22 bp, Homo sapiens
tattttgacgattttatgcaaa

SEQ ID NO: 7134409 - DNA, 22 bp, Homo sapiens
tattttgagcccctgacatcta

SEQ ID NO: 7134410 - DNA, 22 bp, Homo sapiens
tattttgactattaaaccaaca

SEQ ID NO: 7134411 - DNA, 22 bp, Homo sapiens
tattttgaggtatttttgagct

SEQ ID NO: 7134412 - DNA, 22 bp, Homo sapiens
tattttgctttagctgactgtt

SEQ ID NO: 7134413 - DNA, 22 bp, Homo sapiens
tattttgtaattggtcatagct

SEQ ID NO: 7134414 - DNA, 22 bp, Homo sapiens
tattttgtatttatgcaagaaa

SEQ ID NO: 7134415 - DNA, 22 bp, Homo sapiens
tattttgtatttatgcaagaaa

SEQ ID NO: 7134416 - DNA, 22 bp, Homo sapiens
tatttttgcctctcagataaaa

SEQ ID NO: 7134417 - DNA, 22 bp, Homo sapiens
tatttttgcctctcagataaaa

SEQ ID NO: 7134418 - DNA, 22 bp, Homo sapiens
tatttttgcctctcagataaaa

SEQ ID NO: 7134419 - DNA, 22 bp, Homo sapiens
tcaaaaagttgaagagttgggg

SEQ ID NO: 7134420 - DNA, 22 bp, Homo sapiens
tcaaaaataagatattctggac

SEQ ID NO: 7134421 - DNA, 22 bp, Homo sapiens
tcaaaaataagatattctggac

SEQ ID NO: 7134422 - DNA, 22 bp, Homo sapiens
tcaaaaataagatattctggac

SEQ ID NO: 7134423 - DNA, 22 bp, Homo sapiens
tcaaaaataagatattctggac

SEQ ID NO: 7134424 - DNA, 22 bp, Homo sapiens
tattttgtatttatgcaagaaa

SEQ ID NO: 7134425 - DNA, 22 bp, Homo sapiens
tattttgtatttatgcaagaaa

SEQ ID NO: 7134426 - DNA, 22 bp, Homo sapiens
tattttgtcttctgctcatcac

SEQ ID NO: 7134427 - DNA, 22 bp, Homo sapiens
tattttgtcttctgctcatcac

SEQ ID NO: 7134428 - DNA, 22 bp, Homo sapiens
tattttgtcttctgctcatcac

SEQ ID NO: 7134429 - DNA, 22 bp, Homo sapiens
tattttgtgccatgcactgcct

SEQ ID NO: 7134430 - DNA, 22 bp, Homo sapiens
tattttgttaataatccagtcc

SEQ ID NO: 7134431 - DNA, 22 bp, Homo sapiens
tattttgttttgtatccactgt

SEQ ID NO: 7134432 - DNA, 22 bp, Homo sapiens
tattttgttttgtatccactgt

SEQ ID NO: 7134433 - DNA, 22 bp, Homo sapiens
tattttcattctgtgtgactgt

SEQ ID NO: 7134434 - DNA, 23 bp, Homo sapiens
tattttccaaatgatgactacat

SEQ ID NO: 7134435 - DNA, 22 bp, Homo sapiens
tatttggagcctatccatagat

SEQ ID NO: 7134436 - DNA, 22 bp, Homo sapiens
tatttggagctgtgtgagctca

SEQ ID NO: 7134437 - DNA, 22 bp, Homo sapiens
tatttggagataagatttttag

SEQ ID NO: 7134438 - DNA, 22 bp, Homo sapiens
tatttggagataagggctttaa

SEQ ID NO: 7134439 - DNA, 22 bp, Homo sapiens
tatttggagatgggatcttcaa

SEQ ID NO: 7134440 - DNA, 22 bp, Homo sapiens
tattttctggggagagtgaacc

SEQ ID NO: 7134441 - DNA, 22 bp, Homo sapiens
tattttctggggagagtgaacc

SEQ ID NO: 7134442 - DNA, 22 bp, Homo sapiens
tattttctggacagtcttgctt

SEQ ID NO: 7134443 - DNA, 22 bp, Homo sapiens
tattttgaaagtctgttttgaa

SEQ ID NO: 7134444 - DNA, 22 bp, Homo sapiens
tattttgacgattttatgcaaa

SEQ ID NO: 7134445 - DNA, 22 bp, Homo sapiens
tatttggaatagcttgctaatg

SEQ ID NO: 7134446 - DNA, 22 bp, Homo sapiens
tatttggaatctgccttaggac

SEQ ID NO: 7134447 - DNA, 22 bp, Homo sapiens
tatttggacaccaagtagaagt

SEQ ID NO: 7134448 - DNA, 22 bp, Homo sapiens
tatttggacaccaagtagaagt

SEQ ID NO: 7134449 - DNA, 22 bp, Homo sapiens
tatttggaaatgataaagtact

SEQ ID NO: 7134450 - DNA, 22 bp, Homo sapiens
tatttggaaggtataaacacaa

SEQ ID NO: 7134451 - DNA, 22 bp, Homo sapiens
tatttggaaggtataaacacaa

SEQ ID NO: 7134452 - DNA, 22 bp, Homo sapiens
tatttggaatagcttgctaatg

SEQ ID NO: 7134453 - DNA, 23 bp, Homo sapiens
tatttggaaagagggaagaagac

SEQ ID NO: 7134454 - DNA, 23 bp, Homo sapiens
tatttggaaagagggaagaagac

SEQ ID NO: 7134455 - DNA, 22 bp, Homo sapiens
tatttggaaaggacatgtaagt

SEQ ID NO: 7134456 - DNA, 22 bp, Homo sapiens
tatttggaaaggacatgtaagt

SEQ ID NO: 7134457 - DNA, 22 bp, Homo sapiens
tatttggaaagtttatctatct

SEQ ID NO: 7134458 - DNA, 22 bp, Homo sapiens
tatttggaaatagggctttgta

SEQ ID NO: 7134459 - DNA, 22 bp, Homo sapiens
tatttggaaatagggctttgta

SEQ ID NO: 7134460 - DNA, 22 bp, Homo sapiens
tatttggaaatgataaagtact

SEQ ID NO: 7134461 - DNA, 22 bp, Homo sapiens
tatttgctgaatctgattcaga

SEQ ID NO: 7134462 - DNA, 22 bp, Homo sapiens
tatttgctgacagtgctggagc

SEQ ID NO: 7134463 - DNA, 21 bp, Homo sapiens
tatttgctgccatctttgagg

SEQ ID NO: 7134464 - DNA, 22 bp, Homo sapiens
tatttgctgtgcttattccatt

SEQ ID NO: 7134465 - DNA, 22 bp, Homo sapiens
tatttgctttgctttatagaga

SEQ ID NO: 7134466 - DNA, 22 bp, Homo sapiens
tatttggaaaagggaagggaca

SEQ ID NO: 7134467 - DNA, 22 bp, Homo sapiens
tatttggaaaagggaagggaca

SEQ ID NO: 7134468 - DNA, 22 bp, Homo sapiens
tatttggaaacaattcacatgc

SEQ ID NO: 7134469 - DNA, 22 bp, Homo sapiens
tatttgactcttaggaagactc

SEQ ID NO: 7134470 - DNA, 22 bp, Homo sapiens
tatttgactcttaggaagactc

SEQ ID NO: 7134471 - DNA, 22 bp, Homo sapiens
tatttgaccgtgaggaatatga

SEQ ID NO: 7134472 - DNA, 22 bp, Homo sapiens
tatttgaccgtgaggaatatga

SEQ ID NO: 7134473 - DNA, 22 bp, Homo sapiens
tatttgagcgaagcagtgtttt

SEQ ID NO: 7134474 - DNA, 22 bp, Homo sapiens
tatttgatagagataaatgata

SEQ ID NO: 7134475 - DNA, 22 bp, Homo sapiens
tatttgatagagataaatgata

SEQ ID NO: 7134476 - DNA, 22 bp, Homo sapiens
tatttgatagagataaatgata

SEQ ID NO: 7134477 - DNA, 22 bp, Homo sapiens
tatttgatagagataaatgata

SEQ ID NO: 7134478 - DNA, 22 bp, Homo sapiens
tatttgaaggcatacattttga

SEQ ID NO: 7134479 - DNA, 22 bp, Homo sapiens
tatttgaaggcatacattttga

SEQ ID NO: 7134480 - DNA, 22 bp, Homo sapiens
tatttgaagggagaaagtgcca

SEQ ID NO: 7134481 - DNA, 22 bp, Homo sapiens
tatttgaagggagaaagtgcca

SEQ ID NO: 7134482 - DNA, 22 bp, Homo sapiens
tatttgaataaaggataaggaa

SEQ ID NO: 7134483 - DNA, 22 bp, Homo sapiens
tatttgaataaaggataaggaa

SEQ ID NO: 7134484 - DNA, 22 bp, Homo sapiens
tatttcttgttattctcgttga

SEQ ID NO: 7134485 - DNA, 22 bp, Homo sapiens
tatttcttgttattctcgttga

SEQ ID NO: 7134486 - DNA, 22 bp, Homo sapiens
tatttaattagtgattgtagag

SEQ ID NO: 7134487 - DNA, 22 bp, Homo sapiens
tatttaattagtgattgtagag

SEQ ID NO: 7134488 - DNA, 22 bp, Homo sapiens
tatttaattagtgattgtagag

SEQ ID NO: 7134489 - DNA, 22 bp, Homo sapiens
tatttaattagtgattgtagag

SEQ ID NO: 7134490 - DNA, 22 bp, Homo sapiens
tatttgaaggcatacattttga

SEQ ID NO: 7134491 - DNA, 22 bp, Homo sapiens
tatttgcaggacatagatatgg

SEQ ID NO: 7134492 - DNA, 22 bp, Homo sapiens
tatttgcaggacatagatatgg

SEQ ID NO: 7134493 - DNA, 22 bp, Homo sapiens
tatttgcaggacatagatatgg

SEQ ID NO: 7134494 - DNA, 22 bp, Homo sapiens
tatttgcaggacatagatatgg

SEQ ID NO: 7134495 - DNA, 22 bp, Homo sapiens
tatttgcaggcttttgtcatgg

SEQ ID NO: 7134496 - DNA, 22 bp, Homo sapiens
tatttgcgtcaataaccagttt

SEQ ID NO: 7134497 - DNA, 23 bp, Homo sapiens
tatttgctactggtaattctgga

SEQ ID NO: 7134498 - DNA, 22 bp, Homo sapiens
tatttgatgaaggtaaagtctt

SEQ ID NO: 7134499 - DNA, 22 bp, Homo sapiens
tatttgatggttctaaaacagc

SEQ ID NO: 7134500 - DNA, 22 bp, Homo sapiens
tatttgatgaaggtaaagtctt

SEQ ID NO: 7134501 - DNA, 22 bp, Homo sapiens
tatttgatagagataaatgata

SEQ ID NO: 7134502 - DNA, 22 bp, Homo sapiens
tatttgcaacataaaactctga

SEQ ID NO: 7134503 - DNA, 22 bp, Homo sapiens
tatttgatggttctaaaacagc

SEQ ID NO: 7134504 - DNA, 22 bp, Homo sapiens
tatttgatggttctaaaacagc

SEQ ID NO: 7134505 - DNA, 22 bp, Homo sapiens
tatttgcaaagaactacactag

SEQ ID NO: 7134506 - DNA, 21 bp, Homo sapiens
tattaatttttcttcccacta

SEQ ID NO: 7134507 - DNA, 22 bp, Homo sapiens
tattaatttaatctccatggta

SEQ ID NO: 7134508 - DNA, 22 bp, Homo sapiens
tattaatttaatctccatggta

SEQ ID NO: 7134509 - DNA, 22 bp, Homo sapiens
tattacaaattataatgggaga

SEQ ID NO: 7134510 - DNA, 22 bp, Homo sapiens
tattacaaattataatgggaga

SEQ ID NO: 7134511 - DNA, 22 bp, Homo sapiens
tattacaaattataatgggaga

SEQ ID NO: 7134512 - DNA, 22 bp, Homo sapiens
tattacaaattataatgggaga

SEQ ID NO: 7134513 - DNA, 22 bp, Homo sapiens
tattacaagaaagggcatgaat

SEQ ID NO: 7134514 - DNA, 23 bp, Homo sapiens
tattacaattggtcttattaaga

SEQ ID NO: 7134515 - DNA, 23 bp, Homo sapiens
tattacaattggtcttattaaga

SEQ ID NO: 7134516 - DNA, 23 bp, Homo sapiens
tattacaattggtcttattaaga

SEQ ID NO: 7134517 - DNA, 23 bp, Homo sapiens
tattacaattggtcttattaaga

SEQ ID NO: 7134518 - DNA, 22 bp, Homo sapiens
tattacaatttacattgcactt

SEQ ID NO: 7134519 - DNA, 22 bp, Homo sapiens
tattacaatttacattgcactt

SEQ ID NO: 7134520 - DNA, 23 bp, Homo sapiens
tattacaattggtcttattaaga

SEQ ID NO: 7134521 - DNA, 22 bp, Homo sapiens
tattacaatttacattgcactt

SEQ ID NO: 7134522 - DNA, 22 bp, Homo sapiens
tattacaatttacattgcactt

SEQ ID NO: 7134523 - DNA, 22 bp, Homo sapiens
tattgtatcttctgtttagaag

SEQ ID NO: 7134524 - DNA, 22 bp, Homo sapiens
tattgtattaaggattcaagta

SEQ ID NO: 7134525 - DNA, 22 bp, Homo sapiens
tattgtatcttctgtttagaag

SEQ ID NO: 7134526 - DNA, 22 bp, Homo sapiens
tattacaatttacattgcactt

SEQ ID NO: 7134527 - DNA, 21 bp, Homo sapiens
tattgtcaatctgctttcaga

SEQ ID NO: 7134528 - DNA, 22 bp, Homo sapiens
tattgtcaagaagtttatagtg

SEQ ID NO: 7134529 - DNA, 22 bp, Homo sapiens
tattgtcaagaagtttatagtg

SEQ ID NO: 7134530 - DNA, 21 bp, Homo sapiens
tattgtcaatctgctttcaga

SEQ ID NO: 7134531 - DNA, 22 bp, Homo sapiens
tattgtcacgtcttaattctag

SEQ ID NO: 7134532 - DNA, 22 bp, Homo sapiens
tattgtcagtgcctgcctcata

SEQ ID NO: 7134533 - DNA, 22 bp, Homo sapiens
tattgtccaataggatgttcct

SEQ ID NO: 7134534 - DNA, 22 bp, Homo sapiens
tattgtctaggaattgtttaaa

SEQ ID NO: 7134535 - DNA, 22 bp, Homo sapiens
tattgtctctgcgttgttctat

SEQ ID NO: 7134536 - DNA, 22 bp, Homo sapiens
tattgtctgtttgaatgactat

SEQ ID NO: 7134537 - DNA, 20 bp, Homo sapiens
tattgtgataggtgttaatc

SEQ ID NO: 7134538 - DNA, 22 bp, Homo sapiens
tattgtgagtataactgcattt

SEQ ID NO: 7134539 - DNA, 22 bp, Homo sapiens
tattgtgagttcagactaaaaa

SEQ ID NO: 7134540 - DNA, 22 bp, Homo sapiens
tattgtcttcaactctactttt

SEQ ID NO: 7134541 - DNA, 22 bp, Homo sapiens
tattgtgaagggaaaaatagtg

SEQ ID NO: 7134542 - DNA, 22 bp, Homo sapiens
tattgtgaatttggaagcaatg

SEQ ID NO: 7134543 - DNA, 22 bp, Homo sapiens
tatttaaaaagaggccagctgg

SEQ ID NO: 7134544 - DNA, 22 bp, Homo sapiens
tatttaaaaagaggccagctgg

SEQ ID NO: 7134545 - DNA, 22 bp, Homo sapiens
tatttaaaaagaggccagctgg

SEQ ID NO: 7134546 - DNA, 22 bp, Homo sapiens
tatttaaaaagaggccagctgg

SEQ ID NO: 7134547 - DNA, 22 bp, Homo sapiens
tatttaaaaagaggccagctgg

SEQ ID NO: 7134548 - DNA, 22 bp, Homo sapiens
tatttaaaaagaggccagctgg

SEQ ID NO: 7134549 - DNA, 22 bp, Homo sapiens
tatttaaaaagaggccagctgg

SEQ ID NO: 7134550 - DNA, 22 bp, Homo sapiens
tattgtgttttctctgtgcgga

SEQ ID NO: 7134551 - DNA, 22 bp, Homo sapiens
tattgttgttgtgagggggatg

SEQ ID NO: 7134552 - DNA, 22 bp, Homo sapiens
tatttaataaaactatggcatg

SEQ ID NO: 7134553 - DNA, 22 bp, Homo sapiens
tatttaataaaactatggcatg

SEQ ID NO: 7134554 - DNA, 22 bp, Homo sapiens
tatttaagatgtgtcataaaga

SEQ ID NO: 7134555 - DNA, 22 bp, Homo sapiens
tatttaagatgtgtcataaaga

SEQ ID NO: 7134556 - DNA, 22 bp, Homo sapiens
tatttaataaaactatggcatg

SEQ ID NO: 7134557 - DNA, 22 bp, Homo sapiens
tatttaaccagttaaatttcca

SEQ ID NO: 7134558 - DNA, 22 bp, Homo sapiens
tatttaactggaaacacaatga

SEQ ID NO: 7134559 - DNA, 22 bp, Homo sapiens
tatttaactggaaacacaatga

SEQ ID NO: 7134560 - DNA, 22 bp, Homo sapiens
tatttaactggaaacacaatga

SEQ ID NO: 7134561 - DNA, 22 bp, Homo sapiens
tatttaagatgtgtcataaaga

SEQ ID NO: 7134562 - DNA, 22 bp, Homo sapiens
tatttaagatgtgtcataaaga

SEQ ID NO: 7134563 - DNA, 22 bp, Homo sapiens
tatttaagatgtgtcataaaga

SEQ ID NO: 7134564 - DNA, 22 bp, Homo sapiens
tatttaaaataagccccagtgg

SEQ ID NO: 7134565 - DNA, 22 bp, Homo sapiens
tatttaaaataagccccagtgg

SEQ ID NO: 7134566 - DNA, 22 bp, Homo sapiens
tatttaaaataagccccagtgg

SEQ ID NO: 7134567 - DNA, 22 bp, Homo sapiens
tatttaaaataagccccagtgg

SEQ ID NO: 7134568 - DNA, 22 bp, Homo sapiens
tatttaaaatagtgctccagca

SEQ ID NO: 7134569 - DNA, 22 bp, Homo sapiens
tatttaaaatagtgctccagca

SEQ ID NO: 7134570 - DNA, 22 bp, Homo sapiens
tatttaaaatagtgctccagca

SEQ ID NO: 7134571 - DNA, 22 bp, Homo sapiens
tatttaaaatagtgctccagca

SEQ ID NO: 7134572 - DNA, 22 bp, Homo sapiens
tatttaaaatagtgctccagca

SEQ ID NO: 7134573 - DNA, 22 bp, Homo sapiens
tatttaaccagttaaatttcca

SEQ ID NO: 7134574 - DNA, 22 bp, Homo sapiens
taggggcttgtaatttaataga

SEQ ID NO: 7134575 - DNA, 22 bp, Homo sapiens
taggggcttgtaatttaataga

SEQ ID NO: 7134576 - DNA, 22 bp, Homo sapiens
taggggcttgtaatttaataga

SEQ ID NO: 7134577 - DNA, 21 bp, Homo sapiens
taggggctggggctccagctg

SEQ ID NO: 7134578 - DNA, 21 bp, Homo sapiens
taggggctggggctccagctg

SEQ ID NO: 7134579 - DNA, 23 bp, Homo sapiens
taggggctggcgtggagcctgcg

SEQ ID NO: 7134580 - DNA, 23 bp, Homo sapiens
taggggctggcgtggagcctgcg

SEQ ID NO: 7134581 - DNA, 23 bp, Homo sapiens
taggggctggcgtggagcctgcg

SEQ ID NO: 7134582 - DNA, 23 bp, Homo sapiens
taggggctggcgtggagcctgcg

SEQ ID NO: 7134583 - DNA, 23 bp, Homo sapiens
taggggctggcgtggagcctgcg

SEQ ID NO: 7134584 - DNA, 22 bp, Homo sapiens
taggggctcagaacatgtcctt

SEQ ID NO: 7134585 - DNA, 22 bp, Homo sapiens
taggggctcagaacatgtcctt

SEQ ID NO: 7134586 - DNA, 22 bp, Homo sapiens
taggggctcagaacatgtcctt

SEQ ID NO: 7134587 - DNA, 22 bp, Homo sapiens
taggggctcagaacatgtcctt

SEQ ID NO: 7134588 - DNA, 22 bp, Homo sapiens
taggggctcagaacatgtcctt

SEQ ID NO: 7134589 - DNA, 22 bp, Homo sapiens
taggggaactggcacagggcag

SEQ ID NO: 7134590 - DNA, 22 bp, Homo sapiens
taggggaactggcacagggcag

SEQ ID NO: 7134591 - DNA, 23 bp, Homo sapiens
taggggaaaaatcttctgcaatt

SEQ ID NO: 7134592 - DNA, 22 bp, Homo sapiens
taggggagctcgggtgcaatcg

SEQ ID NO: 7134593 - DNA, 22 bp, Homo sapiens
taggggaggggatcatgtgctg

SEQ ID NO: 7134594 - DNA, 22 bp, Homo sapiens
taggggagctcgggtgcaatcg

SEQ ID NO: 7134595 - DNA, 22 bp, Homo sapiens
taggggcagaagcggcggtcca

SEQ ID NO: 7134596 - DNA, 22 bp, Homo sapiens
taggggaggggatcatgtgctg

SEQ ID NO: 7134597 - DNA, 22 bp, Homo sapiens
tagtgcatataactagaatacc

SEQ ID NO: 7134598 - DNA, 22 bp, Homo sapiens
tagtgcattcatctgatcctgt

SEQ ID NO: 7134599 - DNA, 22 bp, Homo sapiens
tagtgcattcatctgatcctgt

SEQ ID NO: 7134600 - DNA, 18 bp, Homo sapiens
tagtgcatgaaaggttca

SEQ ID NO: 7134601 - DNA, 18 bp, Homo sapiens
tagtgcatgaaaggttca

SEQ ID NO: 7134602 - DNA, 22 bp, Homo sapiens
tagtgcagaggaggagcctctg

SEQ ID NO: 7134603 - DNA, 22 bp, Homo sapiens
tagtgcagggttttaagcactg

SEQ ID NO: 7134604 - DNA, 22 bp, Homo sapiens
tagtgcagggttttaagcactg

SEQ ID NO: 7134605 - DNA, 22 bp, Homo sapiens
tagtgcagggttttaagcactg

SEQ ID NO: 7134606 - DNA, 22 bp, Homo sapiens
tagtgcaggttaataggacttc

SEQ ID NO: 7134607 - DNA, 22 bp, Homo sapiens
tagtctctgctttgcccttggc

SEQ ID NO: 7134608 - DNA, 19 bp, Homo sapiens
tagtctctgatgaggcttt

SEQ ID NO: 7134609 - DNA, 22 bp, Homo sapiens
tagtctctggagactctagggg

SEQ ID NO: 7134610 - DNA, 22 bp, Homo sapiens
tagtctctgctttgcccttggc

SEQ ID NO: 7134611 - DNA, 22 bp, Homo sapiens
taggggtgaggccaggcatcag

SEQ ID NO: 7134612 - DNA, 22 bp, Homo sapiens
tagtctctatgagtgaatcaca

SEQ ID NO: 7134613 - DNA, 22 bp, Homo sapiens
tagggggctttgctgcttgaca

SEQ ID NO: 7134614 - DNA, 22 bp, Homo sapiens
tagtctctggagactctagggg

SEQ ID NO: 7134615 - DNA, 22 bp, Homo sapiens
tagtctctgtggtcctgaggaa

SEQ ID NO: 7134616 - DNA, 22 bp, Homo sapiens
tagtgcaacagggaaagagtgt

SEQ ID NO: 7134617 - DNA, 22 bp, Homo sapiens
tagtgccatcttgagctgcttt

SEQ ID NO: 7134618 - DNA, 22 bp, Homo sapiens
tagtgcttaataaatttcagaa

SEQ ID NO: 7134619 - DNA, 22 bp, Homo sapiens
tagtgcttaaaagtggaagaga

SEQ ID NO: 7134620 - DNA, 22 bp, Homo sapiens
tagtgcttaaaagtggaagaga

SEQ ID NO: 7134621 - DNA, 22 bp, Homo sapiens
tagtgcttaaaagtggaagaga

SEQ ID NO: 7134622 - DNA, 22 bp, Homo sapiens
tagtgctatagaagtgcttgcg

SEQ ID NO: 7134623 - DNA, 22 bp, Homo sapiens
tagtggagaagtggagtctgtg

SEQ ID NO: 7134624 - DNA, 22 bp, Homo sapiens
tagtgctttggagctttctcct

SEQ ID NO: 7134625 - DNA, 18 bp, Homo sapiens
tagtggaactgctctggg

SEQ ID NO: 7134626 - DNA, 22 bp, Homo sapiens
tagtgctttattgttcctgaaa

SEQ ID NO: 7134627 - DNA, 22 bp, Homo sapiens
tagtgctttaggcctgagtgtc

SEQ ID NO: 7134628 - DNA, 22 bp, Homo sapiens
tagtgcttggtggagatggaga

SEQ ID NO: 7134629 - DNA, 22 bp, Homo sapiens
tagtgcttggccctaccagata

SEQ ID NO: 7134630 - DNA, 22 bp, Homo sapiens
tagtgcttgagtctctccgtac

SEQ ID NO: 7134631 - DNA, 22 bp, Homo sapiens
tagtgcttctaccctaggcagg

SEQ ID NO: 7134632 - DNA, 22 bp, Homo sapiens
tagtgcttattactgtgctgtc

SEQ ID NO: 7134633 - DNA, 19 bp, Homo sapiens
tagtggagtgacaagttct

SEQ ID NO: 7134634 - DNA, 22 bp, Homo sapiens
tagtggagtagaaaccaaagaa

SEQ ID NO: 7134635 - DNA, 22 bp, Homo sapiens
tagtggaggtggtctgtgaact

SEQ ID NO: 7134636 - DNA, 22 bp, Homo sapiens
tagtggagggtgtagctgctgg

SEQ ID NO: 7134637 - DNA, 22 bp, Homo sapiens
tagtggaggggatgcaaagctt

SEQ ID NO: 7134638 - DNA, 22 bp, Homo sapiens
tagtggaggggatgcaaagctt

SEQ ID NO: 7134639 - DNA, 22 bp, Homo sapiens
tagtggaggcctgttgtgtgca

SEQ ID NO: 7134640 - DNA, 22 bp, Homo sapiens
tagtggagagttgttttgtgca

SEQ ID NO: 7134641 - DNA, 22 bp, Homo sapiens
tagtggagaggatgtggagaaa

SEQ ID NO: 7134642 - DNA, 22 bp, Homo sapiens
tagttacacatgggtagggaat

SEQ ID NO: 7134643 - DNA, 22 bp, Homo sapiens
tagttacaattatgcatggaaa

SEQ ID NO: 7134644 - DNA, 22 bp, Homo sapiens
tagttacaattatgcatggaaa

SEQ ID NO: 7134645 - DNA, 22 bp, Homo sapiens
tagttacaatgggttctgtgac

SEQ ID NO: 7134646 - DNA, 22 bp, Homo sapiens
tagttacaatgggttctgtgac

SEQ ID NO: 7134647 - DNA, 22 bp, Homo sapiens
tagttacaatgggttctgtgac

SEQ ID NO: 7134648 - DNA, 22 bp, Homo sapiens
tagttacaaaccaacaggcagc

SEQ ID NO: 7134649 - DNA, 22 bp, Homo sapiens
tagttacaaaccaacaggcagc

SEQ ID NO: 7134650 - DNA, 22 bp, Homo sapiens
tagttacacatgggtagggaat

SEQ ID NO: 7134651 - DNA, 22 bp, Homo sapiens
tagttacagaagataagggtat

SEQ ID NO: 7134652 - DNA, 22 bp, Homo sapiens
tagttacagaagataagggtat

SEQ ID NO: 7134653 - DNA, 22 bp, Homo sapiens
tagttacagagaaatgatttga

SEQ ID NO: 7134654 - DNA, 22 bp, Homo sapiens
tagttacagagaaatgatttga

SEQ ID NO: 7134655 - DNA, 22 bp, Homo sapiens
tagttacagagaaatgatttga

SEQ ID NO: 7134656 - DNA, 22 bp, Homo sapiens
tagttacagatctaggactgtt

SEQ ID NO: 7134657 - DNA, 22 bp, Homo sapiens
tagttacagatctaggactgtt

SEQ ID NO: 7134658 - DNA, 22 bp, Homo sapiens
tagttacagcaggcaggatata

SEQ ID NO: 7134659 - DNA, 22 bp, Homo sapiens
tagttacagcaggcaggatata

SEQ ID NO: 7134660 - DNA, 22 bp, Homo sapiens
tagtttttactgcgagttataa

SEQ ID NO: 7134661 - DNA, 22 bp, Homo sapiens
tagttttttcaacaaatggtgc

SEQ ID NO: 7134662 - DNA, 22 bp, Homo sapiens
tagttttttcaacaaatggtgc

SEQ ID NO: 7134663 - DNA, 22 bp, Homo sapiens
tagtttttaagtgtacaatttc

SEQ ID NO: 7134664 - DNA, 22 bp, Homo sapiens
tagttttatgaattggtataat

SEQ ID NO: 7134665 - DNA, 22 bp, Homo sapiens
tagtttttaagtgtacaatttc

SEQ ID NO: 7134666 - DNA, 22 bp, Homo sapiens
tagttttataatgttaacatct

SEQ ID NO: 7134667 - DNA, 22 bp, Homo sapiens
tagttttatgaattggtataat

SEQ ID NO: 7134668 - DNA, 22 bp, Homo sapiens
tagttttatgaattggtataat

SEQ ID NO: 7134669 - DNA, 22 bp, Homo sapiens
tagtttatgctgctgcagtgag

SEQ ID NO: 7134670 - DNA, 22 bp, Homo sapiens
tagtttatgattttttggaagg

SEQ ID NO: 7134671 - DNA, 22 bp, Homo sapiens
tagtttatgctgctgcagtgag

SEQ ID NO: 7134672 - DNA, 22 bp, Homo sapiens
tagtttatgattttttggaagg

SEQ ID NO: 7134673 - DNA, 22 bp, Homo sapiens
tagtttatagttagcgagcacg

SEQ ID NO: 7134674 - DNA, 22 bp, Homo sapiens
tagtttatgattttttggaagg

SEQ ID NO: 7134675 - DNA, 22 bp, Homo sapiens
tagtttaggtggggtagacaga

SEQ ID NO: 7134676 - DNA, 22 bp, Homo sapiens
tagtttaggtcgtacaagcaaa

SEQ ID NO: 7134677 - DNA, 22 bp, Homo sapiens
tagtttatgctgctgcagtgag

SEQ ID NO: 7134678 - DNA, 22 bp, Homo sapiens
tagtttcatctccaccctgccc

SEQ ID NO: 7134679 - DNA, 22 bp, Homo sapiens
tagtttagcactaagaaaaaca

SEQ ID NO: 7134680 - DNA, 22 bp, Homo sapiens
tagtttaatggtcaactaatga

SEQ ID NO: 7134681 - DNA, 22 bp, Homo sapiens
tagtttaatggtcaactaatga

SEQ ID NO: 7134682 - DNA, 22 bp, Homo sapiens
tagtttaccaaattgatcttcc

SEQ ID NO: 7134683 - DNA, 22 bp, Homo sapiens
tagtttactcatctataaaatg

SEQ ID NO: 7134684 - DNA, 22 bp, Homo sapiens
tagtttactcatctataaaatg

SEQ ID NO: 7134685 - DNA, 22 bp, Homo sapiens
tagtttactcatctataaaatg

SEQ ID NO: 7134686 - DNA, 22 bp, Homo sapiens
tagtttaatggtcaactaatga

SEQ ID NO: 7134687 - DNA, 22 bp, Homo sapiens
tagttgagcaaggccggaagag

SEQ ID NO: 7134688 - DNA, 22 bp, Homo sapiens
tagttgacttctctatcccagc

SEQ ID NO: 7134689 - DNA, 22 bp, Homo sapiens
tagtttaaaagttagggatgat

SEQ ID NO: 7134690 - DNA, 22 bp, Homo sapiens
tagtttaaaagttagggatgat

SEQ ID NO: 7134691 - DNA, 22 bp, Homo sapiens
tagtttaatggtcaactaatga

SEQ ID NO: 7134692 - DNA, 22 bp, Homo sapiens
tagtttaatggtcaactaatga

SEQ ID NO: 7134693 - DNA, 22 bp, Homo sapiens
tagtttaatggtcaactaatga

SEQ ID NO: 7134694 - DNA, 22 bp, Homo sapiens
tagttctggacacacgttccca

SEQ ID NO: 7134695 - DNA, 22 bp, Homo sapiens
tagttctgtaacatttcaaggg

SEQ ID NO: 7134696 - DNA, 22 bp, Homo sapiens
tagttcttactgttttcagcgt

SEQ ID NO: 7134697 - DNA, 22 bp, Homo sapiens
tagttcttggttcttagttctt

SEQ ID NO: 7134698 - DNA, 22 bp, Homo sapiens
tagttcttggttcttagttctt

SEQ ID NO: 7134699 - DNA, 22 bp, Homo sapiens
tagttctttgacggtgctttga

SEQ ID NO: 7134700 - DNA, 22 bp, Homo sapiens
tagttgaaagggattattgtgg

SEQ ID NO: 7134701 - DNA, 23 bp, Homo sapiens
tagttacattattgtcagagctg

SEQ ID NO: 7134702 - DNA, 22 bp, Homo sapiens
tagttacagtgcatagcaagat

SEQ ID NO: 7134703 - DNA, 22 bp, Homo sapiens
tagttacataaagtggactgtt

SEQ ID NO: 7134704 - DNA, 22 bp, Homo sapiens
tagttacataaagtggactgtt

SEQ ID NO: 7134705 - DNA, 22 bp, Homo sapiens
tagttacataaagtggactgtt

SEQ ID NO: 7134706 - DNA, 22 bp, Homo sapiens
tagttacagcaggcaggatata

SEQ ID NO: 7134707 - DNA, 22 bp, Homo sapiens
tagttacagcaggcaggatata

SEQ ID NO: 7134708 - DNA, 22 bp, Homo sapiens
tagttacaggagtttctgaaat

SEQ ID NO: 7134709 - DNA, 22 bp, Homo sapiens
tagttacaggagtttctgaaat

SEQ ID NO: 7134710 - DNA, 22 bp, Homo sapiens
tagttacagtgcatagcaagat

SEQ ID NO: 7134711 - DNA, 22 bp, Homo sapiens
tagttacagtgcatagcaagat

SEQ ID NO: 7134712 - DNA, 23 bp, Homo sapiens
tagttacattattgtcagagctg

SEQ ID NO: 7134713 - DNA, 22 bp, Homo sapiens
tagttaggaatagcagcgactc

SEQ ID NO: 7134714 - DNA, 22 bp, Homo sapiens
tagttaggggaaaaacgacagg

SEQ ID NO: 7134715 - DNA, 22 bp, Homo sapiens
tagttatatccagtctttaaaa

SEQ ID NO: 7134716 - DNA, 22 bp, Homo sapiens
tagttattattgttactatcag

SEQ ID NO: 7134717 - DNA, 22 bp, Homo sapiens
tagttattattgttactatcag

SEQ ID NO: 7134718 - DNA, 23 bp, Homo sapiens
tagttattttctctgtaatttgc

SEQ ID NO: 7134719 - DNA, 22 bp, Homo sapiens
taggcagggattagggttgatt

SEQ ID NO: 7134720 - DNA, 22 bp, Homo sapiens
taggcaggctgaatgtagattt

SEQ ID NO: 7134721 - DNA, 22 bp, Homo sapiens
taggcaggctgaatgtagattt

SEQ ID NO: 7134722 - DNA, 22 bp, Homo sapiens
taggcaggctgaatgtagattt

SEQ ID NO: 7134723 - DNA, 22 bp, Homo sapiens
taggcaggctgaatgtagattt

SEQ ID NO: 7134724 - DNA, 22 bp, Homo sapiens
taggccagcccttagtcctgtc

SEQ ID NO: 7134725 - DNA, 23 bp, Homo sapiens
taggccagggtgacctggggaga

SEQ ID NO: 7134726 - DNA, 22 bp, Homo sapiens
taggcagatgttaacaggaaaa

SEQ ID NO: 7134727 - DNA, 22 bp, Homo sapiens
taggcagatgttaacaggaaaa

SEQ ID NO: 7134728 - DNA, 22 bp, Homo sapiens
taggcagaggtatggtaaggac

SEQ ID NO: 7134729 - DNA, 20 bp, Homo sapiens
taggcagagctgtgcagcct

SEQ ID NO: 7134730 - DNA, 22 bp, Homo sapiens
taggcagattccatattttggc

SEQ ID NO: 7134731 - DNA, 20 bp, Homo sapiens
taggcagcttgacccttggt

SEQ ID NO: 7134732 - DNA, 23 bp, Homo sapiens
taggcaggactcagatatgacag

SEQ ID NO: 7134733 - DNA, 23 bp, Homo sapiens
taggcaggactcagatatgacag

SEQ ID NO: 7134734 - DNA, 22 bp, Homo sapiens
taggcaggctgaatgtagattt

SEQ ID NO: 7134735 - DNA, 20 bp, Homo sapiens
taggcagagctgtgcagcct

SEQ ID NO: 7134736 - DNA, 20 bp, Homo sapiens
taggcagagctgtgcagcct

SEQ ID NO: 7134737 - DNA, 22 bp, Homo sapiens
taggcagaaaggaaggcaagtt

SEQ ID NO: 7134738 - DNA, 22 bp, Homo sapiens
tagctgtgtagacactcagagc

SEQ ID NO: 7134739 - DNA, 22 bp, Homo sapiens
tagctgtgtagacactcagagc

SEQ ID NO: 7134740 - DNA, 22 bp, Homo sapiens
tagctggttctccaggagctag

SEQ ID NO: 7134741 - DNA, 22 bp, Homo sapiens
tagctgtcagcaatcaagtggt

SEQ ID NO: 7134742 - DNA, 22 bp, Homo sapiens
tagctgtcagcaatcaagtggt

SEQ ID NO: 7134743 - DNA, 22 bp, Homo sapiens
tagctgtcagcaatcaagtggt

SEQ ID NO: 7134744 - DNA, 22 bp, Homo sapiens
tagctgtgaaacagcagaagag

SEQ ID NO: 7134745 - DNA, 22 bp, Homo sapiens
tagctgtgagcacccaggctgt

SEQ ID NO: 7134746 - DNA, 22 bp, Homo sapiens
tagctggtctttaagcatgtaa

SEQ ID NO: 7134747 - DNA, 22 bp, Homo sapiens
tagctgggttgaggtcatctac

SEQ ID NO: 7134748 - DNA, 22 bp, Homo sapiens
tagctgggactactggccctgc

SEQ ID NO: 7134749 - DNA, 22 bp, Homo sapiens
tagctgggactactggccctgc

SEQ ID NO: 7134750 - DNA, 22 bp, Homo sapiens
tagctgggagtgtctgatgggt

SEQ ID NO: 7134751 - DNA, 22 bp, Homo sapiens
tagctgggagtgtctgatgggt

SEQ ID NO: 7134752 - DNA, 22 bp, Homo sapiens
tagctgggagtgtctgatgggt

SEQ ID NO: 7134753 - DNA, 22 bp, Homo sapiens
tagggctgaggcaacaagggag

SEQ ID NO: 7134754 - DNA, 22 bp, Homo sapiens
tagggctgaggcaacaagggag

SEQ ID NO: 7134755 - DNA, 21 bp, Homo sapiens
tagggctctatttttatttca

SEQ ID NO: 7134756 - DNA, 23 bp, Homo sapiens
tagggcagctgggagggacatgc

SEQ ID NO: 7134757 - DNA, 23 bp, Homo sapiens
tagggcagctgggagggacatgc

SEQ ID NO: 7134758 - DNA, 23 bp, Homo sapiens
tagggcagctgggagggacatgc

SEQ ID NO: 7134759 - DNA, 23 bp, Homo sapiens
tagggcagctgggagggacatgc

SEQ ID NO: 7134760 - DNA, 22 bp, Homo sapiens
tagggcagctgcatcaggcact

SEQ ID NO: 7134761 - DNA, 22 bp, Homo sapiens
tagggcagctgcatcaggcact

SEQ ID NO: 7134762 - DNA, 22 bp, Homo sapiens
tagggcagctgcatcaggcact

SEQ ID NO: 7134763 - DNA, 22 bp, Homo sapiens
tagggcagccacccaggctgct

SEQ ID NO: 7134764 - DNA, 22 bp, Homo sapiens
tagggcagccttatagctccca

SEQ ID NO: 7134765 - DNA, 22 bp, Homo sapiens
tagggcagccacccaggctgct

SEQ ID NO: 7134766 - DNA, 22 bp, Homo sapiens
tagggcagccttatagctccca

SEQ ID NO: 7134767 - DNA, 22 bp, Homo sapiens
tagggcagccttatagctccca

SEQ ID NO: 7134768 - DNA, 22 bp, Homo sapiens
tagggcagctgcatcaggcact

SEQ ID NO: 7134769 - DNA, 22 bp, Homo sapiens
tagggcagctgcatcaggcact

SEQ ID NO: 7134770 - DNA, 22 bp, Homo sapiens
tagggcagctgcatcaggcact

SEQ ID NO: 7134771 - DNA, 23 bp, Homo sapiens
tagggcagctgggagggacatgc

SEQ ID NO: 7134772 - DNA, 23 bp, Homo sapiens
tagggcagctgggagggacatgc

SEQ ID NO: 7134773 - DNA, 22 bp, Homo sapiens
tagggcagccacccaggctgct

SEQ ID NO: 7134774 - DNA, 22 bp, Homo sapiens
tagggcagccacccaggctgct

SEQ ID NO: 7134775 - DNA, 22 bp, Homo sapiens
tagggcagccacccaggctgct

SEQ ID NO: 7134776 - DNA, 22 bp, Homo sapiens
tagggcagccacccaggctgct

SEQ ID NO: 7134777 - DNA, 22 bp, Homo sapiens
tagggcagccacccaggctgct

SEQ ID NO: 7134778 - DNA, 22 bp, Homo sapiens
tagggcagccacccaggctgct

SEQ ID NO: 7134779 - DNA, 22 bp, Homo sapiens
tagggcagattcggtggagttt

SEQ ID NO: 7134780 - DNA, 22 bp, Homo sapiens
tagggcagattcggtggagttt

SEQ ID NO: 7134781 - DNA, 22 bp, Homo sapiens
tagggcagattcggtggagttt

SEQ ID NO: 7134782 - DNA, 22 bp, Homo sapiens
tagggcagattcggtggagttt

SEQ ID NO: 7134783 - DNA, 22 bp, Homo sapiens
tagggcagattcggtggagttt

SEQ ID NO: 7134784 - DNA, 22 bp, Homo sapiens
taggccattgatttttataagt

SEQ ID NO: 7134785 - DNA, 22 bp, Homo sapiens
taggcccagttccgcctcccgg

SEQ ID NO: 7134786 - DNA, 22 bp, Homo sapiens
tagggcagagtccaggatgggc

SEQ ID NO: 7134787 - DNA, 22 bp, Homo sapiens
tagggcagagtccaggatgggc

SEQ ID NO: 7134788 - DNA, 22 bp, Homo sapiens
tagggcagagtccaggatgggc

SEQ ID NO: 7134789 - DNA, 22 bp, Homo sapiens
tagggcagagtccaggatgggc

SEQ ID NO: 7134790 - DNA, 22 bp, Homo sapiens
tagggcagagtccaggatgggc

SEQ ID NO: 7134791 - DNA, 22 bp, Homo sapiens
tagggcagattcggtggagttt

SEQ ID NO: 7134792 - DNA, 22 bp, Homo sapiens
tagggctgccatttgcttttct

SEQ ID NO: 7134793 - DNA, 22 bp, Homo sapiens
tagggctgcagaacaatggcct

SEQ ID NO: 7134794 - DNA, 22 bp, Homo sapiens
tagggctgcagaacaatggcct

SEQ ID NO: 7134795 - DNA, 22 bp, Homo sapiens
tagggctgctgcagatgacagg

SEQ ID NO: 7134796 - DNA, 22 bp, Homo sapiens
tagggctgcctatggctagata

SEQ ID NO: 7134797 - DNA, 22 bp, Homo sapiens
tagggctgcctatggctagata

SEQ ID NO: 7134798 - DNA, 22 bp, Homo sapiens
tagggctgcctatggctagata

SEQ ID NO: 7134799 - DNA, 22 bp, Homo sapiens
tagggctgctttgtattctgct

SEQ ID NO: 7134800 - DNA, 22 bp, Homo sapiens
tagggctgctgcagatgacagg

SEQ ID NO: 7134801 - DNA, 22 bp, Homo sapiens
tagggctgctgcagatgacagg

SEQ ID NO: 7134802 - DNA, 22 bp, Homo sapiens
tagggctggcgtgctcagggaa

SEQ ID NO: 7134803 - DNA, 22 bp, Homo sapiens
tagggctggcgtgctcagggaa

SEQ ID NO: 7134804 - DNA, 19 bp, Homo sapiens
tagggctggccgggcggtg

SEQ ID NO: 7134805 - DNA, 16 bp, Homo sapiens
tagggctgggaaggag

SEQ ID NO: 7134806 - DNA, 22 bp, Homo sapiens
tagggctggcgtgctcagggaa

SEQ ID NO: 7134807 - DNA, 16 bp, Homo sapiens
tagggctgggaaggag

SEQ ID NO: 7134808 - DNA, 16 bp, Homo sapiens
tagggctgggaaggag

SEQ ID NO: 7134809 - DNA, 16 bp, Homo sapiens
tagggctgggaaggag

SEQ ID NO: 7134810 - DNA, 22 bp, Homo sapiens
tagggctgtgtctccaggacca

SEQ ID NO: 7134811 - DNA, 22 bp, Homo sapiens
tagggctgtggtcagtcctcta

SEQ ID NO: 7134812 - DNA, 22 bp, Homo sapiens
tagggctgtggtcagtcctcta

SEQ ID NO: 7134813 - DNA, 22 bp, Homo sapiens
tagggctgggtacactcttgcc

SEQ ID NO: 7134814 - DNA, 22 bp, Homo sapiens
tagggctgtttaaaagtgaggt

SEQ ID NO: 7134815 - DNA, 22 bp, Homo sapiens
tagggctgtttaaaagtgaggt

SEQ ID NO: 7134816 - DNA, 22 bp, Homo sapiens
tagggctgtttaaaagtgaggt

SEQ ID NO: 7134817 - DNA, 22 bp, Homo sapiens
tagggctgtttaaaagtgaggt

SEQ ID NO: 7134818 - DNA, 22 bp, Homo sapiens
tagggctgtgtctccaggacca

SEQ ID NO: 7134819 - DNA, 22 bp, Homo sapiens
tagggctgtgtctccaggacca

SEQ ID NO: 7134820 - DNA, 22 bp, Homo sapiens
tagggctgttagtaattctcag

SEQ ID NO: 7134821 - DNA, 22 bp, Homo sapiens
tagctgacgctaaataaatgtt

SEQ ID NO: 7134822 - DNA, 22 bp, Homo sapiens
tagctgacgctaaataaatgtt

SEQ ID NO: 7134823 - DNA, 22 bp, Homo sapiens
tagcagggttttgaagagggtt

SEQ ID NO: 7134824 - DNA, 22 bp, Homo sapiens
tagcagggtccaatgtgaggca

SEQ ID NO: 7134825 - DNA, 22 bp, Homo sapiens
tagcagggtctcaggagtcagg

SEQ ID NO: 7134826 - DNA, 22 bp, Homo sapiens
tagctgccaaaagggtgggcta

SEQ ID NO: 7134827 - DNA, 22 bp, Homo sapiens
tagctgcacaggaagtaagatt

SEQ ID NO: 7134828 - DNA, 22 bp, Homo sapiens
tagctgatgaataattattctt

SEQ ID NO: 7134829 - DNA, 22 bp, Homo sapiens
tagcagggtctcaggagtcagg

SEQ ID NO: 7134830 - DNA, 22 bp, Homo sapiens
tagcagggtccaatgtgaggca

SEQ ID NO: 7134831 - DNA, 22 bp, Homo sapiens
tagcagggtccaatgtgaggca

SEQ ID NO: 7134832 - DNA, 22 bp, Homo sapiens
tagcagggtccaatgtgaggca

SEQ ID NO: 7134833 - DNA, 22 bp, Homo sapiens
tagcaggggtagatagagtgtg

SEQ ID NO: 7134834 - DNA, 18 bp, Homo sapiens
tagcagggcttgtccttt

SEQ ID NO: 7134835 - DNA, 22 bp, Homo sapiens
tagcaggggtagatagagtgtg

SEQ ID NO: 7134836 - DNA, 22 bp, Homo sapiens
tagctgcctttgggctcctgct

SEQ ID NO: 7134837 - DNA, 22 bp, Homo sapiens
tagctgcctttgggctcctgct

SEQ ID NO: 7134838 - DNA, 19 bp, Homo sapiens
tagctgcctgttacctcca

SEQ ID NO: 7134839 - DNA, 22 bp, Homo sapiens
tagctgccagaccattcttact

SEQ ID NO: 7134840 - DNA, 22 bp, Homo sapiens
tagctgccattgctccaggaag

SEQ ID NO: 7134841 - DNA, 22 bp, Homo sapiens
tagctgggaattatctggttgc

SEQ ID NO: 7134842 - DNA, 22 bp, Homo sapiens
tagctgggaattatctggttgc

SEQ ID NO: 7134843 - DNA, 22 bp, Homo sapiens
tagcagggccaggctgggaacc

SEQ ID NO: 7134844 - DNA, 22 bp, Homo sapiens
tagcagggccaggctgggaacc

SEQ ID NO: 7134845 - DNA, 22 bp, Homo sapiens
tagcagggccaggctgggaacc

SEQ ID NO: 7134846 - DNA, 22 bp, Homo sapiens
tagcagggatacaaggtcgcct

SEQ ID NO: 7134847 - DNA, 22 bp, Homo sapiens
tagcagggatacaaggtcgcct

SEQ ID NO: 7134848 - DNA, 22 bp, Homo sapiens
tagcagggaagatgatcagaat

SEQ ID NO: 7134849 - DNA, 22 bp, Homo sapiens
tagcagggaagatgatcagaat

SEQ ID NO: 7134850 - DNA, 22 bp, Homo sapiens
tagcagggaaggtgtgctgagc

SEQ ID NO: 7134851 - DNA, 22 bp, Homo sapiens
tagcagggaaggtgtgctgagc

SEQ ID NO: 7134852 - DNA, 22 bp, Homo sapiens
tagcagggaaggtgtgctgagc

SEQ ID NO: 7134853 - DNA, 22 bp, Homo sapiens
tagcagggagggccagtgtcaa

SEQ ID NO: 7134854 - DNA, 21 bp, Homo sapiens
tagcaggatttggtttatttt

SEQ ID NO: 7134855 - DNA, 22 bp, Homo sapiens
tagcaggcatccaataaatact

SEQ ID NO: 7134856 - DNA, 22 bp, Homo sapiens
tagcaggcatggagatgactgt

SEQ ID NO: 7134857 - DNA, 22 bp, Homo sapiens
tagcaggctcgcaataaaatgt

SEQ ID NO: 7134858 - DNA, 22 bp, Homo sapiens
tagcaggcttgtgaatggagcc

SEQ ID NO: 7134859 - DNA, 22 bp, Homo sapiens
tagcaggcttgtgaatggagcc

SEQ ID NO: 7134860 - DNA, 21 bp, Homo sapiens
tagcaggaggcccctgcttgc

SEQ ID NO: 7134861 - DNA, 21 bp, Homo sapiens
tagcaggagcgaattttgatg

SEQ ID NO: 7134862 - DNA, 21 bp, Homo sapiens
tagcaggagcgaattttgatg

SEQ ID NO: 7134863 - DNA, 22 bp, Homo sapiens
tagcaggagtgtgttctatttt

SEQ ID NO: 7134864 - DNA, 22 bp, Homo sapiens
tagcagctggggctattcatca

SEQ ID NO: 7134865 - DNA, 22 bp, Homo sapiens
tagcagctgcatcattttacag

SEQ ID NO: 7134866 - DNA, 19 bp, Homo sapiens
tagcagctgccaaaggaga

SEQ ID NO: 7134867 - DNA, 22 bp, Homo sapiens
tagcagctgtcagtttcacata

SEQ ID NO: 7134868 - DNA, 22 bp, Homo sapiens
tagcagctgtgagtaaaagcca

SEQ ID NO: 7134869 - DNA, 22 bp, Homo sapiens
tagcagctgtggaggggctgtg

SEQ ID NO: 7134870 - DNA, 22 bp, Homo sapiens
tagcagcttaagtaattagaat

SEQ ID NO: 7134871 - DNA, 22 bp, Homo sapiens
tagcagcttaagtaattagaat

SEQ ID NO: 7134872 - DNA, 22 bp, Homo sapiens
tagcagcttccagagagggcag

SEQ ID NO: 7134873 - DNA, 22 bp, Homo sapiens
tagcaggaagaaagctactcag

SEQ ID NO: 7134874 - DNA, 22 bp, Homo sapiens
tagcaggaatatgaggttaata

SEQ ID NO: 7134875 - DNA, 22 bp, Homo sapiens
tagcaggaatgaagttctgagg

SEQ ID NO: 7134876 - DNA, 22 bp, Homo sapiens
tagcaggaattggctgcagctg

SEQ ID NO: 7134877 - DNA, 20 bp, Homo sapiens
tagatcctggggatttattg

SEQ ID NO: 7134878 - DNA, 22 bp, Homo sapiens
tagatctgatacaattcatctg

SEQ ID NO: 7134879 - DNA, 22 bp, Homo sapiens
tagatctgatacaattcatctg

SEQ ID NO: 7134880 - DNA, 22 bp, Homo sapiens
tagatcttgttacagatttcct

SEQ ID NO: 7134881 - DNA, 22 bp, Homo sapiens
tagatcttgttacagatttcct

SEQ ID NO: 7134882 - DNA, 22 bp, Homo sapiens
tagcaaaagctcaacaggaagg

SEQ ID NO: 7134883 - DNA, 22 bp, Homo sapiens
tagcaaaagctcaacaggaagg

SEQ ID NO: 7134884 - DNA, 22 bp, Homo sapiens
tagcaaaagctcaacaggaagg

SEQ ID NO: 7134885 - DNA, 22 bp, Homo sapiens
tagatgaccttgtgttaggcaa

SEQ ID NO: 7134886 - DNA, 22 bp, Homo sapiens
tagatgaccttgtgttaggcaa

SEQ ID NO: 7134887 - DNA, 22 bp, Homo sapiens
tagatgaccttgtgttaggcaa

SEQ ID NO: 7134888 - DNA, 22 bp, Homo sapiens
tagatgaaggctgagcacctgt

SEQ ID NO: 7134889 - DNA, 22 bp, Homo sapiens
tagatgaaatttgtgtgtatgc

SEQ ID NO: 7134890 - DNA, 22 bp, Homo sapiens
tagatgaactgcctctcagcaa

SEQ ID NO: 7134891 - DNA, 22 bp, Homo sapiens
tagatgaagcaacatgtgtaat

SEQ ID NO: 7134892 - DNA, 22 bp, Homo sapiens
tagcaaagagaaaaattatgct

SEQ ID NO: 7134893 - DNA, 22 bp, Homo sapiens
tagcaaagaagatattattgca

SEQ ID NO: 7134894 - DNA, 22 bp, Homo sapiens
tagcaaagaccaaagctagttg

SEQ ID NO: 7134895 - DNA, 22 bp, Homo sapiens
tagcaaagaccaaagctagttg

SEQ ID NO: 7134896 - DNA, 22 bp, Homo sapiens
tagcaaagaccaaagctagttg

SEQ ID NO: 7134897 - DNA, 21 bp, Homo sapiens
tagcaaagccagatgtatatt

SEQ ID NO: 7134898 - DNA, 21 bp, Homo sapiens
tagcaaagccagatgtatatt

SEQ ID NO: 7134899 - DNA, 21 bp, Homo sapiens
tagcaaagccagatgtatatt

SEQ ID NO: 7134900 - DNA, 22 bp, Homo sapiens
tagcaaagcccacgtgccaagc

SEQ ID NO: 7134901 - DNA, 22 bp, Homo sapiens
tagcaaagcccttgctgtgtaa

SEQ ID NO: 7134902 - DNA, 22 bp, Homo sapiens
tagcaaagcccttgctgtgtaa

SEQ ID NO: 7134903 - DNA, 22 bp, Homo sapiens
tagcaaagcgaaagagatttat

SEQ ID NO: 7134904 - DNA, 22 bp, Homo sapiens
tagcaaagcgaaagagatttat

SEQ ID NO: 7134905 - DNA, 22 bp, Homo sapiens
tagcaaactcatacatgtgggt

SEQ ID NO: 7134906 - DNA, 22 bp, Homo sapiens
tagcaaaatgtggatgtagttg

SEQ ID NO: 7134907 - DNA, 22 bp, Homo sapiens
tagcaaaatgtggatgtagttg

SEQ ID NO: 7134908 - DNA, 22 bp, Homo sapiens
tagcaaaatgtggatgtagttg

SEQ ID NO: 7134909 - DNA, 22 bp, Homo sapiens
tagcaaaatgtggatgtagttg

SEQ ID NO: 7134910 - DNA, 22 bp, Homo sapiens
tagcaaatgtgttatgctatgc

SEQ ID NO: 7134911 - DNA, 21 bp, Homo sapiens
tagcaaattgctattaaggca

SEQ ID NO: 7134912 - DNA, 21 bp, Homo sapiens
tagcaaattggtggaatggga

SEQ ID NO: 7134913 - DNA, 22 bp, Homo sapiens
tagcaacaagtgactatctata

SEQ ID NO: 7134914 - DNA, 22 bp, Homo sapiens
tagcaacaagtgactatctata

SEQ ID NO: 7134915 - DNA, 22 bp, Homo sapiens
tagcaacaatggaagtaacttc

SEQ ID NO: 7134916 - DNA, 22 bp, Homo sapiens
tagcaacaatggaagtaacttc

SEQ ID NO: 7134917 - DNA, 22 bp, Homo sapiens
tagcaacagaaaataggagtgc

SEQ ID NO: 7134918 - DNA, 22 bp, Homo sapiens
tagcaacataagaaacattttg

SEQ ID NO: 7134919 - DNA, 22 bp, Homo sapiens
tagcaacataagaaacattttg

SEQ ID NO: 7134920 - DNA, 22 bp, Homo sapiens
tagcaacataagaaacattttg

SEQ ID NO: 7134921 - DNA, 22 bp, Homo sapiens
tagcaacatggttatcacatta

SEQ ID NO: 7134922 - DNA, 22 bp, Homo sapiens
tagcaacatggttatcacatta

SEQ ID NO: 7134923 - DNA, 22 bp, Homo sapiens
tagcaacatggttatcacatta

SEQ ID NO: 7134924 - DNA, 22 bp, Homo sapiens
tagcaaccagaacagcactcta

SEQ ID NO: 7134925 - DNA, 22 bp, Homo sapiens
tagcaagaagggagatggggtt

SEQ ID NO: 7134926 - DNA, 22 bp, Homo sapiens
tagcagctctgattctgggccc

SEQ ID NO: 7134927 - DNA, 22 bp, Homo sapiens
tagcagctctttactaaccagt

SEQ ID NO: 7134928 - DNA, 22 bp, Homo sapiens
tagcaaatgggcttgttttcca

SEQ ID NO: 7134929 - DNA, 21 bp, Homo sapiens
tagcaaatggagagtaagaga

SEQ ID NO: 7134930 - DNA, 22 bp, Homo sapiens
tagcaaatgggcttgttttcca

SEQ ID NO: 7134931 - DNA, 22 bp, Homo sapiens
tagcaaatgggcttgttttcca

SEQ ID NO: 7134932 - DNA, 22 bp, Homo sapiens
tagcaaatgtctgaaggaatag

SEQ ID NO: 7134933 - DNA, 22 bp, Homo sapiens
tagcaaatgtctgaaggaatag

SEQ ID NO: 7134934 - DNA, 22 bp, Homo sapiens
tagcaaatgtctgaaggaatag

SEQ ID NO: 7134935 - DNA, 22 bp, Homo sapiens
tagcaaatgtgttatgctatgc

SEQ ID NO: 7134936 - DNA, 22 bp, Homo sapiens
tagcaaatgcctggttaattag

SEQ ID NO: 7134937 - DNA, 22 bp, Homo sapiens
tagcaaataaaacagtattgaa

SEQ ID NO: 7134938 - DNA, 22 bp, Homo sapiens
tagcaaatacatgatgtaattt

SEQ ID NO: 7134939 - DNA, 22 bp, Homo sapiens
tagcaaatgcctggttaattag

SEQ ID NO: 7134940 - DNA, 22 bp, Homo sapiens
tagcaaatgcctggttaattag

SEQ ID NO: 7134941 - DNA, 21 bp, Homo sapiens
tagcaaatggagagtaagaga

SEQ ID NO: 7134942 - DNA, 21 bp, Homo sapiens
tagcaaatggagagtaagaga

SEQ ID NO: 7134943 - DNA, 23 bp, Homo sapiens
tagcaaagttgtttgggaaattt

SEQ ID NO: 7134944 - DNA, 22 bp, Homo sapiens
tagcaaagttttgtggtgatta

SEQ ID NO: 7134945 - DNA, 22 bp, Homo sapiens
tagcaaagctccgtagttattt

SEQ ID NO: 7134946 - DNA, 22 bp, Homo sapiens
tagcaaaggatgactatgtacc

SEQ ID NO: 7134947 - DNA, 22 bp, Homo sapiens
tagcaaaggatgactatgtacc

SEQ ID NO: 7134948 - DNA, 22 bp, Homo sapiens
tagcaaaggccttggacacgct

SEQ ID NO: 7134949 - DNA, 22 bp, Homo sapiens
tagcaaagggaaagaagggcct

SEQ ID NO: 7134950 - DNA, 22 bp, Homo sapiens
tagcaaaggtagagttttgaga

SEQ ID NO: 7134951 - DNA, 22 bp, Homo sapiens
tagaacttagcactagacttgt

SEQ ID NO: 7134952 - DNA, 22 bp, Homo sapiens
tagaactggcggctagaccact

SEQ ID NO: 7134953 - DNA, 22 bp, Homo sapiens
tagaacttatttggcattattt

SEQ ID NO: 7134954 - DNA, 22 bp, Homo sapiens
tagaacttgatagacagtacaa

SEQ ID NO: 7134955 - DNA, 22 bp, Homo sapiens
tagaaccagtccacagaatttg

SEQ ID NO: 7134956 - DNA, 22 bp, Homo sapiens
tagaactaagagttatcattta

SEQ ID NO: 7134957 - DNA, 22 bp, Homo sapiens
tagaactagaacaaggatttga

SEQ ID NO: 7134958 - DNA, 22 bp, Homo sapiens
tagaactctggtcttctcatcc

SEQ ID NO: 7134959 - DNA, 22 bp, Homo sapiens
tagaactgacgttagggaagaa

SEQ ID NO: 7134960 - DNA, 22 bp, Homo sapiens
tacttacatgaattcaagagca

SEQ ID NO: 7134961 - DNA, 22 bp, Homo sapiens
tacttacattagcaaacaaggt

SEQ ID NO: 7134962 - DNA, 22 bp, Homo sapiens
tagaaatggagaacagattaat

SEQ ID NO: 7134963 - DNA, 22 bp, Homo sapiens
tagaaatggggaagtagttagg

SEQ ID NO: 7134964 - DNA, 22 bp, Homo sapiens
tagaaatggggaagtagttagg

SEQ ID NO: 7134965 - DNA, 22 bp, Homo sapiens
tagaaatggggaagtagttagg

SEQ ID NO: 7134966 - DNA, 22 bp, Homo sapiens
tagaaatgggttacatttagag

SEQ ID NO: 7134967 - DNA, 22 bp, Homo sapiens
tagaaatgggttacatttagag

SEQ ID NO: 7134968 - DNA, 22 bp, Homo sapiens
tagaaatgggttacatttagag

SEQ ID NO: 7134969 - DNA, 22 bp, Homo sapiens
tagaaatgtaggcttcctgaca

SEQ ID NO: 7134970 - DNA, 23 bp, Homo sapiens
tagaacatcggtgtcttggagca

SEQ ID NO: 7134971 - DNA, 23 bp, Homo sapiens
tagaacatcggtgtcttggagca

SEQ ID NO: 7134972 - DNA, 22 bp, Homo sapiens
tagaacatgacttatttttgga

SEQ ID NO: 7134973 - DNA, 22 bp, Homo sapiens
tagaacatgacttatttttgga

SEQ ID NO: 7134974 - DNA, 22 bp, Homo sapiens
tagaacatgctcatgtataaat

SEQ ID NO: 7134975 - DNA, 22 bp, Homo sapiens
tagaacatttgtagcagctgag

SEQ ID NO: 7134976 - DNA, 22 bp, Homo sapiens
tagaagaacatgtcaaactata

SEQ ID NO: 7134977 - DNA, 22 bp, Homo sapiens
tagaagacaggaaatacaaacc

SEQ ID NO: 7134978 - DNA, 22 bp, Homo sapiens
tagaagagacatagcctgtggt

SEQ ID NO: 7134979 - DNA, 22 bp, Homo sapiens
tagaagaaaagcacttagagat

SEQ ID NO: 7134980 - DNA, 22 bp, Homo sapiens
tagaagaaagtgaagctgggga

SEQ ID NO: 7134981 - DNA, 22 bp, Homo sapiens
tagaagaacatgtcaaactata

SEQ ID NO: 7134982 - DNA, 22 bp, Homo sapiens
tagaagataagacaagtgctgc

SEQ ID NO: 7134983 - DNA, 22 bp, Homo sapiens
tagaagatcttaaaagctgact

SEQ ID NO: 7134984 - DNA, 22 bp, Homo sapiens
tagaagatgccttaaagttgaa

SEQ ID NO: 7134985 - DNA, 22 bp, Homo sapiens
tagaagattcatttcctctgaa

SEQ ID NO: 7134986 - DNA, 22 bp, Homo sapiens
tagaagattccagaggcaaagc

SEQ ID NO: 7134987 - DNA, 22 bp, Homo sapiens
tagaagcacagcctgatggaca

SEQ ID NO: 7134988 - DNA, 22 bp, Homo sapiens
tagaagcacaggttaaaggcat

SEQ ID NO: 7134989 - DNA, 22 bp, Homo sapiens
tagactatagctcacagtgctt

SEQ ID NO: 7134990 - DNA, 22 bp, Homo sapiens
tagactggtgaattagggggaa

SEQ ID NO: 7134991 - DNA, 22 bp, Homo sapiens
tagactggtgaattagggggaa

SEQ ID NO: 7134992 - DNA, 22 bp, Homo sapiens
tagactggtgaattagggggaa

SEQ ID NO: 7134993 - DNA, 22 bp, Homo sapiens
tagactggtgaattagggggaa

SEQ ID NO: 7134994 - DNA, 22 bp, Homo sapiens
tagactgttacagcttttcaga

SEQ ID NO: 7134995 - DNA, 22 bp, Homo sapiens
tagaccattttacaatagtgtg

SEQ ID NO: 7134996 - DNA, 21 bp, Homo sapiens
tagaccagctgtgctcctcgg

SEQ ID NO: 7134997 - DNA, 23 bp, Homo sapiens
tagacctctgctctaaccattag

SEQ ID NO: 7134998 - DNA, 22 bp, Homo sapiens
tagacgtggccgtgttcccaat

SEQ ID NO: 7134999 - DNA, 22 bp, Homo sapiens
tagacaggaaacattaggatgg

SEQ ID NO: 7135000 - DNA, 22 bp, Homo sapiens
tagacaggaaacattaggatgg

SEQ ID NO: 7135001 - DNA, 22 bp, Homo sapiens
tagacaggagtcaggctagaat

SEQ ID NO: 7135002 - DNA, 22 bp, Homo sapiens
tagacagatttcttgttagaca

SEQ ID NO: 7135003 - DNA, 22 bp, Homo sapiens
tagacaggaaacattaggatgg

SEQ ID NO: 7135004 - DNA, 22 bp, Homo sapiens
tagacaggagtcaggctagaat

SEQ ID NO: 7135005 - DNA, 22 bp, Homo sapiens
tagagaaataagctttgccttg

SEQ ID NO: 7135006 - DNA, 22 bp, Homo sapiens
tagagaacaagtatggcacgga

SEQ ID NO: 7135007 - DNA, 22 bp, Homo sapiens
tagagaaacagaaccaacaggg

SEQ ID NO: 7135008 - DNA, 22 bp, Homo sapiens
tagagaaacagaaccaacaggg

SEQ ID NO: 7135009 - DNA, 22 bp, Homo sapiens
tagagaaacagaaccaacaggg

SEQ ID NO: 7135010 - DNA, 21 bp, Homo sapiens
tagagaaaagaagctgttcct

SEQ ID NO: 7135011 - DNA, 21 bp, Homo sapiens
tagagaaaagaagctgttcct

SEQ ID NO: 7135012 - DNA, 22 bp, Homo sapiens
tagagaaaaccactggtgagct

SEQ ID NO: 7135013 - DNA, 22 bp, Homo sapiens
tagagaaaaccactggtgagct

SEQ ID NO: 7135014 - DNA, 22 bp, Homo sapiens
tagagaaaaccactggtgagct

SEQ ID NO: 7135015 - DNA, 22 bp, Homo sapiens
tagagaaaagcagggatcagga

SEQ ID NO: 7135016 - DNA, 22 bp, Homo sapiens
tagagaaaagcagggatcagga

SEQ ID NO: 7135017 - DNA, 19 bp, Homo sapiens
tagacttttccagcaggca

SEQ ID NO: 7135018 - DNA, 22 bp, Homo sapiens
tagagaatggccttgaagtagt

SEQ ID NO: 7135019 - DNA, 22 bp, Homo sapiens
tagagacaccagtaccattctg

SEQ ID NO: 7135020 - DNA, 22 bp, Homo sapiens
tagagacagaaagtagaatggt

SEQ ID NO: 7135021 - DNA, 22 bp, Homo sapiens
tagagacagaaagtagaatggt

SEQ ID NO: 7135022 - DNA, 22 bp, Homo sapiens
tagagagagatatatacacaca

SEQ ID NO: 7135023 - DNA, 22 bp, Homo sapiens
tagagagagatatatacacaca

SEQ ID NO: 7135024 - DNA, 22 bp, Homo sapiens
tagagagagatatatacacaca

SEQ ID NO: 7135025 - DNA, 22 bp, Homo sapiens
tagagagagctgtggtggctct

SEQ ID NO: 7135026 - DNA, 22 bp, Homo sapiens
tagagagagctgtggtggctct

SEQ ID NO: 7135027 - DNA, 22 bp, Homo sapiens
tagagagagctgtggtggctct

SEQ ID NO: 7135028 - DNA, 22 bp, Homo sapiens
tagagagagctgtggtggctct

SEQ ID NO: 7135029 - DNA, 20 bp, Homo sapiens
tagagagaggatattaaagt

SEQ ID NO: 7135030 - DNA, 22 bp, Homo sapiens
tagagagagctgtggtggctct

SEQ ID NO: 7135031 - DNA, 22 bp, Homo sapiens
tagagagccagttgtcatagtt

SEQ ID NO: 7135032 - DNA, 20 bp, Homo sapiens
tagagagatatgggggttcc

SEQ ID NO: 7135033 - DNA, 22 bp, Homo sapiens
tagagaggccgcgggtcccctc

SEQ ID NO: 7135034 - DNA, 16 bp, Homo sapiens
tagagagggcagggag

SEQ ID NO: 7135035 - DNA, 22 bp, Homo sapiens
tagagaggtttgaattggctgc

SEQ ID NO: 7135036 - DNA, 22 bp, Homo sapiens
tagagaggtttgaattggctgc

SEQ ID NO: 7135037 - DNA, 22 bp, Homo sapiens
tagagtcctgtgtgctctgtgg

SEQ ID NO: 7135038 - DNA, 22 bp, Homo sapiens
tagagtctagtgtatacaaagt

SEQ ID NO: 7135039 - DNA, 22 bp, Homo sapiens
tagagtccttcattctgtgcag

SEQ ID NO: 7135040 - DNA, 22 bp, Homo sapiens
tagagtctagtgtatacaaagt

SEQ ID NO: 7135041 - DNA, 22 bp, Homo sapiens
tagatactgcccattgagcaat

SEQ ID NO: 7135042 - DNA, 19 bp, Homo sapiens
tagatactgatgaactcca

SEQ ID NO: 7135043 - DNA, 22 bp, Homo sapiens
tagatactgcccattgagcaat

SEQ ID NO: 7135044 - DNA, 22 bp, Homo sapiens
tagatacctgctggacctcatt

SEQ ID NO: 7135045 - DNA, 22 bp, Homo sapiens
tagatacctgctggacctcatt

SEQ ID NO: 7135046 - DNA, 22 bp, Homo sapiens
tagatacttataatcttccaag

SEQ ID NO: 7135047 - DNA, 22 bp, Homo sapiens
tagatagaagagccacattagc

SEQ ID NO: 7135048 - DNA, 22 bp, Homo sapiens
tagatagaagagccacattagc

SEQ ID NO: 7135049 - DNA, 22 bp, Homo sapiens
tagatagactaatccagcaact

SEQ ID NO: 7135050 - DNA, 22 bp, Homo sapiens
tagatagactaatccagcaact

SEQ ID NO: 7135051 - DNA, 22 bp, Homo sapiens
tagatagataaaatgttgcaga

SEQ ID NO: 7135052 - DNA, 22 bp, Homo sapiens
tagatagataaaatgttgcaga

SEQ ID NO: 7135053 - DNA, 22 bp, Homo sapiens
tagatagattctcctatagagt

SEQ ID NO: 7135054 - DNA, 22 bp, Homo sapiens
tagatagattctcctatagagt

SEQ ID NO: 7135055 - DNA, 23 bp, Homo sapiens
tagatagcacactgacatctgac

SEQ ID NO: 7135056 - DNA, 22 bp, Homo sapiens
tagatataaggtccttagaaca

SEQ ID NO: 7135057 - DNA, 22 bp, Homo sapiens
tagatcctgagccctatctact

SEQ ID NO: 7135058 - DNA, 22 bp, Homo sapiens
tagatcatttgaattgaggtag

SEQ ID NO: 7135059 - DNA, 22 bp, Homo sapiens
tagatcattagcgggggtgaga

SEQ ID NO: 7135060 - DNA, 21 bp, Homo sapiens
tagatcatggtattctttggc

SEQ ID NO: 7135061 - DNA, 22 bp, Homo sapiens
tagatcatggagtaaaatggaa

SEQ ID NO: 7135062 - DNA, 22 bp, Homo sapiens
tagatcatgggtactgcatatg

SEQ ID NO: 7135063 - DNA, 21 bp, Homo sapiens
tagatcatggtattctttggc

SEQ ID NO: 7135064 - DNA, 22 bp, Homo sapiens
tagatcatgggtactgcatatg

SEQ ID NO: 7135065 - DNA, 22 bp, Homo sapiens
tagatcatggagtaaaatggaa

SEQ ID NO: 7135066 - DNA, 22 bp, Homo sapiens
tagatcatatttgtggagaaaa

SEQ ID NO: 7135067 - DNA, 22 bp, Homo sapiens
tagatcatcagtgggctcttat

SEQ ID NO: 7135068 - DNA, 22 bp, Homo sapiens
tagatcatatttgtggagaaaa

SEQ ID NO: 7135069 - DNA, 22 bp, Homo sapiens
tagatcataaatactatggtgc

SEQ ID NO: 7135070 - DNA, 22 bp, Homo sapiens
tagatcatatacttgccatgac

SEQ ID NO: 7135071 - DNA, 22 bp, Homo sapiens
tagatatttctactgtggatta

SEQ ID NO: 7135072 - DNA, 22 bp, Homo sapiens
tagatcaagaatgtccacttgt

SEQ ID NO: 7135073 - DNA, 22 bp, Homo sapiens
tagatataaggtccttagaaca

SEQ ID NO: 7135074 - DNA, 22 bp, Homo sapiens
tagatataaggtccttagaaca

SEQ ID NO: 7135075 - DNA, 22 bp, Homo sapiens
tagatataaggtccttagaaca

SEQ ID NO: 7135076 - DNA, 22 bp, Homo sapiens
tagatatgacagcagaacaagc

SEQ ID NO: 7135077 - DNA, 22 bp, Homo sapiens
tagatatgacagcagaacaagc

SEQ ID NO: 7135078 - DNA, 22 bp, Homo sapiens
taagaccagtatgcattttcac

SEQ ID NO: 7135079 - DNA, 22 bp, Homo sapiens
taagacatttgacaaaccattt

SEQ ID NO: 7135080 - DNA, 22 bp, Homo sapiens
taagactagttgaatggttttc

SEQ ID NO: 7135081 - DNA, 22 bp, Homo sapiens
taagactagttgaatggttttc

SEQ ID NO: 7135082 - DNA, 22 bp, Homo sapiens
taagacttaggtcgagtttggc

SEQ ID NO: 7135083 - DNA, 22 bp, Homo sapiens
taagacttaggtcgagtttggc

SEQ ID NO: 7135084 - DNA, 22 bp, Homo sapiens
taagacatggttgatctagtgt

SEQ ID NO: 7135085 - DNA, 22 bp, Homo sapiens
taagacatggttgatctagtgt

SEQ ID NO: 7135086 - DNA, 22 bp, Homo sapiens
taagacatggttgatctagtgt

SEQ ID NO: 7135087 - DNA, 22 bp, Homo sapiens
taagacatttgaaatgtgatcc

SEQ ID NO: 7135088 - DNA, 22 bp, Homo sapiens
taagacatttgaaatgtgatcc

SEQ ID NO: 7135089 - DNA, 22 bp, Homo sapiens
taagacatttgaaatgtgatcc

SEQ ID NO: 7135090 - DNA, 22 bp, Homo sapiens
taagacatttgaaatgtgatcc

SEQ ID NO: 7135091 - DNA, 22 bp, Homo sapiens
taagacatttgaaatgtgatcc

SEQ ID NO: 7135092 - DNA, 22 bp, Homo sapiens
taagacatgagactcagccagt

SEQ ID NO: 7135093 - DNA, 22 bp, Homo sapiens
taagacatcctggatgttcaaa

SEQ ID NO: 7135094 - DNA, 22 bp, Homo sapiens
taagacatcctggatgttcaaa

SEQ ID NO: 7135095 - DNA, 22 bp, Homo sapiens
taagacatccgttgcttataat

SEQ ID NO: 7135096 - DNA, 21 bp, Homo sapiens
taagacagtatgaatactttc

SEQ ID NO: 7135097 - DNA, 21 bp, Homo sapiens
taagacagtatgaatactttc

SEQ ID NO: 7135098 - DNA, 22 bp, Homo sapiens
taagacataccaagttgtgtga

SEQ ID NO: 7135099 - DNA, 22 bp, Homo sapiens
taagacatcattaaacagcaat

SEQ ID NO: 7135100 - DNA, 22 bp, Homo sapiens
taagacaagcctcgcatttgta

SEQ ID NO: 7135101 - DNA, 22 bp, Homo sapiens
taagacaagcctcgcatttgta

SEQ ID NO: 7135102 - DNA, 18 bp, Homo sapiens
taacatgttttcattaag

SEQ ID NO: 7135103 - DNA, 22 bp, Homo sapiens
taagacaaatactatttcaaga

SEQ ID NO: 7135104 - DNA, 22 bp, Homo sapiens
taagacaaatactatttcaaga

SEQ ID NO: 7135105 - DNA, 22 bp, Homo sapiens
taagacaaatactatttcaaga

SEQ ID NO: 7135106 - DNA, 22 bp, Homo sapiens
taagacaattcttcagtcacaa

SEQ ID NO: 7135107 - DNA, 19 bp, Homo sapiens
taagacagattcctagagt

SEQ ID NO: 7135108 - DNA, 22 bp, Homo sapiens
taagacagggagggctctcagc

SEQ ID NO: 7135109 - DNA, 22 bp, Homo sapiens
taagacagggtctattcttagt

SEQ ID NO: 7135110 - DNA, 22 bp, Homo sapiens
taacatgcatagatttgtatta

SEQ ID NO: 7135111 - DNA, 22 bp, Homo sapiens
taacatgcattgacaaatattt

SEQ ID NO: 7135112 - DNA, 22 bp, Homo sapiens
taacatgcattgacaaatattt

SEQ ID NO: 7135113 - DNA, 22 bp, Homo sapiens
taacatgcattgacaaatattt

SEQ ID NO: 7135114 - DNA, 22 bp, Homo sapiens
taacatgctaatttgcagatag

SEQ ID NO: 7135115 - DNA, 22 bp, Homo sapiens
taacatgctaggaagagtgatt

SEQ ID NO: 7135116 - DNA, 22 bp, Homo sapiens
taacatgctaatttgcagatag

SEQ ID NO: 7135117 - DNA, 22 bp, Homo sapiens
taacatgttaagaaattagata

SEQ ID NO: 7135118 - DNA, 22 bp, Homo sapiens
taagagaatgttgtggctaggt

SEQ ID NO: 7135119 - DNA, 22 bp, Homo sapiens
taagagaatgtcaggagtggat

SEQ ID NO: 7135120 - DNA, 22 bp, Homo sapiens
taagagaatgtcaggagtggat

SEQ ID NO: 7135121 - DNA, 22 bp, Homo sapiens
taagagaaggatctgttccagg

SEQ ID NO: 7135122 - DNA, 22 bp, Homo sapiens
taagacttcattagtaatatgg

SEQ ID NO: 7135123 - DNA, 22 bp, Homo sapiens
taagacttccaggaaaaggtgg

SEQ ID NO: 7135124 - DNA, 22 bp, Homo sapiens
taagacttgatccaaagaacta

SEQ ID NO: 7135125 - DNA, 22 bp, Homo sapiens
taagagaactggatagatagga

SEQ ID NO: 7135126 - DNA, 22 bp, Homo sapiens
taagagaactggatagatagga

SEQ ID NO: 7135127 - DNA, 22 bp, Homo sapiens
taagagaactggatagatagga

SEQ ID NO: 7135128 - DNA, 22 bp, Homo sapiens
taagagaactggatagatagga

SEQ ID NO: 7135129 - DNA, 22 bp, Homo sapiens
taagagcactgaagtcttctta

SEQ ID NO: 7135130 - DNA, 22 bp, Homo sapiens
taagagcactgaagtcttctta

SEQ ID NO: 7135131 - DNA, 22 bp, Homo sapiens
taagagcagaacagcaacatat

SEQ ID NO: 7135132 - DNA, 22 bp, Homo sapiens
taagagcactgaagtcttctta

SEQ ID NO: 7135133 - DNA, 22 bp, Homo sapiens
taagagattaaagatgtaattt

SEQ ID NO: 7135134 - DNA, 22 bp, Homo sapiens
taagagacttaagaataattga

SEQ ID NO: 7135135 - DNA, 22 bp, Homo sapiens
taagagatgcttttctaaataa

SEQ ID NO: 7135136 - DNA, 22 bp, Homo sapiens
taagagaccgatattcttaagt

SEQ ID NO: 7135137 - DNA, 18 bp, Homo sapiens
taagagcagactgtaggc

SEQ ID NO: 7135138 - DNA, 22 bp, Homo sapiens
taagagcagaggttgaataaat

SEQ ID NO: 7135139 - DNA, 22 bp, Homo sapiens
taagagcagaggttgaataaat

SEQ ID NO: 7135140 - DNA, 22 bp, Homo sapiens
taagagcagaggttgaataaat

SEQ ID NO: 7135141 - DNA, 22 bp, Homo sapiens
taagagcataggcttgaaaata

SEQ ID NO: 7135142 - DNA, 22 bp, Homo sapiens
taagagcataggcttgaaaata

SEQ ID NO: 7135143 - DNA, 22 bp, Homo sapiens
taagagcattgtaaaataatct

SEQ ID NO: 7135144 - DNA, 22 bp, Homo sapiens
taagagcattgtaaaataatct

SEQ ID NO: 7135145 - DNA, 21 bp, Homo sapiens
taagagcctaacacagaaagg

SEQ ID NO: 7135146 - DNA, 22 bp, Homo sapiens
taagagcctgtgctttgagttc

SEQ ID NO: 7135147 - DNA, 21 bp, Homo sapiens
taagagctattattgcaaacc

SEQ ID NO: 7135148 - DNA, 21 bp, Homo sapiens
taagagctattattgcaaacc

SEQ ID NO: 7135149 - DNA, 22 bp, Homo sapiens
taagaggcaaaagatactcaga

SEQ ID NO: 7135150 - DNA, 22 bp, Homo sapiens
taagaggatatttggccagaag

SEQ ID NO: 7135151 - DNA, 22 bp, Homo sapiens
taagagctgttcaggtacccat

SEQ ID NO: 7135152 - DNA, 22 bp, Homo sapiens
taagagctcccttctccttgca

SEQ ID NO: 7135153 - DNA, 22 bp, Homo sapiens
taagagctgaggcattgggaca

SEQ ID NO: 7135154 - DNA, 22 bp, Homo sapiens
taaatgttactttcctttcaca

SEQ ID NO: 7135155 - DNA, 22 bp, Homo sapiens
taaatgttatgcccatcatcca

SEQ ID NO: 7135156 - DNA, 22 bp, Homo sapiens
taaatgttatgcccatcatcca

SEQ ID NO: 7135157 - DNA, 22 bp, Homo sapiens
taaatgctatcgcataaaacct

SEQ ID NO: 7135158 - DNA, 22 bp, Homo sapiens
taaatgctcaataaatgttgct

SEQ ID NO: 7135159 - DNA, 22 bp, Homo sapiens
taaatgctcaataaatgttgct

SEQ ID NO: 7135160 - DNA, 18 bp, Homo sapiens
taaatgcatgttaataac

SEQ ID NO: 7135161 - DNA, 22 bp, Homo sapiens
taaatgctccatacatacacca

SEQ ID NO: 7135162 - DNA, 22 bp, Homo sapiens
taaatgctccatacatacacca

SEQ ID NO: 7135163 - DNA, 22 bp, Homo sapiens
taacagctggcgttataggaat

SEQ ID NO: 7135164 - DNA, 20 bp, Homo sapiens
taacaggaagcattatttta

SEQ ID NO: 7135165 - DNA, 22 bp, Homo sapiens
taacaggatgacagcagacatt

SEQ ID NO: 7135166 - DNA, 22 bp, Homo sapiens
taacaggcaaggtcacaccttg

SEQ ID NO: 7135167 - DNA, 22 bp, Homo sapiens
taacaggctgatcatatatcct

SEQ ID NO: 7135168 - DNA, 20 bp, Homo sapiens
taacagggccctagaaagag

SEQ ID NO: 7135169 - DNA, 22 bp, Homo sapiens
taacagctctgtgtggctgtaa

SEQ ID NO: 7135170 - DNA, 22 bp, Homo sapiens
taacagcatttgaatgagtaac

SEQ ID NO: 7135171 - DNA, 22 bp, Homo sapiens
taacagcagtcctcttctcatg

SEQ ID NO: 7135172 - DNA, 22 bp, Homo sapiens
taacagcatttgaatgagtaac

SEQ ID NO: 7135173 - DNA, 22 bp, Homo sapiens
taacagcatttgaatgagtaac

SEQ ID NO: 7135174 - DNA, 22 bp, Homo sapiens
taaatgtttagtcttatttggg

SEQ ID NO: 7135175 - DNA, 22 bp, Homo sapiens
taaatgtttagtcttatttggg

SEQ ID NO: 7135176 - DNA, 22 bp, Homo sapiens
taaatgtttagtcttatttggg

SEQ ID NO: 7135177 - DNA, 22 bp, Homo sapiens
taaatgtttagtcttatttggg

SEQ ID NO: 7135178 - DNA, 22 bp, Homo sapiens
taaatgtttagtcttatttggg

SEQ ID NO: 7135179 - DNA, 22 bp, Homo sapiens
taaatgttttgtgggttgagtt

SEQ ID NO: 7135180 - DNA, 22 bp, Homo sapiens
taaatgttttgtgggttgagtt

SEQ ID NO: 7135181 - DNA, 22 bp, Homo sapiens
taaattaaagattggagaagga

SEQ ID NO: 7135182 - DNA, 22 bp, Homo sapiens
taaatgttggcattggaggccg

SEQ ID NO: 7135183 - DNA, 22 bp, Homo sapiens
taaatgttggcattggaggccg

SEQ ID NO: 7135184 - DNA, 22 bp, Homo sapiens
taaatgttgtaagtacatctaa

SEQ ID NO: 7135185 - DNA, 22 bp, Homo sapiens
taaatgttgtaagtacatctaa

SEQ ID NO: 7135186 - DNA, 22 bp, Homo sapiens
taaatgttgtaagtacatctaa

SEQ ID NO: 7135187 - DNA, 22 bp, Homo sapiens
taaatgttgtaagtacatctaa

SEQ ID NO: 7135188 - DNA, 22 bp, Homo sapiens
taaatgttgtaagtacatctaa

SEQ ID NO: 7135189 - DNA, 22 bp, Homo sapiens
taaatgttgtaagtacatctaa

SEQ ID NO: 7135190 - DNA, 22 bp, Homo sapiens
taaatgttgtaagtacatctaa

SEQ ID NO: 7135191 - DNA, 22 bp, Homo sapiens
taacagtgtgtccagtcagttt

SEQ ID NO: 7135192 - DNA, 20 bp, Homo sapiens
taacagttgaagaacaagga

SEQ ID NO: 7135193 - DNA, 22 bp, Homo sapiens
taacagtgacctgaatgtcaat

SEQ ID NO: 7135194 - DNA, 22 bp, Homo sapiens
taacagtattgaagataaacta

SEQ ID NO: 7135195 - DNA, 22 bp, Homo sapiens
taacagtatagcctaacatttc

SEQ ID NO: 7135196 - DNA, 20 bp, Homo sapiens
taacagtaagtgatgttaca

SEQ ID NO: 7135197 - DNA, 22 bp, Homo sapiens
taacagtacatccttttctctt

SEQ ID NO: 7135198 - DNA, 22 bp, Homo sapiens
taacagtaaagtaagttagctt

SEQ ID NO: 7135199 - DNA, 22 bp, Homo sapiens
taacatcttgcagtagcagaac

SEQ ID NO: 7135200 - DNA, 22 bp, Homo sapiens
taacatcttattggcaaagata

SEQ ID NO: 7135201 - DNA, 22 bp, Homo sapiens
taacatctaagggagagaaagt

SEQ ID NO: 7135202 - DNA, 22 bp, Homo sapiens
taacatctccctgacttttgct

SEQ ID NO: 7135203 - DNA, 22 bp, Homo sapiens
taacatctgggctgcgtcctga

SEQ ID NO: 7135204 - DNA, 22 bp, Homo sapiens
taacatcttaactggatacttc

SEQ ID NO: 7135205 - DNA, 22 bp, Homo sapiens
taacatctttagcagctcgaac

SEQ ID NO: 7135206 - DNA, 22 bp, Homo sapiens
taacatctttagcagctcgaac

SEQ ID NO: 7135207 - DNA, 20 bp, Homo sapiens
taacagttgaagaacaagga

SEQ ID NO: 7135208 - DNA, 22 bp, Homo sapiens
taacagttggtgtaatttcttg

SEQ ID NO: 7135209 - DNA, 22 bp, Homo sapiens
taacataacttttccttgaccc

SEQ ID NO: 7135210 - DNA, 22 bp, Homo sapiens
taacataacttttccttgaccc

SEQ ID NO: 7135211 - DNA, 20 bp, Homo sapiens
taacatagtccagagaacga

SEQ ID NO: 7135212 - DNA, 22 bp, Homo sapiens
taacatattgtgtggcactagg

SEQ ID NO: 7135213 - DNA, 22 bp, Homo sapiens
taacatcaaacatgttttaaag

SEQ ID NO: 7135214 - DNA, 22 bp, Homo sapiens
taacatcaaactgcattttcta

SEQ ID NO: 7135215 - DNA, 22 bp, Homo sapiens
taaagagcacgcttttctctct

SEQ ID NO: 7135216 - DNA, 22 bp, Homo sapiens
taaagagcacgcttttctctct

SEQ ID NO: 7135217 - DNA, 22 bp, Homo sapiens
taaagacatggtgtaggtgaac

SEQ ID NO: 7135218 - DNA, 22 bp, Homo sapiens
taaagacatggtgtaggtgaac

SEQ ID NO: 7135219 - DNA, 22 bp, Homo sapiens
taaagagccattgtatggtttt

SEQ ID NO: 7135220 - DNA, 22 bp, Homo sapiens
taaagagccattgtatggtttt

SEQ ID NO: 7135221 - DNA, 22 bp, Homo sapiens
taaagagccattgtatggtttt

SEQ ID NO: 7135222 - DNA, 22 bp, Homo sapiens
taaagagcgatatgctttaaag

SEQ ID NO: 7135223 - DNA, 22 bp, Homo sapiens
taaagataagacatcaactgag

SEQ ID NO: 7135224 - DNA, 22 bp, Homo sapiens
taaagataagacatcaactgag

SEQ ID NO: 7135225 - DNA, 17 bp, Homo sapiens
taaagatcagccatgta

SEQ ID NO: 7135226 - DNA, 17 bp, Homo sapiens
taaagatcagccatgta

SEQ ID NO: 7135227 - DNA, 22 bp, Homo sapiens
taaagatgcccacattgcaggt

SEQ ID NO: 7135228 - DNA, 22 bp, Homo sapiens
taaagatgcccacattgcaggt

SEQ ID NO: 7135229 - DNA, 22 bp, Homo sapiens
taaagatgctatagtgaaggag

SEQ ID NO: 7135230 - DNA, 22 bp, Homo sapiens
taaagatgctatagtgaaggag

SEQ ID NO: 7135231 - DNA, 22 bp, Homo sapiens
taaagatggagatgacctagga

SEQ ID NO: 7135232 - DNA, 22 bp, Homo sapiens
taaagatgttctcatttcatag

SEQ ID NO: 7135233 - DNA, 22 bp, Homo sapiens
taaagattgctcaaaactgtga

SEQ ID NO: 7135234 - DNA, 22 bp, Homo sapiens
taaagcaaaaatgaactgccat

SEQ ID NO: 7135235 - DNA, 22 bp, Homo sapiens
taaagcaaaaatgaactgccat

SEQ ID NO: 7135236 - DNA, 22 bp, Homo sapiens
taaagcaaaaatgaactgccat

SEQ ID NO: 7135237 - DNA, 22 bp, Homo sapiens
taaagcaaaaatgaactgccat

SEQ ID NO: 7135238 - DNA, 22 bp, Homo sapiens
taaagcaaaaatgaactgccat

SEQ ID NO: 7135239 - DNA, 23 bp, Homo sapiens
taaagcaaagtcaagtgcactcc

SEQ ID NO: 7135240 - DNA, 22 bp, Homo sapiens
taaagcaaggaatagagtagtc

SEQ ID NO: 7135241 - DNA, 22 bp, Homo sapiens
taaagcaaggaatagagtagtc

SEQ ID NO: 7135242 - DNA, 22 bp, Homo sapiens
taaagcaaggaatagagtagtc

SEQ ID NO: 7135243 - DNA, 22 bp, Homo sapiens
taaagcaaggcaaattgttggt

SEQ ID NO: 7135244 - DNA, 22 bp, Homo sapiens
taaagcaaggcaaattgttggt

SEQ ID NO: 7135245 - DNA, 22 bp, Homo sapiens
taaagcaatgaaagttttgcag

SEQ ID NO: 7135246 - DNA, 22 bp, Homo sapiens
taaagcaatgaaagttttgcag

SEQ ID NO: 7135247 - DNA, 22 bp, Homo sapiens
taaagcaatgaaagttttgcag

SEQ ID NO: 7135248 - DNA, 22 bp, Homo sapiens
taaagcaatgaaagttttgcag

SEQ ID NO: 7135249 - DNA, 22 bp, Homo sapiens
taaagcaattactcagtggctt

SEQ ID NO: 7135250 - DNA, 22 bp, Homo sapiens
taaagcaattactcagtggctt

SEQ ID NO: 7135251 - DNA, 22 bp, Homo sapiens
taaagcaattactcagtggctt

SEQ ID NO: 7135252 - DNA, 22 bp, Homo sapiens
taaagcaatttgagcaagttct

SEQ ID NO: 7135253 - DNA, 22 bp, Homo sapiens
taaagcaatttgagcaagttct

SEQ ID NO: 7135254 - DNA, 22 bp, Homo sapiens
taaagcaatttgagcaagttct

SEQ ID NO: 7135255 - DNA, 19 bp, Homo sapiens
taaagcacatagcaaaagt

SEQ ID NO: 7135256 - DNA, 20 bp, Homo sapiens
taaagcagccgtggagggta

SEQ ID NO: 7135257 - DNA, 22 bp, Homo sapiens
taaagcagccagggtctaagcc

SEQ ID NO: 7135258 - DNA, 22 bp, Homo sapiens
taaatgataataatgctagtgt

SEQ ID NO: 7135259 - DNA, 22 bp, Homo sapiens
taaagcagcgtgggtggggcag

SEQ ID NO: 7135260 - DNA, 22 bp, Homo sapiens
taaatgatttatgtatgtgaaa

SEQ ID NO: 7135261 - DNA, 22 bp, Homo sapiens
taaatgatttatgtatgtgaaa

SEQ ID NO: 7135262 - DNA, 22 bp, Homo sapiens
taaatgatttatgtatgtgaaa

SEQ ID NO: 7135263 - DNA, 22 bp, Homo sapiens
taaatgcaagggaaaggcaaga

SEQ ID NO: 7135264 - DNA, 22 bp, Homo sapiens
taaatgcaaagcttggcgctta

SEQ ID NO: 7135265 - DNA, 22 bp, Homo sapiens
taaatgcaaagcttggcgctta

SEQ ID NO: 7135266 - DNA, 22 bp, Homo sapiens
taaatgcaaagcttggcgctta

SEQ ID NO: 7135267 - DNA, 22 bp, Homo sapiens
taaatgcaatgtgctttaccag

SEQ ID NO: 7135268 - DNA, 22 bp, Homo sapiens
taaatgcaagtgctcctgggag

SEQ ID NO: 7135269 - DNA, 22 bp, Homo sapiens
taaatgcaagtgctcctgggag

SEQ ID NO: 7135270 - DNA, 22 bp, Homo sapiens
taaatgcaagggaaaggcaaga

SEQ ID NO: 7135271 - DNA, 22 bp, Homo sapiens
taaatgcaagggaaaggcaaga

SEQ ID NO: 7135272 - DNA, 18 bp, Homo sapiens
taaatgcatgttaataac

SEQ ID NO: 7135273 - DNA, 18 bp, Homo sapiens
taaatgcatgttaataac

SEQ ID NO: 7135274 - DNA, 18 bp, Homo sapiens
taaatgcatgttaataac

SEQ ID NO: 7135275 - DNA, 20 bp, Homo sapiens
taaatgcatgaatgtaaggc

SEQ ID NO: 7135276 - DNA, 20 bp, Homo sapiens
taaatgcatgaatgtaaggc

SEQ ID NO: 7135277 - DNA, 22 bp, Homo sapiens
taaatgcagttagtacttgcca

SEQ ID NO: 7135278 - DNA, 20 bp, Homo sapiens
taaatgcatctgttcaactg

SEQ ID NO: 7135279 - DNA, 20 bp, Homo sapiens
taaatgcatgaatgtaaggc

SEQ ID NO: 7135280 - DNA, 22 bp, Homo sapiens
taaatgcagttagtacttgcca

SEQ ID NO: 7135281 - DNA, 22 bp, Homo sapiens
taaatgcagttagtacttgcca

SEQ ID NO: 7135282 - DNA, 22 bp, Homo sapiens
taaatgcagtacaaattgttct

SEQ ID NO: 7135283 - DNA, 22 bp, Homo sapiens
taaatgcagcagtttctgttct

SEQ ID NO: 7135284 - DNA, 22 bp, Homo sapiens
taaatgcagtacaaattgttct

SEQ ID NO: 7135285 - DNA, 22 bp, Homo sapiens
taaatgcagtacaaattgttct

SEQ ID NO: 7135286 - DNA, 22 bp, Homo sapiens
taaatgcagcagtttctgttct

SEQ ID NO: 7135287 - DNA, 22 bp, Homo sapiens
taaatgcagcagtttctgttct

SEQ ID NO: 7135288 - DNA, 22 bp, Homo sapiens
taaatgcagattcctgagccta

SEQ ID NO: 7135289 - DNA, 22 bp, Homo sapiens
taaaagagaatggataacagag

SEQ ID NO: 7135290 - DNA, 22 bp, Homo sapiens
taaaagagaatggataacagag

SEQ ID NO: 7135291 - DNA, 22 bp, Homo sapiens
taaaagagaatggataacagag

SEQ ID NO: 7135292 - DNA, 22 bp, Homo sapiens
taaaagacatataactgtagga

SEQ ID NO: 7135293 - DNA, 22 bp, Homo sapiens
taaaagaagcttcaaggccggc

SEQ ID NO: 7135294 - DNA, 22 bp, Homo sapiens
taaaagaagcttcaaggccggc

SEQ ID NO: 7135295 - DNA, 22 bp, Homo sapiens
taaaagaagcttcaaggccggc

SEQ ID NO: 7135296 - DNA, 21 bp, Homo sapiens
taaaagatgacaagacagctc

SEQ ID NO: 7135297 - DNA, 21 bp, Homo sapiens
taaaagatgacaagacagctc

SEQ ID NO: 7135298 - DNA, 22 bp, Homo sapiens
taaaagattttataggaacaag

SEQ ID NO: 7135299 - DNA, 22 bp, Homo sapiens
gttttacaaatgacggcattca

SEQ ID NO: 7135300 - DNA, 22 bp, Homo sapiens
gttttacaaatgacggcattca

SEQ ID NO: 7135301 - DNA, 22 bp, Homo sapiens
gttttacaaatgacggcattca

SEQ ID NO: 7135302 - DNA, 22 bp, Homo sapiens
gttttacaaatgacggcattca

SEQ ID NO: 7135303 - DNA, 22 bp, Homo sapiens
taaaactgaatacatactgagg

SEQ ID NO: 7135304 - DNA, 22 bp, Homo sapiens
taaaacttctcatttttatggt

SEQ ID NO: 7135305 - DNA, 22 bp, Homo sapiens
taaaactttgaaggtgctcagt

SEQ ID NO: 7135306 - DNA, 22 bp, Homo sapiens
taaaagaagcttcaaggccggc

SEQ ID NO: 7135307 - DNA, 21 bp, Homo sapiens
taaaactgtaactttgtcctg

SEQ ID NO: 7135308 - DNA, 22 bp, Homo sapiens
taaaacttaactatccagatta

SEQ ID NO: 7135309 - DNA, 22 bp, Homo sapiens
taaaacttaactatccagatta

SEQ ID NO: 7135310 - DNA, 22 bp, Homo sapiens
taaaacttctcatttttatggt

SEQ ID NO: 7135311 - DNA, 22 bp, Homo sapiens
taaaaggcacttggatgctgag

SEQ ID NO: 7135312 - DNA, 22 bp, Homo sapiens
taaaaggcaatactagatgagt

SEQ ID NO: 7135313 - DNA, 22 bp, Homo sapiens
taaaagtatactttcaaaggag

SEQ ID NO: 7135314 - DNA, 22 bp, Homo sapiens
taaaagtatactttcaaaggag

SEQ ID NO: 7135315 - DNA, 22 bp, Homo sapiens
taaaagattttataggaacaag

SEQ ID NO: 7135316 - DNA, 22 bp, Homo sapiens
taaaagctgagatatcctgtac

SEQ ID NO: 7135317 - DNA, 22 bp, Homo sapiens
taaaaggaggttgaagctgtca

SEQ ID NO: 7135318 - DNA, 22 bp, Homo sapiens
taaaaggattagcaggatgggc

SEQ ID NO: 7135319 - DNA, 22 bp, Homo sapiens
taaaagttagctaggacaaagt

SEQ ID NO: 7135320 - DNA, 22 bp, Homo sapiens
taaagacagatggaccagccat

SEQ ID NO: 7135321 - DNA, 23 bp, Homo sapiens
taaagacagccttcaggattctg

SEQ ID NO: 7135322 - DNA, 23 bp, Homo sapiens
taaagacagccttcaggattctg

SEQ ID NO: 7135323 - DNA, 20 bp, Homo sapiens
taaagacataagctactatc

SEQ ID NO: 7135324 - DNA, 20 bp, Homo sapiens
taaagacataagctactatc

SEQ ID NO: 7135325 - DNA, 22 bp, Homo sapiens
taaagacataggatcagggaga

SEQ ID NO: 7135326 - DNA, 22 bp, Homo sapiens
taaagacataggatcagggaga

SEQ ID NO: 7135327 - DNA, 22 bp, Homo sapiens
taaagacataggatcagggaga

SEQ ID NO: 7135328 - DNA, 22 bp, Homo sapiens
taaagacatgcaaagtctaatt

SEQ ID NO: 7135329 - DNA, 22 bp, Homo sapiens
taaagacatgcaaagtctaatt

SEQ ID NO: 7135330 - DNA, 22 bp, Homo sapiens
taaagacatggtgtaggtgaac

SEQ ID NO: 7135331 - DNA, 22 bp, Homo sapiens
gttgagcaaggccagagaagcc

SEQ ID NO: 7135332 - DNA, 22 bp, Homo sapiens
gttgagcaaggccagagaagcc

SEQ ID NO: 7135333 - DNA, 22 bp, Homo sapiens
gttgagaagcctcaaagaagga

SEQ ID NO: 7135334 - DNA, 22 bp, Homo sapiens
gttgagaagcctcaaagaagga

SEQ ID NO: 7135335 - DNA, 22 bp, Homo sapiens
gtttatattcaacggagtatct

SEQ ID NO: 7135336 - DNA, 22 bp, Homo sapiens
gtttatattcaacggagtatct

SEQ ID NO: 7135337 - DNA, 22 bp, Homo sapiens
gtttatattcaacggagtatct

SEQ ID NO: 7135338 - DNA, 22 bp, Homo sapiens
gtttatattcaacggagtatct

SEQ ID NO: 7135339 - DNA, 22 bp, Homo sapiens
gtttatcacaataaataattct

SEQ ID NO: 7135340 - DNA, 22 bp, Homo sapiens
gtttatgaaatttcaggcattt

SEQ ID NO: 7135341 - DNA, 22 bp, Homo sapiens
gtttatcttaatggactcagag

SEQ ID NO: 7135342 - DNA, 22 bp, Homo sapiens
gtttatgaaatttcaggcattt

SEQ ID NO: 7135343 - DNA, 22 bp, Homo sapiens
gtttatctgcactctcttgtag

SEQ ID NO: 7135344 - DNA, 22 bp, Homo sapiens
gtttatcttaatggactcagag

SEQ ID NO: 7135345 - DNA, 22 bp, Homo sapiens
gtttatcagagagcagaggtgg

SEQ ID NO: 7135346 - DNA, 22 bp, Homo sapiens
gtttatcagagagcagaggtgg

SEQ ID NO: 7135347 - DNA, 22 bp, Homo sapiens
gtttatcattattattagcaac

SEQ ID NO: 7135348 - DNA, 21 bp, Homo sapiens
gtttatgaatcttgtcctgct

SEQ ID NO: 7135349 - DNA, 22 bp, Homo sapiens
gtttatgaatgtgtcagacata

SEQ ID NO: 7135350 - DNA, 22 bp, Homo sapiens
gtttatgaatgtgtcagacata

SEQ ID NO: 7135351 - DNA, 22 bp, Homo sapiens
gtttatgaatgttactatagag

SEQ ID NO: 7135352 - DNA, 22 bp, Homo sapiens
gtttatgaatgttactatagag

SEQ ID NO: 7135353 - DNA, 22 bp, Homo sapiens
gtttatgagttacgtaggggtt

SEQ ID NO: 7135354 - DNA, 22 bp, Homo sapiens
gtttatgaggaaaagttatgat

SEQ ID NO: 7135355 - DNA, 22 bp, Homo sapiens
gtttatgaggaaaagttatgat

SEQ ID NO: 7135356 - DNA, 22 bp, Homo sapiens
gtttatgagttacgtaggggtt

SEQ ID NO: 7135357 - DNA, 22 bp, Homo sapiens
gtttattaactgtcaagtgatt

SEQ ID NO: 7135358 - DNA, 22 bp, Homo sapiens
gtttatgaattgcattcccttt

SEQ ID NO: 7135359 - DNA, 21 bp, Homo sapiens
gtttatgaatcttgtcctgct

SEQ ID NO: 7135360 - DNA, 22 bp, Homo sapiens
gtttatgaattgcattcccttt

SEQ ID NO: 7135361 - DNA, 22 bp, Homo sapiens
gtttattaactgtcaagtgatt

SEQ ID NO: 7135362 - DNA, 22 bp, Homo sapiens
gtttattaactgtcaagtgatt

SEQ ID NO: 7135363 - DNA, 22 bp, Homo sapiens
gtttattaactgtcaagtgatt

SEQ ID NO: 7135364 - DNA, 22 bp, Homo sapiens
gtttattagagttttctgtctg

SEQ ID NO: 7135365 - DNA, 22 bp, Homo sapiens
gtttattagagttttctgtctg

SEQ ID NO: 7135366 - DNA, 22 bp, Homo sapiens
gtttattagagttttctgtctg

SEQ ID NO: 7135367 - DNA, 22 bp, Homo sapiens
gtttattagagttttctgtctg

SEQ ID NO: 7135368 - DNA, 22 bp, Homo sapiens
gtttattatacaacaaaagcta

SEQ ID NO: 7135369 - DNA, 22 bp, Homo sapiens
gtttattatacaacaaaagcta

SEQ ID NO: 7135370 - DNA, 22 bp, Homo sapiens
gtttattatacaacaaaagcta

SEQ ID NO: 7135371 - DNA, 22 bp, Homo sapiens
gtttattatacaacaaaagcta

SEQ ID NO: 7135372 - DNA, 22 bp, Homo sapiens
gtttcaaagggaagacgctgga

SEQ ID NO: 7135373 - DNA, 22 bp, Homo sapiens
gtttcaaaggtgtcaggcagtt

SEQ ID NO: 7135374 - DNA, 22 bp, Homo sapiens
gtttcaaaggtgtcaggcagtt

SEQ ID NO: 7135375 - DNA, 22 bp, Homo sapiens
gtttcaaagtcagaaaaggagg

SEQ ID NO: 7135376 - DNA, 22 bp, Homo sapiens
gtttcaaagtcagaaaaggagg

SEQ ID NO: 7135377 - DNA, 22 bp, Homo sapiens
gttctttaagtggagaaggaaa

SEQ ID NO: 7135378 - DNA, 21 bp, Homo sapiens
gttcttcctgactagagtagt

SEQ ID NO: 7135379 - DNA, 22 bp, Homo sapiens
gttcttcctggaagtggatttc

SEQ ID NO: 7135380 - DNA, 22 bp, Homo sapiens
gttcttcctcattgctttgaag

SEQ ID NO: 7135381 - DNA, 22 bp, Homo sapiens
gttcttctcttgtaatggaatc

SEQ ID NO: 7135382 - DNA, 21 bp, Homo sapiens
gttcttgcaggatttccttcc

SEQ ID NO: 7135383 - DNA, 19 bp, Homo sapiens
gttcttttcacctctgtgc

SEQ ID NO: 7135384 - DNA, 19 bp, Homo sapiens
gttctttcatagtaagagc

SEQ ID NO: 7135385 - DNA, 22 bp, Homo sapiens
gttgaaaatacagattcctagg

SEQ ID NO: 7135386 - DNA, 22 bp, Homo sapiens
gttgaaaatacagattcctagg

SEQ ID NO: 7135387 - DNA, 22 bp, Homo sapiens
gttgaaagtagatgctatttgg

SEQ ID NO: 7135388 - DNA, 22 bp, Homo sapiens
gttgaaaatgactttataccat

SEQ ID NO: 7135389 - DNA, 22 bp, Homo sapiens
gttgaaagatgtcttggttccc

SEQ ID NO: 7135390 - DNA, 22 bp, Homo sapiens
gttgaaacttagttgaaattta

SEQ ID NO: 7135391 - DNA, 22 bp, Homo sapiens
gttgaaaatgactttataccat

SEQ ID NO: 7135392 - DNA, 22 bp, Homo sapiens
gttgaaaatgactttataccat

SEQ ID NO: 7135393 - DNA, 22 bp, Homo sapiens
gttgaaatcctaaccccctagt

SEQ ID NO: 7135394 - DNA, 22 bp, Homo sapiens
gttgaactatgttttatctgac

SEQ ID NO: 7135395 - DNA, 22 bp, Homo sapiens
gttgaagtaaggcagccacagg

SEQ ID NO: 7135396 - DNA, 22 bp, Homo sapiens
gttgaactatgttttatctgac

SEQ ID NO: 7135397 - DNA, 22 bp, Homo sapiens
gttgaatacttgagaaatccat

SEQ ID NO: 7135398 - DNA, 21 bp, Homo sapiens
gttgaatatccatgtatgtgt

SEQ ID NO: 7135399 - DNA, 22 bp, Homo sapiens
gttgaatatcccgtatcttaaa

SEQ ID NO: 7135400 - DNA, 22 bp, Homo sapiens
gttgaagtttatatgagtgctt

SEQ ID NO: 7135401 - DNA, 22 bp, Homo sapiens
gttgaatatcgtgttcttgttt

SEQ ID NO: 7135402 - DNA, 22 bp, Homo sapiens
gttgaatattttaagagttttg

SEQ ID NO: 7135403 - DNA, 22 bp, Homo sapiens
gttgacagaaaaataacatagc

SEQ ID NO: 7135404 - DNA, 22 bp, Homo sapiens
gttgacagaattgtgtggctgg

SEQ ID NO: 7135405 - DNA, 22 bp, Homo sapiens
gttgacagagcgcctttgaatt

SEQ ID NO: 7135406 - DNA, 22 bp, Homo sapiens
gttgacagctggtgagctgcta

SEQ ID NO: 7135407 - DNA, 22 bp, Homo sapiens
gttgacaggaaggcgttcccag

SEQ ID NO: 7135408 - DNA, 22 bp, Homo sapiens
gttgacagtgaccctgaaagca

SEQ ID NO: 7135409 - DNA, 22 bp, Homo sapiens
gtttcacagatggtgttcatat

SEQ ID NO: 7135410 - DNA, 22 bp, Homo sapiens
gtttcacagatggggagacacg

SEQ ID NO: 7135411 - DNA, 22 bp, Homo sapiens
gtttcacagatggtgttcatat

SEQ ID NO: 7135412 - DNA, 22 bp, Homo sapiens
gtttcacagtctgcagaatttt

SEQ ID NO: 7135413 - DNA, 22 bp, Homo sapiens
gtttcagaaatggtttatgcaa

SEQ ID NO: 7135414 - DNA, 22 bp, Homo sapiens
gtttcacagatggggagacacg

SEQ ID NO: 7135415 - DNA, 22 bp, Homo sapiens
gtttcacacatcctgcacatag

SEQ ID NO: 7135416 - DNA, 22 bp, Homo sapiens
gtttcaaataggtttcagcaaa

SEQ ID NO: 7135417 - DNA, 22 bp, Homo sapiens
gtttcttagacagacattatct

SEQ ID NO: 7135418 - DNA, 22 bp, Homo sapiens
gtttcagaaatggtttatgcaa

SEQ ID NO: 7135419 - DNA, 22 bp, Homo sapiens
gtttcagaaatgttctcctgct

SEQ ID NO: 7135420 - DNA, 22 bp, Homo sapiens
gtttctttctattgactgaaca

SEQ ID NO: 7135421 - DNA, 22 bp, Homo sapiens
gtttctttctattgactgaaca

SEQ ID NO: 7135422 - DNA, 22 bp, Homo sapiens
gtttctttctattgactgaaca

SEQ ID NO: 7135423 - DNA, 22 bp, Homo sapiens
gtttctttctattgactgaaca

SEQ ID NO: 7135424 - DNA, 22 bp, Homo sapiens
gtttcttttgtgatcaccaacc

SEQ ID NO: 7135425 - DNA, 22 bp, Homo sapiens
gtttcttttgtgatcaccaacc

SEQ ID NO: 7135426 - DNA, 22 bp, Homo sapiens
gtttcttttgtgatcaccaacc

SEQ ID NO: 7135427 - DNA, 22 bp, Homo sapiens
gtttcttttgtgatcaccaacc

SEQ ID NO: 7135428 - DNA, 22 bp, Homo sapiens
gtttcttttaaaatatgtagac

SEQ ID NO: 7135429 - DNA, 22 bp, Homo sapiens
gtttgcagttgtcatcctcctg

SEQ ID NO: 7135430 - DNA, 22 bp, Homo sapiens
gtttgcagggagagatgtggtg

SEQ ID NO: 7135431 - DNA, 21 bp, Homo sapiens
gtttgcagttgagtccttccc

SEQ ID NO: 7135432 - DNA, 22 bp, Homo sapiens
gtttgagaacaaaaggggacct

SEQ ID NO: 7135433 - DNA, 22 bp, Homo sapiens
gtttgagatgggttattgctct

SEQ ID NO: 7135434 - DNA, 22 bp, Homo sapiens
gtttgattcaagaacaaagagt

SEQ ID NO: 7135435 - DNA, 22 bp, Homo sapiens
gtttgattcaagaacaaagagt

SEQ ID NO: 7135436 - DNA, 22 bp, Homo sapiens
gtttgcaacatagtcctatgta

SEQ ID NO: 7135437 - DNA, 22 bp, Homo sapiens
gtttgcaggaactctggggaga

SEQ ID NO: 7135438 - DNA, 22 bp, Homo sapiens
gtttgaaagtggcaagtccttg

SEQ ID NO: 7135439 - DNA, 22 bp, Homo sapiens
gtttgaaagaccaattagattt

SEQ ID NO: 7135440 - DNA, 22 bp, Homo sapiens
gtttgaaagttcaacaggaaaa

SEQ ID NO: 7135441 - DNA, 22 bp, Homo sapiens
gtttgaaagttcaacaggaaaa

SEQ ID NO: 7135442 - DNA, 22 bp, Homo sapiens
gtttgaaatgtctgcaagggaa

SEQ ID NO: 7135443 - DNA, 22 bp, Homo sapiens
gtttgtcaggaggttgaagtca

SEQ ID NO: 7135444 - DNA, 22 bp, Homo sapiens
gtttgtcatttgtacttctagc

SEQ ID NO: 7135445 - DNA, 22 bp, Homo sapiens
gtttgtcttaattaggcatcga

SEQ ID NO: 7135446 - DNA, 22 bp, Homo sapiens
gtttgtgtaacatgatgatgat

SEQ ID NO: 7135447 - DNA, 22 bp, Homo sapiens
gtttgtgtaacatgatgatgat

SEQ ID NO: 7135448 - DNA, 22 bp, Homo sapiens
gtttgtgtaacatgatgatgat

SEQ ID NO: 7135449 - DNA, 22 bp, Homo sapiens
gtttgtgtaacatgatgatgat

SEQ ID NO: 7135450 - DNA, 22 bp, Homo sapiens
gtttgtgtaacatgatgatgat

SEQ ID NO: 7135451 - DNA, 22 bp, Homo sapiens
gtttgttttaagataggatgga

SEQ ID NO: 7135452 - DNA, 22 bp, Homo sapiens
gtttgttttaagataggatgga

SEQ ID NO: 7135453 - DNA, 22 bp, Homo sapiens
gtttgtttgtagggaagccgtg

SEQ ID NO: 7135454 - DNA, 22 bp, Homo sapiens
gtttgtttgtagggaagccgtg

SEQ ID NO: 7135455 - DNA, 22 bp, Homo sapiens
gtttgtttatacaaaagatcct

SEQ ID NO: 7135456 - DNA, 22 bp, Homo sapiens
gtttgtttatacaaaagatcct

SEQ ID NO: 7135457 - DNA, 21 bp, Homo sapiens
gtgctgggacacagccaggct

SEQ ID NO: 7135458 - DNA, 22 bp, Homo sapiens
gtgctgggattacaggtgtgag

SEQ ID NO: 7135459 - DNA, 22 bp, Homo sapiens
gtgctgggattacaggtgtgag

SEQ ID NO: 7135460 - DNA, 22 bp, Homo sapiens
gtgctgggattacaggtgtgag

SEQ ID NO: 7135461 - DNA, 22 bp, Homo sapiens
gtgttattagagcattaatttt

SEQ ID NO: 7135462 - DNA, 22 bp, Homo sapiens
gtgttattagagcattaatttt

SEQ ID NO: 7135463 - DNA, 22 bp, Homo sapiens
gtgttattagagcattaatttt

SEQ ID NO: 7135464 - DNA, 22 bp, Homo sapiens
gtgctggctggggcatcaggca

SEQ ID NO: 7135465 - DNA, 21 bp, Homo sapiens
gtgctgggacacagccaggct

SEQ ID NO: 7135466 - DNA, 21 bp, Homo sapiens
gtgctgggacacagccaggct

SEQ ID NO: 7135467 - DNA, 22 bp, Homo sapiens
gtgctggctgccaggaggctgc

SEQ ID NO: 7135468 - DNA, 17 bp, Homo sapiens
gtgctggcctggggctc

SEQ ID NO: 7135469 - DNA, 17 bp, Homo sapiens
gtgctggcctggggctc

SEQ ID NO: 7135470 - DNA, 22 bp, Homo sapiens
gtgctggcctcagagggtcatg

SEQ ID NO: 7135471 - DNA, 22 bp, Homo sapiens
gtgctggctgccaggaggctgc

SEQ ID NO: 7135472 - DNA, 22 bp, Homo sapiens
gtgctggctgccaggaggctgc

SEQ ID NO: 7135473 - DNA, 22 bp, Homo sapiens
gtgctggctggacatggagcac

SEQ ID NO: 7135474 - DNA, 22 bp, Homo sapiens
gtgctggctggacatggagcac

SEQ ID NO: 7135475 - DNA, 22 bp, Homo sapiens
gtgctggctggacatggagcac

SEQ ID NO: 7135476 - DNA, 21 bp, Homo sapiens
gtgttggcatatggtggttga

SEQ ID NO: 7135477 - DNA, 22 bp, Homo sapiens
gtgttgtggagcttgtcagggg

SEQ ID NO: 7135478 - DNA, 22 bp, Homo sapiens
gtgttgtggagcttgtcagggg

SEQ ID NO: 7135479 - DNA, 22 bp, Homo sapiens
gtgttgatgacattttagaaac

SEQ ID NO: 7135480 - DNA, 22 bp, Homo sapiens
gtgttggacagcttctactgtg

SEQ ID NO: 7135481 - DNA, 23 bp, Homo sapiens
gtgttggcagcagtgctctgggg

SEQ ID NO: 7135482 - DNA, 22 bp, Homo sapiens
gtgttgatgacattttagaaac

SEQ ID NO: 7135483 - DNA, 22 bp, Homo sapiens
gtgttgatgacattttagaaac

SEQ ID NO: 7135484 - DNA, 22 bp, Homo sapiens
gtgttctttatttagtgatgct

SEQ ID NO: 7135485 - DNA, 22 bp, Homo sapiens
gtgttcttttgcttcacagaaa

SEQ ID NO: 7135486 - DNA, 22 bp, Homo sapiens
gtgttcttttgcttcacagaaa

SEQ ID NO: 7135487 - DNA, 22 bp, Homo sapiens
gtgttcatgccccagtgcagga

SEQ ID NO: 7135488 - DNA, 22 bp, Homo sapiens
gtgttcatgccccagtgcagga

SEQ ID NO: 7135489 - DNA, 22 bp, Homo sapiens
gtgttcaggctgacttggagag

SEQ ID NO: 7135490 - DNA, 22 bp, Homo sapiens
gtgttcaggcttccactgtatg

SEQ ID NO: 7135491 - DNA, 22 bp, Homo sapiens
gtgttcatcccaatgctgatag

SEQ ID NO: 7135492 - DNA, 22 bp, Homo sapiens
gtgttcattgctagtgaggtgt

SEQ ID NO: 7135493 - DNA, 22 bp, Homo sapiens
gtgttctctagagctgtacaaa

SEQ ID NO: 7135494 - DNA, 22 bp, Homo sapiens
gttataaatacctaataggatt

SEQ ID NO: 7135495 - DNA, 22 bp, Homo sapiens
gttaacattcaattaaacagtc

SEQ ID NO: 7135496 - DNA, 23 bp, Homo sapiens
gttaacatggtccatggaagagc

SEQ ID NO: 7135497 - DNA, 22 bp, Homo sapiens
gttaacattcaattaaacagtc

SEQ ID NO: 7135498 - DNA, 22 bp, Homo sapiens
gttaacacaggactctctgcct

SEQ ID NO: 7135499 - DNA, 22 bp, Homo sapiens
gttaacacatgcaattgcactt

SEQ ID NO: 7135500 - DNA, 22 bp, Homo sapiens
gttaacaacactgtgagtgctg

SEQ ID NO: 7135501 - DNA, 22 bp, Homo sapiens
gttaacaaatgtaaagcaatta

SEQ ID NO: 7135502 - DNA, 22 bp, Homo sapiens
gttaacaaccaaacagaagttc

SEQ ID NO: 7135503 - DNA, 22 bp, Homo sapiens
gttaacaaccaaacagaagttc

SEQ ID NO: 7135504 - DNA, 22 bp, Homo sapiens
gttaacaagaattactctggaa

SEQ ID NO: 7135505 - DNA, 22 bp, Homo sapiens
gttaacaaggtgtagaggtttt

SEQ ID NO: 7135506 - DNA, 18 bp, Homo sapiens
gttaacaattactaacgc

SEQ ID NO: 7135507 - DNA, 18 bp, Homo sapiens
gttaacaattactaacgc

SEQ ID NO: 7135508 - DNA, 22 bp, Homo sapiens
gttaaatgcattttccaagcac

SEQ ID NO: 7135509 - DNA, 22 bp, Homo sapiens
gttaaattcgatgatggataaa

SEQ ID NO: 7135510 - DNA, 22 bp, Homo sapiens
gttaacaaatgtaaagcaatta

SEQ ID NO: 7135511 - DNA, 22 bp, Homo sapiens
gttaacaaatgtaaagcaatta

SEQ ID NO: 7135512 - DNA, 22 bp, Homo sapiens
gttaaatgcagattctgactca

SEQ ID NO: 7135513 - DNA, 22 bp, Homo sapiens
gttaaatgcactattgaaagct

SEQ ID NO: 7135514 - DNA, 22 bp, Homo sapiens
gttaaataacctcatgtccgtt

SEQ ID NO: 7135515 - DNA, 22 bp, Homo sapiens
gttaaataacctcatgtccgtt

SEQ ID NO: 7135516 - DNA, 22 bp, Homo sapiens
gtgtttaataggtagctgaatc

SEQ ID NO: 7135517 - DNA, 22 bp, Homo sapiens
gtgtttatgagtgaccttgtct

SEQ ID NO: 7135518 - DNA, 20 bp, Homo sapiens
gtgtttcatgtgatacaatg

SEQ ID NO: 7135519 - DNA, 22 bp, Homo sapiens
gtgtttcccaagcctgggaagg

SEQ ID NO: 7135520 - DNA, 22 bp, Homo sapiens
gtgtttgacttaggtacattaa

SEQ ID NO: 7135521 - DNA, 22 bp, Homo sapiens
gtgtttgctggagctctgggtc

SEQ ID NO: 7135522 - DNA, 22 bp, Homo sapiens
gtgtttgctggagctctgggtc

SEQ ID NO: 7135523 - DNA, 22 bp, Homo sapiens
gtgtttccctggcacaagaacc

SEQ ID NO: 7135524 - DNA, 22 bp, Homo sapiens
gttatattcaaaatgaggctgt

SEQ ID NO: 7135525 - DNA, 22 bp, Homo sapiens
gttatatatagtatttctctga

SEQ ID NO: 7135526 - DNA, 22 bp, Homo sapiens
gttatataattcctgtggtagt

SEQ ID NO: 7135527 - DNA, 22 bp, Homo sapiens
gttatagccatgcttatttgtt

SEQ ID NO: 7135528 - DNA, 22 bp, Homo sapiens
gttatataagacaaatcagagt

SEQ ID NO: 7135529 - DNA, 22 bp, Homo sapiens
gttatataagacaaatcagagt

SEQ ID NO: 7135530 - DNA, 22 bp, Homo sapiens
gttataaatgactgcaaaagtt

SEQ ID NO: 7135531 - DNA, 22 bp, Homo sapiens
gttataaatgactgcaaaagtt

SEQ ID NO: 7135532 - DNA, 22 bp, Homo sapiens
gttataaatgactgcaaaagtt

SEQ ID NO: 7135533 - DNA, 22 bp, Homo sapiens
gttatacttatgtgcaaaaata

SEQ ID NO: 7135534 - DNA, 18 bp, Homo sapiens
gttatagcagcagcattt

SEQ ID NO: 7135535 - DNA, 22 bp, Homo sapiens
gttatgaagtcattcacaaata

SEQ ID NO: 7135536 - DNA, 22 bp, Homo sapiens
gttatgaagtcattcacaaata

SEQ ID NO: 7135537 - DNA, 22 bp, Homo sapiens
gttatgaaataaatatagatca

SEQ ID NO: 7135538 - DNA, 22 bp, Homo sapiens
gttatgaaataaatatagatca

SEQ ID NO: 7135539 - DNA, 22 bp, Homo sapiens
gttatcttctatttctcatact

SEQ ID NO: 7135540 - DNA, 22 bp, Homo sapiens
gttatcttccctttgatgattt

SEQ ID NO: 7135541 - DNA, 22 bp, Homo sapiens
gttatcttagggtacaaaggac

SEQ ID NO: 7135542 - DNA, 19 bp, Homo sapiens
gttatcaaggggctacttt

SEQ ID NO: 7135543 - DNA, 22 bp, Homo sapiens
gttatattggcagaagagaaga

SEQ ID NO: 7135544 - DNA, 22 bp, Homo sapiens
gttatattgccaagtatattgt

SEQ ID NO: 7135545 - DNA, 22 bp, Homo sapiens
gttatattgccaagtatattgt

SEQ ID NO: 7135546 - DNA, 22 bp, Homo sapiens
gttatattgccaagtatattgt

SEQ ID NO: 7135547 - DNA, 22 bp, Homo sapiens
gttatattggcagaagagaaga

SEQ ID NO: 7135548 - DNA, 22 bp, Homo sapiens
gttatattggcagaagagaaga

SEQ ID NO: 7135549 - DNA, 22 bp, Homo sapiens
gttatttcagccacagagtgca

SEQ ID NO: 7135550 - DNA, 22 bp, Homo sapiens
gttatttataaggtgtaactcc

SEQ ID NO: 7135551 - DNA, 22 bp, Homo sapiens
gttatttataaggtgtaactcc

SEQ ID NO: 7135552 - DNA, 22 bp, Homo sapiens
gttatttataaggtgtaactcc

SEQ ID NO: 7135553 - DNA, 22 bp, Homo sapiens
gttatttaactttgtagcatgg

SEQ ID NO: 7135554 - DNA, 22 bp, Homo sapiens
gttatttaactttgtagcatgg

SEQ ID NO: 7135555 - DNA, 22 bp, Homo sapiens
gttattgtttatcctgcacccc

SEQ ID NO: 7135556 - DNA, 22 bp, Homo sapiens
gttatttaactttgtagcatgg

SEQ ID NO: 7135557 - DNA, 22 bp, Homo sapiens
gttatttaactttgtagcatgg

SEQ ID NO: 7135558 - DNA, 22 bp, Homo sapiens
gttattgtccatttatttagca

SEQ ID NO: 7135559 - DNA, 22 bp, Homo sapiens
gttattgtccatttatttagca

SEQ ID NO: 7135560 - DNA, 22 bp, Homo sapiens
gttattgtccatttatttagca

SEQ ID NO: 7135561 - DNA, 22 bp, Homo sapiens
gttattgtgtttgttcagggca

SEQ ID NO: 7135562 - DNA, 22 bp, Homo sapiens
gttattgtttatcctgcacccc

SEQ ID NO: 7135563 - DNA, 22 bp, Homo sapiens
gttattgctggatagatacatc

SEQ ID NO: 7135564 - DNA, 22 bp, Homo sapiens
gttattggaaagcctggagggc

SEQ ID NO: 7135565 - DNA, 22 bp, Homo sapiens
gttattggaaagcctggagggc

SEQ ID NO: 7135566 - DNA, 20 bp, Homo sapiens
gttattggaaatattgtgtg

SEQ ID NO: 7135567 - DNA, 20 bp, Homo sapiens
gttattggaaatattgtgtg

SEQ ID NO: 7135568 - DNA, 22 bp, Homo sapiens
gttattggcagcatttcagagt

SEQ ID NO: 7135569 - DNA, 22 bp, Homo sapiens
gttattggcagcatttcagagt

SEQ ID NO: 7135570 - DNA, 22 bp, Homo sapiens
gttattgggtgcctcaggccct

SEQ ID NO: 7135571 - DNA, 22 bp, Homo sapiens
gttattgggtgcctcaggccct

SEQ ID NO: 7135572 - DNA, 20 bp, Homo sapiens
gttattggtcatttttgcca

SEQ ID NO: 7135573 - DNA, 20 bp, Homo sapiens
gttattggtcatttttgcca

SEQ ID NO: 7135574 - DNA, 21 bp, Homo sapiens
gttattggttacactgcactt

SEQ ID NO: 7135575 - DNA, 21 bp, Homo sapiens
gttattggttacactgcactt

SEQ ID NO: 7135576 - DNA, 22 bp, Homo sapiens
gttattgtccagcacagttggg

SEQ ID NO: 7135577 - DNA, 22 bp, Homo sapiens
gttattgtccagcacagttggg

SEQ ID NO: 7135578 - DNA, 22 bp, Homo sapiens
gttattgtccagcacagttggg

SEQ ID NO: 7135579 - DNA, 22 bp, Homo sapiens
gttattttaacttctcagtaat

SEQ ID NO: 7135580 - DNA, 22 bp, Homo sapiens
gttattttaacttctcagtaat

SEQ ID NO: 7135581 - DNA, 22 bp, Homo sapiens
gttctggaagcttttgagcaac

SEQ ID NO: 7135582 - DNA, 21 bp, Homo sapiens
gttctggaggctgcaagtcca

SEQ ID NO: 7135583 - DNA, 22 bp, Homo sapiens
gttctggagtggtgccaggcct

SEQ ID NO: 7135584 - DNA, 22 bp, Homo sapiens
gttcttcagtaaaattaaatgt

SEQ ID NO: 7135585 - DNA, 22 bp, Homo sapiens
gttcttcagtcacatcacagaa

SEQ ID NO: 7135586 - DNA, 22 bp, Homo sapiens
gttcttcagtcacatcacagaa

SEQ ID NO: 7135587 - DNA, 22 bp, Homo sapiens
gttcttcagtcacatcacagaa

SEQ ID NO: 7135588 - DNA, 22 bp, Homo sapiens
gttcttcatcattaacactctg

SEQ ID NO: 7135589 - DNA, 22 bp, Homo sapiens
gttcttcatcttaaccatctgt

SEQ ID NO: 7135590 - DNA, 22 bp, Homo sapiens
gttcttcatcttaaccatctgt

SEQ ID NO: 7135591 - DNA, 22 bp, Homo sapiens
gttcttccctttggggattgtg

SEQ ID NO: 7135592 - DNA, 22 bp, Homo sapiens
taagccccctcaccctggcttc

SEQ ID NO: 7135593 - DNA, 22 bp, Homo sapiens
taagccactagtctgttatgaa

SEQ ID NO: 7135594 - DNA, 21 bp, Homo sapiens
taagccaccatgtgaaaccag

SEQ ID NO: 7135595 - DNA, 21 bp, Homo sapiens
taagccaccatgtgaaaccag

SEQ ID NO: 7135596 - DNA, 22 bp, Homo sapiens
taagccaaaatcaggacacaga

SEQ ID NO: 7135597 - DNA, 22 bp, Homo sapiens
taagcattcaatgcttagcact

SEQ ID NO: 7135598 - DNA, 22 bp, Homo sapiens
taagcattcaatgcttagcact

SEQ ID NO: 7135599 - DNA, 22 bp, Homo sapiens
taagcattaactctgctgcaag

SEQ ID NO: 7135600 - DNA, 22 bp, Homo sapiens
taagcttcaaagaacatattgg

SEQ ID NO: 7135601 - DNA, 22 bp, Homo sapiens
taaggaaaatggacatcaaaca

SEQ ID NO: 7135602 - DNA, 22 bp, Homo sapiens
taagctattcctgaagaaggtt

SEQ ID NO: 7135603 - DNA, 22 bp, Homo sapiens
taagcctgcatgaaccatgaga

SEQ ID NO: 7135604 - DNA, 22 bp, Homo sapiens
taagcctgcatgaaccatgaga

SEQ ID NO: 7135605 - DNA, 22 bp, Homo sapiens
taaggaaggggaaagacatgtc

SEQ ID NO: 7135606 - DNA, 22 bp, Homo sapiens
taaggaaggggaaagacatgtc

SEQ ID NO: 7135607 - DNA, 22 bp, Homo sapiens
taaggaagtcacaagaatcgct

SEQ ID NO: 7135608 - DNA, 22 bp, Homo sapiens
taaggaaggggaaagacatgtc

SEQ ID NO: 7135609 - DNA, 22 bp, Homo sapiens
taaggaaggggaaagacatgtc

SEQ ID NO: 7135610 - DNA, 22 bp, Homo sapiens
taaggaaagtgccatgatttct

SEQ ID NO: 7135611 - DNA, 21 bp, Homo sapiens
taaggaagagcattttaggtc

SEQ ID NO: 7135612 - DNA, 22 bp, Homo sapiens
taaggaaacaacttgtattttt

SEQ ID NO: 7135613 - DNA, 22 bp, Homo sapiens
taaggaaacaacttgtattttt

SEQ ID NO: 7135614 - DNA, 22 bp, Homo sapiens
taaggaaagtacatgttttgac

SEQ ID NO: 7135615 - DNA, 22 bp, Homo sapiens
taaggaaagtacatgttttgac

SEQ ID NO: 7135616 - DNA, 22 bp, Homo sapiens
taaggaaagtgccatgatttct

SEQ ID NO: 7135617 - DNA, 22 bp, Homo sapiens
taatagttatggttggttctca

SEQ ID NO: 7135618 - DNA, 22 bp, Homo sapiens
taatagttatggttggttctca

SEQ ID NO: 7135619 - DNA, 22 bp, Homo sapiens
taatagtcattgtataccttgg

SEQ ID NO: 7135620 - DNA, 22 bp, Homo sapiens
taaggaggctgctgtgaagaaa

SEQ ID NO: 7135621 - DNA, 22 bp, Homo sapiens
taaggaggctgctgtgaagaaa

SEQ ID NO: 7135622 - DNA, 22 bp, Homo sapiens
taaggacaatcaggttagtagc

SEQ ID NO: 7135623 - DNA, 22 bp, Homo sapiens
taaggacaatcaggttagtagc

SEQ ID NO: 7135624 - DNA, 22 bp, Homo sapiens
taaggacaatttgtcgcttgca

SEQ ID NO: 7135625 - DNA, 22 bp, Homo sapiens
taaggacaatttgtcgcttgca

SEQ ID NO: 7135626 - DNA, 22 bp, Homo sapiens
taaggacagcagctacttttcc

SEQ ID NO: 7135627 - DNA, 22 bp, Homo sapiens
taaggacagcagctacttttcc

SEQ ID NO: 7135628 - DNA, 22 bp, Homo sapiens
taaggacattagaaatgatgct

SEQ ID NO: 7135629 - DNA, 22 bp, Homo sapiens
taaggacattagaaatgatgct

SEQ ID NO: 7135630 - DNA, 22 bp, Homo sapiens
taaggacattggttttgagtaa

SEQ ID NO: 7135631 - DNA, 22 bp, Homo sapiens
taaggacattggttttgagtaa

SEQ ID NO: 7135632 - DNA, 22 bp, Homo sapiens
taaggagagaatttagaggttt

SEQ ID NO: 7135633 - DNA, 22 bp, Homo sapiens
taatataccaaactgtaatttt

SEQ ID NO: 7135634 - DNA, 22 bp, Homo sapiens
taatagtttcataatgtgcttc

SEQ ID NO: 7135635 - DNA, 22 bp, Homo sapiens
taatagttgtgactttgtaaag

SEQ ID NO: 7135636 - DNA, 22 bp, Homo sapiens
taatatacttcccatagtttga

SEQ ID NO: 7135637 - DNA, 22 bp, Homo sapiens
taatataccaaactgtaatttt

SEQ ID NO: 7135638 - DNA, 21 bp, Homo sapiens
taatataggttcacaactagt

SEQ ID NO: 7135639 - DNA, 22 bp, Homo sapiens
taatatatacctttgttaggaa

SEQ ID NO: 7135640 - DNA, 22 bp, Homo sapiens
taatatatacctttgttaggaa

SEQ ID NO: 7135641 - DNA, 22 bp, Homo sapiens
taatatatacctttgttaggaa

SEQ ID NO: 7135642 - DNA, 22 bp, Homo sapiens
taatatatacctttgttaggaa

SEQ ID NO: 7135643 - DNA, 22 bp, Homo sapiens
taattattatgacaacaattgc

SEQ ID NO: 7135644 - DNA, 22 bp, Homo sapiens
taattattatgacaacaattgc

SEQ ID NO: 7135645 - DNA, 22 bp, Homo sapiens
taatgaacacagaatttcactt

SEQ ID NO: 7135646 - DNA, 22 bp, Homo sapiens
taatgaacatcttaatctgaaa

SEQ ID NO: 7135647 - DNA, 22 bp, Homo sapiens
taattattatgacaacaattgc

SEQ ID NO: 7135648 - DNA, 22 bp, Homo sapiens
taattattctagtcacatagca

SEQ ID NO: 7135649 - DNA, 22 bp, Homo sapiens
taattattgtctgaagagttat

SEQ ID NO: 7135650 - DNA, 22 bp, Homo sapiens
taattattctagtcacatagca

SEQ ID NO: 7135651 - DNA, 22 bp, Homo sapiens
taatcttagacatgtatttttc

SEQ ID NO: 7135652 - DNA, 22 bp, Homo sapiens
taatcttagacatgtatttttc

SEQ ID NO: 7135653 - DNA, 22 bp, Homo sapiens
taatcttagacatgtatttttc

SEQ ID NO: 7135654 - DNA, 21 bp, Homo sapiens
taatcttcgaaaatgtattag

SEQ ID NO: 7135655 - DNA, 22 bp, Homo sapiens
taatgaacaatatatcaatagc

SEQ ID NO: 7135656 - DNA, 22 bp, Homo sapiens
taatgaacacagaatttcactt

SEQ ID NO: 7135657 - DNA, 22 bp, Homo sapiens
taatctctttatgagaagaagg

SEQ ID NO: 7135658 - DNA, 22 bp, Homo sapiens
taatctctttatgagaagaagg

SEQ ID NO: 7135659 - DNA, 22 bp, Homo sapiens
taatctgaagaaacaggacttg

SEQ ID NO: 7135660 - DNA, 22 bp, Homo sapiens
taatctatcaagcaacaaagtg

SEQ ID NO: 7135661 - DNA, 22 bp, Homo sapiens
taatctctagcccatgcaaaga

SEQ ID NO: 7135662 - DNA, 22 bp, Homo sapiens
taatcctgtcttgaccatcagg

SEQ ID NO: 7135663 - DNA, 22 bp, Homo sapiens
taatcctgtgctgtgtaagtac

SEQ ID NO: 7135664 - DNA, 22 bp, Homo sapiens
taatctaccactattgcaatat

SEQ ID NO: 7135665 - DNA, 22 bp, Homo sapiens
taatctactgtttatatgaaat

SEQ ID NO: 7135666 - DNA, 22 bp, Homo sapiens
taatcctgcttcttctcccttt

SEQ ID NO: 7135667 - DNA, 22 bp, Homo sapiens
taatatatttctgctaagctca

SEQ ID NO: 7135668 - DNA, 22 bp, Homo sapiens
taatatatttctgctaagctca

SEQ ID NO: 7135669 - DNA, 22 bp, Homo sapiens
taatatatttctgctaagctca

SEQ ID NO: 7135670 - DNA, 22 bp, Homo sapiens
taatatatttctgctaagctca

SEQ ID NO: 7135671 - DNA, 22 bp, Homo sapiens
taatatatttctgctaagctca

SEQ ID NO: 7135672 - DNA, 22 bp, Homo sapiens
taatttacttgcaaataacaat

SEQ ID NO: 7135673 - DNA, 22 bp, Homo sapiens
taattgctccaaggagaactaa

SEQ ID NO: 7135674 - DNA, 22 bp, Homo sapiens
taattgctcgagaaataacctc

SEQ ID NO: 7135675 - DNA, 22 bp, Homo sapiens
taattgcagctatcattttagt

SEQ ID NO: 7135676 - DNA, 22 bp, Homo sapiens
taattgcagggtgtcagaatac

SEQ ID NO: 7135677 - DNA, 22 bp, Homo sapiens
taattgcagggtgtcagaatac

SEQ ID NO: 7135678 - DNA, 22 bp, Homo sapiens
taatttatatggaattgttgct

SEQ ID NO: 7135679 - DNA, 22 bp, Homo sapiens
taatttatgatgcaaagaaaag

SEQ ID NO: 7135680 - DNA, 22 bp, Homo sapiens
taatttatgatgcaaagaaaag

SEQ ID NO: 7135681 - DNA, 22 bp, Homo sapiens
taatttatatggaattgttgct

SEQ ID NO: 7135682 - DNA, 22 bp, Homo sapiens
taatttatatggaattgttgct

SEQ ID NO: 7135683 - DNA, 22 bp, Homo sapiens
taatttatatggaattgttgct

SEQ ID NO: 7135684 - DNA, 22 bp, Homo sapiens
taatttacttgcaaataacaat

SEQ ID NO: 7135685 - DNA, 22 bp, Homo sapiens
taatttatagaatttcttggat

SEQ ID NO: 7135686 - DNA, 22 bp, Homo sapiens
taatttatagaatttcttggat

SEQ ID NO: 7135687 - DNA, 22 bp, Homo sapiens
taattcttgttcagaggtagta

SEQ ID NO: 7135688 - DNA, 22 bp, Homo sapiens
taattctagattgacattttga

SEQ ID NO: 7135689 - DNA, 22 bp, Homo sapiens
taattctagattgacattttga

SEQ ID NO: 7135690 - DNA, 22 bp, Homo sapiens
taattcatgggcccagtgatat

SEQ ID NO: 7135691 - DNA, 22 bp, Homo sapiens
taattccacctttttccaactt

SEQ ID NO: 7135692 - DNA, 22 bp, Homo sapiens
taattattgtctgaagagttat

SEQ ID NO: 7135693 - DNA, 22 bp, Homo sapiens
taattatttgaagacattagag

SEQ ID NO: 7135694 - DNA, 22 bp, Homo sapiens
taattatttgaagacattagag

SEQ ID NO: 7135695 - DNA, 23 bp, Homo sapiens
taattcacatatacattgcttca

SEQ ID NO: 7135696 - DNA, 22 bp, Homo sapiens
taattcatgggcccagtgatat

SEQ ID NO: 7135697 - DNA, 22 bp, Homo sapiens
taattcatgggcccagtgatat

SEQ ID NO: 7135698 - DNA, 22 bp, Homo sapiens
tacacaatgacttaagatgtca

SEQ ID NO: 7135699 - DNA, 22 bp, Homo sapiens
tacacaatctgtttttccattt

SEQ ID NO: 7135700 - DNA, 22 bp, Homo sapiens
tacacaatctgtttttccattt

SEQ ID NO: 7135701 - DNA, 22 bp, Homo sapiens
tacacaatgacttaagatgtca

SEQ ID NO: 7135702 - DNA, 22 bp, Homo sapiens
tacacaatgacttaagatgtca

SEQ ID NO: 7135703 - DNA, 22 bp, Homo sapiens
tacaagctcacaaatttttaag

SEQ ID NO: 7135704 - DNA, 22 bp, Homo sapiens
tacaagctcacaaatttttaag

SEQ ID NO: 7135705 - DNA, 22 bp, Homo sapiens
tacaagctcacaaatttttaag

SEQ ID NO: 7135706 - DNA, 22 bp, Homo sapiens
tacaagattaaaacttatacca

SEQ ID NO: 7135707 - DNA, 22 bp, Homo sapiens
tacaagattaaaacttatacca

SEQ ID NO: 7135708 - DNA, 22 bp, Homo sapiens
tacacaactgacaaccattctg

SEQ ID NO: 7135709 - DNA, 22 bp, Homo sapiens
tacacaatctgtttttccattt

SEQ ID NO: 7135710 - DNA, 22 bp, Homo sapiens
tacacaatctgtttttccattt

SEQ ID NO: 7135711 - DNA, 22 bp, Homo sapiens
tacacaatctgtttttccattt

SEQ ID NO: 7135712 - DNA, 21 bp, Homo sapiens
tacaagatagaggtaatatat

SEQ ID NO: 7135713 - DNA, 21 bp, Homo sapiens
tacaagatagaggtaatatat

SEQ ID NO: 7135714 - DNA, 22 bp, Homo sapiens
tacaagaggtatatagaaacag

SEQ ID NO: 7135715 - DNA, 22 bp, Homo sapiens
tacaagaggtatatagaaacag

SEQ ID NO: 7135716 - DNA, 22 bp, Homo sapiens
tacaagagcagtaagcttgtcc

SEQ ID NO: 7135717 - DNA, 22 bp, Homo sapiens
tacaagaggtatatagaaacag

SEQ ID NO: 7135718 - DNA, 22 bp, Homo sapiens
tacaagagtgagattatcatgt

SEQ ID NO: 7135719 - DNA, 22 bp, Homo sapiens
tacaagagtgagattatcatgt

SEQ ID NO: 7135720 - DNA, 22 bp, Homo sapiens
tacaagagaactaatgtaagtc

SEQ ID NO: 7135721 - DNA, 22 bp, Homo sapiens
tacaagagaactaatgtaagtc

SEQ ID NO: 7135722 - DNA, 22 bp, Homo sapiens
tacaagagacaccagggaggct

SEQ ID NO: 7135723 - DNA, 22 bp, Homo sapiens
tacaagagcagtaagcttgtcc

SEQ ID NO: 7135724 - DNA, 22 bp, Homo sapiens
tacaagaggatgtggacatgga

SEQ ID NO: 7135725 - DNA, 22 bp, Homo sapiens
tacaagaaggaaaactagcaat

SEQ ID NO: 7135726 - DNA, 22 bp, Homo sapiens
tacaagaaggaaaactagcaat

SEQ ID NO: 7135727 - DNA, 22 bp, Homo sapiens
tacaagaaggatggagcccact

SEQ ID NO: 7135728 - DNA, 22 bp, Homo sapiens
tacaagaatgtcttaaaagctc

SEQ ID NO: 7135729 - DNA, 22 bp, Homo sapiens
tacaagaatgtcttaaaagctc

SEQ ID NO: 7135730 - DNA, 22 bp, Homo sapiens
tacaagaatgtcttaaaagctc

SEQ ID NO: 7135731 - DNA, 22 bp, Homo sapiens
tacaagaaatttctgcatatat

SEQ ID NO: 7135732 - DNA, 22 bp, Homo sapiens
tacaagaaatttctgcatatat

SEQ ID NO: 7135733 - DNA, 22 bp, Homo sapiens
tacaagaaatttctgcatatat

SEQ ID NO: 7135734 - DNA, 22 bp, Homo sapiens
tacaagaaatttctgcatatat

SEQ ID NO: 7135735 - DNA, 22 bp, Homo sapiens
tacaagaagaggcagagctgga

SEQ ID NO: 7135736 - DNA, 22 bp, Homo sapiens
tacaagaagaggcagagctgga

SEQ ID NO: 7135737 - DNA, 22 bp, Homo sapiens
tacaagaagaggcagagctgga

SEQ ID NO: 7135738 - DNA, 22 bp, Homo sapiens
tacaagaagaggcagagctgga

SEQ ID NO: 7135739 - DNA, 22 bp, Homo sapiens
tacaagaaactacatgaatgca

SEQ ID NO: 7135740 - DNA, 22 bp, Homo sapiens
tacaagaaactacatgaatgca

SEQ ID NO: 7135741 - DNA, 22 bp, Homo sapiens
tacaagaaactacatgaatgca

SEQ ID NO: 7135742 - DNA, 22 bp, Homo sapiens
tacaacttccagctttcagccc

SEQ ID NO: 7135743 - DNA, 22 bp, Homo sapiens
tacaaccatagacatatactag

SEQ ID NO: 7135744 - DNA, 22 bp, Homo sapiens
tacaaccatagacatatactag

SEQ ID NO: 7135745 - DNA, 22 bp, Homo sapiens
tacaactgcacatctgaatcac

SEQ ID NO: 7135746 - DNA, 22 bp, Homo sapiens
tacaactgtcagatgttttgag

SEQ ID NO: 7135747 - DNA, 17 bp, Homo sapiens
tacaactgttgtttata

SEQ ID NO: 7135748 - DNA, 22 bp, Homo sapiens
tacaacatgtggtcctttatga

SEQ ID NO: 7135749 - DNA, 22 bp, Homo sapiens
taatttcaaatttcttagcgtg

SEQ ID NO: 7135750 - DNA, 22 bp, Homo sapiens
taatttcaaatttcttagcgtg

SEQ ID NO: 7135751 - DNA, 22 bp, Homo sapiens
taatttatttcaactgccaagg

SEQ ID NO: 7135752 - DNA, 22 bp, Homo sapiens
taatttcaagtttagggctcta

SEQ ID NO: 7135753 - DNA, 22 bp, Homo sapiens
taatttcaatagcttgcataat

SEQ ID NO: 7135754 - DNA, 22 bp, Homo sapiens
taatttcaatagcttgcataat

SEQ ID NO: 7135755 - DNA, 21 bp, Homo sapiens
taatttattcagcacagtgtt

SEQ ID NO: 7135756 - DNA, 22 bp, Homo sapiens
taatttatttcaactgccaagg

SEQ ID NO: 7135757 - DNA, 22 bp, Homo sapiens
taatttatttcaactgccaagg

SEQ ID NO: 7135758 - DNA, 22 bp, Homo sapiens
taatttatggtatgtgtgtaat

SEQ ID NO: 7135759 - DNA, 21 bp, Homo sapiens
taatttattcagcacagtgtt

SEQ ID NO: 7135760 - DNA, 21 bp, Homo sapiens
taatttattcagcacagtgtt

SEQ ID NO: 7135761 - DNA, 21 bp, Homo sapiens
taatttattcagcacagtgtt

SEQ ID NO: 7135762 - DNA, 21 bp, Homo sapiens
taatttattcagcacagtgtt

SEQ ID NO: 7135763 - DNA, 22 bp, Homo sapiens
taatttatggtatgtgtgtaat

SEQ ID NO: 7135764 - DNA, 22 bp, Homo sapiens
taatttatggtatgtgtgtaat

SEQ ID NO: 7135765 - DNA, 22 bp, Homo sapiens
taatttatgatgcaaagaaaag

SEQ ID NO: 7135766 - DNA, 22 bp, Homo sapiens
taatttatgatgcaaagaaaag

SEQ ID NO: 7135767 - DNA, 22 bp, Homo sapiens
taatttatggtatgtgtgtaat

SEQ ID NO: 7135768 - DNA, 22 bp, Homo sapiens
taatttatggtatgtgtgtaat

SEQ ID NO: 7135769 - DNA, 22 bp, Homo sapiens
tacagacaaagagcatgcggta

SEQ ID NO: 7135770 - DNA, 22 bp, Homo sapiens
tacagacaaagagcatgcggta

SEQ ID NO: 7135771 - DNA, 22 bp, Homo sapiens
tacagacaaagagcatgcggta

SEQ ID NO: 7135772 - DNA, 22 bp, Homo sapiens
tacagacaaagtgctatagggt

SEQ ID NO: 7135773 - DNA, 22 bp, Homo sapiens
tacagacaaagtgctatagggt

SEQ ID NO: 7135774 - DNA, 22 bp, Homo sapiens
tacagacagacttcccaccctc

SEQ ID NO: 7135775 - DNA, 22 bp, Homo sapiens
tacagacagtttttcagatatt

SEQ ID NO: 7135776 - DNA, 22 bp, Homo sapiens
tacagacagtttttcagatatt

SEQ ID NO: 7135777 - DNA, 22 bp, Homo sapiens
tacagaatgttatgaagcatag

SEQ ID NO: 7135778 - DNA, 22 bp, Homo sapiens
tacagaattagattattagaga

SEQ ID NO: 7135779 - DNA, 22 bp, Homo sapiens
tacagaattagattattagaga

SEQ ID NO: 7135780 - DNA, 21 bp, Homo sapiens
tacagaatgcgcttcagtctg

SEQ ID NO: 7135781 - DNA, 21 bp, Homo sapiens
tacagaatgcgcttcagtctg

SEQ ID NO: 7135782 - DNA, 21 bp, Homo sapiens
tacagaatgcgcttcagtctg

SEQ ID NO: 7135783 - DNA, 22 bp, Homo sapiens
tacagaatgtgtatcattacca

SEQ ID NO: 7135784 - DNA, 22 bp, Homo sapiens
tacagaatgtgtatcattacca

SEQ ID NO: 7135785 - DNA, 22 bp, Homo sapiens
tacagaatgtgtatcattacca

SEQ ID NO: 7135786 - DNA, 22 bp, Homo sapiens
tacagaatgtgtatcattacca

SEQ ID NO: 7135787 - DNA, 22 bp, Homo sapiens
tacacataggagggtaataaaa

SEQ ID NO: 7135788 - DNA, 22 bp, Homo sapiens
tacacataggagggtaataaaa

SEQ ID NO: 7135789 - DNA, 22 bp, Homo sapiens
tacacataggagggtaataaaa

SEQ ID NO: 7135790 - DNA, 22 bp, Homo sapiens
tacacataggagggtaataaaa

SEQ ID NO: 7135791 - DNA, 22 bp, Homo sapiens
tacacataggtctgaataaaaa

SEQ ID NO: 7135792 - DNA, 22 bp, Homo sapiens
tacacataggtctgaataaaaa

SEQ ID NO: 7135793 - DNA, 22 bp, Homo sapiens
tacagaatagaatagggacagg

SEQ ID NO: 7135794 - DNA, 22 bp, Homo sapiens
tacagaatatagaagctggaag

SEQ ID NO: 7135795 - DNA, 22 bp, Homo sapiens
tacagaatatttctgccctgag

SEQ ID NO: 7135796 - DNA, 22 bp, Homo sapiens
tacagaatctatgcttcacagt

SEQ ID NO: 7135797 - DNA, 22 bp, Homo sapiens
tacagaatctatgcttcacagt

SEQ ID NO: 7135798 - DNA, 22 bp, Homo sapiens
tacagaatctatgcttcacagt

SEQ ID NO: 7135799 - DNA, 22 bp, Homo sapiens
tacagaatgatgtgtttaaata

SEQ ID NO: 7135800 - DNA, 22 bp, Homo sapiens
tacagaatgatgtgtttaaata

SEQ ID NO: 7135801 - DNA, 20 bp, Homo sapiens
tacagaatgcaataaaatgg

SEQ ID NO: 7135802 - DNA, 20 bp, Homo sapiens
tacagaatgcaataaaatgg

SEQ ID NO: 7135803 - DNA, 20 bp, Homo sapiens
tacagaatgcaataaaatgg

SEQ ID NO: 7135804 - DNA, 22 bp, Homo sapiens
tacacacatgcatttgccttat

SEQ ID NO: 7135805 - DNA, 22 bp, Homo sapiens
tacacacatgcatttgccttat

SEQ ID NO: 7135806 - DNA, 22 bp, Homo sapiens
tacacacatgcatttgccttat

SEQ ID NO: 7135807 - DNA, 22 bp, Homo sapiens
tacacacatgcatttgccttat

SEQ ID NO: 7135808 - DNA, 22 bp, Homo sapiens
tacacacagaggccatgggatt

SEQ ID NO: 7135809 - DNA, 22 bp, Homo sapiens
tacacacagaggccatgggatt

SEQ ID NO: 7135810 - DNA, 22 bp, Homo sapiens
tacacaattagttgcaaagtga

SEQ ID NO: 7135811 - DNA, 22 bp, Homo sapiens
tacacaattagttgcaaagtga

SEQ ID NO: 7135812 - DNA, 22 bp, Homo sapiens
tacacaattagttgcaaagtga

SEQ ID NO: 7135813 - DNA, 22 bp, Homo sapiens
tacacaattctggatgcatgtc

SEQ ID NO: 7135814 - DNA, 22 bp, Homo sapiens
tacacacagaggccatgggatt

SEQ ID NO: 7135815 - DNA, 22 bp, Homo sapiens
tacacacagaggccatgggatt

SEQ ID NO: 7135816 - DNA, 22 bp, Homo sapiens
tacacagaacctggtgtacagt

SEQ ID NO: 7135817 - DNA, 22 bp, Homo sapiens
tacacagtaaatggtaaataca

SEQ ID NO: 7135818 - DNA, 22 bp, Homo sapiens
tacacatacattgcttacaagg

SEQ ID NO: 7135819 - DNA, 22 bp, Homo sapiens
tacacatacaccaatgtggtca

SEQ ID NO: 7135820 - DNA, 22 bp, Homo sapiens
tacacatacattgcttacaagg

SEQ ID NO: 7135821 - DNA, 22 bp, Homo sapiens
tacacataaaatgctcatggta

SEQ ID NO: 7135822 - DNA, 22 bp, Homo sapiens
tacacataaaatgctcatggta

SEQ ID NO: 7135823 - DNA, 22 bp, Homo sapiens
tacttacagaaggaagcaattg

SEQ ID NO: 7135824 - DNA, 22 bp, Homo sapiens
tacttacagaaggaagcaattg

SEQ ID NO: 7135825 - DNA, 22 bp, Homo sapiens
tacttacacagctgtagaaggt

SEQ ID NO: 7135826 - DNA, 22 bp, Homo sapiens
tacttacacagctgtagaaggt

SEQ ID NO: 7135827 - DNA, 22 bp, Homo sapiens
tacttacagagcttataagtta

SEQ ID NO: 7135828 - DNA, 22 bp, Homo sapiens
tacttacagttacggcaagtgg

SEQ ID NO: 7135829 - DNA, 22 bp, Homo sapiens
tacttacagttgatcgatgtat

SEQ ID NO: 7135830 - DNA, 22 bp, Homo sapiens
tacttacataaaaactgaatgt

SEQ ID NO: 7135831 - DNA, 22 bp, Homo sapiens
tacttaaaactgatagaatctc

SEQ ID NO: 7135832 - DNA, 22 bp, Homo sapiens
tacttaaaactgatagaatctc

SEQ ID NO: 7135833 - DNA, 22 bp, Homo sapiens
tacttaaaactgatagaatctc

SEQ ID NO: 7135834 - DNA, 22 bp, Homo sapiens
tacttaaaactgatagaatctc

SEQ ID NO: 7135835 - DNA, 22 bp, Homo sapiens
tacttaaaactgatagaatctc

SEQ ID NO: 7135836 - DNA, 22 bp, Homo sapiens
tacttaaaactgatagaatctc

SEQ ID NO: 7135837 - DNA, 22 bp, Homo sapiens
tacttaaaactgatagaatctc

SEQ ID NO: 7135838 - DNA, 22 bp, Homo sapiens
tacttaaataattgctgctatt

SEQ ID NO: 7135839 - DNA, 22 bp, Homo sapiens
tacttaaaaattatcaaagtgg

SEQ ID NO: 7135840 - DNA, 22 bp, Homo sapiens
tacttaaaaattatcaaagtgg

SEQ ID NO: 7135841 - DNA, 22 bp, Homo sapiens
tacttaaaaattatcaaagtgg

SEQ ID NO: 7135842 - DNA, 22 bp, Homo sapiens
tacttaaaaattatcaaagtgg

SEQ ID NO: 7135843 - DNA, 22 bp, Homo sapiens
tactgttttctttatagtacag

SEQ ID NO: 7135844 - DNA, 22 bp, Homo sapiens
tactgtttttaaaattgcatcc

SEQ ID NO: 7135845 - DNA, 22 bp, Homo sapiens
tactgtttttgcctctttagaa

SEQ ID NO: 7135846 - DNA, 22 bp, Homo sapiens
tactgtttgcagtttgcagtat

SEQ ID NO: 7135847 - DNA, 22 bp, Homo sapiens
tactgtttgcagtttgcagtat

SEQ ID NO: 7135848 - DNA, 22 bp, Homo sapiens
tactgttatatatagcagcagt

SEQ ID NO: 7135849 - DNA, 22 bp, Homo sapiens
tactgttagagcgatttgtcct

SEQ ID NO: 7135850 - DNA, 22 bp, Homo sapiens
tactgtttcaagccctcacaga

SEQ ID NO: 7135851 - DNA, 22 bp, Homo sapiens
tactgtttcctgaagcagatgc

SEQ ID NO: 7135852 - DNA, 22 bp, Homo sapiens
tactgaaagaatacataatttc

SEQ ID NO: 7135853 - DNA, 22 bp, Homo sapiens
tactgtacattccgtttgttgc

SEQ ID NO: 7135854 - DNA, 22 bp, Homo sapiens
tactgaaacttttcttcaactg

SEQ ID NO: 7135855 - DNA, 22 bp, Homo sapiens
tactgaaagaatacataatttc

SEQ ID NO: 7135856 - DNA, 22 bp, Homo sapiens
tactgtactcaacatgtgagtt

SEQ ID NO: 7135857 - DNA, 22 bp, Homo sapiens
tactgtactgcagttctgcaaa

SEQ ID NO: 7135858 - DNA, 22 bp, Homo sapiens
tactgtactgcagttctgcaaa

SEQ ID NO: 7135859 - DNA, 22 bp, Homo sapiens
tactgtactgtcttttttgctg

SEQ ID NO: 7135860 - DNA, 22 bp, Homo sapiens
tactgtgtcttaggatgtggaa

SEQ ID NO: 7135861 - DNA, 22 bp, Homo sapiens
tactgtgtgcccagccgagctg

SEQ ID NO: 7135862 - DNA, 22 bp, Homo sapiens
tactgtgtgcccagccgagctg

SEQ ID NO: 7135863 - DNA, 22 bp, Homo sapiens
tactgtgtgcccagccgagctg

SEQ ID NO: 7135864 - DNA, 22 bp, Homo sapiens
tactgtgttgtgctgaaaggga

SEQ ID NO: 7135865 - DNA, 22 bp, Homo sapiens
tactgttaatgttaaattcagg

SEQ ID NO: 7135866 - DNA, 22 bp, Homo sapiens
tactgaaactcttgtaaatatc

SEQ ID NO: 7135867 - DNA, 22 bp, Homo sapiens
tactgaaaatcctgcctgtcct

SEQ ID NO: 7135868 - DNA, 22 bp, Homo sapiens
tactgaaaatcctgcctgtcct

SEQ ID NO: 7135869 - DNA, 22 bp, Homo sapiens
tactgaaactcttgtaaatatc

SEQ ID NO: 7135870 - DNA, 22 bp, Homo sapiens
tactgaaactcttgtaaatatc

SEQ ID NO: 7135871 - DNA, 22 bp, Homo sapiens
tactgaaactcttgtaaatatc

SEQ ID NO: 7135872 - DNA, 22 bp, Homo sapiens
tactgaaacttttcttcaactg

SEQ ID NO: 7135873 - DNA, 22 bp, Homo sapiens
tactgaaaaagaatccagacct

SEQ ID NO: 7135874 - DNA, 22 bp, Homo sapiens
tactgaaaaagaatccagacct

SEQ ID NO: 7135875 - DNA, 22 bp, Homo sapiens
tactgaaaactgagtcttccgt

SEQ ID NO: 7135876 - DNA, 22 bp, Homo sapiens
tactgaaaagccacaaggacca

SEQ ID NO: 7135877 - DNA, 22 bp, Homo sapiens
tactccagacattctgtcctcg

SEQ ID NO: 7135878 - DNA, 22 bp, Homo sapiens
tactcctgctgatcctgccagc

SEQ ID NO: 7135879 - DNA, 22 bp, Homo sapiens
tactcccaccatggctgatttc

SEQ ID NO: 7135880 - DNA, 22 bp, Homo sapiens
tactctaaaaagaagcagatct

SEQ ID NO: 7135881 - DNA, 22 bp, Homo sapiens
tactctaacatttgttagatgt

SEQ ID NO: 7135882 - DNA, 22 bp, Homo sapiens
tactctctggaaattatagtga

SEQ ID NO: 7135883 - DNA, 22 bp, Homo sapiens
tactctctaggacattttctag

SEQ ID NO: 7135884 - DNA, 22 bp, Homo sapiens
taccatgtcaagcgagacatgt

SEQ ID NO: 7135885 - DNA, 22 bp, Homo sapiens
taccatgctctgcatctcacaa

SEQ ID NO: 7135886 - DNA, 22 bp, Homo sapiens
taccatgctggctcataatcag

SEQ ID NO: 7135887 - DNA, 22 bp, Homo sapiens
taccatgcttgagatacagtga

SEQ ID NO: 7135888 - DNA, 22 bp, Homo sapiens
taccatttcagtaaaaacttag

SEQ ID NO: 7135889 - DNA, 22 bp, Homo sapiens
taccatttcagtaaaaacttag

SEQ ID NO: 7135890 - DNA, 22 bp, Homo sapiens
taccagttgatgttttaaatag

SEQ ID NO: 7135891 - DNA, 22 bp, Homo sapiens
taccataacgtaatgaacttga

SEQ ID NO: 7135892 - DNA, 22 bp, Homo sapiens
taccaggagcccccttctggtc

SEQ ID NO: 7135893 - DNA, 22 bp, Homo sapiens
taccagggaacagggatattaa

SEQ ID NO: 7135894 - DNA, 22 bp, Homo sapiens
taccaggcagctgcacagaggc

SEQ ID NO: 7135895 - DNA, 22 bp, Homo sapiens
taccagggaacagggatattaa

SEQ ID NO: 7135896 - DNA, 22 bp, Homo sapiens
taccaggtctgtgcaggtgtca

SEQ ID NO: 7135897 - DNA, 22 bp, Homo sapiens
taccaggagttacaggcagcag

SEQ ID NO: 7135898 - DNA, 22 bp, Homo sapiens
taccagctcacacaatctttgt

SEQ ID NO: 7135899 - DNA, 15 bp, Homo sapiens
taccagctgatccgt

SEQ ID NO: 7135900 - DNA, 22 bp, Homo sapiens
taccagcttccttcaagatgtg

SEQ ID NO: 7135901 - DNA, 22 bp, Homo sapiens
taccaggaatgttttcaccact

SEQ ID NO: 7135902 - DNA, 22 bp, Homo sapiens
taccagcatcacagcatgttgg

SEQ ID NO: 7135903 - DNA, 22 bp, Homo sapiens
taccagcctcagttgtgagccc

SEQ ID NO: 7135904 - DNA, 22 bp, Homo sapiens
taccagcctctgttgggggtgg

SEQ ID NO: 7135905 - DNA, 22 bp, Homo sapiens
taccagccttttaacatgggcc

SEQ ID NO: 7135906 - DNA, 22 bp, Homo sapiens
taccagctcacacaatctttgt

SEQ ID NO: 7135907 - DNA, 22 bp, Homo sapiens
taccacagtctgccattagatg

SEQ ID NO: 7135908 - DNA, 22 bp, Homo sapiens
taccaccatttgcctgctgtat

SEQ ID NO: 7135909 - DNA, 22 bp, Homo sapiens
taccacctcaacctcatctgac

SEQ ID NO: 7135910 - DNA, 22 bp, Homo sapiens
taccacagcaaatgaggccaac

SEQ ID NO: 7135911 - DNA, 22 bp, Homo sapiens
taccacagcaaatgaggccaac

SEQ ID NO: 7135912 - DNA, 22 bp, Homo sapiens
taccaatgataagacagataat

SEQ ID NO: 7135913 - DNA, 22 bp, Homo sapiens
taccactgataccttggagttc

SEQ ID NO: 7135914 - DNA, 22 bp, Homo sapiens
taccagcaactggaagtcagat

SEQ ID NO: 7135915 - DNA, 22 bp, Homo sapiens
taccagcaactggaagtcagat

SEQ ID NO: 7135916 - DNA, 21 bp, Homo sapiens
tactacagtctctttatcagt

SEQ ID NO: 7135917 - DNA, 22 bp, Homo sapiens
tactacagtatgtgtgttatac

SEQ ID NO: 7135918 - DNA, 23 bp, Homo sapiens
tactacagggtcttgctatgaat

SEQ ID NO: 7135919 - DNA, 23 bp, Homo sapiens
tactacagggtcttgctatgaat

SEQ ID NO: 7135920 - DNA, 22 bp, Homo sapiens
tactacagtatgtgtgttatac

SEQ ID NO: 7135921 - DNA, 21 bp, Homo sapiens
tactacagtctctttatcagt

SEQ ID NO: 7135922 - DNA, 22 bp, Homo sapiens
tactacatacagaatttagaga

SEQ ID NO: 7135923 - DNA, 22 bp, Homo sapiens
tactacatacagaatttagaga

SEQ ID NO: 7135924 - DNA, 22 bp, Homo sapiens
tactacattaataaaacattca

SEQ ID NO: 7135925 - DNA, 22 bp, Homo sapiens
tactagaaaaacacatgctctg

SEQ ID NO: 7135926 - DNA, 23 bp, Homo sapiens
tactacagggtcttgctatgaat

SEQ ID NO: 7135927 - DNA, 22 bp, Homo sapiens
taccattttgaaacatttcatc

SEQ ID NO: 7135928 - DNA, 22 bp, Homo sapiens
taccattttgaaacatttcatc

SEQ ID NO: 7135929 - DNA, 22 bp, Homo sapiens
taccattttgaaacatttcatc

SEQ ID NO: 7135930 - DNA, 22 bp, Homo sapiens
taccattttgaaacatttcatc

SEQ ID NO: 7135931 - DNA, 22 bp, Homo sapiens
tactacaaggccgaagctctca

SEQ ID NO: 7135932 - DNA, 22 bp, Homo sapiens
taccatttctacatatcttgtc

SEQ ID NO: 7135933 - DNA, 22 bp, Homo sapiens
taccatttctacatatcttgtc

SEQ ID NO: 7135934 - DNA, 22 bp, Homo sapiens
taccatttctacatatcttgtc

SEQ ID NO: 7135935 - DNA, 23 bp, Homo sapiens
tactataacgctgtgtcagctcc

SEQ ID NO: 7135936 - DNA, 22 bp, Homo sapiens
tactataaagtcttaatgagtc

SEQ ID NO: 7135937 - DNA, 23 bp, Homo sapiens
tactatggttattatccctctcc

SEQ ID NO: 7135938 - DNA, 21 bp, Homo sapiens
tactatgtagtgattgcagga

SEQ ID NO: 7135939 - DNA, 22 bp, Homo sapiens
tactatgtgaaaatactatagt

SEQ ID NO: 7135940 - DNA, 19 bp, Homo sapiens
tactccaatcaggaacaca

SEQ ID NO: 7135941 - DNA, 22 bp, Homo sapiens
tactagttctcatatgaaataa

SEQ ID NO: 7135942 - DNA, 22 bp, Homo sapiens
tactagtcttctgctattccct

SEQ ID NO: 7135943 - DNA, 22 bp, Homo sapiens
tactaggtggtgaatataagta

SEQ ID NO: 7135944 - DNA, 22 bp, Homo sapiens
tactagaatgccactgttagtg

SEQ ID NO: 7135945 - DNA, 22 bp, Homo sapiens
tactagctaacattctcaccaa

SEQ ID NO: 7135946 - DNA, 22 bp, Homo sapiens
tactaggtggtgaatataagta

SEQ ID NO: 7135947 - DNA, 22 bp, Homo sapiens
tactagaaattaccttctcact

SEQ ID NO: 7135948 - DNA, 22 bp, Homo sapiens
tactagaacctcacaacaatcc

SEQ ID NO: 7135949 - DNA, 22 bp, Homo sapiens
tactagaagctgtaatttttca

SEQ ID NO: 7135950 - DNA, 22 bp, Homo sapiens
tactagaagctgtaatttttca

SEQ ID NO: 7135951 - DNA, 17 bp, Homo sapiens
tactagaatagagacag

SEQ ID NO: 7135952 - DNA, 22 bp, Homo sapiens
tacatgtaattttcatagtaag

SEQ ID NO: 7135953 - DNA, 22 bp, Homo sapiens
tacatggttggcccattcttct

SEQ ID NO: 7135954 - DNA, 22 bp, Homo sapiens
tacatggttgctttgttgatga

SEQ ID NO: 7135955 - DNA, 22 bp, Homo sapiens
tacatgctcttcaaggactcat

SEQ ID NO: 7135956 - DNA, 19 bp, Homo sapiens
tacatgctcttggttcagg

SEQ ID NO: 7135957 - DNA, 22 bp, Homo sapiens
tacatgctggtgactgtagaca

SEQ ID NO: 7135958 - DNA, 22 bp, Homo sapiens
tacatgctggtgactgtagaca

SEQ ID NO: 7135959 - DNA, 22 bp, Homo sapiens
tacatgctggtgactgtagaca

SEQ ID NO: 7135960 - DNA, 22 bp, Homo sapiens
tacatgcttaaaatgcaatgtt

SEQ ID NO: 7135961 - DNA, 22 bp, Homo sapiens
tacatgcttaaaatgcaatgtt

SEQ ID NO: 7135962 - DNA, 22 bp, Homo sapiens
tacatgcttccaactgccccat

SEQ ID NO: 7135963 - DNA, 22 bp, Homo sapiens
tacatgcttctatatgtgaagt

SEQ ID NO: 7135964 - DNA, 22 bp, Homo sapiens
tacatgcttctatatgtgaagt

SEQ ID NO: 7135965 - DNA, 22 bp, Homo sapiens
tacatggatgttatccttactg

SEQ ID NO: 7135966 - DNA, 22 bp, Homo sapiens
tacatggatgttatccttactg

SEQ ID NO: 7135967 - DNA, 18 bp, Homo sapiens
tacatgccagagagttac

SEQ ID NO: 7135968 - DNA, 23 bp, Homo sapiens
tacatgctataatttcaccctca

SEQ ID NO: 7135969 - DNA, 22 bp, Homo sapiens
tacatgctcagtaactttcagt

SEQ ID NO: 7135970 - DNA, 22 bp, Homo sapiens
tacatgctccactttctcctgt

SEQ ID NO: 7135971 - DNA, 22 bp, Homo sapiens
tacatgctccttatgagaatct

SEQ ID NO: 7135972 - DNA, 22 bp, Homo sapiens
tacatgctccttatgagaatct

SEQ ID NO: 7135973 - DNA, 22 bp, Homo sapiens
tacatgcatgtcacagaatgaa

SEQ ID NO: 7135974 - DNA, 22 bp, Homo sapiens
tacatgcatgtgtgtaaatata

SEQ ID NO: 7135975 - DNA, 22 bp, Homo sapiens
tacatgcatgtgtgtaaatata

SEQ ID NO: 7135976 - DNA, 22 bp, Homo sapiens
tacatgcatgtgtgtaaatata

SEQ ID NO: 7135977 - DNA, 22 bp, Homo sapiens
tacatgcatgtgtgtaaatata

SEQ ID NO: 7135978 - DNA, 22 bp, Homo sapiens
tacatgcattggatggcaatag

SEQ ID NO: 7135979 - DNA, 22 bp, Homo sapiens
tacatgcattggatggcaatag

SEQ ID NO: 7135980 - DNA, 22 bp, Homo sapiens
tacatgcattggatggcaatag

SEQ ID NO: 7135981 - DNA, 22 bp, Homo sapiens
tacatgcattggatggcaatag

SEQ ID NO: 7135982 - DNA, 22 bp, Homo sapiens
tacatgtaggtgacattttaat

SEQ ID NO: 7135983 - DNA, 22 bp, Homo sapiens
tacatgtaggtgacattttaat

SEQ ID NO: 7135984 - DNA, 22 bp, Homo sapiens
tacatgtatgtgtacgtgcatg

SEQ ID NO: 7135985 - DNA, 22 bp, Homo sapiens
tacatgtatgtgttaatatctg

SEQ ID NO: 7135986 - DNA, 22 bp, Homo sapiens
tacatgtatgtttatcttgaga

SEQ ID NO: 7135987 - DNA, 22 bp, Homo sapiens
taccaaggtagtggagacagaa

SEQ ID NO: 7135988 - DNA, 22 bp, Homo sapiens
taccaagtgataataggaaagc

SEQ ID NO: 7135989 - DNA, 22 bp, Homo sapiens
taccaagtgtattatgctttgt

SEQ ID NO: 7135990 - DNA, 20 bp, Homo sapiens
taccaacagcaggaagcata

SEQ ID NO: 7135991 - DNA, 22 bp, Homo sapiens
taccaagaaaagggattaaatg

SEQ ID NO: 7135992 - DNA, 22 bp, Homo sapiens
taccaagagttcttgcctgttt

SEQ ID NO: 7135993 - DNA, 22 bp, Homo sapiens
taccaaagttttctgagtgata

SEQ ID NO: 7135994 - DNA, 22 bp, Homo sapiens
tacatgaacctttatgtgtgat

SEQ ID NO: 7135995 - DNA, 22 bp, Homo sapiens
tacatgaagttgtctaaactgg

SEQ ID NO: 7135996 - DNA, 22 bp, Homo sapiens
tacatgaatgtttcaatattgt

SEQ ID NO: 7135997 - DNA, 22 bp, Homo sapiens
tacatgaatgtttcaatattgt

SEQ ID NO: 7135998 - DNA, 22 bp, Homo sapiens
tacatgaatgtttcaatattgt

SEQ ID NO: 7135999 - DNA, 22 bp, Homo sapiens
tacagtgtgacatttctacaaa

SEQ ID NO: 7136000 - DNA, 22 bp, Homo sapiens
tacagtgtctggatatcaaagg

SEQ ID NO: 7136001 - DNA, 22 bp, Homo sapiens
tacagtgtgaataagcaggcat

SEQ ID NO: 7136002 - DNA, 22 bp, Homo sapiens
tacagtgtttcccccaggatag

SEQ ID NO: 7136003 - DNA, 22 bp, Homo sapiens
tacagtgtttcccccaggatag

SEQ ID NO: 7136004 - DNA, 22 bp, Homo sapiens
tacagtgtttcccccaggatag

SEQ ID NO: 7136005 - DNA, 22 bp, Homo sapiens
tacatgaacaaaatagcagaaa

SEQ ID NO: 7136006 - DNA, 22 bp, Homo sapiens
tacatgaacaaaatagcagaaa

SEQ ID NO: 7136007 - DNA, 22 bp, Homo sapiens
tacatgaatttgagtcagagga

SEQ ID NO: 7136008 - DNA, 22 bp, Homo sapiens
tacatgaatttgagtcagagga

SEQ ID NO: 7136009 - DNA, 22 bp, Homo sapiens
tacatgacatttctttctgttc

SEQ ID NO: 7136010 - DNA, 22 bp, Homo sapiens
tacatgacctagacttgctaaa

SEQ ID NO: 7136011 - DNA, 21 bp, Homo sapiens
tacatgagtgtatgagcatat

SEQ ID NO: 7136012 - DNA, 22 bp, Homo sapiens
tacatgcaaggatatttgtgcg

SEQ ID NO: 7136013 - DNA, 22 bp, Homo sapiens
tacatgcaaggatatttgtgcg

SEQ ID NO: 7136014 - DNA, 22 bp, Homo sapiens
tacatgcaaggatatttgtgcg

SEQ ID NO: 7136015 - DNA, 22 bp, Homo sapiens
tacatgcaatgaggattctagt

SEQ ID NO: 7136016 - DNA, 22 bp, Homo sapiens
tacatgcaatgaggattctagt

SEQ ID NO: 7136017 - DNA, 22 bp, Homo sapiens
tacatgcaattaagagggtgaa

SEQ ID NO: 7136018 - DNA, 22 bp, Homo sapiens
tacatgcaattaagagggtgaa

SEQ ID NO: 7136019 - DNA, 22 bp, Homo sapiens
tacatgcaattaagagggtgaa

SEQ ID NO: 7136020 - DNA, 22 bp, Homo sapiens
tacatgcaattaagagggtgaa

SEQ ID NO: 7136021 - DNA, 22 bp, Homo sapiens
tacatgcacatgaacatgtgtg

SEQ ID NO: 7136022 - DNA, 22 bp, Homo sapiens
tacatgcacatgaacatgtgtg

SEQ ID NO: 7136023 - DNA, 22 bp, Homo sapiens
tacatgcacatgaacatgtgtg

SEQ ID NO: 7136024 - DNA, 19 bp, Homo sapiens
tacatgcacatgtgcgtgc

SEQ ID NO: 7136025 - DNA, 19 bp, Homo sapiens
tacatgcacatgtgcgtgc

SEQ ID NO: 7136026 - DNA, 19 bp, Homo sapiens
tacatgcacatgtgcgtgc

SEQ ID NO: 7136027 - DNA, 19 bp, Homo sapiens
tacatgcagcaggcacgca

SEQ ID NO: 7136028 - DNA, 19 bp, Homo sapiens
tacatgcagcaggcacgca

SEQ ID NO: 7136029 - DNA, 19 bp, Homo sapiens
tacatgcagcaggcacgca

SEQ ID NO: 7136030 - DNA, 18 bp, Homo sapiens
tacatgcataaatgaagc

SEQ ID NO: 7136031 - DNA, 18 bp, Homo sapiens
tacatgcataaatgaagc

SEQ ID NO: 7136032 - DNA, 18 bp, Homo sapiens
tacatgcataaatgaagc

SEQ ID NO: 7136033 - DNA, 22 bp, Homo sapiens
tacatgcatacttgtgtgtgta

SEQ ID NO: 7136034 - DNA, 22 bp, Homo sapiens
tacatgcatacttgtgtgtgta

SEQ ID NO: 7136035 - DNA, 22 bp, Homo sapiens
tacatgcatacttgtgtgtgta

SEQ ID NO: 7136036 - DNA, 22 bp, Homo sapiens
tacatgcatgatacaaagttgc

SEQ ID NO: 7136037 - DNA, 22 bp, Homo sapiens
tacatgcatgatacaaagttgc

SEQ ID NO: 7136038 - DNA, 22 bp, Homo sapiens
tacatgcatgatacaaagttgc

SEQ ID NO: 7136039 - DNA, 22 bp, Homo sapiens
tacatgcatgtcacagaatgaa

SEQ ID NO: 7136040 - DNA, 22 bp, Homo sapiens
tacatgcatgtcacagaatgaa

SEQ ID NO: 7136041 - DNA, 22 bp, Homo sapiens
tacatgcatgtcacagaatgaa

SEQ ID NO: 7136042 - DNA, 22 bp, Homo sapiens
tacagtggggagctcaggagag

SEQ ID NO: 7136043 - DNA, 22 bp, Homo sapiens
tacagtggtgacaatatggaca

SEQ ID NO: 7136044 - DNA, 22 bp, Homo sapiens
tacagtggtgacaatatggaca

SEQ ID NO: 7136045 - DNA, 20 bp, Homo sapiens
tacagtgtatgtatttaggc

SEQ ID NO: 7136046 - DNA, 20 bp, Homo sapiens
tacagtgtatgtatttaggc

SEQ ID NO: 7136047 - DNA, 20 bp, Homo sapiens
tacagtgtatgtatttaggc

SEQ ID NO: 7136048 - DNA, 22 bp, Homo sapiens
tacagtggaaaactcagtgtgt

SEQ ID NO: 7136049 - DNA, 22 bp, Homo sapiens
tacagtggaaaactcagtgtgt

SEQ ID NO: 7136050 - DNA, 22 bp, Homo sapiens
tacagtgctttttggtggagaa

SEQ ID NO: 7136051 - DNA, 22 bp, Homo sapiens
tacagtgtatgtatttgtaggt

SEQ ID NO: 7136052 - DNA, 20 bp, Homo sapiens
tacagtgtatgtatttaggc

SEQ ID NO: 7136053 - DNA, 22 bp, Homo sapiens
tacagtgtctgcaactgcacac

SEQ ID NO: 7136054 - DNA, 22 bp, Homo sapiens
tacagtgcaatgtgatgtagat

SEQ ID NO: 7136055 - DNA, 22 bp, Homo sapiens
tacagtgcaatgtgatgtagat

SEQ ID NO: 7136056 - DNA, 22 bp, Homo sapiens
tacagtgcacatttcttaggaa

SEQ ID NO: 7136057 - DNA, 22 bp, Homo sapiens
tacagtgcatagaggcatgata

SEQ ID NO: 7136058 - DNA, 22 bp, Homo sapiens
tacagtgcacatttcttaggaa

SEQ ID NO: 7136059 - DNA, 22 bp, Homo sapiens
tacagtgcgatttttaggcctc

SEQ ID NO: 7136060 - DNA, 22 bp, Homo sapiens
tacagtgcgggtgcgggcctct

SEQ ID NO: 7136061 - DNA, 22 bp, Homo sapiens
tacagtgctagaacctgctgta

SEQ ID NO: 7136062 - DNA, 22 bp, Homo sapiens
tacagtgcttggtatctagtaa

SEQ ID NO: 7136063 - DNA, 22 bp, Homo sapiens
tacagtgcttggtatctagtaa

SEQ ID NO: 7136064 - DNA, 22 bp, Homo sapiens
tacagtgcttggtatctagtaa

SEQ ID NO: 7136065 - DNA, 22 bp, Homo sapiens
tacagtatttgaagaatatgag

SEQ ID NO: 7136066 - DNA, 22 bp, Homo sapiens
tacagtcaacattgatgatgat

SEQ ID NO: 7136067 - DNA, 22 bp, Homo sapiens
tacagtcaacattgatgatgat

SEQ ID NO: 7136068 - DNA, 22 bp, Homo sapiens
tacagtcaagcataagaagtca

SEQ ID NO: 7136069 - DNA, 22 bp, Homo sapiens
tacagtcaagcataagaagtca

SEQ ID NO: 7136070 - DNA, 22 bp, Homo sapiens
tacagtcaagcataagaagtca

SEQ ID NO: 7136071 - DNA, 22 bp, Homo sapiens
tacagtctctgataactgtcag

SEQ ID NO: 7136072 - DNA, 22 bp, Homo sapiens
tacagtctctttgagtgattgt

SEQ ID NO: 7136073 - DNA, 22 bp, Homo sapiens
tacagtctttggaaagagatag

SEQ ID NO: 7136074 - DNA, 22 bp, Homo sapiens
tacagtctttggaaagagatag

SEQ ID NO: 7136075 - DNA, 22 bp, Homo sapiens
tacagtctttggaaagagatag

SEQ ID NO: 7136076 - DNA, 22 bp, Homo sapiens
tacagtgaatgaatggctgtgc

SEQ ID NO: 7136077 - DNA, 22 bp, Homo sapiens
tacagtgaccctatttccaaat

SEQ ID NO: 7136078 - DNA, 21 bp, Homo sapiens
tacagtgaggtgttaggatgt

SEQ ID NO: 7136079 - DNA, 22 bp, Homo sapiens
tacagtgagtggcagagccaga

SEQ ID NO: 7136080 - DNA, 22 bp, Homo sapiens
tacagtgatagagagtagctat

SEQ ID NO: 7136081 - DNA, 22 bp, Homo sapiens
tacagaggaggggattttaata

SEQ ID NO: 7136082 - DNA, 22 bp, Homo sapiens
tacagaggagaccaaggctcag

SEQ ID NO: 7136083 - DNA, 22 bp, Homo sapiens
tacagaggaggtggttgggagt

SEQ ID NO: 7136084 - DNA, 22 bp, Homo sapiens
tacagaggcacatgcaattttc

SEQ ID NO: 7136085 - DNA, 22 bp, Homo sapiens
tacagaggcacatgcaattttc

SEQ ID NO: 7136086 - DNA, 22 bp, Homo sapiens
tacagagatgccgaagagtgaa

SEQ ID NO: 7136087 - DNA, 22 bp, Homo sapiens
tacagagatgtgaaaagctcta

SEQ ID NO: 7136088 - DNA, 22 bp, Homo sapiens
tacagagatttattgctaaggc

SEQ ID NO: 7136089 - DNA, 22 bp, Homo sapiens
tacagagatttattgctaaggc

SEQ ID NO: 7136090 - DNA, 22 bp, Homo sapiens
tacagagatttattgctaaggc

SEQ ID NO: 7136091 - DNA, 22 bp, Homo sapiens
tacagagatttattgctaaggc

SEQ ID NO: 7136092 - DNA, 22 bp, Homo sapiens
tacagacagtttttcagatatt

SEQ ID NO: 7136093 - DNA, 22 bp, Homo sapiens
tacagacagtttttcagatatt

SEQ ID NO: 7136094 - DNA, 20 bp, Homo sapiens
tacagacatgacaataatgg

SEQ ID NO: 7136095 - DNA, 20 bp, Homo sapiens
tacagacatgacaataatgg

SEQ ID NO: 7136096 - DNA, 20 bp, Homo sapiens
tacagacatgacaataatgg

SEQ ID NO: 7136097 - DNA, 22 bp, Homo sapiens
tacagacattcaattttgaccc

SEQ ID NO: 7136098 - DNA, 22 bp, Homo sapiens
tacagacattcaattttgaccc

SEQ ID NO: 7136099 - DNA, 22 bp, Homo sapiens
tacagagagtacagcatccaca

SEQ ID NO: 7136100 - DNA, 22 bp, Homo sapiens
tacagagatactctagatcaaa

SEQ ID NO: 7136101 - DNA, 22 bp, Homo sapiens
tacagagatactctagatcaaa

SEQ ID NO: 7136102 - DNA, 22 bp, Homo sapiens
tacagagatgccgaagagtgaa

SEQ ID NO: 7136103 - DNA, 22 bp, Homo sapiens
tacagaggggacatggaagaca

SEQ ID NO: 7136104 - DNA, 22 bp, Homo sapiens
tacagagggtaattgatcaagg

SEQ ID NO: 7136105 - DNA, 22 bp, Homo sapiens
tacagaggctgggttttcaggg

SEQ ID NO: 7136106 - DNA, 22 bp, Homo sapiens
tacagagggattatctaagggt

SEQ ID NO: 7136107 - DNA, 22 bp, Homo sapiens
tacagagtaatttgcatgggga

SEQ ID NO: 7136108 - DNA, 22 bp, Homo sapiens
tacagagtaatttgcatgggga

SEQ ID NO: 7136109 - DNA, 22 bp, Homo sapiens
tacagagtatttttaatatggt

SEQ ID NO: 7136110 - DNA, 22 bp, Homo sapiens
tacagtatttgaagaatatgag

SEQ ID NO: 7136111 - DNA, 22 bp, Homo sapiens
tacagtatgttcttgaatttgg

SEQ ID NO: 7136112 - DNA, 22 bp, Homo sapiens
tacagtatgttcttgaatttgg

SEQ ID NO: 7136113 - DNA, 22 bp, Homo sapiens
tacagtatggaaaatgtatagt

SEQ ID NO: 7136114 - DNA, 22 bp, Homo sapiens
gtctttaagggactgaatttgg

SEQ ID NO: 7136115 - DNA, 20 bp, Homo sapiens
gtctttatgttttatgacct

SEQ ID NO: 7136116 - DNA, 20 bp, Homo sapiens
gtctttatgttttatgacct

SEQ ID NO: 7136117 - DNA, 22 bp, Homo sapiens
gtcttgggacccgcactgtggg

SEQ ID NO: 7136118 - DNA, 22 bp, Homo sapiens
gtctttagagctcctggcatct

SEQ ID NO: 7136119 - DNA, 22 bp, Homo sapiens
gtctttagttgaaacatgtggt

SEQ ID NO: 7136120 - DNA, 19 bp, Homo sapiens
gtcttggctctcaaccatc

SEQ ID NO: 7136121 - DNA, 22 bp, Homo sapiens
gtcttgcagctcgctttgacta

SEQ ID NO: 7136122 - DNA, 22 bp, Homo sapiens
gtcttggatatgtttgccttca

SEQ ID NO: 7136123 - DNA, 22 bp, Homo sapiens
gtctcccaatccgggacagcct

SEQ ID NO: 7136124 - DNA, 22 bp, Homo sapiens
gtcttgatctcctgaccttgtg

SEQ ID NO: 7136125 - DNA, 22 bp, Homo sapiens
gtctccagttacagcagccagg

SEQ ID NO: 7136126 - DNA, 22 bp, Homo sapiens
gtctccagttacagcagccagg

SEQ ID NO: 7136127 - DNA, 22 bp, Homo sapiens
gtctccatggaaagtagccagt

SEQ ID NO: 7136128 - DNA, 22 bp, Homo sapiens
gtctcccaaactctgatggtcc

SEQ ID NO: 7136129 - DNA, 22 bp, Homo sapiens
gtctcccaaactctgatggtcc

SEQ ID NO: 7136130 - DNA, 22 bp, Homo sapiens
gtctcccaaactctgatggtcc

SEQ ID NO: 7136131 - DNA, 22 bp, Homo sapiens
gtctcccaacccctgtgcccag

SEQ ID NO: 7136132 - DNA, 22 bp, Homo sapiens
gtctcccaacccctgtgcccag

SEQ ID NO: 7136133 - DNA, 22 bp, Homo sapiens
gtctccagggacacactagccg

SEQ ID NO: 7136134 - DNA, 22 bp, Homo sapiens
gtctccagggacacactagccg

SEQ ID NO: 7136135 - DNA, 22 bp, Homo sapiens
gtctccagggacacactagccg

SEQ ID NO: 7136136 - DNA, 22 bp, Homo sapiens
gtctccagggctgctggcgcct

SEQ ID NO: 7136137 - DNA, 22 bp, Homo sapiens
gtctccagggctgctggcgcct

SEQ ID NO: 7136138 - DNA, 22 bp, Homo sapiens
gtctccagtgttcaggtgactg

SEQ ID NO: 7136139 - DNA, 22 bp, Homo sapiens
gtctccagttacagcagccagg

SEQ ID NO: 7136140 - DNA, 22 bp, Homo sapiens
gtctatttgggatcatgatatg

SEQ ID NO: 7136141 - DNA, 22 bp, Homo sapiens
gtctatttgggatcatgatatg

SEQ ID NO: 7136142 - DNA, 22 bp, Homo sapiens
gtctccagaagcctagacagcc

SEQ ID NO: 7136143 - DNA, 22 bp, Homo sapiens
gtctccagaattcttgggaggg

SEQ ID NO: 7136144 - DNA, 22 bp, Homo sapiens
gtctccagaggttacatcctgt

SEQ ID NO: 7136145 - DNA, 22 bp, Homo sapiens
gtctccagatatcctacacaac

SEQ ID NO: 7136146 - DNA, 22 bp, Homo sapiens
gtctccagccattctctgatca

SEQ ID NO: 7136147 - DNA, 22 bp, Homo sapiens
gtctccagcccactctagatat

SEQ ID NO: 7136148 - DNA, 22 bp, Homo sapiens
gtctagggtctgtagtgcatgt

SEQ ID NO: 7136149 - DNA, 22 bp, Homo sapiens
gtctagggtctgtagtgcatgt

SEQ ID NO: 7136150 - DNA, 22 bp, Homo sapiens
gtctagagaggaaggaagtgtg

SEQ ID NO: 7136151 - DNA, 22 bp, Homo sapiens
gtctagcacatcatctcactgc

SEQ ID NO: 7136152 - DNA, 18 bp, Homo sapiens
gtctaggaggtcacaagg

SEQ ID NO: 7136153 - DNA, 22 bp, Homo sapiens
gtctatatattgcttgaataat

SEQ ID NO: 7136154 - DNA, 22 bp, Homo sapiens
gtctatgatattttgttatagc

SEQ ID NO: 7136155 - DNA, 22 bp, Homo sapiens
gtctatgatattttgttatagc

SEQ ID NO: 7136156 - DNA, 22 bp, Homo sapiens
gtctatgatattttgttatagc

SEQ ID NO: 7136157 - DNA, 22 bp, Homo sapiens
gtctacaaagcatataaaagag

SEQ ID NO: 7136158 - DNA, 22 bp, Homo sapiens
gtctacagtgaatgggtcctaa

SEQ ID NO: 7136159 - DNA, 22 bp, Homo sapiens
gtctacatgtgttcttaagaga

SEQ ID NO: 7136160 - DNA, 22 bp, Homo sapiens
gtctactgcccaaatcaatatt

SEQ ID NO: 7136161 - DNA, 22 bp, Homo sapiens
gtctaaacctcaaatcagtgtc

SEQ ID NO: 7136162 - DNA, 22 bp, Homo sapiens
gtctaaacttagggatcgaaca

SEQ ID NO: 7136163 - DNA, 22 bp, Homo sapiens
gtctaaactttacagagtcaag

SEQ ID NO: 7136164 - DNA, 22 bp, Homo sapiens
gtctaaactttggcccagattt

SEQ ID NO: 7136165 - DNA, 22 bp, Homo sapiens
gtctaaggatctgttagctttt

SEQ ID NO: 7136166 - DNA, 22 bp, Homo sapiens
gtctaagtgggtggcactgaca

SEQ ID NO: 7136167 - DNA, 22 bp, Homo sapiens
gtctaattcctgctcttactca

SEQ ID NO: 7136168 - DNA, 22 bp, Homo sapiens
gtctagaaaatgccgagggatg

SEQ ID NO: 7136169 - DNA, 22 bp, Homo sapiens
gtctagaaataggtttcagaaa

SEQ ID NO: 7136170 - DNA, 22 bp, Homo sapiens
gtctagaaataggtttcagaaa

SEQ ID NO: 7136171 - DNA, 22 bp, Homo sapiens
gtctagaaatcatgtactgtga

SEQ ID NO: 7136172 - DNA, 22 bp, Homo sapiens
gtctagaaatgccatacgtgcc

SEQ ID NO: 7136173 - DNA, 22 bp, Homo sapiens
gtctagaaatgttctcaggggt

SEQ ID NO: 7136174 - DNA, 19 bp, Homo sapiens
gtctagaacattgtaggtg

SEQ ID NO: 7136175 - DNA, 22 bp, Homo sapiens
gtctagaatatctagaaagatc

SEQ ID NO: 7136176 - DNA, 22 bp, Homo sapiens
gtctagaatggatgagcatttt

SEQ ID NO: 7136177 - DNA, 22 bp, Homo sapiens
gtctagaattgcttggcagatg

SEQ ID NO: 7136178 - DNA, 22 bp, Homo sapiens
gtctagaattgcttggcagatg

SEQ ID NO: 7136179 - DNA, 22 bp, Homo sapiens
gtctagagaggaaggaagtgtg

SEQ ID NO: 7136180 - DNA, 22 bp, Homo sapiens
gtgaggaagtctgagagccaca

SEQ ID NO: 7136181 - DNA, 22 bp, Homo sapiens
gtgaggactggtaaggactgca

SEQ ID NO: 7136182 - DNA, 22 bp, Homo sapiens
gtgaggaagtggtcaggcatcc

SEQ ID NO: 7136183 - DNA, 22 bp, Homo sapiens
gtgaggaagtgtttgtcaaatt

SEQ ID NO: 7136184 - DNA, 22 bp, Homo sapiens
gtgaggaagtggtcaggcatcc

SEQ ID NO: 7136185 - DNA, 22 bp, Homo sapiens
gtgaggagctgacactggggtg

SEQ ID NO: 7136186 - DNA, 22 bp, Homo sapiens
gtgaggagctgacactggggtg

SEQ ID NO: 7136187 - DNA, 22 bp, Homo sapiens
gtgaggagctctttgactcacg

SEQ ID NO: 7136188 - DNA, 22 bp, Homo sapiens
gtgaggagctctttgactcacg

SEQ ID NO: 7136189 - DNA, 22 bp, Homo sapiens
gtgaggagggctggtcccaggc

SEQ ID NO: 7136190 - DNA, 22 bp, Homo sapiens
gtgagcatgtagtaatctggag

SEQ ID NO: 7136191 - DNA, 22 bp, Homo sapiens
gtgagcatatatgtaatcgttt

SEQ ID NO: 7136192 - DNA, 22 bp, Homo sapiens
gtgagcatcaaaaacgtgtatg

SEQ ID NO: 7136193 - DNA, 22 bp, Homo sapiens
gtgagcatcccttaccggaagt

SEQ ID NO: 7136194 - DNA, 22 bp, Homo sapiens
gtgagcatcttggcagatatga

SEQ ID NO: 7136195 - DNA, 22 bp, Homo sapiens
gtgagcatgccgtccaagtcac

SEQ ID NO: 7136196 - DNA, 22 bp, Homo sapiens
gtgagcatgccgtccaagtcac

SEQ ID NO: 7136197 - DNA, 22 bp, Homo sapiens
gtgagcatagtaccaggtagta

SEQ ID NO: 7136198 - DNA, 22 bp, Homo sapiens
gtgagcatagtaccaggtagta

SEQ ID NO: 7136199 - DNA, 22 bp, Homo sapiens
gtgagcataacaacagagttta

SEQ ID NO: 7136200 - DNA, 22 bp, Homo sapiens
gtgagcataacaacagagttta

SEQ ID NO: 7136201 - DNA, 22 bp, Homo sapiens
gtgagcagtttgttccagaatc

SEQ ID NO: 7136202 - DNA, 22 bp, Homo sapiens
gtgagcagttgtgagccccaaa

SEQ ID NO: 7136203 - DNA, 22 bp, Homo sapiens
gtgagcagtggccagggtccta

SEQ ID NO: 7136204 - DNA, 22 bp, Homo sapiens
gtgagcagttgtataaagactt

SEQ ID NO: 7136205 - DNA, 22 bp, Homo sapiens
gtgagcagttgtataaagactt

SEQ ID NO: 7136206 - DNA, 22 bp, Homo sapiens
gtgagcgtggtcttctgtgggt

SEQ ID NO: 7136207 - DNA, 22 bp, Homo sapiens
gtgagcgtggtcttctgtgggt

SEQ ID NO: 7136208 - DNA, 22 bp, Homo sapiens
gtgagctggaatagtggagaaa

SEQ ID NO: 7136209 - DNA, 17 bp, Homo sapiens
gtgagctgagtcaggac

SEQ ID NO: 7136210 - DNA, 22 bp, Homo sapiens
gtgagccgagtatagttcatag

SEQ ID NO: 7136211 - DNA, 22 bp, Homo sapiens
gtgagccgagtatagttcatag

SEQ ID NO: 7136212 - DNA, 22 bp, Homo sapiens
gtgagctgttggagtggcagag

SEQ ID NO: 7136213 - DNA, 22 bp, Homo sapiens
gtgagctgggtgaatggtaggg

SEQ ID NO: 7136214 - DNA, 22 bp, Homo sapiens
gtgagctgggtgaatggtaggg

SEQ ID NO: 7136215 - DNA, 22 bp, Homo sapiens
gtgagctggaatagtggagaaa

SEQ ID NO: 7136216 - DNA, 22 bp, Homo sapiens
gtgagcagtggccagggtccta

SEQ ID NO: 7136217 - DNA, 22 bp, Homo sapiens
gtgagcagggcaggactgggga

SEQ ID NO: 7136218 - DNA, 22 bp, Homo sapiens
gtgaaaaatgatttgttaactg

SEQ ID NO: 7136219 - DNA, 22 bp, Homo sapiens
gtgaaaaatcatcatgacttga

SEQ ID NO: 7136220 - DNA, 22 bp, Homo sapiens
gtctttttattatagagtggag

SEQ ID NO: 7136221 - DNA, 22 bp, Homo sapiens
gtctttttctacgatagcgcct

SEQ ID NO: 7136222 - DNA, 22 bp, Homo sapiens
gtctttttctacgatagcgcct

SEQ ID NO: 7136223 - DNA, 22 bp, Homo sapiens
gtctttttctacgatagcgcct

SEQ ID NO: 7136224 - DNA, 22 bp, Homo sapiens
gtctttttattatagagtggag

SEQ ID NO: 7136225 - DNA, 22 bp, Homo sapiens
gtctttttgtctggcagaggtc

SEQ ID NO: 7136226 - DNA, 22 bp, Homo sapiens
gtctttttctacgatagcgcct

SEQ ID NO: 7136227 - DNA, 22 bp, Homo sapiens
gtcttttttacaccttacatca

SEQ ID NO: 7136228 - DNA, 22 bp, Homo sapiens
gtcttttttacaccttacatca

SEQ ID NO: 7136229 - DNA, 22 bp, Homo sapiens
gtctttttgtctggcagaggtc

SEQ ID NO: 7136230 - DNA, 22 bp, Homo sapiens
gtcttttttacaccttacatca

SEQ ID NO: 7136231 - DNA, 22 bp, Homo sapiens
gtcttttttacaccttacatca

SEQ ID NO: 7136232 - DNA, 22 bp, Homo sapiens
gtctttctatgcatagagcaga

SEQ ID NO: 7136233 - DNA, 22 bp, Homo sapiens
gtctttctatgcatagagcaga

SEQ ID NO: 7136234 - DNA, 22 bp, Homo sapiens
gtctttctatgcatagagcaga

SEQ ID NO: 7136235 - DNA, 22 bp, Homo sapiens
gtctttctatgatgaactgttg

SEQ ID NO: 7136236 - DNA, 22 bp, Homo sapiens
gtctttctatgcatagagcaga

SEQ ID NO: 7136237 - DNA, 22 bp, Homo sapiens
gtctttgttctgcactattgtc

SEQ ID NO: 7136238 - DNA, 21 bp, Homo sapiens
gtcttttaagtgaagagaggc

SEQ ID NO: 7136239 - DNA, 21 bp, Homo sapiens
gtctttttaattgcgatttcc

SEQ ID NO: 7136240 - DNA, 22 bp, Homo sapiens
gtctttctatgatgaactgttg

SEQ ID NO: 7136241 - DNA, 21 bp, Homo sapiens
gtctttctacctctatgtggc

SEQ ID NO: 7136242 - DNA, 22 bp, Homo sapiens
gtctttatttgagattgtcatt

SEQ ID NO: 7136243 - DNA, 22 bp, Homo sapiens
gtctttatttgagattgtcatt

SEQ ID NO: 7136244 - DNA, 22 bp, Homo sapiens
gtctttcaggaggggcttagag

SEQ ID NO: 7136245 - DNA, 22 bp, Homo sapiens
gtctttcatggatattcagttt

SEQ ID NO: 7136246 - DNA, 17 bp, Homo sapiens
gtgcagggatgaaggat

SEQ ID NO: 7136247 - DNA, 17 bp, Homo sapiens
gtgcagggatgaaggat

SEQ ID NO: 7136248 - DNA, 17 bp, Homo sapiens
gtgcagggatgaaggat

SEQ ID NO: 7136249 - DNA, 17 bp, Homo sapiens
gtgcagggatgaaggat

SEQ ID NO: 7136250 - DNA, 17 bp, Homo sapiens
gtgcagggatgaaggat

SEQ ID NO: 7136251 - DNA, 22 bp, Homo sapiens
gtgcagggcagccgaatgggct

SEQ ID NO: 7136252 - DNA, 22 bp, Homo sapiens
gtgcagggcagccgaatgggct

SEQ ID NO: 7136253 - DNA, 22 bp, Homo sapiens
gtgcagggcagccgaatgggct

SEQ ID NO: 7136254 - DNA, 22 bp, Homo sapiens
gtgcagggcagccgaatgggct

SEQ ID NO: 7136255 - DNA, 22 bp, Homo sapiens
gtgcaggggatcaggttgcagc

SEQ ID NO: 7136256 - DNA, 22 bp, Homo sapiens
gtgcaggggatcaggttgcagc

SEQ ID NO: 7136257 - DNA, 22 bp, Homo sapiens
gtgcagggctggcaccggaggc

SEQ ID NO: 7136258 - DNA, 22 bp, Homo sapiens
gtgcagggctggcaccggaggc

SEQ ID NO: 7136259 - DNA, 22 bp, Homo sapiens
gtgcagggctggcaccggaggc

SEQ ID NO: 7136260 - DNA, 22 bp, Homo sapiens
gtgcaggggatcaggttgcagc

SEQ ID NO: 7136261 - DNA, 22 bp, Homo sapiens
gtgcagggctggcaccggaggc

SEQ ID NO: 7136262 - DNA, 22 bp, Homo sapiens
gtgcagggcagccgaatgggct

SEQ ID NO: 7136263 - DNA, 22 bp, Homo sapiens
gtgcagggcagccgaatgggct

SEQ ID NO: 7136264 - DNA, 22 bp, Homo sapiens
gtgcagggcagccgaatgggct

SEQ ID NO: 7136265 - DNA, 22 bp, Homo sapiens
gtgcagggcaggtgtccttcca

SEQ ID NO: 7136266 - DNA, 22 bp, Homo sapiens
gtgcagggcaggtgtccttcca

SEQ ID NO: 7136267 - DNA, 22 bp, Homo sapiens
gtgcagggcaggtgtccttcca

SEQ ID NO: 7136268 - DNA, 22 bp, Homo sapiens
gtgcagggcaggtgtccttcca

SEQ ID NO: 7136269 - DNA, 22 bp, Homo sapiens
gtgcagggcaggtgtccttcca

SEQ ID NO: 7136270 - DNA, 22 bp, Homo sapiens
gtgcagggccctcctaacatct

SEQ ID NO: 7136271 - DNA, 22 bp, Homo sapiens
gtgcagggccctcctaacatct

SEQ ID NO: 7136272 - DNA, 22 bp, Homo sapiens
gtgcaggggcctccccttgctg

SEQ ID NO: 7136273 - DNA, 22 bp, Homo sapiens
gtgcagggtagcgacggcagga

SEQ ID NO: 7136274 - DNA, 22 bp, Homo sapiens
gtgcagggtagcgacggcagga

SEQ ID NO: 7136275 - DNA, 22 bp, Homo sapiens
gtgccactgataaatcagaatg

SEQ ID NO: 7136276 - DNA, 22 bp, Homo sapiens
gtgcaggggcctccccttgctg

SEQ ID NO: 7136277 - DNA, 22 bp, Homo sapiens
gtgcaggggatcaggttgcagc

SEQ ID NO: 7136278 - DNA, 22 bp, Homo sapiens
gtgcaggggcctccccttgctg

SEQ ID NO: 7136279 - DNA, 22 bp, Homo sapiens
gtgcaggggatcaggttgcagc

SEQ ID NO: 7136280 - DNA, 22 bp, Homo sapiens
gtgcaggggatcaggttgcagc

SEQ ID NO: 7136281 - DNA, 22 bp, Homo sapiens
gtgccagaatctttgaagagag

SEQ ID NO: 7136282 - DNA, 22 bp, Homo sapiens
gtgccagacagggcagtggtat

SEQ ID NO: 7136283 - DNA, 22 bp, Homo sapiens
gtgccagacagggcagtggtat

SEQ ID NO: 7136284 - DNA, 22 bp, Homo sapiens
gtgccagaggcagtgaggagtt

SEQ ID NO: 7136285 - DNA, 22 bp, Homo sapiens
gtgccagaggccccaaacaagt

SEQ ID NO: 7136286 - DNA, 22 bp, Homo sapiens
gtgccagcagttatggtgattt

SEQ ID NO: 7136287 - DNA, 22 bp, Homo sapiens
gtgccagcagttatggtgattt

SEQ ID NO: 7136288 - DNA, 22 bp, Homo sapiens
gtgcagggagcccagaaggtcc

SEQ ID NO: 7136289 - DNA, 17 bp, Homo sapiens
gtgcagggatgaaggat

SEQ ID NO: 7136290 - DNA, 17 bp, Homo sapiens
gtgcagggatgaaggat

SEQ ID NO: 7136291 - DNA, 22 bp, Homo sapiens
gtgcagggagcccagaaggtcc

SEQ ID NO: 7136292 - DNA, 22 bp, Homo sapiens
gtgcagggagcccagaaggtcc

SEQ ID NO: 7136293 - DNA, 22 bp, Homo sapiens
gtgcagggagcccagaaggtcc

SEQ ID NO: 7136294 - DNA, 22 bp, Homo sapiens
gtgcagggagcccagaaggtcc

SEQ ID NO: 7136295 - DNA, 22 bp, Homo sapiens
gtgcagggagcccagaaggtcc

SEQ ID NO: 7136296 - DNA, 22 bp, Homo sapiens
gtgcaggcaaaagggccaggcc

SEQ ID NO: 7136297 - DNA, 22 bp, Homo sapiens
gtgcaggcaaaagggccaggcc

SEQ ID NO: 7136298 - DNA, 22 bp, Homo sapiens
gtgcaggcaaaagggccaggcc

SEQ ID NO: 7136299 - DNA, 22 bp, Homo sapiens
gtgcaggcaaaagggccaggcc

SEQ ID NO: 7136300 - DNA, 22 bp, Homo sapiens
gtgcaggagtaggagagggctt

SEQ ID NO: 7136301 - DNA, 22 bp, Homo sapiens
gtgcaggatgttgggaatcagg

SEQ ID NO: 7136302 - DNA, 20 bp, Homo sapiens
gtgcagcacttgggggtagg

SEQ ID NO: 7136303 - DNA, 20 bp, Homo sapiens
gtgcagcacttgggggtagg

SEQ ID NO: 7136304 - DNA, 22 bp, Homo sapiens
gtgaggattgctctggagaatt

SEQ ID NO: 7136305 - DNA, 22 bp, Homo sapiens
gtgaggatgtactgagataaat

SEQ ID NO: 7136306 - DNA, 22 bp, Homo sapiens
gtgaggatgtactgagataaat

SEQ ID NO: 7136307 - DNA, 22 bp, Homo sapiens
gtgaggatcaaatgaaatagca

SEQ ID NO: 7136308 - DNA, 22 bp, Homo sapiens
gtgaggatgcagatgagggcct

SEQ ID NO: 7136309 - DNA, 22 bp, Homo sapiens
gtgaggatcaaatgaaatagca

SEQ ID NO: 7136310 - DNA, 22 bp, Homo sapiens
gtgaggagtctgaagcacataa

SEQ ID NO: 7136311 - DNA, 22 bp, Homo sapiens
gtgcagcaaagtttgagatata

SEQ ID NO: 7136312 - DNA, 22 bp, Homo sapiens
gtgcagcaaactagtgcgaggg

SEQ ID NO: 7136313 - DNA, 22 bp, Homo sapiens
gtgcagcaaactagtgcgaggg

SEQ ID NO: 7136314 - DNA, 22 bp, Homo sapiens
gtgaggcagcaggagcctctgt

SEQ ID NO: 7136315 - DNA, 22 bp, Homo sapiens
gtgccaggcccagggagcgggg

SEQ ID NO: 7136316 - DNA, 22 bp, Homo sapiens
gtgccagggagtggaggagctt

SEQ ID NO: 7136317 - DNA, 22 bp, Homo sapiens
gtgccagggagtggaggagctt

SEQ ID NO: 7136318 - DNA, 22 bp, Homo sapiens
gtgccaggcccagggagcgggg

SEQ ID NO: 7136319 - DNA, 22 bp, Homo sapiens
gtgccaggcccagggagcgggg

SEQ ID NO: 7136320 - DNA, 22 bp, Homo sapiens
gtgccaggcccagggagcgggg

SEQ ID NO: 7136321 - DNA, 22 bp, Homo sapiens
gtgccaggcccagggagcgggg

SEQ ID NO: 7136322 - DNA, 22 bp, Homo sapiens
gtgccaggcccagggagcgggg

SEQ ID NO: 7136323 - DNA, 20 bp, Homo sapiens
gtgccaggcaagacaggtgg

SEQ ID NO: 7136324 - DNA, 18 bp, Homo sapiens
gtgccaggaggcgcagcc

SEQ ID NO: 7136325 - DNA, 20 bp, Homo sapiens
gtgccaggcaagacaggtgg

SEQ ID NO: 7136326 - DNA, 18 bp, Homo sapiens
gtgccaggaggcgcagcc

SEQ ID NO: 7136327 - DNA, 18 bp, Homo sapiens
gtgccaggaggcgcagcc

SEQ ID NO: 7136328 - DNA, 22 bp, Homo sapiens
gtgccagcctggtgcgcctggg

SEQ ID NO: 7136329 - DNA, 22 bp, Homo sapiens
gtgccagggggcactgaacaga

SEQ ID NO: 7136330 - DNA, 22 bp, Homo sapiens
gtgccagggagtggaggagctt

SEQ ID NO: 7136331 - DNA, 22 bp, Homo sapiens
gtgccagggggcactgaacaga

SEQ ID NO: 7136332 - DNA, 22 bp, Homo sapiens
gtgccaggtgctaagctgtgct

SEQ ID NO: 7136333 - DNA, 22 bp, Homo sapiens
gtgccaggtgctaagctgtgct

SEQ ID NO: 7136334 - DNA, 22 bp, Homo sapiens
gtgccaggtgctaagctgtgct

SEQ ID NO: 7136335 - DNA, 22 bp, Homo sapiens
gtgccatactcatatcattttt

SEQ ID NO: 7136336 - DNA, 22 bp, Homo sapiens
gtgccatcgggctcctcctgct

SEQ ID NO: 7136337 - DNA, 22 bp, Homo sapiens
gtgccaggtgctaagctgtgct

SEQ ID NO: 7136338 - DNA, 22 bp, Homo sapiens
gtgccattgcactccagcctgg

SEQ ID NO: 7136339 - DNA, 22 bp, Homo sapiens
gtgccattgcactccagcctgg

SEQ ID NO: 7136340 - DNA, 22 bp, Homo sapiens
gtgccatttctcaaaacacagt

SEQ ID NO: 7136341 - DNA, 22 bp, Homo sapiens
gtgcccacacatgttcttacat

SEQ ID NO: 7136342 - DNA, 22 bp, Homo sapiens
gtgcccaccacgggctgtggcg

SEQ ID NO: 7136343 - DNA, 22 bp, Homo sapiens
gtgccatttttctccagaaata

SEQ ID NO: 7136344 - DNA, 22 bp, Homo sapiens
gtgcccaccggtgccctgagct

SEQ ID NO: 7136345 - DNA, 22 bp, Homo sapiens
gtgcccacgaggccaggctggt

SEQ ID NO: 7136346 - DNA, 22 bp, Homo sapiens
gtgcccacgaggccaggctggt

SEQ ID NO: 7136347 - DNA, 22 bp, Homo sapiens
gtgcccagcagcagcgtccccg

SEQ ID NO: 7136348 - DNA, 22 bp, Homo sapiens
gtgcccagctccacctcacaga

SEQ ID NO: 7136349 - DNA, 22 bp, Homo sapiens
gtgcccagctccacctcacaga

SEQ ID NO: 7136350 - DNA, 22 bp, Homo sapiens
gtgcccagctccacctcacaga

SEQ ID NO: 7136351 - DNA, 22 bp, Homo sapiens
gtgctgacaggagcctggcggt

SEQ ID NO: 7136352 - DNA, 22 bp, Homo sapiens
gtgctgaatccactcttaggaa

SEQ ID NO: 7136353 - DNA, 22 bp, Homo sapiens
gtgctgaattggagatgctcct

SEQ ID NO: 7136354 - DNA, 22 bp, Homo sapiens
gtgctgaattgtgctctttaca

SEQ ID NO: 7136355 - DNA, 22 bp, Homo sapiens
gtgcccaggggccagctgccgg

SEQ ID NO: 7136356 - DNA, 22 bp, Homo sapiens
gtgctgaagtgaaattcatcaa

SEQ ID NO: 7136357 - DNA, 22 bp, Homo sapiens
gtgcccaggcccaaggcaccac

SEQ ID NO: 7136358 - DNA, 22 bp, Homo sapiens
gtgcccaggggccagctgccgg

SEQ ID NO: 7136359 - DNA, 22 bp, Homo sapiens
gtgctgcctgccagcttctggg

SEQ ID NO: 7136360 - DNA, 21 bp, Homo sapiens
gtgctgctagcgggacgggag

SEQ ID NO: 7136361 - DNA, 22 bp, Homo sapiens
gtgctgctcaagggacaggaca

SEQ ID NO: 7136362 - DNA, 21 bp, Homo sapiens
gtgctgctagcgggacgggag

SEQ ID NO: 7136363 - DNA, 22 bp, Homo sapiens
gtgctgctgccagcaggatcct

SEQ ID NO: 7136364 - DNA, 22 bp, Homo sapiens
gtgctgccggcatagcagtgaa

SEQ ID NO: 7136365 - DNA, 22 bp, Homo sapiens
gtgctgccagacagtgagaggg

SEQ ID NO: 7136366 - DNA, 22 bp, Homo sapiens
gtgctgccagacagtgagaggg

SEQ ID NO: 7136367 - DNA, 22 bp, Homo sapiens
gtgctgccggcatagcagtgaa

SEQ ID NO: 7136368 - DNA, 22 bp, Homo sapiens
gtgctgcctgccagcttctggg

SEQ ID NO: 7136369 - DNA, 22 bp, Homo sapiens
gtgctggcctcagagggtcatg

SEQ ID NO: 7136370 - DNA, 22 bp, Homo sapiens
gtgctggccctgtcctcgagct

SEQ ID NO: 7136371 - DNA, 22 bp, Homo sapiens
gtgctggccctgtcctcgagct

SEQ ID NO: 7136372 - DNA, 22 bp, Homo sapiens
gtgctggccctgtcctcgagct

SEQ ID NO: 7136373 - DNA, 22 bp, Homo sapiens
gtgctggcacccctctccagtt

SEQ ID NO: 7136374 - DNA, 22 bp, Homo sapiens
gtgctggcacccctctccagtt

SEQ ID NO: 7136375 - DNA, 22 bp, Homo sapiens
gtgctggcacccctctccagtt

SEQ ID NO: 7136376 - DNA, 22 bp, Homo sapiens
gtgctgcttgggggcagagcag

SEQ ID NO: 7136377 - DNA, 22 bp, Homo sapiens
gtgctggaccctggaaggtggt

SEQ ID NO: 7136378 - DNA, 22 bp, Homo sapiens
gtgctggaccctggaaggtggt

SEQ ID NO: 7136379 - DNA, 20 bp, Homo sapiens
gtgctggagttaggaaaggt

SEQ ID NO: 7136380 - DNA, 20 bp, Homo sapiens
gtgctggagttaggaaaggt

SEQ ID NO: 7136381 - DNA, 22 bp, Homo sapiens
gtcaaagatcctatgagttaaa

SEQ ID NO: 7136382 - DNA, 22 bp, Homo sapiens
gtcaaagatcctatgagttaaa

SEQ ID NO: 7136383 - DNA, 22 bp, Homo sapiens
gtcaaagatcctatgagttaaa

SEQ ID NO: 7136384 - DNA, 22 bp, Homo sapiens
gtcaaacatagggactttgtgg

SEQ ID NO: 7136385 - DNA, 21 bp, Homo sapiens
gtcaaactggggtacatttgt

SEQ ID NO: 7136386 - DNA, 22 bp, Homo sapiens
gtcaaagaaacgcaccttacat

SEQ ID NO: 7136387 - DNA, 22 bp, Homo sapiens
gtcaaaagctaatttgttattt

SEQ ID NO: 7136388 - DNA, 22 bp, Homo sapiens
gtcaaaatgagctttgttattg

SEQ ID NO: 7136389 - DNA, 22 bp, Homo sapiens
gtcaaaacactggggaatgttg

SEQ ID NO: 7136390 - DNA, 22 bp, Homo sapiens
gtcaaacaaattaacatatcca

SEQ ID NO: 7136391 - DNA, 22 bp, Homo sapiens
gtcaaatatatgcaaaactatt

SEQ ID NO: 7136392 - DNA, 22 bp, Homo sapiens
gtcaaatatactaagaggtaaa

SEQ ID NO: 7136393 - DNA, 16 bp, Homo sapiens
gtcaccatcatgtagt

SEQ ID NO: 7136394 - DNA, 22 bp, Homo sapiens
gtcaccatctacagctccaaac

SEQ ID NO: 7136395 - DNA, 22 bp, Homo sapiens
gtcaccatggataagaatcact

SEQ ID NO: 7136396 - DNA, 22 bp, Homo sapiens
gtcaccattgcccactccatgg

SEQ ID NO: 7136397 - DNA, 19 bp, Homo sapiens
gtcaccatttccaaatgcc

SEQ ID NO: 7136398 - DNA, 22 bp, Homo sapiens
gtcacccactccctgctgctgt

SEQ ID NO: 7136399 - DNA, 22 bp, Homo sapiens
gtatttttcattccaagtgaga

SEQ ID NO: 7136400 - DNA, 22 bp, Homo sapiens
gtatttttcattccaagtgaga

SEQ ID NO: 7136401 - DNA, 22 bp, Homo sapiens
gtatttttcattccaagtgaga

SEQ ID NO: 7136402 - DNA, 22 bp, Homo sapiens
gtatttttcattccaagtgaga

SEQ ID NO: 7136403 - DNA, 22 bp, Homo sapiens
gtcaaaaagtagtcatttctgt

SEQ ID NO: 7136404 - DNA, 22 bp, Homo sapiens
gtcaaaacaaagttaagaattc

SEQ ID NO: 7136405 - DNA, 22 bp, Homo sapiens
gtatttttcagttaggagctta

SEQ ID NO: 7136406 - DNA, 22 bp, Homo sapiens
gtatttttcagttaggagctta

SEQ ID NO: 7136407 - DNA, 22 bp, Homo sapiens
gtatttttagtagagtcggggt

SEQ ID NO: 7136408 - DNA, 22 bp, Homo sapiens
gtatttttaggtaaggaaagta

SEQ ID NO: 7136409 - DNA, 22 bp, Homo sapiens
gtatttttaggtaaggaaagta

SEQ ID NO: 7136410 - DNA, 22 bp, Homo sapiens
gtagttttctgaaaattacttt

SEQ ID NO: 7136411 - DNA, 22 bp, Homo sapiens
gtataaacatggagtgcattct

SEQ ID NO: 7136412 - DNA, 22 bp, Homo sapiens
gtataaacatggagtgcattct

SEQ ID NO: 7136413 - DNA, 22 bp, Homo sapiens
gtagttgcagatattgtcagaa

SEQ ID NO: 7136414 - DNA, 22 bp, Homo sapiens
gtagttttctgaaaattacttt

SEQ ID NO: 7136415 - DNA, 22 bp, Homo sapiens
gtagttccagatcatagagcat

SEQ ID NO: 7136416 - DNA, 22 bp, Homo sapiens
gtagttctgcagtgtcacctga

SEQ ID NO: 7136417 - DNA, 22 bp, Homo sapiens
gtagttctgcagtgtcacctga

SEQ ID NO: 7136418 - DNA, 22 bp, Homo sapiens
gtagtgtgtaggcactgtgctc

SEQ ID NO: 7136419 - DNA, 22 bp, Homo sapiens
gtataagcccattctcagagac

SEQ ID NO: 7136420 - DNA, 22 bp, Homo sapiens
gtataaagtataagcttgtttt

SEQ ID NO: 7136421 - DNA, 22 bp, Homo sapiens
gtatacactggtaagatttgtc

SEQ ID NO: 7136422 - DNA, 22 bp, Homo sapiens
gtatacactggtaagatttgtc

SEQ ID NO: 7136423 - DNA, 22 bp, Homo sapiens
gtatacactgtctcctctaggt

SEQ ID NO: 7136424 - DNA, 22 bp, Homo sapiens
gtattttatggcatgcagtggc

SEQ ID NO: 7136425 - DNA, 22 bp, Homo sapiens
gtatttcctcgcttgtgggatt

SEQ ID NO: 7136426 - DNA, 22 bp, Homo sapiens
gtatttcctcgcttgtgggatt

SEQ ID NO: 7136427 - DNA, 22 bp, Homo sapiens
gtatttcctatagtgagggcct

SEQ ID NO: 7136428 - DNA, 22 bp, Homo sapiens
gtatttccctgagttctgtgag

SEQ ID NO: 7136429 - DNA, 22 bp, Homo sapiens
gtatttccctgagttctgtgag

SEQ ID NO: 7136430 - DNA, 22 bp, Homo sapiens
gtatttcccccagactccctgg

SEQ ID NO: 7136431 - DNA, 22 bp, Homo sapiens
gtatacatacttctagattaaa

SEQ ID NO: 7136432 - DNA, 22 bp, Homo sapiens
gtatacatagatgatgaacaag

SEQ ID NO: 7136433 - DNA, 22 bp, Homo sapiens
gtattttatggcctggggccta

SEQ ID NO: 7136434 - DNA, 22 bp, Homo sapiens
gtattttatggcctggggccta

SEQ ID NO: 7136435 - DNA, 22 bp, Homo sapiens
gtatttttaggtaaggaaagta

SEQ ID NO: 7136436 - DNA, 22 bp, Homo sapiens
gtagtccagagctaaggattat

SEQ ID NO: 7136437 - DNA, 22 bp, Homo sapiens
gtagtataaatgggaaatacat

SEQ ID NO: 7136438 - DNA, 22 bp, Homo sapiens
gtagtatatcagtggtttccat

SEQ ID NO: 7136439 - DNA, 22 bp, Homo sapiens
gtagtattttctgtgatgtagg

SEQ ID NO: 7136440 - DNA, 22 bp, Homo sapiens
gtagtattttctgtgatgtagg

SEQ ID NO: 7136441 - DNA, 22 bp, Homo sapiens
gtagtcacaaaccattcatatg

SEQ ID NO: 7136442 - DNA, 22 bp, Homo sapiens
gtagtgctttcatctggagtgt

SEQ ID NO: 7136443 - DNA, 22 bp, Homo sapiens
gtagtcttttcaatgattgtgt

SEQ ID NO: 7136444 - DNA, 22 bp, Homo sapiens
gtagtggagtctcctgtcctgg

SEQ ID NO: 7136445 - DNA, 22 bp, Homo sapiens
gtagtgcgcatggcctgtttgt

SEQ ID NO: 7136446 - DNA, 22 bp, Homo sapiens
gtagtctgaacagtaattttgt

SEQ ID NO: 7136447 - DNA, 22 bp, Homo sapiens
gtaggtcagacataagaggaca

SEQ ID NO: 7136448 - DNA, 22 bp, Homo sapiens
gtagggttggagagcacaacca

SEQ ID NO: 7136449 - DNA, 22 bp, Homo sapiens
gtagggttggagagcacaacca

SEQ ID NO: 7136450 - DNA, 22 bp, Homo sapiens
gtaggtaagtacttctggtgag

SEQ ID NO: 7136451 - DNA, 22 bp, Homo sapiens
gtaggtgagtgggagaagaggc

SEQ ID NO: 7136452 - DNA, 22 bp, Homo sapiens
gtaggtgagtgggagaagaggc

SEQ ID NO: 7136453 - DNA, 22 bp, Homo sapiens
gtaggtgataatgcaaaaggaa

SEQ ID NO: 7136454 - DNA, 22 bp, Homo sapiens
gtaggtgagtgatgctcagatt

SEQ ID NO: 7136455 - DNA, 22 bp, Homo sapiens
gtagtaaagcaggttttgctgt

SEQ ID NO: 7136456 - DNA, 22 bp, Homo sapiens
gtagtaaagcaggttttgctgt

SEQ ID NO: 7136457 - DNA, 22 bp, Homo sapiens
gtagtaaagcggaaagggtgat

SEQ ID NO: 7136458 - DNA, 22 bp, Homo sapiens
gtagtaatagtacattagaatg

SEQ ID NO: 7136459 - DNA, 22 bp, Homo sapiens
gtagtaattgttttaagccacc

SEQ ID NO: 7136460 - DNA, 22 bp, Homo sapiens
gtaggggtgctgagatctggaa

SEQ ID NO: 7136461 - DNA, 22 bp, Homo sapiens
gtaggggtcaggtagggactct

SEQ ID NO: 7136462 - DNA, 22 bp, Homo sapiens
gtaggggccagaaagacttaga

SEQ ID NO: 7136463 - DNA, 22 bp, Homo sapiens
gtaggggtgctgagatctggaa

SEQ ID NO: 7136464 - DNA, 22 bp, Homo sapiens
gtagggctcagtaaatactttg

SEQ ID NO: 7136465 - DNA, 22 bp, Homo sapiens
gtagggctcagtaaatactttg

SEQ ID NO: 7136466 - DNA, 22 bp, Homo sapiens
gtaggcagataggagtgcagcc

SEQ ID NO: 7136467 - DNA, 22 bp, Homo sapiens
gtaggcactcagataatgaatg

SEQ ID NO: 7136468 - DNA, 22 bp, Homo sapiens
gtaggcactctgtaagcatttg

SEQ ID NO: 7136469 - DNA, 22 bp, Homo sapiens
gtaggcagaccagtggatgggt

SEQ ID NO: 7136470 - DNA, 22 bp, Homo sapiens
gtacaatagcagttttcccttt

SEQ ID NO: 7136471 - DNA, 22 bp, Homo sapiens
gtacaatagtccctgtttggat

SEQ ID NO: 7136472 - DNA, 22 bp, Homo sapiens
gtacacaaaagaggaaaccgga

SEQ ID NO: 7136473 - DNA, 22 bp, Homo sapiens
gtaggaagctctgaggctagtt

SEQ ID NO: 7136474 - DNA, 22 bp, Homo sapiens
gtaggaattggctttggatgtg

SEQ ID NO: 7136475 - DNA, 22 bp, Homo sapiens
gtaggagctcatggggccagga

SEQ ID NO: 7136476 - DNA, 22 bp, Homo sapiens
gtacaaaagttattgcggtttt

SEQ ID NO: 7136477 - DNA, 22 bp, Homo sapiens
gtacaaatacattctgaaggta

SEQ ID NO: 7136478 - DNA, 22 bp, Homo sapiens
gtacaaatgaaaatagaccact

SEQ ID NO: 7136479 - DNA, 22 bp, Homo sapiens
gtacaaaagttattgcggtttt

SEQ ID NO: 7136480 - DNA, 22 bp, Homo sapiens
gtacaaaggcagaattgggtag

SEQ ID NO: 7136481 - DNA, 22 bp, Homo sapiens
gtacaaaggcagaattgggtag

SEQ ID NO: 7136482 - DNA, 22 bp, Homo sapiens
gtacaaaggcagaattgggtag

SEQ ID NO: 7136483 - DNA, 22 bp, Homo sapiens
gtacaaagtggacctgatagta

SEQ ID NO: 7136484 - DNA, 22 bp, Homo sapiens
gtacaaagtggacctgatagta

SEQ ID NO: 7136485 - DNA, 22 bp, Homo sapiens
gtacaaatgagagttctgtttt

SEQ ID NO: 7136486 - DNA, 22 bp, Homo sapiens
gtacaaatgagagttctgtttt

SEQ ID NO: 7136487 - DNA, 22 bp, Homo sapiens
gtacaaatgcaggtttgttaca

SEQ ID NO: 7136488 - DNA, 22 bp, Homo sapiens
gtacaaatgcaggtttgttaca

SEQ ID NO: 7136489 - DNA, 22 bp, Homo sapiens
gtacaaatgtacacttgtataa

SEQ ID NO: 7136490 - DNA, 22 bp, Homo sapiens
gtacaaatgtacacttgtataa

SEQ ID NO: 7136491 - DNA, 22 bp, Homo sapiens
gtacaaattaggaagctttgtg

SEQ ID NO: 7136492 - DNA, 22 bp, Homo sapiens
gtacaaattgatacagatttga

SEQ ID NO: 7136493 - DNA, 22 bp, Homo sapiens
gtacaaattgatacagatttga

SEQ ID NO: 7136494 - DNA, 22 bp, Homo sapiens
gtacaaattgatacaggttttc

SEQ ID NO: 7136495 - DNA, 22 bp, Homo sapiens
gtacaaattttgacatctagga

SEQ ID NO: 7136496 - DNA, 22 bp, Homo sapiens
gtacaaattttgacatctagga

SEQ ID NO: 7136497 - DNA, 22 bp, Homo sapiens
gtacaacaggattgatgtacca

SEQ ID NO: 7136498 - DNA, 22 bp, Homo sapiens
gtacaacatgattttactctct

SEQ ID NO: 7136499 - DNA, 22 bp, Homo sapiens
gtacaacatgattttactctct

SEQ ID NO: 7136500 - DNA, 22 bp, Homo sapiens
gtacaactccccaggcactgct

SEQ ID NO: 7136501 - DNA, 22 bp, Homo sapiens
gtacaacttctgtagctacttt

SEQ ID NO: 7136502 - DNA, 22 bp, Homo sapiens
gtacaagaggagaaaatggagt

SEQ ID NO: 7136503 - DNA, 21 bp, Homo sapiens
gtacaagctcaccaagtggac

SEQ ID NO: 7136504 - DNA, 22 bp, Homo sapiens
gtacaagtgctgtgagggaaaa

SEQ ID NO: 7136505 - DNA, 22 bp, Homo sapiens
gtacaagtgtatttggcttgat

SEQ ID NO: 7136506 - DNA, 22 bp, Homo sapiens
gtacaataactagtcttatagt

SEQ ID NO: 7136507 - DNA, 22 bp, Homo sapiens
gtcctgggaactggacagctaa

SEQ ID NO: 7136508 - DNA, 22 bp, Homo sapiens
gtcctggcttagttcgctgtaa

SEQ ID NO: 7136509 - DNA, 22 bp, Homo sapiens
gtcctgggaactggacagctaa

SEQ ID NO: 7136510 - DNA, 22 bp, Homo sapiens
gtcctgggaactggacagctaa

SEQ ID NO: 7136511 - DNA, 22 bp, Homo sapiens
gtctaaacaaaaatgcaccttt

SEQ ID NO: 7136512 - DNA, 22 bp, Homo sapiens
gtcctggattgaacataggcag

SEQ ID NO: 7136513 - DNA, 22 bp, Homo sapiens
gtcctggcccactggcaggctg

SEQ ID NO: 7136514 - DNA, 22 bp, Homo sapiens
gtcctggcccaggagtacacat

SEQ ID NO: 7136515 - DNA, 22 bp, Homo sapiens
gtcctggcctctgggggtatgg

SEQ ID NO: 7136516 - DNA, 22 bp, Homo sapiens
gtcctggctagtcgtccgcgac

SEQ ID NO: 7136517 - DNA, 22 bp, Homo sapiens
gtcctggctggttctgtggggc

SEQ ID NO: 7136518 - DNA, 22 bp, Homo sapiens
gtcctctgggctttgagcagtc

SEQ ID NO: 7136519 - DNA, 22 bp, Homo sapiens
gtcctctgggctttgagcagtc

SEQ ID NO: 7136520 - DNA, 22 bp, Homo sapiens
gtcctctgtagggctgggccac

SEQ ID NO: 7136521 - DNA, 22 bp, Homo sapiens
gtcctctgtccctggggcacgg

SEQ ID NO: 7136522 - DNA, 22 bp, Homo sapiens
gtcctctgtccctggggcacgg

SEQ ID NO: 7136523 - DNA, 22 bp, Homo sapiens
gtcctctgtagggctgggccac

SEQ ID NO: 7136524 - DNA, 22 bp, Homo sapiens
gtcctctgtgtaggctgcagac

SEQ ID NO: 7136525 - DNA, 22 bp, Homo sapiens
gtcctctgtgtaggctgcagac

SEQ ID NO: 7136526 - DNA, 22 bp, Homo sapiens
gtcctctgtgtaggctgcagac

SEQ ID NO: 7136527 - DNA, 22 bp, Homo sapiens
gtcctgcacatggagggcaatg

SEQ ID NO: 7136528 - DNA, 22 bp, Homo sapiens
gtcctgcacatggagggcaatg

SEQ ID NO: 7136529 - DNA, 22 bp, Homo sapiens
gtcctgctggcttcaggagatt

SEQ ID NO: 7136530 - DNA, 22 bp, Homo sapiens
gtcctgcttcccacagaaaccg

SEQ ID NO: 7136531 - DNA, 22 bp, Homo sapiens
gtcctggaatcctagaacagtg

SEQ ID NO: 7136532 - DNA, 22 bp, Homo sapiens
gtcctggagtggcatggcatgg

SEQ ID NO: 7136533 - DNA, 22 bp, Homo sapiens
gtcctggagtggcatggcatgg

SEQ ID NO: 7136534 - DNA, 22 bp, Homo sapiens
gtcctggattgaacataggcag

SEQ ID NO: 7136535 - DNA, 22 bp, Homo sapiens
gtccaggctcaaaaggttgtta

SEQ ID NO: 7136536 - DNA, 22 bp, Homo sapiens
gtccaggctgacccctagagga

SEQ ID NO: 7136537 - DNA, 22 bp, Homo sapiens
gtccaggctgacccctagagga

SEQ ID NO: 7136538 - DNA, 22 bp, Homo sapiens
gtccaggctaagtcccttctgc

SEQ ID NO: 7136539 - DNA, 22 bp, Homo sapiens
gtccaggctcaaaaggttgtta

SEQ ID NO: 7136540 - DNA, 22 bp, Homo sapiens
gtccaggccccagggattcttg

SEQ ID NO: 7136541 - DNA, 22 bp, Homo sapiens
gtccaggccccagggattcttg

SEQ ID NO: 7136542 - DNA, 22 bp, Homo sapiens
gtccaggcctgcctctgaggag

SEQ ID NO: 7136543 - DNA, 22 bp, Homo sapiens
gtccaggcctgcctctgaggag

SEQ ID NO: 7136544 - DNA, 22 bp, Homo sapiens
gtccaggaagcaataaatagaa

SEQ ID NO: 7136545 - DNA, 22 bp, Homo sapiens
gtccaggagtttccaattaagc

SEQ ID NO: 7136546 - DNA, 22 bp, Homo sapiens
gtccaggcacctcccttgtgct

SEQ ID NO: 7136547 - DNA, 22 bp, Homo sapiens
gtccaggcacctcccttgtgct

SEQ ID NO: 7136548 - DNA, 19 bp, Homo sapiens
gtccaggcattgggttggt

SEQ ID NO: 7136549 - DNA, 19 bp, Homo sapiens
gtccaggcattgggttggt

SEQ ID NO: 7136550 - DNA, 19 bp, Homo sapiens
gtccaggcattgggttggt

SEQ ID NO: 7136551 - DNA, 22 bp, Homo sapiens
gtccaggccatggtggacacag

SEQ ID NO: 7136552 - DNA, 22 bp, Homo sapiens
gtcctctggaagatgagttctt

SEQ ID NO: 7136553 - DNA, 22 bp, Homo sapiens
gtcctctggaagatgagttctt

SEQ ID NO: 7136554 - DNA, 22 bp, Homo sapiens
gtccaggctgacccctagagga

SEQ ID NO: 7136555 - DNA, 22 bp, Homo sapiens
gtccaggctgcccagggtcctg

SEQ ID NO: 7136556 - DNA, 22 bp, Homo sapiens
gtcctctgggcagctgccccac

SEQ ID NO: 7136557 - DNA, 22 bp, Homo sapiens
gtcctctgggcagctgccccac

SEQ ID NO: 7136558 - DNA, 22 bp, Homo sapiens
gtcctctgggagccttgagcct

SEQ ID NO: 7136559 - DNA, 22 bp, Homo sapiens
gtcctctgggagccttgagcct

SEQ ID NO: 7136560 - DNA, 22 bp, Homo sapiens
gtcctctgggagccttgagcct

SEQ ID NO: 7136561 - DNA, 22 bp, Homo sapiens
gtcctctggcctttcccaggac

SEQ ID NO: 7136562 - DNA, 22 bp, Homo sapiens
gtcctctggcctttcccaggac

SEQ ID NO: 7136563 - DNA, 22 bp, Homo sapiens
gtcagacaggaatgttgcaagt

SEQ ID NO: 7136564 - DNA, 22 bp, Homo sapiens
gtcagaaaccagtcaaacaaga

SEQ ID NO: 7136565 - DNA, 22 bp, Homo sapiens
gtcagaagcatttgtggctgaa

SEQ ID NO: 7136566 - DNA, 22 bp, Homo sapiens
gtcagaagcatttgtggctgaa

SEQ ID NO: 7136567 - DNA, 22 bp, Homo sapiens
gtcactttggcctctacagcca

SEQ ID NO: 7136568 - DNA, 17 bp, Homo sapiens
gtcactttgtttaaagg

SEQ ID NO: 7136569 - DNA, 17 bp, Homo sapiens
gtcactttgtttaaagg

SEQ ID NO: 7136570 - DNA, 22 bp, Homo sapiens
gtcacttttaagggccttttct

SEQ ID NO: 7136571 - DNA, 22 bp, Homo sapiens
gtcactgtttcctattatattt

SEQ ID NO: 7136572 - DNA, 22 bp, Homo sapiens
gtcacttaccagagtattttat

SEQ ID NO: 7136573 - DNA, 22 bp, Homo sapiens
gtcactttaaagggttaacagg

SEQ ID NO: 7136574 - DNA, 22 bp, Homo sapiens
gtcactttacactcctactaaa

SEQ ID NO: 7136575 - DNA, 22 bp, Homo sapiens
gtcactttattaattttggtga

SEQ ID NO: 7136576 - DNA, 22 bp, Homo sapiens
gtcactttattaattttggtga

SEQ ID NO: 7136577 - DNA, 22 bp, Homo sapiens
gtcactttcacactttattgct

SEQ ID NO: 7136578 - DNA, 22 bp, Homo sapiens
gtcactttcacactttattgct

SEQ ID NO: 7136579 - DNA, 22 bp, Homo sapiens
gtcactttctgtgagatgtagt

SEQ ID NO: 7136580 - DNA, 22 bp, Homo sapiens
gtcactttgaagctgtttttag

SEQ ID NO: 7136581 - DNA, 22 bp, Homo sapiens
gtcactttgaagctgtttttag

SEQ ID NO: 7136582 - DNA, 22 bp, Homo sapiens
gtcactggggccacatgcagaa

SEQ ID NO: 7136583 - DNA, 22 bp, Homo sapiens
gtcactgtatccaggttccagc

SEQ ID NO: 7136584 - DNA, 22 bp, Homo sapiens
gtcactgtatccaggttccagc

SEQ ID NO: 7136585 - DNA, 22 bp, Homo sapiens
gtcactgcctcttaactttttc

SEQ ID NO: 7136586 - DNA, 22 bp, Homo sapiens
gtcactggaattacaggcatgc

SEQ ID NO: 7136587 - DNA, 22 bp, Homo sapiens
gtcactggagctcttgcggttc

SEQ ID NO: 7136588 - DNA, 22 bp, Homo sapiens
gtcactggggccacatgcagaa

SEQ ID NO: 7136589 - DNA, 22 bp, Homo sapiens
gtcacccgtttgactatccacc

SEQ ID NO: 7136590 - DNA, 22 bp, Homo sapiens
gtcacctctcatcacatgctac

SEQ ID NO: 7136591 - DNA, 22 bp, Homo sapiens
gtcaccttgaacaggctactca

SEQ ID NO: 7136592 - DNA, 22 bp, Homo sapiens
gtcacgtgcgggtttactgaga

SEQ ID NO: 7136593 - DNA, 18 bp, Homo sapiens
gtcactagttcaaacttc

SEQ ID NO: 7136594 - DNA, 22 bp, Homo sapiens
gtcactatcctgtgttgtttgt

SEQ ID NO: 7136595 - DNA, 22 bp, Homo sapiens
gtcagaggaggctgagtaggaa

SEQ ID NO: 7136596 - DNA, 22 bp, Homo sapiens
gtcagaggaggctgagtaggaa

SEQ ID NO: 7136597 - DNA, 22 bp, Homo sapiens
gtccagaagctcaagttgaact

SEQ ID NO: 7136598 - DNA, 22 bp, Homo sapiens
gtccagaattactactgtttga

SEQ ID NO: 7136599 - DNA, 21 bp, Homo sapiens
gtccagagagccggctcctga

SEQ ID NO: 7136600 - DNA, 22 bp, Homo sapiens
gtccagctccagggaggcaggc

SEQ ID NO: 7136601 - DNA, 22 bp, Homo sapiens
gtccagctccagggaggcaggc

SEQ ID NO: 7136602 - DNA, 22 bp, Homo sapiens
gtccagctctcagatggctgca

SEQ ID NO: 7136603 - DNA, 22 bp, Homo sapiens
gtccagcctgaagagtgggggc

SEQ ID NO: 7136604 - DNA, 19 bp, Homo sapiens
gtccagcctttgggtctta

SEQ ID NO: 7136605 - DNA, 22 bp, Homo sapiens
gtccagctctcagatggctgca

SEQ ID NO: 7136606 - DNA, 22 bp, Homo sapiens
gtccagctctgagaagaaacat

SEQ ID NO: 7136607 - DNA, 22 bp, Homo sapiens
gtccagctgatcttgacccagc

SEQ ID NO: 7136608 - DNA, 22 bp, Homo sapiens
gtccagctgatcttgacccagc

SEQ ID NO: 7136609 - DNA, 22 bp, Homo sapiens
gtccagctgcagctgggcagaa

SEQ ID NO: 7136610 - DNA, 22 bp, Homo sapiens
gtccagctgcagctgggcagaa

SEQ ID NO: 7136611 - DNA, 22 bp, Homo sapiens
gtccagctgggccagggcactc

SEQ ID NO: 7136612 - DNA, 22 bp, Homo sapiens
gtccagccaggcctgtctctgg

SEQ ID NO: 7136613 - DNA, 22 bp, Homo sapiens
gtccagccctctgcctccaggt

SEQ ID NO: 7136614 - DNA, 22 bp, Homo sapiens
gtccagcccttgcagcttcttt

SEQ ID NO: 7136615 - DNA, 22 bp, Homo sapiens
ggtgacagcgggtcaagaggag

SEQ ID NO: 7136616 - DNA, 22 bp, Homo sapiens
ggtgagaggcagtgctgtggaa

SEQ ID NO: 7136617 - DNA, 22 bp, Homo sapiens
ggtgacagcgggtcaagaggag

SEQ ID NO: 7136618 - DNA, 22 bp, Homo sapiens
ggtgagcaaagcttcatctgta

SEQ ID NO: 7136619 - DNA, 22 bp, Homo sapiens
ggtgagaggcctgagagctgga

SEQ ID NO: 7136620 - DNA, 22 bp, Homo sapiens
ggtgagaggcctgagagctgga

SEQ ID NO: 7136621 - DNA, 22 bp, Homo sapiens
ggtgagaggcctgagagctgga

SEQ ID NO: 7136622 - DNA, 22 bp, Homo sapiens
ggtgagaggcctgagagctgga

SEQ ID NO: 7136623 - DNA, 22 bp, Homo sapiens
ggtgacacagggaccagagtct

SEQ ID NO: 7136624 - DNA, 21 bp, Homo sapiens
ggtgaatttctaggaagtggc

SEQ ID NO: 7136625 - DNA, 21 bp, Homo sapiens
ggtgacacgtggccccgctct

SEQ ID NO: 7136626 - DNA, 21 bp, Homo sapiens
ggtgacacgtggccccgctct

SEQ ID NO: 7136627 - DNA, 22 bp, Homo sapiens
ggtgacagccgcttgccctgta

SEQ ID NO: 7136628 - DNA, 22 bp, Homo sapiens
ggtgacagccgcttggcgctag

SEQ ID NO: 7136629 - DNA, 22 bp, Homo sapiens
ggtgagctggtctggggctgct

SEQ ID NO: 7136630 - DNA, 22 bp, Homo sapiens
ggtgagcgtggaaggagtggga

SEQ ID NO: 7136631 - DNA, 22 bp, Homo sapiens
ggtgagcttgctgctagaggct

SEQ ID NO: 7136632 - DNA, 22 bp, Homo sapiens
ggtgagccgaaaagggtcataa

SEQ ID NO: 7136633 - DNA, 22 bp, Homo sapiens
ggtgaggaaagatggtgacagt

SEQ ID NO: 7136634 - DNA, 22 bp, Homo sapiens
ggtgaggaaagatggtgacagt

SEQ ID NO: 7136635 - DNA, 22 bp, Homo sapiens
ggtgagcactgccctgggtctc

SEQ ID NO: 7136636 - DNA, 22 bp, Homo sapiens
ggtgagcagctgtctgtatgga

SEQ ID NO: 7136637 - DNA, 22 bp, Homo sapiens
ggtgagcagctgtctgtatgga

SEQ ID NO: 7136638 - DNA, 19 bp, Homo sapiens
ggtgagccctcgcctgcct

SEQ ID NO: 7136639 - DNA, 22 bp, Homo sapiens
ggtgaggaattggggactgacc

SEQ ID NO: 7136640 - DNA, 22 bp, Homo sapiens
ggtgaggaattggggactgacc

SEQ ID NO: 7136641 - DNA, 22 bp, Homo sapiens
ggtgaggaattggggactgacc

SEQ ID NO: 7136642 - DNA, 22 bp, Homo sapiens
ggtgaggaattggggactgacc

SEQ ID NO: 7136643 - DNA, 22 bp, Homo sapiens
ggtgaggcaggtggctgctgag

SEQ ID NO: 7136644 - DNA, 22 bp, Homo sapiens
ggtgaggcaggtggctgctgag

SEQ ID NO: 7136645 - DNA, 22 bp, Homo sapiens
ggtgaggaaagatggtgacagt

SEQ ID NO: 7136646 - DNA, 22 bp, Homo sapiens
ggtgaggaattggggactgacc

SEQ ID NO: 7136647 - DNA, 22 bp, Homo sapiens
ggtgaggaattggggactgacc

SEQ ID NO: 7136648 - DNA, 22 bp, Homo sapiens
ggtgaggaaagatggtgacagt

SEQ ID NO: 7136649 - DNA, 22 bp, Homo sapiens
ggtgagggacatcactcagcca

SEQ ID NO: 7136650 - DNA, 22 bp, Homo sapiens
ggtgagggacatcactcagcca

SEQ ID NO: 7136651 - DNA, 22 bp, Homo sapiens
ggtgaggctggcttgccttctt

SEQ ID NO: 7136652 - DNA, 22 bp, Homo sapiens
ggtgaggctggcttgccttctt

SEQ ID NO: 7136653 - DNA, 22 bp, Homo sapiens
ggtgaggcgtccccaccatggg

SEQ ID NO: 7136654 - DNA, 22 bp, Homo sapiens
ggtgaggcaggtggctgctgag

SEQ ID NO: 7136655 - DNA, 18 bp, Homo sapiens
ggtgaggcggcggccagc

SEQ ID NO: 7136656 - DNA, 18 bp, Homo sapiens
ggtgaggcggcggccagc

SEQ ID NO: 7136657 - DNA, 18 bp, Homo sapiens
ggtgagggagctggaagc

SEQ ID NO: 7136658 - DNA, 22 bp, Homo sapiens
ggtgagggagtggaacgaggtg

SEQ ID NO: 7136659 - DNA, 18 bp, Homo sapiens
ggtgagggagctggaagc

SEQ ID NO: 7136660 - DNA, 18 bp, Homo sapiens
ggtgagggagctggaagc

SEQ ID NO: 7136661 - DNA, 22 bp, Homo sapiens
ggtgagggacatcactcagcca

SEQ ID NO: 7136662 - DNA, 18 bp, Homo sapiens
ggtgagggagctggaagc

SEQ ID NO: 7136663 - DNA, 18 bp, Homo sapiens
ggtgagggagctggaagc

SEQ ID NO: 7136664 - DNA, 21 bp, Homo sapiens
ggtgctcgctgatgaggagtg

SEQ ID NO: 7136665 - DNA, 21 bp, Homo sapiens
ggtgctcctccatgctgctct

SEQ ID NO: 7136666 - DNA, 21 bp, Homo sapiens
ggtgctcctccatgctgctct

SEQ ID NO: 7136667 - DNA, 22 bp, Homo sapiens
ggtgagggagtggaacgaggtg

SEQ ID NO: 7136668 - DNA, 22 bp, Homo sapiens
ggtgagggagtggaacgaggtg

SEQ ID NO: 7136669 - DNA, 21 bp, Homo sapiens
ggtgctcgctgatgaggagtg

SEQ ID NO: 7136670 - DNA, 21 bp, Homo sapiens
ggtgctcgctgatgaggagtg

SEQ ID NO: 7136671 - DNA, 22 bp, Homo sapiens
ggtgctctggtcatggtggagt

SEQ ID NO: 7136672 - DNA, 22 bp, Homo sapiens
ggtgctctttctcagacaagat

SEQ ID NO: 7136673 - DNA, 22 bp, Homo sapiens
ggtggaagccttcagaacagca

SEQ ID NO: 7136674 - DNA, 22 bp, Homo sapiens
ggtggacagtgttagctctggg

SEQ ID NO: 7136675 - DNA, 22 bp, Homo sapiens
ggtggaaggcctggaaggaggc

SEQ ID NO: 7136676 - DNA, 22 bp, Homo sapiens
ggtggacaaatgaatgactgaa

SEQ ID NO: 7136677 - DNA, 22 bp, Homo sapiens
ggtggaaggcctggaaggaggc

SEQ ID NO: 7136678 - DNA, 22 bp, Homo sapiens
ggtggaagccttcagaacagca

SEQ ID NO: 7136679 - DNA, 22 bp, Homo sapiens
ggtggaagccttcagaacagca

SEQ ID NO: 7136680 - DNA, 22 bp, Homo sapiens
ggtggaaggcctggaaggaggc

SEQ ID NO: 7136681 - DNA, 22 bp, Homo sapiens
ggtggaaggcctggaaggaggc

SEQ ID NO: 7136682 - DNA, 22 bp, Homo sapiens
ggtaaaaatcacaaatacttta

SEQ ID NO: 7136683 - DNA, 17 bp, Homo sapiens
gggttttgggagcagct

SEQ ID NO: 7136684 - DNA, 22 bp, Homo sapiens
ggtaaaaatcacaaatacttta

SEQ ID NO: 7136685 - DNA, 22 bp, Homo sapiens
gggttttatggttcacttgcaa

SEQ ID NO: 7136686 - DNA, 22 bp, Homo sapiens
gggttgtgggatagagaaggag

SEQ ID NO: 7136687 - DNA, 22 bp, Homo sapiens
gggttggggcccagcagtctgc

SEQ ID NO: 7136688 - DNA, 22 bp, Homo sapiens
gggttggggcccagcagtctgc

SEQ ID NO: 7136689 - DNA, 22 bp, Homo sapiens
gggttggggcccagcagtctgc

SEQ ID NO: 7136690 - DNA, 22 bp, Homo sapiens
ggtcccagctggtcactgtcag

SEQ ID NO: 7136691 - DNA, 22 bp, Homo sapiens
ggtcccagctggtcactgtcag

SEQ ID NO: 7136692 - DNA, 22 bp, Homo sapiens
ggtcccagctggtcactgtcag

SEQ ID NO: 7136693 - DNA, 22 bp, Homo sapiens
ggtcccaggaagtgcggcggcg

SEQ ID NO: 7136694 - DNA, 22 bp, Homo sapiens
ggtcccaggaatctgtgttcta

SEQ ID NO: 7136695 - DNA, 22 bp, Homo sapiens
gggtgtgcaggtcatggcgtct

SEQ ID NO: 7136696 - DNA, 22 bp, Homo sapiens
gggtgtgcaggtcatggcgtct

SEQ ID NO: 7136697 - DNA, 22 bp, Homo sapiens
gggtggtgtattagagctgcag

SEQ ID NO: 7136698 - DNA, 22 bp, Homo sapiens
gggtggtgtattagagctgcag

SEQ ID NO: 7136699 - DNA, 18 bp, Homo sapiens
gggtggtgtgctcttcgc

SEQ ID NO: 7136700 - DNA, 18 bp, Homo sapiens
gggtggtgtgctcttcgc

SEQ ID NO: 7136701 - DNA, 22 bp, Homo sapiens
gggtgtagacacatgttcatct

SEQ ID NO: 7136702 - DNA, 22 bp, Homo sapiens
gggttggatcctggtggctgcc

SEQ ID NO: 7136703 - DNA, 22 bp, Homo sapiens
gggttggatcctggtggctgcc

SEQ ID NO: 7136704 - DNA, 22 bp, Homo sapiens
gggttggattacttagggagaa

SEQ ID NO: 7136705 - DNA, 22 bp, Homo sapiens
gggttggattacttagggagaa

SEQ ID NO: 7136706 - DNA, 22 bp, Homo sapiens
gggttggattacttagggagaa

SEQ ID NO: 7136707 - DNA, 22 bp, Homo sapiens
gggttggattacttagggagaa

SEQ ID NO: 7136708 - DNA, 22 bp, Homo sapiens
gggttggcagcaccagaggagg

SEQ ID NO: 7136709 - DNA, 22 bp, Homo sapiens
gggttggcatcagggttctgtg

SEQ ID NO: 7136710 - DNA, 22 bp, Homo sapiens
gggttgggactgtcatctggag

SEQ ID NO: 7136711 - DNA, 22 bp, Homo sapiens
gggttgggactgtcatctggag

SEQ ID NO: 7136712 - DNA, 22 bp, Homo sapiens
gggttggggcccagcagtctgc

SEQ ID NO: 7136713 - DNA, 22 bp, Homo sapiens
ggtccctgcctgaggctggcct

SEQ ID NO: 7136714 - DNA, 22 bp, Homo sapiens
ggtccctgcccacctgggagct

SEQ ID NO: 7136715 - DNA, 22 bp, Homo sapiens
ggtccctgaagatgcctgagga

SEQ ID NO: 7136716 - DNA, 23 bp, Homo sapiens
ggtccctgacagcgggcaagttg

SEQ ID NO: 7136717 - DNA, 22 bp, Homo sapiens
ggtccccgtggaggctggagcg

SEQ ID NO: 7136718 - DNA, 22 bp, Homo sapiens
ggtccccgtggaggctggagcg

SEQ ID NO: 7136719 - DNA, 22 bp, Homo sapiens
ggtccctgaagaggcctggggt

SEQ ID NO: 7136720 - DNA, 22 bp, Homo sapiens
ggtccctgaagatgcctgagga

SEQ ID NO: 7136721 - DNA, 22 bp, Homo sapiens
ggtccctgaagatgcctgagga

SEQ ID NO: 7136722 - DNA, 22 bp, Homo sapiens
ggtcccaggagaataggtgcaa

SEQ ID NO: 7136723 - DNA, 22 bp, Homo sapiens
ggtcccaggctgcgggctggtg

SEQ ID NO: 7136724 - DNA, 22 bp, Homo sapiens
ggtcccaggctgcgggctggtg

SEQ ID NO: 7136725 - DNA, 22 bp, Homo sapiens
ggtcccaggttgacagggagac

SEQ ID NO: 7136726 - DNA, 22 bp, Homo sapiens
ggtcccagttgcccaggtcagg

SEQ ID NO: 7136727 - DNA, 22 bp, Homo sapiens
ggtcccatgaaagagggaggcc

SEQ ID NO: 7136728 - DNA, 22 bp, Homo sapiens
ggtccccccatggtgagcactg

SEQ ID NO: 7136729 - DNA, 22 bp, Homo sapiens
ggtccccccatggtgagcactg

SEQ ID NO: 7136730 - DNA, 22 bp, Homo sapiens
ggtccccgtggaggctggagcg

SEQ ID NO: 7136731 - DNA, 22 bp, Homo sapiens
ggtccccgtggaggctggagcg

SEQ ID NO: 7136732 - DNA, 22 bp, Homo sapiens
ggttcagggatgtgggtgatgc

SEQ ID NO: 7136733 - DNA, 22 bp, Homo sapiens
ggttcactccgatctctgcctc

SEQ ID NO: 7136734 - DNA, 22 bp, Homo sapiens
ggttcactctcaagtctgccta

SEQ ID NO: 7136735 - DNA, 22 bp, Homo sapiens
ggttcactctcaagtctgccta

SEQ ID NO: 7136736 - DNA, 22 bp, Homo sapiens
ggttcagcagcagccacaattc

SEQ ID NO: 7136737 - DNA, 19 bp, Homo sapiens
ggttcagcctgtgttttat

SEQ ID NO: 7136738 - DNA, 22 bp, Homo sapiens
ggttccacctggcgaggggtat

SEQ ID NO: 7136739 - DNA, 22 bp, Homo sapiens
ggttccacctggcgaggggtat

SEQ ID NO: 7136740 - DNA, 22 bp, Homo sapiens
ggttcattctgaagtcttcagc

SEQ ID NO: 7136741 - DNA, 19 bp, Homo sapiens
ggttggagaagagcggccc

SEQ ID NO: 7136742 - DNA, 22 bp, Homo sapiens
ggttggaggtgggaatagctag

SEQ ID NO: 7136743 - DNA, 23 bp, Homo sapiens
ggttggctgtacccaggctccct

SEQ ID NO: 7136744 - DNA, 22 bp, Homo sapiens
ggttggggcgagctggaggccc

SEQ ID NO: 7136745 - DNA, 22 bp, Homo sapiens
ggttggggcgagctggaggccc

SEQ ID NO: 7136746 - DNA, 22 bp, Homo sapiens
ggttggggcgagctggaggccc

SEQ ID NO: 7136747 - DNA, 22 bp, Homo sapiens
ggttggggcgagctggaggccc

SEQ ID NO: 7136748 - DNA, 22 bp, Homo sapiens
ggttggggcgagctggaggccc

SEQ ID NO: 7136749 - DNA, 22 bp, Homo sapiens
ggttggtaactccctgtgcagt

SEQ ID NO: 7136750 - DNA, 22 bp, Homo sapiens
ggttggtgagtgcagggtgtta

SEQ ID NO: 7136751 - DNA, 22 bp, Homo sapiens
ggttggtgagtgcagggtgtta

SEQ ID NO: 7136752 - DNA, 22 bp, Homo sapiens
ggttggtgcccaggccatactg

SEQ ID NO: 7136753 - DNA, 22 bp, Homo sapiens
ggttggtgctgcatttgcctca

SEQ ID NO: 7136754 - DNA, 21 bp, Homo sapiens
ggttggtgtgtccagtggcca

SEQ ID NO: 7136755 - DNA, 21 bp, Homo sapiens
ggttggtgtgtccagtggcca

SEQ ID NO: 7136756 - DNA, 21 bp, Homo sapiens
ggttggtgtgtccagtggcca

SEQ ID NO: 7136757 - DNA, 22 bp, Homo sapiens
ggttgtagttggaggttgtata

SEQ ID NO: 7136758 - DNA, 22 bp, Homo sapiens
ggttgttgtgaaggtgaagaga

SEQ ID NO: 7136759 - DNA, 22 bp, Homo sapiens
ggtttaagacaggcttcacagt

SEQ ID NO: 7136760 - DNA, 17 bp, Homo sapiens
ggtttaatccttacctg

SEQ ID NO: 7136761 - DNA, 22 bp, Homo sapiens
ggtttaatggagatatttcaga

SEQ ID NO: 7136762 - DNA, 22 bp, Homo sapiens
ggtttaatgggtgaaggcatga

SEQ ID NO: 7136763 - DNA, 22 bp, Homo sapiens
gtaatgctacaggagtctacat

SEQ ID NO: 7136764 - DNA, 22 bp, Homo sapiens
gtaatgcttttgatacagggac

SEQ ID NO: 7136765 - DNA, 22 bp, Homo sapiens
gtaatgtactgcagccagatgt

SEQ ID NO: 7136766 - DNA, 22 bp, Homo sapiens
gtaatgtgtgtgtcttctctag

SEQ ID NO: 7136767 - DNA, 22 bp, Homo sapiens
gtaattctagagtttggacagc

SEQ ID NO: 7136768 - DNA, 22 bp, Homo sapiens
gtaattctgtgtgaatctatta

SEQ ID NO: 7136769 - DNA, 22 bp, Homo sapiens
gtaattgactcagctctgttca

SEQ ID NO: 7136770 - DNA, 22 bp, Homo sapiens
gtaattgtcttgaattcacaac

SEQ ID NO: 7136771 - DNA, 22 bp, Homo sapiens
gtaattgtgggcttagtagagt

SEQ ID NO: 7136772 - DNA, 22 bp, Homo sapiens
gtaatttaattctctgacttga

SEQ ID NO: 7136773 - DNA, 22 bp, Homo sapiens
gtaattttggagtataacctgg

SEQ ID NO: 7136774 - DNA, 22 bp, Homo sapiens
gtacaaaagttattgcggtttt

SEQ ID NO: 7136775 - DNA, 22 bp, Homo sapiens
gtacaaaagttattgcggtttt

SEQ ID NO: 7136776 - DNA, 22 bp, Homo sapiens
ggtgtttgcatggggccagttt

SEQ ID NO: 7136777 - DNA, 19 bp, Homo sapiens
ggtgtttcttcattttcca

SEQ ID NO: 7136778 - DNA, 22 bp, Homo sapiens
ggttaaaaataatttacttggc

SEQ ID NO: 7136779 - DNA, 17 bp, Homo sapiens
ggtgtttaagtgccagc

SEQ ID NO: 7136780 - DNA, 23 bp, Homo sapiens
ggtgtttaattacagactgagag

SEQ ID NO: 7136781 - DNA, 22 bp, Homo sapiens
ggtgtttagacagggcccctct

SEQ ID NO: 7136782 - DNA, 22 bp, Homo sapiens
ggtgtttagggaggggttataa

SEQ ID NO: 7136783 - DNA, 22 bp, Homo sapiens
ggttaaaactgatattatgggt

SEQ ID NO: 7136784 - DNA, 21 bp, Homo sapiens
ggttaaaagacacatctgttt

SEQ ID NO: 7136785 - DNA, 22 bp, Homo sapiens
ggttaaaatctaaaatgtgact

SEQ ID NO: 7136786 - DNA, 22 bp, Homo sapiens
ggttaaacactttggaagtggc

SEQ ID NO: 7136787 - DNA, 19 bp, Homo sapiens
ggttaatgttaggatactt

SEQ ID NO: 7136788 - DNA, 21 bp, Homo sapiens
ggttacaacagttaaacagag

SEQ ID NO: 7136789 - DNA, 22 bp, Homo sapiens
ggttacaaggatattcaggtaa

SEQ ID NO: 7136790 - DNA, 22 bp, Homo sapiens
ggttacaaggatattcaggtaa

SEQ ID NO: 7136791 - DNA, 22 bp, Homo sapiens
ggtggtggagccagctgggagt

SEQ ID NO: 7136792 - DNA, 22 bp, Homo sapiens
ggtggtggagccagctgggagt

SEQ ID NO: 7136793 - DNA, 22 bp, Homo sapiens
ggtggtggagccagctgggagt

SEQ ID NO: 7136794 - DNA, 22 bp, Homo sapiens
ggtggtggagccagctgggagt

SEQ ID NO: 7136795 - DNA, 22 bp, Homo sapiens
ggtggtggagccagctgggagt

SEQ ID NO: 7136796 - DNA, 22 bp, Homo sapiens
ggtggtggagccagctgggagt

SEQ ID NO: 7136797 - DNA, 22 bp, Homo sapiens
ggtggtctgcgcagcccagggt

SEQ ID NO: 7136798 - DNA, 22 bp, Homo sapiens
ggtggtgaagacaagtggaagt

SEQ ID NO: 7136799 - DNA, 22 bp, Homo sapiens
ggtggtgactgtcctagggatg

SEQ ID NO: 7136800 - DNA, 23 bp, Homo sapiens
ggtggtgctcatatctcaggcct

SEQ ID NO: 7136801 - DNA, 22 bp, Homo sapiens
ggttcactccgatctctgcctc

SEQ ID NO: 7136802 - DNA, 22 bp, Homo sapiens
ggttatttttgattctgtggat

SEQ ID NO: 7136803 - DNA, 22 bp, Homo sapiens
ggttattttggttgtctaaggc

SEQ ID NO: 7136804 - DNA, 22 bp, Homo sapiens
ggttattttggttgtctaaggc

SEQ ID NO: 7136805 - DNA, 23 bp, Homo sapiens
ggttatttgcatcctgtaattat

SEQ ID NO: 7136806 - DNA, 22 bp, Homo sapiens
ggttatttttgattctgtggat

SEQ ID NO: 7136807 - DNA, 23 bp, Homo sapiens
ggttatttgcatcctgtaattat

SEQ ID NO: 7136808 - DNA, 19 bp, Homo sapiens
ggttatttgagggttaaga

SEQ ID NO: 7136809 - DNA, 22 bp, Homo sapiens
ggttatttctgattatatgata

SEQ ID NO: 7136810 - DNA, 21 bp, Homo sapiens
ggttacaacagttaaacagag

SEQ ID NO: 7136811 - DNA, 16 bp, Homo sapiens
ggttaccataaccgcc

SEQ ID NO: 7136812 - DNA, 22 bp, Homo sapiens
ggttagagagctgagaaagttt

SEQ ID NO: 7136813 - DNA, 22 bp, Homo sapiens
ggttaggatcagatcctggagg

SEQ ID NO: 7136814 - DNA, 22 bp, Homo sapiens
ggtggcagagaggaggtagttt

SEQ ID NO: 7136815 - DNA, 22 bp, Homo sapiens
ggtggcagagaggaggtagttt

SEQ ID NO: 7136816 - DNA, 22 bp, Homo sapiens
ggtggcagagacataggacata

SEQ ID NO: 7136817 - DNA, 22 bp, Homo sapiens
ggtggcagagacataggacata

SEQ ID NO: 7136818 - DNA, 22 bp, Homo sapiens
ggtggcagagaggaggtagttt

SEQ ID NO: 7136819 - DNA, 22 bp, Homo sapiens
ggtggcagagaggaggtagttt

SEQ ID NO: 7136820 - DNA, 22 bp, Homo sapiens
ggtgggcaggcgaggcccaggt

SEQ ID NO: 7136821 - DNA, 22 bp, Homo sapiens
ggtgggcaggcgaggcccaggt

SEQ ID NO: 7136822 - DNA, 22 bp, Homo sapiens
ggtgggcaggcgaggcccaggt

SEQ ID NO: 7136823 - DNA, 22 bp, Homo sapiens
ggtgggcaggcgaggcccaggt

SEQ ID NO: 7136824 - DNA, 22 bp, Homo sapiens
ggtgggcaggtcactctgcctc

SEQ ID NO: 7136825 - DNA, 22 bp, Homo sapiens
ggtggcagaataattgaaggtc

SEQ ID NO: 7136826 - DNA, 19 bp, Homo sapiens
ggtggcagaacgtgggtcc

SEQ ID NO: 7136827 - DNA, 22 bp, Homo sapiens
ggtggcagaataattgaaggtc

SEQ ID NO: 7136828 - DNA, 19 bp, Homo sapiens
ggtggcagaacgtgggtcc

SEQ ID NO: 7136829 - DNA, 19 bp, Homo sapiens
ggtggcagaacgtgggtcc

SEQ ID NO: 7136830 - DNA, 19 bp, Homo sapiens
ggtggcagaacgtgggtcc

SEQ ID NO: 7136831 - DNA, 22 bp, Homo sapiens
ggtggcactcattatcaggtgc

SEQ ID NO: 7136832 - DNA, 22 bp, Homo sapiens
ggtggcaccttgatcttggact

SEQ ID NO: 7136833 - DNA, 22 bp, Homo sapiens
ggtggcactcattatcaggtgc

SEQ ID NO: 7136834 - DNA, 22 bp, Homo sapiens
ggtggagagctggatgagaggt

SEQ ID NO: 7136835 - DNA, 22 bp, Homo sapiens
ggtggacttctgtttttctctc

SEQ ID NO: 7136836 - DNA, 22 bp, Homo sapiens
ggtggactcaaaatgtgcttga

SEQ ID NO: 7136837 - DNA, 22 bp, Homo sapiens
ggtggactgtgttggagttgac

SEQ ID NO: 7136838 - DNA, 22 bp, Homo sapiens
ggtggactgtgttggagttgac

SEQ ID NO: 7136839 - DNA, 22 bp, Homo sapiens
ggtggagagctggatgagaggt

SEQ ID NO: 7136840 - DNA, 22 bp, Homo sapiens
ggtggagctggaccaggagagg

SEQ ID NO: 7136841 - DNA, 22 bp, Homo sapiens
ggtggagctggaccaggagagg

SEQ ID NO: 7136842 - DNA, 22 bp, Homo sapiens
ggtggagctggaccaggagagg

SEQ ID NO: 7136843 - DNA, 22 bp, Homo sapiens
ggtggagctggaccaggagagg

SEQ ID NO: 7136844 - DNA, 22 bp, Homo sapiens
ggtggagctgtgagtagaatct

SEQ ID NO: 7136845 - DNA, 22 bp, Homo sapiens
ggtggagctatacgggatggct

SEQ ID NO: 7136846 - DNA, 22 bp, Homo sapiens
ggtggagcgcagggtgctggcg

SEQ ID NO: 7136847 - DNA, 22 bp, Homo sapiens
ggtggagctatacgggatggct

SEQ ID NO: 7136848 - DNA, 22 bp, Homo sapiens
ggtggagctatacgggatggct

SEQ ID NO: 7136849 - DNA, 22 bp, Homo sapiens
ggtggagctatacgggatggct

SEQ ID NO: 7136850 - DNA, 22 bp, Homo sapiens
ggtggcaagggcagccagtaac

SEQ ID NO: 7136851 - DNA, 22 bp, Homo sapiens
ggtggcaccttaccctgcgcag

SEQ ID NO: 7136852 - DNA, 22 bp, Homo sapiens
ggtggatgctgactgttctgct

SEQ ID NO: 7136853 - DNA, 22 bp, Homo sapiens
ggtggatggactctcgggggcc

SEQ ID NO: 7136854 - DNA, 22 bp, Homo sapiens
ggtggggccctggcactggtat

SEQ ID NO: 7136855 - DNA, 22 bp, Homo sapiens
ggtggggccctggcactggtat

SEQ ID NO: 7136856 - DNA, 22 bp, Homo sapiens
ggtggggccctggcactggtat

SEQ ID NO: 7136857 - DNA, 22 bp, Homo sapiens
ggtggggcctgctccagcggcc

SEQ ID NO: 7136858 - DNA, 22 bp, Homo sapiens
ggtggggcctgctccagcggcc

SEQ ID NO: 7136859 - DNA, 22 bp, Homo sapiens
ggtggggccctggcactggtat

SEQ ID NO: 7136860 - DNA, 22 bp, Homo sapiens
ggtggggcctgctccagcggcc

SEQ ID NO: 7136861 - DNA, 22 bp, Homo sapiens
ggtggggcctgctccagcggcc

SEQ ID NO: 7136862 - DNA, 22 bp, Homo sapiens
ggtggggcctgctccagcggcc

SEQ ID NO: 7136863 - DNA, 22 bp, Homo sapiens
ggtggggcctgctccagcggcc

SEQ ID NO: 7136864 - DNA, 22 bp, Homo sapiens
ggtggggcctgctccagcggcc

SEQ ID NO: 7136865 - DNA, 22 bp, Homo sapiens
ggtggggcctgctccagcggcc

SEQ ID NO: 7136866 - DNA, 22 bp, Homo sapiens
ggtggggcctgctccagcggcc

SEQ ID NO: 7136867 - DNA, 22 bp, Homo sapiens
ggtggggctaggacctcaggat

SEQ ID NO: 7136868 - DNA, 22 bp, Homo sapiens
ggtggggctaggacctcaggat

SEQ ID NO: 7136869 - DNA, 22 bp, Homo sapiens
ggtggggctaggacctcaggat

SEQ ID NO: 7136870 - DNA, 19 bp, Homo sapiens
ggtgggtgacctccccacc

SEQ ID NO: 7136871 - DNA, 19 bp, Homo sapiens
ggtgggtgacctccccacc

SEQ ID NO: 7136872 - DNA, 22 bp, Homo sapiens
ggtgggtgagccctgggagctg

SEQ ID NO: 7136873 - DNA, 22 bp, Homo sapiens
ggtgggtgagccctgggagctg

SEQ ID NO: 7136874 - DNA, 22 bp, Homo sapiens
ggtgggtgagccctgggagctg

SEQ ID NO: 7136875 - DNA, 22 bp, Homo sapiens
ggtgggtgagccctgggagctg

SEQ ID NO: 7136876 - DNA, 22 bp, Homo sapiens
ggtgggtggaaacagcatgtac

SEQ ID NO: 7136877 - DNA, 22 bp, Homo sapiens
ggtgggtgcagggggcttctta

SEQ ID NO: 7136878 - DNA, 22 bp, Homo sapiens
ggtgggtggaaacagcatgtac

SEQ ID NO: 7136879 - DNA, 22 bp, Homo sapiens
ggtgggtgagccctgggagctg

SEQ ID NO: 7136880 - DNA, 22 bp, Homo sapiens
ggtgggtgcagggggcttctta

SEQ ID NO: 7136881 - DNA, 22 bp, Homo sapiens
ggtgggcgactgagaggggttt

SEQ ID NO: 7136882 - DNA, 22 bp, Homo sapiens
ggtggggagtcaggcattcttg

SEQ ID NO: 7136883 - DNA, 22 bp, Homo sapiens
ggtggggagtcaggcattcttg

SEQ ID NO: 7136884 - DNA, 22 bp, Homo sapiens
ggtggggagtcaggcattcttg

SEQ ID NO: 7136885 - DNA, 22 bp, Homo sapiens
ggtggggattcctgatcactgt

SEQ ID NO: 7136886 - DNA, 22 bp, Homo sapiens
ggtggggattcctgatcactgt

SEQ ID NO: 7136887 - DNA, 22 bp, Homo sapiens
ggtgggcaggtcactctgcctc

SEQ ID NO: 7136888 - DNA, 22 bp, Homo sapiens
ggtgggcaggtcactctgcctc

SEQ ID NO: 7136889 - DNA, 22 bp, Homo sapiens
ggtgggcaggtcactctgcctc

SEQ ID NO: 7136890 - DNA, 22 bp, Homo sapiens
ggtgggccacggcataacgggc

SEQ ID NO: 7136891 - DNA, 22 bp, Homo sapiens
ggtgggccaggaaggccgccag

SEQ ID NO: 7136892 - DNA, 22 bp, Homo sapiens
ggtgggccaggaaggccgccag

SEQ ID NO: 7136893 - DNA, 22 bp, Homo sapiens
ggtggggattcctgatcactgt

SEQ ID NO: 7136894 - DNA, 22 bp, Homo sapiens
ggtggggattcctgatcactgt

SEQ ID NO: 7136895 - DNA, 22 bp, Homo sapiens
ggtggggattcctgatcactgt

SEQ ID NO: 7136896 - DNA, 22 bp, Homo sapiens
ggtggggccagggctccaacct

SEQ ID NO: 7136897 - DNA, 22 bp, Homo sapiens
ggtggggccagggctccaacct

SEQ ID NO: 7136898 - DNA, 22 bp, Homo sapiens
ggtggggccagggctccaacct

SEQ ID NO: 7136899 - DNA, 22 bp, Homo sapiens
ggtggggcccaggcatctgatg

SEQ ID NO: 7136900 - DNA, 22 bp, Homo sapiens
ggtggggcccaggcatctgatg

SEQ ID NO: 7136901 - DNA, 22 bp, Homo sapiens
ggtggggcccaggcatctgatg

SEQ ID NO: 7136902 - DNA, 22 bp, Homo sapiens
ggtggggcccaggcatctgatg

SEQ ID NO: 7136903 - DNA, 22 bp, Homo sapiens
ggtggggccctggcactggtat

SEQ ID NO: 7136904 - DNA, 22 bp, Homo sapiens
ggtggggccctggcactggtat

SEQ ID NO: 7136905 - DNA, 21 bp, Homo sapiens
gggtggtctgctgaagaggga

SEQ ID NO: 7136906 - DNA, 22 bp, Homo sapiens
gggtggtcatctgaaggtctgg

SEQ ID NO: 7136907 - DNA, 21 bp, Homo sapiens
gggtggtctagctcaggaact

SEQ ID NO: 7136908 - DNA, 22 bp, Homo sapiens
gggtggtctggcaggctggaaa

SEQ ID NO: 7136909 - DNA, 22 bp, Homo sapiens
gggtggtctggcaggctggaaa

SEQ ID NO: 7136910 - DNA, 22 bp, Homo sapiens
gggtggtctggcaggctggaaa

SEQ ID NO: 7136911 - DNA, 22 bp, Homo sapiens
gggtggtctggcaggctggaaa

SEQ ID NO: 7136912 - DNA, 16 bp, Homo sapiens
gggtggtcttggagac

SEQ ID NO: 7136913 - DNA, 22 bp, Homo sapiens
gggtggtgagatgtagctgatg

SEQ ID NO: 7136914 - DNA, 22 bp, Homo sapiens
gggtggtgagatgtagctgatg

SEQ ID NO: 7136915 - DNA, 22 bp, Homo sapiens
gggtggtggccagcagtgggca

SEQ ID NO: 7136916 - DNA, 22 bp, Homo sapiens
gggtggtggccagcagtgggca

SEQ ID NO: 7136917 - DNA, 22 bp, Homo sapiens
gggtggtggccagcagtgggca

SEQ ID NO: 7136918 - DNA, 22 bp, Homo sapiens
gggtggtggccagcagtgggca

SEQ ID NO: 7136919 - DNA, 22 bp, Homo sapiens
gggtggtggccagcagtgggca

SEQ ID NO: 7136920 - DNA, 22 bp, Homo sapiens
gggtggtggccagcagtgggca

SEQ ID NO: 7136921 - DNA, 22 bp, Homo sapiens
gggtggtggcggaggctccagg

SEQ ID NO: 7136922 - DNA, 22 bp, Homo sapiens
gggtggtggcggaggctccagg

SEQ ID NO: 7136923 - DNA, 22 bp, Homo sapiens
gggtggtggcggaggctccagg

SEQ ID NO: 7136924 - DNA, 22 bp, Homo sapiens
gggtggtggcggaggctccagg

SEQ ID NO: 7136925 - DNA, 22 bp, Homo sapiens
gggtggtgggcacagaatctgg

SEQ ID NO: 7136926 - DNA, 22 bp, Homo sapiens
gggtggtgggcacagaatctgg

SEQ ID NO: 7136927 - DNA, 22 bp, Homo sapiens
gggtggtgtattagagctgcag

SEQ ID NO: 7136928 - DNA, 22 bp, Homo sapiens
gggtggtgtattagagctgcag

SEQ ID NO: 7136929 - DNA, 22 bp, Homo sapiens
gggtggtgtattagagctgcag

SEQ ID NO: 7136930 - DNA, 22 bp, Homo sapiens
gggtggtgtattagagctgcag

SEQ ID NO: 7136931 - DNA, 22 bp, Homo sapiens
gggtggagaggctaagtccagt

SEQ ID NO: 7136932 - DNA, 22 bp, Homo sapiens
gggtggagaggctaagtccagt

SEQ ID NO: 7136933 - DNA, 22 bp, Homo sapiens
gggtggagaggctaagtccagt

SEQ ID NO: 7136934 - DNA, 22 bp, Homo sapiens
gggtggagaggctaagtccagt

SEQ ID NO: 7136935 - DNA, 22 bp, Homo sapiens
gggtggagccagttgactctgt

SEQ ID NO: 7136936 - DNA, 22 bp, Homo sapiens
gggtggagccagttgactctgt

SEQ ID NO: 7136937 - DNA, 22 bp, Homo sapiens
gggtggagccagttgactctgt

SEQ ID NO: 7136938 - DNA, 22 bp, Homo sapiens
gggtggagaggctaagtccagt

SEQ ID NO: 7136939 - DNA, 22 bp, Homo sapiens
gggtggagagaaagaaacgtga

SEQ ID NO: 7136940 - DNA, 22 bp, Homo sapiens
gggtggagagaaagaaacgtga

SEQ ID NO: 7136941 - DNA, 22 bp, Homo sapiens
gggtggagagaaagaaacgtga

SEQ ID NO: 7136942 - DNA, 21 bp, Homo sapiens
gggtggggttccagccttttc

SEQ ID NO: 7136943 - DNA, 21 bp, Homo sapiens
gggtggggttccagccttttc

SEQ ID NO: 7136944 - DNA, 21 bp, Homo sapiens
gggtggggttccagccttttc

SEQ ID NO: 7136945 - DNA, 21 bp, Homo sapiens
gggtgggtggaattaggagtg

SEQ ID NO: 7136946 - DNA, 21 bp, Homo sapiens
gggtgggtggaattaggagtg

SEQ ID NO: 7136947 - DNA, 21 bp, Homo sapiens
gggtggggttccagccttttc

SEQ ID NO: 7136948 - DNA, 21 bp, Homo sapiens
gggtggggttccagccttttc

SEQ ID NO: 7136949 - DNA, 21 bp, Homo sapiens
gggtggggttccagccttttc

SEQ ID NO: 7136950 - DNA, 21 bp, Homo sapiens
gggtggggttccagccttttc

SEQ ID NO: 7136951 - DNA, 21 bp, Homo sapiens
gggtgggtggaattaggagtg

SEQ ID NO: 7136952 - DNA, 22 bp, Homo sapiens
gggtgggtggcagcaccgaggc

SEQ ID NO: 7136953 - DNA, 22 bp, Homo sapiens
gggtgggtggcagcaccgaggc

SEQ ID NO: 7136954 - DNA, 22 bp, Homo sapiens
gggtgggtggtccgcagacata

SEQ ID NO: 7136955 - DNA, 22 bp, Homo sapiens
gggtgggtggtccgcagacata

SEQ ID NO: 7136956 - DNA, 22 bp, Homo sapiens
gggtgcagagcttaactgtagg

SEQ ID NO: 7136957 - DNA, 22 bp, Homo sapiens
gggtgagggatgagccttcttc

SEQ ID NO: 7136958 - DNA, 22 bp, Homo sapiens
gggtgaggccttgctgccatca

SEQ ID NO: 7136959 - DNA, 22 bp, Homo sapiens
gggtgagggatgagccttcttc

SEQ ID NO: 7136960 - DNA, 22 bp, Homo sapiens
gggtgaggcccatttgaggcca

SEQ ID NO: 7136961 - DNA, 22 bp, Homo sapiens
gggtgaggccttgctgccatca

SEQ ID NO: 7136962 - DNA, 22 bp, Homo sapiens
gggtgaggcccatttgaggcca

SEQ ID NO: 7136963 - DNA, 20 bp, Homo sapiens
gggtgaggatggagaatttg

SEQ ID NO: 7136964 - DNA, 20 bp, Homo sapiens
gggtgaggatggagaatttg

SEQ ID NO: 7136965 - DNA, 22 bp, Homo sapiens
gggtgaggagctgccagtcatg

SEQ ID NO: 7136966 - DNA, 22 bp, Homo sapiens
gggtgaggagctgccagtcatg

SEQ ID NO: 7136967 - DNA, 22 bp, Homo sapiens
gggtgaggagctgccagtcatg

SEQ ID NO: 7136968 - DNA, 22 bp, Homo sapiens
gggtgaggagctgccagtcatg

SEQ ID NO: 7136969 - DNA, 21 bp, Homo sapiens
gggtgctgtggtcatgcagga

SEQ ID NO: 7136970 - DNA, 22 bp, Homo sapiens
gggtggaaagtatttggggacc

SEQ ID NO: 7136971 - DNA, 22 bp, Homo sapiens
gggtgcaggcagcccaggcagg

SEQ ID NO: 7136972 - DNA, 23 bp, Homo sapiens
gggtgctgcctgtagtcatgctg

SEQ ID NO: 7136973 - DNA, 18 bp, Homo sapiens
gggtgctggggccccttg

SEQ ID NO: 7136974 - DNA, 21 bp, Homo sapiens
gggtgctgtggtcatgcagga

SEQ ID NO: 7136975 - DNA, 21 bp, Homo sapiens
gggtgctgtggtcatgcagga

SEQ ID NO: 7136976 - DNA, 18 bp, Homo sapiens
gggtgcaggcactgactg

SEQ ID NO: 7136977 - DNA, 22 bp, Homo sapiens
gggtgcagcagagctcctctgt

SEQ ID NO: 7136978 - DNA, 22 bp, Homo sapiens
gggtgcagcagagctcctctgt

SEQ ID NO: 7136979 - DNA, 18 bp, Homo sapiens
gggtgcaggcactgactg

SEQ ID NO: 7136980 - DNA, 22 bp, Homo sapiens
gggtgcaggcagcccaggcagg

SEQ ID NO: 7136981 - DNA, 22 bp, Homo sapiens
gggtgcaggcagcccaggcagg

SEQ ID NO: 7136982 - DNA, 18 bp, Homo sapiens
gggtgcaggcactgactg

SEQ ID NO: 7136983 - DNA, 22 bp, Homo sapiens
ggggcccttgtggctgcaggcc

SEQ ID NO: 7136984 - DNA, 22 bp, Homo sapiens
ggggcccgggcactggccgtca

SEQ ID NO: 7136985 - DNA, 19 bp, Homo sapiens
ggggcccggggtctgcgag

SEQ ID NO: 7136986 - DNA, 22 bp, Homo sapiens
ggggcccttgtggctgcaggcc

SEQ ID NO: 7136987 - DNA, 22 bp, Homo sapiens
ggggcccttgtggctgcaggcc

SEQ ID NO: 7136988 - DNA, 22 bp, Homo sapiens
ggggcccagggcagcagtgcag

SEQ ID NO: 7136989 - DNA, 22 bp, Homo sapiens
ggggcccctcggacacgtgcgg

SEQ ID NO: 7136990 - DNA, 22 bp, Homo sapiens
ggggcccagggcagcagtgcag

SEQ ID NO: 7136991 - DNA, 22 bp, Homo sapiens
ggggcccagcacccctcctcgc

SEQ ID NO: 7136992 - DNA, 22 bp, Homo sapiens
ggggcccagcacccctcctcgc

SEQ ID NO: 7136993 - DNA, 22 bp, Homo sapiens
ggggcccagggcagcagtgcag

SEQ ID NO: 7136994 - DNA, 22 bp, Homo sapiens
ggggcccagggcagcagtgcag

SEQ ID NO: 7136995 - DNA, 22 bp, Homo sapiens
ggggcccagggcagcagtgcag

SEQ ID NO: 7136996 - DNA, 22 bp, Homo sapiens
ggggtagggcgattgctgcttt

SEQ ID NO: 7136997 - DNA, 22 bp, Homo sapiens
ggggtagggcgattgctgcttt

SEQ ID NO: 7136998 - DNA, 22 bp, Homo sapiens
ggggtagggtgattgtgaagta

SEQ ID NO: 7136999 - DNA, 22 bp, Homo sapiens
ggggtgagtgctcagccccgga

SEQ ID NO: 7137000 - DNA, 22 bp, Homo sapiens
ggggtagggcgattgctgcttt

SEQ ID NO: 7137001 - DNA, 22 bp, Homo sapiens
ggggcccttgtggctgcaggcc

SEQ ID NO: 7137002 - DNA, 22 bp, Homo sapiens
ggggcccttgtggctgcaggcc

SEQ ID NO: 7137003 - DNA, 22 bp, Homo sapiens
ggggccagtaggagtgatgtac

SEQ ID NO: 7137004 - DNA, 22 bp, Homo sapiens
ggggccagtaggagtgatgtac

SEQ ID NO: 7137005 - DNA, 22 bp, Homo sapiens
ggggccagtaggagtgatgtac

SEQ ID NO: 7137006 - DNA, 20 bp, Homo sapiens
ggggcccaagccctcttgcc

SEQ ID NO: 7137007 - DNA, 20 bp, Homo sapiens
ggggcccaagccctcttgcc

SEQ ID NO: 7137008 - DNA, 20 bp, Homo sapiens
ggggcccaagccctcttgcc

SEQ ID NO: 7137009 - DNA, 22 bp, Homo sapiens
ggggcccagcacccctcctcgc

SEQ ID NO: 7137010 - DNA, 22 bp, Homo sapiens
ggggcccagcacccctcctcgc

SEQ ID NO: 7137011 - DNA, 22 bp, Homo sapiens
ggggccaggtccagcttccaaa

SEQ ID NO: 7137012 - DNA, 22 bp, Homo sapiens
ggggccagcttcgcgtgctctt

SEQ ID NO: 7137013 - DNA, 22 bp, Homo sapiens
ggggccaggtccagcttccaaa

SEQ ID NO: 7137014 - DNA, 22 bp, Homo sapiens
ggggccaggtccagcttccaaa

SEQ ID NO: 7137015 - DNA, 22 bp, Homo sapiens
ggggccaggtccagcttccaaa

SEQ ID NO: 7137016 - DNA, 22 bp, Homo sapiens
ggggccagcttcgcgtgctctt

SEQ ID NO: 7137017 - DNA, 22 bp, Homo sapiens
ggggccagcaatgttgaggaat

SEQ ID NO: 7137018 - DNA, 22 bp, Homo sapiens
ggggccagcactgtgcctttgt

SEQ ID NO: 7137019 - DNA, 22 bp, Homo sapiens
ggggccagcttcgcgtgctctt

SEQ ID NO: 7137020 - DNA, 22 bp, Homo sapiens
ggggccagcaatgttgaggaat

SEQ ID NO: 7137021 - DNA, 22 bp, Homo sapiens
ggggccagatatcactaaggtt

SEQ ID NO: 7137022 - DNA, 22 bp, Homo sapiens
ggggccagatatcactaaggtt

SEQ ID NO: 7137023 - DNA, 22 bp, Homo sapiens
ggggccagatatcactaaggtt

SEQ ID NO: 7137024 - DNA, 22 bp, Homo sapiens
ggggccagatatcactaaggtt

SEQ ID NO: 7137025 - DNA, 22 bp, Homo sapiens
ggggccagcaatgttgaggaat

SEQ ID NO: 7137026 - DNA, 22 bp, Homo sapiens
ggggtggagctaaatgtctact

SEQ ID NO: 7137027 - DNA, 22 bp, Homo sapiens
ggggtggagatggtggcccttt

SEQ ID NO: 7137028 - DNA, 22 bp, Homo sapiens
ggggtggagatggtggcccttt

SEQ ID NO: 7137029 - DNA, 22 bp, Homo sapiens
ggggtgctgaagatgtcatggt

SEQ ID NO: 7137030 - DNA, 22 bp, Homo sapiens
ggggtgagttagcgtcggcttg

SEQ ID NO: 7137031 - DNA, 19 bp, Homo sapiens
ggggtgctagggagggatc

SEQ ID NO: 7137032 - DNA, 19 bp, Homo sapiens
ggggtgctagggagggatc

SEQ ID NO: 7137033 - DNA, 19 bp, Homo sapiens
ggggtgctagggagggatc

SEQ ID NO: 7137034 - DNA, 22 bp, Homo sapiens
ggggtggattcctacaggtcca

SEQ ID NO: 7137035 - DNA, 22 bp, Homo sapiens
ggggtggattcctacaggtcca

SEQ ID NO: 7137036 - DNA, 22 bp, Homo sapiens
ggggtggattcctacaggtcca

SEQ ID NO: 7137037 - DNA, 22 bp, Homo sapiens
ggggtggattcctacaggtcca

SEQ ID NO: 7137038 - DNA, 22 bp, Homo sapiens
ggggtggagctaaatgtctact

SEQ ID NO: 7137039 - DNA, 22 bp, Homo sapiens
ggggtggatcaggcaggcccag

SEQ ID NO: 7137040 - DNA, 22 bp, Homo sapiens
ggggtggattcctacaggtcca

SEQ ID NO: 7137041 - DNA, 22 bp, Homo sapiens
ggggtggatttcaggcggtgtc

SEQ ID NO: 7137042 - DNA, 22 bp, Homo sapiens
ggggtggatttcaggcggtgtc

SEQ ID NO: 7137043 - DNA, 22 bp, Homo sapiens
ggggtggccaaggactctgacc

SEQ ID NO: 7137044 - DNA, 22 bp, Homo sapiens
ggggtggccaaggactctgacc

SEQ ID NO: 7137045 - DNA, 19 bp, Homo sapiens
ggggtggctggggctccag

SEQ ID NO: 7137046 - DNA, 19 bp, Homo sapiens
ggggtggctggggctccag

SEQ ID NO: 7137047 - DNA, 22 bp, Homo sapiens
ggggtggctggcacctcctggt

SEQ ID NO: 7137048 - DNA, 22 bp, Homo sapiens
ggggtggctggcacctcctggt

SEQ ID NO: 7137049 - DNA, 22 bp, Homo sapiens
ggggtggctggcacctcctggt

SEQ ID NO: 7137050 - DNA, 22 bp, Homo sapiens
ggggtggctggcacctcctggt

SEQ ID NO: 7137051 - DNA, 19 bp, Homo sapiens
ggggtggctggggctccag

SEQ ID NO: 7137052 - DNA, 22 bp, Homo sapiens
ggggtggccctaccctctggaa

SEQ ID NO: 7137053 - DNA, 22 bp, Homo sapiens
ggggtggccctaccctctggaa

SEQ ID NO: 7137054 - DNA, 22 bp, Homo sapiens
ggggtggcctgtaggcagcatg

SEQ ID NO: 7137055 - DNA, 22 bp, Homo sapiens
ggggtggcctgtaggcagcatg

SEQ ID NO: 7137056 - DNA, 22 bp, Homo sapiens
ggggtggcctgtaggcagcatg

SEQ ID NO: 7137057 - DNA, 22 bp, Homo sapiens
ggggtggcctgtaggcagcatg

SEQ ID NO: 7137058 - DNA, 22 bp, Homo sapiens
ggggtggcctgtaggcagcatg

SEQ ID NO: 7137059 - DNA, 22 bp, Homo sapiens
ggggtgggagtgccatccttga

SEQ ID NO: 7137060 - DNA, 22 bp, Homo sapiens
ggggtgggagtgccatccttga

SEQ ID NO: 7137061 - DNA, 22 bp, Homo sapiens
ggggtgggagtgccatccttga

SEQ ID NO: 7137062 - DNA, 22 bp, Homo sapiens
ggggtgggcgtgcagggacacc

SEQ ID NO: 7137063 - DNA, 22 bp, Homo sapiens
ggggtgggagtgccatccttga

SEQ ID NO: 7137064 - DNA, 22 bp, Homo sapiens
ggggtgggagtgccatccttga

SEQ ID NO: 7137065 - DNA, 22 bp, Homo sapiens
ggggtgggagtgccatccttga

SEQ ID NO: 7137066 - DNA, 22 bp, Homo sapiens
ggggtgggagtgccatccttga

SEQ ID NO: 7137067 - DNA, 19 bp, Homo sapiens
ggggtggctggggctccag

SEQ ID NO: 7137068 - DNA, 19 bp, Homo sapiens
ggggtggctggggctccag

SEQ ID NO: 7137069 - DNA, 22 bp, Homo sapiens
ggggtgggagtgccatccttga

SEQ ID NO: 7137070 - DNA, 22 bp, Homo sapiens
ggggtgggagtgccatccttga

SEQ ID NO: 7137071 - DNA, 22 bp, Homo sapiens
ggggtgggagtgccatccttga

SEQ ID NO: 7137072 - DNA, 22 bp, Homo sapiens
ggggtgggagtgccatccttga

SEQ ID NO: 7137073 - DNA, 22 bp, Homo sapiens
ggggagaattacatggcgtgga

SEQ ID NO: 7137074 - DNA, 22 bp, Homo sapiens
ggggagaattacatggcgtgga

SEQ ID NO: 7137075 - DNA, 22 bp, Homo sapiens
ggggagaataaatcagatttta

SEQ ID NO: 7137076 - DNA, 22 bp, Homo sapiens
ggggagaattaccaaaagcgct

SEQ ID NO: 7137077 - DNA, 22 bp, Homo sapiens
ggggagaattacatggcgtgga

SEQ ID NO: 7137078 - DNA, 22 bp, Homo sapiens
ggggagaattaccaaaagcgct

SEQ ID NO: 7137079 - DNA, 22 bp, Homo sapiens
ggggagaattaccaaaagcgct

SEQ ID NO: 7137080 - DNA, 22 bp, Homo sapiens
ggggagaccatctgaaggtgat

SEQ ID NO: 7137081 - DNA, 22 bp, Homo sapiens
gggcttctgtacctacctggaa

SEQ ID NO: 7137082 - DNA, 19 bp, Homo sapiens
ggggagaactagagacagc

SEQ ID NO: 7137083 - DNA, 22 bp, Homo sapiens
ggggagaataaatcagatttta

SEQ ID NO: 7137084 - DNA, 22 bp, Homo sapiens
ggggaggaagctggaacacggg

SEQ ID NO: 7137085 - DNA, 22 bp, Homo sapiens
ggggaggaagctggaacacggg

SEQ ID NO: 7137086 - DNA, 22 bp, Homo sapiens
ggggaggaagctggaacacggg

SEQ ID NO: 7137087 - DNA, 22 bp, Homo sapiens
ggggaggaagctggaacacggg

SEQ ID NO: 7137088 - DNA, 22 bp, Homo sapiens
ggggaggaagctggaacacggg

SEQ ID NO: 7137089 - DNA, 22 bp, Homo sapiens
ggggaggaagctctcagttcca

SEQ ID NO: 7137090 - DNA, 22 bp, Homo sapiens
ggggaggaagctggaacacggg

SEQ ID NO: 7137091 - DNA, 22 bp, Homo sapiens
ggggaggaagctggaacacggg

SEQ ID NO: 7137092 - DNA, 22 bp, Homo sapiens
ggggaggacctttccaaggctt

SEQ ID NO: 7137093 - DNA, 22 bp, Homo sapiens
ggggaggacctttccaaggctt

SEQ ID NO: 7137094 - DNA, 22 bp, Homo sapiens
ggggaggacctttccaaggctt

SEQ ID NO: 7137095 - DNA, 22 bp, Homo sapiens
ggggaggaagctggaacacggg

SEQ ID NO: 7137096 - DNA, 22 bp, Homo sapiens
ggggaggaagctggaacacggg

SEQ ID NO: 7137097 - DNA, 22 bp, Homo sapiens
ggggaggaagctggaacacggg

SEQ ID NO: 7137098 - DNA, 22 bp, Homo sapiens
ggggaggaagctggaacacggg

SEQ ID NO: 7137099 - DNA, 22 bp, Homo sapiens
ggggaggcaagatgaagtgagg

SEQ ID NO: 7137100 - DNA, 22 bp, Homo sapiens
ggggaggcaagatgaagtgagg

SEQ ID NO: 7137101 - DNA, 22 bp, Homo sapiens
ggggaggcaagatgaagtgagg

SEQ ID NO: 7137102 - DNA, 22 bp, Homo sapiens
ggggaggcaagatgaagtgagg

SEQ ID NO: 7137103 - DNA, 22 bp, Homo sapiens
ggggaggccagtggaccgtccc

SEQ ID NO: 7137104 - DNA, 22 bp, Homo sapiens
ggggaggccagtggaccgtccc

SEQ ID NO: 7137105 - DNA, 22 bp, Homo sapiens
ggggaggccagtggaccgtccc

SEQ ID NO: 7137106 - DNA, 22 bp, Homo sapiens
ggggaggccagtggaccgtccc

SEQ ID NO: 7137107 - DNA, 22 bp, Homo sapiens
ggggaggctgatgtgggcaaag

SEQ ID NO: 7137108 - DNA, 22 bp, Homo sapiens
ggggaggctgatgtgggcaaag

SEQ ID NO: 7137109 - DNA, 22 bp, Homo sapiens
ggggaggctgatgtgggcaaag

SEQ ID NO: 7137110 - DNA, 22 bp, Homo sapiens
ggggaggctgatgtgggcaaag

SEQ ID NO: 7137111 - DNA, 22 bp, Homo sapiens
ggggaggacctttccaaggctt

SEQ ID NO: 7137112 - DNA, 22 bp, Homo sapiens
ggggaggacctttccaaggctt

SEQ ID NO: 7137113 - DNA, 22 bp, Homo sapiens
ggggaggacctttccaaggctt

SEQ ID NO: 7137114 - DNA, 22 bp, Homo sapiens
ggggaggagccatgtaactagt

SEQ ID NO: 7137115 - DNA, 22 bp, Homo sapiens
ggggaggagccatgtaactagt

SEQ ID NO: 7137116 - DNA, 22 bp, Homo sapiens
ggggaggagccatgtaactagt

SEQ ID NO: 7137117 - DNA, 22 bp, Homo sapiens
ggggaggagccatgtaactagt

SEQ ID NO: 7137118 - DNA, 22 bp, Homo sapiens
ggggaggagccatgtaactagt

SEQ ID NO: 7137119 - DNA, 22 bp, Homo sapiens
ggggaggagtgtacaggtttat

SEQ ID NO: 7137120 - DNA, 22 bp, Homo sapiens
ggggaggagtgtacaggtttat

SEQ ID NO: 7137121 - DNA, 22 bp, Homo sapiens
ggggaggcaagatgaagtgagg

SEQ ID NO: 7137122 - DNA, 22 bp, Homo sapiens
ggggagtgttttcatgggcttg

SEQ ID NO: 7137123 - DNA, 22 bp, Homo sapiens
ggggagtgttttcatgggcttg

SEQ ID NO: 7137124 - DNA, 22 bp, Homo sapiens
ggggagtgttttcatgggcttg

SEQ ID NO: 7137125 - DNA, 22 bp, Homo sapiens
ggggagtgttttcatgggcttg

SEQ ID NO: 7137126 - DNA, 22 bp, Homo sapiens
ggggagtgttttcatgggcttg

SEQ ID NO: 7137127 - DNA, 22 bp, Homo sapiens
ggggagttaaaatgtgctgcaa

SEQ ID NO: 7137128 - DNA, 19 bp, Homo sapiens
ggggaggtattgttttcat

SEQ ID NO: 7137129 - DNA, 22 bp, Homo sapiens
ggggagtgacgcagggccatag

SEQ ID NO: 7137130 - DNA, 22 bp, Homo sapiens
ggggaggctgatgtgggcaaag

SEQ ID NO: 7137131 - DNA, 22 bp, Homo sapiens
ggggagtgacgcagggccatag

SEQ ID NO: 7137132 - DNA, 22 bp, Homo sapiens
ggggcaggaggtgttctctttt

SEQ ID NO: 7137133 - DNA, 22 bp, Homo sapiens
ggggcaggaggtgttctctttt

SEQ ID NO: 7137134 - DNA, 22 bp, Homo sapiens
ggggcaggaggtgttctctttt

SEQ ID NO: 7137135 - DNA, 22 bp, Homo sapiens
ggggcaggaggtgttctctttt

SEQ ID NO: 7137136 - DNA, 22 bp, Homo sapiens
ggggcaggaggtgttctctttt

SEQ ID NO: 7137137 - DNA, 22 bp, Homo sapiens
ggggcagggaggttatcgccga

SEQ ID NO: 7137138 - DNA, 22 bp, Homo sapiens
ggggcaggaggtgttctctttt

SEQ ID NO: 7137139 - DNA, 21 bp, Homo sapiens
ggggatgcgaccacaggctcc

SEQ ID NO: 7137140 - DNA, 21 bp, Homo sapiens
ggggatgcgaccacaggctcc

SEQ ID NO: 7137141 - DNA, 22 bp, Homo sapiens
ggggagttcatgcatttgtgga

SEQ ID NO: 7137142 - DNA, 22 bp, Homo sapiens
ggggatgagactagagctaaag

SEQ ID NO: 7137143 - DNA, 22 bp, Homo sapiens
ggggatgagactagagctaaag

SEQ ID NO: 7137144 - DNA, 22 bp, Homo sapiens
ggggccagatatcactaaggtt

SEQ ID NO: 7137145 - DNA, 22 bp, Homo sapiens
ggggccagatatcactaaggtt

SEQ ID NO: 7137146 - DNA, 22 bp, Homo sapiens
ggggccagatatcactaaggtt

SEQ ID NO: 7137147 - DNA, 22 bp, Homo sapiens
ggggccagagaggacccaggtg

SEQ ID NO: 7137148 - DNA, 22 bp, Homo sapiens
ggggccagagaggacccaggtg

SEQ ID NO: 7137149 - DNA, 22 bp, Homo sapiens
ggggccagagaggacccaggtg

SEQ ID NO: 7137150 - DNA, 22 bp, Homo sapiens
ggggccagagaggacccaggtg

SEQ ID NO: 7137151 - DNA, 22 bp, Homo sapiens
ggggccagagaggacccaggtg

SEQ ID NO: 7137152 - DNA, 22 bp, Homo sapiens
ggggccagagaggacccaggtg

SEQ ID NO: 7137153 - DNA, 22 bp, Homo sapiens
ggggccaagggaatgtattgtg

SEQ ID NO: 7137154 - DNA, 22 bp, Homo sapiens
ggggccagagaggacccaggtg

SEQ ID NO: 7137155 - DNA, 22 bp, Homo sapiens
ggggccaagggaatgtattgtg

SEQ ID NO: 7137156 - DNA, 22 bp, Homo sapiens
ggggccactggcaggaccttgg

SEQ ID NO: 7137157 - DNA, 22 bp, Homo sapiens
ggggcattgtgtctgggttcct

SEQ ID NO: 7137158 - DNA, 22 bp, Homo sapiens
ggggcatcagaaccctgtggga

SEQ ID NO: 7137159 - DNA, 20 bp, Homo sapiens
ggggcaggtttttatggcta

SEQ ID NO: 7137160 - DNA, 20 bp, Homo sapiens
ggggcaggtttttatggcta

SEQ ID NO: 7137161 - DNA, 22 bp, Homo sapiens
ggggcagtgaggtggcagcccg

SEQ ID NO: 7137162 - DNA, 22 bp, Homo sapiens
ggggcagtgaggtggcagcccg

SEQ ID NO: 7137163 - DNA, 20 bp, Homo sapiens
ggggcaggtttttatggcta

SEQ ID NO: 7137164 - DNA, 20 bp, Homo sapiens
ggggcaggtttttatggcta

SEQ ID NO: 7137165 - DNA, 22 bp, Homo sapiens
ggggcagggaggttatcgccga

SEQ ID NO: 7137166 - DNA, 22 bp, Homo sapiens
ggggcagggaggttatcgccga

SEQ ID NO: 7137167 - DNA, 22 bp, Homo sapiens
ggggcagggaggttatcgccga

SEQ ID NO: 7137168 - DNA, 22 bp, Homo sapiens
ggggcagggaggttatcgccga

SEQ ID NO: 7137169 - DNA, 20 bp, Homo sapiens
ggggcaggtttttatggcta

SEQ ID NO: 7137170 - DNA, 20 bp, Homo sapiens
ggggcaggtttttatggcta

SEQ ID NO: 7137171 - DNA, 20 bp, Homo sapiens
ggggcaggtttttatggcta

SEQ ID NO: 7137172 - DNA, 22 bp, Homo sapiens
gggcttctctttagtgagctga

SEQ ID NO: 7137173 - DNA, 22 bp, Homo sapiens
gggcttctggctactgtatgag

SEQ ID NO: 7137174 - DNA, 22 bp, Homo sapiens
gggcttctggtcattcctcatc

SEQ ID NO: 7137175 - DNA, 22 bp, Homo sapiens
gggcttctctcaggggcatgag

SEQ ID NO: 7137176 - DNA, 22 bp, Homo sapiens
gggcttctattctggcacaaga

SEQ ID NO: 7137177 - DNA, 22 bp, Homo sapiens
gggcttcagttctgaccatctt

SEQ ID NO: 7137178 - DNA, 22 bp, Homo sapiens
gggcttcagttctgaccatctt

SEQ ID NO: 7137179 - DNA, 22 bp, Homo sapiens
gggcttctagaccagcagtgag

SEQ ID NO: 7137180 - DNA, 22 bp, Homo sapiens
gggcttaaggtgcaaagtcata

SEQ ID NO: 7137181 - DNA, 22 bp, Homo sapiens
gggcttatggagggctttgtac

SEQ ID NO: 7137182 - DNA, 22 bp, Homo sapiens
gggcttaaggccagtgtgcttt

SEQ ID NO: 7137183 - DNA, 22 bp, Homo sapiens
gggcttaagatttggcgcggtt

SEQ ID NO: 7137184 - DNA, 22 bp, Homo sapiens
gggcttaattcatcccataaat

SEQ ID NO: 7137185 - DNA, 16 bp, Homo sapiens
gggctgggggattctg

SEQ ID NO: 7137186 - DNA, 16 bp, Homo sapiens
gggctgggggattctg

SEQ ID NO: 7137187 - DNA, 16 bp, Homo sapiens
gggctgggggattctg

SEQ ID NO: 7137188 - DNA, 22 bp, Homo sapiens
gggctctggggtgccctggcat

SEQ ID NO: 7137189 - DNA, 16 bp, Homo sapiens
gggctgggggattctg

SEQ ID NO: 7137190 - DNA, 16 bp, Homo sapiens
gggctgggggattctg

SEQ ID NO: 7137191 - DNA, 22 bp, Homo sapiens
gggctctggggtcagacagcct

SEQ ID NO: 7137192 - DNA, 22 bp, Homo sapiens
gggctctggggtcagacagcct

SEQ ID NO: 7137193 - DNA, 22 bp, Homo sapiens
gggctctggggtgccctggcat

SEQ ID NO: 7137194 - DNA, 22 bp, Homo sapiens
gggctctggggtgccctggcat

SEQ ID NO: 7137195 - DNA, 22 bp, Homo sapiens
gggctctggggtcagacagcct

SEQ ID NO: 7137196 - DNA, 22 bp, Homo sapiens
gggctctggggtgccctggcat

SEQ ID NO: 7137197 - DNA, 22 bp, Homo sapiens
gggctctggggtgccctggcat

SEQ ID NO: 7137198 - DNA, 22 bp, Homo sapiens
gggctgtgtgcccacttcccat

SEQ ID NO: 7137199 - DNA, 22 bp, Homo sapiens
gggctgtgtgcccacttcccat

SEQ ID NO: 7137200 - DNA, 22 bp, Homo sapiens
gggctgtgttaggtgcggttac

SEQ ID NO: 7137201 - DNA, 18 bp, Homo sapiens
gggctgtgttcatgccca

SEQ ID NO: 7137202 - DNA, 18 bp, Homo sapiens
gggctgtgttcatgccca

SEQ ID NO: 7137203 - DNA, 18 bp, Homo sapiens
gggctgtgttcatgccca

SEQ ID NO: 7137204 - DNA, 22 bp, Homo sapiens
gggctctgggatgctcttagag

SEQ ID NO: 7137205 - DNA, 22 bp, Homo sapiens
gggctctgggattcagagcaag

SEQ ID NO: 7137206 - DNA, 22 bp, Homo sapiens
gggctctgggatgctcttagag

SEQ ID NO: 7137207 - DNA, 22 bp, Homo sapiens
gggctctgggatgctcttagag

SEQ ID NO: 7137208 - DNA, 22 bp, Homo sapiens
gggctctgggattcagagcaag

SEQ ID NO: 7137209 - DNA, 22 bp, Homo sapiens
gggctctgggattcagagcaag

SEQ ID NO: 7137210 - DNA, 22 bp, Homo sapiens
gggctctgggattcagagcaag

SEQ ID NO: 7137211 - DNA, 22 bp, Homo sapiens
gggctctggggaggacccttca

SEQ ID NO: 7137212 - DNA, 22 bp, Homo sapiens
gggctctggggaggacccttca

SEQ ID NO: 7137213 - DNA, 22 bp, Homo sapiens
gggctctggggtcagacagcct

SEQ ID NO: 7137214 - DNA, 19 bp, Homo sapiens
gggctctggcctcagtggg

SEQ ID NO: 7137215 - DNA, 18 bp, Homo sapiens
gggctctggcatctgggt

SEQ ID NO: 7137216 - DNA, 20 bp, Homo sapiens
gggctctggccaatgctttg

SEQ ID NO: 7137217 - DNA, 18 bp, Homo sapiens
gggctctggcatctgggt

SEQ ID NO: 7137218 - DNA, 19 bp, Homo sapiens
gggctctggcctcagtggg

SEQ ID NO: 7137219 - DNA, 19 bp, Homo sapiens
gggctctggcctcagtggg

SEQ ID NO: 7137220 - DNA, 22 bp, Homo sapiens
gggctctgggatgctcttagag

SEQ ID NO: 7137221 - DNA, 22 bp, Homo sapiens
gggctctgggatgctcttagag

SEQ ID NO: 7137222 - DNA, 22 bp, Homo sapiens
gggccgtagaccacgtccgggc

SEQ ID NO: 7137223 - DNA, 22 bp, Homo sapiens
gggccggagctgggtcccgcgc

SEQ ID NO: 7137224 - DNA, 22 bp, Homo sapiens
gggcccttcagcttcctctgca

SEQ ID NO: 7137225 - DNA, 22 bp, Homo sapiens
gggccctgtgatttcttgagga

SEQ ID NO: 7137226 - DNA, 22 bp, Homo sapiens
gggccggagctgggtcccgcgc

SEQ ID NO: 7137227 - DNA, 22 bp, Homo sapiens
gggccctgtgatttcttgagga

SEQ ID NO: 7137228 - DNA, 22 bp, Homo sapiens
gggccctgtgatttcttgagga

SEQ ID NO: 7137229 - DNA, 22 bp, Homo sapiens
gggccctggggcctgatttgca

SEQ ID NO: 7137230 - DNA, 22 bp, Homo sapiens
gggctcagacatccctcctgga

SEQ ID NO: 7137231 - DNA, 22 bp, Homo sapiens
gggctcagacatccctcctgga

SEQ ID NO: 7137232 - DNA, 18 bp, Homo sapiens
gggctcacacaggtcatc

SEQ ID NO: 7137233 - DNA, 22 bp, Homo sapiens
gggctaggtctgatcagagaag

SEQ ID NO: 7137234 - DNA, 22 bp, Homo sapiens
gggctatagcactatgtatggg

SEQ ID NO: 7137235 - DNA, 19 bp, Homo sapiens
gggcctcacccacacctcc

SEQ ID NO: 7137236 - DNA, 22 bp, Homo sapiens
gggccctggggatgtggacgcg

SEQ ID NO: 7137237 - DNA, 22 bp, Homo sapiens
gggccctggggatgtggacgcg

SEQ ID NO: 7137238 - DNA, 22 bp, Homo sapiens
gggccctgggattcagagcaag

SEQ ID NO: 7137239 - DNA, 22 bp, Homo sapiens
gggccctgggattcagagcaag

SEQ ID NO: 7137240 - DNA, 22 bp, Homo sapiens
gggccctgcctaaggaacacac

SEQ ID NO: 7137241 - DNA, 22 bp, Homo sapiens
gggccctgcgactcgcggcgga

SEQ ID NO: 7137242 - DNA, 22 bp, Homo sapiens
gggccctgcctaaggaacacac

SEQ ID NO: 7137243 - DNA, 22 bp, Homo sapiens
gggccctgatctgtgagcgcag

SEQ ID NO: 7137244 - DNA, 22 bp, Homo sapiens
gggccctgatctgtgagcgcag

SEQ ID NO: 7137245 - DNA, 22 bp, Homo sapiens
gggccctcagtcccaggccttc

SEQ ID NO: 7137246 - DNA, 22 bp, Homo sapiens
gggccctcagtcccaggccttc

SEQ ID NO: 7137247 - DNA, 22 bp, Homo sapiens
gggccctctgcagctgcccagg

SEQ ID NO: 7137248 - DNA, 22 bp, Homo sapiens
gggccctgatctgtgagcgcag

SEQ ID NO: 7137249 - DNA, 22 bp, Homo sapiens
gggccctgccccgtggctctga

SEQ ID NO: 7137250 - DNA, 22 bp, Homo sapiens
gggccctgccccgtggctctga

SEQ ID NO: 7137251 - DNA, 22 bp, Homo sapiens
gggccctgccccgtggctctga

SEQ ID NO: 7137252 - DNA, 22 bp, Homo sapiens
gggcaggtgtttccaaggtgag

SEQ ID NO: 7137253 - DNA, 22 bp, Homo sapiens
gggcaggtgtgcagagctgttg

SEQ ID NO: 7137254 - DNA, 22 bp, Homo sapiens
gggcaggtgtttccaaggtgag

SEQ ID NO: 7137255 - DNA, 22 bp, Homo sapiens
gggcaggtgtttccaaggtgag

SEQ ID NO: 7137256 - DNA, 22 bp, Homo sapiens
gggcaggtgtttccaaggtgag

SEQ ID NO: 7137257 - DNA, 22 bp, Homo sapiens
gggcaggtgtgcagagctgttg

SEQ ID NO: 7137258 - DNA, 22 bp, Homo sapiens
gggcaggtgttgtcaatctaat

SEQ ID NO: 7137259 - DNA, 22 bp, Homo sapiens
gggcaggtggcctcttgtacta

SEQ ID NO: 7137260 - DNA, 22 bp, Homo sapiens
gggcaggtgtgcagagctgttg

SEQ ID NO: 7137261 - DNA, 22 bp, Homo sapiens
gggcaggtgtgcagagctgttg

SEQ ID NO: 7137262 - DNA, 22 bp, Homo sapiens
gggcaggtggcagggtctctgg

SEQ ID NO: 7137263 - DNA, 22 bp, Homo sapiens
gggcaggtggcagggtctctgg

SEQ ID NO: 7137264 - DNA, 22 bp, Homo sapiens
gggcaggtggcaaagccagagg

SEQ ID NO: 7137265 - DNA, 22 bp, Homo sapiens
gggcaggtgcccagggccagag

SEQ ID NO: 7137266 - DNA, 22 bp, Homo sapiens
gggcaggtgcccagggccagag

SEQ ID NO: 7137267 - DNA, 22 bp, Homo sapiens
gggcaggtgcccagggccagag

SEQ ID NO: 7137268 - DNA, 22 bp, Homo sapiens
gggcaggtggagggcccagcca

SEQ ID NO: 7137269 - DNA, 22 bp, Homo sapiens
gggcaggtggagggcccagcca

SEQ ID NO: 7137270 - DNA, 22 bp, Homo sapiens
gggcaggtggagggcccagcca

SEQ ID NO: 7137271 - DNA, 22 bp, Homo sapiens
gggcaggtggagggcccagcca

SEQ ID NO: 7137272 - DNA, 22 bp, Homo sapiens
gggcaggtggagggcccagcca

SEQ ID NO: 7137273 - DNA, 22 bp, Homo sapiens
gggcaggtggagggcccagcca

SEQ ID NO: 7137274 - DNA, 22 bp, Homo sapiens
gggcaggtggcaaagccagagg

SEQ ID NO: 7137275 - DNA, 22 bp, Homo sapiens
gggcaggtggcaaagccagagg

SEQ ID NO: 7137276 - DNA, 22 bp, Homo sapiens
gggcaggtgtttccaaggtgag

SEQ ID NO: 7137277 - DNA, 22 bp, Homo sapiens
gggcccaggcctccttccttcc

SEQ ID NO: 7137278 - DNA, 22 bp, Homo sapiens
gggcccagtaccctctgccaag

SEQ ID NO: 7137279 - DNA, 22 bp, Homo sapiens
gggcccagtaccctctgccaag

SEQ ID NO: 7137280 - DNA, 22 bp, Homo sapiens
gggcccagtaccctctgccaag

SEQ ID NO: 7137281 - DNA, 22 bp, Homo sapiens
gggcccagtaccctctgccaag

SEQ ID NO: 7137282 - DNA, 22 bp, Homo sapiens
gggcccagtaccctctgccaag

SEQ ID NO: 7137283 - DNA, 22 bp, Homo sapiens
gggccccaaaatgccaggctct

SEQ ID NO: 7137284 - DNA, 22 bp, Homo sapiens
gggccccaaaatgccaggctct

SEQ ID NO: 7137285 - DNA, 22 bp, Homo sapiens
gggccccaaaatgccaggctct

SEQ ID NO: 7137286 - DNA, 22 bp, Homo sapiens
gggccccaagaacctcctcctg

SEQ ID NO: 7137287 - DNA, 22 bp, Homo sapiens
gggccccaagaacctcctcctg

SEQ ID NO: 7137288 - DNA, 22 bp, Homo sapiens
gggccccagtcctcccacgtgg

SEQ ID NO: 7137289 - DNA, 22 bp, Homo sapiens
gggccccactggggctgcctgc

SEQ ID NO: 7137290 - DNA, 22 bp, Homo sapiens
gggccccactggggctgcctgc

SEQ ID NO: 7137291 - DNA, 22 bp, Homo sapiens
gggccccactggggctgcctgc

SEQ ID NO: 7137292 - DNA, 22 bp, Homo sapiens
gggccccagtcctcccacgtgg

SEQ ID NO: 7137293 - DNA, 22 bp, Homo sapiens
gggccccttgctgctctgctgg

SEQ ID NO: 7137294 - DNA, 22 bp, Homo sapiens
gggccccttgctgctctgctgg

SEQ ID NO: 7137295 - DNA, 22 bp, Homo sapiens
gggccccttgtatctctggctc

SEQ ID NO: 7137296 - DNA, 22 bp, Homo sapiens
gggccccttgtatctctggctc

SEQ ID NO: 7137297 - DNA, 21 bp, Homo sapiens
gggctcagcgctcggctcctc

SEQ ID NO: 7137298 - DNA, 22 bp, Homo sapiens
gggctcagcctcctcacttcga

SEQ ID NO: 7137299 - DNA, 22 bp, Homo sapiens
gggctcagcctcctcacttcga

SEQ ID NO: 7137300 - DNA, 23 bp, Homo sapiens
gggctcagatttcattctgtgcc

SEQ ID NO: 7137301 - DNA, 22 bp, Homo sapiens
gggctcagccccattgaaccag

SEQ ID NO: 7137302 - DNA, 22 bp, Homo sapiens
gggctcagccccattgaaccag

SEQ ID NO: 7137303 - DNA, 22 bp, Homo sapiens
gggctcagccccattgaaccag

SEQ ID NO: 7137304 - DNA, 22 bp, Homo sapiens
gggctcagcctcctcacttcga

SEQ ID NO: 7137305 - DNA, 22 bp, Homo sapiens
gggctcagcctcctcacttcga

SEQ ID NO: 7137306 - DNA, 23 bp, Homo sapiens
gggctcagatttcattctgtgcc

SEQ ID NO: 7137307 - DNA, 16 bp, Homo sapiens
gggctcagatctttga

SEQ ID NO: 7137308 - DNA, 16 bp, Homo sapiens
gggctcagatctttga

SEQ ID NO: 7137309 - DNA, 22 bp, Homo sapiens
gggctcagaggagtggcctggg

SEQ ID NO: 7137310 - DNA, 16 bp, Homo sapiens
gggctcagatctttga

SEQ ID NO: 7137311 - DNA, 23 bp, Homo sapiens
gggctcagatttcattctgtgcc

SEQ ID NO: 7137312 - DNA, 23 bp, Homo sapiens
gggctcagatttcattctgtgcc

SEQ ID NO: 7137313 - DNA, 22 bp, Homo sapiens
gggctcagccccattgaaccag

SEQ ID NO: 7137314 - DNA, 22 bp, Homo sapiens
gggctcagccccattgaaccag

SEQ ID NO: 7137315 - DNA, 22 bp, Homo sapiens
gggctcagaggagtggcctggg

SEQ ID NO: 7137316 - DNA, 22 bp, Homo sapiens
gggctcagaggagtggcctggg

SEQ ID NO: 7137317 - DNA, 22 bp, Homo sapiens
gggctcagaggagtggcctggg

SEQ ID NO: 7137318 - DNA, 22 bp, Homo sapiens
gggctcagaggagtggcctggg

SEQ ID NO: 7137319 - DNA, 22 bp, Homo sapiens
gggctcagaggagtggcctggg

SEQ ID NO: 7137320 - DNA, 22 bp, Homo sapiens
gggctcagacatccctcctgga

SEQ ID NO: 7137321 - DNA, 22 bp, Homo sapiens
gggctcagacatccctcctgga

SEQ ID NO: 7137322 - DNA, 22 bp, Homo sapiens
gggctcagacatccctcctgga

SEQ ID NO: 7137323 - DNA, 22 bp, Homo sapiens
gggctcagagcatttgggttgg

SEQ ID NO: 7137324 - DNA, 22 bp, Homo sapiens
gggctcagagcatttgggttgg

SEQ ID NO: 7137325 - DNA, 22 bp, Homo sapiens
gggctcagagcatttgggttgg

SEQ ID NO: 7137326 - DNA, 22 bp, Homo sapiens
gggctcagagcatttgggttgg

SEQ ID NO: 7137327 - DNA, 22 bp, Homo sapiens
gggctcagctgggcgtgctggt

SEQ ID NO: 7137328 - DNA, 22 bp, Homo sapiens
gggctcagctgggcgtgctggt

SEQ ID NO: 7137329 - DNA, 22 bp, Homo sapiens
gggctcagctgggcgtgctggt

SEQ ID NO: 7137330 - DNA, 22 bp, Homo sapiens
gggctcagctccttccttccta

SEQ ID NO: 7137331 - DNA, 21 bp, Homo sapiens
gggctcagcgctcggctcctc

SEQ ID NO: 7137332 - DNA, 21 bp, Homo sapiens
gggctcagcgctcggctcctc

SEQ ID NO: 7137333 - DNA, 21 bp, Homo sapiens
gggctcagcgctcggctcctc

SEQ ID NO: 7137334 - DNA, 22 bp, Homo sapiens
gggctcagctccttccttccta

SEQ ID NO: 7137335 - DNA, 22 bp, Homo sapiens
gggctcagctccttccttccta

SEQ ID NO: 7137336 - DNA, 22 bp, Homo sapiens
gggctcagctccttccttccta

SEQ ID NO: 7137337 - DNA, 22 bp, Homo sapiens
gggctcagctccttccttccta

SEQ ID NO: 7137338 - DNA, 22 bp, Homo sapiens
gggctcagctgggcgtgctggt

SEQ ID NO: 7137339 - DNA, 22 bp, Homo sapiens
gggctcagttctgcttcatgct

SEQ ID NO: 7137340 - DNA, 22 bp, Homo sapiens
gggctcagttctgcttcatgct

SEQ ID NO: 7137341 - DNA, 22 bp, Homo sapiens
gggctcagttctgcttcatgct

SEQ ID NO: 7137342 - DNA, 22 bp, Homo sapiens
gggctcagttctgcttcatgct

SEQ ID NO: 7137343 - DNA, 22 bp, Homo sapiens
gggctcattcatctgggcttgg

SEQ ID NO: 7137344 - DNA, 22 bp, Homo sapiens
gggctcagttctgcttcatgct

SEQ ID NO: 7137345 - DNA, 22 bp, Homo sapiens
gggctccaacggtgagcatgga

SEQ ID NO: 7137346 - DNA, 22 bp, Homo sapiens
gggctccaacggtgagcatgga

SEQ ID NO: 7137347 - DNA, 22 bp, Homo sapiens
gggctctgaatcccaggtctgc

SEQ ID NO: 7137348 - DNA, 22 bp, Homo sapiens
gggctctgaatcccaggtctgc

SEQ ID NO: 7137349 - DNA, 22 bp, Homo sapiens
gggctctgaatcccaggtctgc

SEQ ID NO: 7137350 - DNA, 22 bp, Homo sapiens
gggctctgaatgagttaccaag

SEQ ID NO: 7137351 - DNA, 22 bp, Homo sapiens
gggctctgactgaatattgaat

SEQ ID NO: 7137352 - DNA, 22 bp, Homo sapiens
gggctctgagctctgggaatta

SEQ ID NO: 7137353 - DNA, 22 bp, Homo sapiens
gggctctggaaatgggagctcc

SEQ ID NO: 7137354 - DNA, 22 bp, Homo sapiens
gggctctggaaatgggagctcc

SEQ ID NO: 7137355 - DNA, 22 bp, Homo sapiens
gggctctggacccaggcaagag

SEQ ID NO: 7137356 - DNA, 22 bp, Homo sapiens
gggctctggagttctagaaaga

SEQ ID NO: 7137357 - DNA, 22 bp, Homo sapiens
gggctctggagttctagaaaga

SEQ ID NO: 7137358 - DNA, 22 bp, Homo sapiens
gggctctggatggagcctgcag

SEQ ID NO: 7137359 - DNA, 22 bp, Homo sapiens
gggctctggatggagcctgcag

SEQ ID NO: 7137360 - DNA, 22 bp, Homo sapiens
gggctctggatggagcctgcag

SEQ ID NO: 7137361 - DNA, 22 bp, Homo sapiens
gggctctggatggagcctgcag

SEQ ID NO: 7137362 - DNA, 22 bp, Homo sapiens
gggctctggatggagcctgcag

SEQ ID NO: 7137363 - DNA, 18 bp, Homo sapiens
gggctctggcatctgggt

SEQ ID NO: 7137364 - DNA, 22 bp, Homo sapiens
gggctctggaaatgggagctcc

SEQ ID NO: 7137365 - DNA, 22 bp, Homo sapiens
gggctctggaaatgggagctcc

SEQ ID NO: 7137366 - DNA, 22 bp, Homo sapiens
gggctctggaaatgggagctcc

SEQ ID NO: 7137367 - DNA, 22 bp, Homo sapiens
gggctctggaaatgggagctcc

SEQ ID NO: 7137368 - DNA, 22 bp, Homo sapiens
gggctctggaaggtgcaccatg

SEQ ID NO: 7137369 - DNA, 22 bp, Homo sapiens
gggctctggacccaggcaagag

SEQ ID NO: 7137370 - DNA, 22 bp, Homo sapiens
gggctctggacccaggcaagag

SEQ ID NO: 7137371 - DNA, 22 bp, Homo sapiens
gggcagaggctctggcccatcc

SEQ ID NO: 7137372 - DNA, 22 bp, Homo sapiens
gggcagaggctctggcccatcc

SEQ ID NO: 7137373 - DNA, 22 bp, Homo sapiens
gggcagaggctctggcccatcc

SEQ ID NO: 7137374 - DNA, 22 bp, Homo sapiens
gggcagaggctctggcccatcc

SEQ ID NO: 7137375 - DNA, 22 bp, Homo sapiens
gggcagaggctctggcccatcc

SEQ ID NO: 7137376 - DNA, 22 bp, Homo sapiens
gggcagaggctctggcccatcc

SEQ ID NO: 7137377 - DNA, 21 bp, Homo sapiens
gggcagaggggcctcctgggt

SEQ ID NO: 7137378 - DNA, 21 bp, Homo sapiens
gggcagaggggcctcctgggt

SEQ ID NO: 7137379 - DNA, 21 bp, Homo sapiens
gggcagaggggcctcctgggt

SEQ ID NO: 7137380 - DNA, 21 bp, Homo sapiens
gggcagaggggcctcctgggt

SEQ ID NO: 7137381 - DNA, 17 bp, Homo sapiens
gggcagggactcctggg

SEQ ID NO: 7137382 - DNA, 17 bp, Homo sapiens
gggcagggactcctggg

SEQ ID NO: 7137383 - DNA, 17 bp, Homo sapiens
gggcagggactcctggg

SEQ ID NO: 7137384 - DNA, 17 bp, Homo sapiens
gggcagggactcctggg

SEQ ID NO: 7137385 - DNA, 21 bp, Homo sapiens
gggcagaggggcctcctgggt

SEQ ID NO: 7137386 - DNA, 21 bp, Homo sapiens
gggcagaggggcctcctgggt

SEQ ID NO: 7137387 - DNA, 21 bp, Homo sapiens
gggcagaggggcctcctgggt

SEQ ID NO: 7137388 - DNA, 21 bp, Homo sapiens
gggcagaggggcctcctgggt

SEQ ID NO: 7137389 - DNA, 21 bp, Homo sapiens
gggcagaggggcctcctgggt

SEQ ID NO: 7137390 - DNA, 22 bp, Homo sapiens
gggcaggtgccagctccctgtc

SEQ ID NO: 7137391 - DNA, 22 bp, Homo sapiens
gggcaggtgccagctccctgtc

SEQ ID NO: 7137392 - DNA, 22 bp, Homo sapiens
gggcaggtgccagctccctgtc

SEQ ID NO: 7137393 - DNA, 22 bp, Homo sapiens
gggcaggtgcccagggccagag

SEQ ID NO: 7137394 - DNA, 22 bp, Homo sapiens
gggcaggtgcccagggccagag

SEQ ID NO: 7137395 - DNA, 22 bp, Homo sapiens
gggcaggtgcccagggccagag

SEQ ID NO: 7137396 - DNA, 22 bp, Homo sapiens
gggcaggtgcccagggccagag

SEQ ID NO: 7137397 - DNA, 22 bp, Homo sapiens
gggcaggtctgggtcagcctga

SEQ ID NO: 7137398 - DNA, 22 bp, Homo sapiens
gggcaggtgacctcttgtcctg

SEQ ID NO: 7137399 - DNA, 22 bp, Homo sapiens
gggcaggtgacctcttgtcctg

SEQ ID NO: 7137400 - DNA, 22 bp, Homo sapiens
gggcaggtgattttggctccat

SEQ ID NO: 7137401 - DNA, 22 bp, Homo sapiens
gggcaggtgacctcttgtcctg

SEQ ID NO: 7137402 - DNA, 22 bp, Homo sapiens
gggcaggtgattttggctccat

SEQ ID NO: 7137403 - DNA, 21 bp, Homo sapiens
gggcaggtctctgatgtcaac

SEQ ID NO: 7137404 - DNA, 21 bp, Homo sapiens
gggcaggtctctgatgtcaac

SEQ ID NO: 7137405 - DNA, 17 bp, Homo sapiens
gggcagggactcctggg

SEQ ID NO: 7137406 - DNA, 17 bp, Homo sapiens
gggcagggactcctggg

SEQ ID NO: 7137407 - DNA, 17 bp, Homo sapiens
gggcagggactcctggg

SEQ ID NO: 7137408 - DNA, 17 bp, Homo sapiens
gggcagggactcctggg

SEQ ID NO: 7137409 - DNA, 15 bp, Homo sapiens
gggcaggtctggggc

SEQ ID NO: 7137410 - DNA, 15 bp, Homo sapiens
gggcaggtctggggc

SEQ ID NO: 7137411 - DNA, 22 bp, Homo sapiens
gggcaggtctgggtcagcctga

SEQ ID NO: 7137412 - DNA, 22 bp, Homo sapiens
gggcaggtctgggtcagcctga

SEQ ID NO: 7137413 - DNA, 22 bp, Homo sapiens
gggcaggtctgggtcagcctga

SEQ ID NO: 7137414 - DNA, 22 bp, Homo sapiens
gggcagaggctctggcccatcc

SEQ ID NO: 7137415 - DNA, 20 bp, Homo sapiens
gggcagagccagccagtccc

SEQ ID NO: 7137416 - DNA, 20 bp, Homo sapiens
gggcagagccagccagtccc

SEQ ID NO: 7137417 - DNA, 20 bp, Homo sapiens
gggcagagccagccagtccc

SEQ ID NO: 7137418 - DNA, 20 bp, Homo sapiens
gggcagagccagccagtccc

SEQ ID NO: 7137419 - DNA, 20 bp, Homo sapiens
gggcagagccagccagtccc

SEQ ID NO: 7137420 - DNA, 20 bp, Homo sapiens
gggcagagccagccagtccc

SEQ ID NO: 7137421 - DNA, 20 bp, Homo sapiens
gggcagagccagccagtccc

SEQ ID NO: 7137422 - DNA, 20 bp, Homo sapiens
gggcagagccagccagtccc

SEQ ID NO: 7137423 - DNA, 20 bp, Homo sapiens
gggcagagccagccagtccc

SEQ ID NO: 7137424 - DNA, 20 bp, Homo sapiens
gggcagagccagccagtccc

SEQ ID NO: 7137425 - DNA, 22 bp, Homo sapiens
gggcagagagctggaactcctt

SEQ ID NO: 7137426 - DNA, 22 bp, Homo sapiens
gggcagagagctggaactcctt

SEQ ID NO: 7137427 - DNA, 22 bp, Homo sapiens
gggcagagagctggaactcctt

SEQ ID NO: 7137428 - DNA, 22 bp, Homo sapiens
gggcagagagctggaactcctt

SEQ ID NO: 7137429 - DNA, 22 bp, Homo sapiens
gggcagagagctggaactcctt

SEQ ID NO: 7137430 - DNA, 22 bp, Homo sapiens
gggcagagagctggaactcctt

SEQ ID NO: 7137431 - DNA, 22 bp, Homo sapiens
gggcagagagctggaactcctt

SEQ ID NO: 7137432 - DNA, 22 bp, Homo sapiens
gggcagagactcagaaacagaa

SEQ ID NO: 7137433 - DNA, 22 bp, Homo sapiens
gggcagagactcagaaacagaa

SEQ ID NO: 7137434 - DNA, 22 bp, Homo sapiens
gggcagagactcagaaacagaa

SEQ ID NO: 7137435 - DNA, 22 bp, Homo sapiens
gggcagagactcagaaacagaa

SEQ ID NO: 7137436 - DNA, 22 bp, Homo sapiens
gggcagagagctggaactcctt

SEQ ID NO: 7137437 - DNA, 22 bp, Homo sapiens
gggcagagactcagaaacagaa

SEQ ID NO: 7137438 - DNA, 22 bp, Homo sapiens
gggcagagactcagaaacagaa

SEQ ID NO: 7137439 - DNA, 22 bp, Homo sapiens
gggcagagactcagaaacagaa

SEQ ID NO: 7137440 - DNA, 22 bp, Homo sapiens
gggcagagactcagaaacagaa

SEQ ID NO: 7137441 - DNA, 22 bp, Homo sapiens
gggcagagactcagaaacagaa

SEQ ID NO: 7137442 - DNA, 22 bp, Homo sapiens
gggcagagactcagaaacagaa

SEQ ID NO: 7137443 - DNA, 22 bp, Homo sapiens
gggcagagactcagaaacagaa

SEQ ID NO: 7137444 - DNA, 22 bp, Homo sapiens
gggcactgtgctaggtgctgag

SEQ ID NO: 7137445 - DNA, 22 bp, Homo sapiens
gggcactgtacactgtgcatgg

SEQ ID NO: 7137446 - DNA, 22 bp, Homo sapiens
gggcactgtacactgtgcatgg

SEQ ID NO: 7137447 - DNA, 22 bp, Homo sapiens
gggcactgtacactgtgcatgg

SEQ ID NO: 7137448 - DNA, 22 bp, Homo sapiens
gggcactgggtcttctccacgc

SEQ ID NO: 7137449 - DNA, 22 bp, Homo sapiens
gggcactggtgctgccatcttg

SEQ ID NO: 7137450 - DNA, 22 bp, Homo sapiens
gggcactggtgctgccatcttg

SEQ ID NO: 7137451 - DNA, 22 bp, Homo sapiens
gggcactggtgctgccatcttg

SEQ ID NO: 7137452 - DNA, 22 bp, Homo sapiens
gggcactgggtcttctccacgc

SEQ ID NO: 7137453 - DNA, 20 bp, Homo sapiens
gggatcaggaaaggaggcta

SEQ ID NO: 7137454 - DNA, 18 bp, Homo sapiens
gggatcaggctgcctagg

SEQ ID NO: 7137455 - DNA, 18 bp, Homo sapiens
gggatcaggctgcctagg

SEQ ID NO: 7137456 - DNA, 18 bp, Homo sapiens
gggatcaggctgcctagg

SEQ ID NO: 7137457 - DNA, 22 bp, Homo sapiens
gggatcagttaaggagagtttt

SEQ ID NO: 7137458 - DNA, 16 bp, Homo sapiens
gggagtgaaggagggt

SEQ ID NO: 7137459 - DNA, 16 bp, Homo sapiens
gggagtgaaggagggt

SEQ ID NO: 7137460 - DNA, 22 bp, Homo sapiens
gggagtcagtgaaggagtcaga

SEQ ID NO: 7137461 - DNA, 22 bp, Homo sapiens
gggagtaaactatggtgaggat

SEQ ID NO: 7137462 - DNA, 22 bp, Homo sapiens
gggagtcaggctccctcagaga

SEQ ID NO: 7137463 - DNA, 22 bp, Homo sapiens
gggagtggattatgtggaccca

SEQ ID NO: 7137464 - DNA, 22 bp, Homo sapiens
gggagtggattatgtggaccca

SEQ ID NO: 7137465 - DNA, 22 bp, Homo sapiens
gggagtggagagcaatggatga

SEQ ID NO: 7137466 - DNA, 22 bp, Homo sapiens
gggagtggagagcaatggatga

SEQ ID NO: 7137467 - DNA, 22 bp, Homo sapiens
gggagctgaatggcaatggaga

SEQ ID NO: 7137468 - DNA, 22 bp, Homo sapiens
gggagctgaatggcaatggaga

SEQ ID NO: 7137469 - DNA, 21 bp, Homo sapiens
gggagctgacagcagcacggc

SEQ ID NO: 7137470 - DNA, 22 bp, Homo sapiens
gggaggttgaggctgcagtgag

SEQ ID NO: 7137471 - DNA, 22 bp, Homo sapiens
gggaggttgaggctgcagtgag

SEQ ID NO: 7137472 - DNA, 19 bp, Homo sapiens
gggagtcaagagattagtt

SEQ ID NO: 7137473 - DNA, 22 bp, Homo sapiens
gggagctccactgcctctcatt

SEQ ID NO: 7137474 - DNA, 22 bp, Homo sapiens
gggagcgggactgcgcaggctt

SEQ ID NO: 7137475 - DNA, 22 bp, Homo sapiens
gggagctcgtgcgcccaggtgc

SEQ ID NO: 7137476 - DNA, 22 bp, Homo sapiens
gggagctcgtgcgcccaggtgc

SEQ ID NO: 7137477 - DNA, 22 bp, Homo sapiens
gggagctctccctgaggcctgg

SEQ ID NO: 7137478 - DNA, 22 bp, Homo sapiens
gggagcgggactgcgcaggctt

SEQ ID NO: 7137479 - DNA, 22 bp, Homo sapiens
gggagccttgggagtgccagcc

SEQ ID NO: 7137480 - DNA, 22 bp, Homo sapiens
gggagcgcccctgcctgtttga

SEQ ID NO: 7137481 - DNA, 22 bp, Homo sapiens
gggagctgaatggcaatggaga

SEQ ID NO: 7137482 - DNA, 22 bp, Homo sapiens
gggagctgaatggcaatggaga

SEQ ID NO: 7137483 - DNA, 22 bp, Homo sapiens
gggagctgaagtaggggtaaat

SEQ ID NO: 7137484 - DNA, 22 bp, Homo sapiens
gggagctgaagtaggggtaaat

SEQ ID NO: 7137485 - DNA, 22 bp, Homo sapiens
gggagctgaaggagccggcggg

SEQ ID NO: 7137486 - DNA, 22 bp, Homo sapiens
gggagctgaaggagccggcggg

SEQ ID NO: 7137487 - DNA, 22 bp, Homo sapiens
gggagctgaagtaggggtaaat

SEQ ID NO: 7137488 - DNA, 22 bp, Homo sapiens
gggagctctccctgaggcctgg

SEQ ID NO: 7137489 - DNA, 22 bp, Homo sapiens
gggagctctccctgaggcctgg

SEQ ID NO: 7137490 - DNA, 22 bp, Homo sapiens
gggagctgaactgctgaagttg

SEQ ID NO: 7137491 - DNA, 22 bp, Homo sapiens
gggagctgaactgctgaagttg

SEQ ID NO: 7137492 - DNA, 22 bp, Homo sapiens
gggagctgaaggagccggcggg

SEQ ID NO: 7137493 - DNA, 22 bp, Homo sapiens
gggagctgaaggagccggcggg

SEQ ID NO: 7137494 - DNA, 22 bp, Homo sapiens
gggatcagcaagccactgcacc

SEQ ID NO: 7137495 - DNA, 22 bp, Homo sapiens
gggatcagcaagccactgcacc

SEQ ID NO: 7137496 - DNA, 22 bp, Homo sapiens
gggatcagactctgggatgtag

SEQ ID NO: 7137497 - DNA, 22 bp, Homo sapiens
gggatcagactctgggatgtag

SEQ ID NO: 7137498 - DNA, 22 bp, Homo sapiens
gggatcagattccctgtcccaa

SEQ ID NO: 7137499 - DNA, 22 bp, Homo sapiens
gggatcagattccctgtcccaa

SEQ ID NO: 7137500 - DNA, 22 bp, Homo sapiens
gggatcagaaacatagccctga

SEQ ID NO: 7137501 - DNA, 22 bp, Homo sapiens
gggatcagcaagccactgcacc

SEQ ID NO: 7137502 - DNA, 19 bp, Homo sapiens
gggatcagcccagggctct

SEQ ID NO: 7137503 - DNA, 20 bp, Homo sapiens
gggatcaggaaaggaggcta

SEQ ID NO: 7137504 - DNA, 20 bp, Homo sapiens
gggatcaggaaaggaggcta

SEQ ID NO: 7137505 - DNA, 22 bp, Homo sapiens
gggataggagattgggagtgtt

SEQ ID NO: 7137506 - DNA, 22 bp, Homo sapiens
gggataagagagtatttatgca

SEQ ID NO: 7137507 - DNA, 22 bp, Homo sapiens
gggagtggttgatggtgaaaat

SEQ ID NO: 7137508 - DNA, 22 bp, Homo sapiens
gggagtggttgatggtgaaaat

SEQ ID NO: 7137509 - DNA, 22 bp, Homo sapiens
gggataggagattgggagtgtt

SEQ ID NO: 7137510 - DNA, 22 bp, Homo sapiens
gggataggagattgggagtgtt

SEQ ID NO: 7137511 - DNA, 22 bp, Homo sapiens
gggagtgggtttggcctaggcc

SEQ ID NO: 7137512 - DNA, 22 bp, Homo sapiens
gggagtggggcttaccttgaag

SEQ ID NO: 7137513 - DNA, 22 bp, Homo sapiens
gggagtgggtttggcctaggcc

SEQ ID NO: 7137514 - DNA, 22 bp, Homo sapiens
gggagtggggcttaccttgaag

SEQ ID NO: 7137515 - DNA, 22 bp, Homo sapiens
gggagtggggcttaccttgaag

SEQ ID NO: 7137516 - DNA, 22 bp, Homo sapiens
gggagtggattatgtggaccca

SEQ ID NO: 7137517 - DNA, 22 bp, Homo sapiens
gggagtggggcttaccttgaag

SEQ ID NO: 7137518 - DNA, 22 bp, Homo sapiens
gggagtggggcttaccttgaag

SEQ ID NO: 7137519 - DNA, 22 bp, Homo sapiens
gggagtgggtttggcctaggcc

SEQ ID NO: 7137520 - DNA, 22 bp, Homo sapiens
gggagtgggtttggcctaggcc

SEQ ID NO: 7137521 - DNA, 22 bp, Homo sapiens
gggagtgggtttggcctaggcc

SEQ ID NO: 7137522 - DNA, 22 bp, Homo sapiens
gggagtgggtttggcctaggcc

SEQ ID NO: 7137523 - DNA, 20 bp, Homo sapiens
gggagtggtggtagcctgtg

SEQ ID NO: 7137524 - DNA, 22 bp, Homo sapiens
gggagtggtcctttcctatctg

SEQ ID NO: 7137525 - DNA, 22 bp, Homo sapiens
gggagtggtcctttcctatctg

SEQ ID NO: 7137526 - DNA, 20 bp, Homo sapiens
gggagtggtggtagcctgtg

SEQ ID NO: 7137527 - DNA, 22 bp, Homo sapiens
gggagtgggtttggcctaggcc

SEQ ID NO: 7137528 - DNA, 22 bp, Homo sapiens
gggagtgggtttggcctaggcc

SEQ ID NO: 7137529 - DNA, 22 bp, Homo sapiens
gggagtgggtttggcctaggcc

SEQ ID NO: 7137530 - DNA, 22 bp, Homo sapiens
gggagtggttgatggtgaaaat

SEQ ID NO: 7137531 - DNA, 22 bp, Homo sapiens
gggagtggttgatggtgaaaat

SEQ ID NO: 7137532 - DNA, 20 bp, Homo sapiens
gggagtggtggtagcctgtg

SEQ ID NO: 7137533 - DNA, 18 bp, Homo sapiens
gggaagccgggaagccgg

SEQ ID NO: 7137534 - DNA, 22 bp, Homo sapiens
gggaaggaggtggcttgaagtg

SEQ ID NO: 7137535 - DNA, 22 bp, Homo sapiens
gggaagccatgctcagaggtac

SEQ ID NO: 7137536 - DNA, 22 bp, Homo sapiens
gggaagcatctgagggtccact

SEQ ID NO: 7137537 - DNA, 22 bp, Homo sapiens
gggaaggcaccatggtgttcca

SEQ ID NO: 7137538 - DNA, 22 bp, Homo sapiens
gggaaggcaccatggtgttcca

SEQ ID NO: 7137539 - DNA, 22 bp, Homo sapiens
gggaaggcaggattctctggtg

SEQ ID NO: 7137540 - DNA, 22 bp, Homo sapiens
gggaaggcagtgtctggttgaa

SEQ ID NO: 7137541 - DNA, 22 bp, Homo sapiens
gggaaggcagtgtctggttgaa

SEQ ID NO: 7137542 - DNA, 22 bp, Homo sapiens
gggaaggcagtgtctggttgaa

SEQ ID NO: 7137543 - DNA, 22 bp, Homo sapiens
gggaaggcatacctgagggaga

SEQ ID NO: 7137544 - DNA, 22 bp, Homo sapiens
gggaaggcatacctgagggaga

SEQ ID NO: 7137545 - DNA, 22 bp, Homo sapiens
gggaaggcatacctgagggaga

SEQ ID NO: 7137546 - DNA, 22 bp, Homo sapiens
gggaaggcaggcctctgttgga

SEQ ID NO: 7137547 - DNA, 22 bp, Homo sapiens
gggaaggcagtgggaggaactg

SEQ ID NO: 7137548 - DNA, 22 bp, Homo sapiens
gggaagcagcattgtgctggct

SEQ ID NO: 7137549 - DNA, 22 bp, Homo sapiens
gggaagatagtgttgagggccc

SEQ ID NO: 7137550 - DNA, 22 bp, Homo sapiens
gggaagcagatcataccagacc

SEQ ID NO: 7137551 - DNA, 22 bp, Homo sapiens
gggaagcagcattgtgctggct

SEQ ID NO: 7137552 - DNA, 22 bp, Homo sapiens
gggaagcagcattgtgctggct

SEQ ID NO: 7137553 - DNA, 22 bp, Homo sapiens
gggaagatagtgttgagggccc

SEQ ID NO: 7137554 - DNA, 22 bp, Homo sapiens
gggaagatagtgttgagggccc

SEQ ID NO: 7137555 - DNA, 22 bp, Homo sapiens
gggaagatagtgttgagggccc

SEQ ID NO: 7137556 - DNA, 22 bp, Homo sapiens
gggaagagtgtcggttgaagtg

SEQ ID NO: 7137557 - DNA, 22 bp, Homo sapiens
gggaagagtgtcggttgaagtg

SEQ ID NO: 7137558 - DNA, 22 bp, Homo sapiens
gggaagatagtgttgagggccc

SEQ ID NO: 7137559 - DNA, 22 bp, Homo sapiens
gggaagagggagctggaatgat

SEQ ID NO: 7137560 - DNA, 22 bp, Homo sapiens
gggaagagggagctggaatgat

SEQ ID NO: 7137561 - DNA, 22 bp, Homo sapiens
gggaagagtaactagcccatgt

SEQ ID NO: 7137562 - DNA, 22 bp, Homo sapiens
gggaagagtaactagcccatgt

SEQ ID NO: 7137563 - DNA, 22 bp, Homo sapiens
gggaagagtaactagcccatgt

SEQ ID NO: 7137564 - DNA, 22 bp, Homo sapiens
gggaagagtaactagcccatgt

SEQ ID NO: 7137565 - DNA, 22 bp, Homo sapiens
gggaagagtaactagcccatgt

SEQ ID NO: 7137566 - DNA, 22 bp, Homo sapiens
gggaagagtgtcggttgaagtg

SEQ ID NO: 7137567 - DNA, 22 bp, Homo sapiens
gggaagagtgtcggttgaagtg

SEQ ID NO: 7137568 - DNA, 23 bp, Homo sapiens
gggagccaggacctcgcgcccca

SEQ ID NO: 7137569 - DNA, 23 bp, Homo sapiens
gggagccaggacctcgcgcccca

SEQ ID NO: 7137570 - DNA, 22 bp, Homo sapiens
gggagccagcctttgcctataa

SEQ ID NO: 7137571 - DNA, 22 bp, Homo sapiens
gggagccatgctggtcttcttt

SEQ ID NO: 7137572 - DNA, 23 bp, Homo sapiens
gggagccatgggtggtcatggag

SEQ ID NO: 7137573 - DNA, 23 bp, Homo sapiens
gggagccatgggtggtcatggag

SEQ ID NO: 7137574 - DNA, 22 bp, Homo sapiens
gggagccagcagggcatggagc

SEQ ID NO: 7137575 - DNA, 22 bp, Homo sapiens
gggagccagagtcacctagaga

SEQ ID NO: 7137576 - DNA, 22 bp, Homo sapiens
gggagccagcagggcatggagc

SEQ ID NO: 7137577 - DNA, 22 bp, Homo sapiens
gggagccagcagggcatggagc

SEQ ID NO: 7137578 - DNA, 22 bp, Homo sapiens
gggagccagcagggcatggagc

SEQ ID NO: 7137579 - DNA, 22 bp, Homo sapiens
gggagccagcagggcatggagc

SEQ ID NO: 7137580 - DNA, 22 bp, Homo sapiens
gggagccactcagctgagagtt

SEQ ID NO: 7137581 - DNA, 22 bp, Homo sapiens
gggagccactcagctgagagtt

SEQ ID NO: 7137582 - DNA, 22 bp, Homo sapiens
gggagatgactcagtgacctcg

SEQ ID NO: 7137583 - DNA, 22 bp, Homo sapiens
gggagatggctcagaggccgcg

SEQ ID NO: 7137584 - DNA, 22 bp, Homo sapiens
gggagatggctcagaggccgcg

SEQ ID NO: 7137585 - DNA, 22 bp, Homo sapiens
gggagatggctcagaggccgcg

SEQ ID NO: 7137586 - DNA, 22 bp, Homo sapiens
gggagatggctcagaggccgcg

SEQ ID NO: 7137587 - DNA, 22 bp, Homo sapiens
gggaaggccttgtcagcggatt

SEQ ID NO: 7137588 - DNA, 22 bp, Homo sapiens
gggaaggccttgtcagcggatt

SEQ ID NO: 7137589 - DNA, 22 bp, Homo sapiens
gggagatgactcagtgacctcg

SEQ ID NO: 7137590 - DNA, 22 bp, Homo sapiens
gggaaggccggtccagtcaggt

SEQ ID NO: 7137591 - DNA, 22 bp, Homo sapiens
gggaaggccggtccagtcaggt

SEQ ID NO: 7137592 - DNA, 22 bp, Homo sapiens
gggaaggcatacctgagggaga

SEQ ID NO: 7137593 - DNA, 22 bp, Homo sapiens
gggaaggccggtccagtcaggt

SEQ ID NO: 7137594 - DNA, 22 bp, Homo sapiens
gggaaggccggtccagtcaggt

SEQ ID NO: 7137595 - DNA, 22 bp, Homo sapiens
gggagccacagtgaggtgcatg

SEQ ID NO: 7137596 - DNA, 22 bp, Homo sapiens
gggagccacagtgaggtgcatg

SEQ ID NO: 7137597 - DNA, 22 bp, Homo sapiens
gggagccacagtttatagtgat

SEQ ID NO: 7137598 - DNA, 23 bp, Homo sapiens
gggagatgggaaatgaaggctct

SEQ ID NO: 7137599 - DNA, 23 bp, Homo sapiens
gggagatgggaaatgaaggctct

SEQ ID NO: 7137600 - DNA, 23 bp, Homo sapiens
gggagatgggaaatgaaggctct

SEQ ID NO: 7137601 - DNA, 22 bp, Homo sapiens
gggagccacagtagcagctact

SEQ ID NO: 7137602 - DNA, 22 bp, Homo sapiens
gggagccacagtgaggtgcatg

SEQ ID NO: 7137603 - DNA, 22 bp, Homo sapiens
gggagccacagtgaggtgcatg

SEQ ID NO: 7137604 - DNA, 22 bp, Homo sapiens
gggagccacagtgaggtgcatg

SEQ ID NO: 7137605 - DNA, 22 bp, Homo sapiens
gggaagagggagctggaatgat

SEQ ID NO: 7137606 - DNA, 22 bp, Homo sapiens
gggaagagggagctggaatgat

SEQ ID NO: 7137607 - DNA, 22 bp, Homo sapiens
gggaagagggagctggaatgat

SEQ ID NO: 7137608 - DNA, 22 bp, Homo sapiens
gggaagagggagctggaatgat

SEQ ID NO: 7137609 - DNA, 22 bp, Homo sapiens
gggaagagggagctggaatgat

SEQ ID NO: 7137610 - DNA, 22 bp, Homo sapiens
gggaagagggagctggaatgat

SEQ ID NO: 7137611 - DNA, 22 bp, Homo sapiens
gggaagagggagctggaatgat

SEQ ID NO: 7137612 - DNA, 22 bp, Homo sapiens
gggaagagggagctggaatgat

SEQ ID NO: 7137613 - DNA, 22 bp, Homo sapiens
ggctgtggtctgggtgctcccc

SEQ ID NO: 7137614 - DNA, 22 bp, Homo sapiens
ggctgtggtcattaggaggttg

SEQ ID NO: 7137615 - DNA, 22 bp, Homo sapiens
ggctgtggtctgggtgctcccc

SEQ ID NO: 7137616 - DNA, 22 bp, Homo sapiens
ggctgtggtcattaggaggttg

SEQ ID NO: 7137617 - DNA, 22 bp, Homo sapiens
ggctgtggtcattaggaggttg

SEQ ID NO: 7137618 - DNA, 22 bp, Homo sapiens
ggctgtgggtgtgacaggcctc

SEQ ID NO: 7137619 - DNA, 22 bp, Homo sapiens
ggctgtggtcattaggaggttg

SEQ ID NO: 7137620 - DNA, 22 bp, Homo sapiens
ggctgtggtcattaggaggttg

SEQ ID NO: 7137621 - DNA, 22 bp, Homo sapiens
ggctgtggtcattaggaggttg

SEQ ID NO: 7137622 - DNA, 22 bp, Homo sapiens
ggctgtggggccgggtacagtg

SEQ ID NO: 7137623 - DNA, 22 bp, Homo sapiens
ggctgtggggggagcctgcccg

SEQ ID NO: 7137624 - DNA, 22 bp, Homo sapiens
ggctgtgggtgtgacaggcctc

SEQ ID NO: 7137625 - DNA, 22 bp, Homo sapiens
ggctgtgggtgtgacaggcctc

SEQ ID NO: 7137626 - DNA, 22 bp, Homo sapiens
ggctgtggggggagcctgcccg

SEQ ID NO: 7137627 - DNA, 22 bp, Homo sapiens
ggctgtggggccgggtacagtg

SEQ ID NO: 7137628 - DNA, 22 bp, Homo sapiens
ggctgtggggccgggtacagtg

SEQ ID NO: 7137629 - DNA, 22 bp, Homo sapiens
ggctgtggggaccaacaggact

SEQ ID NO: 7137630 - DNA, 22 bp, Homo sapiens
ggctgtggggaccaacaggact

SEQ ID NO: 7137631 - DNA, 22 bp, Homo sapiens
ggctgtggggaccaacaggact

SEQ ID NO: 7137632 - DNA, 22 bp, Homo sapiens
ggctgtggggaccaacaggact

SEQ ID NO: 7137633 - DNA, 22 bp, Homo sapiens
ggctgtggccagcggggctgag

SEQ ID NO: 7137634 - DNA, 22 bp, Homo sapiens
ggctgtggccagcggggctgag

SEQ ID NO: 7137635 - DNA, 22 bp, Homo sapiens
ggctgtggccagcggggctgag

SEQ ID NO: 7137636 - DNA, 22 bp, Homo sapiens
ggctgtggccagcggggctgag

SEQ ID NO: 7137637 - DNA, 22 bp, Homo sapiens
ggctgtggccagcggggctgag

SEQ ID NO: 7137638 - DNA, 22 bp, Homo sapiens
ggctgtggccagcggggctgag

SEQ ID NO: 7137639 - DNA, 22 bp, Homo sapiens
ggctgtgggatgcataggagct

SEQ ID NO: 7137640 - DNA, 22 bp, Homo sapiens
ggctgtgggatgcataggagct

SEQ ID NO: 7137641 - DNA, 22 bp, Homo sapiens
ggctgtgggatgcataggagct

SEQ ID NO: 7137642 - DNA, 22 bp, Homo sapiens
ggctgtgggatgcataggagct

SEQ ID NO: 7137643 - DNA, 22 bp, Homo sapiens
ggctgtgggatgcataggagct

SEQ ID NO: 7137644 - DNA, 22 bp, Homo sapiens
ggctgtgggccagctagaccct

SEQ ID NO: 7137645 - DNA, 22 bp, Homo sapiens
ggctgtggcattaggtgaggcc

SEQ ID NO: 7137646 - DNA, 22 bp, Homo sapiens
ggctgtggcattaggtgaggcc

SEQ ID NO: 7137647 - DNA, 22 bp, Homo sapiens
ggctgtggcattaggtgaggcc

SEQ ID NO: 7137648 - DNA, 22 bp, Homo sapiens
ggctgtggcattaggtgaggcc

SEQ ID NO: 7137649 - DNA, 22 bp, Homo sapiens
ggctgtggcattaggtgaggcc

SEQ ID NO: 7137650 - DNA, 22 bp, Homo sapiens
ggctgtggcagctggaagtggt

SEQ ID NO: 7137651 - DNA, 22 bp, Homo sapiens
ggctgtggcagctggaagtggt

SEQ ID NO: 7137652 - DNA, 22 bp, Homo sapiens
ggctgtggcagctggaagtggt

SEQ ID NO: 7137653 - DNA, 22 bp, Homo sapiens
ggctgtggcagctggaagtggt

SEQ ID NO: 7137654 - DNA, 22 bp, Homo sapiens
ggctgtggcattaggtgaggcc

SEQ ID NO: 7137655 - DNA, 22 bp, Homo sapiens
ggctgtggcattaggtgaggcc

SEQ ID NO: 7137656 - DNA, 22 bp, Homo sapiens
ggctgtggcattaggtgaggcc

SEQ ID NO: 7137657 - DNA, 22 bp, Homo sapiens
ggctgtggcattaggtgaggcc

SEQ ID NO: 7137658 - DNA, 22 bp, Homo sapiens
ggctgtggcattaggtgaggcc

SEQ ID NO: 7137659 - DNA, 22 bp, Homo sapiens
ggctgtggcagctggaagtggt

SEQ ID NO: 7137660 - DNA, 22 bp, Homo sapiens
ggctgtggcagctggaagtggt

SEQ ID NO: 7137661 - DNA, 22 bp, Homo sapiens
ggctgtggcagctggaagtggt

SEQ ID NO: 7137662 - DNA, 22 bp, Homo sapiens
ggctgtggcagctggaagtggt

SEQ ID NO: 7137663 - DNA, 22 bp, Homo sapiens
ggctgtggcagctggaagtggt

SEQ ID NO: 7137664 - DNA, 21 bp, Homo sapiens
ggctgtggagccatgactcac

SEQ ID NO: 7137665 - DNA, 22 bp, Homo sapiens
ggctgtggagctgcagagttgg

SEQ ID NO: 7137666 - DNA, 22 bp, Homo sapiens
ggctgtggcagctggaagtggt

SEQ ID NO: 7137667 - DNA, 22 bp, Homo sapiens
ggctgtgcgtcatccggctgca

SEQ ID NO: 7137668 - DNA, 22 bp, Homo sapiens
ggctgtgcgtcatccggctgca

SEQ ID NO: 7137669 - DNA, 18 bp, Homo sapiens
ggctgtgcgtggaggctg

SEQ ID NO: 7137670 - DNA, 18 bp, Homo sapiens
ggctgtgcgtggaggctg

SEQ ID NO: 7137671 - DNA, 23 bp, Homo sapiens
ggctggcccggggctgctcctga

SEQ ID NO: 7137672 - DNA, 22 bp, Homo sapiens
ggctgtgcgggcagccgtggga

SEQ ID NO: 7137673 - DNA, 22 bp, Homo sapiens
ggctgtgcgggcagccgtggga

SEQ ID NO: 7137674 - DNA, 22 bp, Homo sapiens
ggctgtgcgggcagccgtggga

SEQ ID NO: 7137675 - DNA, 22 bp, Homo sapiens
ggctgtgctgagggggaagccc

SEQ ID NO: 7137676 - DNA, 18 bp, Homo sapiens
ggctgtgcgtggaggctg

SEQ ID NO: 7137677 - DNA, 18 bp, Homo sapiens
ggctgtgcgtggaggctg

SEQ ID NO: 7137678 - DNA, 22 bp, Homo sapiens
ggctgtgctgagggggaagccc

SEQ ID NO: 7137679 - DNA, 22 bp, Homo sapiens
ggctgtgctgagggggaagccc

SEQ ID NO: 7137680 - DNA, 22 bp, Homo sapiens
ggctgtgctttgcccaaagggc

SEQ ID NO: 7137681 - DNA, 22 bp, Homo sapiens
ggctgtgctgagggggaagccc

SEQ ID NO: 7137682 - DNA, 22 bp, Homo sapiens
ggctgtggacactgagctcaga

SEQ ID NO: 7137683 - DNA, 22 bp, Homo sapiens
ggctgtggacactgagctcaga

SEQ ID NO: 7137684 - DNA, 22 bp, Homo sapiens
ggctgtggacactgagctcaga

SEQ ID NO: 7137685 - DNA, 22 bp, Homo sapiens
ggctgtggacactgagctcaga

SEQ ID NO: 7137686 - DNA, 22 bp, Homo sapiens
ggctggcagaggggagtctgtg

SEQ ID NO: 7137687 - DNA, 22 bp, Homo sapiens
ggctggcagaggggagtctgtg

SEQ ID NO: 7137688 - DNA, 22 bp, Homo sapiens
ggctggcaggcacagtatgcaa

SEQ ID NO: 7137689 - DNA, 22 bp, Homo sapiens
ggctggcaggactcacacttgg

SEQ ID NO: 7137690 - DNA, 22 bp, Homo sapiens
ggctggcagcttcatcccagat

SEQ ID NO: 7137691 - DNA, 22 bp, Homo sapiens
ggctggcagcttcatcccagat

SEQ ID NO: 7137692 - DNA, 22 bp, Homo sapiens
ggctggcagtgtgagagaggga

SEQ ID NO: 7137693 - DNA, 22 bp, Homo sapiens
ggctggcaggggatgtcagatg

SEQ ID NO: 7137694 - DNA, 22 bp, Homo sapiens
ggctggcatttacacaatgcat

SEQ ID NO: 7137695 - DNA, 22 bp, Homo sapiens
ggctggcattgctctattgcct

SEQ ID NO: 7137696 - DNA, 22 bp, Homo sapiens
ggctggccagggccctcgctgg

SEQ ID NO: 7137697 - DNA, 22 bp, Homo sapiens
ggctggcattgctctattgcct

SEQ ID NO: 7137698 - DNA, 22 bp, Homo sapiens
ggctggcatccagggaaatcca

SEQ ID NO: 7137699 - DNA, 22 bp, Homo sapiens
ggctggcagttaatacctgaag

SEQ ID NO: 7137700 - DNA, 19 bp, Homo sapiens
ggctggagtggccatctgt

SEQ ID NO: 7137701 - DNA, 19 bp, Homo sapiens
ggctggagtggccatctgt

SEQ ID NO: 7137702 - DNA, 22 bp, Homo sapiens
ggctggagtgggctccagagtt

SEQ ID NO: 7137703 - DNA, 22 bp, Homo sapiens
ggctggagtgggctccagagtt

SEQ ID NO: 7137704 - DNA, 22 bp, Homo sapiens
ggctggataccaggagacaggg

SEQ ID NO: 7137705 - DNA, 22 bp, Homo sapiens
ggctggcagaagtgtgctggct

SEQ ID NO: 7137706 - DNA, 22 bp, Homo sapiens
ggctggaggtagaagaacactt

SEQ ID NO: 7137707 - DNA, 19 bp, Homo sapiens
ggctggagtggccatctgt

SEQ ID NO: 7137708 - DNA, 19 bp, Homo sapiens
ggctggagtggccatctgt

SEQ ID NO: 7137709 - DNA, 22 bp, Homo sapiens
ggctggaggtagaagaacactt

SEQ ID NO: 7137710 - DNA, 17 bp, Homo sapiens
ggctggaggggacccgg

SEQ ID NO: 7137711 - DNA, 22 bp, Homo sapiens
ggctggaggagaatgggtgtga

SEQ ID NO: 7137712 - DNA, 22 bp, Homo sapiens
ggctggaggagaatgggtgtga

SEQ ID NO: 7137713 - DNA, 17 bp, Homo sapiens
ggctggaggggacccgg

SEQ ID NO: 7137714 - DNA, 17 bp, Homo sapiens
ggctggaggggacccgg

SEQ ID NO: 7137715 - DNA, 22 bp, Homo sapiens
ggctggaggagaatgggtgtga

SEQ ID NO: 7137716 - DNA, 17 bp, Homo sapiens
ggctggagcagctcccc

SEQ ID NO: 7137717 - DNA, 22 bp, Homo sapiens
ggctggaggagaatgggtgtga

SEQ ID NO: 7137718 - DNA, 22 bp, Homo sapiens
ggctggaggagaatgggtgtga

SEQ ID NO: 7137719 - DNA, 22 bp, Homo sapiens
ggctggaggagaatgggtgtga

SEQ ID NO: 7137720 - DNA, 22 bp, Homo sapiens
ggctggagatatgtctggaaca

SEQ ID NO: 7137721 - DNA, 17 bp, Homo sapiens
ggctggagcagctcccc

SEQ ID NO: 7137722 - DNA, 17 bp, Homo sapiens
ggctggagcagctcccc

SEQ ID NO: 7137723 - DNA, 22 bp, Homo sapiens
ggctggagacaacgtcctgccc

SEQ ID NO: 7137724 - DNA, 22 bp, Homo sapiens
ggctggagacaacgtcctgccc

SEQ ID NO: 7137725 - DNA, 22 bp, Homo sapiens
ggctggagacaacgtcctgccc

SEQ ID NO: 7137726 - DNA, 22 bp, Homo sapiens
ggctgcctgctcctcctgcacg

SEQ ID NO: 7137727 - DNA, 22 bp, Homo sapiens
ggctgcctggacctcctctttc

SEQ ID NO: 7137728 - DNA, 19 bp, Homo sapiens
ggctgcctggagcgagggc

SEQ ID NO: 7137729 - DNA, 22 bp, Homo sapiens
ggctgcctctgatgtgcagacg

SEQ ID NO: 7137730 - DNA, 22 bp, Homo sapiens
ggctgcctctggaagctggaga

SEQ ID NO: 7137731 - DNA, 22 bp, Homo sapiens
ggctgcctgaactttggggaaa

SEQ ID NO: 7137732 - DNA, 22 bp, Homo sapiens
ggctgcctgaggctgaggcccg

SEQ ID NO: 7137733 - DNA, 22 bp, Homo sapiens
ggctgcctgaggctgaggcccg

SEQ ID NO: 7137734 - DNA, 22 bp, Homo sapiens
ggctgcctgccgcccacttggc

SEQ ID NO: 7137735 - DNA, 22 bp, Homo sapiens
ggctgcctgcctccaagccggg

SEQ ID NO: 7137736 - DNA, 22 bp, Homo sapiens
ggctgcctgctcaggtgcggcg

SEQ ID NO: 7137737 - DNA, 22 bp, Homo sapiens
ggctgcctgctcaggtgcggcg

SEQ ID NO: 7137738 - DNA, 22 bp, Homo sapiens
ggctgcctgctcctcctgcacg

SEQ ID NO: 7137739 - DNA, 21 bp, Homo sapiens
ggctgcagggagccctggggt

SEQ ID NO: 7137740 - DNA, 21 bp, Homo sapiens
ggctgcagggagccctggggt

SEQ ID NO: 7137741 - DNA, 21 bp, Homo sapiens
ggctgcagggagccctggggt

SEQ ID NO: 7137742 - DNA, 21 bp, Homo sapiens
ggctgcagggagccctggggt

SEQ ID NO: 7137743 - DNA, 22 bp, Homo sapiens
ggctctgctcacagcccgcagc

SEQ ID NO: 7137744 - DNA, 22 bp, Homo sapiens
ggctctgcggcgtgtgcgcagg

SEQ ID NO: 7137745 - DNA, 22 bp, Homo sapiens
ggctctgcggcgtgtgcgcagg

SEQ ID NO: 7137746 - DNA, 22 bp, Homo sapiens
ggctctgcgcctgcggggactt

SEQ ID NO: 7137747 - DNA, 22 bp, Homo sapiens
ggctctgcgcggtaaagtgact

SEQ ID NO: 7137748 - DNA, 22 bp, Homo sapiens
ggctctgcgcggtaaagtgact

SEQ ID NO: 7137749 - DNA, 22 bp, Homo sapiens
ggctgcaggcttccctccagca

SEQ ID NO: 7137750 - DNA, 22 bp, Homo sapiens
ggctgcaggcttccctccagca

SEQ ID NO: 7137751 - DNA, 22 bp, Homo sapiens
ggctgcaggttggttggcagct

SEQ ID NO: 7137752 - DNA, 22 bp, Homo sapiens
ggctgcaggttggttggcagct

SEQ ID NO: 7137753 - DNA, 22 bp, Homo sapiens
ggctgcagggcagctggtgtgg

SEQ ID NO: 7137754 - DNA, 22 bp, Homo sapiens
ggctgcaggttggttggcagct

SEQ ID NO: 7137755 - DNA, 17 bp, Homo sapiens
ggctgcagtccaggagg

SEQ ID NO: 7137756 - DNA, 17 bp, Homo sapiens
ggctgcagtccaggagg

SEQ ID NO: 7137757 - DNA, 20 bp, Homo sapiens
ggctgcagtgcacctcatct

SEQ ID NO: 7137758 - DNA, 17 bp, Homo sapiens
ggctgcagtccaggagg

SEQ ID NO: 7137759 - DNA, 22 bp, Homo sapiens
ggctgcagttgtgtgaaggccg

SEQ ID NO: 7137760 - DNA, 22 bp, Homo sapiens
ggctgcagttgtgtgaaggccg

SEQ ID NO: 7137761 - DNA, 22 bp, Homo sapiens
ggctgcagttgtgtgaaggccg

SEQ ID NO: 7137762 - DNA, 22 bp, Homo sapiens
ggctgcagttgtgtgaaggccg

SEQ ID NO: 7137763 - DNA, 22 bp, Homo sapiens
ggctgcagttgtgtgaaggccg

SEQ ID NO: 7137764 - DNA, 22 bp, Homo sapiens
ggctgcagttgtgtgaaggccg

SEQ ID NO: 7137765 - DNA, 22 bp, Homo sapiens
ggctgcataggcagaagctgtg

SEQ ID NO: 7137766 - DNA, 22 bp, Homo sapiens
ggctgccacgtcgagggtccaa

SEQ ID NO: 7137767 - DNA, 22 bp, Homo sapiens
ggctgccagcactggtgtagag

SEQ ID NO: 7137768 - DNA, 22 bp, Homo sapiens
ggctgccagcactggtgtagag

SEQ ID NO: 7137769 - DNA, 22 bp, Homo sapiens
ggctgccaggagaagctcagtg

SEQ ID NO: 7137770 - DNA, 22 bp, Homo sapiens
ggctgccaggagggaggccagt

SEQ ID NO: 7137771 - DNA, 22 bp, Homo sapiens
ggctgccaggagggaggccagt

SEQ ID NO: 7137772 - DNA, 22 bp, Homo sapiens
ggctgccagtgagtgcagaccg

SEQ ID NO: 7137773 - DNA, 22 bp, Homo sapiens
ggctgccataacagagtaccac

SEQ ID NO: 7137774 - DNA, 22 bp, Homo sapiens
ggctgccagtgagtgcagaccg

SEQ ID NO: 7137775 - DNA, 22 bp, Homo sapiens
ggctgcctccactgcttgtccc

SEQ ID NO: 7137776 - DNA, 22 bp, Homo sapiens
ggctgcctccactgcttgtccc

SEQ ID NO: 7137777 - DNA, 22 bp, Homo sapiens
ggctgcctcccaggagaatctg

SEQ ID NO: 7137778 - DNA, 22 bp, Homo sapiens
ggctgcctcctcgagacaggat

SEQ ID NO: 7137779 - DNA, 22 bp, Homo sapiens
ggctgcctcctgctgggctgga

SEQ ID NO: 7137780 - DNA, 22 bp, Homo sapiens
ggctgcctcctgctgggctgga

SEQ ID NO: 7137781 - DNA, 19 bp, Homo sapiens
ggctgcctcctgggagatt

SEQ ID NO: 7137782 - DNA, 20 bp, Homo sapiens
ggctgcctccttcctttcct

SEQ ID NO: 7137783 - DNA, 20 bp, Homo sapiens
ggctgcctccttcctttcct

SEQ ID NO: 7137784 - DNA, 18 bp, Homo sapiens
ggcaggggtgaaccacag

SEQ ID NO: 7137785 - DNA, 22 bp, Homo sapiens
ggcagtgagaggtctcctggtc

SEQ ID NO: 7137786 - DNA, 22 bp, Homo sapiens
ggcagtgagctggagggaagga

SEQ ID NO: 7137787 - DNA, 22 bp, Homo sapiens
ggcagtgagctggagggaagga

SEQ ID NO: 7137788 - DNA, 22 bp, Homo sapiens
ggcagtgagaggtctcctggtc

SEQ ID NO: 7137789 - DNA, 22 bp, Homo sapiens
ggcagtgagctggagggaagga

SEQ ID NO: 7137790 - DNA, 22 bp, Homo sapiens
ggcagtgagtcccggagaggcc

SEQ ID NO: 7137791 - DNA, 22 bp, Homo sapiens
ggcagtgagtcccggagaggcc

SEQ ID NO: 7137792 - DNA, 21 bp, Homo sapiens
ggcagtgatgtgaagtgcatc

SEQ ID NO: 7137793 - DNA, 22 bp, Homo sapiens
ggcagtgatgtcaaacagtgaa

SEQ ID NO: 7137794 - DNA, 22 bp, Homo sapiens
ggcagtgcaaggcagcctggat

SEQ ID NO: 7137795 - DNA, 22 bp, Homo sapiens
ggcagtgcaaggcagcctggat

SEQ ID NO: 7137796 - DNA, 22 bp, Homo sapiens
ggcagtgcaaggctggcacagt

SEQ ID NO: 7137797 - DNA, 22 bp, Homo sapiens
ggcagtgccactaagctctgct

SEQ ID NO: 7137798 - DNA, 22 bp, Homo sapiens
ggcagtgcccggtgcctcctct

SEQ ID NO: 7137799 - DNA, 17 bp, Homo sapiens
ggcagtggaggaagaga

SEQ ID NO: 7137800 - DNA, 17 bp, Homo sapiens
ggcagtggaggaagaga

SEQ ID NO: 7137801 - DNA, 17 bp, Homo sapiens
ggcagtggaggaagaga

SEQ ID NO: 7137802 - DNA, 17 bp, Homo sapiens
ggcagtggaggaagaga

SEQ ID NO: 7137803 - DNA, 17 bp, Homo sapiens
ggcagtggaggaagaga

SEQ ID NO: 7137804 - DNA, 17 bp, Homo sapiens
ggcagtggaggaagaga

SEQ ID NO: 7137805 - DNA, 22 bp, Homo sapiens
ggcagtggcagagcttggtcta

SEQ ID NO: 7137806 - DNA, 22 bp, Homo sapiens
ggcagtggcagagcttggtcta

SEQ ID NO: 7137807 - DNA, 22 bp, Homo sapiens
ggcagtggcagagcttggtcta

SEQ ID NO: 7137808 - DNA, 22 bp, Homo sapiens
ggcagtggcagagcttggtcta

SEQ ID NO: 7137809 - DNA, 22 bp, Homo sapiens
ggcaggggtcctggtgttgact

SEQ ID NO: 7137810 - DNA, 22 bp, Homo sapiens
ggcaggggtcctggtgttgact

SEQ ID NO: 7137811 - DNA, 22 bp, Homo sapiens
ggcagggcttgtctctgtgatg

SEQ ID NO: 7137812 - DNA, 22 bp, Homo sapiens
ggcaggggtcctggtgttgact

SEQ ID NO: 7137813 - DNA, 18 bp, Homo sapiens
ggcaggggtgaaccacag

SEQ ID NO: 7137814 - DNA, 22 bp, Homo sapiens
ggcaggggtcctggtgttgact

SEQ ID NO: 7137815 - DNA, 22 bp, Homo sapiens
ggcaggggtcctggtgttgact

SEQ ID NO: 7137816 - DNA, 22 bp, Homo sapiens
ggcagggagagcatgctgataa

SEQ ID NO: 7137817 - DNA, 20 bp, Homo sapiens
ggcagggcatcaacagctct

SEQ ID NO: 7137818 - DNA, 20 bp, Homo sapiens
ggcagggcatcaacagctct

SEQ ID NO: 7137819 - DNA, 20 bp, Homo sapiens
ggcagggcatcaacagctct

SEQ ID NO: 7137820 - DNA, 22 bp, Homo sapiens
ggcagggcttgtctctgtgatg

SEQ ID NO: 7137821 - DNA, 22 bp, Homo sapiens
ggcagggcttgtctctgtgatg

SEQ ID NO: 7137822 - DNA, 22 bp, Homo sapiens
ggcagggccctgattcctgggg

SEQ ID NO: 7137823 - DNA, 22 bp, Homo sapiens
ggcagggccctgattcctgggg

SEQ ID NO: 7137824 - DNA, 20 bp, Homo sapiens
ggcagggcatcaacagctct

SEQ ID NO: 7137825 - DNA, 22 bp, Homo sapiens
ggcagggccctgattcctgggg

SEQ ID NO: 7137826 - DNA, 22 bp, Homo sapiens
ggcagggccctgattcctgggg

SEQ ID NO: 7137827 - DNA, 22 bp, Homo sapiens
ggcagggccctgattcctgggg

SEQ ID NO: 7137828 - DNA, 22 bp, Homo sapiens
ggcagggaagctggcatcacgg

SEQ ID NO: 7137829 - DNA, 22 bp, Homo sapiens
ggcagggaagctggcatcacgg

SEQ ID NO: 7137830 - DNA, 22 bp, Homo sapiens
ggcagggacaggatagggtttt

SEQ ID NO: 7137831 - DNA, 22 bp, Homo sapiens
ggcagggacaggatagggtttt

SEQ ID NO: 7137832 - DNA, 22 bp, Homo sapiens
ggcagggacaggatagggtttt

SEQ ID NO: 7137833 - DNA, 22 bp, Homo sapiens
ggcagggactatgtttcatgga

SEQ ID NO: 7137834 - DNA, 22 bp, Homo sapiens
ggcagggactatgtttcatgga

SEQ ID NO: 7137835 - DNA, 22 bp, Homo sapiens
ggcagggactttgcaaatcttt

SEQ ID NO: 7137836 - DNA, 22 bp, Homo sapiens
ggcagggagagcatgctgataa

SEQ ID NO: 7137837 - DNA, 22 bp, Homo sapiens
ggcagggaaacagctgatccca

SEQ ID NO: 7137838 - DNA, 22 bp, Homo sapiens
ggcagggaagctggcatcacgg

SEQ ID NO: 7137839 - DNA, 22 bp, Homo sapiens
ggcagggaagctggcatcacgg

SEQ ID NO: 7137840 - DNA, 22 bp, Homo sapiens
ggcagggaagctggcatcacgg

SEQ ID NO: 7137841 - DNA, 22 bp, Homo sapiens
ggcagggaaacagctgatccca

SEQ ID NO: 7137842 - DNA, 18 bp, Homo sapiens
ggcagggaaaagataggg

SEQ ID NO: 7137843 - DNA, 22 bp, Homo sapiens
ggcagccttgagggaggcctgg

SEQ ID NO: 7137844 - DNA, 22 bp, Homo sapiens
ggcagccttgagggaggcctgg

SEQ ID NO: 7137845 - DNA, 20 bp, Homo sapiens
ggcagcgggttcgggcgcag

SEQ ID NO: 7137846 - DNA, 22 bp, Homo sapiens
ggcagctcactgattagcaatt

SEQ ID NO: 7137847 - DNA, 22 bp, Homo sapiens
ggcaggctgttcacctgctttt

SEQ ID NO: 7137848 - DNA, 22 bp, Homo sapiens
ggcaggctgttcacctgctttt

SEQ ID NO: 7137849 - DNA, 22 bp, Homo sapiens
ggcaggctgttcacctgctttt

SEQ ID NO: 7137850 - DNA, 22 bp, Homo sapiens
ggcaggcttgatatggggggac

SEQ ID NO: 7137851 - DNA, 22 bp, Homo sapiens
ggcaggcttgatatggggggac

SEQ ID NO: 7137852 - DNA, 22 bp, Homo sapiens
ggcaggcttgatatggggggac

SEQ ID NO: 7137853 - DNA, 22 bp, Homo sapiens
ggcaggcttgatatggggggac

SEQ ID NO: 7137854 - DNA, 22 bp, Homo sapiens
ggcaggcttgatatggggggac

SEQ ID NO: 7137855 - DNA, 22 bp, Homo sapiens
ggcaggcttggtggcaccggtt

SEQ ID NO: 7137856 - DNA, 22 bp, Homo sapiens
ggcaggcttggtggcaccggtt

SEQ ID NO: 7137857 - DNA, 22 bp, Homo sapiens
ggcaggcttggtggcaccggtt

SEQ ID NO: 7137858 - DNA, 20 bp, Homo sapiens
ggcaggctttatatggaggg

SEQ ID NO: 7137859 - DNA, 20 bp, Homo sapiens
ggcaggctttatatggaggg

SEQ ID NO: 7137860 - DNA, 20 bp, Homo sapiens
ggcaggctttatatggaggg

SEQ ID NO: 7137861 - DNA, 22 bp, Homo sapiens
ggcaggctttcagcatcaagtc

SEQ ID NO: 7137862 - DNA, 22 bp, Homo sapiens
ggcaggctttgagaaagagcat

SEQ ID NO: 7137863 - DNA, 18 bp, Homo sapiens
ggcagggaaaagataggg

SEQ ID NO: 7137864 - DNA, 18 bp, Homo sapiens
ggcagggaaaagataggg

SEQ ID NO: 7137865 - DNA, 18 bp, Homo sapiens
ggcagggaaaagataggg

SEQ ID NO: 7137866 - DNA, 22 bp, Homo sapiens
ggcagccttgactagtgactta

SEQ ID NO: 7137867 - DNA, 22 bp, Homo sapiens
ggcagccttgagggaggcctgg

SEQ ID NO: 7137868 - DNA, 22 bp, Homo sapiens
ggcagccttgagggaggcctgg

SEQ ID NO: 7137869 - DNA, 22 bp, Homo sapiens
ggcagccttgactagtgactta

SEQ ID NO: 7137870 - DNA, 22 bp, Homo sapiens
ggcagccttctctcataggtga

SEQ ID NO: 7137871 - DNA, 22 bp, Homo sapiens
ggcagccttgactagtgactta

SEQ ID NO: 7137872 - DNA, 22 bp, Homo sapiens
ggcagccttgactagtgactta

SEQ ID NO: 7137873 - DNA, 22 bp, Homo sapiens
ggcagccttctctcataggtga

SEQ ID NO: 7137874 - DNA, 18 bp, Homo sapiens
ggcagcctggacatgctc

SEQ ID NO: 7137875 - DNA, 18 bp, Homo sapiens
ggcagcctggacatgctc

SEQ ID NO: 7137876 - DNA, 19 bp, Homo sapiens
ggcagcctgcacgggctgc

SEQ ID NO: 7137877 - DNA, 18 bp, Homo sapiens
ggcagcctggacatgctc

SEQ ID NO: 7137878 - DNA, 19 bp, Homo sapiens
ggcagcctgcacgggctgc

SEQ ID NO: 7137879 - DNA, 19 bp, Homo sapiens
ggcagcctgcacgggctgc

SEQ ID NO: 7137880 - DNA, 22 bp, Homo sapiens
ggcagcctccagggcactggtg

SEQ ID NO: 7137881 - DNA, 23 bp, Homo sapiens
ggcagcctctgactctgctttgc

SEQ ID NO: 7137882 - DNA, 22 bp, Homo sapiens
ggcagcctccagggcactggtg

SEQ ID NO: 7137883 - DNA, 22 bp, Homo sapiens
ggcagcctccagggcactggtg

SEQ ID NO: 7137884 - DNA, 22 bp, Homo sapiens
ggcagcctccagggcactggtg

SEQ ID NO: 7137885 - DNA, 21 bp, Homo sapiens
ggcagcctctgtggaagggga

SEQ ID NO: 7137886 - DNA, 21 bp, Homo sapiens
ggcagcctctgtggaagggga

SEQ ID NO: 7137887 - DNA, 21 bp, Homo sapiens
ggcagcctctgtggaagggga

SEQ ID NO: 7137888 - DNA, 21 bp, Homo sapiens
ggcagcctgacccccagagag

SEQ ID NO: 7137889 - DNA, 21 bp, Homo sapiens
ggcagcctgacccccagagag

SEQ ID NO: 7137890 - DNA, 19 bp, Homo sapiens
ggcagcctgcacgggctgc

SEQ ID NO: 7137891 - DNA, 17 bp, Homo sapiens
ggcagcctcaggcgttt

SEQ ID NO: 7137892 - DNA, 17 bp, Homo sapiens
ggcagcctcaggcgttt

SEQ ID NO: 7137893 - DNA, 18 bp, Homo sapiens
ggcagcctacccacttgt

SEQ ID NO: 7137894 - DNA, 17 bp, Homo sapiens
ggcagcctcaggcgttt

SEQ ID NO: 7137895 - DNA, 17 bp, Homo sapiens
ggcagcctcaggcgttt

SEQ ID NO: 7137896 - DNA, 17 bp, Homo sapiens
ggcagcctcaggcgttt

SEQ ID NO: 7137897 - DNA, 22 bp, Homo sapiens
ggcagccctgtggagaggccca

SEQ ID NO: 7137898 - DNA, 22 bp, Homo sapiens
ggcagccctttctggccagctc

SEQ ID NO: 7137899 - DNA, 22 bp, Homo sapiens
ggcagccctttctggccagctc

SEQ ID NO: 7137900 - DNA, 21 bp, Homo sapiens
ggcagcccgccctctcctggc

SEQ ID NO: 7137901 - DNA, 22 bp, Homo sapiens
ggcagccatgtgggcagcgagt

SEQ ID NO: 7137902 - DNA, 22 bp, Homo sapiens
ggcagccatgtgggcagcgagt

SEQ ID NO: 7137903 - DNA, 22 bp, Homo sapiens
ggcagccatgtcccagggcttc

SEQ ID NO: 7137904 - DNA, 22 bp, Homo sapiens
ggcagccatgtcccagggcttc

SEQ ID NO: 7137905 - DNA, 22 bp, Homo sapiens
ggcagccatgtcccagggcttc

SEQ ID NO: 7137906 - DNA, 22 bp, Homo sapiens
ggcagccatgtcccagggcttc

SEQ ID NO: 7137907 - DNA, 22 bp, Homo sapiens
ggcagcagaactggccctgtat

SEQ ID NO: 7137908 - DNA, 22 bp, Homo sapiens
ggcagcagaactggccctgtat

SEQ ID NO: 7137909 - DNA, 22 bp, Homo sapiens
ggcagcactgcagcttgttggg

SEQ ID NO: 7137910 - DNA, 22 bp, Homo sapiens
ggcagcagaactggccctgtat

SEQ ID NO: 7137911 - DNA, 22 bp, Homo sapiens
ggcagcagaactggccctgtat

SEQ ID NO: 7137912 - DNA, 22 bp, Homo sapiens
ggcagcagaactggccctgtat

SEQ ID NO: 7137913 - DNA, 22 bp, Homo sapiens
ggcagcagacccctaagtctac

SEQ ID NO: 7137914 - DNA, 22 bp, Homo sapiens
ggcagcagacccctaagtctac

SEQ ID NO: 7137915 - DNA, 22 bp, Homo sapiens
ggcagcactgcagcttgttggg

SEQ ID NO: 7137916 - DNA, 22 bp, Homo sapiens
ggcagcactgcagcttgttggg

SEQ ID NO: 7137917 - DNA, 21 bp, Homo sapiens
ggcagcactacctgaagcata

SEQ ID NO: 7137918 - DNA, 22 bp, Homo sapiens
ggcagcacgacaggagtggaag

SEQ ID NO: 7137919 - DNA, 22 bp, Homo sapiens
ggcagcacgacaggagtggaag

SEQ ID NO: 7137920 - DNA, 21 bp, Homo sapiens
ggcagcactacctgaagcata

SEQ ID NO: 7137921 - DNA, 21 bp, Homo sapiens
ggcagcactacctgaagcata

SEQ ID NO: 7137922 - DNA, 20 bp, Homo sapiens
ggcagcaattcaccctatcc

SEQ ID NO: 7137923 - DNA, 22 bp, Homo sapiens
ggcagcaattcttcagaatcat

SEQ ID NO: 7137924 - DNA, 22 bp, Homo sapiens
ggcagcaaatattgtcagctgt

SEQ ID NO: 7137925 - DNA, 22 bp, Homo sapiens
ggcagcaaccaaccaggcattt

SEQ ID NO: 7137926 - DNA, 22 bp, Homo sapiens
ggcagatgttgcagtgagcaga

SEQ ID NO: 7137927 - DNA, 18 bp, Homo sapiens
ggcagcaagaagggaggg

SEQ ID NO: 7137928 - DNA, 22 bp, Homo sapiens
ggcagcaactcggagagaagag

SEQ ID NO: 7137929 - DNA, 22 bp, Homo sapiens
ggcagcaactcggagagaagag

SEQ ID NO: 7137930 - DNA, 22 bp, Homo sapiens
ggcagcaactcggagagaagag

SEQ ID NO: 7137931 - DNA, 22 bp, Homo sapiens
ggcagcaactcattattcctgt

SEQ ID NO: 7137932 - DNA, 22 bp, Homo sapiens
ggcagcaagtggtgggagactt

SEQ ID NO: 7137933 - DNA, 22 bp, Homo sapiens
ggcacgtgcctaaggagcaggc

SEQ ID NO: 7137934 - DNA, 22 bp, Homo sapiens
ggcacgtgcctaaggagcaggc

SEQ ID NO: 7137935 - DNA, 21 bp, Homo sapiens
ggcactaggcccggaggaagc

SEQ ID NO: 7137936 - DNA, 22 bp, Homo sapiens
ggcactatgagttataagtgga

SEQ ID NO: 7137937 - DNA, 22 bp, Homo sapiens
ggcactattaattttgagagaa

SEQ ID NO: 7137938 - DNA, 22 bp, Homo sapiens
ggcactattaattttgagagaa

SEQ ID NO: 7137939 - DNA, 22 bp, Homo sapiens
ggcactcaataaatgttgccaa

SEQ ID NO: 7137940 - DNA, 22 bp, Homo sapiens
ggcactcaataaatgttgccaa

SEQ ID NO: 7137941 - DNA, 22 bp, Homo sapiens
ggcactcagagattcaggctgt

SEQ ID NO: 7137942 - DNA, 22 bp, Homo sapiens
ggcactcagagattcaggctgt

SEQ ID NO: 7137943 - DNA, 23 bp, Homo sapiens
ggcactcggccgtgaactcgtgc

SEQ ID NO: 7137944 - DNA, 23 bp, Homo sapiens
ggcactgaagctacaatggtgag

SEQ ID NO: 7137945 - DNA, 22 bp, Homo sapiens
ggcactgaatttcttggcatct

SEQ ID NO: 7137946 - DNA, 22 bp, Homo sapiens
ggcactgactgtgcagcgcacc

SEQ ID NO: 7137947 - DNA, 22 bp, Homo sapiens
ggcactgagaacaggctgactt

SEQ ID NO: 7137948 - DNA, 22 bp, Homo sapiens
ggcactgagaggctcttcctaa

SEQ ID NO: 7137949 - DNA, 22 bp, Homo sapiens
ggcactgagcgggctctgagcg

SEQ ID NO: 7137950 - DNA, 22 bp, Homo sapiens
ggcagatgttatatgatctgag

SEQ ID NO: 7137951 - DNA, 22 bp, Homo sapiens
ggcagatgttatatgatctgag

SEQ ID NO: 7137952 - DNA, 22 bp, Homo sapiens
ggcagatgttatatgatctgag

SEQ ID NO: 7137953 - DNA, 22 bp, Homo sapiens
ggcagatgttgcagtgagcaga

SEQ ID NO: 7137954 - DNA, 22 bp, Homo sapiens
ggcagatgttgcagtgagcaga

SEQ ID NO: 7137955 - DNA, 22 bp, Homo sapiens
ggcagatggggtgacaagagag

SEQ ID NO: 7137956 - DNA, 22 bp, Homo sapiens
ggcagatggagaagcagcaggt

SEQ ID NO: 7137957 - DNA, 22 bp, Homo sapiens
ggcagaggtgacagtgtctttt

SEQ ID NO: 7137958 - DNA, 22 bp, Homo sapiens
ggcagaggtgacagtgtctttt

SEQ ID NO: 7137959 - DNA, 22 bp, Homo sapiens
ggcagaggtgacagtgtctttt

SEQ ID NO: 7137960 - DNA, 22 bp, Homo sapiens
ggcagaggtgaagttcacaagg

SEQ ID NO: 7137961 - DNA, 22 bp, Homo sapiens
ggcagaggtgacagtgtctttt

SEQ ID NO: 7137962 - DNA, 22 bp, Homo sapiens
ggcagaggtgaagttcacaagg

SEQ ID NO: 7137963 - DNA, 22 bp, Homo sapiens
ggcagaggtgaagttcacaagg

SEQ ID NO: 7137964 - DNA, 22 bp, Homo sapiens
ggcagaggtgaagttcacaagg

SEQ ID NO: 7137965 - DNA, 22 bp, Homo sapiens
ggcactgatctgatttccctcc

SEQ ID NO: 7137966 - DNA, 22 bp, Homo sapiens
ggcactgattccattcatgaag

SEQ ID NO: 7137967 - DNA, 22 bp, Homo sapiens
ggaggagtgtggggcactctgc

SEQ ID NO: 7137968 - DNA, 22 bp, Homo sapiens
ggaggagtcagttgggctgctt

SEQ ID NO: 7137969 - DNA, 22 bp, Homo sapiens
ggaggagtcagttgggctgctt

SEQ ID NO: 7137970 - DNA, 22 bp, Homo sapiens
ggaggatgagctacgaggagct

SEQ ID NO: 7137971 - DNA, 22 bp, Homo sapiens
ggaggatgagctacgaggagct

SEQ ID NO: 7137972 - DNA, 22 bp, Homo sapiens
ggaggaggggtttacattggaa

SEQ ID NO: 7137973 - DNA, 22 bp, Homo sapiens
ggaggaggggtttacattggaa

SEQ ID NO: 7137974 - DNA, 22 bp, Homo sapiens
ggaggaggtgggttaagttgta

SEQ ID NO: 7137975 - DNA, 22 bp, Homo sapiens
ggaggaggtgggttaagttgta

SEQ ID NO: 7137976 - DNA, 22 bp, Homo sapiens
ggaggaggggtgactgaatgct

SEQ ID NO: 7137977 - DNA, 22 bp, Homo sapiens
ggaggaggggtgactgaatgct

SEQ ID NO: 7137978 - DNA, 22 bp, Homo sapiens
ggaggaggggtgactgaatgct

SEQ ID NO: 7137979 - DNA, 22 bp, Homo sapiens
ggaggaggggtgactgaatgct

SEQ ID NO: 7137980 - DNA, 22 bp, Homo sapiens
ggaggaggggtgactgaatgct

SEQ ID NO: 7137981 - DNA, 22 bp, Homo sapiens
ggaggaggggtgactgaatgct

SEQ ID NO: 7137982 - DNA, 22 bp, Homo sapiens
ggaggaggggtttacattggaa

SEQ ID NO: 7137983 - DNA, 22 bp, Homo sapiens
ggaggaggggtttacattggaa

SEQ ID NO: 7137984 - DNA, 22 bp, Homo sapiens
ggaggaggggtttacattggaa

SEQ ID NO: 7137985 - DNA, 22 bp, Homo sapiens
ggaggaggggtgactgaatgct

SEQ ID NO: 7137986 - DNA, 22 bp, Homo sapiens
ggaggaggggtttacattggaa

SEQ ID NO: 7137987 - DNA, 22 bp, Homo sapiens
ggaggaggggtttacattggaa

SEQ ID NO: 7137988 - DNA, 22 bp, Homo sapiens
ggaggatgagctacgaggagct

SEQ ID NO: 7137989 - DNA, 22 bp, Homo sapiens
ggaggatgagctacgaggagct

SEQ ID NO: 7137990 - DNA, 22 bp, Homo sapiens
ggaggcaaagcactttgcttgg

SEQ ID NO: 7137991 - DNA, 22 bp, Homo sapiens
ggaggcaacacagggtgtgttt

SEQ ID NO: 7137992 - DNA, 17 bp, Homo sapiens
ggaggcaacagacaggg

SEQ ID NO: 7137993 - DNA, 22 bp, Homo sapiens
ggaggcaacatgcttgtttcta

SEQ ID NO: 7137994 - DNA, 22 bp, Homo sapiens
ggaggcacacctcagactggga

SEQ ID NO: 7137995 - DNA, 22 bp, Homo sapiens
ggaggcaccactcatcatcctc

SEQ ID NO: 7137996 - DNA, 22 bp, Homo sapiens
ggaggcacccttcattgagttt

SEQ ID NO: 7137997 - DNA, 23 bp, Homo sapiens
ggaggcacttaggcagagcagag

SEQ ID NO: 7137998 - DNA, 23 bp, Homo sapiens
ggaggcacttaggcagagcagag

SEQ ID NO: 7137999 - DNA, 22 bp, Homo sapiens
ggaggcacttcccgtctcagcc

SEQ ID NO: 7138000 - DNA, 22 bp, Homo sapiens
ggaggcagaacttcccgtcagt

SEQ ID NO: 7138001 - DNA, 22 bp, Homo sapiens
ggaggcagaacttcccgtcagt

SEQ ID NO: 7138002 - DNA, 22 bp, Homo sapiens
ggaggcagaacttcccgtcagt

SEQ ID NO: 7138003 - DNA, 22 bp, Homo sapiens
ggaggcagaacttcccgtcagt

SEQ ID NO: 7138004 - DNA, 22 bp, Homo sapiens
ggcaccagggaaggaaggctgg

SEQ ID NO: 7138005 - DNA, 22 bp, Homo sapiens
ggaggcagaacttcccgtcagt

SEQ ID NO: 7138006 - DNA, 22 bp, Homo sapiens
ggcaccaggctgggcataggcc

SEQ ID NO: 7138007 - DNA, 22 bp, Homo sapiens
ggcaccaggctgggcataggcc

SEQ ID NO: 7138008 - DNA, 22 bp, Homo sapiens
ggcaccaggctgggcataggcc

SEQ ID NO: 7138009 - DNA, 16 bp, Homo sapiens
ggcaccagtgaacaca

SEQ ID NO: 7138010 - DNA, 16 bp, Homo sapiens
ggcaccagtgaacaca

SEQ ID NO: 7138011 - DNA, 22 bp, Homo sapiens
ggcaccatcagctgtgcagggg

SEQ ID NO: 7138012 - DNA, 18 bp, Homo sapiens
ggcacctctcttgcctta

SEQ ID NO: 7138013 - DNA, 18 bp, Homo sapiens
ggcacctctcttgcctta

SEQ ID NO: 7138014 - DNA, 22 bp, Homo sapiens
ggcaccagggcaagggtctttc

SEQ ID NO: 7138015 - DNA, 22 bp, Homo sapiens
ggcaccaggggatgtaatgtcc

SEQ ID NO: 7138016 - DNA, 22 bp, Homo sapiens
ggcaccagggacaatcctcttc

SEQ ID NO: 7138017 - DNA, 22 bp, Homo sapiens
ggcaccagggacaatcctcttc

SEQ ID NO: 7138018 - DNA, 22 bp, Homo sapiens
ggcaccagggaaggaaggctgg

SEQ ID NO: 7138019 - DNA, 22 bp, Homo sapiens
ggcaccagggaaggaaggctgg

SEQ ID NO: 7138020 - DNA, 22 bp, Homo sapiens
ggcacctgtgtaagatctggaa

SEQ ID NO: 7138021 - DNA, 22 bp, Homo sapiens
ggcacctgtctgctcacagtga

SEQ ID NO: 7138022 - DNA, 22 bp, Homo sapiens
ggcacctggtaagtgctcagta

SEQ ID NO: 7138023 - DNA, 22 bp, Homo sapiens
ggcacctggtaagtgctcagta

SEQ ID NO: 7138024 - DNA, 22 bp, Homo sapiens
ggcacctgtagttattttgttt

SEQ ID NO: 7138025 - DNA, 22 bp, Homo sapiens
ggcaccttgagggcagaacctt

SEQ ID NO: 7138026 - DNA, 22 bp, Homo sapiens
ggcaccttggctagtgatcaac

SEQ ID NO: 7138027 - DNA, 19 bp, Homo sapiens
ggcaccttggctatgcctg

SEQ ID NO: 7138028 - DNA, 19 bp, Homo sapiens
ggcaccttggtcttggact

SEQ ID NO: 7138029 - DNA, 19 bp, Homo sapiens
ggcaccttggtcttggact

SEQ ID NO: 7138030 - DNA, 22 bp, Homo sapiens
ggcacctttcatcccatctaga

SEQ ID NO: 7138031 - DNA, 19 bp, Homo sapiens
ggcacctttctgctgtgtc

SEQ ID NO: 7138032 - DNA, 22 bp, Homo sapiens
ggcacctgctcatctggactca

SEQ ID NO: 7138033 - DNA, 22 bp, Homo sapiens
ggcacctggaggtttactggat

SEQ ID NO: 7138034 - DNA, 22 bp, Homo sapiens
ggcacctggatgtagcagtgaa

SEQ ID NO: 7138035 - DNA, 22 bp, Homo sapiens
ggcacctggatgtagcagtgaa

SEQ ID NO: 7138036 - DNA, 22 bp, Homo sapiens
ggcacctggatgtagcagtgaa

SEQ ID NO: 7138037 - DNA, 22 bp, Homo sapiens
ggcacctggatgtagcagtgaa

SEQ ID NO: 7138038 - DNA, 22 bp, Homo sapiens
ggcacctggatgtagcagtgaa

SEQ ID NO: 7138039 - DNA, 22 bp, Homo sapiens
ggcacctggtaagtgctcagta

SEQ ID NO: 7138040 - DNA, 22 bp, Homo sapiens
ggctctgcccaggtggacagca

SEQ ID NO: 7138041 - DNA, 22 bp, Homo sapiens
ggctctgcccagatgaagagga

SEQ ID NO: 7138042 - DNA, 22 bp, Homo sapiens
ggctctgcccaggtggacagca

SEQ ID NO: 7138043 - DNA, 22 bp, Homo sapiens
ggctctgcccaggtggacagca

SEQ ID NO: 7138044 - DNA, 20 bp, Homo sapiens
ggctctgccccaccccgtcc

SEQ ID NO: 7138045 - DNA, 20 bp, Homo sapiens
ggctctgccccaccccgtcc

SEQ ID NO: 7138046 - DNA, 22 bp, Homo sapiens
ggctctgcccgcggctgcccac

SEQ ID NO: 7138047 - DNA, 22 bp, Homo sapiens
ggctctgcccgcggctgcccac

SEQ ID NO: 7138048 - DNA, 22 bp, Homo sapiens
ggctctgccacttcttggctgt

SEQ ID NO: 7138049 - DNA, 22 bp, Homo sapiens
ggctctgccatttcctagctgc

SEQ ID NO: 7138050 - DNA, 22 bp, Homo sapiens
ggctctgccatttcctagctgc

SEQ ID NO: 7138051 - DNA, 22 bp, Homo sapiens
ggctctgccatttcctagctgc

SEQ ID NO: 7138052 - DNA, 22 bp, Homo sapiens
ggctctgccgtgtgctcacatg

SEQ ID NO: 7138053 - DNA, 22 bp, Homo sapiens
ggctctgcccgcggctgcccac

SEQ ID NO: 7138054 - DNA, 22 bp, Homo sapiens
ggctctgccgtgtgctcacatg

SEQ ID NO: 7138055 - DNA, 22 bp, Homo sapiens
ggctctgccgtgtgctcacatg

SEQ ID NO: 7138056 - DNA, 22 bp, Homo sapiens
ggctctgcctctgaccctctgg

SEQ ID NO: 7138057 - DNA, 22 bp, Homo sapiens
ggctctgcctctgaccctctgg

SEQ ID NO: 7138058 - DNA, 22 bp, Homo sapiens
ggctctgcctctgaccctctgg

SEQ ID NO: 7138059 - DNA, 22 bp, Homo sapiens
ggctctgcctgcccagcagcac

SEQ ID NO: 7138060 - DNA, 22 bp, Homo sapiens
ggctctgcctgcccagcagcac

SEQ ID NO: 7138061 - DNA, 22 bp, Homo sapiens
ggctctgcctgcccagcagcac

SEQ ID NO: 7138062 - DNA, 22 bp, Homo sapiens
ggctctgcctgcctgagtgtcc

SEQ ID NO: 7138063 - DNA, 22 bp, Homo sapiens
ggctctgcctgcctgagtgtcc

SEQ ID NO: 7138064 - DNA, 22 bp, Homo sapiens
ggctctgcctgcctgagtgtcc

SEQ ID NO: 7138065 - DNA, 22 bp, Homo sapiens
ggctctgcctgcctgagtgtcc

SEQ ID NO: 7138066 - DNA, 22 bp, Homo sapiens
ggctctgcctgcctgagtgtcc

SEQ ID NO: 7138067 - DNA, 22 bp, Homo sapiens
ggctctgcgcctgcggggactt

SEQ ID NO: 7138068 - DNA, 22 bp, Homo sapiens
ggctctgcgcctgcggggactt

SEQ ID NO: 7138069 - DNA, 23 bp, Homo sapiens
ggctctgaggatggagctggtgg

SEQ ID NO: 7138070 - DNA, 22 bp, Homo sapiens
ggctctgacctcccaggcagtt

SEQ ID NO: 7138071 - DNA, 22 bp, Homo sapiens
ggctctgacctcccaggcagtt

SEQ ID NO: 7138072 - DNA, 22 bp, Homo sapiens
ggctctgagtttagaagggtgg

SEQ ID NO: 7138073 - DNA, 22 bp, Homo sapiens
ggctctgagtttagaagggtgg

SEQ ID NO: 7138074 - DNA, 22 bp, Homo sapiens
ggctctgagtttagaagggtgg

SEQ ID NO: 7138075 - DNA, 22 bp, Homo sapiens
ggctctgcaaaagtagatactt

SEQ ID NO: 7138076 - DNA, 22 bp, Homo sapiens
ggctctgcaaaagtagatactt

SEQ ID NO: 7138077 - DNA, 22 bp, Homo sapiens
ggctctgcactcagagtcattc

SEQ ID NO: 7138078 - DNA, 22 bp, Homo sapiens
ggctctgcactcagagtcattc

SEQ ID NO: 7138079 - DNA, 22 bp, Homo sapiens
ggctctgcactcagagtcattc

SEQ ID NO: 7138080 - DNA, 22 bp, Homo sapiens
ggctctgcagagggcccagctt

SEQ ID NO: 7138081 - DNA, 22 bp, Homo sapiens
ggctctgcagagggcccagctt

SEQ ID NO: 7138082 - DNA, 22 bp, Homo sapiens
ggctctgcagagggcccagctt

SEQ ID NO: 7138083 - DNA, 22 bp, Homo sapiens
ggctctgcagagggcccagctt

SEQ ID NO: 7138084 - DNA, 22 bp, Homo sapiens
ggctctgcagcttgctaactgt

SEQ ID NO: 7138085 - DNA, 22 bp, Homo sapiens
ggctctgcagcttgctaactgt

SEQ ID NO: 7138086 - DNA, 22 bp, Homo sapiens
ggctctgcagtgacttgagggg

SEQ ID NO: 7138087 - DNA, 22 bp, Homo sapiens
ggctctgcagtgacttgagggg

SEQ ID NO: 7138088 - DNA, 22 bp, Homo sapiens
ggctctgcagtgacttgagggg

SEQ ID NO: 7138089 - DNA, 22 bp, Homo sapiens
ggctctgcatgcaggttgtcag

SEQ ID NO: 7138090 - DNA, 22 bp, Homo sapiens
ggctctgcatgtgagtgggtgg

SEQ ID NO: 7138091 - DNA, 22 bp, Homo sapiens
ggctctgcatgtgagtgggtgg

SEQ ID NO: 7138092 - DNA, 22 bp, Homo sapiens
ggctctgcatgtgagtgggtgg

SEQ ID NO: 7138093 - DNA, 22 bp, Homo sapiens
ggctctgaaggagacagctgct

SEQ ID NO: 7138094 - DNA, 22 bp, Homo sapiens
ggctctgaacatggggaggagt

SEQ ID NO: 7138095 - DNA, 22 bp, Homo sapiens
ggctctgaaggagacagctgct

SEQ ID NO: 7138096 - DNA, 17 bp, Homo sapiens
ggctctcttccagactt

SEQ ID NO: 7138097 - DNA, 22 bp, Homo sapiens
ggctctgaacatggggaggagt

SEQ ID NO: 7138098 - DNA, 22 bp, Homo sapiens
ggctctcttaactggccatcct

SEQ ID NO: 7138099 - DNA, 22 bp, Homo sapiens
ggctctcttaactggccatcct

SEQ ID NO: 7138100 - DNA, 22 bp, Homo sapiens
ggctctctgaggaaacccttcc

SEQ ID NO: 7138101 - DNA, 22 bp, Homo sapiens
ggctctctccttggctttcaga

SEQ ID NO: 7138102 - DNA, 22 bp, Homo sapiens
ggctctctggaggagctcaccc

SEQ ID NO: 7138103 - DNA, 22 bp, Homo sapiens
ggctcagagttaggacccatgt

SEQ ID NO: 7138104 - DNA, 22 bp, Homo sapiens
ggctcagatggtttgttctaga

SEQ ID NO: 7138105 - DNA, 22 bp, Homo sapiens
ggctcagatggtttgttctaga

SEQ ID NO: 7138106 - DNA, 22 bp, Homo sapiens
ggctcagattccgagtggccct

SEQ ID NO: 7138107 - DNA, 22 bp, Homo sapiens
ggctcagattccgagtggccct

SEQ ID NO: 7138108 - DNA, 22 bp, Homo sapiens
ggctcagattccgagtggccct

SEQ ID NO: 7138109 - DNA, 22 bp, Homo sapiens
ggctcagattccgagtggccct

SEQ ID NO: 7138110 - DNA, 22 bp, Homo sapiens
ggctcagcaatgatgagcccct

SEQ ID NO: 7138111 - DNA, 22 bp, Homo sapiens
ggctcagcaatgatgagcccct

SEQ ID NO: 7138112 - DNA, 22 bp, Homo sapiens
ggctcagcacagggctggcatc

SEQ ID NO: 7138113 - DNA, 22 bp, Homo sapiens
ggctcagcacagggctggcatc

SEQ ID NO: 7138114 - DNA, 22 bp, Homo sapiens
ggctcactgcaagctccgcctc

SEQ ID NO: 7138115 - DNA, 23 bp, Homo sapiens
ggctcagaaaaagtcctggcctc

SEQ ID NO: 7138116 - DNA, 22 bp, Homo sapiens
ggctcactgcaacttccgcctc

SEQ ID NO: 7138117 - DNA, 22 bp, Homo sapiens
ggctcagaaacctctggtgtct

SEQ ID NO: 7138118 - DNA, 22 bp, Homo sapiens
ggctcagaaacctctggtgtct

SEQ ID NO: 7138119 - DNA, 22 bp, Homo sapiens
ggctcagaaggccatgctctgc

SEQ ID NO: 7138120 - DNA, 22 bp, Homo sapiens
ggctcagaaggccatgctctgc

SEQ ID NO: 7138121 - DNA, 22 bp, Homo sapiens
ggctcagaaggccatgctctgc

SEQ ID NO: 7138122 - DNA, 22 bp, Homo sapiens
ggctcagacctcccagctccag

SEQ ID NO: 7138123 - DNA, 22 bp, Homo sapiens
ggctcagacctcccagctccag

SEQ ID NO: 7138124 - DNA, 22 bp, Homo sapiens
ggctcagactcccaggccctct

SEQ ID NO: 7138125 - DNA, 22 bp, Homo sapiens
ggctcagactcccaggccctct

SEQ ID NO: 7138126 - DNA, 22 bp, Homo sapiens
ggctcagagacctgcgatctga

SEQ ID NO: 7138127 - DNA, 22 bp, Homo sapiens
ggctcagagacctgcgatctga

SEQ ID NO: 7138128 - DNA, 22 bp, Homo sapiens
ggctcagagacctgcgatctga

SEQ ID NO: 7138129 - DNA, 22 bp, Homo sapiens
ggctcagagacctgcgatctga

SEQ ID NO: 7138130 - DNA, 22 bp, Homo sapiens
ggctcagaggagctggaacggt

SEQ ID NO: 7138131 - DNA, 22 bp, Homo sapiens
ggctcagaggagctggaacggt

SEQ ID NO: 7138132 - DNA, 22 bp, Homo sapiens
ggctcagaggccagcaggtaga

SEQ ID NO: 7138133 - DNA, 22 bp, Homo sapiens
ggctcagaggccagcaggtaga

SEQ ID NO: 7138134 - DNA, 22 bp, Homo sapiens
ggctcagaggccagcaggtaga

SEQ ID NO: 7138135 - DNA, 22 bp, Homo sapiens
ggctcagaggccagcaggtaga

SEQ ID NO: 7138136 - DNA, 22 bp, Homo sapiens
ggctcagaggttgaggccggca

SEQ ID NO: 7138137 - DNA, 22 bp, Homo sapiens
ggctcagaggttgaggccggca

SEQ ID NO: 7138138 - DNA, 22 bp, Homo sapiens
ggctcaccattttcactctctg

SEQ ID NO: 7138139 - DNA, 23 bp, Homo sapiens
ggctcacacggagtgcctccacc

SEQ ID NO: 7138140 - DNA, 22 bp, Homo sapiens
ggctcacgcaattatcccggcc

SEQ ID NO: 7138141 - DNA, 22 bp, Homo sapiens
ggctcaccatggcctccctgct

SEQ ID NO: 7138142 - DNA, 22 bp, Homo sapiens
ggctagggacacagctctgctc

SEQ ID NO: 7138143 - DNA, 22 bp, Homo sapiens
ggctagggaaatcctgatccaa

SEQ ID NO: 7138144 - DNA, 22 bp, Homo sapiens
ggctagggaaaatgattggata

SEQ ID NO: 7138145 - DNA, 22 bp, Homo sapiens
ggctagggacacagctctgctc

SEQ ID NO: 7138146 - DNA, 22 bp, Homo sapiens
ggctcacgcaattatcccggcc

SEQ ID NO: 7138147 - DNA, 22 bp, Homo sapiens
ggctcactacaacctccgcctt

SEQ ID NO: 7138148 - DNA, 22 bp, Homo sapiens
ggctcactgcaaactgtgcctc

SEQ ID NO: 7138149 - DNA, 22 bp, Homo sapiens
ggctcactgcaacctccacctc

SEQ ID NO: 7138150 - DNA, 22 bp, Homo sapiens
ggctcactgcaacctctgcctc

SEQ ID NO: 7138151 - DNA, 22 bp, Homo sapiens
ggctcactgcaacctctgcctc

SEQ ID NO: 7138152 - DNA, 22 bp, Homo sapiens
ggctcactgcaacttccgcctc

SEQ ID NO: 7138153 - DNA, 22 bp, Homo sapiens
ggctcactgcaacttccgcctc

SEQ ID NO: 7138154 - DNA, 22 bp, Homo sapiens
ggctcactgcaacttccgcctc

SEQ ID NO: 7138155 - DNA, 22 bp, Homo sapiens
ggctaggctcacctggagagtt

SEQ ID NO: 7138156 - DNA, 22 bp, Homo sapiens
ggcctctggttcacagggagga

SEQ ID NO: 7138157 - DNA, 22 bp, Homo sapiens
ggcctctggtcaagacaagcat

SEQ ID NO: 7138158 - DNA, 22 bp, Homo sapiens
ggcctctggtgcctgaagcgcc

SEQ ID NO: 7138159 - DNA, 22 bp, Homo sapiens
ggcctctggttcacagggagga

SEQ ID NO: 7138160 - DNA, 22 bp, Homo sapiens
ggcctctggttcacagggagga

SEQ ID NO: 7138161 - DNA, 22 bp, Homo sapiens
ggcctctggggtcctgagccca

SEQ ID NO: 7138162 - DNA, 22 bp, Homo sapiens
ggcctctggtcaagacaagcat

SEQ ID NO: 7138163 - DNA, 22 bp, Homo sapiens
ggcctctggtcaagacaagcat

SEQ ID NO: 7138164 - DNA, 22 bp, Homo sapiens
ggcctctggggtcctgagccca

SEQ ID NO: 7138165 - DNA, 22 bp, Homo sapiens
ggcctctggggtcctgagccca

SEQ ID NO: 7138166 - DNA, 22 bp, Homo sapiens
ggcctctggggtcctgagccca

SEQ ID NO: 7138167 - DNA, 22 bp, Homo sapiens
ggcctctggcaggcaggccctc

SEQ ID NO: 7138168 - DNA, 18 bp, Homo sapiens
ggcctctggactggcagc

SEQ ID NO: 7138169 - DNA, 18 bp, Homo sapiens
ggcctctggactggcagc

SEQ ID NO: 7138170 - DNA, 22 bp, Homo sapiens
ggcctctgcttatgctgatgac

SEQ ID NO: 7138171 - DNA, 22 bp, Homo sapiens
ggcctctgcttatgctgatgac

SEQ ID NO: 7138172 - DNA, 20 bp, Homo sapiens
ggcctctgaggacaaggaga

SEQ ID NO: 7138173 - DNA, 22 bp, Homo sapiens
ggcctctcttgggacagctgtc

SEQ ID NO: 7138174 - DNA, 22 bp, Homo sapiens
ggcctctcttgggacagctgtc

SEQ ID NO: 7138175 - DNA, 22 bp, Homo sapiens
ggcctctcttgggacagctgtc

SEQ ID NO: 7138176 - DNA, 22 bp, Homo sapiens
ggcctctctgagagcagacgtt

SEQ ID NO: 7138177 - DNA, 22 bp, Homo sapiens
ggcctctctgagagcagacgtt

SEQ ID NO: 7138178 - DNA, 22 bp, Homo sapiens
ggcctctctggcatggctgccc

SEQ ID NO: 7138179 - DNA, 22 bp, Homo sapiens
ggcctctcttgggacagctgtc

SEQ ID NO: 7138180 - DNA, 22 bp, Homo sapiens
ggcctccaggcctactcagggc

SEQ ID NO: 7138181 - DNA, 21 bp, Homo sapiens
ggcctcccggaccgcagcgcc

SEQ ID NO: 7138182 - DNA, 21 bp, Homo sapiens
ggcctcctacagtcatgggcc

SEQ ID NO: 7138183 - DNA, 22 bp, Homo sapiens
ggcctcctcaccctgctcaggc

SEQ ID NO: 7138184 - DNA, 22 bp, Homo sapiens
ggcctcctcaccctgctcaggc

SEQ ID NO: 7138185 - DNA, 21 bp, Homo sapiens
ggcctcctacagtcatgggcc

SEQ ID NO: 7138186 - DNA, 22 bp, Homo sapiens
ggcctctctccttggcttgcag

SEQ ID NO: 7138187 - DNA, 22 bp, Homo sapiens
ggcctctctgagagcagacgtt

SEQ ID NO: 7138188 - DNA, 22 bp, Homo sapiens
ggcctctctgagagcagacgtt

SEQ ID NO: 7138189 - DNA, 22 bp, Homo sapiens
ggcctctgcctcatctgggcac

SEQ ID NO: 7138190 - DNA, 22 bp, Homo sapiens
ggcctctgccccagccacacct

SEQ ID NO: 7138191 - DNA, 22 bp, Homo sapiens
ggcctctgccccgcggggctcg

SEQ ID NO: 7138192 - DNA, 22 bp, Homo sapiens
ggcctctgccctcactcctgtc

SEQ ID NO: 7138193 - DNA, 22 bp, Homo sapiens
ggcctctgcctcatctgggcac

SEQ ID NO: 7138194 - DNA, 22 bp, Homo sapiens
ggcctctgcctcatctgggcac

SEQ ID NO: 7138195 - DNA, 19 bp, Homo sapiens
ggcctctgcaggccgcccc

SEQ ID NO: 7138196 - DNA, 22 bp, Homo sapiens
ggcctctgcaggcctcgacaag

SEQ ID NO: 7138197 - DNA, 22 bp, Homo sapiens
ggcctctgccccagccacacct

SEQ ID NO: 7138198 - DNA, 22 bp, Homo sapiens
ggcctctgcaactggctgtggc

SEQ ID NO: 7138199 - DNA, 19 bp, Homo sapiens
ggcctctgcaggccgcccc

SEQ ID NO: 7138200 - DNA, 19 bp, Homo sapiens
ggcctctgcaggccgcccc

SEQ ID NO: 7138201 - DNA, 19 bp, Homo sapiens
ggcctctgcaggccgcccc

SEQ ID NO: 7138202 - DNA, 22 bp, Homo sapiens
ggcctctgcaactggctgtggc

SEQ ID NO: 7138203 - DNA, 22 bp, Homo sapiens
ggcctctgcaactggctgtggc

SEQ ID NO: 7138204 - DNA, 20 bp, Homo sapiens
ggccacagggtgctggtgga

SEQ ID NO: 7138205 - DNA, 20 bp, Homo sapiens
ggccacagggtgctggtgga

SEQ ID NO: 7138206 - DNA, 22 bp, Homo sapiens
ggccacagggctgaacgtggac

SEQ ID NO: 7138207 - DNA, 20 bp, Homo sapiens
ggccacagggtgctggtgga

SEQ ID NO: 7138208 - DNA, 20 bp, Homo sapiens
ggccacagggtgctggtgga

SEQ ID NO: 7138209 - DNA, 20 bp, Homo sapiens
ggccacagggtgctggtgga

SEQ ID NO: 7138210 - DNA, 22 bp, Homo sapiens
ggccacagtctctggaaggatg

SEQ ID NO: 7138211 - DNA, 22 bp, Homo sapiens
ggccacagtctctggaaggatg

SEQ ID NO: 7138212 - DNA, 22 bp, Homo sapiens
ggccacagtctctggaaggatg

SEQ ID NO: 7138213 - DNA, 22 bp, Homo sapiens
ggccacagcaatgctgtgatgt

SEQ ID NO: 7138214 - DNA, 22 bp, Homo sapiens
ggccacagcaatgctgtgatgt

SEQ ID NO: 7138215 - DNA, 22 bp, Homo sapiens
ggccacagagggcgggatgctg

SEQ ID NO: 7138216 - DNA, 22 bp, Homo sapiens
ggccacagagggcgggatgctg

SEQ ID NO: 7138217 - DNA, 22 bp, Homo sapiens
ggccacagcaatgctgtgatgt

SEQ ID NO: 7138218 - DNA, 22 bp, Homo sapiens
ggccacagcaatgctgtgatgt

SEQ ID NO: 7138219 - DNA, 22 bp, Homo sapiens
ggccacagcaatgctgtgatgt

SEQ ID NO: 7138220 - DNA, 22 bp, Homo sapiens
ggccacagcagatgcttcagat

SEQ ID NO: 7138221 - DNA, 22 bp, Homo sapiens
ggccacagcagatgcttcagat

SEQ ID NO: 7138222 - DNA, 22 bp, Homo sapiens
ggcagtgggaaataagtgagaa

SEQ ID NO: 7138223 - DNA, 22 bp, Homo sapiens
ggcagtgggtggatctcaggga

SEQ ID NO: 7138224 - DNA, 22 bp, Homo sapiens
ggcagtgggtggatctcaggga

SEQ ID NO: 7138225 - DNA, 22 bp, Homo sapiens
ggcagtgggaaataagtgagaa

SEQ ID NO: 7138226 - DNA, 22 bp, Homo sapiens
ggcagtgggaaataagtgagaa

SEQ ID NO: 7138227 - DNA, 17 bp, Homo sapiens
ggccacagagcttgggg

SEQ ID NO: 7138228 - DNA, 17 bp, Homo sapiens
ggccacagagcttgggg

SEQ ID NO: 7138229 - DNA, 17 bp, Homo sapiens
ggccacagagcttgggg

SEQ ID NO: 7138230 - DNA, 17 bp, Homo sapiens
ggccacagagcttgggg

SEQ ID NO: 7138231 - DNA, 22 bp, Homo sapiens
ggcagtggcatgtgggtagtgg

SEQ ID NO: 7138232 - DNA, 22 bp, Homo sapiens
ggcagtggcatgtgggtagtgg

SEQ ID NO: 7138233 - DNA, 22 bp, Homo sapiens
ggcagtggcatgtgggtagtgg

SEQ ID NO: 7138234 - DNA, 22 bp, Homo sapiens
ggcagtggcatgtgggtagtgg

SEQ ID NO: 7138235 - DNA, 22 bp, Homo sapiens
ggcagtggctgtagtctcttgg

SEQ ID NO: 7138236 - DNA, 22 bp, Homo sapiens
ggcagtggctcctctctactcc

SEQ ID NO: 7138237 - DNA, 22 bp, Homo sapiens
ggcagtgggaaataagtgagaa

SEQ ID NO: 7138238 - DNA, 22 bp, Homo sapiens
ggcagtggctgtagtctcttgg

SEQ ID NO: 7138239 - DNA, 22 bp, Homo sapiens
ggccacagtgggaaatcctggg

SEQ ID NO: 7138240 - DNA, 22 bp, Homo sapiens
ggccacagtgggaaatcctggg

SEQ ID NO: 7138241 - DNA, 22 bp, Homo sapiens
ggccacagtgggaaatcctggg

SEQ ID NO: 7138242 - DNA, 22 bp, Homo sapiens
ggccacagtgggaaatcctggg

SEQ ID NO: 7138243 - DNA, 21 bp, Homo sapiens
ggccacagttagggctcagga

SEQ ID NO: 7138244 - DNA, 21 bp, Homo sapiens
ggccacagttagggctcagga

SEQ ID NO: 7138245 - DNA, 21 bp, Homo sapiens
ggccacagttagggctcagga

SEQ ID NO: 7138246 - DNA, 22 bp, Homo sapiens
ggccacatgaattcttggacag

SEQ ID NO: 7138247 - DNA, 22 bp, Homo sapiens
ggccacatgaattcttggacag

SEQ ID NO: 7138248 - DNA, 22 bp, Homo sapiens
ggccacatgtggctgctcgtat

SEQ ID NO: 7138249 - DNA, 22 bp, Homo sapiens
ggccacatgtggctgctcgtat

SEQ ID NO: 7138250 - DNA, 22 bp, Homo sapiens
ggccacattcaaagctgtcctg

SEQ ID NO: 7138251 - DNA, 22 bp, Homo sapiens
ggccacattcaaagctgtcctg

SEQ ID NO: 7138252 - DNA, 22 bp, Homo sapiens
ggccacattcaaagctgtcctg

SEQ ID NO: 7138253 - DNA, 22 bp, Homo sapiens
ggccaccaaagtcctgtggctt

SEQ ID NO: 7138254 - DNA, 22 bp, Homo sapiens
ggccaccagtcctctggcaggg

SEQ ID NO: 7138255 - DNA, 22 bp, Homo sapiens
ggccaccagtcctctggcaggg

SEQ ID NO: 7138256 - DNA, 22 bp, Homo sapiens
ggccaccagtcctctggcaggg

SEQ ID NO: 7138257 - DNA, 22 bp, Homo sapiens
ggccaccagtcctctggcaggg

SEQ ID NO: 7138258 - DNA, 22 bp, Homo sapiens
ggccacctaggagccacagtga

SEQ ID NO: 7138259 - DNA, 22 bp, Homo sapiens
ggccagagttgatggcatcttg

SEQ ID NO: 7138260 - DNA, 22 bp, Homo sapiens
ggccagagttgatggcatcttg

SEQ ID NO: 7138261 - DNA, 22 bp, Homo sapiens
ggccagagtctatatgcagaca

SEQ ID NO: 7138262 - DNA, 22 bp, Homo sapiens
ggccagagtctatatgcagaca

SEQ ID NO: 7138263 - DNA, 22 bp, Homo sapiens
ggccagagtctatatgcagaca

SEQ ID NO: 7138264 - DNA, 22 bp, Homo sapiens
ggccagagtctatatgcagaca

SEQ ID NO: 7138265 - DNA, 22 bp, Homo sapiens
ggccacctctgccctactgagt

SEQ ID NO: 7138266 - DNA, 22 bp, Homo sapiens
ggccagaggtgtcctcagttct

SEQ ID NO: 7138267 - DNA, 22 bp, Homo sapiens
ggccacctctgccctaccgagt

SEQ ID NO: 7138268 - DNA, 19 bp, Homo sapiens
ggccacctctcttcccagg

SEQ ID NO: 7138269 - DNA, 22 bp, Homo sapiens
ggccacctccgtgaaggaatga

SEQ ID NO: 7138270 - DNA, 19 bp, Homo sapiens
ggccacctctcttcccagg

SEQ ID NO: 7138271 - DNA, 22 bp, Homo sapiens
ggccagcagacctcagggactc

SEQ ID NO: 7138272 - DNA, 22 bp, Homo sapiens
ggccagcagacctcagggactc

SEQ ID NO: 7138273 - DNA, 22 bp, Homo sapiens
ggccagcagacctcagggactc

SEQ ID NO: 7138274 - DNA, 22 bp, Homo sapiens
ggccagcagacctcagggactc

SEQ ID NO: 7138275 - DNA, 22 bp, Homo sapiens
ggccagcagacctcagggactc

SEQ ID NO: 7138276 - DNA, 22 bp, Homo sapiens
ggccagcagacctcagggactc

SEQ ID NO: 7138277 - DNA, 21 bp, Homo sapiens
ggccagcagcgtccactgtgg

SEQ ID NO: 7138278 - DNA, 21 bp, Homo sapiens
ggccagcagcgtccactgtgg

SEQ ID NO: 7138279 - DNA, 21 bp, Homo sapiens
ggccagcagcgtccactgtgg

SEQ ID NO: 7138280 - DNA, 22 bp, Homo sapiens
ggccagagttgatggcatcttg

SEQ ID NO: 7138281 - DNA, 22 bp, Homo sapiens
ggccagagttgatggcatcttg

SEQ ID NO: 7138282 - DNA, 19 bp, Homo sapiens
ggccagcacagggctctgt

SEQ ID NO: 7138283 - DNA, 19 bp, Homo sapiens
ggccagcacagggctctgt

SEQ ID NO: 7138284 - DNA, 19 bp, Homo sapiens
ggccagcacagggctctgt

SEQ ID NO: 7138285 - DNA, 19 bp, Homo sapiens
ggccagcacagggctctgt

SEQ ID NO: 7138286 - DNA, 22 bp, Homo sapiens
ggccagcagtatatagctaatt

SEQ ID NO: 7138287 - DNA, 22 bp, Homo sapiens
ggccagcagtatatagctaatt

SEQ ID NO: 7138288 - DNA, 22 bp, Homo sapiens
ggccagcagtcacagggtcaga

SEQ ID NO: 7138289 - DNA, 22 bp, Homo sapiens
ggccagcagtcacagggtcaga

SEQ ID NO: 7138290 - DNA, 22 bp, Homo sapiens
ggccagcagtcacagggtcaga

SEQ ID NO: 7138291 - DNA, 21 bp, Homo sapiens
ggccagcagcgtccactgtgg

SEQ ID NO: 7138292 - DNA, 22 bp, Homo sapiens
ggccagcaggccctgtgatcct

SEQ ID NO: 7138293 - DNA, 22 bp, Homo sapiens
ggccagcaggccctgtgatcct

SEQ ID NO: 7138294 - DNA, 22 bp, Homo sapiens
ggccagcaggccctgtgatcct

SEQ ID NO: 7138295 - DNA, 22 bp, Homo sapiens
ggccagcagtcacagggtcaga

SEQ ID NO: 7138296 - DNA, 22 bp, Homo sapiens
ggccagcagtcacagggtcaga

SEQ ID NO: 7138297 - DNA, 22 bp, Homo sapiens
ggccagcagtcacagggtcaga

SEQ ID NO: 7138298 - DNA, 22 bp, Homo sapiens
ggccagcagtcacagggtcaga

SEQ ID NO: 7138299 - DNA, 22 bp, Homo sapiens
ggccagcatatagagtgaagta

SEQ ID NO: 7138300 - DNA, 22 bp, Homo sapiens
ggccagcatatagagtgaagta

SEQ ID NO: 7138301 - DNA, 22 bp, Homo sapiens
ggccagcatatagagtgaagta

SEQ ID NO: 7138302 - DNA, 22 bp, Homo sapiens
ggccagcatatagagtgaagta

SEQ ID NO: 7138303 - DNA, 22 bp, Homo sapiens
ggccagcatggcaagaccaact

SEQ ID NO: 7138304 - DNA, 22 bp, Homo sapiens
ggccagcatggcaagaccaact

SEQ ID NO: 7138305 - DNA, 22 bp, Homo sapiens
ggccagcatggcaagaccaact

SEQ ID NO: 7138306 - DNA, 22 bp, Homo sapiens
ggccagcatggcaagaccaact

SEQ ID NO: 7138307 - DNA, 19 bp, Homo sapiens
ggccagccacctcgcctgg

SEQ ID NO: 7138308 - DNA, 22 bp, Homo sapiens
ggccagcccagtggtcctctct

SEQ ID NO: 7138309 - DNA, 22 bp, Homo sapiens
ggccagcccagtggtcctctct

SEQ ID NO: 7138310 - DNA, 22 bp, Homo sapiens
ggccagcccagtggtcctctct

SEQ ID NO: 7138311 - DNA, 22 bp, Homo sapiens
ggccagctctgcacagcagctg

SEQ ID NO: 7138312 - DNA, 22 bp, Homo sapiens
ggccagctctgcacagcagctg

SEQ ID NO: 7138313 - DNA, 22 bp, Homo sapiens
ggccagctgagctgctgcacag

SEQ ID NO: 7138314 - DNA, 22 bp, Homo sapiens
ggcccagctgggcggggacacg

SEQ ID NO: 7138315 - DNA, 22 bp, Homo sapiens
ggcccagctctattgaattaca

SEQ ID NO: 7138316 - DNA, 22 bp, Homo sapiens
ggcccagctctattgaattaca

SEQ ID NO: 7138317 - DNA, 22 bp, Homo sapiens
ggcccagctctattgaattaca

SEQ ID NO: 7138318 - DNA, 22 bp, Homo sapiens
ggcccagcgaggccacctacag

SEQ ID NO: 7138319 - DNA, 22 bp, Homo sapiens
ggccagctggatgtgggtgacg

SEQ ID NO: 7138320 - DNA, 20 bp, Homo sapiens
ggccagctggaggcgccggg

SEQ ID NO: 7138321 - DNA, 22 bp, Homo sapiens
ggccagctggagttccgggtgg

SEQ ID NO: 7138322 - DNA, 22 bp, Homo sapiens
ggccagctggatgtgggtgacg

SEQ ID NO: 7138323 - DNA, 21 bp, Homo sapiens
ggccagctgcatatgtcactg

SEQ ID NO: 7138324 - DNA, 22 bp, Homo sapiens
ggccagctgccaccagccctat

SEQ ID NO: 7138325 - DNA, 22 bp, Homo sapiens
ggccagctgctcagtgtctctg

SEQ ID NO: 7138326 - DNA, 22 bp, Homo sapiens
ggccagctgctcagtgtctctg

SEQ ID NO: 7138327 - DNA, 22 bp, Homo sapiens
ggcccagtgctgttcacccagt

SEQ ID NO: 7138328 - DNA, 22 bp, Homo sapiens
ggcccagtgtcccggtcgtggc

SEQ ID NO: 7138329 - DNA, 22 bp, Homo sapiens
ggcccagtgttgccagacctga

SEQ ID NO: 7138330 - DNA, 22 bp, Homo sapiens
ggcccagtgttgccagacctga

SEQ ID NO: 7138331 - DNA, 22 bp, Homo sapiens
ggcccagttgagaatgaatgat

SEQ ID NO: 7138332 - DNA, 22 bp, Homo sapiens
ggcccatccatgctgctggtct

SEQ ID NO: 7138333 - DNA, 22 bp, Homo sapiens
ggcccatccatgctgctggtct

SEQ ID NO: 7138334 - DNA, 22 bp, Homo sapiens
ggcccatctcttgctctgggtt

SEQ ID NO: 7138335 - DNA, 22 bp, Homo sapiens
ggcccatgaccctagccaactg

SEQ ID NO: 7138336 - DNA, 22 bp, Homo sapiens
ggcccatgcatcctgtgcagcc

SEQ ID NO: 7138337 - DNA, 22 bp, Homo sapiens
ggcccaggctggagtgcggtgg

SEQ ID NO: 7138338 - DNA, 22 bp, Homo sapiens
ggcccaggctggagtgcggtgg

SEQ ID NO: 7138339 - DNA, 22 bp, Homo sapiens
ggcccaggtccagcgagtacct

SEQ ID NO: 7138340 - DNA, 22 bp, Homo sapiens
ggcccaggtccagcgagtacct

SEQ ID NO: 7138341 - DNA, 22 bp, Homo sapiens
ggcccaggtccagcgagtacct

SEQ ID NO: 7138342 - DNA, 22 bp, Homo sapiens
ggcccaggtccagcgagtacct

SEQ ID NO: 7138343 - DNA, 22 bp, Homo sapiens
ggcccaggctggagtgcagtgg

SEQ ID NO: 7138344 - DNA, 22 bp, Homo sapiens
ggcccaggctggagtgcagtgg

SEQ ID NO: 7138345 - DNA, 22 bp, Homo sapiens
ggcccaggatgcaagaactgaa

SEQ ID NO: 7138346 - DNA, 22 bp, Homo sapiens
ggcccaggctggagtgcagtgg

SEQ ID NO: 7138347 - DNA, 22 bp, Homo sapiens
ggcccaggctggagtgcagtgg

SEQ ID NO: 7138348 - DNA, 22 bp, Homo sapiens
ggcccaggctggagtgcagtgg

SEQ ID NO: 7138349 - DNA, 22 bp, Homo sapiens
ggcccaggctggagtgcagtgg

SEQ ID NO: 7138350 - DNA, 22 bp, Homo sapiens
ggcccaggctggagtgcagtgg

SEQ ID NO: 7138351 - DNA, 22 bp, Homo sapiens
ggcccaggctggagtgcggtgg

SEQ ID NO: 7138352 - DNA, 22 bp, Homo sapiens
ggcccaggatgcaagaactgaa

SEQ ID NO: 7138353 - DNA, 22 bp, Homo sapiens
ggcccaggatgcaagaactgaa

SEQ ID NO: 7138354 - DNA, 22 bp, Homo sapiens
ggcccaggatgcaagaactgaa

SEQ ID NO: 7138355 - DNA, 22 bp, Homo sapiens
ggcccaggatgcaagaactgaa

SEQ ID NO: 7138356 - DNA, 22 bp, Homo sapiens
ggcccagctttcattccttgct

SEQ ID NO: 7138357 - DNA, 22 bp, Homo sapiens
ggcccagctgtgcttccagccc

SEQ ID NO: 7138358 - DNA, 22 bp, Homo sapiens
ggcccagctgtgcttccagccc

SEQ ID NO: 7138359 - DNA, 22 bp, Homo sapiens
ggcccagctttcattccttgct

SEQ ID NO: 7138360 - DNA, 22 bp, Homo sapiens
ggcccagctgtgcttccagccc

SEQ ID NO: 7138361 - DNA, 22 bp, Homo sapiens
ggcccagctgtgcttccagccc

SEQ ID NO: 7138362 - DNA, 22 bp, Homo sapiens
ggcccagctgtgcttccagccc

SEQ ID NO: 7138363 - DNA, 22 bp, Homo sapiens
ggcccagctgtatattacagtt

SEQ ID NO: 7138364 - DNA, 22 bp, Homo sapiens
ggcccagctgtatattacagtt

SEQ ID NO: 7138365 - DNA, 22 bp, Homo sapiens
ggcccagctgtatattacagtt

SEQ ID NO: 7138366 - DNA, 22 bp, Homo sapiens
ggcccagctgtatattacagtt

SEQ ID NO: 7138367 - DNA, 22 bp, Homo sapiens
ggcccagctgggcggggacacg

SEQ ID NO: 7138368 - DNA, 22 bp, Homo sapiens
ggcccagctgggcggggacacg

SEQ ID NO: 7138369 - DNA, 20 bp, Homo sapiens
gctgaggggtctatggcata

SEQ ID NO: 7138370 - DNA, 22 bp, Homo sapiens
gctgagggtaacacttcgggat

SEQ ID NO: 7138371 - DNA, 22 bp, Homo sapiens
gctgagggtaacacttcgggat

SEQ ID NO: 7138372 - DNA, 23 bp, Homo sapiens
gctgaggtacatttacaggaaga

SEQ ID NO: 7138373 - DNA, 23 bp, Homo sapiens
gctgaggtacatttacaggaaga

SEQ ID NO: 7138374 - DNA, 22 bp, Homo sapiens
gctgagggggaaggaaagctga

SEQ ID NO: 7138375 - DNA, 22 bp, Homo sapiens
gctctgtgtccacagctggaaa

SEQ ID NO: 7138376 - DNA, 22 bp, Homo sapiens
gctgagggctgtaacagcagag

SEQ ID NO: 7138377 - DNA, 22 bp, Homo sapiens
gctgagggctgtaacagcagag

SEQ ID NO: 7138378 - DNA, 22 bp, Homo sapiens
gctctgtgtatgtggcaggtgc

SEQ ID NO: 7138379 - DNA, 22 bp, Homo sapiens
gctctgtgtatgtggcaggtgc

SEQ ID NO: 7138380 - DNA, 22 bp, Homo sapiens
gctctgtggtggggcagagttt

SEQ ID NO: 7138381 - DNA, 22 bp, Homo sapiens
gctctgtggtggggcagagttt

SEQ ID NO: 7138382 - DNA, 22 bp, Homo sapiens
gctctgtgggggaaatcctggg

SEQ ID NO: 7138383 - DNA, 22 bp, Homo sapiens
gctctgtggcattcatgggcag

SEQ ID NO: 7138384 - DNA, 20 bp, Homo sapiens
gctgaggtttcttcctatat

SEQ ID NO: 7138385 - DNA, 22 bp, Homo sapiens
gctgaggttttctgcctgctca

SEQ ID NO: 7138386 - DNA, 22 bp, Homo sapiens
gctgaggtttcaggagtggcag

SEQ ID NO: 7138387 - DNA, 22 bp, Homo sapiens
gctgaggtttcaggagtggcag

SEQ ID NO: 7138388 - DNA, 22 bp, Homo sapiens
gctgaggtgtcaccttgctggg

SEQ ID NO: 7138389 - DNA, 22 bp, Homo sapiens
gctgaggtgtcaccttgctggg

SEQ ID NO: 7138390 - DNA, 18 bp, Homo sapiens
gctgaggtggtgtcagag

SEQ ID NO: 7138391 - DNA, 22 bp, Homo sapiens
gctgaggtggtgatggttcatc

SEQ ID NO: 7138392 - DNA, 18 bp, Homo sapiens
gctgaggtggtgtcagag

SEQ ID NO: 7138393 - DNA, 22 bp, Homo sapiens
gctgagtgaggtccagagcttg

SEQ ID NO: 7138394 - DNA, 22 bp, Homo sapiens
gctgagtgaggctgtcaaaatg

SEQ ID NO: 7138395 - DNA, 22 bp, Homo sapiens
gctgagtgaggaaaaggttata

SEQ ID NO: 7138396 - DNA, 22 bp, Homo sapiens
gctgagtgaggaaaaggttata

SEQ ID NO: 7138397 - DNA, 22 bp, Homo sapiens
gctgagtgattgatattttagt

SEQ ID NO: 7138398 - DNA, 22 bp, Homo sapiens
gctgagtgaggtccagagcttg

SEQ ID NO: 7138399 - DNA, 22 bp, Homo sapiens
gctgagtgaggtccagagcttg

SEQ ID NO: 7138400 - DNA, 22 bp, Homo sapiens
gctgagtgattgatattttagt

SEQ ID NO: 7138401 - DNA, 17 bp, Homo sapiens
gctgagtgcagggagtc

SEQ ID NO: 7138402 - DNA, 17 bp, Homo sapiens
gctgagtgcagggagtc

SEQ ID NO: 7138403 - DNA, 22 bp, Homo sapiens
gctgagtggagcagtcagcgct

SEQ ID NO: 7138404 - DNA, 22 bp, Homo sapiens
gctgagtggagcagtcagcgct

SEQ ID NO: 7138405 - DNA, 22 bp, Homo sapiens
gctgagtggagcagtcagcgct

SEQ ID NO: 7138406 - DNA, 22 bp, Homo sapiens
gctgagtgtaatgatggcagag

SEQ ID NO: 7138407 - DNA, 22 bp, Homo sapiens
gctgagttgaaagcagaggata

SEQ ID NO: 7138408 - DNA, 22 bp, Homo sapiens
gctgatagactgaatgttggga

SEQ ID NO: 7138409 - DNA, 22 bp, Homo sapiens
gctgatagactgaatgttggga

SEQ ID NO: 7138410 - DNA, 22 bp, Homo sapiens
gctgatagactgaatgttggga

SEQ ID NO: 7138411 - DNA, 22 bp, Homo sapiens
gctgatagactgaatgttggga

SEQ ID NO: 7138412 - DNA, 22 bp, Homo sapiens
gctgataagagggcaatgagtg

SEQ ID NO: 7138413 - DNA, 23 bp, Homo sapiens
gctgataatgcattctgtttaat

SEQ ID NO: 7138414 - DNA, 22 bp, Homo sapiens
gctgagttggagatcactttga

SEQ ID NO: 7138415 - DNA, 22 bp, Homo sapiens
gctgagttgaaagcagaggata

SEQ ID NO: 7138416 - DNA, 22 bp, Homo sapiens
gctgataaatagttgatgtacc

SEQ ID NO: 7138417 - DNA, 22 bp, Homo sapiens
gctgataaatagttgatgtacc

SEQ ID NO: 7138418 - DNA, 22 bp, Homo sapiens
gctgataaattacccagcatct

SEQ ID NO: 7138419 - DNA, 22 bp, Homo sapiens
gctgataagaagacccatcctg

SEQ ID NO: 7138420 - DNA, 22 bp, Homo sapiens
gctgcaggatgaggctctgctc

SEQ ID NO: 7138421 - DNA, 22 bp, Homo sapiens
gctgcaggatgaggctctgctc

SEQ ID NO: 7138422 - DNA, 22 bp, Homo sapiens
gctgcaggcagaatctcccaat

SEQ ID NO: 7138423 - DNA, 22 bp, Homo sapiens
gctgcaggcattttcctgggca

SEQ ID NO: 7138424 - DNA, 22 bp, Homo sapiens
gctgcaggcagaatctcccaat

SEQ ID NO: 7138425 - DNA, 18 bp, Homo sapiens
gctgcaggcgcctgcggt

SEQ ID NO: 7138426 - DNA, 18 bp, Homo sapiens
gctgcaggcgcctgcggt

SEQ ID NO: 7138427 - DNA, 18 bp, Homo sapiens
gctgcaggccctccgagg

SEQ ID NO: 7138428 - DNA, 22 bp, Homo sapiens
gctgcaggcattttcctgggca

SEQ ID NO: 7138429 - DNA, 22 bp, Homo sapiens
gctgcaggcattttcctgggca

SEQ ID NO: 7138430 - DNA, 18 bp, Homo sapiens
gctgcaggcgcctgcggt

SEQ ID NO: 7138431 - DNA, 18 bp, Homo sapiens
gctgcaggcgcctgcggt

SEQ ID NO: 7138432 - DNA, 22 bp, Homo sapiens
gctgcaggcgcctgcggtctct

SEQ ID NO: 7138433 - DNA, 22 bp, Homo sapiens
gctgcctctgcgactctgggcg

SEQ ID NO: 7138434 - DNA, 22 bp, Homo sapiens
gctgcctctgcgactctgggcg

SEQ ID NO: 7138435 - DNA, 22 bp, Homo sapiens
gctgcctctgcacagctcactc

SEQ ID NO: 7138436 - DNA, 22 bp, Homo sapiens
gctgcctctgcacagctcactc

SEQ ID NO: 7138437 - DNA, 22 bp, Homo sapiens
gctgcctctcctgagttgacag

SEQ ID NO: 7138438 - DNA, 22 bp, Homo sapiens
gctgcctctcctgagttgacag

SEQ ID NO: 7138439 - DNA, 22 bp, Homo sapiens
gctgcctcctgagatttgggca

SEQ ID NO: 7138440 - DNA, 22 bp, Homo sapiens
gctgcctcctgagatttgggca

SEQ ID NO: 7138441 - DNA, 22 bp, Homo sapiens
gctgcctctcctgagttgacag

SEQ ID NO: 7138442 - DNA, 22 bp, Homo sapiens
gctgcctcctgaaagcgctctg

SEQ ID NO: 7138443 - DNA, 22 bp, Homo sapiens
gctgcctcctgaaagcgctctg

SEQ ID NO: 7138444 - DNA, 22 bp, Homo sapiens
gctgcctcctgaaagcgctctg

SEQ ID NO: 7138445 - DNA, 23 bp, Homo sapiens
gctgcctcctacaaaagcccagc

SEQ ID NO: 7138446 - DNA, 23 bp, Homo sapiens
gctgcctcctacaaaagcccagc

SEQ ID NO: 7138447 - DNA, 22 bp, Homo sapiens
gctgcctccgccggctccacag

SEQ ID NO: 7138448 - DNA, 22 bp, Homo sapiens
gctgcctccgccggctccacag

SEQ ID NO: 7138449 - DNA, 22 bp, Homo sapiens
gctgcctcccccatggctggaa

SEQ ID NO: 7138450 - DNA, 22 bp, Homo sapiens
gctgcctccgccggctccacag

SEQ ID NO: 7138451 - DNA, 22 bp, Homo sapiens
gctgcctccgccggctccacag

SEQ ID NO: 7138452 - DNA, 22 bp, Homo sapiens
gctgcctccgccggctccacag

SEQ ID NO: 7138453 - DNA, 22 bp, Homo sapiens
gctgcctcccccatggctggaa

SEQ ID NO: 7138454 - DNA, 22 bp, Homo sapiens
gctgcctcccccatggctggaa

SEQ ID NO: 7138455 - DNA, 22 bp, Homo sapiens
gctgcctcccagagccctgcag

SEQ ID NO: 7138456 - DNA, 22 bp, Homo sapiens
gctgcctcccagagccctgcag

SEQ ID NO: 7138457 - DNA, 22 bp, Homo sapiens
gctgcctccactggctcccagt

SEQ ID NO: 7138458 - DNA, 22 bp, Homo sapiens
gctgcctcccagagccctgcag

SEQ ID NO: 7138459 - DNA, 22 bp, Homo sapiens
gctgcctcccagagccctgcag

SEQ ID NO: 7138460 - DNA, 22 bp, Homo sapiens
gctgcctcccagagccctgcag

SEQ ID NO: 7138461 - DNA, 22 bp, Homo sapiens
gctgcctccactggctcccagt

SEQ ID NO: 7138462 - DNA, 22 bp, Homo sapiens
gctgcctccaatctgtgccccg

SEQ ID NO: 7138463 - DNA, 22 bp, Homo sapiens
gctgcctccactggctcccagt

SEQ ID NO: 7138464 - DNA, 22 bp, Homo sapiens
gctgcctccactggctcccagt

SEQ ID NO: 7138465 - DNA, 22 bp, Homo sapiens
gctgcagggagctggaaggctc

SEQ ID NO: 7138466 - DNA, 22 bp, Homo sapiens
gctgcagggagctggaaggctc

SEQ ID NO: 7138467 - DNA, 22 bp, Homo sapiens
gctgcagggagctggaaggctc

SEQ ID NO: 7138468 - DNA, 22 bp, Homo sapiens
gctgcagggagctggaaggctc

SEQ ID NO: 7138469 - DNA, 22 bp, Homo sapiens
gctgcagggagctggaaggctc

SEQ ID NO: 7138470 - DNA, 21 bp, Homo sapiens
gctgcagggcccagggcaccc

SEQ ID NO: 7138471 - DNA, 21 bp, Homo sapiens
gctgcagggcccagggcaccc

SEQ ID NO: 7138472 - DNA, 21 bp, Homo sapiens
gctgcagggcccagggcaccc

SEQ ID NO: 7138473 - DNA, 22 bp, Homo sapiens
gctgcagggagctggaaggctc

SEQ ID NO: 7138474 - DNA, 22 bp, Homo sapiens
gctgcagggagctggaaggctc

SEQ ID NO: 7138475 - DNA, 22 bp, Homo sapiens
gctgcagggagctggaaggctc

SEQ ID NO: 7138476 - DNA, 21 bp, Homo sapiens
gctgcagggcccagggcaccc

SEQ ID NO: 7138477 - DNA, 22 bp, Homo sapiens
gctgcagggctctcacaggggg

SEQ ID NO: 7138478 - DNA, 22 bp, Homo sapiens
gctgcaggggggtctggacttg

SEQ ID NO: 7138479 - DNA, 22 bp, Homo sapiens
gctgcaggggggtctggacttg

SEQ ID NO: 7138480 - DNA, 22 bp, Homo sapiens
gctgcaggggggtctggacttg

SEQ ID NO: 7138481 - DNA, 22 bp, Homo sapiens
gctgcaggggggtctggacttg

SEQ ID NO: 7138482 - DNA, 22 bp, Homo sapiens
gctgcaggggggtctggacttg

SEQ ID NO: 7138483 - DNA, 22 bp, Homo sapiens
gctgcctccaatctgtgccccg

SEQ ID NO: 7138484 - DNA, 22 bp, Homo sapiens
gctgcctccaatctgtgccccg

SEQ ID NO: 7138485 - DNA, 21 bp, Homo sapiens
gctgcagggcccagggcaccc

SEQ ID NO: 7138486 - DNA, 22 bp, Homo sapiens
gctgcagggctctcacaggggg

SEQ ID NO: 7138487 - DNA, 22 bp, Homo sapiens
gctgcagggctctcacaggggg

SEQ ID NO: 7138488 - DNA, 22 bp, Homo sapiens
gctgcagggctctcacaggggg

SEQ ID NO: 7138489 - DNA, 22 bp, Homo sapiens
gctgcagggctctcacaggggg

SEQ ID NO: 7138490 - DNA, 22 bp, Homo sapiens
gctgcagggctctcacaggggg

SEQ ID NO: 7138491 - DNA, 22 bp, Homo sapiens
gctgcagggctctcacaggggg

SEQ ID NO: 7138492 - DNA, 22 bp, Homo sapiens
gctgcaggctctgcaggaattg

SEQ ID NO: 7138493 - DNA, 22 bp, Homo sapiens
gctgcaggctgtggcaggggag

SEQ ID NO: 7138494 - DNA, 22 bp, Homo sapiens
gctgcaggctctgcaggaattg

SEQ ID NO: 7138495 - DNA, 22 bp, Homo sapiens
gctgcaggctgtggcaggggag

SEQ ID NO: 7138496 - DNA, 22 bp, Homo sapiens
gctgcaggctgtggcaggggag

SEQ ID NO: 7138497 - DNA, 22 bp, Homo sapiens
gctgcaggctctgcaggaattg

SEQ ID NO: 7138498 - DNA, 22 bp, Homo sapiens
gctgcaggctgtggcaggggag

SEQ ID NO: 7138499 - DNA, 22 bp, Homo sapiens
gctgcaggcgcctgcggtctct

SEQ ID NO: 7138500 - DNA, 22 bp, Homo sapiens
gctgcaggcgcctgcggtctct

SEQ ID NO: 7138501 - DNA, 22 bp, Homo sapiens
gctgcaggcggccgtggtggcg

SEQ ID NO: 7138502 - DNA, 22 bp, Homo sapiens
gctgcaggcggccgtggtggcg

SEQ ID NO: 7138503 - DNA, 22 bp, Homo sapiens
gctgcaggcggccgtggtggcg

SEQ ID NO: 7138504 - DNA, 22 bp, Homo sapiens
gctgcaggctgtggcaggggag

SEQ ID NO: 7138505 - DNA, 22 bp, Homo sapiens
gctgcaggctgtggcaggggag

SEQ ID NO: 7138506 - DNA, 22 bp, Homo sapiens
gctgcagggaatgtatggattt

SEQ ID NO: 7138507 - DNA, 22 bp, Homo sapiens
gctgcagggagctggaaggctc

SEQ ID NO: 7138508 - DNA, 22 bp, Homo sapiens
gctgcagggagctggaaggctc

SEQ ID NO: 7138509 - DNA, 22 bp, Homo sapiens
gctgcagggagctggaaggctc

SEQ ID NO: 7138510 - DNA, 22 bp, Homo sapiens
gctgcagggagctggaaggctc

SEQ ID NO: 7138511 - DNA, 22 bp, Homo sapiens
gctggagtgctggagtgcagtg

SEQ ID NO: 7138512 - DNA, 22 bp, Homo sapiens
gctggagtgcagttgcacagtc

SEQ ID NO: 7138513 - DNA, 22 bp, Homo sapiens
gctggagtctacattcaagaat

SEQ ID NO: 7138514 - DNA, 22 bp, Homo sapiens
gctggagtcttgaaagtggact

SEQ ID NO: 7138515 - DNA, 22 bp, Homo sapiens
gctggagtgagtatgtgtagtc

SEQ ID NO: 7138516 - DNA, 22 bp, Homo sapiens
gctggaggtttcacctgagttt

SEQ ID NO: 7138517 - DNA, 22 bp, Homo sapiens
gctggaggtttcacctgagttt

SEQ ID NO: 7138518 - DNA, 22 bp, Homo sapiens
gctggaggtttcacctgagttt

SEQ ID NO: 7138519 - DNA, 22 bp, Homo sapiens
gctggagtatctggggaaggag

SEQ ID NO: 7138520 - DNA, 22 bp, Homo sapiens
gctggagtccagtggcatgatc

SEQ ID NO: 7138521 - DNA, 22 bp, Homo sapiens
gctggaggtagggaggtcctgt

SEQ ID NO: 7138522 - DNA, 22 bp, Homo sapiens
gctggaggtagggaggtcctgt

SEQ ID NO: 7138523 - DNA, 22 bp, Homo sapiens
gctggaggtagggaggtcctgt

SEQ ID NO: 7138524 - DNA, 22 bp, Homo sapiens
gctggaggtagggaggtcctgt

SEQ ID NO: 7138525 - DNA, 22 bp, Homo sapiens
gctggaggtagggaggtcctgt

SEQ ID NO: 7138526 - DNA, 22 bp, Homo sapiens
gctggaggtagggaggtcctgt

SEQ ID NO: 7138527 - DNA, 22 bp, Homo sapiens
gctggaggtggtgagaaaaggt

SEQ ID NO: 7138528 - DNA, 22 bp, Homo sapiens
gctggaggtggtgagaaaaggt

SEQ ID NO: 7138529 - DNA, 22 bp, Homo sapiens
gctggaggtttcacctgagttt

SEQ ID NO: 7138530 - DNA, 22 bp, Homo sapiens
gctggaggtttcacctgagttt

SEQ ID NO: 7138531 - DNA, 22 bp, Homo sapiens
gctggaggtttcacctgagttt

SEQ ID NO: 7138532 - DNA, 22 bp, Homo sapiens
gctggcaggtccaagatagagc

SEQ ID NO: 7138533 - DNA, 22 bp, Homo sapiens
gctggcaggtccaagatagagc

SEQ ID NO: 7138534 - DNA, 22 bp, Homo sapiens
gctggcaggtccaagatagagc

SEQ ID NO: 7138535 - DNA, 22 bp, Homo sapiens
gctggcaggtccaagatagagc

SEQ ID NO: 7138536 - DNA, 22 bp, Homo sapiens
gctggcaggtaaagccccgggg

SEQ ID NO: 7138537 - DNA, 22 bp, Homo sapiens
gctggcaggtaaagccccgggg

SEQ ID NO: 7138538 - DNA, 22 bp, Homo sapiens
gctggcagggttctcactgaaa

SEQ ID NO: 7138539 - DNA, 22 bp, Homo sapiens
gctggcaggtaaagccccgggg

SEQ ID NO: 7138540 - DNA, 22 bp, Homo sapiens
gctggcaggtaaagccccgggg

SEQ ID NO: 7138541 - DNA, 22 bp, Homo sapiens
gctggcaggtaaagccccgggg

SEQ ID NO: 7138542 - DNA, 22 bp, Homo sapiens
gctggagttggcaaggcatgta

SEQ ID NO: 7138543 - DNA, 22 bp, Homo sapiens
gctggcagggtggttgagagag

SEQ ID NO: 7138544 - DNA, 22 bp, Homo sapiens
gctggcagggtggttgagagag

SEQ ID NO: 7138545 - DNA, 22 bp, Homo sapiens
gctggcagggttctcactgaaa

SEQ ID NO: 7138546 - DNA, 22 bp, Homo sapiens
gctggcaggtccaagatagagc

SEQ ID NO: 7138547 - DNA, 22 bp, Homo sapiens
gctggcagtaaagggtttggca

SEQ ID NO: 7138548 - DNA, 22 bp, Homo sapiens
gctggcagtaaagggtttggca

SEQ ID NO: 7138549 - DNA, 22 bp, Homo sapiens
gctggcagtcccatcagctggg

SEQ ID NO: 7138550 - DNA, 22 bp, Homo sapiens
gctggcagtcccatcagctggg

SEQ ID NO: 7138551 - DNA, 22 bp, Homo sapiens
gctggcagtcccatcagctggg

SEQ ID NO: 7138552 - DNA, 22 bp, Homo sapiens
gctggcagtcccatcagctggg

SEQ ID NO: 7138553 - DNA, 22 bp, Homo sapiens
gctggcagtcccatcagctggg

SEQ ID NO: 7138554 - DNA, 22 bp, Homo sapiens
gctggcagtgtattgttagctg

SEQ ID NO: 7138555 - DNA, 22 bp, Homo sapiens
gctggcagtgtattgttagctg

SEQ ID NO: 7138556 - DNA, 22 bp, Homo sapiens
gctggcagtgtattgttagctg

SEQ ID NO: 7138557 - DNA, 22 bp, Homo sapiens
gctggcagtgtattgttagctg

SEQ ID NO: 7138558 - DNA, 22 bp, Homo sapiens
gctggcagtgtgaatgacaagc

SEQ ID NO: 7138559 - DNA, 22 bp, Homo sapiens
gctggcagtgtgaatgacaagc

SEQ ID NO: 7138560 - DNA, 22 bp, Homo sapiens
gctggcagtgtgaatgacaagc

SEQ ID NO: 7138561 - DNA, 22 bp, Homo sapiens
gctggcagtgtgaatgacaagc

SEQ ID NO: 7138562 - DNA, 22 bp, Homo sapiens
gctggcagtttcctcaccgagg

SEQ ID NO: 7138563 - DNA, 22 bp, Homo sapiens
gctggcagtttcctcaccgagg

SEQ ID NO: 7138564 - DNA, 22 bp, Homo sapiens
gctggcatcactggcttcggtg

SEQ ID NO: 7138565 - DNA, 22 bp, Homo sapiens
gctggcatcactggcttcggtg

SEQ ID NO: 7138566 - DNA, 22 bp, Homo sapiens
gctggcatggagactctgggtc

SEQ ID NO: 7138567 - DNA, 22 bp, Homo sapiens
gctggcattacaggagagaacc

SEQ ID NO: 7138568 - DNA, 22 bp, Homo sapiens
gctggccaaagtgtacctggag

SEQ ID NO: 7138569 - DNA, 22 bp, Homo sapiens
gctggccaaagtgtacctggag

SEQ ID NO: 7138570 - DNA, 22 bp, Homo sapiens
gctggaggggtaataggatggg

SEQ ID NO: 7138571 - DNA, 22 bp, Homo sapiens
gctggaggggtaataggatggg

SEQ ID NO: 7138572 - DNA, 22 bp, Homo sapiens
gctggaggggtaataggatggg

SEQ ID NO: 7138573 - DNA, 22 bp, Homo sapiens
gctggaggggtaataggatggg

SEQ ID NO: 7138574 - DNA, 22 bp, Homo sapiens
gctggaggggtaataggatggg

SEQ ID NO: 7138575 - DNA, 22 bp, Homo sapiens
gctggaggggtaataggatggg

SEQ ID NO: 7138576 - DNA, 22 bp, Homo sapiens
gctggaggggtaataggatggg

SEQ ID NO: 7138577 - DNA, 16 bp, Homo sapiens
gctggagggaggggtt

SEQ ID NO: 7138578 - DNA, 22 bp, Homo sapiens
gctggaggggtaataggatggg

SEQ ID NO: 7138579 - DNA, 22 bp, Homo sapiens
gctggaggggtaataggatggg

SEQ ID NO: 7138580 - DNA, 22 bp, Homo sapiens
gctggaggggtaataggatggg

SEQ ID NO: 7138581 - DNA, 22 bp, Homo sapiens
gctggagcttgagaggacaggg

SEQ ID NO: 7138582 - DNA, 22 bp, Homo sapiens
gctggagcttgagaggacaggg

SEQ ID NO: 7138583 - DNA, 22 bp, Homo sapiens
gctggagcttgagaggacaggg

SEQ ID NO: 7138584 - DNA, 22 bp, Homo sapiens
gctggagcttgagaggacaggg

SEQ ID NO: 7138585 - DNA, 22 bp, Homo sapiens
gctggagcttgagaggacaggg

SEQ ID NO: 7138586 - DNA, 22 bp, Homo sapiens
gctggagctgcagcctgggcct

SEQ ID NO: 7138587 - DNA, 22 bp, Homo sapiens
gctggagctgcagcctgggcct

SEQ ID NO: 7138588 - DNA, 22 bp, Homo sapiens
gctggagcttgagaggacaggg

SEQ ID NO: 7138589 - DNA, 22 bp, Homo sapiens
gctggagctgcagcctgggcct

SEQ ID NO: 7138590 - DNA, 22 bp, Homo sapiens
gctggagcttgagaggacaggg

SEQ ID NO: 7138591 - DNA, 22 bp, Homo sapiens
gctgctgtctcatgcgatgcgg

SEQ ID NO: 7138592 - DNA, 22 bp, Homo sapiens
gctgctgtcagtggtggcagtt

SEQ ID NO: 7138593 - DNA, 18 bp, Homo sapiens
gctgctggtggagggagc

SEQ ID NO: 7138594 - DNA, 18 bp, Homo sapiens
gctgctggtggagggagc

SEQ ID NO: 7138595 - DNA, 18 bp, Homo sapiens
gctgctggtggagggagc

SEQ ID NO: 7138596 - DNA, 18 bp, Homo sapiens
gctgctggtggagggagc

SEQ ID NO: 7138597 - DNA, 22 bp, Homo sapiens
gctgctggggtggagaaacgct

SEQ ID NO: 7138598 - DNA, 22 bp, Homo sapiens
gctgctggggtggagaaacgct

SEQ ID NO: 7138599 - DNA, 22 bp, Homo sapiens
gctgctgggtccctctgtgcca

SEQ ID NO: 7138600 - DNA, 22 bp, Homo sapiens
gctgctggtcctcagagctcat

SEQ ID NO: 7138601 - DNA, 22 bp, Homo sapiens
gctgctggtcctcagagctcat

SEQ ID NO: 7138602 - DNA, 22 bp, Homo sapiens
gctgctggtcctcagagctcat

SEQ ID NO: 7138603 - DNA, 22 bp, Homo sapiens
gctgctggtcctcagagctcat

SEQ ID NO: 7138604 - DNA, 18 bp, Homo sapiens
gctgctggtggagggagc

SEQ ID NO: 7138605 - DNA, 23 bp, Homo sapiens
gctgcctctgttggtcttcagtt

SEQ ID NO: 7138606 - DNA, 23 bp, Homo sapiens
gctgcctctgttggtcttcagtt

SEQ ID NO: 7138607 - DNA, 22 bp, Homo sapiens
gctgcctgaaatgttgcctagc

SEQ ID NO: 7138608 - DNA, 22 bp, Homo sapiens
gctgcctctgtagctttggacc

SEQ ID NO: 7138609 - DNA, 22 bp, Homo sapiens
gctgctggaacaaatcacccca

SEQ ID NO: 7138610 - DNA, 22 bp, Homo sapiens
gctgctgcttgaaggctcggag

SEQ ID NO: 7138611 - DNA, 22 bp, Homo sapiens
gctgctgcttgaaggctcggag

SEQ ID NO: 7138612 - DNA, 22 bp, Homo sapiens
gctgctggaacaaatcacccca

SEQ ID NO: 7138613 - DNA, 22 bp, Homo sapiens
gctgctggcgctgggcgtccgg

SEQ ID NO: 7138614 - DNA, 22 bp, Homo sapiens
gctgctggcgctgggcgtccgg

SEQ ID NO: 7138615 - DNA, 19 bp, Homo sapiens
gctgctggctctggctgga

SEQ ID NO: 7138616 - DNA, 19 bp, Homo sapiens
gctgctggctctggctgga

SEQ ID NO: 7138617 - DNA, 22 bp, Homo sapiens
gctgctggggtcacatggtaag

SEQ ID NO: 7138618 - DNA, 22 bp, Homo sapiens
gctgctgggggaacagttaaaa

SEQ ID NO: 7138619 - DNA, 22 bp, Homo sapiens
gctgctggggtcacatggtaag

SEQ ID NO: 7138620 - DNA, 22 bp, Homo sapiens
gctgctgggatcctgggtctca

SEQ ID NO: 7138621 - DNA, 22 bp, Homo sapiens
gctgctgggatcctgggtctca

SEQ ID NO: 7138622 - DNA, 22 bp, Homo sapiens
gctgctgggcaccccctgagct

SEQ ID NO: 7138623 - DNA, 22 bp, Homo sapiens
gctgctgggcaccccctgagct

SEQ ID NO: 7138624 - DNA, 22 bp, Homo sapiens
gctgctgggaatgaacagtgtt

SEQ ID NO: 7138625 - DNA, 22 bp, Homo sapiens
gctgctggcttcctgctgtttt

SEQ ID NO: 7138626 - DNA, 22 bp, Homo sapiens
gctgctggcttcctgctgtttt

SEQ ID NO: 7138627 - DNA, 22 bp, Homo sapiens
gctgctgggaatgaacagtgtt

SEQ ID NO: 7138628 - DNA, 22 bp, Homo sapiens
gctgctggcttcctgctgtttt

SEQ ID NO: 7138629 - DNA, 19 bp, Homo sapiens
gctgctggctctggctgga

SEQ ID NO: 7138630 - DNA, 19 bp, Homo sapiens
gctgctggctctggctgga

SEQ ID NO: 7138631 - DNA, 19 bp, Homo sapiens
gctgctggctctggctgga

SEQ ID NO: 7138632 - DNA, 19 bp, Homo sapiens
gctgctggctctggctgga

SEQ ID NO: 7138633 - DNA, 22 bp, Homo sapiens
gctccccattgatctgcaggct

SEQ ID NO: 7138634 - DNA, 22 bp, Homo sapiens
gctccccaggctggtcccctcg

SEQ ID NO: 7138635 - DNA, 22 bp, Homo sapiens
gctccccattgatctgcaggct

SEQ ID NO: 7138636 - DNA, 20 bp, Homo sapiens
gctccccttctctgggcctc

SEQ ID NO: 7138637 - DNA, 20 bp, Homo sapiens
gctccccttctctgggcctc

SEQ ID NO: 7138638 - DNA, 22 bp, Homo sapiens
gctccctaatttgttaatgctg

SEQ ID NO: 7138639 - DNA, 22 bp, Homo sapiens
gctccctatttggccttctctg

SEQ ID NO: 7138640 - DNA, 22 bp, Homo sapiens
gctccctccatgaggcagaccg

SEQ ID NO: 7138641 - DNA, 22 bp, Homo sapiens
gctccctcccaccagcctgcag

SEQ ID NO: 7138642 - DNA, 22 bp, Homo sapiens
gctccctcccaccagcctgcag

SEQ ID NO: 7138643 - DNA, 22 bp, Homo sapiens
gctccctcccaccagcctgcag

SEQ ID NO: 7138644 - DNA, 22 bp, Homo sapiens
gctcccaggaagagaagggcca

SEQ ID NO: 7138645 - DNA, 22 bp, Homo sapiens
gctcccaggatgaggagccagg

SEQ ID NO: 7138646 - DNA, 22 bp, Homo sapiens
gctcccagctggagcctcaaca

SEQ ID NO: 7138647 - DNA, 22 bp, Homo sapiens
gctcccaggaagagaagggcca

SEQ ID NO: 7138648 - DNA, 22 bp, Homo sapiens
gctcccagctggagcctcaaca

SEQ ID NO: 7138649 - DNA, 22 bp, Homo sapiens
gctcccagctggagcctcaaca

SEQ ID NO: 7138650 - DNA, 22 bp, Homo sapiens
gctcccagctggagcctcaaca

SEQ ID NO: 7138651 - DNA, 22 bp, Homo sapiens
gctcccagcattgctgctgaat

SEQ ID NO: 7138652 - DNA, 22 bp, Homo sapiens
gctcccagcattgcttcccagg

SEQ ID NO: 7138653 - DNA, 22 bp, Homo sapiens
gctcccagcattgcttcccagg

SEQ ID NO: 7138654 - DNA, 22 bp, Homo sapiens
gctcccagcattgcttcccagg

SEQ ID NO: 7138655 - DNA, 22 bp, Homo sapiens
gctcccagcattgctgctgaat

SEQ ID NO: 7138656 - DNA, 22 bp, Homo sapiens
gctcccagcattgctgctgaat

SEQ ID NO: 7138657 - DNA, 22 bp, Homo sapiens
gctcccagcattgcttcccagg

SEQ ID NO: 7138658 - DNA, 20 bp, Homo sapiens
gctcccagcctgcagtcccc

SEQ ID NO: 7138659 - DNA, 20 bp, Homo sapiens
gctcccagcctgcagtcccc

SEQ ID NO: 7138660 - DNA, 20 bp, Homo sapiens
gctcccagcctgcagtcccc

SEQ ID NO: 7138661 - DNA, 22 bp, Homo sapiens
gctctctgccatatgaggatac

SEQ ID NO: 7138662 - DNA, 22 bp, Homo sapiens
gctctctgccatatgaggatac

SEQ ID NO: 7138663 - DNA, 22 bp, Homo sapiens
gctctctgcagcctccttggag

SEQ ID NO: 7138664 - DNA, 22 bp, Homo sapiens
gctctctgcagcctccttggag

SEQ ID NO: 7138665 - DNA, 21 bp, Homo sapiens
gctctctgcatggtggctcag

SEQ ID NO: 7138666 - DNA, 21 bp, Homo sapiens
gctctctgcatggtggctcag

SEQ ID NO: 7138667 - DNA, 21 bp, Homo sapiens
gctctctgcatggtggctcag

SEQ ID NO: 7138668 - DNA, 22 bp, Homo sapiens
gctctctgcagcctccttggag

SEQ ID NO: 7138669 - DNA, 22 bp, Homo sapiens
gctctctgcagcctccttggag

SEQ ID NO: 7138670 - DNA, 22 bp, Homo sapiens
gctctctgcaagtcagcagcct

SEQ ID NO: 7138671 - DNA, 22 bp, Homo sapiens
gctctctgcaagtcagcagcct

SEQ ID NO: 7138672 - DNA, 22 bp, Homo sapiens
gctctctgaggtgctggcagag

SEQ ID NO: 7138673 - DNA, 22 bp, Homo sapiens
gctctctgaggtgctggcagag

SEQ ID NO: 7138674 - DNA, 22 bp, Homo sapiens
gctctctgaggtgctggcagag

SEQ ID NO: 7138675 - DNA, 22 bp, Homo sapiens
gctctctcttggggattcagca

SEQ ID NO: 7138676 - DNA, 22 bp, Homo sapiens
gctctctcgtgaacaggtggtt

SEQ ID NO: 7138677 - DNA, 22 bp, Homo sapiens
gctctctgaggtgctggcagag

SEQ ID NO: 7138678 - DNA, 22 bp, Homo sapiens
gctctctgaggtgctggcagag

SEQ ID NO: 7138679 - DNA, 22 bp, Homo sapiens
gctctctccctaggcaagtgag

SEQ ID NO: 7138680 - DNA, 22 bp, Homo sapiens
gctctctcgtgaacaggtggtt

SEQ ID NO: 7138681 - DNA, 22 bp, Homo sapiens
gctctctcgtgaacaggtggtt

SEQ ID NO: 7138682 - DNA, 22 bp, Homo sapiens
gctctctccctaggcaagtgag

SEQ ID NO: 7138683 - DNA, 22 bp, Homo sapiens
gctctccaggtctcatgcactg

SEQ ID NO: 7138684 - DNA, 22 bp, Homo sapiens
gctctccaggtctcatgcactg

SEQ ID NO: 7138685 - DNA, 22 bp, Homo sapiens
gctctcccgcagcctggtgggc

SEQ ID NO: 7138686 - DNA, 22 bp, Homo sapiens
gctctcccgcagcctggtgggc

SEQ ID NO: 7138687 - DNA, 22 bp, Homo sapiens
gctctcccgcagcctggtgggc

SEQ ID NO: 7138688 - DNA, 22 bp, Homo sapiens
gctctcccgcagcctggtgggc

SEQ ID NO: 7138689 - DNA, 22 bp, Homo sapiens
gctctcccgcagcctggtgggc

SEQ ID NO: 7138690 - DNA, 19 bp, Homo sapiens
gctctccctctcagttgag

SEQ ID NO: 7138691 - DNA, 19 bp, Homo sapiens
gctctccctctcagttgag

SEQ ID NO: 7138692 - DNA, 19 bp, Homo sapiens
gctctccctctcagttgag

SEQ ID NO: 7138693 - DNA, 22 bp, Homo sapiens
gctctcctgtgcagatgctgct

SEQ ID NO: 7138694 - DNA, 22 bp, Homo sapiens
gctctcctgtgcagatgctgct

SEQ ID NO: 7138695 - DNA, 22 bp, Homo sapiens
gctctcctgtgcagatgctgct

SEQ ID NO: 7138696 - DNA, 22 bp, Homo sapiens
gctctccaggggctcccaggat

SEQ ID NO: 7138697 - DNA, 22 bp, Homo sapiens
gctctccaggggctcccaggat

SEQ ID NO: 7138698 - DNA, 22 bp, Homo sapiens
gctctccaggtccaagaatcca

SEQ ID NO: 7138699 - DNA, 22 bp, Homo sapiens
gctctccaggtctcatgcactg

SEQ ID NO: 7138700 - DNA, 21 bp, Homo sapiens
gctctccagggccagcccagg

SEQ ID NO: 7138701 - DNA, 22 bp, Homo sapiens
gctccctcccaccagcctgcag

SEQ ID NO: 7138702 - DNA, 22 bp, Homo sapiens
gctccctcccaccagcctgcag

SEQ ID NO: 7138703 - DNA, 22 bp, Homo sapiens
gctccctctgctcaggcacttg

SEQ ID NO: 7138704 - DNA, 22 bp, Homo sapiens
gctctgtggcattcatgggcag

SEQ ID NO: 7138705 - DNA, 20 bp, Homo sapiens
gctctgtgctggcggaggct

SEQ ID NO: 7138706 - DNA, 20 bp, Homo sapiens
gctctgtgctggcggaggct

SEQ ID NO: 7138707 - DNA, 20 bp, Homo sapiens
gctctgtgctggcggaggct

SEQ ID NO: 7138708 - DNA, 22 bp, Homo sapiens
gctctgtgcccctgccgtggac

SEQ ID NO: 7138709 - DNA, 22 bp, Homo sapiens
gctctgtgccagggctgggcca

SEQ ID NO: 7138710 - DNA, 22 bp, Homo sapiens
gctctgtgctagaactaagaat

SEQ ID NO: 7138711 - DNA, 22 bp, Homo sapiens
gctctgtgccacatgcagtgtt

SEQ ID NO: 7138712 - DNA, 22 bp, Homo sapiens
gctctgtgccacatgcagtgtt

SEQ ID NO: 7138713 - DNA, 22 bp, Homo sapiens
gctctgtgcagttcagggacac

SEQ ID NO: 7138714 - DNA, 19 bp, Homo sapiens
gctctgtgatgctgagggg

SEQ ID NO: 7138715 - DNA, 22 bp, Homo sapiens
gctctgtgcaaatagcacccct

SEQ ID NO: 7138716 - DNA, 22 bp, Homo sapiens
gctctgtgcaaatagcacccct

SEQ ID NO: 7138717 - DNA, 22 bp, Homo sapiens
gctctgtgagccacttgatgta

SEQ ID NO: 7138718 - DNA, 22 bp, Homo sapiens
gctctgtgagtattggccctgg

SEQ ID NO: 7138719 - DNA, 19 bp, Homo sapiens
gctctgtgatgctgagggg

SEQ ID NO: 7138720 - DNA, 22 bp, Homo sapiens
gctctgtgaccttaggcaagtt

SEQ ID NO: 7138721 - DNA, 22 bp, Homo sapiens
gctctgtgaccttaggcaagtt

SEQ ID NO: 7138722 - DNA, 22 bp, Homo sapiens
gctctgtcaacagctagctgtg

SEQ ID NO: 7138723 - DNA, 22 bp, Homo sapiens
gctctgtcaacagctagctgtg

SEQ ID NO: 7138724 - DNA, 22 bp, Homo sapiens
gctctctggttccagtcaggaa

SEQ ID NO: 7138725 - DNA, 22 bp, Homo sapiens
gctctctggttccagtcaggaa

SEQ ID NO: 7138726 - DNA, 22 bp, Homo sapiens
gctctctggttccagtcaggaa

SEQ ID NO: 7138727 - DNA, 22 bp, Homo sapiens
gctctctgggtgtgtctagata

SEQ ID NO: 7138728 - DNA, 22 bp, Homo sapiens
gctctctggctagtccatcggg

SEQ ID NO: 7138729 - DNA, 22 bp, Homo sapiens
gctctctggctagtccatcggg

SEQ ID NO: 7138730 - DNA, 22 bp, Homo sapiens
gctctctggctagtccatcggg

SEQ ID NO: 7138731 - DNA, 22 bp, Homo sapiens
gctctctggctagtccatcggg

SEQ ID NO: 7138732 - DNA, 22 bp, Homo sapiens
gctctctgggcgggagctaaga

SEQ ID NO: 7138733 - DNA, 22 bp, Homo sapiens
gctctctgggtggtgggcaaca

SEQ ID NO: 7138734 - DNA, 22 bp, Homo sapiens
gctctctgggtggtgggcaaca

SEQ ID NO: 7138735 - DNA, 22 bp, Homo sapiens
gctctctggaggccatggacag

SEQ ID NO: 7138736 - DNA, 22 bp, Homo sapiens
gctctctggaaggtatcattat

SEQ ID NO: 7138737 - DNA, 22 bp, Homo sapiens
gctctctgccatatgaggatac

SEQ ID NO: 7138738 - DNA, 22 bp, Homo sapiens
gctctctgcctttctcaatgac

SEQ ID NO: 7138739 - DNA, 22 bp, Homo sapiens
gctctggtttcctgttcactca

SEQ ID NO: 7138740 - DNA, 22 bp, Homo sapiens
gctctggttttagcctttcagg

SEQ ID NO: 7138741 - DNA, 22 bp, Homo sapiens
gctctgggtagccactgcctgg

SEQ ID NO: 7138742 - DNA, 22 bp, Homo sapiens
gctctggttctcttagagtagt

SEQ ID NO: 7138743 - DNA, 22 bp, Homo sapiens
gctctgtagtatttagtaaata

SEQ ID NO: 7138744 - DNA, 22 bp, Homo sapiens
gctctgggtagccactgcctgg

SEQ ID NO: 7138745 - DNA, 22 bp, Homo sapiens
gctctgggtagccactgcctgg

SEQ ID NO: 7138746 - DNA, 22 bp, Homo sapiens
gctctgggtagccactgcctgg

SEQ ID NO: 7138747 - DNA, 22 bp, Homo sapiens
gctctgggtagccactgcctgg

SEQ ID NO: 7138748 - DNA, 22 bp, Homo sapiens
gctctctgttattaagatcttt

SEQ ID NO: 7138749 - DNA, 22 bp, Homo sapiens
gctctcttgacagcttgctgtt

SEQ ID NO: 7138750 - DNA, 22 bp, Homo sapiens
gctctcttgacagcttgctgtt

SEQ ID NO: 7138751 - DNA, 22 bp, Homo sapiens
gctctctgtcgttatgcttcat

SEQ ID NO: 7138752 - DNA, 22 bp, Homo sapiens
gctctggggttggaaagtgatc

SEQ ID NO: 7138753 - DNA, 22 bp, Homo sapiens
gctctcttggtggctgtcctgg

SEQ ID NO: 7138754 - DNA, 22 bp, Homo sapiens
gctctcttggtggctgtcctgg

SEQ ID NO: 7138755 - DNA, 22 bp, Homo sapiens
gctcagggcgcgagggacgtgg

SEQ ID NO: 7138756 - DNA, 22 bp, Homo sapiens
gctcagggcgcgagggacgtgg

SEQ ID NO: 7138757 - DNA, 20 bp, Homo sapiens
gctcagggcctgggtctgga

SEQ ID NO: 7138758 - DNA, 20 bp, Homo sapiens
gctcagggcctgggtctgga

SEQ ID NO: 7138759 - DNA, 20 bp, Homo sapiens
gctcagggcctgggtctgga

SEQ ID NO: 7138760 - DNA, 20 bp, Homo sapiens
gctcagggcctgggtctgga

SEQ ID NO: 7138761 - DNA, 20 bp, Homo sapiens
gctcagggcctgggtctgga

SEQ ID NO: 7138762 - DNA, 22 bp, Homo sapiens
gctcagggcctggctgcggact

SEQ ID NO: 7138763 - DNA, 22 bp, Homo sapiens
gctcagggcctggctgcggact

SEQ ID NO: 7138764 - DNA, 22 bp, Homo sapiens
gctcagggcctggctgcggact

SEQ ID NO: 7138765 - DNA, 22 bp, Homo sapiens
gctcagggagtttcacagtgta

SEQ ID NO: 7138766 - DNA, 22 bp, Homo sapiens
gctcagggccatggaccagcag

SEQ ID NO: 7138767 - DNA, 22 bp, Homo sapiens
gctcagggccatggaccagcag

SEQ ID NO: 7138768 - DNA, 22 bp, Homo sapiens
gctcagggccatggaccagcag

SEQ ID NO: 7138769 - DNA, 22 bp, Homo sapiens
gctcagggccatggaccagcag

SEQ ID NO: 7138770 - DNA, 22 bp, Homo sapiens
gctcagggccatggaccagcag

SEQ ID NO: 7138771 - DNA, 22 bp, Homo sapiens
gctcagggagagagggcagccg

SEQ ID NO: 7138772 - DNA, 22 bp, Homo sapiens
gctcagggagagagggcagccg

SEQ ID NO: 7138773 - DNA, 22 bp, Homo sapiens
gctcagggagcgatttaccatg

SEQ ID NO: 7138774 - DNA, 22 bp, Homo sapiens
gctcagggagtttcacagtgta

SEQ ID NO: 7138775 - DNA, 22 bp, Homo sapiens
gctcagggagtttcacagtgta

SEQ ID NO: 7138776 - DNA, 22 bp, Homo sapiens
gctcagggagagagggcagccg

SEQ ID NO: 7138777 - DNA, 22 bp, Homo sapiens
gctcagggagagagggcagccg

SEQ ID NO: 7138778 - DNA, 20 bp, Homo sapiens
gctcagggaattcaggaagc

SEQ ID NO: 7138779 - DNA, 20 bp, Homo sapiens
gctcagggaattcaggaagc

SEQ ID NO: 7138780 - DNA, 20 bp, Homo sapiens
gctcagggaattcaggaagc

SEQ ID NO: 7138781 - DNA, 22 bp, Homo sapiens
gctcagggagagagggcagccg

SEQ ID NO: 7138782 - DNA, 22 bp, Homo sapiens
gctcagggagagagggcagccg

SEQ ID NO: 7138783 - DNA, 22 bp, Homo sapiens
gctcagggaatgagaagatgtt

SEQ ID NO: 7138784 - DNA, 22 bp, Homo sapiens
gctcagggaatgagaagatgtt

SEQ ID NO: 7138785 - DNA, 22 bp, Homo sapiens
gctcagggaaggccacgtgaga

SEQ ID NO: 7138786 - DNA, 21 bp, Homo sapiens
gctatacagaatggccagagg

SEQ ID NO: 7138787 - DNA, 22 bp, Homo sapiens
gctcagggaaggccacgtgaga

SEQ ID NO: 7138788 - DNA, 22 bp, Homo sapiens
gctcagggaaggccacgtgaga

SEQ ID NO: 7138789 - DNA, 22 bp, Homo sapiens
gctcagggaactttttgcaggc

SEQ ID NO: 7138790 - DNA, 22 bp, Homo sapiens
gctatacacatttcttggtagt

SEQ ID NO: 7138791 - DNA, 22 bp, Homo sapiens
gctatacaagtgtagaatagag

SEQ ID NO: 7138792 - DNA, 22 bp, Homo sapiens
gctatacaagtgtagaatagag

SEQ ID NO: 7138793 - DNA, 22 bp, Homo sapiens
gctagtgcagggaaatctttgg

SEQ ID NO: 7138794 - DNA, 22 bp, Homo sapiens
gctagtttcttgaatactctaa

SEQ ID NO: 7138795 - DNA, 22 bp, Homo sapiens
gctaggtgcagcagacagctta

SEQ ID NO: 7138796 - DNA, 22 bp, Homo sapiens
gctaggtgcagcagacagctta

SEQ ID NO: 7138797 - DNA, 19 bp, Homo sapiens
gctaggtgaccagctggat

SEQ ID NO: 7138798 - DNA, 22 bp, Homo sapiens
gctcagggcgcgagggacgtgg

SEQ ID NO: 7138799 - DNA, 22 bp, Homo sapiens
gctcagggctaaggctgagggg

SEQ ID NO: 7138800 - DNA, 22 bp, Homo sapiens
gctcagggctaaggctgagggg

SEQ ID NO: 7138801 - DNA, 22 bp, Homo sapiens
gctcagtgaagggtgccaagta

SEQ ID NO: 7138802 - DNA, 22 bp, Homo sapiens
gctcagtgcatcattccaggct

SEQ ID NO: 7138803 - DNA, 22 bp, Homo sapiens
gctcagtgcatcattccaggct

SEQ ID NO: 7138804 - DNA, 23 bp, Homo sapiens
gctcatcaggcttagagtcaagg

SEQ ID NO: 7138805 - DNA, 23 bp, Homo sapiens
gctcatcaggcttagagtcaagg

SEQ ID NO: 7138806 - DNA, 23 bp, Homo sapiens
gctcatcaggcttagagtcaagg

SEQ ID NO: 7138807 - DNA, 22 bp, Homo sapiens
gctcagtgttcatctgtatgca

SEQ ID NO: 7138808 - DNA, 22 bp, Homo sapiens
gctcccagcattgctgctgaat

SEQ ID NO: 7138809 - DNA, 22 bp, Homo sapiens
gctcccagcattgctgctgaat

SEQ ID NO: 7138810 - DNA, 22 bp, Homo sapiens
gctcccagcaattgaggcagcc

SEQ ID NO: 7138811 - DNA, 22 bp, Homo sapiens
gctcccagcaattgaggcagcc

SEQ ID NO: 7138812 - DNA, 22 bp, Homo sapiens
gctcccagatttcagccttgtg

SEQ ID NO: 7138813 - DNA, 22 bp, Homo sapiens
gctcccagcaattgaggcagcc

SEQ ID NO: 7138814 - DNA, 22 bp, Homo sapiens
gctcccagcaattgaggcagcc

SEQ ID NO: 7138815 - DNA, 22 bp, Homo sapiens
gctcccagatttcagccttgtg

SEQ ID NO: 7138816 - DNA, 22 bp, Homo sapiens
gctcccagatttcagccttgtg

SEQ ID NO: 7138817 - DNA, 22 bp, Homo sapiens
gctcccagatttcagccttgtg

SEQ ID NO: 7138818 - DNA, 22 bp, Homo sapiens
gctcccagatttcagccttgtg

SEQ ID NO: 7138819 - DNA, 22 bp, Homo sapiens
gctcccagatttcagccttgtg

SEQ ID NO: 7138820 - DNA, 22 bp, Homo sapiens
gctcccagactgaccagaggtg

SEQ ID NO: 7138821 - DNA, 22 bp, Homo sapiens
gctcccagactgaccagaggtg

SEQ ID NO: 7138822 - DNA, 23 bp, Homo sapiens
gctcatccacggagaggggctcc

SEQ ID NO: 7138823 - DNA, 22 bp, Homo sapiens
gctcatccagcaagccagggcc

SEQ ID NO: 7138824 - DNA, 22 bp, Homo sapiens
gctcccagactgaccagaggtg

SEQ ID NO: 7138825 - DNA, 22 bp, Homo sapiens
gctcccagactgaccagaggtg

SEQ ID NO: 7138826 - DNA, 19 bp, Homo sapiens
gctaggctggccttgaggg

SEQ ID NO: 7138827 - DNA, 22 bp, Homo sapiens
gctaggctgtgtttcagaccct

SEQ ID NO: 7138828 - DNA, 22 bp, Homo sapiens
gctagggtggctaataggagag

SEQ ID NO: 7138829 - DNA, 19 bp, Homo sapiens
gctagggttggtggcgtgc

SEQ ID NO: 7138830 - DNA, 18 bp, Homo sapiens
gctagggcatgcatggtg

SEQ ID NO: 7138831 - DNA, 18 bp, Homo sapiens
gctagggcatgcatggtg

SEQ ID NO: 7138832 - DNA, 22 bp, Homo sapiens
gctagggcgggagtgctggaga

SEQ ID NO: 7138833 - DNA, 22 bp, Homo sapiens
gctagggatctgatttgctgtt

SEQ ID NO: 7138834 - DNA, 22 bp, Homo sapiens
gctagggactagggaaggagca

SEQ ID NO: 7138835 - DNA, 22 bp, Homo sapiens
gctaggcttcaaaatctccctg

SEQ ID NO: 7138836 - DNA, 22 bp, Homo sapiens
gctagggaacctcttctgagga

SEQ ID NO: 7138837 - DNA, 22 bp, Homo sapiens
gctagggactagggaaggagca

SEQ ID NO: 7138838 - DNA, 22 bp, Homo sapiens
gctagggactagggaaggagca

SEQ ID NO: 7138839 - DNA, 22 bp, Homo sapiens
gctaggaaaggaagaactttga

SEQ ID NO: 7138840 - DNA, 22 bp, Homo sapiens
gctagctgggtttcactgtgga

SEQ ID NO: 7138841 - DNA, 22 bp, Homo sapiens
gctaggaagaagggtgcttgaa

SEQ ID NO: 7138842 - DNA, 22 bp, Homo sapiens
gctaggaagaagggtgcttgaa

SEQ ID NO: 7138843 - DNA, 22 bp, Homo sapiens
gctaggaagctggggagaagtc

SEQ ID NO: 7138844 - DNA, 22 bp, Homo sapiens
gctaggaagctggggagaagtc

SEQ ID NO: 7138845 - DNA, 22 bp, Homo sapiens
gctaggaatcggacccaggaag

SEQ ID NO: 7138846 - DNA, 22 bp, Homo sapiens
gctagagaccagaggccttgaa

SEQ ID NO: 7138847 - DNA, 22 bp, Homo sapiens
gctagaatattgggtaggcaag

SEQ ID NO: 7138848 - DNA, 22 bp, Homo sapiens
gctagccaagatgggtcacaaa

SEQ ID NO: 7138849 - DNA, 22 bp, Homo sapiens
gctagcctcccttttccatggt

SEQ ID NO: 7138850 - DNA, 22 bp, Homo sapiens
gcctggcaccacagcctttcag

SEQ ID NO: 7138851 - DNA, 20 bp, Homo sapiens
gcctggcacccggggctggc

SEQ ID NO: 7138852 - DNA, 20 bp, Homo sapiens
gcctggcacccggggctggc

SEQ ID NO: 7138853 - DNA, 20 bp, Homo sapiens
gcctggcacccggggctggc

SEQ ID NO: 7138854 - DNA, 20 bp, Homo sapiens
gcctggcacccggggctggc

SEQ ID NO: 7138855 - DNA, 20 bp, Homo sapiens
gcctggcacccggggctggc

SEQ ID NO: 7138856 - DNA, 20 bp, Homo sapiens
gcctggcacccggggctggc

SEQ ID NO: 7138857 - DNA, 16 bp, Homo sapiens
gcctggcaccgtcggc

SEQ ID NO: 7138858 - DNA, 16 bp, Homo sapiens
gcctggcaccgtcggc

SEQ ID NO: 7138859 - DNA, 22 bp, Homo sapiens
gcctggagttcagccaagtccc

SEQ ID NO: 7138860 - DNA, 22 bp, Homo sapiens
gcctggagttcagccaagtccc

SEQ ID NO: 7138861 - DNA, 22 bp, Homo sapiens
gcctggagttcagccaagtccc

SEQ ID NO: 7138862 - DNA, 22 bp, Homo sapiens
gcctggagttcagccaagtccc

SEQ ID NO: 7138863 - DNA, 22 bp, Homo sapiens
gcctggcaccacagcctttcag

SEQ ID NO: 7138864 - DNA, 20 bp, Homo sapiens
gcctggagttagttttcctt

SEQ ID NO: 7138865 - DNA, 22 bp, Homo sapiens
gcctggagtgttggtatttctc

SEQ ID NO: 7138866 - DNA, 20 bp, Homo sapiens
gcctggagttagttttcctt

SEQ ID NO: 7138867 - DNA, 20 bp, Homo sapiens
gcctggagttagttttcctt

SEQ ID NO: 7138868 - DNA, 20 bp, Homo sapiens
gcctggagttagttttcctt

SEQ ID NO: 7138869 - DNA, 22 bp, Homo sapiens
gcctggagtgttggtatttctc

SEQ ID NO: 7138870 - DNA, 22 bp, Homo sapiens
gcctggagtgttggtatttctc

SEQ ID NO: 7138871 - DNA, 22 bp, Homo sapiens
gcctggagtgttggtatttctc

SEQ ID NO: 7138872 - DNA, 22 bp, Homo sapiens
gcctggagtggtcctgctgccc

SEQ ID NO: 7138873 - DNA, 22 bp, Homo sapiens
gcctggagtggtcctgctgccc

SEQ ID NO: 7138874 - DNA, 22 bp, Homo sapiens
gcctggagtggtcctgctgccc

SEQ ID NO: 7138875 - DNA, 22 bp, Homo sapiens
gcctggagtggtcctgctgccc

SEQ ID NO: 7138876 - DNA, 22 bp, Homo sapiens
gcctggagtggtcctgctgccc

SEQ ID NO: 7138877 - DNA, 22 bp, Homo sapiens
gcctggagtggtcctgctgccc

SEQ ID NO: 7138878 - DNA, 22 bp, Homo sapiens
gcctggcactcactgaagaggc

SEQ ID NO: 7138879 - DNA, 22 bp, Homo sapiens
gcctggcactcactgaagaggc

SEQ ID NO: 7138880 - DNA, 22 bp, Homo sapiens
gcctggcactcactgaagaggc

SEQ ID NO: 7138881 - DNA, 22 bp, Homo sapiens
gcctggcactcaatcatctgct

SEQ ID NO: 7138882 - DNA, 22 bp, Homo sapiens
gcctggcactcactgaagaggc

SEQ ID NO: 7138883 - DNA, 16 bp, Homo sapiens
gcctggcaccgtcggc

SEQ ID NO: 7138884 - DNA, 16 bp, Homo sapiens
gcctggcaccgtcggc

SEQ ID NO: 7138885 - DNA, 22 bp, Homo sapiens
gcctggcacgggctcggcccac

SEQ ID NO: 7138886 - DNA, 22 bp, Homo sapiens
gcctggcacgggctcggcccac

SEQ ID NO: 7138887 - DNA, 22 bp, Homo sapiens
gcctggcacgggctcggcccac

SEQ ID NO: 7138888 - DNA, 22 bp, Homo sapiens
gcctggcactcaatcatctgct

SEQ ID NO: 7138889 - DNA, 22 bp, Homo sapiens
gcctggcactcaatcatctgct

SEQ ID NO: 7138890 - DNA, 22 bp, Homo sapiens
gcctggcactcaatcatctgct

SEQ ID NO: 7138891 - DNA, 22 bp, Homo sapiens
gcctggcactcactgaagaggc

SEQ ID NO: 7138892 - DNA, 22 bp, Homo sapiens
gcctggcactgggctcctggcc

SEQ ID NO: 7138893 - DNA, 22 bp, Homo sapiens
gcctggcactgggctcctggcc

SEQ ID NO: 7138894 - DNA, 22 bp, Homo sapiens
gcctggcactgggctcctggcc

SEQ ID NO: 7138895 - DNA, 22 bp, Homo sapiens
gcctggcagattgacatagcca

SEQ ID NO: 7138896 - DNA, 22 bp, Homo sapiens
gcctggcagattgacatagcca

SEQ ID NO: 7138897 - DNA, 22 bp, Homo sapiens
gcctggcagattgacatagcca

SEQ ID NO: 7138898 - DNA, 22 bp, Homo sapiens
gcctggcagattgacatagcca

SEQ ID NO: 7138899 - DNA, 22 bp, Homo sapiens
gcctggcagcccctagacattt

SEQ ID NO: 7138900 - DNA, 22 bp, Homo sapiens
gcctggcagcccctagacattt

SEQ ID NO: 7138901 - DNA, 22 bp, Homo sapiens
gcctggcagcccctagacattt

SEQ ID NO: 7138902 - DNA, 22 bp, Homo sapiens
gcctggcagcctccaaccttca

SEQ ID NO: 7138903 - DNA, 22 bp, Homo sapiens
gcctggcagcctccaaccttca

SEQ ID NO: 7138904 - DNA, 22 bp, Homo sapiens
gcctggcagcctccaaccttca

SEQ ID NO: 7138905 - DNA, 22 bp, Homo sapiens
gcctggcaggaatctcagtgct

SEQ ID NO: 7138906 - DNA, 22 bp, Homo sapiens
gcctggcaggaatctcagtgct

SEQ ID NO: 7138907 - DNA, 22 bp, Homo sapiens
gcctggcaggaatctcagtgct

SEQ ID NO: 7138908 - DNA, 22 bp, Homo sapiens
gcctggcaggaatctcagtgct

SEQ ID NO: 7138909 - DNA, 22 bp, Homo sapiens
gcctggcaggaatctcagtgct

SEQ ID NO: 7138910 - DNA, 22 bp, Homo sapiens
gcctggcaggcctcatgagggg

SEQ ID NO: 7138911 - DNA, 22 bp, Homo sapiens
gcctggcaggcctcatgagggg

SEQ ID NO: 7138912 - DNA, 22 bp, Homo sapiens
gcctggcaggcctcatgagggg

SEQ ID NO: 7138913 - DNA, 22 bp, Homo sapiens
gcctggcaggcctcatgagggg

SEQ ID NO: 7138914 - DNA, 22 bp, Homo sapiens
gctagaaaatgaaagataattt

SEQ ID NO: 7138915 - DNA, 22 bp, Homo sapiens
gctagaaatcgacttcagaatt

SEQ ID NO: 7138916 - DNA, 19 bp, Homo sapiens
gctggccacgccccagttg

SEQ ID NO: 7138917 - DNA, 19 bp, Homo sapiens
gctggccacgccccagttg

SEQ ID NO: 7138918 - DNA, 19 bp, Homo sapiens
gctggccacgccccagttg

SEQ ID NO: 7138919 - DNA, 22 bp, Homo sapiens
gctggccagccctcttcctcca

SEQ ID NO: 7138920 - DNA, 22 bp, Homo sapiens
gctggccaggaagagtctcaga

SEQ ID NO: 7138921 - DNA, 22 bp, Homo sapiens
gctggccacagatccccaggga

SEQ ID NO: 7138922 - DNA, 22 bp, Homo sapiens
gctggccacagatccccaggga

SEQ ID NO: 7138923 - DNA, 22 bp, Homo sapiens
gctggccacattgtgccgtcct

SEQ ID NO: 7138924 - DNA, 22 bp, Homo sapiens
gctggccacactgctgatggag

SEQ ID NO: 7138925 - DNA, 22 bp, Homo sapiens
gctggccacactgctgatggag

SEQ ID NO: 7138926 - DNA, 22 bp, Homo sapiens
gctggtcagggagggcacccat

SEQ ID NO: 7138927 - DNA, 22 bp, Homo sapiens
gctggtcagggagggcacccat

SEQ ID NO: 7138928 - DNA, 22 bp, Homo sapiens
gctggtcagggtattggaggcc

SEQ ID NO: 7138929 - DNA, 22 bp, Homo sapiens
gctggtccacatcctggtacgt

SEQ ID NO: 7138930 - DNA, 22 bp, Homo sapiens
gctggtccactccctggaggct

SEQ ID NO: 7138931 - DNA, 22 bp, Homo sapiens
gctggtccactccctggaggct

SEQ ID NO: 7138932 - DNA, 22 bp, Homo sapiens
gctggtccagggcctctgtggg

SEQ ID NO: 7138933 - DNA, 22 bp, Homo sapiens
gctggtccattggcactgctca

SEQ ID NO: 7138934 - DNA, 22 bp, Homo sapiens
gctggtccattggcactgctca

SEQ ID NO: 7138935 - DNA, 23 bp, Homo sapiens
gctgtacaggaaccagtttggag

SEQ ID NO: 7138936 - DNA, 22 bp, Homo sapiens
gctgtacagggttatcctttcc

SEQ ID NO: 7138937 - DNA, 19 bp, Homo sapiens
gctgtacagtaaggagaca

SEQ ID NO: 7138938 - DNA, 22 bp, Homo sapiens
gctgtacagtttactaggtggg

SEQ ID NO: 7138939 - DNA, 22 bp, Homo sapiens
gctgtacatcacaatttgctgt

SEQ ID NO: 7138940 - DNA, 22 bp, Homo sapiens
gctgtacattctgcacaggccc

SEQ ID NO: 7138941 - DNA, 22 bp, Homo sapiens
gctgtacattctgcacaggccc

SEQ ID NO: 7138942 - DNA, 22 bp, Homo sapiens
gctgtacattctgtgggtttgg

SEQ ID NO: 7138943 - DNA, 22 bp, Homo sapiens
gctgtacatttgtgtacacttg

SEQ ID NO: 7138944 - DNA, 22 bp, Homo sapiens
gctgtcagttttacccacagac

SEQ ID NO: 7138945 - DNA, 22 bp, Homo sapiens
gctgtcacaaattgggttcttt

SEQ ID NO: 7138946 - DNA, 22 bp, Homo sapiens
gctgtcacacatggccccagct

SEQ ID NO: 7138947 - DNA, 22 bp, Homo sapiens
gctgtcacacatgggatctcag

SEQ ID NO: 7138948 - DNA, 22 bp, Homo sapiens
gctgtcacatcaaggcactaaa

SEQ ID NO: 7138949 - DNA, 22 bp, Homo sapiens
gctgtcacatttggagcactgg

SEQ ID NO: 7138950 - DNA, 22 bp, Homo sapiens
gctgtattggaacacatccatg

SEQ ID NO: 7138951 - DNA, 22 bp, Homo sapiens
gctgtatttaacaactggctca

SEQ ID NO: 7138952 - DNA, 22 bp, Homo sapiens
gctgtattcctgcactgtatag

SEQ ID NO: 7138953 - DNA, 22 bp, Homo sapiens
gctgtatgtgaggccacagtga

SEQ ID NO: 7138954 - DNA, 22 bp, Homo sapiens
gctgtagtgaatggccgcgttc

SEQ ID NO: 7138955 - DNA, 22 bp, Homo sapiens
gctgtatgtgaggccacagtga

SEQ ID NO: 7138956 - DNA, 22 bp, Homo sapiens
gctgtagtgaatggccgcgttc

SEQ ID NO: 7138957 - DNA, 21 bp, Homo sapiens
gctgtactttgaactgggtgt

SEQ ID NO: 7138958 - DNA, 22 bp, Homo sapiens
gctgtgtgacctgggcaagtct

SEQ ID NO: 7138959 - DNA, 22 bp, Homo sapiens
gctgtgtgacctgggcaagtct

SEQ ID NO: 7138960 - DNA, 19 bp, Homo sapiens
gctgtgtgaccttgggcaa

SEQ ID NO: 7138961 - DNA, 22 bp, Homo sapiens
gctgtgtgactgagagcctggc

SEQ ID NO: 7138962 - DNA, 22 bp, Homo sapiens
gctgtgtgactgagagcctggc

SEQ ID NO: 7138963 - DNA, 22 bp, Homo sapiens
gctgtgtgactgagagcctggc

SEQ ID NO: 7138964 - DNA, 22 bp, Homo sapiens
gctgtgtgactgagagcctggc

SEQ ID NO: 7138965 - DNA, 18 bp, Homo sapiens
gctgtgtgcacctgataa

SEQ ID NO: 7138966 - DNA, 22 bp, Homo sapiens
gctgtgtgccaggggaaggctg

SEQ ID NO: 7138967 - DNA, 22 bp, Homo sapiens
gctgtgtgccaggggaaggctg

SEQ ID NO: 7138968 - DNA, 22 bp, Homo sapiens
gctgtgtgccaggggaaggctg

SEQ ID NO: 7138969 - DNA, 22 bp, Homo sapiens
gctgtgtgctaggatatgtttt

SEQ ID NO: 7138970 - DNA, 22 bp, Homo sapiens
gctgtgtgctaggatatgtttt

SEQ ID NO: 7138971 - DNA, 22 bp, Homo sapiens
gctgtgtgccaggggaaggctg

SEQ ID NO: 7138972 - DNA, 22 bp, Homo sapiens
gctgtgtgctcacgtagtggaa

SEQ ID NO: 7138973 - DNA, 22 bp, Homo sapiens
gctgtgtgctaggatatgtttt

SEQ ID NO: 7138974 - DNA, 22 bp, Homo sapiens
gctgtgtgctcacgtagtggaa

SEQ ID NO: 7138975 - DNA, 22 bp, Homo sapiens
gctgtgtgctcacgtagtggaa

SEQ ID NO: 7138976 - DNA, 22 bp, Homo sapiens
gctgtgtgctcacgtagtggaa

SEQ ID NO: 7138977 - DNA, 22 bp, Homo sapiens
gctgtctggcatggcgtggctg

SEQ ID NO: 7138978 - DNA, 22 bp, Homo sapiens
gctgtctggaggctctgaggga

SEQ ID NO: 7138979 - DNA, 22 bp, Homo sapiens
gctgtctggaggctctgaggga

SEQ ID NO: 7138980 - DNA, 22 bp, Homo sapiens
gctgtctggaggctctgaggga

SEQ ID NO: 7138981 - DNA, 22 bp, Homo sapiens
gctgtctggatatcttggaatt

SEQ ID NO: 7138982 - DNA, 22 bp, Homo sapiens
gctgtctgggttgagggccctg

SEQ ID NO: 7138983 - DNA, 22 bp, Homo sapiens
gctgtctgggttgagggccctg

SEQ ID NO: 7138984 - DNA, 23 bp, Homo sapiens
gctgtctgtcatctctgcgggag

SEQ ID NO: 7138985 - DNA, 22 bp, Homo sapiens
gctgtctgtctctgtcccacca

SEQ ID NO: 7138986 - DNA, 22 bp, Homo sapiens
gctgtctgttcgagcgtgtgtt

SEQ ID NO: 7138987 - DNA, 22 bp, Homo sapiens
gctgtctgctgtgcactgagca

SEQ ID NO: 7138988 - DNA, 22 bp, Homo sapiens
gctgtctcatgggtgctagtcc

SEQ ID NO: 7138989 - DNA, 22 bp, Homo sapiens
gctgtctgctgggtcgctcagg

SEQ ID NO: 7138990 - DNA, 22 bp, Homo sapiens
gctgtctgctgtgcactgagca

SEQ ID NO: 7138991 - DNA, 22 bp, Homo sapiens
gctgtctcatacaaggccctgc

SEQ ID NO: 7138992 - DNA, 22 bp, Homo sapiens
gctgtctcatacaaggccctgc

SEQ ID NO: 7138993 - DNA, 22 bp, Homo sapiens
gctgtctcatgggtgctagtcc

SEQ ID NO: 7138994 - DNA, 22 bp, Homo sapiens
gctgtcctgggaacaggcacta

SEQ ID NO: 7138995 - DNA, 22 bp, Homo sapiens
gctgtctagggaggctgtcacc

SEQ ID NO: 7138996 - DNA, 22 bp, Homo sapiens
gctgtcccgctgacttccagct

SEQ ID NO: 7138997 - DNA, 17 bp, Homo sapiens
gctgtcccttcaagagt

SEQ ID NO: 7138998 - DNA, 22 bp, Homo sapiens
gctgtcccttgtcccaccttgc

SEQ ID NO: 7138999 - DNA, 22 bp, Homo sapiens
gctgtccctttcacaaggtttt

SEQ ID NO: 7139000 - DNA, 23 bp, Homo sapiens
gctgtcctcctgggcccagcagc

SEQ ID NO: 7139001 - DNA, 23 bp, Homo sapiens
gctgtcctcctgggcccagcagc

SEQ ID NO: 7139002 - DNA, 22 bp, Homo sapiens
gctgtcctcgtctctcacgcaa

SEQ ID NO: 7139003 - DNA, 22 bp, Homo sapiens
gctgtcctctgatctctggagg

SEQ ID NO: 7139004 - DNA, 22 bp, Homo sapiens
gctgtcctctgatctctggagg

SEQ ID NO: 7139005 - DNA, 22 bp, Homo sapiens
gctgtcctcttggactcagggc

SEQ ID NO: 7139006 - DNA, 22 bp, Homo sapiens
gctgtccaacctgcactcgcgt

SEQ ID NO: 7139007 - DNA, 22 bp, Homo sapiens
gctgtccaacctgcactcgcgt

SEQ ID NO: 7139008 - DNA, 22 bp, Homo sapiens
gctgtccacctccagagcctta

SEQ ID NO: 7139009 - DNA, 22 bp, Homo sapiens
gctgtccagctccagccagcca

SEQ ID NO: 7139010 - DNA, 22 bp, Homo sapiens
gctgtccaggagtgcagagatt

SEQ ID NO: 7139011 - DNA, 22 bp, Homo sapiens
gctgtccatccacttcccagcg

SEQ ID NO: 7139012 - DNA, 22 bp, Homo sapiens
gctgtccatccacttcccagcg

SEQ ID NO: 7139013 - DNA, 22 bp, Homo sapiens
gctgtccatgtctggcctcagt

SEQ ID NO: 7139014 - DNA, 20 bp, Homo sapiens
gctgtcccaggccaaagggc

SEQ ID NO: 7139015 - DNA, 20 bp, Homo sapiens
gctgtcccaggccaaagggc

SEQ ID NO: 7139016 - DNA, 22 bp, Homo sapiens
gctgtcccatggttgcaagatg

SEQ ID NO: 7139017 - DNA, 23 bp, Homo sapiens
gctgtccccatgctccatccctg

SEQ ID NO: 7139018 - DNA, 23 bp, Homo sapiens
gctgtccccatgctccatccctg

SEQ ID NO: 7139019 - DNA, 22 bp, Homo sapiens
gctgtcccgctgacttccagct

SEQ ID NO: 7139020 - DNA, 22 bp, Homo sapiens
gctttggtcaggtgtccagccc

SEQ ID NO: 7139021 - DNA, 22 bp, Homo sapiens
gctttggtcaggtgtccagccc

SEQ ID NO: 7139022 - DNA, 22 bp, Homo sapiens
gctttggtcttctagctgtgag

SEQ ID NO: 7139023 - DNA, 22 bp, Homo sapiens
gctttggtacctcctgctgatc

SEQ ID NO: 7139024 - DNA, 22 bp, Homo sapiens
gctttgggtgtcctctgggcct

SEQ ID NO: 7139025 - DNA, 22 bp, Homo sapiens
gctttgggtgtcctctgggcct

SEQ ID NO: 7139026 - DNA, 22 bp, Homo sapiens
gctttggtgatacttgctggct

SEQ ID NO: 7139027 - DNA, 22 bp, Homo sapiens
gctttggttcaaccaggcaatt

SEQ ID NO: 7139028 - DNA, 22 bp, Homo sapiens
gctttgtgaattattactcaca

SEQ ID NO: 7139029 - DNA, 22 bp, Homo sapiens
gctttggcccaggagccaaggt

SEQ ID NO: 7139030 - DNA, 22 bp, Homo sapiens
gctttgggggctgcagtgcgtg

SEQ ID NO: 7139031 - DNA, 22 bp, Homo sapiens
gctttatccgcttgacccttac

SEQ ID NO: 7139032 - DNA, 22 bp, Homo sapiens
gctttatccgcttgacccttac

SEQ ID NO: 7139033 - DNA, 21 bp, Homo sapiens
gctttagatttagtgagccag

SEQ ID NO: 7139034 - DNA, 22 bp, Homo sapiens
gctttatagccctattacatga

SEQ ID NO: 7139035 - DNA, 22 bp, Homo sapiens
gctttagagcccagcttggtgg

SEQ ID NO: 7139036 - DNA, 22 bp, Homo sapiens
gctttagatactcccaatgtcc

SEQ ID NO: 7139037 - DNA, 22 bp, Homo sapiens
gctttagatagatttagtcttt

SEQ ID NO: 7139038 - DNA, 22 bp, Homo sapiens
gctttagatctgactttctgtg

SEQ ID NO: 7139039 - DNA, 22 bp, Homo sapiens
gctttactgtctggaaagtttg

SEQ ID NO: 7139040 - DNA, 22 bp, Homo sapiens
gctttactgagatgacacaggg

SEQ ID NO: 7139041 - DNA, 22 bp, Homo sapiens
gctttactgagatgacacaggg

SEQ ID NO: 7139042 - DNA, 22 bp, Homo sapiens
gctttagaaatatcactgtgga

SEQ ID NO: 7139043 - DNA, 22 bp, Homo sapiens
gctttagaaatgagtaaattag

SEQ ID NO: 7139044 - DNA, 22 bp, Homo sapiens
gctttagaaatgtaggagatac

SEQ ID NO: 7139045 - DNA, 22 bp, Homo sapiens
gctttagaagacactctgtttt

SEQ ID NO: 7139046 - DNA, 22 bp, Homo sapiens
gctttagacataaagttcttca

SEQ ID NO: 7139047 - DNA, 22 bp, Homo sapiens
gctttagagaagaaaggttgct

SEQ ID NO: 7139048 - DNA, 22 bp, Homo sapiens
gcttttttgctattgaagtggt

SEQ ID NO: 7139049 - DNA, 23 bp, Homo sapiens
ggaaaaacactgtgtcttggcag

SEQ ID NO: 7139050 - DNA, 18 bp, Homo sapiens
gctttttagtgcatcttc

SEQ ID NO: 7139051 - DNA, 18 bp, Homo sapiens
gctttttagtgcatcttc

SEQ ID NO: 7139052 - DNA, 22 bp, Homo sapiens
gcttttgtgagattaagctact

SEQ ID NO: 7139053 - DNA, 22 bp, Homo sapiens
gcttttgtgagctctcactttg

SEQ ID NO: 7139054 - DNA, 22 bp, Homo sapiens
gcttttgtggctgtcttcattg

SEQ ID NO: 7139055 - DNA, 22 bp, Homo sapiens
gcttttggacctctgatgtttc

SEQ ID NO: 7139056 - DNA, 22 bp, Homo sapiens
gcttttggacctctgatgtttc

SEQ ID NO: 7139057 - DNA, 22 bp, Homo sapiens
gcttttggccagatggggaaac

SEQ ID NO: 7139058 - DNA, 22 bp, Homo sapiens
gcttttgtcattcaaatgctct

SEQ ID NO: 7139059 - DNA, 22 bp, Homo sapiens
gcttttatttcttcacaaaagt

SEQ ID NO: 7139060 - DNA, 22 bp, Homo sapiens
gcttttaattagttgcttccat

SEQ ID NO: 7139061 - DNA, 22 bp, Homo sapiens
gcttttatgcacataagggtca

SEQ ID NO: 7139062 - DNA, 23 bp, Homo sapiens
gcttttaaacctgtgactgccgc

SEQ ID NO: 7139063 - DNA, 22 bp, Homo sapiens
gctttgtgtagaaggaggatgg

SEQ ID NO: 7139064 - DNA, 19 bp, Homo sapiens
gcttttattgctcaggtgc

SEQ ID NO: 7139065 - DNA, 22 bp, Homo sapiens
gcttttattgtctttacgacga

SEQ ID NO: 7139066 - DNA, 22 bp, Homo sapiens
gctttaaacctctactctgtcc

SEQ ID NO: 7139067 - DNA, 22 bp, Homo sapiens
gctttaaacctctactctgtcc

SEQ ID NO: 7139068 - DNA, 22 bp, Homo sapiens
gctttaaacctctactctgtcc

SEQ ID NO: 7139069 - DNA, 20 bp, Homo sapiens
gctttaagacacagctaaaa

SEQ ID NO: 7139070 - DNA, 22 bp, Homo sapiens
gctttaatgcaatttcacctca

SEQ ID NO: 7139071 - DNA, 22 bp, Homo sapiens
gctttacagggcacaaagggag

SEQ ID NO: 7139072 - DNA, 22 bp, Homo sapiens
gctttacatgagatgaggacaa

SEQ ID NO: 7139073 - DNA, 22 bp, Homo sapiens
gcttaaattgtttgtggatagt

SEQ ID NO: 7139074 - DNA, 22 bp, Homo sapiens
gcttaaatcccaatgctagacc

SEQ ID NO: 7139075 - DNA, 22 bp, Homo sapiens
gcttaaatcccaatgctagacc

SEQ ID NO: 7139076 - DNA, 22 bp, Homo sapiens
gcttaaatcccaatgctagacc

SEQ ID NO: 7139077 - DNA, 22 bp, Homo sapiens
gcttggagtagaatgcattctt

SEQ ID NO: 7139078 - DNA, 22 bp, Homo sapiens
gcttggaagtaggattgggaga

SEQ ID NO: 7139079 - DNA, 22 bp, Homo sapiens
gcttggaagtaggattgggaga

SEQ ID NO: 7139080 - DNA, 20 bp, Homo sapiens
gcttggaccttctgctctgt

SEQ ID NO: 7139081 - DNA, 22 bp, Homo sapiens
gcttggagaagatgttctcaat

SEQ ID NO: 7139082 - DNA, 22 bp, Homo sapiens
gcttggtttggcaaaggaagga

SEQ ID NO: 7139083 - DNA, 18 bp, Homo sapiens
gcttggtttccacaaacc

SEQ ID NO: 7139084 - DNA, 22 bp, Homo sapiens
gcttggcagggcctgctggagc

SEQ ID NO: 7139085 - DNA, 22 bp, Homo sapiens
gcttggggtcatgaggctgctg

SEQ ID NO: 7139086 - DNA, 22 bp, Homo sapiens
gcttggggtcatgaggctgctg

SEQ ID NO: 7139087 - DNA, 22 bp, Homo sapiens
gcttggggtcatgaggctgctg

SEQ ID NO: 7139088 - DNA, 22 bp, Homo sapiens
gctgtgttggtgaagctgtagc

SEQ ID NO: 7139089 - DNA, 22 bp, Homo sapiens
gctgtgttgggaatcatgtggg

SEQ ID NO: 7139090 - DNA, 22 bp, Homo sapiens
gctgtgtgttcaataatgtgat

SEQ ID NO: 7139091 - DNA, 22 bp, Homo sapiens
gctgtgtgttcaataatgtgat

SEQ ID NO: 7139092 - DNA, 22 bp, Homo sapiens
gctgtgtgttcaataatgtgat

SEQ ID NO: 7139093 - DNA, 22 bp, Homo sapiens
gctgtgtgttcaataatgtgat

SEQ ID NO: 7139094 - DNA, 22 bp, Homo sapiens
gctgtgtgttcaataatgtgat

SEQ ID NO: 7139095 - DNA, 22 bp, Homo sapiens
gctgtgttcattttgcatatgt

SEQ ID NO: 7139096 - DNA, 22 bp, Homo sapiens
gctgtgttgggaatcatgtggg

SEQ ID NO: 7139097 - DNA, 22 bp, Homo sapiens
gctgtgtggcaaagggattaca

SEQ ID NO: 7139098 - DNA, 22 bp, Homo sapiens
gctgtgtggctgtgccgtcacg

SEQ ID NO: 7139099 - DNA, 22 bp, Homo sapiens
gctgtgtgctgggcatggcact

SEQ ID NO: 7139100 - DNA, 22 bp, Homo sapiens
gctgtgtgctgggcatggcact

SEQ ID NO: 7139101 - DNA, 22 bp, Homo sapiens
gctgtgtggcaaagggattaca

SEQ ID NO: 7139102 - DNA, 22 bp, Homo sapiens
gctgtgtgctcacgtagtggaa

SEQ ID NO: 7139103 - DNA, 22 bp, Homo sapiens
gctgtgtgctcacgtagtggaa

SEQ ID NO: 7139104 - DNA, 22 bp, Homo sapiens
gctgtgtgctctggtctttctt

SEQ ID NO: 7139105 - DNA, 22 bp, Homo sapiens
gctgtgtgctctggtctttctt

SEQ ID NO: 7139106 - DNA, 22 bp, Homo sapiens
gctgtgtgctctggtctttctt

SEQ ID NO: 7139107 - DNA, 22 bp, Homo sapiens
gctgtgtgctgggcatggcact

SEQ ID NO: 7139108 - DNA, 22 bp, Homo sapiens
gctgtttgaggcacatgattaa

SEQ ID NO: 7139109 - DNA, 22 bp, Homo sapiens
gctgtttgcccccactccttca

SEQ ID NO: 7139110 - DNA, 22 bp, Homo sapiens
gcttaaaagccacttagtctat

SEQ ID NO: 7139111 - DNA, 23 bp, Homo sapiens
gctgtttccccatgtgctgaagg

SEQ ID NO: 7139112 - DNA, 22 bp, Homo sapiens
gctgtttctaccagaagaatca

SEQ ID NO: 7139113 - DNA, 19 bp, Homo sapiens
ggacttggtttccaggctc

SEQ ID NO: 7139114 - DNA, 22 bp, Homo sapiens
ggacttgggctggtctgtttct

SEQ ID NO: 7139115 - DNA, 22 bp, Homo sapiens
ggacttgggctggtctgtttct

SEQ ID NO: 7139116 - DNA, 22 bp, Homo sapiens
ggacttgggctggtctgtttct

SEQ ID NO: 7139117 - DNA, 22 bp, Homo sapiens
ggagaaagaagacgaacattgt

SEQ ID NO: 7139118 - DNA, 22 bp, Homo sapiens
ggagaaagaagacgaacattgt

SEQ ID NO: 7139119 - DNA, 22 bp, Homo sapiens
ggagaaagctatgtgggggagt

SEQ ID NO: 7139120 - DNA, 22 bp, Homo sapiens
ggagaaaattgatgaagttggc

SEQ ID NO: 7139121 - DNA, 22 bp, Homo sapiens
ggagaaaattgatgaagttggc

SEQ ID NO: 7139122 - DNA, 22 bp, Homo sapiens
ggagaaaattgatgaagttggc

SEQ ID NO: 7139123 - DNA, 22 bp, Homo sapiens
ggagaaagaaatttttgattgg

SEQ ID NO: 7139124 - DNA, 22 bp, Homo sapiens
ggagaaagctgtagtggaatgt

SEQ ID NO: 7139125 - DNA, 22 bp, Homo sapiens
ggagaaagctgtagtggaatgt

SEQ ID NO: 7139126 - DNA, 22 bp, Homo sapiens
ggagaaagctgtagtggaatgt

SEQ ID NO: 7139127 - DNA, 22 bp, Homo sapiens
ggagaaaggataggaatgtgct

SEQ ID NO: 7139128 - DNA, 22 bp, Homo sapiens
ggactgggaatcagggagatgc

SEQ ID NO: 7139129 - DNA, 22 bp, Homo sapiens
ggactgggtaggagcccagggc

SEQ ID NO: 7139130 - DNA, 22 bp, Homo sapiens
ggactgggaatcagggagatgc

SEQ ID NO: 7139131 - DNA, 22 bp, Homo sapiens
ggactgggaatcagggagatgc

SEQ ID NO: 7139132 - DNA, 22 bp, Homo sapiens
ggactgggaatcagggagatgc

SEQ ID NO: 7139133 - DNA, 22 bp, Homo sapiens
ggactgggaatcagggagatgc

SEQ ID NO: 7139134 - DNA, 22 bp, Homo sapiens
ggactgggaatcagggagatgc

SEQ ID NO: 7139135 - DNA, 22 bp, Homo sapiens
ggactgctacaatatacaatta

SEQ ID NO: 7139136 - DNA, 22 bp, Homo sapiens
ggactggactctcaggctcaca

SEQ ID NO: 7139137 - DNA, 22 bp, Homo sapiens
ggactggactctcaggctcaca

SEQ ID NO: 7139138 - DNA, 22 bp, Homo sapiens
ggactgggaatcagggagatgc

SEQ ID NO: 7139139 - DNA, 22 bp, Homo sapiens
ggactgggtcactaagatagta

SEQ ID NO: 7139140 - DNA, 22 bp, Homo sapiens
ggactgggtcactaagatagta

SEQ ID NO: 7139141 - DNA, 22 bp, Homo sapiens
ggactgggtcactaagatagta

SEQ ID NO: 7139142 - DNA, 22 bp, Homo sapiens
ggactgtagacatcagcctgta

SEQ ID NO: 7139143 - DNA, 22 bp, Homo sapiens
ggactgtctactaacaagaagc

SEQ ID NO: 7139144 - DNA, 19 bp, Homo sapiens
ggactgttgccaggcctct

SEQ ID NO: 7139145 - DNA, 21 bp, Homo sapiens
ggacttacataggtaaggggt

SEQ ID NO: 7139146 - DNA, 22 bp, Homo sapiens
ggacttgcaggggagactgcgt

SEQ ID NO: 7139147 - DNA, 21 bp, Homo sapiens
ggacttggatggtggcagtag

SEQ ID NO: 7139148 - DNA, 22 bp, Homo sapiens
ggacttggcttctttcagagac

SEQ ID NO: 7139149 - DNA, 22 bp, Homo sapiens
ggacaggggcgtggggattgtt

SEQ ID NO: 7139150 - DNA, 22 bp, Homo sapiens
ggacaggggcgtggggattgtt

SEQ ID NO: 7139151 - DNA, 22 bp, Homo sapiens
ggacagggctcttggcactcct

SEQ ID NO: 7139152 - DNA, 22 bp, Homo sapiens
ggacaggggcgtggggattgtt

SEQ ID NO: 7139153 - DNA, 22 bp, Homo sapiens
ggacagggctcttggcactcct

SEQ ID NO: 7139154 - DNA, 22 bp, Homo sapiens
ggacagggctcttggcactcct

SEQ ID NO: 7139155 - DNA, 22 bp, Homo sapiens
ggacagggctcttggcactcct

SEQ ID NO: 7139156 - DNA, 22 bp, Homo sapiens
ggacagggctcttggcactcct

SEQ ID NO: 7139157 - DNA, 22 bp, Homo sapiens
ggacagggctcttggcactcct

SEQ ID NO: 7139158 - DNA, 22 bp, Homo sapiens
ggacagggctcttggcactcct

SEQ ID NO: 7139159 - DNA, 22 bp, Homo sapiens
ggacaggggcgtggggattgtt

SEQ ID NO: 7139160 - DNA, 22 bp, Homo sapiens
ggacagggtaagtactagtgtg

SEQ ID NO: 7139161 - DNA, 19 bp, Homo sapiens
ggacagggggagcttttat

SEQ ID NO: 7139162 - DNA, 19 bp, Homo sapiens
ggacagggggagcttttat

SEQ ID NO: 7139163 - DNA, 19 bp, Homo sapiens
ggacagggggagcttttat

SEQ ID NO: 7139164 - DNA, 22 bp, Homo sapiens
ggacaggggcgtggggattgtt

SEQ ID NO: 7139165 - DNA, 22 bp, Homo sapiens
ggacaggggcgtggggattgtt

SEQ ID NO: 7139166 - DNA, 22 bp, Homo sapiens
ggacaggggcgtggggattgtt

SEQ ID NO: 7139167 - DNA, 22 bp, Homo sapiens
ggacaggggcgtggggattgtt

SEQ ID NO: 7139168 - DNA, 22 bp, Homo sapiens
ggacaggctgcatctgagcatg

SEQ ID NO: 7139169 - DNA, 22 bp, Homo sapiens
ggacagggatcattatctgagc

SEQ ID NO: 7139170 - DNA, 22 bp, Homo sapiens
ggacagggatcattatctgagc

SEQ ID NO: 7139171 - DNA, 23 bp, Homo sapiens
ggacagggccctgccctatggcc

SEQ ID NO: 7139172 - DNA, 23 bp, Homo sapiens
ggacagggccctgccctatggcc

SEQ ID NO: 7139173 - DNA, 22 bp, Homo sapiens
ggacagggatcattatctgagc

SEQ ID NO: 7139174 - DNA, 23 bp, Homo sapiens
ggacagggccctgccctatggcc

SEQ ID NO: 7139175 - DNA, 22 bp, Homo sapiens
ggacagggctcttggcactcct

SEQ ID NO: 7139176 - DNA, 22 bp, Homo sapiens
ggacagggctcttggcactcct

SEQ ID NO: 7139177 - DNA, 22 bp, Homo sapiens
ggacagggctcttggcactcct

SEQ ID NO: 7139178 - DNA, 23 bp, Homo sapiens
ggacagggccctgccctatggcc

SEQ ID NO: 7139179 - DNA, 23 bp, Homo sapiens
ggacagggccctgccctatggcc

SEQ ID NO: 7139180 - DNA, 23 bp, Homo sapiens
ggacagggccctgccctatggcc

SEQ ID NO: 7139181 - DNA, 22 bp, Homo sapiens
ggacaggctgcatctgagcatg

SEQ ID NO: 7139182 - DNA, 22 bp, Homo sapiens
ggacaggctgcatctgagcatg

SEQ ID NO: 7139183 - DNA, 22 bp, Homo sapiens
ggacaggctgcatctgagcatg

SEQ ID NO: 7139184 - DNA, 22 bp, Homo sapiens
ggacaggctgcatctgagcatg

SEQ ID NO: 7139185 - DNA, 22 bp, Homo sapiens
ggacaggctgcatctgagcatg

SEQ ID NO: 7139186 - DNA, 22 bp, Homo sapiens
ggacaggcctggcacagtactg

SEQ ID NO: 7139187 - DNA, 22 bp, Homo sapiens
ggacaggccgcctcggtggggg

SEQ ID NO: 7139188 - DNA, 22 bp, Homo sapiens
ggacaggcctggcacagtactg

SEQ ID NO: 7139189 - DNA, 22 bp, Homo sapiens
ggacaggccgcctcggtggggg

SEQ ID NO: 7139190 - DNA, 22 bp, Homo sapiens
ggacaggccgcctcggtggggg

SEQ ID NO: 7139191 - DNA, 22 bp, Homo sapiens
ggacaggccgcctcggtggggg

SEQ ID NO: 7139192 - DNA, 22 bp, Homo sapiens
ggacaggcctggcacagtactg

SEQ ID NO: 7139193 - DNA, 22 bp, Homo sapiens
ggacaggcgcagggccaaggaa

SEQ ID NO: 7139194 - DNA, 22 bp, Homo sapiens
ggacaggcgcagggccaaggaa

SEQ ID NO: 7139195 - DNA, 22 bp, Homo sapiens
ggacaggcgcagggccaaggaa

SEQ ID NO: 7139196 - DNA, 22 bp, Homo sapiens
ggacaggctgcatctgagcatg

SEQ ID NO: 7139197 - DNA, 22 bp, Homo sapiens
ggacaggccgcctcggtggggg

SEQ ID NO: 7139198 - DNA, 22 bp, Homo sapiens
ggacaggccctctggtcagctt

SEQ ID NO: 7139199 - DNA, 22 bp, Homo sapiens
ggacaggccctctggtcagctt

SEQ ID NO: 7139200 - DNA, 22 bp, Homo sapiens
ggacaggcccggggagcctgga

SEQ ID NO: 7139201 - DNA, 22 bp, Homo sapiens
ggacaggcccggggagcctgga

SEQ ID NO: 7139202 - DNA, 22 bp, Homo sapiens
ggacaggcaggtgatttccaga

SEQ ID NO: 7139203 - DNA, 22 bp, Homo sapiens
ggacaggcaggtgatttccaga

SEQ ID NO: 7139204 - DNA, 22 bp, Homo sapiens
ggacaggccatatggaatacat

SEQ ID NO: 7139205 - DNA, 22 bp, Homo sapiens
ggacaggccatatggaatacat

SEQ ID NO: 7139206 - DNA, 22 bp, Homo sapiens
ggacaggcccggggagcctgga

SEQ ID NO: 7139207 - DNA, 22 bp, Homo sapiens
ggacaggcccggggagcctgga

SEQ ID NO: 7139208 - DNA, 22 bp, Homo sapiens
ggacaggcccggggagcctgga

SEQ ID NO: 7139209 - DNA, 22 bp, Homo sapiens
ggacaggcccggggagcctgga

SEQ ID NO: 7139210 - DNA, 22 bp, Homo sapiens
ggaaggagccatatcatatcca

SEQ ID NO: 7139211 - DNA, 22 bp, Homo sapiens
ggaaggaggatgctctggcctt

SEQ ID NO: 7139212 - DNA, 22 bp, Homo sapiens
ggaaggaggatgctctggcctt

SEQ ID NO: 7139213 - DNA, 22 bp, Homo sapiens
ggaaggaggatgctctggcctt

SEQ ID NO: 7139214 - DNA, 22 bp, Homo sapiens
ggaaggaggatgctctggcctt

SEQ ID NO: 7139215 - DNA, 22 bp, Homo sapiens
ggaaggaggatgctctggcctt

SEQ ID NO: 7139216 - DNA, 22 bp, Homo sapiens
ggaaggaggggcaaagcagttc

SEQ ID NO: 7139217 - DNA, 22 bp, Homo sapiens
ggaaggaggggcaaagcagttc

SEQ ID NO: 7139218 - DNA, 22 bp, Homo sapiens
ggaaggaggggcaaagcagttc

SEQ ID NO: 7139219 - DNA, 22 bp, Homo sapiens
ggaaggagggcggcaatgatga

SEQ ID NO: 7139220 - DNA, 22 bp, Homo sapiens
ggaaggagggcggcaatgatga

SEQ ID NO: 7139221 - DNA, 22 bp, Homo sapiens
ggaaggagggcggcaatgatga

SEQ ID NO: 7139222 - DNA, 22 bp, Homo sapiens
ggaaggagtctttaacacccat

SEQ ID NO: 7139223 - DNA, 22 bp, Homo sapiens
ggaaggagtctttaacacccat

SEQ ID NO: 7139224 - DNA, 22 bp, Homo sapiens
ggaaggagtctttaacacccat

SEQ ID NO: 7139225 - DNA, 22 bp, Homo sapiens
ggaaggaggggcaaagcagttc

SEQ ID NO: 7139226 - DNA, 18 bp, Homo sapiens
ggaaggagtggaccccag

SEQ ID NO: 7139227 - DNA, 18 bp, Homo sapiens
ggaaggagtggaccccag

SEQ ID NO: 7139228 - DNA, 19 bp, Homo sapiens
ggaaggcagaggggctgtg

SEQ ID NO: 7139229 - DNA, 19 bp, Homo sapiens
ggaaggcagaggggctgtg

SEQ ID NO: 7139230 - DNA, 19 bp, Homo sapiens
ggaaggagagaaatgcatg

SEQ ID NO: 7139231 - DNA, 22 bp, Homo sapiens
ggaaggagcatttgccagttta

SEQ ID NO: 7139232 - DNA, 22 bp, Homo sapiens
ggaaggagcatttgccagttta

SEQ ID NO: 7139233 - DNA, 22 bp, Homo sapiens
ggaaggagcatttgccagttta

SEQ ID NO: 7139234 - DNA, 22 bp, Homo sapiens
ggaaggaattccaagactaaag

SEQ ID NO: 7139235 - DNA, 22 bp, Homo sapiens
ggaaggaagtgcagactttaaa

SEQ ID NO: 7139236 - DNA, 22 bp, Homo sapiens
ggaaggaattccaagactaaag

SEQ ID NO: 7139237 - DNA, 22 bp, Homo sapiens
ggaaggaagtgcagactttaaa

SEQ ID NO: 7139238 - DNA, 22 bp, Homo sapiens
ggaaaaatgacacatatctcaa

SEQ ID NO: 7139239 - DNA, 22 bp, Homo sapiens
ggaaaaacagtctttattattt

SEQ ID NO: 7139240 - DNA, 22 bp, Homo sapiens
ggaaaaacagtctttattattt

SEQ ID NO: 7139241 - DNA, 22 bp, Homo sapiens
ggaaaaacagtctttattattt

SEQ ID NO: 7139242 - DNA, 22 bp, Homo sapiens
ggaaggctacaggaatccagcg

SEQ ID NO: 7139243 - DNA, 22 bp, Homo sapiens
ggaaggctcgaggatgcttctg

SEQ ID NO: 7139244 - DNA, 22 bp, Homo sapiens
ggaaggctttctgttctgtgac

SEQ ID NO: 7139245 - DNA, 22 bp, Homo sapiens
ggaaggctttgaggggtgctgg

SEQ ID NO: 7139246 - DNA, 22 bp, Homo sapiens
ggaaggctttgaggggtgctgg

SEQ ID NO: 7139247 - DNA, 22 bp, Homo sapiens
ggaaggcagtgaaggggctgat

SEQ ID NO: 7139248 - DNA, 19 bp, Homo sapiens
ggaaggccacggcaggctt

SEQ ID NO: 7139249 - DNA, 19 bp, Homo sapiens
ggaaggccacggcaggctt

SEQ ID NO: 7139250 - DNA, 22 bp, Homo sapiens
ggaaggcagaggtgtcgtgggg

SEQ ID NO: 7139251 - DNA, 19 bp, Homo sapiens
ggaaggcagaggggctgtg

SEQ ID NO: 7139252 - DNA, 22 bp, Homo sapiens
ggaaggcagtgaaggggctgat

SEQ ID NO: 7139253 - DNA, 22 bp, Homo sapiens
ggaaggcagtgaaggggctgat

SEQ ID NO: 7139254 - DNA, 22 bp, Homo sapiens
ggacagagggttgacagagtat

SEQ ID NO: 7139255 - DNA, 22 bp, Homo sapiens
ggacagagggttgacagagtat

SEQ ID NO: 7139256 - DNA, 22 bp, Homo sapiens
ggacagagggttgacagagtat

SEQ ID NO: 7139257 - DNA, 22 bp, Homo sapiens
ggacagagggttgacagagtat

SEQ ID NO: 7139258 - DNA, 22 bp, Homo sapiens
ggaagggaaaattcattcggct

SEQ ID NO: 7139259 - DNA, 22 bp, Homo sapiens
ggaagggaatccatctggttag

SEQ ID NO: 7139260 - DNA, 22 bp, Homo sapiens
ggaagggagtagttggaatgca

SEQ ID NO: 7139261 - DNA, 22 bp, Homo sapiens
ggaagggagtagttggaatgca

SEQ ID NO: 7139262 - DNA, 22 bp, Homo sapiens
ggaagggaaaattcattcggct

SEQ ID NO: 7139263 - DNA, 22 bp, Homo sapiens
ggaagggaaaattcattcggct

SEQ ID NO: 7139264 - DNA, 22 bp, Homo sapiens
ggacagagggttgacagagtat

SEQ ID NO: 7139265 - DNA, 22 bp, Homo sapiens
ggacagagggttgacagagtat

SEQ ID NO: 7139266 - DNA, 22 bp, Homo sapiens
ggacagagggttgacagagtat

SEQ ID NO: 7139267 - DNA, 22 bp, Homo sapiens
ggacaggatgctgaagatgaag

SEQ ID NO: 7139268 - DNA, 22 bp, Homo sapiens
ggacaggatgctgaagatgaag

SEQ ID NO: 7139269 - DNA, 22 bp, Homo sapiens
ggacaggataagagacactgcc

SEQ ID NO: 7139270 - DNA, 22 bp, Homo sapiens
ggacaggataagagacactgcc

SEQ ID NO: 7139271 - DNA, 22 bp, Homo sapiens
ggagctgggaattggatcatct

SEQ ID NO: 7139272 - DNA, 22 bp, Homo sapiens
ggagctgggaattggatcatct

SEQ ID NO: 7139273 - DNA, 22 bp, Homo sapiens
ggagctgggaattggatcatct

SEQ ID NO: 7139274 - DNA, 22 bp, Homo sapiens
ggagctgggaactatgtagtat

SEQ ID NO: 7139275 - DNA, 22 bp, Homo sapiens
ggagctgggaactatgtagtat

SEQ ID NO: 7139276 - DNA, 22 bp, Homo sapiens
ggagctggctacagagaactcc

SEQ ID NO: 7139277 - DNA, 22 bp, Homo sapiens
ggagctgggaactatgtagtat

SEQ ID NO: 7139278 - DNA, 22 bp, Homo sapiens
ggagctgggaccctgtcatctg

SEQ ID NO: 7139279 - DNA, 22 bp, Homo sapiens
ggagctgggaccctgtcatctg

SEQ ID NO: 7139280 - DNA, 22 bp, Homo sapiens
ggagctgggaccctgtcatctg

SEQ ID NO: 7139281 - DNA, 18 bp, Homo sapiens
ggagctgggccccactcc

SEQ ID NO: 7139282 - DNA, 18 bp, Homo sapiens
ggagctgggccccactcc

SEQ ID NO: 7139283 - DNA, 18 bp, Homo sapiens
ggagctgggccccactcc

SEQ ID NO: 7139284 - DNA, 18 bp, Homo sapiens
ggagctgggcctggttcc

SEQ ID NO: 7139285 - DNA, 18 bp, Homo sapiens
ggagctgggcctggttcc

SEQ ID NO: 7139286 - DNA, 21 bp, Homo sapiens
ggagctggggagctggcccca

SEQ ID NO: 7139287 - DNA, 21 bp, Homo sapiens
ggagctggggagctggcccca

SEQ ID NO: 7139288 - DNA, 21 bp, Homo sapiens
ggagctggggagctggcccca

SEQ ID NO: 7139289 - DNA, 21 bp, Homo sapiens
ggagctggggagctggcccca

SEQ ID NO: 7139290 - DNA, 18 bp, Homo sapiens
ggagctgggcctggttcc

SEQ ID NO: 7139291 - DNA, 22 bp, Homo sapiens
ggagctggctacagagaactcc

SEQ ID NO: 7139292 - DNA, 22 bp, Homo sapiens
ggagctggctacagagaactcc

SEQ ID NO: 7139293 - DNA, 22 bp, Homo sapiens
ggagctggctacagagaactcc

SEQ ID NO: 7139294 - DNA, 22 bp, Homo sapiens
ggagctggctacagagaactcc

SEQ ID NO: 7139295 - DNA, 20 bp, Homo sapiens
ggagctgccctgggctggag

SEQ ID NO: 7139296 - DNA, 22 bp, Homo sapiens
ggagctgctcagagccagtccc

SEQ ID NO: 7139297 - DNA, 22 bp, Homo sapiens
ggagctgcatttagggagcctt

SEQ ID NO: 7139298 - DNA, 22 bp, Homo sapiens
ggagctgcatttagggagcctt

SEQ ID NO: 7139299 - DNA, 22 bp, Homo sapiens
ggagcctggtcaggttggctcc

SEQ ID NO: 7139300 - DNA, 22 bp, Homo sapiens
ggagcctggtatagtgttgcat

SEQ ID NO: 7139301 - DNA, 22 bp, Homo sapiens
ggagcctggcctggctctgtgt

SEQ ID NO: 7139302 - DNA, 22 bp, Homo sapiens
ggagcctgggcctcctgccctt

SEQ ID NO: 7139303 - DNA, 22 bp, Homo sapiens
ggagcctggtatagtgttgcat

SEQ ID NO: 7139304 - DNA, 22 bp, Homo sapiens
ggaggaggggtgactgaatgct

SEQ ID NO: 7139305 - DNA, 22 bp, Homo sapiens
ggaggaggggtgactgaatgct

SEQ ID NO: 7139306 - DNA, 22 bp, Homo sapiens
ggaggaggggcgctttgtctat

SEQ ID NO: 7139307 - DNA, 22 bp, Homo sapiens
ggaggaggggtgactgaatgct

SEQ ID NO: 7139308 - DNA, 22 bp, Homo sapiens
ggaggaggggtgactgaatgct

SEQ ID NO: 7139309 - DNA, 22 bp, Homo sapiens
ggaggaggggtgactgaatgct

SEQ ID NO: 7139310 - DNA, 22 bp, Homo sapiens
ggaggaggggtgactgaatgct

SEQ ID NO: 7139311 - DNA, 22 bp, Homo sapiens
ggaggaggcggcagaagttcct

SEQ ID NO: 7139312 - DNA, 22 bp, Homo sapiens
ggaggaggcggcagaagttcct

SEQ ID NO: 7139313 - DNA, 22 bp, Homo sapiens
ggaggaggcggcagaagttcct

SEQ ID NO: 7139314 - DNA, 22 bp, Homo sapiens
ggaggaggggcgctttgtctat

SEQ ID NO: 7139315 - DNA, 22 bp, Homo sapiens
ggaggaggggcgctttgtctat

SEQ ID NO: 7139316 - DNA, 22 bp, Homo sapiens
ggaggaggggcgctttgtctat

SEQ ID NO: 7139317 - DNA, 21 bp, Homo sapiens
ggaggaaaaaggaatgacttg

SEQ ID NO: 7139318 - DNA, 19 bp, Homo sapiens
ggagcttggtggctgtggc

SEQ ID NO: 7139319 - DNA, 19 bp, Homo sapiens
ggagcttggtggctgtggc

SEQ ID NO: 7139320 - DNA, 21 bp, Homo sapiens
ggaggaaaaaggaatgacttg

SEQ ID NO: 7139321 - DNA, 21 bp, Homo sapiens
ggaggaaaaaggaatgacttg

SEQ ID NO: 7139322 - DNA, 22 bp, Homo sapiens
ggagctgtctgtagggcacagg

SEQ ID NO: 7139323 - DNA, 22 bp, Homo sapiens
ggagctggtcagccttgagcat

SEQ ID NO: 7139324 - DNA, 22 bp, Homo sapiens
ggagctggtcagccttgagcat

SEQ ID NO: 7139325 - DNA, 22 bp, Homo sapiens
ggagctggtcagccttgagcat

SEQ ID NO: 7139326 - DNA, 22 bp, Homo sapiens
ggagctgtaacgagccattgct

SEQ ID NO: 7139327 - DNA, 22 bp, Homo sapiens
ggagctggggttggcatcttcc

SEQ ID NO: 7139328 - DNA, 22 bp, Homo sapiens
ggagctggggttggcatcttcc

SEQ ID NO: 7139329 - DNA, 18 bp, Homo sapiens
ggagcccagaggtgagtt

SEQ ID NO: 7139330 - DNA, 22 bp, Homo sapiens
ggagccctagctgtgcatcaga

SEQ ID NO: 7139331 - DNA, 22 bp, Homo sapiens
ggagcccagtcggggtgtaggt

SEQ ID NO: 7139332 - DNA, 22 bp, Homo sapiens
ggagccctcaccggcgagtgcc

SEQ ID NO: 7139333 - DNA, 22 bp, Homo sapiens
ggagcctggagtttctgatggg

SEQ ID NO: 7139334 - DNA, 22 bp, Homo sapiens
ggagcctggagtttctgatggg

SEQ ID NO: 7139335 - DNA, 22 bp, Homo sapiens
ggagcctggcaatgctgcgtcc

SEQ ID NO: 7139336 - DNA, 22 bp, Homo sapiens
ggagcctggcaatgctgcgtcc

SEQ ID NO: 7139337 - DNA, 19 bp, Homo sapiens
ggagcctggcaggggcgtg

SEQ ID NO: 7139338 - DNA, 19 bp, Homo sapiens
ggagcctggcaggggcgtg

SEQ ID NO: 7139339 - DNA, 23 bp, Homo sapiens
ggagcctggcatatgagacgcat

SEQ ID NO: 7139340 - DNA, 23 bp, Homo sapiens
ggagcctggcatatgagacgcat

SEQ ID NO: 7139341 - DNA, 22 bp, Homo sapiens
ggagcctggcccggcccttggc

SEQ ID NO: 7139342 - DNA, 22 bp, Homo sapiens
ggagcctggcccggcccttggc

SEQ ID NO: 7139343 - DNA, 22 bp, Homo sapiens
ggagcctggcccggcccttggc

SEQ ID NO: 7139344 - DNA, 18 bp, Homo sapiens
ggagcccagaggtgagtt

SEQ ID NO: 7139345 - DNA, 18 bp, Homo sapiens
ggagcccagaggacagga

SEQ ID NO: 7139346 - DNA, 22 bp, Homo sapiens
ggagcccaagtctgcactcggc

SEQ ID NO: 7139347 - DNA, 18 bp, Homo sapiens
ggagcccacggcgtccca

SEQ ID NO: 7139348 - DNA, 22 bp, Homo sapiens
ggagccagtgccctctggtgga

SEQ ID NO: 7139349 - DNA, 18 bp, Homo sapiens
ggagccagtctgtctctg

SEQ ID NO: 7139350 - DNA, 18 bp, Homo sapiens
ggagccagtctgtctctg

SEQ ID NO: 7139351 - DNA, 18 bp, Homo sapiens
ggagccagtctgtctctg

SEQ ID NO: 7139352 - DNA, 22 bp, Homo sapiens
ggagccagtatttagtggtctt

SEQ ID NO: 7139353 - DNA, 22 bp, Homo sapiens
ggagccagtgccctctggtgga

SEQ ID NO: 7139354 - DNA, 22 bp, Homo sapiens
ggagccagtttagacctcagtt

SEQ ID NO: 7139355 - DNA, 22 bp, Homo sapiens
ggagccagtgccctctggtgga

SEQ ID NO: 7139356 - DNA, 22 bp, Homo sapiens
ggagccagtgccctctggtgga

SEQ ID NO: 7139357 - DNA, 22 bp, Homo sapiens
ggagaagcaggtgctttgggtc

SEQ ID NO: 7139358 - DNA, 17 bp, Homo sapiens
ggagccaggagcccacc

SEQ ID NO: 7139359 - DNA, 22 bp, Homo sapiens
ggagaagcagcttcttgatgaa

SEQ ID NO: 7139360 - DNA, 22 bp, Homo sapiens
ggagaagcagcttcttgatgaa

SEQ ID NO: 7139361 - DNA, 22 bp, Homo sapiens
ggagaagattggaattaagcac

SEQ ID NO: 7139362 - DNA, 22 bp, Homo sapiens
ggagccaggcatatcggggcac

SEQ ID NO: 7139363 - DNA, 22 bp, Homo sapiens
ggagccaggcatatcggggcac

SEQ ID NO: 7139364 - DNA, 17 bp, Homo sapiens
ggagccaggagcccacc

SEQ ID NO: 7139365 - DNA, 22 bp, Homo sapiens
ggagccaggcaatctgtacttt

SEQ ID NO: 7139366 - DNA, 22 bp, Homo sapiens
ggagccaggcaatctgtacttt

SEQ ID NO: 7139367 - DNA, 22 bp, Homo sapiens
ggagccaggcaatctgtacttt

SEQ ID NO: 7139368 - DNA, 22 bp, Homo sapiens
ggagccagtatttagtggtctt

SEQ ID NO: 7139369 - DNA, 22 bp, Homo sapiens
ggagccagtatttagtggtctt

SEQ ID NO: 7139370 - DNA, 22 bp, Homo sapiens
ggagccaggggaccttcacaga

SEQ ID NO: 7139371 - DNA, 22 bp, Homo sapiens
ggagccagtatttagtggtctt

SEQ ID NO: 7139372 - DNA, 22 bp, Homo sapiens
ggagccagtatttagtggtctt

SEQ ID NO: 7139373 - DNA, 22 bp, Homo sapiens
ggagccaggcatatcggggcac

SEQ ID NO: 7139374 - DNA, 22 bp, Homo sapiens
ggagccaggcatatcggggcac

SEQ ID NO: 7139375 - DNA, 22 bp, Homo sapiens
ggagccagggaagctgcttcct

SEQ ID NO: 7139376 - DNA, 22 bp, Homo sapiens
ggagccagggaagctgcttcct

SEQ ID NO: 7139377 - DNA, 22 bp, Homo sapiens
ggagccagggaagctgcttcct

SEQ ID NO: 7139378 - DNA, 22 bp, Homo sapiens
ggagaaagtacagcaggcaaca

SEQ ID NO: 7139379 - DNA, 22 bp, Homo sapiens
ggagaaagtacagcaggcaaca

SEQ ID NO: 7139380 - DNA, 22 bp, Homo sapiens
ggagaaagtacagcaggcaaca

SEQ ID NO: 7139381 - DNA, 22 bp, Homo sapiens
ggagaaaggcatagcagaacct

SEQ ID NO: 7139382 - DNA, 22 bp, Homo sapiens
ggagaaagggactgatctgctc

SEQ ID NO: 7139383 - DNA, 22 bp, Homo sapiens
ggagaaagtcagctccaagcag

SEQ ID NO: 7139384 - DNA, 22 bp, Homo sapiens
ggagaacaaatatctggcttct

SEQ ID NO: 7139385 - DNA, 22 bp, Homo sapiens
ggagaacaggcaagcatctggc

SEQ ID NO: 7139386 - DNA, 22 bp, Homo sapiens
ggagaacatatctcccacattg

SEQ ID NO: 7139387 - DNA, 22 bp, Homo sapiens
ggagaactccaaatccatattt

SEQ ID NO: 7139388 - DNA, 18 bp, Homo sapiens
ggagaagaacagatgtgg

SEQ ID NO: 7139389 - DNA, 18 bp, Homo sapiens
ggagaagaacagatgtgg

SEQ ID NO: 7139390 - DNA, 18 bp, Homo sapiens
ggagaagaacagatgtgg

SEQ ID NO: 7139391 - DNA, 22 bp, Homo sapiens
ggagaagaggagctggaagcct

SEQ ID NO: 7139392 - DNA, 22 bp, Homo sapiens
ggagaagaggagctggaagcct

SEQ ID NO: 7139393 - DNA, 22 bp, Homo sapiens
ggagaagaggagctggaagcct

SEQ ID NO: 7139394 - DNA, 22 bp, Homo sapiens
ggagaagaggagctggaagcct

SEQ ID NO: 7139395 - DNA, 22 bp, Homo sapiens
ggagaagaggagctggaagcct

SEQ ID NO: 7139396 - DNA, 22 bp, Homo sapiens
ggagaagaggagctggaagcct

SEQ ID NO: 7139397 - DNA, 22 bp, Homo sapiens
ggagaagaggagctggaagcct

SEQ ID NO: 7139398 - DNA, 22 bp, Homo sapiens
gcaaggagactgtagggccaag

SEQ ID NO: 7139399 - DNA, 22 bp, Homo sapiens
gcaaggagcacctttctggaac

SEQ ID NO: 7139400 - DNA, 22 bp, Homo sapiens
gcaaggagcctggaggtgagtg

SEQ ID NO: 7139401 - DNA, 22 bp, Homo sapiens
gcaaggagcctggaggtgagtg

SEQ ID NO: 7139402 - DNA, 22 bp, Homo sapiens
gcaaggagcctggaggtgagtg

SEQ ID NO: 7139403 - DNA, 21 bp, Homo sapiens
gcaaggcaatgccatgatttc

SEQ ID NO: 7139404 - DNA, 22 bp, Homo sapiens
gcaaggagcctggaggtgagtg

SEQ ID NO: 7139405 - DNA, 22 bp, Homo sapiens
gcaaggagcctggaggtgagtg

SEQ ID NO: 7139406 - DNA, 22 bp, Homo sapiens
gcaaggaggctggtggaggaag

SEQ ID NO: 7139407 - DNA, 22 bp, Homo sapiens
gcaaggaggctggtggaggaag

SEQ ID NO: 7139408 - DNA, 22 bp, Homo sapiens
gcaaggaggctggtggaggaag

SEQ ID NO: 7139409 - DNA, 22 bp, Homo sapiens
gcaaggaggctggtggaggaag

SEQ ID NO: 7139410 - DNA, 22 bp, Homo sapiens
gcaaggaggctggtggaggaag

SEQ ID NO: 7139411 - DNA, 17 bp, Homo sapiens
gcaaggaagttctttgc

SEQ ID NO: 7139412 - DNA, 22 bp, Homo sapiens
gcaaggaagcagagttgctatc

SEQ ID NO: 7139413 - DNA, 22 bp, Homo sapiens
gcaaggactccctgggtcattc

SEQ ID NO: 7139414 - DNA, 22 bp, Homo sapiens
gcaaggagactgtagggccaag

SEQ ID NO: 7139415 - DNA, 22 bp, Homo sapiens
gcaaggagactgtagggccaag

SEQ ID NO: 7139416 - DNA, 22 bp, Homo sapiens
gagtcacaaaagatgcccaggg

SEQ ID NO: 7139417 - DNA, 19 bp, Homo sapiens
gagtattttccaacttggt

SEQ ID NO: 7139418 - DNA, 22 bp, Homo sapiens
gagtataagctttttcacttca

SEQ ID NO: 7139419 - DNA, 22 bp, Homo sapiens
gagtataagctttttcacttca

SEQ ID NO: 7139420 - DNA, 22 bp, Homo sapiens
gagtataagtaatttcaagcaa

SEQ ID NO: 7139421 - DNA, 22 bp, Homo sapiens
gagtataagtaatttcaagcaa

SEQ ID NO: 7139422 - DNA, 22 bp, Homo sapiens
gagtagggtttccaggttagag

SEQ ID NO: 7139423 - DNA, 22 bp, Homo sapiens
gagtataatgattttcattcac

SEQ ID NO: 7139424 - DNA, 22 bp, Homo sapiens
gagtataatgattttcattcac

SEQ ID NO: 7139425 - DNA, 22 bp, Homo sapiens
gagtatataattaattggtctg

SEQ ID NO: 7139426 - DNA, 22 bp, Homo sapiens
gagtatatatagacatgtcaca

SEQ ID NO: 7139427 - DNA, 22 bp, Homo sapiens
gagtatatgactttcttttgca

SEQ ID NO: 7139428 - DNA, 22 bp, Homo sapiens
gagtatatttctctctcttaag

SEQ ID NO: 7139429 - DNA, 22 bp, Homo sapiens
gagtatatttctctctcttaag

SEQ ID NO: 7139430 - DNA, 20 bp, Homo sapiens
gagtatatttcttcctttgc

SEQ ID NO: 7139431 - DNA, 22 bp, Homo sapiens
gagtatgatgggatgacaggag

SEQ ID NO: 7139432 - DNA, 22 bp, Homo sapiens
gagtattcctcagtcattttgt

SEQ ID NO: 7139433 - DNA, 18 bp, Homo sapiens
gagtagcattgaggaaac

SEQ ID NO: 7139434 - DNA, 22 bp, Homo sapiens
gagtagcagccacagaggaccc

SEQ ID NO: 7139435 - DNA, 22 bp, Homo sapiens
gagtagcattctagagtatgct

SEQ ID NO: 7139436 - DNA, 22 bp, Homo sapiens
gagtacccagatatctctgctc

SEQ ID NO: 7139437 - DNA, 22 bp, Homo sapiens
gagtacttaactccaaatagga

SEQ ID NO: 7139438 - DNA, 22 bp, Homo sapiens
gcaatacagtaggtttattggt

SEQ ID NO: 7139439 - DNA, 22 bp, Homo sapiens
gcaataaataacatggaagaca

SEQ ID NO: 7139440 - DNA, 20 bp, Homo sapiens
gcaataagtaagtacaacag

SEQ ID NO: 7139441 - DNA, 22 bp, Homo sapiens
gcaataaagtagcagctcatca

SEQ ID NO: 7139442 - DNA, 22 bp, Homo sapiens
gcaataaagtagcagctcatca

SEQ ID NO: 7139443 - DNA, 22 bp, Homo sapiens
gcaaggctcccgcagcccaggg

SEQ ID NO: 7139444 - DNA, 22 bp, Homo sapiens
gcaataaaatgtaatgattggg

SEQ ID NO: 7139445 - DNA, 22 bp, Homo sapiens
gcaataaacatgtttgatgcgc

SEQ ID NO: 7139446 - DNA, 22 bp, Homo sapiens
gcaataaacatgtttgatgcgc

SEQ ID NO: 7139447 - DNA, 18 bp, Homo sapiens
gcaaggctcaggccaggc

SEQ ID NO: 7139448 - DNA, 22 bp, Homo sapiens
gcaaggctcacattgaactgaa

SEQ ID NO: 7139449 - DNA, 22 bp, Homo sapiens
gcaaggcctgaggtgggtgctc

SEQ ID NO: 7139450 - DNA, 17 bp, Homo sapiens
gcaaggcctgtttgttc

SEQ ID NO: 7139451 - DNA, 22 bp, Homo sapiens
gcaaggctcacattgaactgaa

SEQ ID NO: 7139452 - DNA, 18 bp, Homo sapiens
gcaaggctcaggccaggc

SEQ ID NO: 7139453 - DNA, 21 bp, Homo sapiens
gcaaggctcattcttgttgta

SEQ ID NO: 7139454 - DNA, 20 bp, Homo sapiens
gcaaggctccaaggggtgtg

SEQ ID NO: 7139455 - DNA, 22 bp, Homo sapiens
gcaaggcagtcctggggccctg

SEQ ID NO: 7139456 - DNA, 19 bp, Homo sapiens
gcaaggccagcttgatgtg

SEQ ID NO: 7139457 - DNA, 21 bp, Homo sapiens
gcaaggcctatcatggcagct

SEQ ID NO: 7139458 - DNA, 21 bp, Homo sapiens
gcaaggcctatcatggcagct

SEQ ID NO: 7139459 - DNA, 21 bp, Homo sapiens
gcaaggcctatcatggcagct

SEQ ID NO: 7139460 - DNA, 22 bp, Homo sapiens
gcaaggcctgaggtgggtgctc

SEQ ID NO: 7139461 - DNA, 22 bp, Homo sapiens
gcaaggcctgaggtgggtgctc

SEQ ID NO: 7139462 - DNA, 22 bp, Homo sapiens
gcaaggcagcgcggagtagcta

SEQ ID NO: 7139463 - DNA, 20 bp, Homo sapiens
gcaaggcacagtgaggaggg

SEQ ID NO: 7139464 - DNA, 20 bp, Homo sapiens
gcaaggcacagtgaggaggg

SEQ ID NO: 7139465 - DNA, 20 bp, Homo sapiens
gcaaggcacagtgaggaggg

SEQ ID NO: 7139466 - DNA, 22 bp, Homo sapiens
gcacagaaccagacatgaggca

SEQ ID NO: 7139467 - DNA, 22 bp, Homo sapiens
gcaatagattatgatctacagt

SEQ ID NO: 7139468 - DNA, 22 bp, Homo sapiens
gcaatactgagattattgtact

SEQ ID NO: 7139469 - DNA, 22 bp, Homo sapiens
gcaatactgagattattgtact

SEQ ID NO: 7139470 - DNA, 22 bp, Homo sapiens
gcaatacagtaggtttattggt

SEQ ID NO: 7139471 - DNA, 22 bp, Homo sapiens
gcaatactaagtgacttttggg

SEQ ID NO: 7139472 - DNA, 22 bp, Homo sapiens
gcaatactaagtgacttttggg

SEQ ID NO: 7139473 - DNA, 22 bp, Homo sapiens
gcaatactcaacacttttgctt

SEQ ID NO: 7139474 - DNA, 22 bp, Homo sapiens
gcaatagactgtttttattgtt

SEQ ID NO: 7139475 - DNA, 22 bp, Homo sapiens
gcaatagactgtttttattgtt

SEQ ID NO: 7139476 - DNA, 22 bp, Homo sapiens
gcaatagacttggttcttctgt

SEQ ID NO: 7139477 - DNA, 22 bp, Homo sapiens
gcaatagacttggttcttctgt

SEQ ID NO: 7139478 - DNA, 22 bp, Homo sapiens
gcaatagagcagctaatggaaa

SEQ ID NO: 7139479 - DNA, 22 bp, Homo sapiens
gcaatagattatgatctacagt

SEQ ID NO: 7139480 - DNA, 22 bp, Homo sapiens
gcaatagattatgatctacagt

SEQ ID NO: 7139481 - DNA, 22 bp, Homo sapiens
gcacagaagtaaaatacaagtc

SEQ ID NO: 7139482 - DNA, 22 bp, Homo sapiens
gcacagaagtaaaatacaagtc

SEQ ID NO: 7139483 - DNA, 22 bp, Homo sapiens
gcacagaataacactctgggct

SEQ ID NO: 7139484 - DNA, 22 bp, Homo sapiens
gcacagacagaatccctactcc

SEQ ID NO: 7139485 - DNA, 22 bp, Homo sapiens
gcacagacaccattaaatattt

SEQ ID NO: 7139486 - DNA, 22 bp, Homo sapiens
gcacagacagaatccctactcc

SEQ ID NO: 7139487 - DNA, 22 bp, Homo sapiens
gcacagacatatccatatttac

SEQ ID NO: 7139488 - DNA, 22 bp, Homo sapiens
gcacagacccaccatctatagt

SEQ ID NO: 7139489 - DNA, 22 bp, Homo sapiens
gcacagactcaccttaatttga

SEQ ID NO: 7139490 - DNA, 22 bp, Homo sapiens
gcacagactgtatcttaatcat

SEQ ID NO: 7139491 - DNA, 22 bp, Homo sapiens
gcacagactttgattgcagtca

SEQ ID NO: 7139492 - DNA, 22 bp, Homo sapiens
gcacagactttgattgcagtca

SEQ ID NO: 7139493 - DNA, 22 bp, Homo sapiens
gcacagagacagtcctgagatc

SEQ ID NO: 7139494 - DNA, 22 bp, Homo sapiens
gcacagagacagtcctgagatc

SEQ ID NO: 7139495 - DNA, 22 bp, Homo sapiens
gcacagagagcagtgggggaca

SEQ ID NO: 7139496 - DNA, 22 bp, Homo sapiens
gcacagagagcagtgggggaca

SEQ ID NO: 7139497 - DNA, 22 bp, Homo sapiens
gcacagagaggctgtgagcgcc

SEQ ID NO: 7139498 - DNA, 22 bp, Homo sapiens
gcacagagaggctgtgagcgcc

SEQ ID NO: 7139499 - DNA, 20 bp, Homo sapiens
gcacagagatgagcaaagta

SEQ ID NO: 7139500 - DNA, 22 bp, Homo sapiens
gcacagagagtcccgggtgccc

SEQ ID NO: 7139501 - DNA, 22 bp, Homo sapiens
gcacagagagggaaggtaactt

SEQ ID NO: 7139502 - DNA, 22 bp, Homo sapiens
gcacagagagtcccgggtgccc

SEQ ID NO: 7139503 - DNA, 20 bp, Homo sapiens
gcacagagatgagcaaagta

SEQ ID NO: 7139504 - DNA, 22 bp, Homo sapiens
gcacagagggcagtgagcctct

SEQ ID NO: 7139505 - DNA, 22 bp, Homo sapiens
gcacagagggcagtgagcctct

SEQ ID NO: 7139506 - DNA, 22 bp, Homo sapiens
gcacagaggtggaggacaaata

SEQ ID NO: 7139507 - DNA, 22 bp, Homo sapiens
gcacagaggtggaggacaaata

SEQ ID NO: 7139508 - DNA, 22 bp, Homo sapiens
gcacagagtcactagctaagca

SEQ ID NO: 7139509 - DNA, 22 bp, Homo sapiens
gcacagaggtggaggacaaata

SEQ ID NO: 7139510 - DNA, 22 bp, Homo sapiens
gcacagagtcactagctaagca

SEQ ID NO: 7139511 - DNA, 22 bp, Homo sapiens
gcacagagtgggtgagatgtgg

SEQ ID NO: 7139512 - DNA, 22 bp, Homo sapiens
gcacagagtgggtgagatgtgg

SEQ ID NO: 7139513 - DNA, 22 bp, Homo sapiens
gcacagagtgggtgagatgtgg

SEQ ID NO: 7139514 - DNA, 22 bp, Homo sapiens
gcacagagtgggtgagatgtgg

SEQ ID NO: 7139515 - DNA, 22 bp, Homo sapiens
gcacagcagctgggggccctgg

SEQ ID NO: 7139516 - DNA, 22 bp, Homo sapiens
gcacagcagctgggggccctgg

SEQ ID NO: 7139517 - DNA, 22 bp, Homo sapiens
gcacagcagctgctcagttgct

SEQ ID NO: 7139518 - DNA, 22 bp, Homo sapiens
gcacagcagctgggggccctgg

SEQ ID NO: 7139519 - DNA, 22 bp, Homo sapiens
gcacagcagctgggggccctgg

SEQ ID NO: 7139520 - DNA, 20 bp, Homo sapiens
gcacatgcaacttttattta

SEQ ID NO: 7139521 - DNA, 20 bp, Homo sapiens
gcacatgcaacttttattta

SEQ ID NO: 7139522 - DNA, 22 bp, Homo sapiens
gcacatgcactgtgggggcaat

SEQ ID NO: 7139523 - DNA, 22 bp, Homo sapiens
gcacatgcactgtgggggcaat

SEQ ID NO: 7139524 - DNA, 22 bp, Homo sapiens
gcacagcacagcaacatgtttt

SEQ ID NO: 7139525 - DNA, 22 bp, Homo sapiens
gcacagcacagcaacatgtttt

SEQ ID NO: 7139526 - DNA, 22 bp, Homo sapiens
gcacagcagacttggtggggct

SEQ ID NO: 7139527 - DNA, 22 bp, Homo sapiens
gcacagcagacttggtggggct

SEQ ID NO: 7139528 - DNA, 22 bp, Homo sapiens
gcacagcagacttggtggggct

SEQ ID NO: 7139529 - DNA, 22 bp, Homo sapiens
gcacagcagccgaaatgccctt

SEQ ID NO: 7139530 - DNA, 22 bp, Homo sapiens
gcacatgtgagagtagaggcct

SEQ ID NO: 7139531 - DNA, 22 bp, Homo sapiens
gcacatgtgagagtagaggcct

SEQ ID NO: 7139532 - DNA, 22 bp, Homo sapiens
gcacatgtgggaatggtgctga

SEQ ID NO: 7139533 - DNA, 22 bp, Homo sapiens
gcacatgtcttattcactgtta

SEQ ID NO: 7139534 - DNA, 22 bp, Homo sapiens
gcacatgtcttattcactgtta

SEQ ID NO: 7139535 - DNA, 22 bp, Homo sapiens
gcacatgtcttattcactgtta

SEQ ID NO: 7139536 - DNA, 22 bp, Homo sapiens
gcacatgtgggtaagcacatgg

SEQ ID NO: 7139537 - DNA, 18 bp, Homo sapiens
gcacatgtgtaaggcgac

SEQ ID NO: 7139538 - DNA, 17 bp, Homo sapiens
gcacatgtgttctttta

SEQ ID NO: 7139539 - DNA, 22 bp, Homo sapiens
gcacatgttgctagttacttgc

SEQ ID NO: 7139540 - DNA, 22 bp, Homo sapiens
gcacattgcttgcccattgtaa

SEQ ID NO: 7139541 - DNA, 22 bp, Homo sapiens
gcacattgttactcttactgtg

SEQ ID NO: 7139542 - DNA, 22 bp, Homo sapiens
gcacatttaactgagctcagga

SEQ ID NO: 7139543 - DNA, 22 bp, Homo sapiens
gcacatttaactgagctcagga

SEQ ID NO: 7139544 - DNA, 22 bp, Homo sapiens
gcacatggtaggcatttgatgt

SEQ ID NO: 7139545 - DNA, 18 bp, Homo sapiens
gcacatgtaagagtaaag

SEQ ID NO: 7139546 - DNA, 22 bp, Homo sapiens
gcacatgcttgagtgtgatgtg

SEQ ID NO: 7139547 - DNA, 22 bp, Homo sapiens
gcacatggacaatggaggtgca

SEQ ID NO: 7139548 - DNA, 22 bp, Homo sapiens
gcacatgcagactcattatcta

SEQ ID NO: 7139549 - DNA, 22 bp, Homo sapiens
gcacatgcagactcattatcta

SEQ ID NO: 7139550 - DNA, 22 bp, Homo sapiens
gcacatgcatgcatattcctgg

SEQ ID NO: 7139551 - DNA, 22 bp, Homo sapiens
gcacatgcatgcatattcctgg

SEQ ID NO: 7139552 - DNA, 22 bp, Homo sapiens
gcacatgccccattcttgtcac

SEQ ID NO: 7139553 - DNA, 22 bp, Homo sapiens
gcacatgccccattcttgtcac

SEQ ID NO: 7139554 - DNA, 22 bp, Homo sapiens
gcacatgccccattcttgtcac

SEQ ID NO: 7139555 - DNA, 22 bp, Homo sapiens
gcacatgcctgcatatccgtgt

SEQ ID NO: 7139556 - DNA, 22 bp, Homo sapiens
gcacatgcgtgcttagaaagaa

SEQ ID NO: 7139557 - DNA, 22 bp, Homo sapiens
gcacatgcgtgcttagaaagaa

SEQ ID NO: 7139558 - DNA, 22 bp, Homo sapiens
gcacatgctcaatgtgtatgta

SEQ ID NO: 7139559 - DNA, 21 bp, Homo sapiens
gcacatgctgtgtgtttctct

SEQ ID NO: 7139560 - DNA, 21 bp, Homo sapiens
gcacatgctgtgtgtttctct

SEQ ID NO: 7139561 - DNA, 22 bp, Homo sapiens
gcacatgctcaatgtgtatgta

SEQ ID NO: 7139562 - DNA, 22 bp, Homo sapiens
gcacatgcttgagtgtgatgtg

SEQ ID NO: 7139563 - DNA, 22 bp, Homo sapiens
gcacatgcttgagtgtgatgtg

SEQ ID NO: 7139564 - DNA, 20 bp, Homo sapiens
gcacccagcttcttgttcta

SEQ ID NO: 7139565 - DNA, 20 bp, Homo sapiens
gcacccagcttcttgttcta

SEQ ID NO: 7139566 - DNA, 22 bp, Homo sapiens
gcagaaggatccgcaggtgcaa

SEQ ID NO: 7139567 - DNA, 22 bp, Homo sapiens
gcagaaggatccgcaggtgcaa

SEQ ID NO: 7139568 - DNA, 22 bp, Homo sapiens
gcagaaggatccgcaggtgcaa

SEQ ID NO: 7139569 - DNA, 22 bp, Homo sapiens
gcagaaggatccgcaggtgcaa

SEQ ID NO: 7139570 - DNA, 22 bp, Homo sapiens
gcagaaggatccgcaggtgcaa

SEQ ID NO: 7139571 - DNA, 22 bp, Homo sapiens
gcacccagcccagggcgtgatg

SEQ ID NO: 7139572 - DNA, 22 bp, Homo sapiens
gcacccagcccagggcgtgatg

SEQ ID NO: 7139573 - DNA, 22 bp, Homo sapiens
gcacccagcccagggcgtgatg

SEQ ID NO: 7139574 - DNA, 21 bp, Homo sapiens
gcacccagccggttctcccag

SEQ ID NO: 7139575 - DNA, 21 bp, Homo sapiens
gcacccagccggttctcccag

SEQ ID NO: 7139576 - DNA, 21 bp, Homo sapiens
gcacccagccggttctcccag

SEQ ID NO: 7139577 - DNA, 22 bp, Homo sapiens
gcacccagaggtcagcagtgct

SEQ ID NO: 7139578 - DNA, 22 bp, Homo sapiens
gcacccagaggtcagcagtgct

SEQ ID NO: 7139579 - DNA, 22 bp, Homo sapiens
gcacccagaggtcagcagtgct

SEQ ID NO: 7139580 - DNA, 22 bp, Homo sapiens
gcacccagatagcaaggattag

SEQ ID NO: 7139581 - DNA, 22 bp, Homo sapiens
gcacccagatattgccttgacc

SEQ ID NO: 7139582 - DNA, 22 bp, Homo sapiens
gcacccagatattgccttgacc

SEQ ID NO: 7139583 - DNA, 22 bp, Homo sapiens
gcacccagccagcatctcagag

SEQ ID NO: 7139584 - DNA, 22 bp, Homo sapiens
gcacccagccagcatctcagag

SEQ ID NO: 7139585 - DNA, 22 bp, Homo sapiens
gcacccagccagcatctcagag

SEQ ID NO: 7139586 - DNA, 22 bp, Homo sapiens
gcacccagccagcatctcagag

SEQ ID NO: 7139587 - DNA, 22 bp, Homo sapiens
gcacccagccagcatctcagag

SEQ ID NO: 7139588 - DNA, 22 bp, Homo sapiens
gcacccagaggtcagcagtgct

SEQ ID NO: 7139589 - DNA, 22 bp, Homo sapiens
gcacccagaggtcagcagtgct

SEQ ID NO: 7139590 - DNA, 22 bp, Homo sapiens
gcacccagaggtcagcagtgct

SEQ ID NO: 7139591 - DNA, 22 bp, Homo sapiens
gcaccaggaggcccttctcatc

SEQ ID NO: 7139592 - DNA, 22 bp, Homo sapiens
gcacccagagggcagggtctcc

SEQ ID NO: 7139593 - DNA, 22 bp, Homo sapiens
gcaccagctgcagggtggctga

SEQ ID NO: 7139594 - DNA, 22 bp, Homo sapiens
gcaccagctgccttctgtgccc

SEQ ID NO: 7139595 - DNA, 22 bp, Homo sapiens
gcaccagctgccttctgtgccc

SEQ ID NO: 7139596 - DNA, 22 bp, Homo sapiens
gcaccagctgccttctgtgccc

SEQ ID NO: 7139597 - DNA, 22 bp, Homo sapiens
gcaccagctgccttctgtgccc

SEQ ID NO: 7139598 - DNA, 22 bp, Homo sapiens
gcaccagctgctgggttctaga

SEQ ID NO: 7139599 - DNA, 22 bp, Homo sapiens
gcaccagctgcagggtggctga

SEQ ID NO: 7139600 - DNA, 22 bp, Homo sapiens
gcaccagagggggctctgcagg

SEQ ID NO: 7139601 - DNA, 22 bp, Homo sapiens
gcaccagagggggctctgcagg

SEQ ID NO: 7139602 - DNA, 19 bp, Homo sapiens
gcaccagattgagtgacac

SEQ ID NO: 7139603 - DNA, 22 bp, Homo sapiens
gcaccactaagagcagggaccg

SEQ ID NO: 7139604 - DNA, 22 bp, Homo sapiens
gcaccactaagagcagggaccg

SEQ ID NO: 7139605 - DNA, 22 bp, Homo sapiens
gcaccactacactccagcctgg

SEQ ID NO: 7139606 - DNA, 22 bp, Homo sapiens
gcacatttaactgagctcagga

SEQ ID NO: 7139607 - DNA, 22 bp, Homo sapiens
gcacatttctcaaagaattgtc

SEQ ID NO: 7139608 - DNA, 22 bp, Homo sapiens
gcacatttgagacatccaggca

SEQ ID NO: 7139609 - DNA, 22 bp, Homo sapiens
gcacatttgccactgagctcct

SEQ ID NO: 7139610 - DNA, 22 bp, Homo sapiens
gcagaagggaataaggagcttt

SEQ ID NO: 7139611 - DNA, 22 bp, Homo sapiens
gcagaagggaataaggagcttt

SEQ ID NO: 7139612 - DNA, 22 bp, Homo sapiens
gcagacacagggaaggcaagga

SEQ ID NO: 7139613 - DNA, 22 bp, Homo sapiens
gcagacacagggaaggcaagga

SEQ ID NO: 7139614 - DNA, 22 bp, Homo sapiens
gcagacacagggaaggcaagga

SEQ ID NO: 7139615 - DNA, 22 bp, Homo sapiens
gcagacacagggaaggcaagga

SEQ ID NO: 7139616 - DNA, 22 bp, Homo sapiens
gcagacaccttgtaggtgtgta

SEQ ID NO: 7139617 - DNA, 22 bp, Homo sapiens
gcagacaccttgtaggtgtgta

SEQ ID NO: 7139618 - DNA, 22 bp, Homo sapiens
gcagacaccttgtaggtgtgta

SEQ ID NO: 7139619 - DNA, 18 bp, Homo sapiens
gcagacactcgtggaggg

SEQ ID NO: 7139620 - DNA, 18 bp, Homo sapiens
gcagacactcgtggaggg

SEQ ID NO: 7139621 - DNA, 22 bp, Homo sapiens
gcagacacttcccactgcagcg

SEQ ID NO: 7139622 - DNA, 18 bp, Homo sapiens
gcagacactcgtggaggg

SEQ ID NO: 7139623 - DNA, 23 bp, Homo sapiens
gcagacagagcagactaagacaa

SEQ ID NO: 7139624 - DNA, 22 bp, Homo sapiens
gcagacagactgcagtgatttt

SEQ ID NO: 7139625 - DNA, 22 bp, Homo sapiens
gcagacagactgcagtgatttt

SEQ ID NO: 7139626 - DNA, 17 bp, Homo sapiens
gcagacacttctattga

SEQ ID NO: 7139627 - DNA, 22 bp, Homo sapiens
gcagacacttgaggtgggcttt

SEQ ID NO: 7139628 - DNA, 22 bp, Homo sapiens
gcagacacttgaggtgggcttt

SEQ ID NO: 7139629 - DNA, 22 bp, Homo sapiens
gcagacacttttattctgcata

SEQ ID NO: 7139630 - DNA, 22 bp, Homo sapiens
gcagacacttttattctgcata

SEQ ID NO: 7139631 - DNA, 22 bp, Homo sapiens
gcagacagaagctaagtagaca

SEQ ID NO: 7139632 - DNA, 22 bp, Homo sapiens
gcagacagaagctaagtagaca

SEQ ID NO: 7139633 - DNA, 22 bp, Homo sapiens
gcagacaggcccagtggaggga

SEQ ID NO: 7139634 - DNA, 22 bp, Homo sapiens
gcagacaggcccagtggaggga

SEQ ID NO: 7139635 - DNA, 22 bp, Homo sapiens
gcagacaggcccagtggaggga

SEQ ID NO: 7139636 - DNA, 22 bp, Homo sapiens
gcagacaggcccagtggaggga

SEQ ID NO: 7139637 - DNA, 22 bp, Homo sapiens
gcagacagccagactgcactgg

SEQ ID NO: 7139638 - DNA, 22 bp, Homo sapiens
gcagacagccagactgcactgg

SEQ ID NO: 7139639 - DNA, 22 bp, Homo sapiens
gcagacagcatgttgggctatt

SEQ ID NO: 7139640 - DNA, 22 bp, Homo sapiens
gcagacagccagactgcactgg

SEQ ID NO: 7139641 - DNA, 22 bp, Homo sapiens
gcagacagccagactgcactgg

SEQ ID NO: 7139642 - DNA, 22 bp, Homo sapiens
gcagacaggattgggttaatag

SEQ ID NO: 7139643 - DNA, 22 bp, Homo sapiens
gcagacagcatgttgggctatt

SEQ ID NO: 7139644 - DNA, 22 bp, Homo sapiens
gcagacagcatgttgggctatt

SEQ ID NO: 7139645 - DNA, 22 bp, Homo sapiens
gcagacagcatgttgggctatt

SEQ ID NO: 7139646 - DNA, 22 bp, Homo sapiens
gcagacagcatgttgggctatt

SEQ ID NO: 7139647 - DNA, 22 bp, Homo sapiens
gcagacagatgagggtgctggg

SEQ ID NO: 7139648 - DNA, 22 bp, Homo sapiens
gcagacagatgagggtgctggg

SEQ ID NO: 7139649 - DNA, 22 bp, Homo sapiens
gcagacagatgagggtgctggg

SEQ ID NO: 7139650 - DNA, 22 bp, Homo sapiens
gcagacagatgagggtgctggg

SEQ ID NO: 7139651 - DNA, 22 bp, Homo sapiens
gcagacagatgagggtgctggg

SEQ ID NO: 7139652 - DNA, 23 bp, Homo sapiens
gcagacagagcagactaagacaa

SEQ ID NO: 7139653 - DNA, 22 bp, Homo sapiens
gcagagtgaagcagtatggaaa

SEQ ID NO: 7139654 - DNA, 22 bp, Homo sapiens
gcagagtctggtaggtgctggt

SEQ ID NO: 7139655 - DNA, 22 bp, Homo sapiens
gcagagtcccagcaggtggtgg

SEQ ID NO: 7139656 - DNA, 22 bp, Homo sapiens
gcagagtatgagcatggcttta

SEQ ID NO: 7139657 - DNA, 23 bp, Homo sapiens
gcagaggtttttcagtatggttt

SEQ ID NO: 7139658 - DNA, 23 bp, Homo sapiens
gcagaggtttttcagtatggttt

SEQ ID NO: 7139659 - DNA, 23 bp, Homo sapiens
gcagaggtttttcagtatggttt

SEQ ID NO: 7139660 - DNA, 22 bp, Homo sapiens
gcagaggtgtgggaggggccac

SEQ ID NO: 7139661 - DNA, 22 bp, Homo sapiens
gcagaggtgtgggaggggccac

SEQ ID NO: 7139662 - DNA, 22 bp, Homo sapiens
gcagaggttggattggtgactt

SEQ ID NO: 7139663 - DNA, 22 bp, Homo sapiens
gcagaggttggattggtgactt

SEQ ID NO: 7139664 - DNA, 22 bp, Homo sapiens
gcagagtatgagcatggcttta

SEQ ID NO: 7139665 - DNA, 22 bp, Homo sapiens
gcagagtcaggattccatccca

SEQ ID NO: 7139666 - DNA, 22 bp, Homo sapiens
gcagaggtggcatctgggctct

SEQ ID NO: 7139667 - DNA, 22 bp, Homo sapiens
gcagaggtggcatctgggctct

SEQ ID NO: 7139668 - DNA, 22 bp, Homo sapiens
gcagaggtgctcagtggcagaa

SEQ ID NO: 7139669 - DNA, 22 bp, Homo sapiens
gcagaggtgctcagtggcagaa

SEQ ID NO: 7139670 - DNA, 22 bp, Homo sapiens
gcagacagggctacagaggtac

SEQ ID NO: 7139671 - DNA, 22 bp, Homo sapiens
gcagacagggctacagaggtac

SEQ ID NO: 7139672 - DNA, 22 bp, Homo sapiens
gcagacagggctacagaggtac

SEQ ID NO: 7139673 - DNA, 22 bp, Homo sapiens
gcagacagggctacagaggtac

SEQ ID NO: 7139674 - DNA, 22 bp, Homo sapiens
gcagacaggcccagtggaggga

SEQ ID NO: 7139675 - DNA, 22 bp, Homo sapiens
gcagacagggctacagaggtac

SEQ ID NO: 7139676 - DNA, 22 bp, Homo sapiens
gcagacagggctacagaggtac

SEQ ID NO: 7139677 - DNA, 22 bp, Homo sapiens
gcagacagggctacagaggtac

SEQ ID NO: 7139678 - DNA, 22 bp, Homo sapiens
gcagacaggggcttaggaaagg

SEQ ID NO: 7139679 - DNA, 22 bp, Homo sapiens
gcagacaggggcttaggaaagg

SEQ ID NO: 7139680 - DNA, 22 bp, Homo sapiens
gcagaggtgctcagtggcagaa

SEQ ID NO: 7139681 - DNA, 22 bp, Homo sapiens
gcagagtgggagcccagggctg

SEQ ID NO: 7139682 - DNA, 18 bp, Homo sapiens
gcagagtgcgtctctgtg

SEQ ID NO: 7139683 - DNA, 22 bp, Homo sapiens
gcagagtgccgagatggaagcg

SEQ ID NO: 7139684 - DNA, 22 bp, Homo sapiens
gcagagtgatggaatgtgggtg

SEQ ID NO: 7139685 - DNA, 22 bp, Homo sapiens
gcagagtgatggaatgtgggtg

SEQ ID NO: 7139686 - DNA, 22 bp, Homo sapiens
gcagagtgagccgaggctgctc

SEQ ID NO: 7139687 - DNA, 22 bp, Homo sapiens
gcagagtgagccgaggctgctc

SEQ ID NO: 7139688 - DNA, 22 bp, Homo sapiens
gcagagtgagccgaggctgctc

SEQ ID NO: 7139689 - DNA, 22 bp, Homo sapiens
gcagagtgagatatgaacccag

SEQ ID NO: 7139690 - DNA, 22 bp, Homo sapiens
gcagagtgaagggagaggtgtg

SEQ ID NO: 7139691 - DNA, 22 bp, Homo sapiens
gcagagtgaagggagaggtgtg

SEQ ID NO: 7139692 - DNA, 22 bp, Homo sapiens
gcagagtgaagggagaggtgtg

SEQ ID NO: 7139693 - DNA, 22 bp, Homo sapiens
gcagcaagaataatttgggtag

SEQ ID NO: 7139694 - DNA, 22 bp, Homo sapiens
gcagcaagaggtgccatcttga

SEQ ID NO: 7139695 - DNA, 22 bp, Homo sapiens
gcagcaagaggtgccatcttga

SEQ ID NO: 7139696 - DNA, 21 bp, Homo sapiens
gcagcaaatgacaacagtgag

SEQ ID NO: 7139697 - DNA, 21 bp, Homo sapiens
gcagcaaatgacaacagtgag

SEQ ID NO: 7139698 - DNA, 19 bp, Homo sapiens
gcagcaaacaaaacaggta

SEQ ID NO: 7139699 - DNA, 22 bp, Homo sapiens
gcagcaaacttccacaagtaga

SEQ ID NO: 7139700 - DNA, 22 bp, Homo sapiens
gcagcaaagctcttcatgtgat

SEQ ID NO: 7139701 - DNA, 22 bp, Homo sapiens
gcagcaaagctcttcatgtgat

SEQ ID NO: 7139702 - DNA, 22 bp, Homo sapiens
gcagagtgggagcccagggctg

SEQ ID NO: 7139703 - DNA, 19 bp, Homo sapiens
gcagagtggggtggagggt

SEQ ID NO: 7139704 - DNA, 22 bp, Homo sapiens
gcagagtgggagcccagggctg

SEQ ID NO: 7139705 - DNA, 19 bp, Homo sapiens
gcagagtggggtggagggt

SEQ ID NO: 7139706 - DNA, 19 bp, Homo sapiens
gcagagtggggtggagggt

SEQ ID NO: 7139707 - DNA, 19 bp, Homo sapiens
gcagagtggggtggagggt

SEQ ID NO: 7139708 - DNA, 19 bp, Homo sapiens
gcagagtggggtggagggt

SEQ ID NO: 7139709 - DNA, 22 bp, Homo sapiens
gcagatgttgatgcaagaagag

SEQ ID NO: 7139710 - DNA, 22 bp, Homo sapiens
gcagatgttgtgaggctggtaa

SEQ ID NO: 7139711 - DNA, 22 bp, Homo sapiens
gcagatttcatttaaacctttc

SEQ ID NO: 7139712 - DNA, 22 bp, Homo sapiens
gcagatttctaataagcaatgt

SEQ ID NO: 7139713 - DNA, 22 bp, Homo sapiens
gcagcaaaaaagtaatatttat

SEQ ID NO: 7139714 - DNA, 22 bp, Homo sapiens
gcagcaaaaaagtaatatttat

SEQ ID NO: 7139715 - DNA, 19 bp, Homo sapiens
gcaggcccagtcgggctgg

SEQ ID NO: 7139716 - DNA, 22 bp, Homo sapiens
gcaggccctcctctagcaaggc

SEQ ID NO: 7139717 - DNA, 22 bp, Homo sapiens
gcaggccctcctctagcaaggc

SEQ ID NO: 7139718 - DNA, 20 bp, Homo sapiens
gcaggccctctctctagtct

SEQ ID NO: 7139719 - DNA, 22 bp, Homo sapiens
gcaggccctcctctagcaaggc

SEQ ID NO: 7139720 - DNA, 20 bp, Homo sapiens
gcaggccctctctctagtct

SEQ ID NO: 7139721 - DNA, 19 bp, Homo sapiens
gcaggcccagtcgggctgg

SEQ ID NO: 7139722 - DNA, 19 bp, Homo sapiens
gcaggcccagtcgggctgg

SEQ ID NO: 7139723 - DNA, 22 bp, Homo sapiens
gcaggcccttagccttggtggg

SEQ ID NO: 7139724 - DNA, 18 bp, Homo sapiens
gcaggccctgtttctggg

SEQ ID NO: 7139725 - DNA, 20 bp, Homo sapiens
gcaggccctctctctagtct

SEQ ID NO: 7139726 - DNA, 18 bp, Homo sapiens
gcaggccctgtttctggg

SEQ ID NO: 7139727 - DNA, 20 bp, Homo sapiens
gcaggccctctctctagtct

SEQ ID NO: 7139728 - DNA, 18 bp, Homo sapiens
gcaggccctgtttctggg

SEQ ID NO: 7139729 - DNA, 22 bp, Homo sapiens
gcaggcccttagccttggtggg

SEQ ID NO: 7139730 - DNA, 22 bp, Homo sapiens
gcaggcccttagccttggtggg

SEQ ID NO: 7139731 - DNA, 22 bp, Homo sapiens
gcaggcccttagccttggtggg

SEQ ID NO: 7139732 - DNA, 22 bp, Homo sapiens
gcaggcccttagccttggtggg

SEQ ID NO: 7139733 - DNA, 22 bp, Homo sapiens
gcaggcctaagagaaggcattg

SEQ ID NO: 7139734 - DNA, 22 bp, Homo sapiens
gcaggcctaagagaaggcattg

SEQ ID NO: 7139735 - DNA, 18 bp, Homo sapiens
gcaggcctagaacttggt

SEQ ID NO: 7139736 - DNA, 18 bp, Homo sapiens
gcaggcctagaacttggt

SEQ ID NO: 7139737 - DNA, 22 bp, Homo sapiens
gcaggcctcccctgctggagct

SEQ ID NO: 7139738 - DNA, 22 bp, Homo sapiens
gcaggcctcccctgctggagct

SEQ ID NO: 7139739 - DNA, 22 bp, Homo sapiens
gcaggcctcccctgctggagct

SEQ ID NO: 7139740 - DNA, 22 bp, Homo sapiens
gcaggcctcccctgctggagct

SEQ ID NO: 7139741 - DNA, 22 bp, Homo sapiens
gcaggcctcccctgctggagct

SEQ ID NO: 7139742 - DNA, 22 bp, Homo sapiens
gcaggcctcccctgctggagct

SEQ ID NO: 7139743 - DNA, 22 bp, Homo sapiens
gcaggcctctaattcaccgcag

SEQ ID NO: 7139744 - DNA, 22 bp, Homo sapiens
gcaggcctctaattcaccgcag

SEQ ID NO: 7139745 - DNA, 22 bp, Homo sapiens
gcagggcagcttagtccctgtc

SEQ ID NO: 7139746 - DNA, 22 bp, Homo sapiens
gcagggcagctgaagctaggtg

SEQ ID NO: 7139747 - DNA, 22 bp, Homo sapiens
gcagggcagcttagtccctgtc

SEQ ID NO: 7139748 - DNA, 22 bp, Homo sapiens
gcagggcagctgaagctaggtg

SEQ ID NO: 7139749 - DNA, 22 bp, Homo sapiens
gcagggcagctgaagctaggtg

SEQ ID NO: 7139750 - DNA, 22 bp, Homo sapiens
gcagggcagctgaagctaggtg

SEQ ID NO: 7139751 - DNA, 22 bp, Homo sapiens
gcagggcagcttagtccctgtc

SEQ ID NO: 7139752 - DNA, 22 bp, Homo sapiens
gcagggcagcttagtccctgtc

SEQ ID NO: 7139753 - DNA, 22 bp, Homo sapiens
gcagggcagcttagtccctgtc

SEQ ID NO: 7139754 - DNA, 22 bp, Homo sapiens
gcagggcagctcactgtggttc

SEQ ID NO: 7139755 - DNA, 22 bp, Homo sapiens
gcagggcagctcactgtggttc

SEQ ID NO: 7139756 - DNA, 22 bp, Homo sapiens
gcagggcagctcactgtggttc

SEQ ID NO: 7139757 - DNA, 22 bp, Homo sapiens
gcagggcagctcactgtggttc

SEQ ID NO: 7139758 - DNA, 22 bp, Homo sapiens
gcagggcagctcactgtggttc

SEQ ID NO: 7139759 - DNA, 22 bp, Homo sapiens
gcagggcagctcactgtggttc

SEQ ID NO: 7139760 - DNA, 22 bp, Homo sapiens
gcagggcagctgaagctaggtg

SEQ ID NO: 7139761 - DNA, 22 bp, Homo sapiens
gcagggcagctgaagctaggtg

SEQ ID NO: 7139762 - DNA, 22 bp, Homo sapiens
gcagggcagctgaagctaggtg

SEQ ID NO: 7139763 - DNA, 22 bp, Homo sapiens
gcagggcagctgaagctaggtg

SEQ ID NO: 7139764 - DNA, 19 bp, Homo sapiens
gcaggccaggaggcggagg

SEQ ID NO: 7139765 - DNA, 22 bp, Homo sapiens
gcaggccagctgtgcagatggg

SEQ ID NO: 7139766 - DNA, 19 bp, Homo sapiens
gcaggccaggaggcggagg

SEQ ID NO: 7139767 - DNA, 22 bp, Homo sapiens
gcaggccaggctaggggctgtc

SEQ ID NO: 7139768 - DNA, 22 bp, Homo sapiens
gcaggccaggctaggggctgtc

SEQ ID NO: 7139769 - DNA, 22 bp, Homo sapiens
gcaggccattcaggagatgtgc

SEQ ID NO: 7139770 - DNA, 22 bp, Homo sapiens
gcaggccattcaggagatgtgc

SEQ ID NO: 7139771 - DNA, 22 bp, Homo sapiens
gcaggccattcaggagatgtgc

SEQ ID NO: 7139772 - DNA, 22 bp, Homo sapiens
gcaggcccagagtcgctggcct

SEQ ID NO: 7139773 - DNA, 22 bp, Homo sapiens
gcaggcccagagtcgctggcct

SEQ ID NO: 7139774 - DNA, 22 bp, Homo sapiens
gcaggcccagagtcgctggcct

SEQ ID NO: 7139775 - DNA, 22 bp, Homo sapiens
gcaggcccagagtcgctggcct

SEQ ID NO: 7139776 - DNA, 22 bp, Homo sapiens
gcaggcccagagtcgctggcct

SEQ ID NO: 7139777 - DNA, 22 bp, Homo sapiens
gcaggccagctgtgcagatggg

SEQ ID NO: 7139778 - DNA, 22 bp, Homo sapiens
gcaggccactgtctcctctggg

SEQ ID NO: 7139779 - DNA, 22 bp, Homo sapiens
gcaggccagctgtgcagatggg

SEQ ID NO: 7139780 - DNA, 22 bp, Homo sapiens
gcaggccagctgtgcagatggg

SEQ ID NO: 7139781 - DNA, 22 bp, Homo sapiens
gcaggccacagtggagtctctg

SEQ ID NO: 7139782 - DNA, 22 bp, Homo sapiens
gcaggccacagtggagtctctg

SEQ ID NO: 7139783 - DNA, 22 bp, Homo sapiens
gcaggccacagtggagtctctg

SEQ ID NO: 7139784 - DNA, 22 bp, Homo sapiens
gcaggccacagtggagtctctg

SEQ ID NO: 7139785 - DNA, 22 bp, Homo sapiens
gcaggccactgtctcctctggg

SEQ ID NO: 7139786 - DNA, 22 bp, Homo sapiens
gcaggccactgtctcctctggg

SEQ ID NO: 7139787 - DNA, 22 bp, Homo sapiens
gcaggccactgtctcctctggg

SEQ ID NO: 7139788 - DNA, 22 bp, Homo sapiens
gcaggccactgtctcctctggg

SEQ ID NO: 7139789 - DNA, 23 bp, Homo sapiens
gcagctggttagaagggaaggag

SEQ ID NO: 7139790 - DNA, 22 bp, Homo sapiens
gcagctgtaaagcagaaatagt

SEQ ID NO: 7139791 - DNA, 22 bp, Homo sapiens
gcagctgtactggcagcattgt

SEQ ID NO: 7139792 - DNA, 22 bp, Homo sapiens
gcagctgtcactttcacaatgc

SEQ ID NO: 7139793 - DNA, 22 bp, Homo sapiens
gcaggcagttgcagttttctag

SEQ ID NO: 7139794 - DNA, 22 bp, Homo sapiens
gcaggcagtttgcttttccctc

SEQ ID NO: 7139795 - DNA, 22 bp, Homo sapiens
gcaggcagtttgcttttccctc

SEQ ID NO: 7139796 - DNA, 22 bp, Homo sapiens
gcaggcatctctgtagccaggg

SEQ ID NO: 7139797 - DNA, 22 bp, Homo sapiens
gcaggcatctctgtagccaggg

SEQ ID NO: 7139798 - DNA, 22 bp, Homo sapiens
gcaggcatggtcgctgccaggt

SEQ ID NO: 7139799 - DNA, 22 bp, Homo sapiens
gcaggcatggtcgctgccaggt

SEQ ID NO: 7139800 - DNA, 22 bp, Homo sapiens
gcaggccaagccctcgcagaga

SEQ ID NO: 7139801 - DNA, 22 bp, Homo sapiens
gcaggccaagccctcgcagaga

SEQ ID NO: 7139802 - DNA, 22 bp, Homo sapiens
gcaggccaagccctcgcagaga

SEQ ID NO: 7139803 - DNA, 22 bp, Homo sapiens
gcaggccaagccctcgcagaga

SEQ ID NO: 7139804 - DNA, 22 bp, Homo sapiens
gcaggccacagtggagtctctg

SEQ ID NO: 7139805 - DNA, 22 bp, Homo sapiens
gcaggccacagtggagtctctg

SEQ ID NO: 7139806 - DNA, 22 bp, Homo sapiens
gcagggccagtgcagagaggaa

SEQ ID NO: 7139807 - DNA, 22 bp, Homo sapiens
gcagggccagtgcagagaggaa

SEQ ID NO: 7139808 - DNA, 22 bp, Homo sapiens
gcagggccagtgcagagaggaa

SEQ ID NO: 7139809 - DNA, 22 bp, Homo sapiens
gcagggccaggtacaagaagca

SEQ ID NO: 7139810 - DNA, 22 bp, Homo sapiens
gcagggccagtgcagagaggaa

SEQ ID NO: 7139811 - DNA, 22 bp, Homo sapiens
gcagggccaggtacaagaagca

SEQ ID NO: 7139812 - DNA, 22 bp, Homo sapiens
gcagggccaggtacaagaagca

SEQ ID NO: 7139813 - DNA, 22 bp, Homo sapiens
gcagggtgtgtctcatacagtt

SEQ ID NO: 7139814 - DNA, 22 bp, Homo sapiens
gcagggtgtgtctcatacagtt

SEQ ID NO: 7139815 - DNA, 22 bp, Homo sapiens
gcagggtgtgtctcatacagtt

SEQ ID NO: 7139816 - DNA, 22 bp, Homo sapiens
gcagggccttagcagcggctgc

SEQ ID NO: 7139817 - DNA, 19 bp, Homo sapiens
gcagggtggcagagctctt

SEQ ID NO: 7139818 - DNA, 19 bp, Homo sapiens
gcagggtggcagagctctt

SEQ ID NO: 7139819 - DNA, 22 bp, Homo sapiens
gcagggccagtgcagagaggaa

SEQ ID NO: 7139820 - DNA, 22 bp, Homo sapiens
gcagggccagtgcagagaggaa

SEQ ID NO: 7139821 - DNA, 22 bp, Homo sapiens
gcagggcagtaagagctagagt

SEQ ID NO: 7139822 - DNA, 22 bp, Homo sapiens
gcagggcagggcaagaactggg

SEQ ID NO: 7139823 - DNA, 22 bp, Homo sapiens
gcagggcagtaagagctagagt

SEQ ID NO: 7139824 - DNA, 22 bp, Homo sapiens
gcagggcagtaagagctagagt

SEQ ID NO: 7139825 - DNA, 22 bp, Homo sapiens
gcagggcagtaagagctagagt

SEQ ID NO: 7139826 - DNA, 22 bp, Homo sapiens
gcagggcagggcaagaactggg

SEQ ID NO: 7139827 - DNA, 22 bp, Homo sapiens
gcagggcaggatttgaacccag

SEQ ID NO: 7139828 - DNA, 22 bp, Homo sapiens
gcagggcaggatttgaacccag

SEQ ID NO: 7139829 - DNA, 22 bp, Homo sapiens
gcagggcaggatttgaacccag

SEQ ID NO: 7139830 - DNA, 22 bp, Homo sapiens
gcagggcaggatttgaacccag

SEQ ID NO: 7139831 - DNA, 22 bp, Homo sapiens
gcagggcagggcaagaactggg

SEQ ID NO: 7139832 - DNA, 22 bp, Homo sapiens
gcagggcagggcaagaactggg

SEQ ID NO: 7139833 - DNA, 22 bp, Homo sapiens
gcagggcatgggccctgtctgc

SEQ ID NO: 7139834 - DNA, 22 bp, Homo sapiens
gcagggcatgggccctgtctgc

SEQ ID NO: 7139835 - DNA, 22 bp, Homo sapiens
gcagggccagggctcaggctgt

SEQ ID NO: 7139836 - DNA, 22 bp, Homo sapiens
gcagggccagggctcaggctgt

SEQ ID NO: 7139837 - DNA, 22 bp, Homo sapiens
gcagggccagggctcaggctgt

SEQ ID NO: 7139838 - DNA, 22 bp, Homo sapiens
gcagggccagggctcaggctgt

SEQ ID NO: 7139839 - DNA, 19 bp, Homo sapiens
gcaggtcattaggctaggt

SEQ ID NO: 7139840 - DNA, 19 bp, Homo sapiens
gcaggtcattaggctaggt

SEQ ID NO: 7139841 - DNA, 22 bp, Homo sapiens
gcaggtagtgatcgagggtgac

SEQ ID NO: 7139842 - DNA, 22 bp, Homo sapiens
gcaggtcccagaaagttaattc

SEQ ID NO: 7139843 - DNA, 20 bp, Homo sapiens
gcaggtccctggcatgcaga

SEQ ID NO: 7139844 - DNA, 22 bp, Homo sapiens
gcaggtctagaagctgcctctg

SEQ ID NO: 7139845 - DNA, 22 bp, Homo sapiens
gcaggtctagaagctgcctctg

SEQ ID NO: 7139846 - DNA, 22 bp, Homo sapiens
gcaggtagtgatcgagggtgac

SEQ ID NO: 7139847 - DNA, 19 bp, Homo sapiens
gcaggtagagacagcagcc

SEQ ID NO: 7139848 - DNA, 22 bp, Homo sapiens
gcaggtacccttgtccatgaca

SEQ ID NO: 7139849 - DNA, 19 bp, Homo sapiens
gcagggtgttgactgtccc

SEQ ID NO: 7139850 - DNA, 19 bp, Homo sapiens
gcagggtgttgactgtccc

SEQ ID NO: 7139851 - DNA, 22 bp, Homo sapiens
gcaggtgaatgatggactagga

SEQ ID NO: 7139852 - DNA, 22 bp, Homo sapiens
gcaggtgaatgatggactagga

SEQ ID NO: 7139853 - DNA, 22 bp, Homo sapiens
gcaggtgaatgatggactagga

SEQ ID NO: 7139854 - DNA, 22 bp, Homo sapiens
gcaggtgaatgatggactagga

SEQ ID NO: 7139855 - DNA, 22 bp, Homo sapiens
gcaggtgaaagtgagtagtgag

SEQ ID NO: 7139856 - DNA, 22 bp, Homo sapiens
gcaggtgatgtgatgtgagcat

SEQ ID NO: 7139857 - DNA, 22 bp, Homo sapiens
gcaggtgatgtgatgtgagcat

SEQ ID NO: 7139858 - DNA, 22 bp, Homo sapiens
gcaggtctcaatctgagcaggc

SEQ ID NO: 7139859 - DNA, 22 bp, Homo sapiens
gcaggtgaaagtgagtagtgag

SEQ ID NO: 7139860 - DNA, 22 bp, Homo sapiens
gcagctggctcagagaggtggg

SEQ ID NO: 7139861 - DNA, 22 bp, Homo sapiens
gcagcccacaccactctgctca

SEQ ID NO: 7139862 - DNA, 22 bp, Homo sapiens
gcagcccacagctggaggccta

SEQ ID NO: 7139863 - DNA, 22 bp, Homo sapiens
gcagcccacagctggaggccta

SEQ ID NO: 7139864 - DNA, 22 bp, Homo sapiens
gcagcccaagcctgagcatcct

SEQ ID NO: 7139865 - DNA, 22 bp, Homo sapiens
gcagcccaatggactgagacag

SEQ ID NO: 7139866 - DNA, 22 bp, Homo sapiens
gcagctggctcagagaggtggg

SEQ ID NO: 7139867 - DNA, 22 bp, Homo sapiens
gcagctggctcagagaggtggg

SEQ ID NO: 7139868 - DNA, 22 bp, Homo sapiens
gcagctgggacactgaggccag

SEQ ID NO: 7139869 - DNA, 22 bp, Homo sapiens
gcagctgggacactgaggccag

SEQ ID NO: 7139870 - DNA, 22 bp, Homo sapiens
gcagctgggacactgaggccag

SEQ ID NO: 7139871 - DNA, 22 bp, Homo sapiens
gcagctgggacactgaggccag

SEQ ID NO: 7139872 - DNA, 17 bp, Homo sapiens
gcagccagtgcagcagg

SEQ ID NO: 7139873 - DNA, 17 bp, Homo sapiens
gcagccagtgcagcagg

SEQ ID NO: 7139874 - DNA, 17 bp, Homo sapiens
gcagccagtgcagcagg

SEQ ID NO: 7139875 - DNA, 22 bp, Homo sapiens
gcagccagtatcctctgagatt

SEQ ID NO: 7139876 - DNA, 17 bp, Homo sapiens
gcagccagtgcagcagg

SEQ ID NO: 7139877 - DNA, 17 bp, Homo sapiens
gcagccagtgcagcagg

SEQ ID NO: 7139878 - DNA, 22 bp, Homo sapiens
gcagccaggaagcccaggacac

SEQ ID NO: 7139879 - DNA, 22 bp, Homo sapiens
gcagccaggaagcccaggacac

SEQ ID NO: 7139880 - DNA, 22 bp, Homo sapiens
gcagccaggaagcccaggacac

SEQ ID NO: 7139881 - DNA, 22 bp, Homo sapiens
gcagccaggaagcccaggacac

SEQ ID NO: 7139882 - DNA, 22 bp, Homo sapiens
gcagccaggtttgaggaccact

SEQ ID NO: 7139883 - DNA, 22 bp, Homo sapiens
gcagccagtatcctctgagatt

SEQ ID NO: 7139884 - DNA, 22 bp, Homo sapiens
gcagccagtatcctctgagatt

SEQ ID NO: 7139885 - DNA, 17 bp, Homo sapiens
gcagccagtgcagcagg

SEQ ID NO: 7139886 - DNA, 22 bp, Homo sapiens
gcagccagtgggatgagaaaga

SEQ ID NO: 7139887 - DNA, 22 bp, Homo sapiens
gcagccagtgggatgagaaaga

SEQ ID NO: 7139888 - DNA, 23 bp, Homo sapiens
gcagccatgttcccgtctcagct

SEQ ID NO: 7139889 - DNA, 23 bp, Homo sapiens
gcagccatgttcccgtctcagct

SEQ ID NO: 7139890 - DNA, 22 bp, Homo sapiens
gcagcccaaaaaagaggtagat

SEQ ID NO: 7139891 - DNA, 22 bp, Homo sapiens
gcagcccaaaaaagaggtagat

SEQ ID NO: 7139892 - DNA, 22 bp, Homo sapiens
gcagcccaaaaaagaggtagat

SEQ ID NO: 7139893 - DNA, 22 bp, Homo sapiens
gcagcccaagagactctgttga

SEQ ID NO: 7139894 - DNA, 22 bp, Homo sapiens
gcagcccaagagactctgttga

SEQ ID NO: 7139895 - DNA, 22 bp, Homo sapiens
gcagcccaagcctgagcatcct

SEQ ID NO: 7139896 - DNA, 23 bp, Homo sapiens
gcagctggttagaagggaaggag

SEQ ID NO: 7139897 - DNA, 23 bp, Homo sapiens
gcagctggttagaagggaaggag

SEQ ID NO: 7139898 - DNA, 22 bp, Homo sapiens
gcagctggttaatgggagaatt

SEQ ID NO: 7139899 - DNA, 22 bp, Homo sapiens
gcagctggtctggcctagagta

SEQ ID NO: 7139900 - DNA, 22 bp, Homo sapiens
gcagctggtctggcctagagta

SEQ ID NO: 7139901 - DNA, 22 bp, Homo sapiens
gcagctggtctggcctagagta

SEQ ID NO: 7139902 - DNA, 22 bp, Homo sapiens
gcagctggtgcaaatgtcactc

SEQ ID NO: 7139903 - DNA, 22 bp, Homo sapiens
gcagctggtgcaaatgtcactc

SEQ ID NO: 7139904 - DNA, 22 bp, Homo sapiens
gcagctggtgcaaatgtcactc

SEQ ID NO: 7139905 - DNA, 22 bp, Homo sapiens
gcagctgggccccagcctctcc

SEQ ID NO: 7139906 - DNA, 22 bp, Homo sapiens
gcagctgggacactgaggccag

SEQ ID NO: 7139907 - DNA, 22 bp, Homo sapiens
gcagctggggaggtcgtgggga

SEQ ID NO: 7139908 - DNA, 22 bp, Homo sapiens
gcagctggggaggtcgtgggga

SEQ ID NO: 7139909 - DNA, 22 bp, Homo sapiens
gcagctggggccacacttaggc

SEQ ID NO: 7139910 - DNA, 22 bp, Homo sapiens
gcagctggggccacacttaggc

SEQ ID NO: 7139911 - DNA, 22 bp, Homo sapiens
gcagctggggccacacttaggc

SEQ ID NO: 7139912 - DNA, 22 bp, Homo sapiens
gcagctgggtctgtgtgggctg

SEQ ID NO: 7139913 - DNA, 22 bp, Homo sapiens
gcagctgggtctgtgtgggctg

SEQ ID NO: 7139914 - DNA, 22 bp, Homo sapiens
gcagccaggaaagctggaccct

SEQ ID NO: 7139915 - DNA, 22 bp, Homo sapiens
gcagccaggaaagctggaccct

SEQ ID NO: 7139916 - DNA, 21 bp, Homo sapiens
gcagccagccgagaccatgcc

SEQ ID NO: 7139917 - DNA, 21 bp, Homo sapiens
gcagccagccgagaccatgcc

SEQ ID NO: 7139918 - DNA, 22 bp, Homo sapiens
gcagccaggaaagctggaccct

SEQ ID NO: 7139919 - DNA, 22 bp, Homo sapiens
gcagccaggaaagctggaccct

SEQ ID NO: 7139920 - DNA, 22 bp, Homo sapiens
gcagccagccctagtcccactt

SEQ ID NO: 7139921 - DNA, 22 bp, Homo sapiens
gcagccagccctagtcccactt

SEQ ID NO: 7139922 - DNA, 22 bp, Homo sapiens
gcagccagccctagtcccactt

SEQ ID NO: 7139923 - DNA, 22 bp, Homo sapiens
gcagccagccctagtcccactt

SEQ ID NO: 7139924 - DNA, 21 bp, Homo sapiens
gcagccagccgagaccatgcc

SEQ ID NO: 7139925 - DNA, 21 bp, Homo sapiens
gcagccagccgagaccatgcc

SEQ ID NO: 7139926 - DNA, 21 bp, Homo sapiens
gcagccagccgagaccatgcc

SEQ ID NO: 7139927 - DNA, 21 bp, Homo sapiens
gcagccagccgagaccatgcc

SEQ ID NO: 7139928 - DNA, 21 bp, Homo sapiens
gcagccagccgagaccatgcc

SEQ ID NO: 7139929 - DNA, 22 bp, Homo sapiens
gcagccagcccctctgacctct

SEQ ID NO: 7139930 - DNA, 22 bp, Homo sapiens
gcagccagcaggaagcgggaga

SEQ ID NO: 7139931 - DNA, 22 bp, Homo sapiens
gcagccagcaggaagcgggaga

SEQ ID NO: 7139932 - DNA, 22 bp, Homo sapiens
gcagccagcaggaagcgggaga

SEQ ID NO: 7139933 - DNA, 22 bp, Homo sapiens
gcagccagcaggaagcgggaga

SEQ ID NO: 7139934 - DNA, 22 bp, Homo sapiens
gcagccagcccctctgacctct

SEQ ID NO: 7139935 - DNA, 22 bp, Homo sapiens
gcagccagaagactcagaacaa

SEQ ID NO: 7139936 - DNA, 21 bp, Homo sapiens
gcagccagacgggattcagtt

SEQ ID NO: 7139937 - DNA, 21 bp, Homo sapiens
gcagccagacgggattcagtt

SEQ ID NO: 7139938 - DNA, 21 bp, Homo sapiens
gcagccagacgggattcagtt

SEQ ID NO: 7139939 - DNA, 21 bp, Homo sapiens
gcagccagacgggattcagtt

SEQ ID NO: 7139940 - DNA, 21 bp, Homo sapiens
gcagccagacgggattcagtt

SEQ ID NO: 7139941 - DNA, 22 bp, Homo sapiens
gcagccagagggggtgtgatca

SEQ ID NO: 7139942 - DNA, 22 bp, Homo sapiens
gcagccaccctcaaggctgaat

SEQ ID NO: 7139943 - DNA, 19 bp, Homo sapiens
gcagccaccgcggcggccg

SEQ ID NO: 7139944 - DNA, 19 bp, Homo sapiens
gcagccaccgcggcggccg

SEQ ID NO: 7139945 - DNA, 22 bp, Homo sapiens
gcagccactagttttcctgttt

SEQ ID NO: 7139946 - DNA, 22 bp, Homo sapiens
gcagccacctcccatggcgggg

SEQ ID NO: 7139947 - DNA, 22 bp, Homo sapiens
gcagccactagttttcctgttt

SEQ ID NO: 7139948 - DNA, 22 bp, Homo sapiens
gcagccactctcattccacgtg

SEQ ID NO: 7139949 - DNA, 21 bp, Homo sapiens
gcagccactgccttcaacaat

SEQ ID NO: 7139950 - DNA, 22 bp, Homo sapiens
gcagccactttgcaaccaagag

SEQ ID NO: 7139951 - DNA, 22 bp, Homo sapiens
gcagccactgggagtgcttata

SEQ ID NO: 7139952 - DNA, 22 bp, Homo sapiens
gcagccactttgcaaccaagag

SEQ ID NO: 7139953 - DNA, 22 bp, Homo sapiens
gcagccagaagactcagaacaa

SEQ ID NO: 7139954 - DNA, 22 bp, Homo sapiens
gcagccagaagactcagaacaa

SEQ ID NO: 7139955 - DNA, 22 bp, Homo sapiens
gcagccagaagactcagaacaa

SEQ ID NO: 7139956 - DNA, 22 bp, Homo sapiens
gcagccaccctcaaggctgaat

SEQ ID NO: 7139957 - DNA, 21 bp, Homo sapiens
gcagccacagccaccaagcta

SEQ ID NO: 7139958 - DNA, 21 bp, Homo sapiens
gcagccacagccaccaagcta

SEQ ID NO: 7139959 - DNA, 22 bp, Homo sapiens
gcagcagcccagggctctcaga

SEQ ID NO: 7139960 - DNA, 22 bp, Homo sapiens
gcagccacagaggagggatgca

SEQ ID NO: 7139961 - DNA, 22 bp, Homo sapiens
gcagccacagaggagggatgca

SEQ ID NO: 7139962 - DNA, 22 bp, Homo sapiens
gcagcagcccagggctctcaga

SEQ ID NO: 7139963 - DNA, 22 bp, Homo sapiens
gcagcagcccagggctctcaga

SEQ ID NO: 7139964 - DNA, 22 bp, Homo sapiens
gcagcagcccagggctctcaga

SEQ ID NO: 7139965 - DNA, 22 bp, Homo sapiens
gcagcagcccagggctctcaga

SEQ ID NO: 7139966 - DNA, 22 bp, Homo sapiens
gcagcagcccagggctctcaga

SEQ ID NO: 7139967 - DNA, 22 bp, Homo sapiens
gcagcagaagtagaagtacagg

SEQ ID NO: 7139968 - DNA, 22 bp, Homo sapiens
gcagcagaaggccaaggggagc

SEQ ID NO: 7139969 - DNA, 22 bp, Homo sapiens
gcagcagaagtagaagtacagg

SEQ ID NO: 7139970 - DNA, 22 bp, Homo sapiens
gcagcagcaagaaggttggact

SEQ ID NO: 7139971 - DNA, 22 bp, Homo sapiens
gcagcagcaagaaggttggact

SEQ ID NO: 7139972 - DNA, 22 bp, Homo sapiens
gcagcagcaagaaggttggact

SEQ ID NO: 7139973 - DNA, 22 bp, Homo sapiens
gcagcagcagcaattttctgtc

SEQ ID NO: 7139974 - DNA, 22 bp, Homo sapiens
gcagcagcaggcgctcggccgt

SEQ ID NO: 7139975 - DNA, 22 bp, Homo sapiens
gcagcagcaggcgctcggccgt

SEQ ID NO: 7139976 - DNA, 22 bp, Homo sapiens
gcagcagcaggcgctcggccgt

SEQ ID NO: 7139977 - DNA, 22 bp, Homo sapiens
gcagcagcagggagtctgactt

SEQ ID NO: 7139978 - DNA, 22 bp, Homo sapiens
gcagcagcagggagtctgactt

SEQ ID NO: 7139979 - DNA, 19 bp, Homo sapiens
gcagcagcatttggtaata

SEQ ID NO: 7139980 - DNA, 19 bp, Homo sapiens
gcagcagcatttggtaata

SEQ ID NO: 7139981 - DNA, 22 bp, Homo sapiens
gcagcagccactattctggcat

SEQ ID NO: 7139982 - DNA, 22 bp, Homo sapiens
gcagcagccactattctggcat

SEQ ID NO: 7139983 - DNA, 22 bp, Homo sapiens
gcagcagaaggccaaggggagc

SEQ ID NO: 7139984 - DNA, 22 bp, Homo sapiens
gcagcagaaggccaaggggagc

SEQ ID NO: 7139985 - DNA, 22 bp, Homo sapiens
gcagcactaatgggccccagaa

SEQ ID NO: 7139986 - DNA, 22 bp, Homo sapiens
gcagcactaatgggccccagaa

SEQ ID NO: 7139987 - DNA, 22 bp, Homo sapiens
gcagcactgatcctaaacttag

SEQ ID NO: 7139988 - DNA, 22 bp, Homo sapiens
gcagcacatataaacaaagaga

SEQ ID NO: 7139989 - DNA, 22 bp, Homo sapiens
gcagcacatataaacaaagaga

SEQ ID NO: 7139990 - DNA, 22 bp, Homo sapiens
gcagcacacggtggtgccctgg

SEQ ID NO: 7139991 - DNA, 22 bp, Homo sapiens
gcagcacacggtggtgccctgg

SEQ ID NO: 7139992 - DNA, 22 bp, Homo sapiens
gcagcacaaagtccccagggac

SEQ ID NO: 7139993 - DNA, 19 bp, Homo sapiens
gcagcaatagaagacaaat

SEQ ID NO: 7139994 - DNA, 22 bp, Homo sapiens
gcagcaaggatgaagcacttgg

SEQ ID NO: 7139995 - DNA, 22 bp, Homo sapiens
gcagcaaggatgaagcacttgg

SEQ ID NO: 7139996 - DNA, 22 bp, Homo sapiens
gcagcaagtctagtttgtaggc

SEQ ID NO: 7139997 - DNA, 22 bp, Homo sapiens
gcagcaagtctagtttgtaggc

SEQ ID NO: 7139998 - DNA, 22 bp, Homo sapiens
gcagcaagaggtttctgttgac

SEQ ID NO: 7139999 - DNA, 22 bp, Homo sapiens
gcagcaaggatgaagcacttgg

SEQ ID NO: 7140000 - DNA, 22 bp, Homo sapiens
gcagcaaggatgaagcacttgg

SEQ ID NO: 7140001 - DNA, 22 bp, Homo sapiens
gcccaagatctggagctgcagg

SEQ ID NO: 7140002 - DNA, 22 bp, Homo sapiens
gcccaagatctggagctgcagg

SEQ ID NO: 7140003 - DNA, 22 bp, Homo sapiens
gcccaagcagcttcccgagctt

SEQ ID NO: 7140004 - DNA, 22 bp, Homo sapiens
gcccaagagagcgaaggttggc

SEQ ID NO: 7140005 - DNA, 22 bp, Homo sapiens
gcccaagatcacactggaaatc

SEQ ID NO: 7140006 - DNA, 22 bp, Homo sapiens
gcccaagatcagtggggcagat

SEQ ID NO: 7140007 - DNA, 22 bp, Homo sapiens
gcccaagatcagtggggcagat

SEQ ID NO: 7140008 - DNA, 22 bp, Homo sapiens
gcccaaagccagtgtgctctcc

SEQ ID NO: 7140009 - DNA, 22 bp, Homo sapiens
gcccaaagtcactcagctagga

SEQ ID NO: 7140010 - DNA, 22 bp, Homo sapiens
gcccaaagtcactcagctagga

SEQ ID NO: 7140011 - DNA, 22 bp, Homo sapiens
gccattttctgtcttgtttatt

SEQ ID NO: 7140012 - DNA, 22 bp, Homo sapiens
gccattttgaaaaccgttgcta

SEQ ID NO: 7140013 - DNA, 22 bp, Homo sapiens
gcccaaagagctttgatctcag

SEQ ID NO: 7140014 - DNA, 22 bp, Homo sapiens
gcccaaagagctttgatctcag

SEQ ID NO: 7140015 - DNA, 22 bp, Homo sapiens
gcccaaagccagtgtgctctcc

SEQ ID NO: 7140016 - DNA, 23 bp, Homo sapiens
gccaggctccggtctgtggccac

SEQ ID NO: 7140017 - DNA, 22 bp, Homo sapiens
gccaggctctcagtgactgccc

SEQ ID NO: 7140018 - DNA, 20 bp, Homo sapiens
gcccaaggtccagaaggggg

SEQ ID NO: 7140019 - DNA, 20 bp, Homo sapiens
gcccaaggtccagaaggggg

SEQ ID NO: 7140020 - DNA, 22 bp, Homo sapiens
gcccaaggtcacacacaggaag

SEQ ID NO: 7140021 - DNA, 22 bp, Homo sapiens
gcccaaggtcacacacaggaag

SEQ ID NO: 7140022 - DNA, 22 bp, Homo sapiens
gcccaaggtcacacacaggaag

SEQ ID NO: 7140023 - DNA, 22 bp, Homo sapiens
gcccaaggtatatcagagacag

SEQ ID NO: 7140024 - DNA, 22 bp, Homo sapiens
gcccaaggtcacacacaggaag

SEQ ID NO: 7140025 - DNA, 22 bp, Homo sapiens
gcccaagggcatcaagttctac

SEQ ID NO: 7140026 - DNA, 22 bp, Homo sapiens
gcccaaggtatatcagagacag

SEQ ID NO: 7140027 - DNA, 22 bp, Homo sapiens
gcccaaggtatatcagagacag

SEQ ID NO: 7140028 - DNA, 22 bp, Homo sapiens
gcccaaggtatatcagagacag

SEQ ID NO: 7140029 - DNA, 22 bp, Homo sapiens
gcccaagccgccttccagagac

SEQ ID NO: 7140030 - DNA, 22 bp, Homo sapiens
gcccaagccggagctgggagag

SEQ ID NO: 7140031 - DNA, 22 bp, Homo sapiens
gcccaagccggagctgggagag

SEQ ID NO: 7140032 - DNA, 22 bp, Homo sapiens
gcccaagccggagctgggagag

SEQ ID NO: 7140033 - DNA, 22 bp, Homo sapiens
gcccaagccggagctgggagag

SEQ ID NO: 7140034 - DNA, 22 bp, Homo sapiens
gcccaagccggagctgggagag

SEQ ID NO: 7140035 - DNA, 20 bp, Homo sapiens
gcccaagcgccggccgcaga

SEQ ID NO: 7140036 - DNA, 20 bp, Homo sapiens
gcccaagcgccggccgcaga

SEQ ID NO: 7140037 - DNA, 22 bp, Homo sapiens
gcccaagctggactgcagtggc

SEQ ID NO: 7140038 - DNA, 22 bp, Homo sapiens
gcccaagctggactgcagtggc

SEQ ID NO: 7140039 - DNA, 22 bp, Homo sapiens
gcccaagctggactgcagtggc

SEQ ID NO: 7140040 - DNA, 20 bp, Homo sapiens
gcccaagcgccggccgcaga

SEQ ID NO: 7140041 - DNA, 23 bp, Homo sapiens
gccaggctccggtctgtggccac

SEQ ID NO: 7140042 - DNA, 23 bp, Homo sapiens
gccaggctccggtctgtggccac

SEQ ID NO: 7140043 - DNA, 23 bp, Homo sapiens
gccaggctccggtctgtggccac

SEQ ID NO: 7140044 - DNA, 23 bp, Homo sapiens
gccaggctccggtctgtggccac

SEQ ID NO: 7140045 - DNA, 22 bp, Homo sapiens
gccaggctccccggatccctgg

SEQ ID NO: 7140046 - DNA, 22 bp, Homo sapiens
gccaggctccccggatccctgg

SEQ ID NO: 7140047 - DNA, 22 bp, Homo sapiens
gccaggctccccggatccctgg

SEQ ID NO: 7140048 - DNA, 22 bp, Homo sapiens
gccaggctccccggatccctgg

SEQ ID NO: 7140049 - DNA, 19 bp, Homo sapiens
gccaggctccatagccggc

SEQ ID NO: 7140050 - DNA, 22 bp, Homo sapiens
gccaggctccaggccctcctga

SEQ ID NO: 7140051 - DNA, 22 bp, Homo sapiens
gccaggctccaggccctcctga

SEQ ID NO: 7140052 - DNA, 22 bp, Homo sapiens
gccaggctccaggccctcctga

SEQ ID NO: 7140053 - DNA, 22 bp, Homo sapiens
gccaggctccaggccctcctga

SEQ ID NO: 7140054 - DNA, 22 bp, Homo sapiens
gccaggctccaggccctcctga

SEQ ID NO: 7140055 - DNA, 22 bp, Homo sapiens
gccaggctcagtagcgattcct

SEQ ID NO: 7140056 - DNA, 22 bp, Homo sapiens
gccaggctcagcagtcaacctg

SEQ ID NO: 7140057 - DNA, 22 bp, Homo sapiens
gccaggctaagaaaggtgtgat

SEQ ID NO: 7140058 - DNA, 22 bp, Homo sapiens
gccaggctaagaaaggtgtgat

SEQ ID NO: 7140059 - DNA, 22 bp, Homo sapiens
gccaggcattattccgatccct

SEQ ID NO: 7140060 - DNA, 22 bp, Homo sapiens
gccaggcgggtctcaaactcct

SEQ ID NO: 7140061 - DNA, 22 bp, Homo sapiens
gccaggctaagaaaggtgtgat

SEQ ID NO: 7140062 - DNA, 22 bp, Homo sapiens
gccaggctaagaaaggtgtgat

SEQ ID NO: 7140063 - DNA, 22 bp, Homo sapiens
gccaggaaaaaccggccctgct

SEQ ID NO: 7140064 - DNA, 22 bp, Homo sapiens
gccaggaaaaaccggccctgct

SEQ ID NO: 7140065 - DNA, 22 bp, Homo sapiens
gccaggaaaaaccggccctgct

SEQ ID NO: 7140066 - DNA, 22 bp, Homo sapiens
gccaggaaaaacgtggtgggag

SEQ ID NO: 7140067 - DNA, 22 bp, Homo sapiens
gccaggaaaaagggtggccaat

SEQ ID NO: 7140068 - DNA, 22 bp, Homo sapiens
gccaggaaaaagggtggccaat

SEQ ID NO: 7140069 - DNA, 22 bp, Homo sapiens
gccaggaaaagaagctggtgct

SEQ ID NO: 7140070 - DNA, 19 bp, Homo sapiens
gccaggaaagaatcaggcg

SEQ ID NO: 7140071 - DNA, 22 bp, Homo sapiens
gccaggaaagccactggcatac

SEQ ID NO: 7140072 - DNA, 22 bp, Homo sapiens
gccagctgtttcagagcccagt

SEQ ID NO: 7140073 - DNA, 22 bp, Homo sapiens
gccagctgtttcagagcccagt

SEQ ID NO: 7140074 - DNA, 23 bp, Homo sapiens
gccagctttggtctgtctcctag

SEQ ID NO: 7140075 - DNA, 22 bp, Homo sapiens
gccagcttggccagtggccagt

SEQ ID NO: 7140076 - DNA, 22 bp, Homo sapiens
gccagcttccatggccacgtca

SEQ ID NO: 7140077 - DNA, 22 bp, Homo sapiens
gccagcttcccatctggcttcc

SEQ ID NO: 7140078 - DNA, 17 bp, Homo sapiens
gccagcttgagggccat

SEQ ID NO: 7140079 - DNA, 22 bp, Homo sapiens
gccagcttggcatgtgaggagt

SEQ ID NO: 7140080 - DNA, 22 bp, Homo sapiens
gccaggaaattcatgccagatc

SEQ ID NO: 7140081 - DNA, 22 bp, Homo sapiens
gccaggaacacaatgccaagct

SEQ ID NO: 7140082 - DNA, 22 bp, Homo sapiens
gccaggaagagagagccctcca

SEQ ID NO: 7140083 - DNA, 18 bp, Homo sapiens
gccaggaagaggaatgtg

SEQ ID NO: 7140084 - DNA, 18 bp, Homo sapiens
gccaggaagcatggggac

SEQ ID NO: 7140085 - DNA, 22 bp, Homo sapiens
gccaggaaggctccctggtcac

SEQ ID NO: 7140086 - DNA, 22 bp, Homo sapiens
gccaggaaggctgaagccagaa

SEQ ID NO: 7140087 - DNA, 22 bp, Homo sapiens
gccaggaagtcagccaagccca

SEQ ID NO: 7140088 - DNA, 22 bp, Homo sapiens
gccaggaagtcagccaagccca

SEQ ID NO: 7140089 - DNA, 22 bp, Homo sapiens
gccaggaagtgcagccctgcca

SEQ ID NO: 7140090 - DNA, 22 bp, Homo sapiens
gccaggaagtgcagccctgcca

SEQ ID NO: 7140091 - DNA, 22 bp, Homo sapiens
gccaggaagtgcagccctgcca

SEQ ID NO: 7140092 - DNA, 22 bp, Homo sapiens
gccaggaagttgggccagtcta

SEQ ID NO: 7140093 - DNA, 22 bp, Homo sapiens
gccaggaatcactgctgagtaa

SEQ ID NO: 7140094 - DNA, 22 bp, Homo sapiens
gccaggcatgtcctctgcagaa

SEQ ID NO: 7140095 - DNA, 22 bp, Homo sapiens
gccagctggtaggcacctagcc

SEQ ID NO: 7140096 - DNA, 22 bp, Homo sapiens
gccagctggtaggcacctagcc

SEQ ID NO: 7140097 - DNA, 22 bp, Homo sapiens
gccagctggtaggcacctagcc

SEQ ID NO: 7140098 - DNA, 22 bp, Homo sapiens
gccagctgaggccgtgcaggct

SEQ ID NO: 7140099 - DNA, 22 bp, Homo sapiens
gccagctgggccttagggctgg

SEQ ID NO: 7140100 - DNA, 22 bp, Homo sapiens
gccagctgggccttagggctgg

SEQ ID NO: 7140101 - DNA, 22 bp, Homo sapiens
gccagctgtaggtggtgggttg

SEQ ID NO: 7140102 - DNA, 22 bp, Homo sapiens
gccagctgtatctttggccagc

SEQ ID NO: 7140103 - DNA, 22 bp, Homo sapiens
gccagctgtctaagagagtaaa

SEQ ID NO: 7140104 - DNA, 22 bp, Homo sapiens
gccagctgtctaagagagtaaa

SEQ ID NO: 7140105 - DNA, 22 bp, Homo sapiens
gccagaagactggagtcagctg

SEQ ID NO: 7140106 - DNA, 22 bp, Homo sapiens
gccagaaagaggaggacctggg

SEQ ID NO: 7140107 - DNA, 22 bp, Homo sapiens
gccagaagactggagtcagctg

SEQ ID NO: 7140108 - DNA, 22 bp, Homo sapiens
gccagaaggggtggatccaggc

SEQ ID NO: 7140109 - DNA, 22 bp, Homo sapiens
gccagaaggggtggatccaggc

SEQ ID NO: 7140110 - DNA, 22 bp, Homo sapiens
gccagaagcacatgagaggtga

SEQ ID NO: 7140111 - DNA, 22 bp, Homo sapiens
gccagaaggggtggatccaggc

SEQ ID NO: 7140112 - DNA, 22 bp, Homo sapiens
gccacttctgcctggcagggcc

SEQ ID NO: 7140113 - DNA, 22 bp, Homo sapiens
gccacttatattcccactgtgc

SEQ ID NO: 7140114 - DNA, 16 bp, Homo sapiens
gccacttattgattga

SEQ ID NO: 7140115 - DNA, 22 bp, Homo sapiens
gccacttgtgtaagcgcctgtc

SEQ ID NO: 7140116 - DNA, 22 bp, Homo sapiens
gccactttgatgatataaaaac

SEQ ID NO: 7140117 - DNA, 22 bp, Homo sapiens
gccagaaacatacacatcactt

SEQ ID NO: 7140118 - DNA, 22 bp, Homo sapiens
gccagagacacttggaggtaga

SEQ ID NO: 7140119 - DNA, 22 bp, Homo sapiens
gccagctgaggccgtgcaggct

SEQ ID NO: 7140120 - DNA, 22 bp, Homo sapiens
gccagctgaggccgtgcaggct

SEQ ID NO: 7140121 - DNA, 22 bp, Homo sapiens
gccacctcggctttctctgctc

SEQ ID NO: 7140122 - DNA, 21 bp, Homo sapiens
gccacctcgtctcggagcagc

SEQ ID NO: 7140123 - DNA, 22 bp, Homo sapiens
gccacctcggctttctctgctc

SEQ ID NO: 7140124 - DNA, 21 bp, Homo sapiens
gccacctcgtctcggagcagc

SEQ ID NO: 7140125 - DNA, 22 bp, Homo sapiens
gccacctctagcaaagctcagc

SEQ ID NO: 7140126 - DNA, 21 bp, Homo sapiens
gccacctcgtctcggagcagc

SEQ ID NO: 7140127 - DNA, 22 bp, Homo sapiens
gccacctctagcaaagctcagc

SEQ ID NO: 7140128 - DNA, 22 bp, Homo sapiens
gccacctctagcaaagctcagc

SEQ ID NO: 7140129 - DNA, 22 bp, Homo sapiens
gccacctctctcttgactcgag

SEQ ID NO: 7140130 - DNA, 22 bp, Homo sapiens
gccacctctctcttgactcgag

SEQ ID NO: 7140131 - DNA, 20 bp, Homo sapiens
gccacctctctagcagtaga

SEQ ID NO: 7140132 - DNA, 20 bp, Homo sapiens
gccacctctctagcagtaga

SEQ ID NO: 7140133 - DNA, 20 bp, Homo sapiens
gccacctctctagcagtaga

SEQ ID NO: 7140134 - DNA, 22 bp, Homo sapiens
gccacctctttgtctctgccgc

SEQ ID NO: 7140135 - DNA, 22 bp, Homo sapiens
gccacccttgcgtcactgacat

SEQ ID NO: 7140136 - DNA, 21 bp, Homo sapiens
gccacctcaatcttctagcgc

SEQ ID NO: 7140137 - DNA, 22 bp, Homo sapiens
gccacctcccaggacgaggctg

SEQ ID NO: 7140138 - DNA, 22 bp, Homo sapiens
gccacctcccaggacgaggctg

SEQ ID NO: 7140139 - DNA, 23 bp, Homo sapiens
gccacctcctggtcagaaagagg

SEQ ID NO: 7140140 - DNA, 23 bp, Homo sapiens
gccacctcctggtcagaaagagg

SEQ ID NO: 7140141 - DNA, 22 bp, Homo sapiens
gccacctccttattccacctgt

SEQ ID NO: 7140142 - DNA, 22 bp, Homo sapiens
gccacctccttattccacctgt

SEQ ID NO: 7140143 - DNA, 22 bp, Homo sapiens
gccactgttgctcctcaggaaa

SEQ ID NO: 7140144 - DNA, 22 bp, Homo sapiens
gccacttactaacctcctatcc

SEQ ID NO: 7140145 - DNA, 22 bp, Homo sapiens
gccactgtgttgatctagcctg

SEQ ID NO: 7140146 - DNA, 22 bp, Homo sapiens
gccactgttccaccatcttgat

SEQ ID NO: 7140147 - DNA, 20 bp, Homo sapiens
gccactgtgcttacactgct

SEQ ID NO: 7140148 - DNA, 22 bp, Homo sapiens
gccaccttccaaaataatcaca

SEQ ID NO: 7140149 - DNA, 22 bp, Homo sapiens
gccaccttccaaaataatcaca

SEQ ID NO: 7140150 - DNA, 22 bp, Homo sapiens
gccacctgtttcgcttgcccag

SEQ ID NO: 7140151 - DNA, 22 bp, Homo sapiens
gccacctggactcagagccagg

SEQ ID NO: 7140152 - DNA, 22 bp, Homo sapiens
gccacctggacagctgtgccct

SEQ ID NO: 7140153 - DNA, 22 bp, Homo sapiens
gccacctggacagctgtgccct

SEQ ID NO: 7140154 - DNA, 22 bp, Homo sapiens
gcatttaaatttgaacttcaga

SEQ ID NO: 7140155 - DNA, 22 bp, Homo sapiens
gcattgtcctgcttctgagtgt

SEQ ID NO: 7140156 - DNA, 22 bp, Homo sapiens
gcattgttagtctatgcagata

SEQ ID NO: 7140157 - DNA, 22 bp, Homo sapiens
gcattgttgaaaggaatgggct

SEQ ID NO: 7140158 - DNA, 21 bp, Homo sapiens
gcattgttggctgctgctagg

SEQ ID NO: 7140159 - DNA, 20 bp, Homo sapiens
gcattgttgtagtagattgt

SEQ ID NO: 7140160 - DNA, 22 bp, Homo sapiens
gcattgtttaagtgggtggggt

SEQ ID NO: 7140161 - DNA, 22 bp, Homo sapiens
gcattgtttaagtgggtggggt

SEQ ID NO: 7140162 - DNA, 22 bp, Homo sapiens
gcattgtttcagtccactgtag

SEQ ID NO: 7140163 - DNA, 22 bp, Homo sapiens
gcatttaaatttgaacttcaga

SEQ ID NO: 7140164 - DNA, 22 bp, Homo sapiens
gcattgcaagggaaatagctgc

SEQ ID NO: 7140165 - DNA, 22 bp, Homo sapiens
gcattggttaagagctttgggg

SEQ ID NO: 7140166 - DNA, 22 bp, Homo sapiens
gcattggttcaaggttgtgcag

SEQ ID NO: 7140167 - DNA, 22 bp, Homo sapiens
gcattggtttacacagggtgaa

SEQ ID NO: 7140168 - DNA, 22 bp, Homo sapiens
gcattgcaactgacagatcatt

SEQ ID NO: 7140169 - DNA, 22 bp, Homo sapiens
gcattgattctgaagtgaaatg

SEQ ID NO: 7140170 - DNA, 22 bp, Homo sapiens
gcatttatattctgttcggata

SEQ ID NO: 7140171 - DNA, 18 bp, Homo sapiens
gcatttatgcggggctac

SEQ ID NO: 7140172 - DNA, 22 bp, Homo sapiens
gcatttattatctgccaggcac

SEQ ID NO: 7140173 - DNA, 22 bp, Homo sapiens
gcatttatttctttactgcatc

SEQ ID NO: 7140174 - DNA, 22 bp, Homo sapiens
gcatttatttctttactgcatc

SEQ ID NO: 7140175 - DNA, 22 bp, Homo sapiens
gcagtttactgtcaataactct

SEQ ID NO: 7140176 - DNA, 22 bp, Homo sapiens
gcagtttagtagatgacattat

SEQ ID NO: 7140177 - DNA, 22 bp, Homo sapiens
gcagtttactgtcaataactct

SEQ ID NO: 7140178 - DNA, 22 bp, Homo sapiens
gcagttgtaatatgatgtgagg

SEQ ID NO: 7140179 - DNA, 22 bp, Homo sapiens
gcagttgctcttgaggcacttt

SEQ ID NO: 7140180 - DNA, 22 bp, Homo sapiens
gcagttggcagggagcccagat

SEQ ID NO: 7140181 - DNA, 22 bp, Homo sapiens
gcagttacttctgagaagtgaa

SEQ ID NO: 7140182 - DNA, 23 bp, Homo sapiens
gcagttagtccactttgcagaga

SEQ ID NO: 7140183 - DNA, 23 bp, Homo sapiens
gcagttagtccactttgcagaga

SEQ ID NO: 7140184 - DNA, 22 bp, Homo sapiens
gcagttatgtgaatcatgtgac

SEQ ID NO: 7140185 - DNA, 22 bp, Homo sapiens
gcagttctcagccaggcggcag

SEQ ID NO: 7140186 - DNA, 17 bp, Homo sapiens
gcagttaaattaagatg

SEQ ID NO: 7140187 - DNA, 17 bp, Homo sapiens
gcagttaaattaagatg

SEQ ID NO: 7140188 - DNA, 22 bp, Homo sapiens
gcagttaaaaataaaccttcat

SEQ ID NO: 7140189 - DNA, 21 bp, Homo sapiens
gcagttaatagcagagcacac

SEQ ID NO: 7140190 - DNA, 22 bp, Homo sapiens
gcagtgtttttcaatgcttcca

SEQ ID NO: 7140191 - DNA, 22 bp, Homo sapiens
gcagtgttttacagaccagcat

SEQ ID NO: 7140192 - DNA, 22 bp, Homo sapiens
gcagtgtttgtgttctcacatg

SEQ ID NO: 7140193 - DNA, 22 bp, Homo sapiens
gcaggtgattcaccctgggcct

SEQ ID NO: 7140194 - DNA, 22 bp, Homo sapiens
gcaggtgattcaccctgggcct

SEQ ID NO: 7140195 - DNA, 22 bp, Homo sapiens
gcaggtgattcaccctgggcct

SEQ ID NO: 7140196 - DNA, 22 bp, Homo sapiens
gcaggtgattcaccctgggcct

SEQ ID NO: 7140197 - DNA, 18 bp, Homo sapiens
gcaggtgccactgctgtt

SEQ ID NO: 7140198 - DNA, 18 bp, Homo sapiens
gcaggtgccactgctgtt

SEQ ID NO: 7140199 - DNA, 22 bp, Homo sapiens
gcaggtggaagcagcagactca

SEQ ID NO: 7140200 - DNA, 22 bp, Homo sapiens
gcaggtggaagcagcagactca

SEQ ID NO: 7140201 - DNA, 22 bp, Homo sapiens
gcaggtggaagcagcagactca

SEQ ID NO: 7140202 - DNA, 22 bp, Homo sapiens
gcagtgttggtttgctctgcag

SEQ ID NO: 7140203 - DNA, 22 bp, Homo sapiens
gcaggtggaagcagcagactca

SEQ ID NO: 7140204 - DNA, 22 bp, Homo sapiens
gcagtgttggcaggatggggct

SEQ ID NO: 7140205 - DNA, 22 bp, Homo sapiens
gcagtgtttggatccatagcga

SEQ ID NO: 7140206 - DNA, 23 bp, Homo sapiens
gcagtgtttgcttcatcttatcc

SEQ ID NO: 7140207 - DNA, 22 bp, Homo sapiens
gcagtgtttcccagagatggaa

SEQ ID NO: 7140208 - DNA, 22 bp, Homo sapiens
gcagtgtttcagtgctttttct

SEQ ID NO: 7140209 - DNA, 22 bp, Homo sapiens
gcagtgtttcaaatcaaaggca

SEQ ID NO: 7140210 - DNA, 22 bp, Homo sapiens
gcagtgtttacatattagaaac

SEQ ID NO: 7140211 - DNA, 22 bp, Homo sapiens
gcagtgttgttaaaagattaga

SEQ ID NO: 7140212 - DNA, 22 bp, Homo sapiens
gcagtgttgtgatccaggtctt

SEQ ID NO: 7140213 - DNA, 22 bp, Homo sapiens
gcagttttagagctttaagatg

SEQ ID NO: 7140214 - DNA, 22 bp, Homo sapiens
gcagttttagtggatctggggc

SEQ ID NO: 7140215 - DNA, 22 bp, Homo sapiens
gcagttttattatgatggaaat

SEQ ID NO: 7140216 - DNA, 21 bp, Homo sapiens
gcagtttatgtaatatgcact

SEQ ID NO: 7140217 - DNA, 22 bp, Homo sapiens
gcagtttctgaatttatccaag

SEQ ID NO: 7140218 - DNA, 22 bp, Homo sapiens
gcagtttctgaatttatccaag

SEQ ID NO: 7140219 - DNA, 22 bp, Homo sapiens
gcataaactccaaaaggcaggg

SEQ ID NO: 7140220 - DNA, 22 bp, Homo sapiens
gcattaatgtaagacccactcc

SEQ ID NO: 7140221 - DNA, 22 bp, Homo sapiens
gcattacaggctgtaagatgca

SEQ ID NO: 7140222 - DNA, 22 bp, Homo sapiens
gcattagacccaaggtattttg

SEQ ID NO: 7140223 - DNA, 22 bp, Homo sapiens
gcattctttgaatgcttctaat

SEQ ID NO: 7140224 - DNA, 22 bp, Homo sapiens
gcattgaaatggcaaaaagaga

SEQ ID NO: 7140225 - DNA, 23 bp, Homo sapiens
gcattgaacaaaagaggggagta

SEQ ID NO: 7140226 - DNA, 22 bp, Homo sapiens
gcattgaaccatctagatttct

SEQ ID NO: 7140227 - DNA, 22 bp, Homo sapiens
gcattgaagatcttagactagg

SEQ ID NO: 7140228 - DNA, 22 bp, Homo sapiens
gcattgaaggacttccattata

SEQ ID NO: 7140229 - DNA, 22 bp, Homo sapiens
gcattgaaggacttccattata

SEQ ID NO: 7140230 - DNA, 22 bp, Homo sapiens
gcattgaaggcattttatctac

SEQ ID NO: 7140231 - DNA, 22 bp, Homo sapiens
gcattgaaggcattttatctac

SEQ ID NO: 7140232 - DNA, 22 bp, Homo sapiens
gcattgaatcctatcaggcaaa

SEQ ID NO: 7140233 - DNA, 22 bp, Homo sapiens
gcattgaatcctatcaggcaaa

SEQ ID NO: 7140234 - DNA, 22 bp, Homo sapiens
gccctagcgccagctcagcacc

SEQ ID NO: 7140235 - DNA, 22 bp, Homo sapiens
gccctacctcagtccagatctg

SEQ ID NO: 7140236 - DNA, 22 bp, Homo sapiens
gccctagccatcctgtgctctg

SEQ ID NO: 7140237 - DNA, 22 bp, Homo sapiens
gcccgtgtgcagagtgggagct

SEQ ID NO: 7140238 - DNA, 18 bp, Homo sapiens
gcccgtgtggagaccatg

SEQ ID NO: 7140239 - DNA, 22 bp, Homo sapiens
gcccgcgccagcctctccatct

SEQ ID NO: 7140240 - DNA, 22 bp, Homo sapiens
gcccgcgccagcctctccatct

SEQ ID NO: 7140241 - DNA, 22 bp, Homo sapiens
gcccgcagagatctttaacaaa

SEQ ID NO: 7140242 - DNA, 22 bp, Homo sapiens
gcccgcgccagcctctccatct

SEQ ID NO: 7140243 - DNA, 22 bp, Homo sapiens
gccccttgtctccaggccccaa

SEQ ID NO: 7140244 - DNA, 22 bp, Homo sapiens
gccccttgggaattcctccact

SEQ ID NO: 7140245 - DNA, 22 bp, Homo sapiens
gcccctgggagcagagccacca

SEQ ID NO: 7140246 - DNA, 22 bp, Homo sapiens
gccctcagaatgggctctaatc

SEQ ID NO: 7140247 - DNA, 22 bp, Homo sapiens
gccctagggggaaccgaggact

SEQ ID NO: 7140248 - DNA, 22 bp, Homo sapiens
gccctagcgccagctcagcacc

SEQ ID NO: 7140249 - DNA, 21 bp, Homo sapiens
gccctaggctacctggagcgc

SEQ ID NO: 7140250 - DNA, 21 bp, Homo sapiens
gccctaggctacctggagcgc

SEQ ID NO: 7140251 - DNA, 21 bp, Homo sapiens
gccctaggctacctggagcgc

SEQ ID NO: 7140252 - DNA, 22 bp, Homo sapiens
gccctaggcttttgtgactgcc

SEQ ID NO: 7140253 - DNA, 22 bp, Homo sapiens
gccctaggcttttgtgactgcc

SEQ ID NO: 7140254 - DNA, 22 bp, Homo sapiens
gccctagggcttttgggcctgt

SEQ ID NO: 7140255 - DNA, 22 bp, Homo sapiens
gccctgagttgagccttccaaa

SEQ ID NO: 7140256 - DNA, 22 bp, Homo sapiens
gccctgagttgagccttccaaa

SEQ ID NO: 7140257 - DNA, 22 bp, Homo sapiens
gccctgagttgagccttccaaa

SEQ ID NO: 7140258 - DNA, 22 bp, Homo sapiens
gccctgagtggtacctgtgggt

SEQ ID NO: 7140259 - DNA, 22 bp, Homo sapiens
gccctgagtggtacctgtgggt

SEQ ID NO: 7140260 - DNA, 22 bp, Homo sapiens
gccctgagtgcctgtgtaagaa

SEQ ID NO: 7140261 - DNA, 19 bp, Homo sapiens
gccctgagtaagctaggag

SEQ ID NO: 7140262 - DNA, 22 bp, Homo sapiens
gccctcagaggacagctgactt

SEQ ID NO: 7140263 - DNA, 22 bp, Homo sapiens
gccctcagaggacagctgactt

SEQ ID NO: 7140264 - DNA, 22 bp, Homo sapiens
gccccaggggaggtgccctgca

SEQ ID NO: 7140265 - DNA, 22 bp, Homo sapiens
gcccacaggggacctggtggct

SEQ ID NO: 7140266 - DNA, 22 bp, Homo sapiens
gcccacaggggacctggtggct

SEQ ID NO: 7140267 - DNA, 22 bp, Homo sapiens
gcccacagaggcaccaccaggc

SEQ ID NO: 7140268 - DNA, 22 bp, Homo sapiens
gcccacagaggcaccaccaggc

SEQ ID NO: 7140269 - DNA, 22 bp, Homo sapiens
gcccacagaggcaccaccaggc

SEQ ID NO: 7140270 - DNA, 22 bp, Homo sapiens
gcccacagctcgttcctctcct

SEQ ID NO: 7140271 - DNA, 22 bp, Homo sapiens
gcccaagtcagtgcttctggca

SEQ ID NO: 7140272 - DNA, 22 bp, Homo sapiens
gcccaagtcagtgcttctggca

SEQ ID NO: 7140273 - DNA, 22 bp, Homo sapiens
gcccaaggtcccatggcagcac

SEQ ID NO: 7140274 - DNA, 22 bp, Homo sapiens
gcccaaggtcccatggcagcac

SEQ ID NO: 7140275 - DNA, 22 bp, Homo sapiens
gcccaaggtcccatggcagcac

SEQ ID NO: 7140276 - DNA, 22 bp, Homo sapiens
gcccacacaccagctcaggagg

SEQ ID NO: 7140277 - DNA, 22 bp, Homo sapiens
gcccacacaccagctcaggagg

SEQ ID NO: 7140278 - DNA, 22 bp, Homo sapiens
gccccaggtggtaaacctaaga

SEQ ID NO: 7140279 - DNA, 22 bp, Homo sapiens
gccccaggtggtaaacctaaga

SEQ ID NO: 7140280 - DNA, 22 bp, Homo sapiens
gccccaggttgcctgtcccagg

SEQ ID NO: 7140281 - DNA, 22 bp, Homo sapiens
gccccaggttgcctgtcccagg

SEQ ID NO: 7140282 - DNA, 22 bp, Homo sapiens
gcccctccatccatcaccgggg

SEQ ID NO: 7140283 - DNA, 22 bp, Homo sapiens
gcccctccatccatcaccgggg

SEQ ID NO: 7140284 - DNA, 22 bp, Homo sapiens
gcccctcccagtcaggagcact

SEQ ID NO: 7140285 - DNA, 22 bp, Homo sapiens
gcccctcccagtcaggagcact

SEQ ID NO: 7140286 - DNA, 22 bp, Homo sapiens
gcccctcccagtcaggagcact

SEQ ID NO: 7140287 - DNA, 22 bp, Homo sapiens
gcccctccgggcgcgtcatagc

SEQ ID NO: 7140288 - DNA, 22 bp, Homo sapiens
gcccctctccttgtgcacctgc

SEQ ID NO: 7140289 - DNA, 22 bp, Homo sapiens
gcccctggctggccagctcctc

SEQ ID NO: 7140290 - DNA, 22 bp, Homo sapiens
gcccctggctggccagctcctc

SEQ ID NO: 7140291 - DNA, 22 bp, Homo sapiens
gcccctctccttgtgcacctgc

SEQ ID NO: 7140292 - DNA, 22 bp, Homo sapiens
gccctgctctggtctctgcccg

SEQ ID NO: 7140293 - DNA, 22 bp, Homo sapiens
gccctgctctgttggtcacctg

SEQ ID NO: 7140294 - DNA, 22 bp, Homo sapiens
gccctgctctggtctctgcccg

SEQ ID NO: 7140295 - DNA, 22 bp, Homo sapiens
gccctgctctggtctctgcccg

SEQ ID NO: 7140296 - DNA, 22 bp, Homo sapiens
gccctgctctggtctctgcccg

SEQ ID NO: 7140297 - DNA, 22 bp, Homo sapiens
gccctgctctggtctctgcccg

SEQ ID NO: 7140298 - DNA, 22 bp, Homo sapiens
gccctgctctggtctctgcccg

SEQ ID NO: 7140299 - DNA, 22 bp, Homo sapiens
gccctgctcctccgtcccacga

SEQ ID NO: 7140300 - DNA, 22 bp, Homo sapiens
gccctgctccaggagaataccc

SEQ ID NO: 7140301 - DNA, 23 bp, Homo sapiens
gccctgctcctggctgggaggga

SEQ ID NO: 7140302 - DNA, 23 bp, Homo sapiens
gccctgctcctggctgggaggga

SEQ ID NO: 7140303 - DNA, 22 bp, Homo sapiens
gccctgctcatttcacgtgttt

SEQ ID NO: 7140304 - DNA, 22 bp, Homo sapiens
gccctgctcatttcacgtgttt

SEQ ID NO: 7140305 - DNA, 23 bp, Homo sapiens
gccctgctactcacaagctgtgt

SEQ ID NO: 7140306 - DNA, 22 bp, Homo sapiens
gccctgcgccgtcccgctggtg

SEQ ID NO: 7140307 - DNA, 22 bp, Homo sapiens
gccctgcctgtctgctgggagg

SEQ ID NO: 7140308 - DNA, 22 bp, Homo sapiens
gccctgctaatttcgtactttt

SEQ ID NO: 7140309 - DNA, 17 bp, Homo sapiens
gccctgcctgctgccct

SEQ ID NO: 7140310 - DNA, 22 bp, Homo sapiens
gccctgcctgtctgctgggagg

SEQ ID NO: 7140311 - DNA, 22 bp, Homo sapiens
gccctgcctgtctgctgggagg

SEQ ID NO: 7140312 - DNA, 22 bp, Homo sapiens
gccctgagttgagccttccaaa

SEQ ID NO: 7140313 - DNA, 17 bp, Homo sapiens
gccctgcctgctgccct

SEQ ID NO: 7140314 - DNA, 22 bp, Homo sapiens
gccctgctgagtccggctcaga

SEQ ID NO: 7140315 - DNA, 22 bp, Homo sapiens
gccctgctgcgcagcacgcatg

SEQ ID NO: 7140316 - DNA, 22 bp, Homo sapiens
gccctgctcttttgcccaccca

SEQ ID NO: 7140317 - DNA, 22 bp, Homo sapiens
gccctgctcttttgcccaccca

SEQ ID NO: 7140318 - DNA, 22 bp, Homo sapiens
gccctgctcttttgcccaccca

SEQ ID NO: 7140319 - DNA, 22 bp, Homo sapiens
gccctgctgcgcagcacgcatg

SEQ ID NO: 7140320 - DNA, 23 bp, Homo sapiens
gccctgctgggacctcctgctac

SEQ ID NO: 7140321 - DNA, 23 bp, Homo sapiens
gccctgctgggacctcctgctac

SEQ ID NO: 7140322 - DNA, 22 bp, Homo sapiens
gccctgctgctggcagaggcgc

SEQ ID NO: 7140323 - DNA, 22 bp, Homo sapiens
gccctgcttctggcatgcagaa

SEQ ID NO: 7140324 - DNA, 22 bp, Homo sapiens
gccctgctgtttagagagctac

SEQ ID NO: 7140325 - DNA, 22 bp, Homo sapiens
gccctgctgtttagagagctac

SEQ ID NO: 7140326 - DNA, 22 bp, Homo sapiens
gccctgctgtttagagagctac

SEQ ID NO: 7140327 - DNA, 22 bp, Homo sapiens
gccctgctgtcttcagagtata

SEQ ID NO: 7140328 - DNA, 23 bp, Homo sapiens
gccctgctgggacctcctgctac

SEQ ID NO: 7140329 - DNA, 23 bp, Homo sapiens
gccctgctgggacctcctgctac

SEQ ID NO: 7140330 - DNA, 22 bp, Homo sapiens
gccctgctggggcacagcaaga

SEQ ID NO: 7140331 - DNA, 22 bp, Homo sapiens
gccctgcttggtcatggccttc

SEQ ID NO: 7140332 - DNA, 22 bp, Homo sapiens
gccctgcttggtcatggccttc

SEQ ID NO: 7140333 - DNA, 22 bp, Homo sapiens
gccctgcttggtcatggccttc

SEQ ID NO: 7140334 - DNA, 22 bp, Homo sapiens
gccctgcttctggcatgcagaa

SEQ ID NO: 7140335 - DNA, 22 bp, Homo sapiens
gccctgcttctggcatgcagaa

SEQ ID NO: 7140336 - DNA, 22 bp, Homo sapiens
gccctggaaaggaacctgggct

SEQ ID NO: 7140337 - DNA, 22 bp, Homo sapiens
gccctggaaaggaacctgggct

SEQ ID NO: 7140338 - DNA, 22 bp, Homo sapiens
gccctggaaaggaacctgggct

SEQ ID NO: 7140339 - DNA, 22 bp, Homo sapiens
gccctggaatctctccatggga

SEQ ID NO: 7140340 - DNA, 22 bp, Homo sapiens
gccctggaatctctccatggga

SEQ ID NO: 7140341 - DNA, 20 bp, Homo sapiens
gccctggacgtggcctcggc

SEQ ID NO: 7140342 - DNA, 20 bp, Homo sapiens
gccctggacgtggcctcggc

SEQ ID NO: 7140343 - DNA, 22 bp, Homo sapiens
gcctcagggggagaggccagct

SEQ ID NO: 7140344 - DNA, 22 bp, Homo sapiens
gcctcagggggagaggccagct

SEQ ID NO: 7140345 - DNA, 22 bp, Homo sapiens
gcctcagggggagaggccagct

SEQ ID NO: 7140346 - DNA, 22 bp, Homo sapiens
gcctcagggggagaggccagct

SEQ ID NO: 7140347 - DNA, 22 bp, Homo sapiens
gcctcaggtgcatctctcattc

SEQ ID NO: 7140348 - DNA, 19 bp, Homo sapiens
gcctcatttccacctcccc

SEQ ID NO: 7140349 - DNA, 19 bp, Homo sapiens
gcctcatttccacctcccc

SEQ ID NO: 7140350 - DNA, 19 bp, Homo sapiens
gcctcatttccacctcccc

SEQ ID NO: 7140351 - DNA, 20 bp, Homo sapiens
gcctccacactcacccctta

SEQ ID NO: 7140352 - DNA, 20 bp, Homo sapiens
gcctccacactcacccctta

SEQ ID NO: 7140353 - DNA, 18 bp, Homo sapiens
gcctccaccatggagggt

SEQ ID NO: 7140354 - DNA, 18 bp, Homo sapiens
gcctccaccatggagggt

SEQ ID NO: 7140355 - DNA, 20 bp, Homo sapiens
gcctccaccccaggcttcag

SEQ ID NO: 7140356 - DNA, 20 bp, Homo sapiens
gcctccaccccaggcttcag

SEQ ID NO: 7140357 - DNA, 20 bp, Homo sapiens
gcctccaccccaggcttcag

SEQ ID NO: 7140358 - DNA, 22 bp, Homo sapiens
gcctcagtgatatgtgggacaa

SEQ ID NO: 7140359 - DNA, 22 bp, Homo sapiens
gcctcagtgtcctcctccatgt

SEQ ID NO: 7140360 - DNA, 22 bp, Homo sapiens
gcctcagtctcccgagtagctg

SEQ ID NO: 7140361 - DNA, 22 bp, Homo sapiens
gcctcaggtgcatctctcattc

SEQ ID NO: 7140362 - DNA, 22 bp, Homo sapiens
gcctgaggaatgctcctgactt

SEQ ID NO: 7140363 - DNA, 22 bp, Homo sapiens
gcctgagggctcctagcaggct

SEQ ID NO: 7140364 - DNA, 22 bp, Homo sapiens
gcctgagggctcctagcaggct

SEQ ID NO: 7140365 - DNA, 22 bp, Homo sapiens
gcctcccttggtgtctcccggg

SEQ ID NO: 7140366 - DNA, 22 bp, Homo sapiens
gcctgaggaattgagggggtaa

SEQ ID NO: 7140367 - DNA, 22 bp, Homo sapiens
gcctccctgtttcctgctccaa

SEQ ID NO: 7140368 - DNA, 22 bp, Homo sapiens
gcctgagggctcctagcaggct

SEQ ID NO: 7140369 - DNA, 22 bp, Homo sapiens
gcctgagggctcctagcaggct

SEQ ID NO: 7140370 - DNA, 22 bp, Homo sapiens
gcctgagggctcctagcaggct

SEQ ID NO: 7140371 - DNA, 22 bp, Homo sapiens
gcctccctgtttcctgctccaa

SEQ ID NO: 7140372 - DNA, 22 bp, Homo sapiens
gcctccctgttcttccacaata

SEQ ID NO: 7140373 - DNA, 22 bp, Homo sapiens
gcctccctgttcttccacaata

SEQ ID NO: 7140374 - DNA, 18 bp, Homo sapiens
gcctccctggctacactt

SEQ ID NO: 7140375 - DNA, 18 bp, Homo sapiens
gcctccctggctacactt

SEQ ID NO: 7140376 - DNA, 22 bp, Homo sapiens
gcctccctgtagaggccagcct

SEQ ID NO: 7140377 - DNA, 22 bp, Homo sapiens
gcctccctgttcttccacaata

SEQ ID NO: 7140378 - DNA, 22 bp, Homo sapiens
gcctccacccctggggagtgga

SEQ ID NO: 7140379 - DNA, 22 bp, Homo sapiens
gcctccacccctggggagtgga

SEQ ID NO: 7140380 - DNA, 22 bp, Homo sapiens
gcctccaccgaacgctctcttg

SEQ ID NO: 7140381 - DNA, 22 bp, Homo sapiens
gcctccaccgaacgctctcttg

SEQ ID NO: 7140382 - DNA, 22 bp, Homo sapiens
gcctccaccgaacgctctcttg

SEQ ID NO: 7140383 - DNA, 22 bp, Homo sapiens
gcctccaccgaacgctctcttg

SEQ ID NO: 7140384 - DNA, 22 bp, Homo sapiens
gcctccaccgaacgctctcttg

SEQ ID NO: 7140385 - DNA, 22 bp, Homo sapiens
gcctccactgatcagacttgac

SEQ ID NO: 7140386 - DNA, 22 bp, Homo sapiens
gcctccactgatcagacttgac

SEQ ID NO: 7140387 - DNA, 22 bp, Homo sapiens
gcctccacttctttagtatgac

SEQ ID NO: 7140388 - DNA, 22 bp, Homo sapiens
gcctccacttctttagtatgac

SEQ ID NO: 7140389 - DNA, 22 bp, Homo sapiens
gcctccccaggggtgtcatgag

SEQ ID NO: 7140390 - DNA, 22 bp, Homo sapiens
gcctcccctgcaattgtccttg

SEQ ID NO: 7140391 - DNA, 22 bp, Homo sapiens
gcctccctccaccactgcaggt

SEQ ID NO: 7140392 - DNA, 22 bp, Homo sapiens
gcctccctccaccactgcaggt

SEQ ID NO: 7140393 - DNA, 22 bp, Homo sapiens
gcctccctgagtcacccaagca

SEQ ID NO: 7140394 - DNA, 22 bp, Homo sapiens
gcctccctgagtcacccaagca

SEQ ID NO: 7140395 - DNA, 22 bp, Homo sapiens
gcctccctggcccacagcagcg

SEQ ID NO: 7140396 - DNA, 22 bp, Homo sapiens
gcctccctggcccacagcagcg

SEQ ID NO: 7140397 - DNA, 22 bp, Homo sapiens
gcctccctggcccacagcagcg

SEQ ID NO: 7140398 - DNA, 22 bp, Homo sapiens
gcctgcagcctcagagaatttt

SEQ ID NO: 7140399 - DNA, 22 bp, Homo sapiens
gcctgcagcctcagagaatttt

SEQ ID NO: 7140400 - DNA, 22 bp, Homo sapiens
gcctgcagctgcttccacacac

SEQ ID NO: 7140401 - DNA, 18 bp, Homo sapiens
gcctgcaggcacgggggt

SEQ ID NO: 7140402 - DNA, 18 bp, Homo sapiens
gcctgcaggcacgggggt

SEQ ID NO: 7140403 - DNA, 18 bp, Homo sapiens
gcctgcaggcacgggggt

SEQ ID NO: 7140404 - DNA, 17 bp, Homo sapiens
gcctgcaggcccgcaga

SEQ ID NO: 7140405 - DNA, 17 bp, Homo sapiens
gcctgcaggcccgcaga

SEQ ID NO: 7140406 - DNA, 22 bp, Homo sapiens
gcctgcaggctgtagtttgtga

SEQ ID NO: 7140407 - DNA, 22 bp, Homo sapiens
gcctgcagggcccttgtgggtc

SEQ ID NO: 7140408 - DNA, 22 bp, Homo sapiens
gcctgcagggcccttgtgggtc

SEQ ID NO: 7140409 - DNA, 22 bp, Homo sapiens
gcctgcagggcctgggcctacc

SEQ ID NO: 7140410 - DNA, 22 bp, Homo sapiens
gcctgcagggcctgggcctacc

SEQ ID NO: 7140411 - DNA, 22 bp, Homo sapiens
gcctgcagatatataggatggt

SEQ ID NO: 7140412 - DNA, 22 bp, Homo sapiens
gcctgcagcatgctaggtcttg

SEQ ID NO: 7140413 - DNA, 22 bp, Homo sapiens
gcctgcagcccctctgcagtag

SEQ ID NO: 7140414 - DNA, 22 bp, Homo sapiens
gcctgcagcccctctgcagtag

SEQ ID NO: 7140415 - DNA, 22 bp, Homo sapiens
gcctgcagcctcaagggctgag

SEQ ID NO: 7140416 - DNA, 22 bp, Homo sapiens
gcctgcagcctcaagggctgag

SEQ ID NO: 7140417 - DNA, 22 bp, Homo sapiens
gcctgcagcctcaagggctgag

SEQ ID NO: 7140418 - DNA, 20 bp, Homo sapiens
gcctgcagagaaggtcagag

SEQ ID NO: 7140419 - DNA, 20 bp, Homo sapiens
gcctgcagagaaggtcagag

SEQ ID NO: 7140420 - DNA, 20 bp, Homo sapiens
gcctgcagagaaggtcagag

SEQ ID NO: 7140421 - DNA, 22 bp, Homo sapiens
gcctgcagaggtgctgctagct

SEQ ID NO: 7140422 - DNA, 22 bp, Homo sapiens
gcctgcagaggtgctgctagct

SEQ ID NO: 7140423 - DNA, 22 bp, Homo sapiens
gcctgcagaactgtgaggcaat

SEQ ID NO: 7140424 - DNA, 21 bp, Homo sapiens
gcctgcagaccccaccaggct

SEQ ID NO: 7140425 - DNA, 21 bp, Homo sapiens
gcctgcagaccccaccaggct

SEQ ID NO: 7140426 - DNA, 22 bp, Homo sapiens
gcctgcagaactgtgaggcaat

SEQ ID NO: 7140427 - DNA, 22 bp, Homo sapiens
gcctgcagaactgtgaggcaat

SEQ ID NO: 7140428 - DNA, 21 bp, Homo sapiens
gcctgcagaccccaccaggct

SEQ ID NO: 7140429 - DNA, 21 bp, Homo sapiens
gcctgcagaccccaccaggct

SEQ ID NO: 7140430 - DNA, 20 bp, Homo sapiens
gcctgcagagaaggtcagag

SEQ ID NO: 7140431 - DNA, 20 bp, Homo sapiens
gcctgcagagaaggtcagag

SEQ ID NO: 7140432 - DNA, 19 bp, Homo sapiens
gcctgcagaaaaggcaggg

SEQ ID NO: 7140433 - DNA, 22 bp, Homo sapiens
gcctgcagaactgtgaggcaat

SEQ ID NO: 7140434 - DNA, 22 bp, Homo sapiens
gcctgcagaactgtgaggcaat

SEQ ID NO: 7140435 - DNA, 19 bp, Homo sapiens
gcctgcagaaaaggcaggg

SEQ ID NO: 7140436 - DNA, 22 bp, Homo sapiens
gcctgagtttgaactctagctc

SEQ ID NO: 7140437 - DNA, 22 bp, Homo sapiens
gcctgcaagatggctggtcact

SEQ ID NO: 7140438 - DNA, 21 bp, Homo sapiens
gcctgcacacagtaggtgcac

SEQ ID NO: 7140439 - DNA, 22 bp, Homo sapiens
gcctgcacccacaggcatggcc

SEQ ID NO: 7140440 - DNA, 23 bp, Homo sapiens
gcctggagaaaagctgcagttca

SEQ ID NO: 7140441 - DNA, 23 bp, Homo sapiens
gcctggagaaaagctgcagttca

SEQ ID NO: 7140442 - DNA, 22 bp, Homo sapiens
gcctgccaaaagaagctgctgg

SEQ ID NO: 7140443 - DNA, 23 bp, Homo sapiens
gcctggagaaaagctgcagttca

SEQ ID NO: 7140444 - DNA, 23 bp, Homo sapiens
gcctggagaaaagctgcagttca

SEQ ID NO: 7140445 - DNA, 23 bp, Homo sapiens
gcctggagaaaagctgcagttca

SEQ ID NO: 7140446 - DNA, 23 bp, Homo sapiens
gcctggagaaaagctgcagttca

SEQ ID NO: 7140447 - DNA, 22 bp, Homo sapiens
gcctgcagtgagtgcagaaggt

SEQ ID NO: 7140448 - DNA, 22 bp, Homo sapiens
gcctgcagtgagtgcagaaggt

SEQ ID NO: 7140449 - DNA, 22 bp, Homo sapiens
gcctgcagttctgtgctaggca

SEQ ID NO: 7140450 - DNA, 22 bp, Homo sapiens
gcctgcagttctgtgctaggca

SEQ ID NO: 7140451 - DNA, 22 bp, Homo sapiens
gcctgcagttctgtgctaggca

SEQ ID NO: 7140452 - DNA, 20 bp, Homo sapiens
gcctgcaggttggatgggat

SEQ ID NO: 7140453 - DNA, 22 bp, Homo sapiens
gcctgcagggtgatgggctgcc

SEQ ID NO: 7140454 - DNA, 20 bp, Homo sapiens
gcctgcaggttggatgggat

SEQ ID NO: 7140455 - DNA, 22 bp, Homo sapiens
gcctgcagtgagtgcagaaggt

SEQ ID NO: 7140456 - DNA, 22 bp, Homo sapiens
gcctgcagtgagtgcagaaggt

SEQ ID NO: 7140457 - DNA, 20 bp, Homo sapiens
gcctgcaggttggatgggat

SEQ ID NO: 7140458 - DNA, 22 bp, Homo sapiens
gcctgcagggtgatgggctgcc

SEQ ID NO: 7140459 - DNA, 22 bp, Homo sapiens
gcctgcagggcctgggcctacc

SEQ ID NO: 7140460 - DNA, 22 bp, Homo sapiens
gcctgcagggcctgggcctacc

SEQ ID NO: 7140461 - DNA, 22 bp, Homo sapiens
gcctgcagggtgatgggctgcc

SEQ ID NO: 7140462 - DNA, 22 bp, Homo sapiens
gcctggagaaaggaaggtggga

SEQ ID NO: 7140463 - DNA, 22 bp, Homo sapiens
gcctggagaaaggaaggtggga

SEQ ID NO: 7140464 - DNA, 22 bp, Homo sapiens
gcctggagaaaggaaggtggga

SEQ ID NO: 7140465 - DNA, 22 bp, Homo sapiens
gcctggagaaaggaaggtggga

SEQ ID NO: 7140466 - DNA, 22 bp, Homo sapiens
gcctggagaaaggaaggtggga

SEQ ID NO: 7140467 - DNA, 22 bp, Homo sapiens
gcctggagaaaggaaggtggga

SEQ ID NO: 7140468 - DNA, 22 bp, Homo sapiens
gcctggagaaaggaaggtggga

SEQ ID NO: 7140469 - DNA, 22 bp, Homo sapiens
gcctggagaagatggaactagc

SEQ ID NO: 7140470 - DNA, 22 bp, Homo sapiens
gcctggagaagatggaactagc

SEQ ID NO: 7140471 - DNA, 22 bp, Homo sapiens
gcctggagaagatggaactagc

SEQ ID NO: 7140472 - DNA, 22 bp, Homo sapiens
gcctggagaagatggaactagc

SEQ ID NO: 7140473 - DNA, 22 bp, Homo sapiens
gcctggagaattaaaaggaagg

SEQ ID NO: 7140474 - DNA, 22 bp, Homo sapiens
gcctggagaattaaaaggaagg

SEQ ID NO: 7140475 - DNA, 22 bp, Homo sapiens
gcctggagaattaaaaggaagg

SEQ ID NO: 7140476 - DNA, 22 bp, Homo sapiens
gcctggagaattaaaaggaagg

SEQ ID NO: 7140477 - DNA, 22 bp, Homo sapiens
gcctggagaattaaaaggaagg

SEQ ID NO: 7140478 - DNA, 22 bp, Homo sapiens
gcctggagacaaggacaaaggg

SEQ ID NO: 7140479 - DNA, 22 bp, Homo sapiens
gcctggagacaaggacaaaggg

SEQ ID NO: 7140480 - DNA, 22 bp, Homo sapiens
gcctggagacaaggacaaaggg

SEQ ID NO: 7140481 - DNA, 22 bp, Homo sapiens
gcctggagacaaggacaaaggg

SEQ ID NO: 7140482 - DNA, 22 bp, Homo sapiens
gcctggagacaaggacaaaggg

SEQ ID NO: 7140483 - DNA, 22 bp, Homo sapiens
gcctggagacaaggacaaaggg

SEQ ID NO: 7140484 - DNA, 22 bp, Homo sapiens
gcctggagacagcagaggcggc

SEQ ID NO: 7140485 - DNA, 22 bp, Homo sapiens
gcctggagacagcagaggcggc

SEQ ID NO: 7140486 - DNA, 22 bp, Homo sapiens
gcctggagacagcagaggcggc

SEQ ID NO: 7140487 - DNA, 22 bp, Homo sapiens
gcctggagacagcagaggcggc

SEQ ID NO: 7140488 - DNA, 22 bp, Homo sapiens
gcctggagtagcatggcaagcc

SEQ ID NO: 7140489 - DNA, 22 bp, Homo sapiens
gcctggagtagcatggcaagcc

SEQ ID NO: 7140490 - DNA, 22 bp, Homo sapiens
gcctggagtgcagtggcgtgat

SEQ ID NO: 7140491 - DNA, 22 bp, Homo sapiens
gcctggagtgcagtggcgtgat

SEQ ID NO: 7140492 - DNA, 22 bp, Homo sapiens
gcctggagtgcagtggcgtgat

SEQ ID NO: 7140493 - DNA, 22 bp, Homo sapiens
gcctggagcccagtgtggggct

SEQ ID NO: 7140494 - DNA, 22 bp, Homo sapiens
gcctggagcccagtgtggggct

SEQ ID NO: 7140495 - DNA, 22 bp, Homo sapiens
gcctggagcccagtgtggggct

SEQ ID NO: 7140496 - DNA, 22 bp, Homo sapiens
gcctggagcctcagcaaggagg

SEQ ID NO: 7140497 - DNA, 22 bp, Homo sapiens
gcctggagtgcagtggcgtgat

SEQ ID NO: 7140498 - DNA, 22 bp, Homo sapiens
gcctggagtgcagtggcgtgat

SEQ ID NO: 7140499 - DNA, 22 bp, Homo sapiens
gcctggagtgcagtggcgtgat

SEQ ID NO: 7140500 - DNA, 22 bp, Homo sapiens
gcctggagtggacttggcccct

SEQ ID NO: 7140501 - DNA, 22 bp, Homo sapiens
gcctggagtggacttggcccct

SEQ ID NO: 7140502 - DNA, 22 bp, Homo sapiens
gcctggagtggacttggcccct

SEQ ID NO: 7140503 - DNA, 22 bp, Homo sapiens
gcctggagtggacttggcccct

SEQ ID NO: 7140504 - DNA, 16 bp, Homo sapiens
gcctggagtggcaggg

SEQ ID NO: 7140505 - DNA, 16 bp, Homo sapiens
gcctggagtggcaggg

SEQ ID NO: 7140506 - DNA, 16 bp, Homo sapiens
gcctggagtggcaggg

SEQ ID NO: 7140507 - DNA, 16 bp, Homo sapiens
gcctggagtggcaggg

SEQ ID NO: 7140508 - DNA, 16 bp, Homo sapiens
gcctggagtggcaggg

SEQ ID NO: 7140509 - DNA, 22 bp, Homo sapiens
gcctggagaggaagccggtgga

SEQ ID NO: 7140510 - DNA, 22 bp, Homo sapiens
gcctggagaggaagccggtgga

SEQ ID NO: 7140511 - DNA, 22 bp, Homo sapiens
gcctggagaggaagccggtgga

SEQ ID NO: 7140512 - DNA, 22 bp, Homo sapiens
gcctggagaggaagccggtgga

SEQ ID NO: 7140513 - DNA, 22 bp, Homo sapiens
gcctggagaggaagccggtgga

SEQ ID NO: 7140514 - DNA, 22 bp, Homo sapiens
gcctggagaggaagccggtgga

SEQ ID NO: 7140515 - DNA, 22 bp, Homo sapiens
gcctggagaggaagccggtgga

SEQ ID NO: 7140516 - DNA, 22 bp, Homo sapiens
gcctggagcagacgtgtcccgg

SEQ ID NO: 7140517 - DNA, 22 bp, Homo sapiens
gcctggagcagacgtgtcccgg

SEQ ID NO: 7140518 - DNA, 22 bp, Homo sapiens
gcctggagcagacgtgtcccgg

SEQ ID NO: 7140519 - DNA, 22 bp, Homo sapiens
gcctggagcagacgtgtcccgg

SEQ ID NO: 7140520 - DNA, 22 bp, Homo sapiens
gcctggagcagacgtgtcccgg

SEQ ID NO: 7140521 - DNA, 22 bp, Homo sapiens
gcctggagcccagtgtggggct

SEQ ID NO: 7140522 - DNA, 22 bp, Homo sapiens
gcctggagcccagtgtggggct

SEQ ID NO: 7140523 - DNA, 22 bp, Homo sapiens
gcctggagcccagtgtggggct

SEQ ID NO: 7140524 - DNA, 22 bp, Homo sapiens
gcctggagagcactgtgcgctt

SEQ ID NO: 7140525 - DNA, 22 bp, Homo sapiens
gcctggagagcactgtgcgctt

SEQ ID NO: 7140526 - DNA, 22 bp, Homo sapiens
gcctggagagcactgtgcgctt

SEQ ID NO: 7140527 - DNA, 22 bp, Homo sapiens
gcctggagagcactgtgcgctt

SEQ ID NO: 7140528 - DNA, 22 bp, Homo sapiens
gcctggagagcactgtgcgctt

SEQ ID NO: 7140529 - DNA, 22 bp, Homo sapiens
gcctggagagcactgtgcgctt

SEQ ID NO: 7140530 - DNA, 22 bp, Homo sapiens
gcctggagacagcagaggcggc

SEQ ID NO: 7140531 - DNA, 22 bp, Homo sapiens
gcctggagacagcagaggcggc

SEQ ID NO: 7140532 - DNA, 22 bp, Homo sapiens
gcctggagacctgctcctctac

SEQ ID NO: 7140533 - DNA, 22 bp, Homo sapiens
gcctggagacctgctcctctac

SEQ ID NO: 7140534 - DNA, 22 bp, Homo sapiens
gcctggagacctgctcctctac

SEQ ID NO: 7140535 - DNA, 22 bp, Homo sapiens
gcctggagacctgctcctctac

SEQ ID NO: 7140536 - DNA, 22 bp, Homo sapiens
gcctggagacctgctcctctac

SEQ ID NO: 7140537 - DNA, 22 bp, Homo sapiens
gacatggcttctaggaagcttt

SEQ ID NO: 7140538 - DNA, 22 bp, Homo sapiens
gacatggatacttgataagggg

SEQ ID NO: 7140539 - DNA, 22 bp, Homo sapiens
gacatgctgaataactatatga

SEQ ID NO: 7140540 - DNA, 22 bp, Homo sapiens
gacatgcatgaatgcaggtctc

SEQ ID NO: 7140541 - DNA, 22 bp, Homo sapiens
gacatgcattaagacacactga

SEQ ID NO: 7140542 - DNA, 22 bp, Homo sapiens
gacatgcattaagacacactga

SEQ ID NO: 7140543 - DNA, 22 bp, Homo sapiens
gacatgcattaagacacactga

SEQ ID NO: 7140544 - DNA, 22 bp, Homo sapiens
gacatgctaattactggttcaa

SEQ ID NO: 7140545 - DNA, 22 bp, Homo sapiens
gacatgtgagagctcggttttc

SEQ ID NO: 7140546 - DNA, 22 bp, Homo sapiens
gacatgtattagtcatgcacag

SEQ ID NO: 7140547 - DNA, 22 bp, Homo sapiens
gacatgtcggatagaatgagtt

SEQ ID NO: 7140548 - DNA, 22 bp, Homo sapiens
gacatgtaaatggcaattatgg

SEQ ID NO: 7140549 - DNA, 22 bp, Homo sapiens
gacatgtattagtacatatggt

SEQ ID NO: 7140550 - DNA, 22 bp, Homo sapiens
gacatgcatgaatgcaggtctc

SEQ ID NO: 7140551 - DNA, 22 bp, Homo sapiens
gacatgcatgaatgcaggtctc

SEQ ID NO: 7140552 - DNA, 22 bp, Homo sapiens
gacatgcaatgcagtggtaagt

SEQ ID NO: 7140553 - DNA, 22 bp, Homo sapiens
gacatgcaatgcagtggtaagt

SEQ ID NO: 7140554 - DNA, 22 bp, Homo sapiens
gacatgcagttctcaagggtag

SEQ ID NO: 7140555 - DNA, 22 bp, Homo sapiens
gacatgcataacaagattggaa

SEQ ID NO: 7140556 - DNA, 22 bp, Homo sapiens
gacatgcataacaagattggaa

SEQ ID NO: 7140557 - DNA, 22 bp, Homo sapiens
gacatgcatattcactcttctt

SEQ ID NO: 7140558 - DNA, 23 bp, Homo sapiens
gacatctgttttgtccctgtgct

SEQ ID NO: 7140559 - DNA, 23 bp, Homo sapiens
gacatctgttttgtccctgtgct

SEQ ID NO: 7140560 - DNA, 23 bp, Homo sapiens
gacatctgttttgtccctgtgct

SEQ ID NO: 7140561 - DNA, 22 bp, Homo sapiens
gacatcttccggatcgccaccc

SEQ ID NO: 7140562 - DNA, 22 bp, Homo sapiens
gacatgaatgttatactttatt

SEQ ID NO: 7140563 - DNA, 22 bp, Homo sapiens
gacatgatgcttggaactacat

SEQ ID NO: 7140564 - DNA, 22 bp, Homo sapiens
gacatgatggaaaaaaatgctc

SEQ ID NO: 7140565 - DNA, 22 bp, Homo sapiens
gacatgcaacaatttggcattt

SEQ ID NO: 7140566 - DNA, 22 bp, Homo sapiens
gacatgcaacaatttggcattt

SEQ ID NO: 7140567 - DNA, 22 bp, Homo sapiens
gacatgcaacaatttggcattt

SEQ ID NO: 7140568 - DNA, 22 bp, Homo sapiens
gacctggaatttgtgtgtgttc

SEQ ID NO: 7140569 - DNA, 22 bp, Homo sapiens
gacctggcaactgtagcttctg

SEQ ID NO: 7140570 - DNA, 22 bp, Homo sapiens
gacctggcatattcattggcac

SEQ ID NO: 7140571 - DNA, 19 bp, Homo sapiens
gacctggccaagttactta

SEQ ID NO: 7140572 - DNA, 22 bp, Homo sapiens
gacctgcctgagctgcctctgc

SEQ ID NO: 7140573 - DNA, 22 bp, Homo sapiens
gacctggaatgaagggtccctc

SEQ ID NO: 7140574 - DNA, 22 bp, Homo sapiens
gacatgtgagcaagcgtgcggc

SEQ ID NO: 7140575 - DNA, 22 bp, Homo sapiens
gacatgtgctgtctcttaaatt

SEQ ID NO: 7140576 - DNA, 22 bp, Homo sapiens
gacatgtgagagctcggttttc

SEQ ID NO: 7140577 - DNA, 22 bp, Homo sapiens
gacatgtgtctgcaagttgatc

SEQ ID NO: 7140578 - DNA, 22 bp, Homo sapiens
gacatgttatctctggcttcaa

SEQ ID NO: 7140579 - DNA, 22 bp, Homo sapiens
gacatgttatctctggcttcaa

SEQ ID NO: 7140580 - DNA, 22 bp, Homo sapiens
gacatgttgaagaatatttgga

SEQ ID NO: 7140581 - DNA, 22 bp, Homo sapiens
gacatgtttgctatagggattt

SEQ ID NO: 7140582 - DNA, 22 bp, Homo sapiens
gacattaatggcaaattaatta

SEQ ID NO: 7140583 - DNA, 22 bp, Homo sapiens
gacattaatggcaaattaatta

SEQ ID NO: 7140584 - DNA, 22 bp, Homo sapiens
gacattaatggcaaattaatta

SEQ ID NO: 7140585 - DNA, 22 bp, Homo sapiens
gacctggggtggaaggaaggca

SEQ ID NO: 7140586 - DNA, 22 bp, Homo sapiens
gacctggtccttgtactttgaa

SEQ ID NO: 7140587 - DNA, 22 bp, Homo sapiens
gacctggcctgcacagccctta

SEQ ID NO: 7140588 - DNA, 23 bp, Homo sapiens
gacctggctttgaatcttgactc

SEQ ID NO: 7140589 - DNA, 22 bp, Homo sapiens
gacctggctttgggccccggca

SEQ ID NO: 7140590 - DNA, 22 bp, Homo sapiens
gacctggggtaagcttggcaac

SEQ ID NO: 7140591 - DNA, 22 bp, Homo sapiens
gaccttcttgctgtgtcctaac

SEQ ID NO: 7140592 - DNA, 22 bp, Homo sapiens
gaccttcttgctgtgtcctaac

SEQ ID NO: 7140593 - DNA, 22 bp, Homo sapiens
gaccttccaggctgaatggctg

SEQ ID NO: 7140594 - DNA, 22 bp, Homo sapiens
gacctggtccttgtactttgaa

SEQ ID NO: 7140595 - DNA, 22 bp, Homo sapiens
gaccttcaagcaccatatttat

SEQ ID NO: 7140596 - DNA, 22 bp, Homo sapiens
gactatttatttacagaaagct

SEQ ID NO: 7140597 - DNA, 22 bp, Homo sapiens
gactatttccctcatcatcttc

SEQ ID NO: 7140598 - DNA, 22 bp, Homo sapiens
gactatttccctcatcatcttc

SEQ ID NO: 7140599 - DNA, 22 bp, Homo sapiens
gactattttataaactagtgaa

SEQ ID NO: 7140600 - DNA, 22 bp, Homo sapiens
gactatttagtttcagattagt

SEQ ID NO: 7140601 - DNA, 22 bp, Homo sapiens
gactagaagggcaagagtccct

SEQ ID NO: 7140602 - DNA, 22 bp, Homo sapiens
gactagaatagggggtaggaag

SEQ ID NO: 7140603 - DNA, 22 bp, Homo sapiens
gactagaatagggggtaggaag

SEQ ID NO: 7140604 - DNA, 22 bp, Homo sapiens
gactagggaatcattcttggat

SEQ ID NO: 7140605 - DNA, 22 bp, Homo sapiens
gactaggggcagcgtgggagct

SEQ ID NO: 7140606 - DNA, 22 bp, Homo sapiens
gactagtcatttgcattccgtc

SEQ ID NO: 7140607 - DNA, 22 bp, Homo sapiens
gactacaggtgtgtgccaccat

SEQ ID NO: 7140608 - DNA, 19 bp, Homo sapiens
gactacagggggaagaagt

SEQ ID NO: 7140609 - DNA, 22 bp, Homo sapiens
gactagaagggcaagagtccct

SEQ ID NO: 7140610 - DNA, 22 bp, Homo sapiens
gaccttgtgatccacccgcctt

SEQ ID NO: 7140611 - DNA, 22 bp, Homo sapiens
gaccttgggcacagcacagctt

SEQ ID NO: 7140612 - DNA, 22 bp, Homo sapiens
gaccttgtgatccacccgcctt

SEQ ID NO: 7140613 - DNA, 22 bp, Homo sapiens
gaccttgtgatccacccgcctt

SEQ ID NO: 7140614 - DNA, 22 bp, Homo sapiens
gaccttcttgctgtgtcctaac

SEQ ID NO: 7140615 - DNA, 22 bp, Homo sapiens
gaccttggttgagcttcctaat

SEQ ID NO: 7140616 - DNA, 22 bp, Homo sapiens
gaccttgtaaattttcactcca

SEQ ID NO: 7140617 - DNA, 22 bp, Homo sapiens
gacatacagccctctccctggt

SEQ ID NO: 7140618 - DNA, 22 bp, Homo sapiens
gacagtctgggcacacatgaaa

SEQ ID NO: 7140619 - DNA, 22 bp, Homo sapiens
gacagtctggcctaaagggtta

SEQ ID NO: 7140620 - DNA, 22 bp, Homo sapiens
gacagtctgggcacacatgaaa

SEQ ID NO: 7140621 - DNA, 22 bp, Homo sapiens
gacagtgagtacctcaaaggcc

SEQ ID NO: 7140622 - DNA, 22 bp, Homo sapiens
gacagtgattagttactataaa

SEQ ID NO: 7140623 - DNA, 18 bp, Homo sapiens
gacagctgtcctgagccc

SEQ ID NO: 7140624 - DNA, 22 bp, Homo sapiens
gacagctgtacactcctggtta

SEQ ID NO: 7140625 - DNA, 18 bp, Homo sapiens
gacagctgtcctgagccc

SEQ ID NO: 7140626 - DNA, 22 bp, Homo sapiens
gacagctgtacactcctggtta

SEQ ID NO: 7140627 - DNA, 22 bp, Homo sapiens
gacagctgtacactcctggtta

SEQ ID NO: 7140628 - DNA, 17 bp, Homo sapiens
gacagctggttcctggc

SEQ ID NO: 7140629 - DNA, 17 bp, Homo sapiens
gacagctggttcctggc

SEQ ID NO: 7140630 - DNA, 17 bp, Homo sapiens
gacagctggttcctggc

SEQ ID NO: 7140631 - DNA, 17 bp, Homo sapiens
gacagctgggcgcacgc

SEQ ID NO: 7140632 - DNA, 17 bp, Homo sapiens
gacagctgggcgcacgc

SEQ ID NO: 7140633 - DNA, 17 bp, Homo sapiens
gacagctgggcgcacgc

SEQ ID NO: 7140634 - DNA, 22 bp, Homo sapiens
gacagctggcagtggaaaggtg

SEQ ID NO: 7140635 - DNA, 17 bp, Homo sapiens
gacagctgggcgcacgc

SEQ ID NO: 7140636 - DNA, 22 bp, Homo sapiens
gacatacatctctggaaaaaaa

SEQ ID NO: 7140637 - DNA, 22 bp, Homo sapiens
gacatacatctctggaaaaaaa

SEQ ID NO: 7140638 - DNA, 22 bp, Homo sapiens
gacatagacaaagtcattgtca

SEQ ID NO: 7140639 - DNA, 22 bp, Homo sapiens
gacatagactgagtttagctga

SEQ ID NO: 7140640 - DNA, 22 bp, Homo sapiens
gacatatactatggatggttct

SEQ ID NO: 7140641 - DNA, 22 bp, Homo sapiens
gacatatactatggatggttct

SEQ ID NO: 7140642 - DNA, 18 bp, Homo sapiens
gacatagctcagagctca

SEQ ID NO: 7140643 - DNA, 22 bp, Homo sapiens
gacatatgtgtacatggagatt

SEQ ID NO: 7140644 - DNA, 22 bp, Homo sapiens
gacatatgtgtacatggagatt

SEQ ID NO: 7140645 - DNA, 22 bp, Homo sapiens
gacatatttgaaaccaagagaa

SEQ ID NO: 7140646 - DNA, 22 bp, Homo sapiens
gacatcaattcagcattttaag

SEQ ID NO: 7140647 - DNA, 22 bp, Homo sapiens
gacatcaggaagacatgagagg

SEQ ID NO: 7140648 - DNA, 22 bp, Homo sapiens
gacatcaggcctgcagtctggg

SEQ ID NO: 7140649 - DNA, 17 bp, Homo sapiens
gacatcagtacttacag

SEQ ID NO: 7140650 - DNA, 22 bp, Homo sapiens
gacatcatagggtgggaggaaa

SEQ ID NO: 7140651 - DNA, 22 bp, Homo sapiens
gacatcatagggtgggaggaaa

SEQ ID NO: 7140652 - DNA, 22 bp, Homo sapiens
gacatcatggagaggataaata

SEQ ID NO: 7140653 - DNA, 20 bp, Homo sapiens
gacatcatgtacacattgcc

SEQ ID NO: 7140654 - DNA, 22 bp, Homo sapiens
gacatctccaaggcaacctgtt

SEQ ID NO: 7140655 - DNA, 22 bp, Homo sapiens
gacatctgaatattagagagaa

SEQ ID NO: 7140656 - DNA, 22 bp, Homo sapiens
gacatctgaatattagagagaa

SEQ ID NO: 7140657 - DNA, 22 bp, Homo sapiens
gacatctgaggccctcagagcc

SEQ ID NO: 7140658 - DNA, 22 bp, Homo sapiens
gacatctgaatttagcagtttt

SEQ ID NO: 7140659 - DNA, 22 bp, Homo sapiens
gacatctgaggccctcagagcc

SEQ ID NO: 7140660 - DNA, 22 bp, Homo sapiens
gacatctggaggagatgaatgg

SEQ ID NO: 7140661 - DNA, 22 bp, Homo sapiens
gacatctggaggagatgaatgg

SEQ ID NO: 7140662 - DNA, 22 bp, Homo sapiens
gacatctggaggagatgaatgg

SEQ ID NO: 7140663 - DNA, 22 bp, Homo sapiens
gacagctggcagtggaaaggtg

SEQ ID NO: 7140664 - DNA, 22 bp, Homo sapiens
gacagctggcagtggaaaggtg

SEQ ID NO: 7140665 - DNA, 22 bp, Homo sapiens
gacagctggcagtggaaaggtg

SEQ ID NO: 7140666 - DNA, 22 bp, Homo sapiens
gacagctgctcccgtttctgct

SEQ ID NO: 7140667 - DNA, 22 bp, Homo sapiens
gacagctggacagacactgatg

SEQ ID NO: 7140668 - DNA, 22 bp, Homo sapiens
gacagctgcatcctcagacaca

SEQ ID NO: 7140669 - DNA, 22 bp, Homo sapiens
gacagctgcatcctcagacaca

SEQ ID NO: 7140670 - DNA, 22 bp, Homo sapiens
gacagctgctcccgtttctgct

SEQ ID NO: 7140671 - DNA, 22 bp, Homo sapiens
gacagccatcagcacacgctgc

SEQ ID NO: 7140672 - DNA, 22 bp, Homo sapiens
gacagccatgcacttctgctgt

SEQ ID NO: 7140673 - DNA, 22 bp, Homo sapiens
gacagccatgcacttctgctgt

SEQ ID NO: 7140674 - DNA, 22 bp, Homo sapiens
gacagcctcatgaggagcaaaa

SEQ ID NO: 7140675 - DNA, 22 bp, Homo sapiens
gacagcctcatgaggagcaaaa

SEQ ID NO: 7140676 - DNA, 22 bp, Homo sapiens
gacagcctcatgaggagcaaaa

SEQ ID NO: 7140677 - DNA, 22 bp, Homo sapiens
gacagctccagctcctccaggc

SEQ ID NO: 7140678 - DNA, 22 bp, Homo sapiens
gacagctcctttctgaggatga

SEQ ID NO: 7140679 - DNA, 22 bp, Homo sapiens
gacagctccttttggtgcatat

SEQ ID NO: 7140680 - DNA, 22 bp, Homo sapiens
gacagctgaaaaatgtaaggta

SEQ ID NO: 7140681 - DNA, 22 bp, Homo sapiens
gacagctgaaaaatgtaaggta

SEQ ID NO: 7140682 - DNA, 22 bp, Homo sapiens
gacagcagtcctggagttccca

SEQ ID NO: 7140683 - DNA, 22 bp, Homo sapiens
gacagcagtttttctctagggt

SEQ ID NO: 7140684 - DNA, 22 bp, Homo sapiens
gacagcaggtgcttgggaaagg

SEQ ID NO: 7140685 - DNA, 22 bp, Homo sapiens
gacagcaggtgcttgggaaagg

SEQ ID NO: 7140686 - DNA, 22 bp, Homo sapiens
gacagcaggtgcttgggaaagg

SEQ ID NO: 7140687 - DNA, 22 bp, Homo sapiens
gacagcaggtaattagttaaca

SEQ ID NO: 7140688 - DNA, 22 bp, Homo sapiens
gacagcaggtgcttgggaaagg

SEQ ID NO: 7140689 - DNA, 22 bp, Homo sapiens
gacagcaggtgcttgggaaagg

SEQ ID NO: 7140690 - DNA, 22 bp, Homo sapiens
gacagcagggacatgtaggaag

SEQ ID NO: 7140691 - DNA, 22 bp, Homo sapiens
gacagcagggacatgtaggaag

SEQ ID NO: 7140692 - DNA, 22 bp, Homo sapiens
gacagcagtttttctctagggt

SEQ ID NO: 7140693 - DNA, 22 bp, Homo sapiens
gacagcagtttttctctagggt

SEQ ID NO: 7140694 - DNA, 22 bp, Homo sapiens
gacagcagtttttctctagggt

SEQ ID NO: 7140695 - DNA, 22 bp, Homo sapiens
gacagcatccaagagggaggga

SEQ ID NO: 7140696 - DNA, 22 bp, Homo sapiens
gacagcatctgtgtggcaggag

SEQ ID NO: 7140697 - DNA, 22 bp, Homo sapiens
gacagcatggtgtctgttcagg

SEQ ID NO: 7140698 - DNA, 22 bp, Homo sapiens
gacagcattccatctgcaggtt

SEQ ID NO: 7140699 - DNA, 22 bp, Homo sapiens
gacagccatcagcacacgctgc

SEQ ID NO: 7140700 - DNA, 22 bp, Homo sapiens
gaatggaaactgggagatggcc

SEQ ID NO: 7140701 - DNA, 22 bp, Homo sapiens
gaatggcatagctttctttaca

SEQ ID NO: 7140702 - DNA, 22 bp, Homo sapiens
gaatggaaactgggagatggcc

SEQ ID NO: 7140703 - DNA, 22 bp, Homo sapiens
gaatggaaactgggagatggcc

SEQ ID NO: 7140704 - DNA, 22 bp, Homo sapiens
gaatgctggcttacaggcagtt

SEQ ID NO: 7140705 - DNA, 22 bp, Homo sapiens
gaatgctggcttacaggcagtt

SEQ ID NO: 7140706 - DNA, 22 bp, Homo sapiens
gaatgcttggaacctgaagttc

SEQ ID NO: 7140707 - DNA, 22 bp, Homo sapiens
gaatggtaagagacaaaagtat

SEQ ID NO: 7140708 - DNA, 22 bp, Homo sapiens
gaatgtttgactaaaggtagct

SEQ ID NO: 7140709 - DNA, 19 bp, Homo sapiens
gaatgtttgtattcagcgc

SEQ ID NO: 7140710 - DNA, 19 bp, Homo sapiens
gaatgtttgtattcagcgc

SEQ ID NO: 7140711 - DNA, 22 bp, Homo sapiens
gaatgtttgtgcagagtcatct

SEQ ID NO: 7140712 - DNA, 22 bp, Homo sapiens
gaatggctatcggattattagg

SEQ ID NO: 7140713 - DNA, 22 bp, Homo sapiens
gaatggctgaatgtcttaaatt

SEQ ID NO: 7140714 - DNA, 19 bp, Homo sapiens
gaatgggaatgggaaagct

SEQ ID NO: 7140715 - DNA, 19 bp, Homo sapiens
gaatgggttctgtagggag

SEQ ID NO: 7140716 - DNA, 22 bp, Homo sapiens
gaattacagccagaagaatgaa

SEQ ID NO: 7140717 - DNA, 22 bp, Homo sapiens
gaattacaaagtgagacaagct

SEQ ID NO: 7140718 - DNA, 22 bp, Homo sapiens
gaattacaaagtgagacaagct

SEQ ID NO: 7140719 - DNA, 22 bp, Homo sapiens
gaattacataataaaatgagag

SEQ ID NO: 7140720 - DNA, 22 bp, Homo sapiens
gaatttaaggaccaagcatttt

SEQ ID NO: 7140721 - DNA, 22 bp, Homo sapiens
gaatgtttgtgcagagtcatct

SEQ ID NO: 7140722 - DNA, 22 bp, Homo sapiens
gaatgtttgtgcagagtcatct

SEQ ID NO: 7140723 - DNA, 22 bp, Homo sapiens
gaatgtttttaggaatgttatg

SEQ ID NO: 7140724 - DNA, 22 bp, Homo sapiens
gaatgtttttaggaatgttatg

SEQ ID NO: 7140725 - DNA, 22 bp, Homo sapiens
gaatgtttttataagtgttaca

SEQ ID NO: 7140726 - DNA, 22 bp, Homo sapiens
gaatgtttttataagtgttaca

SEQ ID NO: 7140727 - DNA, 22 bp, Homo sapiens
gaatgtttttcaaacctgtggc

SEQ ID NO: 7140728 - DNA, 22 bp, Homo sapiens
gaatgtttttcaaacctgtggc

SEQ ID NO: 7140729 - DNA, 22 bp, Homo sapiens
gaatgtttttcattggtgactc

SEQ ID NO: 7140730 - DNA, 22 bp, Homo sapiens
gaatgtttttcattggtgactc

SEQ ID NO: 7140731 - DNA, 22 bp, Homo sapiens
gaattaaaatagttttggtcga

SEQ ID NO: 7140732 - DNA, 22 bp, Homo sapiens
gaattaaaatagttttggtcga

SEQ ID NO: 7140733 - DNA, 22 bp, Homo sapiens
gaattacaaagtgagacaagct

SEQ ID NO: 7140734 - DNA, 22 bp, Homo sapiens
gaatgctaagcatgtgggagtt

SEQ ID NO: 7140735 - DNA, 22 bp, Homo sapiens
gaatgcattctcttagcatcta

SEQ ID NO: 7140736 - DNA, 22 bp, Homo sapiens
gaatgctaagcatgtgggagtt

SEQ ID NO: 7140737 - DNA, 22 bp, Homo sapiens
gaatgctaagcatgtgggagtt

SEQ ID NO: 7140738 - DNA, 22 bp, Homo sapiens
gaatgcattccacggtagtgat

SEQ ID NO: 7140739 - DNA, 22 bp, Homo sapiens
gaatgcatgtgaagcaaagaat

SEQ ID NO: 7140740 - DNA, 22 bp, Homo sapiens
gaatgcatgtgaagcaaagaat

SEQ ID NO: 7140741 - DNA, 22 bp, Homo sapiens
gaatgcagtgacggaggcttac

SEQ ID NO: 7140742 - DNA, 22 bp, Homo sapiens
gaatgcagtggtgagatcttgg

SEQ ID NO: 7140743 - DNA, 22 bp, Homo sapiens
gaatgcagatggctggtgtatg

SEQ ID NO: 7140744 - DNA, 19 bp, Homo sapiens
gaatgcagaagagagtgga

SEQ ID NO: 7140745 - DNA, 19 bp, Homo sapiens
gaatgcagaagagagtgga

SEQ ID NO: 7140746 - DNA, 22 bp, Homo sapiens
gaatgcagatggctggtgtatg

SEQ ID NO: 7140747 - DNA, 22 bp, Homo sapiens
gaatgcagctgacagtcgtttt

SEQ ID NO: 7140748 - DNA, 22 bp, Homo sapiens
gaatgcagatggctggtgtatg

SEQ ID NO: 7140749 - DNA, 22 bp, Homo sapiens
gaatgcagtgacggaggcttac

SEQ ID NO: 7140750 - DNA, 22 bp, Homo sapiens
gaatgcaaagctctctatgtta

SEQ ID NO: 7140751 - DNA, 22 bp, Homo sapiens
gaatgcaagttgcatgaaggca

SEQ ID NO: 7140752 - DNA, 22 bp, Homo sapiens
gaatgcaagttgcatgaaggca

SEQ ID NO: 7140753 - DNA, 21 bp, Homo sapiens
gaagacaaatgggaatagctg

SEQ ID NO: 7140754 - DNA, 21 bp, Homo sapiens
gaagacaaatgggaatagctg

SEQ ID NO: 7140755 - DNA, 21 bp, Homo sapiens
gaagacaaatgggaatagctg

SEQ ID NO: 7140756 - DNA, 22 bp, Homo sapiens
gaagaatctgaggacagtcatt

SEQ ID NO: 7140757 - DNA, 22 bp, Homo sapiens
gaagaattgaggatgtttacct

SEQ ID NO: 7140758 - DNA, 22 bp, Homo sapiens
gaagaattgcccatttctgtct

SEQ ID NO: 7140759 - DNA, 22 bp, Homo sapiens
gaagaattgcccatttctgtct

SEQ ID NO: 7140760 - DNA, 22 bp, Homo sapiens
gaagaattgcccatttctgtct

SEQ ID NO: 7140761 - DNA, 22 bp, Homo sapiens
gaagaatattcttgatcttaga

SEQ ID NO: 7140762 - DNA, 22 bp, Homo sapiens
gaagaatatataatgattttgt

SEQ ID NO: 7140763 - DNA, 22 bp, Homo sapiens
gaagaatatataatgattttgt

SEQ ID NO: 7140764 - DNA, 22 bp, Homo sapiens
gaagaatatggctctcagcaat

SEQ ID NO: 7140765 - DNA, 22 bp, Homo sapiens
gaagaatatggctctcagcaat

SEQ ID NO: 7140766 - DNA, 22 bp, Homo sapiens
gaagaatattcttgatcttaga

SEQ ID NO: 7140767 - DNA, 22 bp, Homo sapiens
gaagaatattcttgatcttaga

SEQ ID NO: 7140768 - DNA, 22 bp, Homo sapiens
gaagaagtgtaagtctgtttca

SEQ ID NO: 7140769 - DNA, 22 bp, Homo sapiens
gaagaaggtggcccaggggtag

SEQ ID NO: 7140770 - DNA, 22 bp, Homo sapiens
gaagaaggtggcccaggggtag

SEQ ID NO: 7140771 - DNA, 22 bp, Homo sapiens
gaagaaggtggcccaggggtag

SEQ ID NO: 7140772 - DNA, 22 bp, Homo sapiens
gaagaaggtgctacacagggca

SEQ ID NO: 7140773 - DNA, 22 bp, Homo sapiens
gaagaaggtgctacacagggca

SEQ ID NO: 7140774 - DNA, 22 bp, Homo sapiens
gaagaaggtgctacacagggca

SEQ ID NO: 7140775 - DNA, 22 bp, Homo sapiens
gaagaaggtgccagaggcttac

SEQ ID NO: 7140776 - DNA, 22 bp, Homo sapiens
gaagaaggtgccagaggcttac

SEQ ID NO: 7140777 - DNA, 22 bp, Homo sapiens
gaagaagggtaaggagtgttga

SEQ ID NO: 7140778 - DNA, 22 bp, Homo sapiens
gacagcagccacagggagaggg

SEQ ID NO: 7140779 - DNA, 22 bp, Homo sapiens
gacagcagccacagggagaggg

SEQ ID NO: 7140780 - DNA, 22 bp, Homo sapiens
gacagcagccacagggagaggg

SEQ ID NO: 7140781 - DNA, 20 bp, Homo sapiens
gacaacagagtaccaggaag

SEQ ID NO: 7140782 - DNA, 22 bp, Homo sapiens
gacaacagcatatggactgtca

SEQ ID NO: 7140783 - DNA, 20 bp, Homo sapiens
gacaacagagtaccaggaag

SEQ ID NO: 7140784 - DNA, 20 bp, Homo sapiens
gacaacagagtaccaggaag

SEQ ID NO: 7140785 - DNA, 22 bp, Homo sapiens
gacagcagccacagggagaggg

SEQ ID NO: 7140786 - DNA, 18 bp, Homo sapiens
gacagcagcttttgttct

SEQ ID NO: 7140787 - DNA, 22 bp, Homo sapiens
gacagcaggagatcatgataga

SEQ ID NO: 7140788 - DNA, 22 bp, Homo sapiens
gacagcagggacatgtaggaag

SEQ ID NO: 7140789 - DNA, 22 bp, Homo sapiens
gacagcagggaaagtccagacc

SEQ ID NO: 7140790 - DNA, 22 bp, Homo sapiens
gacagcaggatgtgaggggatg

SEQ ID NO: 7140791 - DNA, 22 bp, Homo sapiens
gacagcaggatgtgaggggatg

SEQ ID NO: 7140792 - DNA, 22 bp, Homo sapiens
gacagcaggagatcatgataga

SEQ ID NO: 7140793 - DNA, 22 bp, Homo sapiens
gacagcaggagatcatgataga

SEQ ID NO: 7140794 - DNA, 22 bp, Homo sapiens
gacagcaggagatcatgataga

SEQ ID NO: 7140795 - DNA, 22 bp, Homo sapiens
gacagcaggatgtgaggggatg

SEQ ID NO: 7140796 - DNA, 22 bp, Homo sapiens
gacagcaggatgtgaggggatg

SEQ ID NO: 7140797 - DNA, 22 bp, Homo sapiens
gacaaagctttggcatccttac

SEQ ID NO: 7140798 - DNA, 21 bp, Homo sapiens
gacaaagtgaagcaggcagga

SEQ ID NO: 7140799 - DNA, 22 bp, Homo sapiens
gacaaataggtcaacaggaggg

SEQ ID NO: 7140800 - DNA, 22 bp, Homo sapiens
gacaaatgaagtcactgacctt

SEQ ID NO: 7140801 - DNA, 22 bp, Homo sapiens
gacaaatgaagtcactgacctt

SEQ ID NO: 7140802 - DNA, 22 bp, Homo sapiens
gacaaatgaagtcactgacctt

SEQ ID NO: 7140803 - DNA, 22 bp, Homo sapiens
gacaaatgaagtcactgacctt

SEQ ID NO: 7140804 - DNA, 22 bp, Homo sapiens
gacaaatgaatgatgaacacca

SEQ ID NO: 7140805 - DNA, 22 bp, Homo sapiens
gacaaatgaatgatgaacacca

SEQ ID NO: 7140806 - DNA, 22 bp, Homo sapiens
gacaaatgaatgatgaacacca

SEQ ID NO: 7140807 - DNA, 22 bp, Homo sapiens
gacaaatgagacatcaattccc

SEQ ID NO: 7140808 - DNA, 22 bp, Homo sapiens
gacaaatgagtctcatacccgg

SEQ ID NO: 7140809 - DNA, 22 bp, Homo sapiens
gacaaatgagtctcatacccgg

SEQ ID NO: 7140810 - DNA, 22 bp, Homo sapiens
gacaaatgagtctcatacccgg

SEQ ID NO: 7140811 - DNA, 18 bp, Homo sapiens
gacaaatgcaatttaaag

SEQ ID NO: 7140812 - DNA, 22 bp, Homo sapiens
gacaaatgtacccctagagtct

SEQ ID NO: 7140813 - DNA, 22 bp, Homo sapiens
gacaaatgtacccctagagtct

SEQ ID NO: 7140814 - DNA, 22 bp, Homo sapiens
gacaaatgtacccctagagtct

SEQ ID NO: 7140815 - DNA, 22 bp, Homo sapiens
gacaaatgtacccctagagtct

SEQ ID NO: 7140816 - DNA, 22 bp, Homo sapiens
gacaacaataatgtggagctga

SEQ ID NO: 7140817 - DNA, 22 bp, Homo sapiens
gacaacaataatgtggagctga

SEQ ID NO: 7140818 - DNA, 18 bp, Homo sapiens
gacaaaagtacagacaga

SEQ ID NO: 7140819 - DNA, 18 bp, Homo sapiens
gacaaaagtacagacaga

SEQ ID NO: 7140820 - DNA, 22 bp, Homo sapiens
gacaaaagtgttttgaacaagg

SEQ ID NO: 7140821 - DNA, 22 bp, Homo sapiens
gacaaaactgagatcacactgt

SEQ ID NO: 7140822 - DNA, 22 bp, Homo sapiens
gacaaaactgagatcacactgt

SEQ ID NO: 7140823 - DNA, 22 bp, Homo sapiens
gacaaaactgagatcacactgt

SEQ ID NO: 7140824 - DNA, 18 bp, Homo sapiens
gacaaaagtacagacaga

SEQ ID NO: 7140825 - DNA, 22 bp, Homo sapiens
gacaaaacacattagtttaaaa

SEQ ID NO: 7140826 - DNA, 22 bp, Homo sapiens
gacaaaactgagatcacactgt

SEQ ID NO: 7140827 - DNA, 22 bp, Homo sapiens
gacaaaagtgttttgaacaagg

SEQ ID NO: 7140828 - DNA, 22 bp, Homo sapiens
gacaaaagtgttttgaacaagg

SEQ ID NO: 7140829 - DNA, 21 bp, Homo sapiens
gacaaacatttcatagcttta

SEQ ID NO: 7140830 - DNA, 21 bp, Homo sapiens
gacaaacatttcatagcttta

SEQ ID NO: 7140831 - DNA, 21 bp, Homo sapiens
gacaaacatttcatagcttta

SEQ ID NO: 7140832 - DNA, 21 bp, Homo sapiens
gacaaacatttcatagcttta

SEQ ID NO: 7140833 - DNA, 21 bp, Homo sapiens
gacaaacatttcatagcttta

SEQ ID NO: 7140834 - DNA, 21 bp, Homo sapiens
gacaaacatttcatagcttta

SEQ ID NO: 7140835 - DNA, 22 bp, Homo sapiens
gacaaagagaagtaacagtacc

SEQ ID NO: 7140836 - DNA, 22 bp, Homo sapiens
gacaaagagaagtaacagtacc

SEQ ID NO: 7140837 - DNA, 22 bp, Homo sapiens
gacaaaacacattagtttaaaa

SEQ ID NO: 7140838 - DNA, 22 bp, Homo sapiens
gacaaaacacattagtttaaaa

SEQ ID NO: 7140839 - DNA, 22 bp, Homo sapiens
gacaaaacacattagtttaaaa

SEQ ID NO: 7140840 - DNA, 22 bp, Homo sapiens
gacaaaacacattagtttaaaa

SEQ ID NO: 7140841 - DNA, 22 bp, Homo sapiens
gaattttgcttttatgtcaagt

SEQ ID NO: 7140842 - DNA, 22 bp, Homo sapiens
gaatttatctacgttaagtatg

SEQ ID NO: 7140843 - DNA, 22 bp, Homo sapiens
gaattttattactagtcaactg

SEQ ID NO: 7140844 - DNA, 22 bp, Homo sapiens
gagaagcaatcgtgacatctcc

SEQ ID NO: 7140845 - DNA, 22 bp, Homo sapiens
gagaagcaatcgtgacatctcc

SEQ ID NO: 7140846 - DNA, 22 bp, Homo sapiens
gagaagcaatcgtgacatctcc

SEQ ID NO: 7140847 - DNA, 22 bp, Homo sapiens
gagaagcaatcgtgacatctcc

SEQ ID NO: 7140848 - DNA, 22 bp, Homo sapiens
gagaagcaatcgtgacatctcc

SEQ ID NO: 7140849 - DNA, 22 bp, Homo sapiens
gagaagcaatcagtggccaccc

SEQ ID NO: 7140850 - DNA, 22 bp, Homo sapiens
gagaagcaatcagtggccaccc

SEQ ID NO: 7140851 - DNA, 22 bp, Homo sapiens
gagaagcaatcagcagccaccc

SEQ ID NO: 7140852 - DNA, 22 bp, Homo sapiens
gagaagcaatcagcagccaccc

SEQ ID NO: 7140853 - DNA, 22 bp, Homo sapiens
gagaagcaatcagtggccaccc

SEQ ID NO: 7140854 - DNA, 22 bp, Homo sapiens
gagaagcaggtttagcagacaa

SEQ ID NO: 7140855 - DNA, 22 bp, Homo sapiens
gagaagcaggtttagcagacaa

SEQ ID NO: 7140856 - DNA, 22 bp, Homo sapiens
gagaagcaggtttagcagacaa

SEQ ID NO: 7140857 - DNA, 22 bp, Homo sapiens
gagaagcaggtttagcagacaa

SEQ ID NO: 7140858 - DNA, 22 bp, Homo sapiens
gagaagcaatttccaactgtgc

SEQ ID NO: 7140859 - DNA, 22 bp, Homo sapiens
gagaagcaatttccaactgtgc

SEQ ID NO: 7140860 - DNA, 22 bp, Homo sapiens
gagaagcaatttccaactgtgc

SEQ ID NO: 7140861 - DNA, 22 bp, Homo sapiens
gagaaggactacacatctggcc

SEQ ID NO: 7140862 - DNA, 22 bp, Homo sapiens
gagaaggaagttgagccagcat

SEQ ID NO: 7140863 - DNA, 22 bp, Homo sapiens
gagaaggaagttgagccagcat

SEQ ID NO: 7140864 - DNA, 22 bp, Homo sapiens
gagaaggaagttgagccagcat

SEQ ID NO: 7140865 - DNA, 22 bp, Homo sapiens
gagaaggaagttgagccagcat

SEQ ID NO: 7140866 - DNA, 22 bp, Homo sapiens
gagaagctctagaggtgttttt

SEQ ID NO: 7140867 - DNA, 22 bp, Homo sapiens
gagaagctggactttccaaact

SEQ ID NO: 7140868 - DNA, 22 bp, Homo sapiens
gagagaagaaagccatggtcct

SEQ ID NO: 7140869 - DNA, 22 bp, Homo sapiens
gagagaagaacaatgtcattca

SEQ ID NO: 7140870 - DNA, 22 bp, Homo sapiens
gagagaagaatgttccgaggcc

SEQ ID NO: 7140871 - DNA, 22 bp, Homo sapiens
gagagaagaatgttccgaggcc

SEQ ID NO: 7140872 - DNA, 22 bp, Homo sapiens
gagagaagaatgttccgaggcc

SEQ ID NO: 7140873 - DNA, 22 bp, Homo sapiens
gagagaagggacttctacactt

SEQ ID NO: 7140874 - DNA, 22 bp, Homo sapiens
gagagaagggggatatgagcct

SEQ ID NO: 7140875 - DNA, 22 bp, Homo sapiens
gagagaagggggatatgagcct

SEQ ID NO: 7140876 - DNA, 16 bp, Homo sapiens
gagaagagcccggcag

SEQ ID NO: 7140877 - DNA, 22 bp, Homo sapiens
gagaagaacttgggcaaagtca

SEQ ID NO: 7140878 - DNA, 22 bp, Homo sapiens
gagaagaaatagaatcacattt

SEQ ID NO: 7140879 - DNA, 22 bp, Homo sapiens
gagaagaaatagaatcacattt

SEQ ID NO: 7140880 - DNA, 22 bp, Homo sapiens
gagaagaaaattccgtgaacac

SEQ ID NO: 7140881 - DNA, 22 bp, Homo sapiens
gagaagaaatagaatcacattt

SEQ ID NO: 7140882 - DNA, 22 bp, Homo sapiens
gagaagaacttgggcaaagtca

SEQ ID NO: 7140883 - DNA, 22 bp, Homo sapiens
gagaagaacttgggcaaagtca

SEQ ID NO: 7140884 - DNA, 22 bp, Homo sapiens
gagaagaacttgggcaaagtca

SEQ ID NO: 7140885 - DNA, 22 bp, Homo sapiens
gagaactcagacgcaggtcatg

SEQ ID NO: 7140886 - DNA, 22 bp, Homo sapiens
gagaactttctgtgtttttatc

SEQ ID NO: 7140887 - DNA, 22 bp, Homo sapiens
gagaactaatcatgcatggagt

SEQ ID NO: 7140888 - DNA, 22 bp, Homo sapiens
gagaactcagacgcaggtcatg

SEQ ID NO: 7140889 - DNA, 22 bp, Homo sapiens
gagaacagtgtcatcctataat

SEQ ID NO: 7140890 - DNA, 22 bp, Homo sapiens
gagaacagtgttgtattttttc

SEQ ID NO: 7140891 - DNA, 22 bp, Homo sapiens
gagaacagtgttgtattttttc

SEQ ID NO: 7140892 - DNA, 22 bp, Homo sapiens
gagaacagtgtcatcctataat

SEQ ID NO: 7140893 - DNA, 22 bp, Homo sapiens
gagaaagggataatttgaagag

SEQ ID NO: 7140894 - DNA, 22 bp, Homo sapiens
gagaacaggctctggagtcaga

SEQ ID NO: 7140895 - DNA, 22 bp, Homo sapiens
gagaacaggctctggagtcaga

SEQ ID NO: 7140896 - DNA, 22 bp, Homo sapiens
gagaaagggaacttacagagtg

SEQ ID NO: 7140897 - DNA, 22 bp, Homo sapiens
gagaaagggaacttacagagtg

SEQ ID NO: 7140898 - DNA, 22 bp, Homo sapiens
gagaaagggaacttacagagtg

SEQ ID NO: 7140899 - DNA, 22 bp, Homo sapiens
gagaaagggaacttacagagtg

SEQ ID NO: 7140900 - DNA, 22 bp, Homo sapiens
gagaaagggaacttacagagtg

SEQ ID NO: 7140901 - DNA, 22 bp, Homo sapiens
gagaaagggaacttacagagtg

SEQ ID NO: 7140902 - DNA, 22 bp, Homo sapiens
gactcagtgatttgacatgcct

SEQ ID NO: 7140903 - DNA, 19 bp, Homo sapiens
gactccaactttaagcatg

SEQ ID NO: 7140904 - DNA, 19 bp, Homo sapiens
gactcacaccttccgctgt

SEQ ID NO: 7140905 - DNA, 19 bp, Homo sapiens
gactcacaccttccgctgt

SEQ ID NO: 7140906 - DNA, 22 bp, Homo sapiens
gactatttttatctaactgggt

SEQ ID NO: 7140907 - DNA, 22 bp, Homo sapiens
gactatttttatctaactgggt

SEQ ID NO: 7140908 - DNA, 22 bp, Homo sapiens
gagaggagtaggctgatggtgc

SEQ ID NO: 7140909 - DNA, 22 bp, Homo sapiens
gagaggagtagacactttggtt

SEQ ID NO: 7140910 - DNA, 22 bp, Homo sapiens
gagaggagtagacactttggtt

SEQ ID NO: 7140911 - DNA, 22 bp, Homo sapiens
gagaggagtaggctgatggtgc

SEQ ID NO: 7140912 - DNA, 22 bp, Homo sapiens
gagaggagtaggctgatggtgc

SEQ ID NO: 7140913 - DNA, 22 bp, Homo sapiens
gagaggagtccctatcacagtt

SEQ ID NO: 7140914 - DNA, 22 bp, Homo sapiens
gagaggagtccctatcacagtt

SEQ ID NO: 7140915 - DNA, 22 bp, Homo sapiens
gagaggagtccctatcacagtt

SEQ ID NO: 7140916 - DNA, 22 bp, Homo sapiens
gagaggagtccctatcacagtt

SEQ ID NO: 7140917 - DNA, 22 bp, Homo sapiens
gagaggagtccctatcacagtt

SEQ ID NO: 7140918 - DNA, 22 bp, Homo sapiens
gagaggaggtggctatgacagc

SEQ ID NO: 7140919 - DNA, 18 bp, Homo sapiens
gagaggagccagaatttt

SEQ ID NO: 7140920 - DNA, 18 bp, Homo sapiens
gagaggagccagaatttt

SEQ ID NO: 7140921 - DNA, 18 bp, Homo sapiens
gagaggagccagaatttt

SEQ ID NO: 7140922 - DNA, 22 bp, Homo sapiens
gagaggagtagacactttggtt

SEQ ID NO: 7140923 - DNA, 22 bp, Homo sapiens
gagaggaggtggctatgacagc

SEQ ID NO: 7140924 - DNA, 22 bp, Homo sapiens
gagaggaggtggctatgacagc

SEQ ID NO: 7140925 - DNA, 22 bp, Homo sapiens
gagagctgtccggctgagcagc

SEQ ID NO: 7140926 - DNA, 17 bp, Homo sapiens
gagagccctcagatgtc

SEQ ID NO: 7140927 - DNA, 22 bp, Homo sapiens
gagagccctgcatggctgatga

SEQ ID NO: 7140928 - DNA, 22 bp, Homo sapiens
gagagccctgcatggctgatga

SEQ ID NO: 7140929 - DNA, 22 bp, Homo sapiens
gagagccctgctcctatcccag

SEQ ID NO: 7140930 - DNA, 22 bp, Homo sapiens
gagagctgtcagcgtagcaccg

SEQ ID NO: 7140931 - DNA, 22 bp, Homo sapiens
gagaggagacttatccagattg

SEQ ID NO: 7140932 - DNA, 22 bp, Homo sapiens
gagaggagacttatccagattg

SEQ ID NO: 7140933 - DNA, 18 bp, Homo sapiens
gagaggagccagaatttt

SEQ ID NO: 7140934 - DNA, 18 bp, Homo sapiens
gagaggagccagaatttt

SEQ ID NO: 7140935 - DNA, 22 bp, Homo sapiens
gagaggagacttatccagattg

SEQ ID NO: 7140936 - DNA, 22 bp, Homo sapiens
gagaggagacttatccagattg

SEQ ID NO: 7140937 - DNA, 22 bp, Homo sapiens
gagaggagacttatccagattg

SEQ ID NO: 7140938 - DNA, 22 bp, Homo sapiens
gagaggagaagcctgcgcttca

SEQ ID NO: 7140939 - DNA, 22 bp, Homo sapiens
gagaggagaagcctgcgcttca

SEQ ID NO: 7140940 - DNA, 22 bp, Homo sapiens
gagaggagaagcctgcgcttca

SEQ ID NO: 7140941 - DNA, 22 bp, Homo sapiens
gagagacagcacacagtgtggg

SEQ ID NO: 7140942 - DNA, 22 bp, Homo sapiens
gagagacagcacacagtgtggg

SEQ ID NO: 7140943 - DNA, 22 bp, Homo sapiens
gagagacagcacacagtgtggg

SEQ ID NO: 7140944 - DNA, 22 bp, Homo sapiens
gagagacagcagaacgtgcagc

SEQ ID NO: 7140945 - DNA, 22 bp, Homo sapiens
gagagacagcagaacgtgcagc

SEQ ID NO: 7140946 - DNA, 22 bp, Homo sapiens
gagagacagcagaacgtgcagc

SEQ ID NO: 7140947 - DNA, 22 bp, Homo sapiens
gagagactgatgtggctatgta

SEQ ID NO: 7140948 - DNA, 22 bp, Homo sapiens
gagagacagcagaacgtgcagc

SEQ ID NO: 7140949 - DNA, 22 bp, Homo sapiens
gagagactgatgtggctatgta

SEQ ID NO: 7140950 - DNA, 22 bp, Homo sapiens
gagagactggaatgggctgtgg

SEQ ID NO: 7140951 - DNA, 22 bp, Homo sapiens
gagagactgggcagggccggca

SEQ ID NO: 7140952 - DNA, 22 bp, Homo sapiens
gagagagaaaatgactccggac

SEQ ID NO: 7140953 - DNA, 22 bp, Homo sapiens
gagagagaaccccgtgcccttc

SEQ ID NO: 7140954 - DNA, 22 bp, Homo sapiens
gagagagaaccccgtgcccttc

SEQ ID NO: 7140955 - DNA, 22 bp, Homo sapiens
gagagagaaccccgtgcccttc

SEQ ID NO: 7140956 - DNA, 22 bp, Homo sapiens
gagagagaaggcctgtgggtgt

SEQ ID NO: 7140957 - DNA, 22 bp, Homo sapiens
gagagagaaggcctgtgggtgt

SEQ ID NO: 7140958 - DNA, 22 bp, Homo sapiens
gagagagaaggcctgtgggtgt

SEQ ID NO: 7140959 - DNA, 22 bp, Homo sapiens
gagagagaaggcctgtgggtgt

SEQ ID NO: 7140960 - DNA, 22 bp, Homo sapiens
gagagagaaggcctgtgggtgt

SEQ ID NO: 7140961 - DNA, 22 bp, Homo sapiens
gagagcaggaggcagcgggacg

SEQ ID NO: 7140962 - DNA, 22 bp, Homo sapiens
gagagccatggtggagatgggg

SEQ ID NO: 7140963 - DNA, 22 bp, Homo sapiens
gagagccatggtggagatgggg

SEQ ID NO: 7140964 - DNA, 22 bp, Homo sapiens
gagagcaggaggcagcgggacg

SEQ ID NO: 7140965 - DNA, 22 bp, Homo sapiens
gagagcaggctctcgggggcca

SEQ ID NO: 7140966 - DNA, 22 bp, Homo sapiens
gagagcatactataatggaggt

SEQ ID NO: 7140967 - DNA, 22 bp, Homo sapiens
gagagcatgtggtctagtttta

SEQ ID NO: 7140968 - DNA, 22 bp, Homo sapiens
gagagccagcagtaaagacatt

SEQ ID NO: 7140969 - DNA, 22 bp, Homo sapiens
gagagccagcagtaaagacatt

SEQ ID NO: 7140970 - DNA, 22 bp, Homo sapiens
gagcaagatcctgtttttctat

SEQ ID NO: 7140971 - DNA, 22 bp, Homo sapiens
gagcaagattaaaaggctgggt

SEQ ID NO: 7140972 - DNA, 22 bp, Homo sapiens
gagcaagattaaaaggctgggt

SEQ ID NO: 7140973 - DNA, 22 bp, Homo sapiens
gagcaagattaaaaggctgggt

SEQ ID NO: 7140974 - DNA, 22 bp, Homo sapiens
gagcaagactacaggcagatga

SEQ ID NO: 7140975 - DNA, 22 bp, Homo sapiens
gagcaagactcactgcatcttg

SEQ ID NO: 7140976 - DNA, 22 bp, Homo sapiens
gagcaagactcactgcatcttg

SEQ ID NO: 7140977 - DNA, 22 bp, Homo sapiens
gagcaaggtagctctctggggc

SEQ ID NO: 7140978 - DNA, 22 bp, Homo sapiens
gagcaaggatgggtctatagta

SEQ ID NO: 7140979 - DNA, 22 bp, Homo sapiens
gagcaaggcggcatctctctga

SEQ ID NO: 7140980 - DNA, 22 bp, Homo sapiens
gagcaaggatgggtctatagta

SEQ ID NO: 7140981 - DNA, 22 bp, Homo sapiens
gagcacagatcctggagccaca

SEQ ID NO: 7140982 - DNA, 22 bp, Homo sapiens
gagcacagatcctggagccaca

SEQ ID NO: 7140983 - DNA, 22 bp, Homo sapiens
gagcacagatcctggagccaca

SEQ ID NO: 7140984 - DNA, 22 bp, Homo sapiens
gagcacagaactaaatgctggt

SEQ ID NO: 7140985 - DNA, 22 bp, Homo sapiens
gagcacagaaggagaaatatgg

SEQ ID NO: 7140986 - DNA, 22 bp, Homo sapiens
gagcacagaaggagaaatatgg

SEQ ID NO: 7140987 - DNA, 22 bp, Homo sapiens
gagcacagaatcttcccatgca

SEQ ID NO: 7140988 - DNA, 22 bp, Homo sapiens
gagcacagaatcttcccatgca

SEQ ID NO: 7140989 - DNA, 22 bp, Homo sapiens
gagcacagaatcttcccatgca

SEQ ID NO: 7140990 - DNA, 22 bp, Homo sapiens
gagcacagaatcttcccatgca

SEQ ID NO: 7140991 - DNA, 22 bp, Homo sapiens
gagcacagaatcttcccatgca

SEQ ID NO: 7140992 - DNA, 22 bp, Homo sapiens
gagcaatagaaagaatactgct

SEQ ID NO: 7140993 - DNA, 22 bp, Homo sapiens
gagcaatacatggcatgaaatt

SEQ ID NO: 7140994 - DNA, 22 bp, Homo sapiens
gagcaatagcaccaattaactc

SEQ ID NO: 7140995 - DNA, 22 bp, Homo sapiens
gagcaatgcccttcaccagccc

SEQ ID NO: 7140996 - DNA, 22 bp, Homo sapiens
gagcaatggaagatagataaca

SEQ ID NO: 7140997 - DNA, 22 bp, Homo sapiens
gagcacacagtgtgcctgtgta

SEQ ID NO: 7140998 - DNA, 22 bp, Homo sapiens
gagcacagaactaaatgctggt

SEQ ID NO: 7140999 - DNA, 22 bp, Homo sapiens
gagcacagaactaaatgctggt

SEQ ID NO: 7141000 - DNA, 22 bp, Homo sapiens
gagcaagaccctgggttctctc

SEQ ID NO: 7141001 - DNA, 22 bp, Homo sapiens
gagcaagactacaggcagatga

SEQ ID NO: 7141002 - DNA, 22 bp, Homo sapiens
gagcaacaggtgatggggctgt

SEQ ID NO: 7141003 - DNA, 22 bp, Homo sapiens
gagcaacagtggcagtggtggg

SEQ ID NO: 7141004 - DNA, 22 bp, Homo sapiens
gagcaacactccacattgctag

SEQ ID NO: 7141005 - DNA, 22 bp, Homo sapiens
gagcaacactccacattgctag

SEQ ID NO: 7141006 - DNA, 22 bp, Homo sapiens
gagcaacacattgaatgaggat

SEQ ID NO: 7141007 - DNA, 22 bp, Homo sapiens
gagcaacacattgaatgaggat

SEQ ID NO: 7141008 - DNA, 22 bp, Homo sapiens
gagcaacacgcagtagtatacg

SEQ ID NO: 7141009 - DNA, 22 bp, Homo sapiens
gagcaaaataaattctgacaaa

SEQ ID NO: 7141010 - DNA, 22 bp, Homo sapiens
gagcaaagcttttagggccttt

SEQ ID NO: 7141011 - DNA, 22 bp, Homo sapiens
gagcaaagcttttagggccttt

SEQ ID NO: 7141012 - DNA, 22 bp, Homo sapiens
gagcaaagcttttagggccttt

SEQ ID NO: 7141013 - DNA, 22 bp, Homo sapiens
gagcaaatggagcttgtctact

SEQ ID NO: 7141014 - DNA, 22 bp, Homo sapiens
gagaggcaggaatcctgggtga

SEQ ID NO: 7141015 - DNA, 22 bp, Homo sapiens
gagaggcagaggcctgaaaccg

SEQ ID NO: 7141016 - DNA, 22 bp, Homo sapiens
gagaggatccacaaaccaggaa

SEQ ID NO: 7141017 - DNA, 22 bp, Homo sapiens
gagaggcagaggcctgaaaccg

SEQ ID NO: 7141018 - DNA, 22 bp, Homo sapiens
gagaggagttactatttccgag

SEQ ID NO: 7141019 - DNA, 22 bp, Homo sapiens
gagaggagttactatttccgag

SEQ ID NO: 7141020 - DNA, 22 bp, Homo sapiens
gagaggagtccctatcacagtt

SEQ ID NO: 7141021 - DNA, 22 bp, Homo sapiens
gagaggagtccctatcacagtt

SEQ ID NO: 7141022 - DNA, 22 bp, Homo sapiens
gagaggagtccctatcacagtt

SEQ ID NO: 7141023 - DNA, 22 bp, Homo sapiens
gagattttcagcttgactggga

SEQ ID NO: 7141024 - DNA, 22 bp, Homo sapiens
gagaggcaggcgctgcaatggt

SEQ ID NO: 7141025 - DNA, 20 bp, Homo sapiens
gagcacagtaatgactgcta

SEQ ID NO: 7141026 - DNA, 20 bp, Homo sapiens
gagcacagtaatgactgcta

SEQ ID NO: 7141027 - DNA, 22 bp, Homo sapiens
gagcacagtaaagcagtgtcac

SEQ ID NO: 7141028 - DNA, 22 bp, Homo sapiens
gagcacagatcctggagccaca

SEQ ID NO: 7141029 - DNA, 22 bp, Homo sapiens
gagcacagtaaagcagtgtcac

SEQ ID NO: 7141030 - DNA, 20 bp, Homo sapiens
gagcacagtaatgactgcta

SEQ ID NO: 7141031 - DNA, 22 bp, Homo sapiens
gagcacagtccttttgttaaaa

SEQ ID NO: 7141032 - DNA, 22 bp, Homo sapiens
gagcacagtccttttgttaaaa

SEQ ID NO: 7141033 - DNA, 22 bp, Homo sapiens
gagcacagtccttttgttaaaa

SEQ ID NO: 7141034 - DNA, 22 bp, Homo sapiens
gagcacagtccttttgttaaaa

SEQ ID NO: 7141035 - DNA, 22 bp, Homo sapiens
gagcacagtccttttgttaaaa

SEQ ID NO: 7141036 - DNA, 22 bp, Homo sapiens
gagcacagtccttttgttaaaa

SEQ ID NO: 7141037 - DNA, 22 bp, Homo sapiens
gagcacagtgcagtttctgcta

SEQ ID NO: 7141038 - DNA, 22 bp, Homo sapiens
gagcacagtgcagtttctgcta

SEQ ID NO: 7141039 - DNA, 22 bp, Homo sapiens
gagcacagtgtgttgtgatttc

SEQ ID NO: 7141040 - DNA, 22 bp, Homo sapiens
gagcacagtgtgttgtgatttc

SEQ ID NO: 7141041 - DNA, 22 bp, Homo sapiens
gagcacatgagaggaaatcaaa

SEQ ID NO: 7141042 - DNA, 22 bp, Homo sapiens
gagcacatgtggagagtctggg

SEQ ID NO: 7141043 - DNA, 22 bp, Homo sapiens
gagcacattcccaggagctgct

SEQ ID NO: 7141044 - DNA, 22 bp, Homo sapiens
gagcacattcctcctgtgaatt

SEQ ID NO: 7141045 - DNA, 22 bp, Homo sapiens
gagcaccaaggctctgccatgg

SEQ ID NO: 7141046 - DNA, 22 bp, Homo sapiens
gagcacagtgtgttgtgatttc

SEQ ID NO: 7141047 - DNA, 22 bp, Homo sapiens
gagcacagtgtgttgtgatttc

SEQ ID NO: 7141048 - DNA, 22 bp, Homo sapiens
gagcacatgagaggaaatcaaa

SEQ ID NO: 7141049 - DNA, 22 bp, Homo sapiens
gagcacatgagaggaaatcaaa

SEQ ID NO: 7141050 - DNA, 22 bp, Homo sapiens
gagcaccctacctgccactgag

SEQ ID NO: 7141051 - DNA, 22 bp, Homo sapiens
gagcaccctacctgccactgag

SEQ ID NO: 7141052 - DNA, 22 bp, Homo sapiens
gagcacccttgagagactctcg

SEQ ID NO: 7141053 - DNA, 22 bp, Homo sapiens
gagcaccctttgcacatcagtc

SEQ ID NO: 7141054 - DNA, 22 bp, Homo sapiens
gagcactgaggaaagctggtta

SEQ ID NO: 7141055 - DNA, 22 bp, Homo sapiens
gagcactgatttatttttgtct

SEQ ID NO: 7141056 - DNA, 22 bp, Homo sapiens
gagcactgatttatttttgtct

SEQ ID NO: 7141057 - DNA, 22 bp, Homo sapiens
gagcactgatttatttttgtct

SEQ ID NO: 7141058 - DNA, 18 bp, Homo sapiens
gagcactggtgttgaggt

SEQ ID NO: 7141059 - DNA, 22 bp, Homo sapiens
gagcacctcaaatgaacataaa

SEQ ID NO: 7141060 - DNA, 22 bp, Homo sapiens
gagcacctcaatttgctatttg

SEQ ID NO: 7141061 - DNA, 22 bp, Homo sapiens
gagcacctgcctcctcatttga

SEQ ID NO: 7141062 - DNA, 22 bp, Homo sapiens
gagcacctgctaaatgacagtt

SEQ ID NO: 7141063 - DNA, 22 bp, Homo sapiens
gagcacctgctaaatgacagtt

SEQ ID NO: 7141064 - DNA, 22 bp, Homo sapiens
gagcacctgggacacagcttgt

SEQ ID NO: 7141065 - DNA, 22 bp, Homo sapiens
gagcacttagatgctatgaatg

SEQ ID NO: 7141066 - DNA, 22 bp, Homo sapiens
gagcagaacaggccgggtggga

SEQ ID NO: 7141067 - DNA, 22 bp, Homo sapiens
gagcagaaagttatgtcttgca

SEQ ID NO: 7141068 - DNA, 22 bp, Homo sapiens
gagcagacgctgcagtcttggg

SEQ ID NO: 7141069 - DNA, 22 bp, Homo sapiens
gagcagagaatccagctaagtg

SEQ ID NO: 7141070 - DNA, 22 bp, Homo sapiens
gagcagagaatccagctaagtg

SEQ ID NO: 7141071 - DNA, 18 bp, Homo sapiens
gagcagaggctcaactgg

SEQ ID NO: 7141072 - DNA, 19 bp, Homo sapiens
gagcagcttcctatctggt

SEQ ID NO: 7141073 - DNA, 22 bp, Homo sapiens
gagcagagcttctcaaagtaaa

SEQ ID NO: 7141074 - DNA, 22 bp, Homo sapiens
gagcagagcttctcaaagtaaa

SEQ ID NO: 7141075 - DNA, 22 bp, Homo sapiens
gagcagagcttctcaaagtaaa

SEQ ID NO: 7141076 - DNA, 22 bp, Homo sapiens
gagcagagcttctcaaagtaaa

SEQ ID NO: 7141077 - DNA, 22 bp, Homo sapiens
gagcagagcttctcaaagtaaa

SEQ ID NO: 7141078 - DNA, 22 bp, Homo sapiens
gagcagagcttctcaaagtaaa

SEQ ID NO: 7141079 - DNA, 23 bp, Homo sapiens
gagcagagcgggcgggggtcctg

SEQ ID NO: 7141080 - DNA, 23 bp, Homo sapiens
gagcagagcgggcgggggtcctg

SEQ ID NO: 7141081 - DNA, 22 bp, Homo sapiens
gagcagagacagtacaactggc

SEQ ID NO: 7141082 - DNA, 22 bp, Homo sapiens
gagcagagacagtacaactggc

SEQ ID NO: 7141083 - DNA, 22 bp, Homo sapiens
gagcagagacagtacaactggc

SEQ ID NO: 7141084 - DNA, 22 bp, Homo sapiens
gagcagagacagtacaactggc

SEQ ID NO: 7141085 - DNA, 22 bp, Homo sapiens
gagcagagacagtacaactggc

SEQ ID NO: 7141086 - DNA, 22 bp, Homo sapiens
gagcagagacagtacaactggc

SEQ ID NO: 7141087 - DNA, 22 bp, Homo sapiens
gagcaggacagcagcttcctgg

SEQ ID NO: 7141088 - DNA, 22 bp, Homo sapiens
gagcaggacagcagcttcctgg

SEQ ID NO: 7141089 - DNA, 22 bp, Homo sapiens
gagcaggacagcagcttcctgg

SEQ ID NO: 7141090 - DNA, 22 bp, Homo sapiens
gagcaggacgtgggaatgggaa

SEQ ID NO: 7141091 - DNA, 22 bp, Homo sapiens
gagcaggacgtgggaatgggaa

SEQ ID NO: 7141092 - DNA, 22 bp, Homo sapiens
gagcaggacgtgggaatgggaa

SEQ ID NO: 7141093 - DNA, 22 bp, Homo sapiens
gagcaggaaggccagaagggtc

SEQ ID NO: 7141094 - DNA, 22 bp, Homo sapiens
gagcaggaaggccagaagggtc

SEQ ID NO: 7141095 - DNA, 22 bp, Homo sapiens
gagcaggaaggccagaagggtc

SEQ ID NO: 7141096 - DNA, 22 bp, Homo sapiens
gagcaggaaggccagaagggtc

SEQ ID NO: 7141097 - DNA, 22 bp, Homo sapiens
gagcaggacagcagcttcctgg

SEQ ID NO: 7141098 - DNA, 22 bp, Homo sapiens
gagcaggaaggccagaagggtc

SEQ ID NO: 7141099 - DNA, 22 bp, Homo sapiens
gagcaggaaggccagaagggtc

SEQ ID NO: 7141100 - DNA, 22 bp, Homo sapiens
gagcaggaaggccagaagggtc

SEQ ID NO: 7141101 - DNA, 22 bp, Homo sapiens
gagcaggaactgaaaatgagac

SEQ ID NO: 7141102 - DNA, 22 bp, Homo sapiens
gagcaggaactgaaaatgagac

SEQ ID NO: 7141103 - DNA, 22 bp, Homo sapiens
gagcaggaactgaaaatgagac

SEQ ID NO: 7141104 - DNA, 22 bp, Homo sapiens
gagcaggaactgaaaatgagac

SEQ ID NO: 7141105 - DNA, 22 bp, Homo sapiens
gagcaggaacagatcccttgga

SEQ ID NO: 7141106 - DNA, 22 bp, Homo sapiens
gagcaggaacagatcccttgga

SEQ ID NO: 7141107 - DNA, 22 bp, Homo sapiens
gagcagcttgcgctgtcttcac

SEQ ID NO: 7141108 - DNA, 22 bp, Homo sapiens
gagcagcttgcgctgtcttcac

SEQ ID NO: 7141109 - DNA, 22 bp, Homo sapiens
gagggcctctgctgctccacat

SEQ ID NO: 7141110 - DNA, 22 bp, Homo sapiens
gagggcctctgctgctccacat

SEQ ID NO: 7141111 - DNA, 22 bp, Homo sapiens
gagggcctctgtgggtgctcac

SEQ ID NO: 7141112 - DNA, 22 bp, Homo sapiens
gagggcctctgtgggtgctcac

SEQ ID NO: 7141113 - DNA, 22 bp, Homo sapiens
gagggcctggcacagggaggct

SEQ ID NO: 7141114 - DNA, 22 bp, Homo sapiens
gagggcctggcacagggaggct

SEQ ID NO: 7141115 - DNA, 22 bp, Homo sapiens
gagggccctggctggctccagc

SEQ ID NO: 7141116 - DNA, 22 bp, Homo sapiens
gagggccctggcttcttgctgg

SEQ ID NO: 7141117 - DNA, 22 bp, Homo sapiens
gagggccctggctggctccagc

SEQ ID NO: 7141118 - DNA, 22 bp, Homo sapiens
gagggctgataaatgcgcatgg

SEQ ID NO: 7141119 - DNA, 22 bp, Homo sapiens
gagggctgataaatgcgcatgg

SEQ ID NO: 7141120 - DNA, 22 bp, Homo sapiens
gagggctgataaatgcgcatgg

SEQ ID NO: 7141121 - DNA, 22 bp, Homo sapiens
gagggctgataaatgcgcatgg

SEQ ID NO: 7141122 - DNA, 22 bp, Homo sapiens
gagggctgaagtgttttatgag

SEQ ID NO: 7141123 - DNA, 22 bp, Homo sapiens
gagggctgaagtgttttatgag

SEQ ID NO: 7141124 - DNA, 22 bp, Homo sapiens
gagggctgataacaggaataca

SEQ ID NO: 7141125 - DNA, 22 bp, Homo sapiens
gagggctgataacaggaataca

SEQ ID NO: 7141126 - DNA, 22 bp, Homo sapiens
gagggccaggcggagacaggcg

SEQ ID NO: 7141127 - DNA, 22 bp, Homo sapiens
gagggccaggcggagacaggcg

SEQ ID NO: 7141128 - DNA, 22 bp, Homo sapiens
gagggccaggcggagacaggcg

SEQ ID NO: 7141129 - DNA, 22 bp, Homo sapiens
gagggccaggcggagacaggcg

SEQ ID NO: 7141130 - DNA, 22 bp, Homo sapiens
gagggccagcctgccaagggcc

SEQ ID NO: 7141131 - DNA, 22 bp, Homo sapiens
gagggccagatcccaggaggaa

SEQ ID NO: 7141132 - DNA, 22 bp, Homo sapiens
gagggccagagtcctggggtca

SEQ ID NO: 7141133 - DNA, 22 bp, Homo sapiens
gagggccagatcccaggaggaa

SEQ ID NO: 7141134 - DNA, 22 bp, Homo sapiens
gagggccagcagcctcagcatg

SEQ ID NO: 7141135 - DNA, 22 bp, Homo sapiens
gagggccagcagcctcagcatg

SEQ ID NO: 7141136 - DNA, 22 bp, Homo sapiens
gagggccagcagcctcagcatg

SEQ ID NO: 7141137 - DNA, 22 bp, Homo sapiens
gagggacagctaaagagaaatt

SEQ ID NO: 7141138 - DNA, 22 bp, Homo sapiens
gagggaccccaggctggccctt

SEQ ID NO: 7141139 - DNA, 22 bp, Homo sapiens
gagggacctttacacagacatt

SEQ ID NO: 7141140 - DNA, 22 bp, Homo sapiens
gagggagaaggactatcaggct

SEQ ID NO: 7141141 - DNA, 22 bp, Homo sapiens
gagggacagctaaagagaaatt

SEQ ID NO: 7141142 - DNA, 22 bp, Homo sapiens
gagggaatggtgtgcaagaggt

SEQ ID NO: 7141143 - DNA, 22 bp, Homo sapiens
gagggaagtcataatgttctag

SEQ ID NO: 7141144 - DNA, 22 bp, Homo sapiens
gagggagaaggactatcaggct

SEQ ID NO: 7141145 - DNA, 22 bp, Homo sapiens
gagggagaattgcagccagcgt

SEQ ID NO: 7141146 - DNA, 22 bp, Homo sapiens
gagggagaattgcagccagcgt

SEQ ID NO: 7141147 - DNA, 22 bp, Homo sapiens
gagggccacgttcagggctctc

SEQ ID NO: 7141148 - DNA, 22 bp, Homo sapiens
gagggccagagtcctggggtca

SEQ ID NO: 7141149 - DNA, 22 bp, Homo sapiens
gagggccagagtcctggggtca

SEQ ID NO: 7141150 - DNA, 22 bp, Homo sapiens
gagggccacgttcagggctctc

SEQ ID NO: 7141151 - DNA, 22 bp, Homo sapiens
gagggccacgttcagggctctc

SEQ ID NO: 7141152 - DNA, 22 bp, Homo sapiens
gagggaaggacccattttaagt

SEQ ID NO: 7141153 - DNA, 22 bp, Homo sapiens
gagggaagagggtttgaattca

SEQ ID NO: 7141154 - DNA, 22 bp, Homo sapiens
gagggaagaggcctgacatttt

SEQ ID NO: 7141155 - DNA, 22 bp, Homo sapiens
gagggaagaggcctgacatttt

SEQ ID NO: 7141156 - DNA, 22 bp, Homo sapiens
gaggctgtctgttagcctggga

SEQ ID NO: 7141157 - DNA, 21 bp, Homo sapiens
gaggctgtctgctgctggcct

SEQ ID NO: 7141158 - DNA, 22 bp, Homo sapiens
gaggctgtaacttgggcactgg

SEQ ID NO: 7141159 - DNA, 22 bp, Homo sapiens
gaggctggtttgccttttggca

SEQ ID NO: 7141160 - DNA, 22 bp, Homo sapiens
gaggcctgtcgctaggcctctg

SEQ ID NO: 7141161 - DNA, 22 bp, Homo sapiens
gaggcctgtcgctaggcctctg

SEQ ID NO: 7141162 - DNA, 22 bp, Homo sapiens
gaggcctgtagtcatggatgta

SEQ ID NO: 7141163 - DNA, 22 bp, Homo sapiens
gaggcctgtagtcatggatgta

SEQ ID NO: 7141164 - DNA, 22 bp, Homo sapiens
gaggccttcagaaggcattagt

SEQ ID NO: 7141165 - DNA, 18 bp, Homo sapiens
gaggcgagctcttcagaa

SEQ ID NO: 7141166 - DNA, 19 bp, Homo sapiens
gaggcgaggcgtgcaggag

SEQ ID NO: 7141167 - DNA, 19 bp, Homo sapiens
gaggcgaggcgtgcaggag

SEQ ID NO: 7141168 - DNA, 22 bp, Homo sapiens
gaggcgagaagctggagatggt

SEQ ID NO: 7141169 - DNA, 22 bp, Homo sapiens
gaggcgagaagctggagatggt

SEQ ID NO: 7141170 - DNA, 22 bp, Homo sapiens
gaggcgagaagctggagatggt

SEQ ID NO: 7141171 - DNA, 22 bp, Homo sapiens
gaggcgagaagctggagatggt

SEQ ID NO: 7141172 - DNA, 22 bp, Homo sapiens
gaggcctggtttgcatgagaat

SEQ ID NO: 7141173 - DNA, 22 bp, Homo sapiens
gaggcctggtttgcatgagaat

SEQ ID NO: 7141174 - DNA, 22 bp, Homo sapiens
gaggcctggtttccagcatcct

SEQ ID NO: 7141175 - DNA, 22 bp, Homo sapiens
gaggcctggtttccagcatcct

SEQ ID NO: 7141176 - DNA, 22 bp, Homo sapiens
gaggcctggtttgcatgagaat

SEQ ID NO: 7141177 - DNA, 22 bp, Homo sapiens
gaggcctgtagtcatggatgta

SEQ ID NO: 7141178 - DNA, 22 bp, Homo sapiens
gaggcctgtagtcatggatgta

SEQ ID NO: 7141179 - DNA, 22 bp, Homo sapiens
gaggcctggtctatgagatgtt

SEQ ID NO: 7141180 - DNA, 22 bp, Homo sapiens
gaggcctggagccgcctaggcg

SEQ ID NO: 7141181 - DNA, 22 bp, Homo sapiens
gaggcctgggttggaggtgcat

SEQ ID NO: 7141182 - DNA, 22 bp, Homo sapiens
gaggcctggtagccgagcccca

SEQ ID NO: 7141183 - DNA, 22 bp, Homo sapiens
gaggcctggtctatgagatgtt

SEQ ID NO: 7141184 - DNA, 22 bp, Homo sapiens
gaggcctggtctatgagatgtt

SEQ ID NO: 7141185 - DNA, 22 bp, Homo sapiens
gaggcctggtctatgagatgtt

SEQ ID NO: 7141186 - DNA, 22 bp, Homo sapiens
gaggcctggtgctgtgtccaca

SEQ ID NO: 7141187 - DNA, 22 bp, Homo sapiens
gaggcctggtgctgtgtccaca

SEQ ID NO: 7141188 - DNA, 22 bp, Homo sapiens
gaggcctggtgctgtgtccaca

SEQ ID NO: 7141189 - DNA, 22 bp, Homo sapiens
gaggcctggtgtgtctcccgct

SEQ ID NO: 7141190 - DNA, 22 bp, Homo sapiens
gaggcctggtgtgtctcccgct

SEQ ID NO: 7141191 - DNA, 22 bp, Homo sapiens
gaggctggtttgccttttggca

SEQ ID NO: 7141192 - DNA, 22 bp, Homo sapiens
gaggctggttctgaagtactgt

SEQ ID NO: 7141193 - DNA, 22 bp, Homo sapiens
gaggctggttctgaagtactgt

SEQ ID NO: 7141194 - DNA, 22 bp, Homo sapiens
gaggctggttctgaagtactgt

SEQ ID NO: 7141195 - DNA, 22 bp, Homo sapiens
gaggctggttctgaagtactgt

SEQ ID NO: 7141196 - DNA, 22 bp, Homo sapiens
gaggctggttcccttgatcttt

SEQ ID NO: 7141197 - DNA, 22 bp, Homo sapiens
gaggctggtggttagttccatt

SEQ ID NO: 7141198 - DNA, 22 bp, Homo sapiens
gaggctggttcccttgatcttt

SEQ ID NO: 7141199 - DNA, 22 bp, Homo sapiens
gaggctggtggttagttccatt

SEQ ID NO: 7141200 - DNA, 22 bp, Homo sapiens
gaggctggtggttagttccatt

SEQ ID NO: 7141201 - DNA, 22 bp, Homo sapiens
gaggctggtcagccctaagatc

SEQ ID NO: 7141202 - DNA, 22 bp, Homo sapiens
gaggctggtcagccctaagatc

SEQ ID NO: 7141203 - DNA, 22 bp, Homo sapiens
gaggctggtaggaaaggaaaca

SEQ ID NO: 7141204 - DNA, 22 bp, Homo sapiens
gaggctggtaggaaaggaaaca

SEQ ID NO: 7141205 - DNA, 22 bp, Homo sapiens
gaggctggtaggaaaggaaaca

SEQ ID NO: 7141206 - DNA, 22 bp, Homo sapiens
gaggctggtaggaaaggaaaca

SEQ ID NO: 7141207 - DNA, 22 bp, Homo sapiens
gaggctggtaggaaaggaaaca

SEQ ID NO: 7141208 - DNA, 22 bp, Homo sapiens
gaggctcaaacctggacagagc

SEQ ID NO: 7141209 - DNA, 22 bp, Homo sapiens
gaggctggggtctgcctttctg

SEQ ID NO: 7141210 - DNA, 22 bp, Homo sapiens
gaggcgggcagatcacctgagg

SEQ ID NO: 7141211 - DNA, 22 bp, Homo sapiens
gaggctaaggtgccagacgaat

SEQ ID NO: 7141212 - DNA, 22 bp, Homo sapiens
gaggctaaggttctgccagaag

SEQ ID NO: 7141213 - DNA, 22 bp, Homo sapiens
gaggctaaggttctgccagaag

SEQ ID NO: 7141214 - DNA, 22 bp, Homo sapiens
gaggctaagtaactgtccatgg

SEQ ID NO: 7141215 - DNA, 22 bp, Homo sapiens
gaggctaagtaactgtccatgg

SEQ ID NO: 7141216 - DNA, 22 bp, Homo sapiens
gaggctcaaacctggacagagc

SEQ ID NO: 7141217 - DNA, 22 bp, Homo sapiens
gaggctagagcaggggctcaat

SEQ ID NO: 7141218 - DNA, 22 bp, Homo sapiens
gaggcgcagcccggaggagaca

SEQ ID NO: 7141219 - DNA, 22 bp, Homo sapiens
gaggcggccagcgaggccgcaa

SEQ ID NO: 7141220 - DNA, 22 bp, Homo sapiens
gaggcggcggccgagcctggct

SEQ ID NO: 7141221 - DNA, 22 bp, Homo sapiens
gaggcgggcagatcacctgagg

SEQ ID NO: 7141222 - DNA, 22 bp, Homo sapiens
gaggcggtacagccagtcctcc

SEQ ID NO: 7141223 - DNA, 22 bp, Homo sapiens
gaggtgagtggatcacgaggtc

SEQ ID NO: 7141224 - DNA, 22 bp, Homo sapiens
gaggtgagaagggggtcagatg

SEQ ID NO: 7141225 - DNA, 22 bp, Homo sapiens
gaggtgagaagggggtcagatg

SEQ ID NO: 7141226 - DNA, 22 bp, Homo sapiens
gaggtgagtggatcacgaggtc

SEQ ID NO: 7141227 - DNA, 22 bp, Homo sapiens
gaggtgagaagggggtcagatg

SEQ ID NO: 7141228 - DNA, 22 bp, Homo sapiens
gaggtgagaagggggtcagatg

SEQ ID NO: 7141229 - DNA, 22 bp, Homo sapiens
gaggtgagaagggggtcagatg

SEQ ID NO: 7141230 - DNA, 22 bp, Homo sapiens
gaggtgagaagggggtcagatg

SEQ ID NO: 7141231 - DNA, 22 bp, Homo sapiens
gaggtgaaagttattcatttat

SEQ ID NO: 7141232 - DNA, 22 bp, Homo sapiens
gaggtcttgtctgatagggaaa

SEQ ID NO: 7141233 - DNA, 22 bp, Homo sapiens
gaggtcttgtctgatagggaaa

SEQ ID NO: 7141234 - DNA, 22 bp, Homo sapiens
gaggtgagaagggggtcagatg

SEQ ID NO: 7141235 - DNA, 22 bp, Homo sapiens
gaggtgagaagggggtcagatg

SEQ ID NO: 7141236 - DNA, 22 bp, Homo sapiens
gaggtgagaagggggtcagatg

SEQ ID NO: 7141237 - DNA, 22 bp, Homo sapiens
gaggtgagtggatcacgaggtc

SEQ ID NO: 7141238 - DNA, 22 bp, Homo sapiens
gaggtgagtggatcacgaggtc

SEQ ID NO: 7141239 - DNA, 22 bp, Homo sapiens
gaggtgagtggatcacgaggtc

SEQ ID NO: 7141240 - DNA, 22 bp, Homo sapiens
gaggtgagtggatcacgaggtc

SEQ ID NO: 7141241 - DNA, 22 bp, Homo sapiens
gaggtgagtggatcacgaggtc

SEQ ID NO: 7141242 - DNA, 22 bp, Homo sapiens
gaggtgcctggcgatgtctctg

SEQ ID NO: 7141243 - DNA, 22 bp, Homo sapiens
gaggtgcttcctttgggctctg

SEQ ID NO: 7141244 - DNA, 22 bp, Homo sapiens
gaggtgctgctgtacttcttgc

SEQ ID NO: 7141245 - DNA, 22 bp, Homo sapiens
gaggtgctgctgtacttcttgc

SEQ ID NO: 7141246 - DNA, 22 bp, Homo sapiens
gaggtgctgctgtacttcttgc

SEQ ID NO: 7141247 - DNA, 22 bp, Homo sapiens
gaggtgcctggcgatgtctctg

SEQ ID NO: 7141248 - DNA, 22 bp, Homo sapiens
gaggtggctgggagtagggaat

SEQ ID NO: 7141249 - DNA, 22 bp, Homo sapiens
gaggtggctgggagtagggaat

SEQ ID NO: 7141250 - DNA, 18 bp, Homo sapiens
gaggtggctgggccatct

SEQ ID NO: 7141251 - DNA, 22 bp, Homo sapiens
gaggtggctgggagtagggaat

SEQ ID NO: 7141252 - DNA, 22 bp, Homo sapiens
gaggtggctgcttgctgggaaa

SEQ ID NO: 7141253 - DNA, 22 bp, Homo sapiens
gaggtggctgcttgctgggaaa

SEQ ID NO: 7141254 - DNA, 22 bp, Homo sapiens
gaggtggctgcttgctgggaaa

SEQ ID NO: 7141255 - DNA, 22 bp, Homo sapiens
gaggtggctggctcagagccag

SEQ ID NO: 7141256 - DNA, 22 bp, Homo sapiens
gaggtggctccttcagggaata

SEQ ID NO: 7141257 - DNA, 22 bp, Homo sapiens
gaggtggctccttcagggaata

SEQ ID NO: 7141258 - DNA, 22 bp, Homo sapiens
gaggtggctgcttgctgggaaa

SEQ ID NO: 7141259 - DNA, 22 bp, Homo sapiens
gaggtggctgcttgctgggaaa

SEQ ID NO: 7141260 - DNA, 22 bp, Homo sapiens
gaggtggctgcttgctgggaaa

SEQ ID NO: 7141261 - DNA, 22 bp, Homo sapiens
gaggtggaaggcaggaacaaat

SEQ ID NO: 7141262 - DNA, 22 bp, Homo sapiens
gaggtggaggggaaaaatagat

SEQ ID NO: 7141263 - DNA, 22 bp, Homo sapiens
gaggtggatgttgcagtgagct

SEQ ID NO: 7141264 - DNA, 22 bp, Homo sapiens
gaggtggatgttgcagtgagct

SEQ ID NO: 7141265 - DNA, 19 bp, Homo sapiens
gagtacaggtgcagaaatg

SEQ ID NO: 7141266 - DNA, 22 bp, Homo sapiens
gagtacatcttaatttgactaa

SEQ ID NO: 7141267 - DNA, 22 bp, Homo sapiens
gagtacatgtatagagattaac

SEQ ID NO: 7141268 - DNA, 22 bp, Homo sapiens
gagtaattttcttaaaacatca

SEQ ID NO: 7141269 - DNA, 22 bp, Homo sapiens
gagtacagctcttttgttttca

SEQ ID NO: 7141270 - DNA, 22 bp, Homo sapiens
gagtaatgctcaaggtctgttt

SEQ ID NO: 7141271 - DNA, 22 bp, Homo sapiens
gagtaatgctgttccatcttgg

SEQ ID NO: 7141272 - DNA, 22 bp, Homo sapiens
gagtaatggccgtaggttggga

SEQ ID NO: 7141273 - DNA, 22 bp, Homo sapiens
gagtaattgtgtctggcacact

SEQ ID NO: 7141274 - DNA, 22 bp, Homo sapiens
gagtaaaagttggattacaaag

SEQ ID NO: 7141275 - DNA, 22 bp, Homo sapiens
gagtaaaagttggattacaaag

SEQ ID NO: 7141276 - DNA, 22 bp, Homo sapiens
gagtaaaataggtgagaatcaa

SEQ ID NO: 7141277 - DNA, 22 bp, Homo sapiens
gagtaacaaatacttcagtagt

SEQ ID NO: 7141278 - DNA, 22 bp, Homo sapiens
gagtaacataccaaaattcaca

SEQ ID NO: 7141279 - DNA, 22 bp, Homo sapiens
gagtaacaaatacttcagtagt

SEQ ID NO: 7141280 - DNA, 22 bp, Homo sapiens
gagtaacataccaaaattcaca

SEQ ID NO: 7141281 - DNA, 22 bp, Homo sapiens
gagtaaggctgctgatggagtg

SEQ ID NO: 7141282 - DNA, 22 bp, Homo sapiens
gaggttttaggctgccattatt

SEQ ID NO: 7141283 - DNA, 22 bp, Homo sapiens
gaggttttaagttgaaggggga

SEQ ID NO: 7141284 - DNA, 22 bp, Homo sapiens
gaggtttcttatcaagaaagct

SEQ ID NO: 7141285 - DNA, 19 bp, Homo sapiens
gaggtttctgaagtgggct

SEQ ID NO: 7141286 - DNA, 22 bp, Homo sapiens
gagtaaaagatgaggcagtaga

SEQ ID NO: 7141287 - DNA, 22 bp, Homo sapiens
gagtaaaagttggattacaaag

SEQ ID NO: 7141288 - DNA, 22 bp, Homo sapiens
gagtaaaagttggattacaaag

SEQ ID NO: 7141289 - DNA, 22 bp, Homo sapiens
gaggtttcactgtgttgtccag

SEQ ID NO: 7141290 - DNA, 22 bp, Homo sapiens
gaggtttcactgtgttgtccag

SEQ ID NO: 7141291 - DNA, 22 bp, Homo sapiens
gaggttggttccaaccctccca

SEQ ID NO: 7141292 - DNA, 23 bp, Homo sapiens
gaggtgtgaattctgggtgctgc

SEQ ID NO: 7141293 - DNA, 23 bp, Homo sapiens
gaggtgtgaattctgggtgctgc

SEQ ID NO: 7141294 - DNA, 23 bp, Homo sapiens
gaggtgtgaattctgggtgctgc

SEQ ID NO: 7141295 - DNA, 23 bp, Homo sapiens
gaggtgtgaattctgggtgctgc

SEQ ID NO: 7141296 - DNA, 22 bp, Homo sapiens
gaggtggcttagtctctggaca

SEQ ID NO: 7141297 - DNA, 22 bp, Homo sapiens
gaggtggcttagtctctggaca

SEQ ID NO: 7141298 - DNA, 22 bp, Homo sapiens
gaggtggcttagtctctggaca

SEQ ID NO: 7141299 - DNA, 22 bp, Homo sapiens
gaggtgggagggcagtccctaa

SEQ ID NO: 7141300 - DNA, 22 bp, Homo sapiens
gaggtgggagggcagtccctaa

SEQ ID NO: 7141301 - DNA, 22 bp, Homo sapiens
gaggtgggagggcagtccctaa

SEQ ID NO: 7141302 - DNA, 22 bp, Homo sapiens
gaggtgtctgttaggaataggc

SEQ ID NO: 7141303 - DNA, 19 bp, Homo sapiens
gaggtgtctttcctgagta

SEQ ID NO: 7141304 - DNA, 19 bp, Homo sapiens
gaggtgtctttcctgagta

SEQ ID NO: 7141305 - DNA, 22 bp, Homo sapiens
gaggtctgccttcaggagagtt

SEQ ID NO: 7141306 - DNA, 22 bp, Homo sapiens
gaggtctgccttcaggagagtt

SEQ ID NO: 7141307 - DNA, 22 bp, Homo sapiens
gaggtctgccttcaggagagtt

SEQ ID NO: 7141308 - DNA, 22 bp, Homo sapiens
gaggtctgccttcaggagagtt

SEQ ID NO: 7141309 - DNA, 22 bp, Homo sapiens
gaggtctgcttatctctcacag

SEQ ID NO: 7141310 - DNA, 22 bp, Homo sapiens
gaggtctgcttatctctcacag

SEQ ID NO: 7141311 - DNA, 22 bp, Homo sapiens
gaggtctggaccaagtcgcccc

SEQ ID NO: 7141312 - DNA, 22 bp, Homo sapiens
gaggtctggaccaagtcgcccc

SEQ ID NO: 7141313 - DNA, 22 bp, Homo sapiens
gaggtctgggatggggcctgaa

SEQ ID NO: 7141314 - DNA, 22 bp, Homo sapiens
gaggtctgggatggggcctgaa

SEQ ID NO: 7141315 - DNA, 22 bp, Homo sapiens
gaggtctgggcttgggcctggt

SEQ ID NO: 7141316 - DNA, 22 bp, Homo sapiens
gaggtctgggcttgggcctggt

SEQ ID NO: 7141317 - DNA, 22 bp, Homo sapiens
gaggtctgtgtcactttagtgc

SEQ ID NO: 7141318 - DNA, 22 bp, Homo sapiens
gaggtctgtgtcactttagtgc

SEQ ID NO: 7141319 - DNA, 22 bp, Homo sapiens
gaggtcctgtctgagaatggag

SEQ ID NO: 7141320 - DNA, 22 bp, Homo sapiens
gaggtctcactatgttgcccag

SEQ ID NO: 7141321 - DNA, 22 bp, Homo sapiens
gaggtctgagtgcggaaagcct

SEQ ID NO: 7141322 - DNA, 22 bp, Homo sapiens
gagggtggtggcttaaggtgct

SEQ ID NO: 7141323 - DNA, 22 bp, Homo sapiens
gagggtgtctcacgtgaaagta

SEQ ID NO: 7141324 - DNA, 22 bp, Homo sapiens
gagggtggtggcttaaggtgct

SEQ ID NO: 7141325 - DNA, 22 bp, Homo sapiens
gagggtggtggcttaaggtgct

SEQ ID NO: 7141326 - DNA, 22 bp, Homo sapiens
gagggtggtggcttaaggtgct

SEQ ID NO: 7141327 - DNA, 22 bp, Homo sapiens
gagggtgggtttcttgcacgtc

SEQ ID NO: 7141328 - DNA, 22 bp, Homo sapiens
gagggtgggtttcttgcacgtc

SEQ ID NO: 7141329 - DNA, 22 bp, Homo sapiens
gagggtggtggcttaaggtgct

SEQ ID NO: 7141330 - DNA, 22 bp, Homo sapiens
gagggtggtggcttaaggtgct

SEQ ID NO: 7141331 - DNA, 22 bp, Homo sapiens
gagggtgggctttgttcctcca

SEQ ID NO: 7141332 - DNA, 22 bp, Homo sapiens
gagggtgggctttgttcctcca

SEQ ID NO: 7141333 - DNA, 22 bp, Homo sapiens
gagggtggggaatagactgcta

SEQ ID NO: 7141334 - DNA, 22 bp, Homo sapiens
gagggtgggctcctatctgggt

SEQ ID NO: 7141335 - DNA, 20 bp, Homo sapiens
gagggtgggacttcctaggc

SEQ ID NO: 7141336 - DNA, 22 bp, Homo sapiens
gagggtgggccagatatgaggg

SEQ ID NO: 7141337 - DNA, 22 bp, Homo sapiens
gagggtgggccagatatgaggg

SEQ ID NO: 7141338 - DNA, 22 bp, Homo sapiens
gagggtgggccagatatgaggg

SEQ ID NO: 7141339 - DNA, 22 bp, Homo sapiens
gagggtgggccagatatgaggg

SEQ ID NO: 7141340 - DNA, 22 bp, Homo sapiens
gagggtgggccagatatgaggg

SEQ ID NO: 7141341 - DNA, 22 bp, Homo sapiens
gagggtgggctcctatctgggt

SEQ ID NO: 7141342 - DNA, 22 bp, Homo sapiens
gagggtggggaatagactgcta

SEQ ID NO: 7141343 - DNA, 22 bp, Homo sapiens
gagggtggggaatagactgcta

SEQ ID NO: 7141344 - DNA, 22 bp, Homo sapiens
gagggtggggaatagactgcta

SEQ ID NO: 7141345 - DNA, 22 bp, Homo sapiens
gagggtggggaatagactgcta

SEQ ID NO: 7141346 - DNA, 22 bp, Homo sapiens
gagggtggggaatagactgcta

SEQ ID NO: 7141347 - DNA, 22 bp, Homo sapiens
gagggtgggtacaccagccctc

SEQ ID NO: 7141348 - DNA, 22 bp, Homo sapiens
gagggtgggtacaccagccctc

SEQ ID NO: 7141349 - DNA, 22 bp, Homo sapiens
gagggtgggtttcttgcacgtc

SEQ ID NO: 7141350 - DNA, 22 bp, Homo sapiens
gagggtggaagagctgctgaga

SEQ ID NO: 7141351 - DNA, 22 bp, Homo sapiens
gagggtggaagagctgctgaga

SEQ ID NO: 7141352 - DNA, 22 bp, Homo sapiens
gagggtggaagagctgctgaga

SEQ ID NO: 7141353 - DNA, 22 bp, Homo sapiens
gagggtggaagagctgctgaga

SEQ ID NO: 7141354 - DNA, 22 bp, Homo sapiens
gagggtggaagagctgctgaga

SEQ ID NO: 7141355 - DNA, 22 bp, Homo sapiens
gagggtggaagagctgctgaga

SEQ ID NO: 7141356 - DNA, 22 bp, Homo sapiens
gagggtggatcagcctgattgg

SEQ ID NO: 7141357 - DNA, 22 bp, Homo sapiens
gagggtggcctttagagcccat

SEQ ID NO: 7141358 - DNA, 22 bp, Homo sapiens
gagggtggcctttagagcccat

SEQ ID NO: 7141359 - DNA, 22 bp, Homo sapiens
gagggtggagctccagaatctg

SEQ ID NO: 7141360 - DNA, 22 bp, Homo sapiens
gagggtggagctccagaatctg

SEQ ID NO: 7141361 - DNA, 22 bp, Homo sapiens
gagggtggagctccagaatctg

SEQ ID NO: 7141362 - DNA, 22 bp, Homo sapiens
gagggtggagctccagaatctg

SEQ ID NO: 7141363 - DNA, 22 bp, Homo sapiens
gagggtggagctccagaatctg

SEQ ID NO: 7141364 - DNA, 22 bp, Homo sapiens
gagggtggagctccagaatctg

SEQ ID NO: 7141365 - DNA, 22 bp, Homo sapiens
gagggtggcctttagagcccat

SEQ ID NO: 7141366 - DNA, 22 bp, Homo sapiens
gagggtggcctttagagcccat

SEQ ID NO: 7141367 - DNA, 22 bp, Homo sapiens
gagggtggcctttagagcccat

SEQ ID NO: 7141368 - DNA, 22 bp, Homo sapiens
gagggtggctcctccctgggcc

SEQ ID NO: 7141369 - DNA, 22 bp, Homo sapiens
gagggtggcctttagagcccat

SEQ ID NO: 7141370 - DNA, 22 bp, Homo sapiens
gagggtggctcctccctgggcc

SEQ ID NO: 7141371 - DNA, 22 bp, Homo sapiens
gagggtggcctttagagcccat

SEQ ID NO: 7141372 - DNA, 22 bp, Homo sapiens
gagggtggcctttagagcccat

SEQ ID NO: 7141373 - DNA, 22 bp, Homo sapiens
gagggtggctcctccctgggcc

SEQ ID NO: 7141374 - DNA, 22 bp, Homo sapiens
gagggtggctcctccctgggcc

SEQ ID NO: 7141375 - DNA, 20 bp, Homo sapiens
gagggtgggacttcctaggc

SEQ ID NO: 7141376 - DNA, 22 bp, Homo sapiens
gagggtgcaggaggatggtagt

SEQ ID NO: 7141377 - DNA, 22 bp, Homo sapiens
gagggtgcaggaggatggtagt

SEQ ID NO: 7141378 - DNA, 22 bp, Homo sapiens
gagggtcttacctaagcagggt

SEQ ID NO: 7141379 - DNA, 22 bp, Homo sapiens
gagggtgcagctgggccccacg

SEQ ID NO: 7141380 - DNA, 22 bp, Homo sapiens
gagggtgcaggcaagagcaaaa

SEQ ID NO: 7141381 - DNA, 22 bp, Homo sapiens
gagggtggaaagggtgtacctg

SEQ ID NO: 7141382 - DNA, 22 bp, Homo sapiens
gagggtggaaagggtgtacctg

SEQ ID NO: 7141383 - DNA, 22 bp, Homo sapiens
gagggtcttacctaagcagggt

SEQ ID NO: 7141384 - DNA, 22 bp, Homo sapiens
gagggtctcttaatgccagggg

SEQ ID NO: 7141385 - DNA, 22 bp, Homo sapiens
gagggctgatgttgccacctca

SEQ ID NO: 7141386 - DNA, 22 bp, Homo sapiens
gagggtctcttaatgccagggg

SEQ ID NO: 7141387 - DNA, 22 bp, Homo sapiens
gagggtctcttaatgccagggg

SEQ ID NO: 7141388 - DNA, 22 bp, Homo sapiens
gagggctgataacaggaataca

SEQ ID NO: 7141389 - DNA, 22 bp, Homo sapiens
gagggctgatgcttacttattt

SEQ ID NO: 7141390 - DNA, 22 bp, Homo sapiens
gagggctgatgcttacttattt

SEQ ID NO: 7141391 - DNA, 22 bp, Homo sapiens
gaggcatggcctgaggctagga

SEQ ID NO: 7141392 - DNA, 22 bp, Homo sapiens
gaggcatggcctgaggctagga

SEQ ID NO: 7141393 - DNA, 22 bp, Homo sapiens
gaggcatggcctgaggctagga

SEQ ID NO: 7141394 - DNA, 22 bp, Homo sapiens
gaggcatggcctgaggctagga

SEQ ID NO: 7141395 - DNA, 22 bp, Homo sapiens
gaggcatgcagagctggagcag

SEQ ID NO: 7141396 - DNA, 22 bp, Homo sapiens
gaggcaagagaagccagctttc

SEQ ID NO: 7141397 - DNA, 22 bp, Homo sapiens
gaggcatgcagagctggagcag

SEQ ID NO: 7141398 - DNA, 22 bp, Homo sapiens
gaggcatgcagagctggagcag

SEQ ID NO: 7141399 - DNA, 22 bp, Homo sapiens
gaggccactgtccctgccttcc

SEQ ID NO: 7141400 - DNA, 22 bp, Homo sapiens
gaggccactgtccctgccttcc

SEQ ID NO: 7141401 - DNA, 22 bp, Homo sapiens
gaggccactgtccctgccttcc

SEQ ID NO: 7141402 - DNA, 21 bp, Homo sapiens
gaggccactaataggggcaga

SEQ ID NO: 7141403 - DNA, 22 bp, Homo sapiens
gaggccacggttttccttgggg

SEQ ID NO: 7141404 - DNA, 22 bp, Homo sapiens
gaggccacggttttccttgggg

SEQ ID NO: 7141405 - DNA, 22 bp, Homo sapiens
gaggccacggaagggagctgtg

SEQ ID NO: 7141406 - DNA, 22 bp, Homo sapiens
gaggccacggttttccttgggg

SEQ ID NO: 7141407 - DNA, 22 bp, Homo sapiens
gaggccacgtgcttatgtttct

SEQ ID NO: 7141408 - DNA, 22 bp, Homo sapiens
gaggccacgtgcttatgtttct

SEQ ID NO: 7141409 - DNA, 22 bp, Homo sapiens
gaggatggtgagcaggacccag

SEQ ID NO: 7141410 - DNA, 22 bp, Homo sapiens
gaggatggtatgaggcaagcaa

SEQ ID NO: 7141411 - DNA, 22 bp, Homo sapiens
gaggatggtatgaggcaagcaa

SEQ ID NO: 7141412 - DNA, 22 bp, Homo sapiens
gaggatggaggtgtgagctatg

SEQ ID NO: 7141413 - DNA, 22 bp, Homo sapiens
gaggatggtatgaggcaagcaa

SEQ ID NO: 7141414 - DNA, 22 bp, Homo sapiens
gaggatggtatgaggcaagcaa

SEQ ID NO: 7141415 - DNA, 22 bp, Homo sapiens
gaggatggaggtgtgagctatg

SEQ ID NO: 7141416 - DNA, 22 bp, Homo sapiens
gaggatggaggtgtgagctatg

SEQ ID NO: 7141417 - DNA, 22 bp, Homo sapiens
gaggatgtaaaatagacaaaat

SEQ ID NO: 7141418 - DNA, 22 bp, Homo sapiens
gaggatggtgagcaggacccag

SEQ ID NO: 7141419 - DNA, 22 bp, Homo sapiens
gaggatgtgtctggtctgggca

SEQ ID NO: 7141420 - DNA, 22 bp, Homo sapiens
gaggcaacaatgatggtgtgta

SEQ ID NO: 7141421 - DNA, 22 bp, Homo sapiens
gaggcaacacatttggaaagca

SEQ ID NO: 7141422 - DNA, 22 bp, Homo sapiens
gaggcaacattgagcttctgta

SEQ ID NO: 7141423 - DNA, 22 bp, Homo sapiens
gaggcaactgcttttcctcctt

SEQ ID NO: 7141424 - DNA, 22 bp, Homo sapiens
gaggcaactggaacactggtca

SEQ ID NO: 7141425 - DNA, 22 bp, Homo sapiens
gaggcaacttcctgtcctctcc

SEQ ID NO: 7141426 - DNA, 22 bp, Homo sapiens
gaggccagaagtctgagatcag

SEQ ID NO: 7141427 - DNA, 22 bp, Homo sapiens
gaggccagaagtctgagatcag

SEQ ID NO: 7141428 - DNA, 22 bp, Homo sapiens
gaggccacttcctactggagga

SEQ ID NO: 7141429 - DNA, 22 bp, Homo sapiens
gaggccactgtccctgccttcc

SEQ ID NO: 7141430 - DNA, 22 bp, Homo sapiens
gaggccacttcctactggagga

SEQ ID NO: 7141431 - DNA, 22 bp, Homo sapiens
gaggccagaagtctgagatcag

SEQ ID NO: 7141432 - DNA, 22 bp, Homo sapiens
gaggccagaagtctgagatcag

SEQ ID NO: 7141433 - DNA, 22 bp, Homo sapiens
gaggccagaagtctgagatcag

SEQ ID NO: 7141434 - DNA, 22 bp, Homo sapiens
gaggccagaagtctgagatcag

SEQ ID NO: 7141435 - DNA, 22 bp, Homo sapiens
gaggccagaagtgcctcgggct

SEQ ID NO: 7141436 - DNA, 22 bp, Homo sapiens
gaggccagaagtgcctcgggct

SEQ ID NO: 7141437 - DNA, 22 bp, Homo sapiens
gaggccagaatgagctgaatgc

SEQ ID NO: 7141438 - DNA, 22 bp, Homo sapiens
gaggccagaatgagtctctggg

SEQ ID NO: 7141439 - DNA, 22 bp, Homo sapiens
gaggccagaatgagtctctggg

SEQ ID NO: 7141440 - DNA, 22 bp, Homo sapiens
gaggccagaatgagctgaatgc

SEQ ID NO: 7141441 - DNA, 22 bp, Homo sapiens
gaggccagaagtgcctcgggct

SEQ ID NO: 7141442 - DNA, 22 bp, Homo sapiens
gaggccagaatgagctgaatgc

SEQ ID NO: 7141443 - DNA, 22 bp, Homo sapiens
gaggccagaatgagctgaatgc

SEQ ID NO: 7141444 - DNA, 22 bp, Homo sapiens
gaggccagaagtgcctcgggct

SEQ ID NO: 7141445 - DNA, 22 bp, Homo sapiens
gaggccagaagtgcctcgggct

SEQ ID NO: 7141446 - DNA, 22 bp, Homo sapiens
gaggccagaatgagtctctggg

SEQ ID NO: 7141447 - DNA, 22 bp, Homo sapiens
gaggccagaatgagtctctggg

SEQ ID NO: 7141448 - DNA, 22 bp, Homo sapiens
gaggccagaatgagtctctggg

SEQ ID NO: 7141449 - DNA, 22 bp, Homo sapiens
gaggccagaatgagtctctggg

SEQ ID NO: 7141450 - DNA, 22 bp, Homo sapiens
gaggccagactgccttttatga

SEQ ID NO: 7141451 - DNA, 22 bp, Homo sapiens
gaggccagagttccccgagtca

SEQ ID NO: 7141452 - DNA, 22 bp, Homo sapiens
gaggccagatactctcttctgc

SEQ ID NO: 7141453 - DNA, 22 bp, Homo sapiens
gaggccagatactctcttctgc

SEQ ID NO: 7141454 - DNA, 22 bp, Homo sapiens
gaggcctggagccgcctaggcg

SEQ ID NO: 7141455 - DNA, 22 bp, Homo sapiens
gaggcctggagccgcctaggcg

SEQ ID NO: 7141456 - DNA, 22 bp, Homo sapiens
gaggcctgggttggaggtgcat

SEQ ID NO: 7141457 - DNA, 22 bp, Homo sapiens
gaggcctggaccagccacagag

SEQ ID NO: 7141458 - DNA, 22 bp, Homo sapiens
gaggcctggaccagccacagag

SEQ ID NO: 7141459 - DNA, 22 bp, Homo sapiens
gaggccagatactctcttctgc

SEQ ID NO: 7141460 - DNA, 22 bp, Homo sapiens
gaggcctggaattccagcctgg

SEQ ID NO: 7141461 - DNA, 22 bp, Homo sapiens
gaggcctggaccagccacagag

SEQ ID NO: 7141462 - DNA, 22 bp, Homo sapiens
gaggcctggaccagccacagag

SEQ ID NO: 7141463 - DNA, 22 bp, Homo sapiens
gaggagtggagttgctgggttg

SEQ ID NO: 7141464 - DNA, 22 bp, Homo sapiens
gaggagtggagttgctgggttg

SEQ ID NO: 7141465 - DNA, 22 bp, Homo sapiens
gaggagtgccagccgtggagtc

SEQ ID NO: 7141466 - DNA, 22 bp, Homo sapiens
gaggagtgccagccgtggagtc

SEQ ID NO: 7141467 - DNA, 22 bp, Homo sapiens
gaggagtgccagccgtggagtc

SEQ ID NO: 7141468 - DNA, 22 bp, Homo sapiens
gaggagtgccagccgtggagtc

SEQ ID NO: 7141469 - DNA, 22 bp, Homo sapiens
gaggagtctttccctaagtcct

SEQ ID NO: 7141470 - DNA, 22 bp, Homo sapiens
gaggagtctttttagggcctga

SEQ ID NO: 7141471 - DNA, 22 bp, Homo sapiens
gaggagtctttttagggcctga

SEQ ID NO: 7141472 - DNA, 22 bp, Homo sapiens
gaggagtctagtttatggcttc

SEQ ID NO: 7141473 - DNA, 22 bp, Homo sapiens
gaggaggttgacggcactgtga

SEQ ID NO: 7141474 - DNA, 22 bp, Homo sapiens
gaggaggttccgggtggagaag

SEQ ID NO: 7141475 - DNA, 22 bp, Homo sapiens
gaggaggttccgggtggagaag

SEQ ID NO: 7141476 - DNA, 22 bp, Homo sapiens
gaggaggtggagtcatgcagag

SEQ ID NO: 7141477 - DNA, 22 bp, Homo sapiens
gaggaggtggagtcatgcagag

SEQ ID NO: 7141478 - DNA, 22 bp, Homo sapiens
gaggaggtggagtcatgcagag

SEQ ID NO: 7141479 - DNA, 22 bp, Homo sapiens
gaggaggttccgggtggagaag

SEQ ID NO: 7141480 - DNA, 22 bp, Homo sapiens
gaggaggttccgggtggagaag

SEQ ID NO: 7141481 - DNA, 22 bp, Homo sapiens
gaggaggttccgggtggagaag

SEQ ID NO: 7141482 - DNA, 22 bp, Homo sapiens
gaggaggtggagtcatgcagag

SEQ ID NO: 7141483 - DNA, 22 bp, Homo sapiens
gaggagagaagctaacggtgct

SEQ ID NO: 7141484 - DNA, 22 bp, Homo sapiens
gaggagagaagctaacggtgct

SEQ ID NO: 7141485 - DNA, 22 bp, Homo sapiens
gaggagagagggactgtctgca

SEQ ID NO: 7141486 - DNA, 22 bp, Homo sapiens
gaggatgctgcagtgcaggaca

SEQ ID NO: 7141487 - DNA, 19 bp, Homo sapiens
gaggatgctcggtcccagg

SEQ ID NO: 7141488 - DNA, 20 bp, Homo sapiens
gaggatgcagacagagggca

SEQ ID NO: 7141489 - DNA, 22 bp, Homo sapiens
gaggatgcctgggtcggggaag

SEQ ID NO: 7141490 - DNA, 22 bp, Homo sapiens
gaggagtggagttgctgggttg

SEQ ID NO: 7141491 - DNA, 22 bp, Homo sapiens
gaggagtgggttagtgcttatt

SEQ ID NO: 7141492 - DNA, 22 bp, Homo sapiens
gaggatggaggcagttagggcc

SEQ ID NO: 7141493 - DNA, 22 bp, Homo sapiens
gaggatggaggcagttagggcc

SEQ ID NO: 7141494 - DNA, 22 bp, Homo sapiens
gaggatggaggcagttagggcc

SEQ ID NO: 7141495 - DNA, 18 bp, Homo sapiens
gaggatggaaggagatgc

SEQ ID NO: 7141496 - DNA, 18 bp, Homo sapiens
gaggatggaaggagatgc

SEQ ID NO: 7141497 - DNA, 18 bp, Homo sapiens
gaggatggaaggagatgc

SEQ ID NO: 7141498 - DNA, 22 bp, Homo sapiens
gaggagacggggtgcctggagc

SEQ ID NO: 7141499 - DNA, 22 bp, Homo sapiens
gaggagaaattatccttggtgt

SEQ ID NO: 7141500 - DNA, 22 bp, Homo sapiens
gaggagacagtggagccgctac

SEQ ID NO: 7141501 - DNA, 22 bp, Homo sapiens
gaggagaaagcagtgatttgtg

SEQ ID NO: 7141502 - DNA, 22 bp, Homo sapiens
gaggactgcagatgggtgcatc

SEQ ID NO: 7141503 - DNA, 22 bp, Homo sapiens
gaggactgaaacttacaggaaa

SEQ ID NO: 7141504 - DNA, 22 bp, Homo sapiens
gaggactctttgagtctgacat

SEQ ID NO: 7141505 - DNA, 22 bp, Homo sapiens
gaggagactgacagcagattct

SEQ ID NO: 7141506 - DNA, 22 bp, Homo sapiens
gaggagactgacagcagattct

SEQ ID NO: 7141507 - DNA, 22 bp, Homo sapiens
gaggagacggggtgcctggagc

SEQ ID NO: 7141508 - DNA, 22 bp, Homo sapiens
gaggagactgacagcagattct

SEQ ID NO: 7141509 - DNA, 22 bp, Homo sapiens
gaggagagaacattcctccata

SEQ ID NO: 7141510 - DNA, 22 bp, Homo sapiens
gaggagagaacattcctccata

SEQ ID NO: 7141511 - DNA, 22 bp, Homo sapiens
gaggagagaagctaacggtgct

SEQ ID NO: 7141512 - DNA, 22 bp, Homo sapiens
gaggagagaagctaacggtgct

SEQ ID NO: 7141513 - DNA, 22 bp, Homo sapiens
gaggacagtgtgatctgccagc

SEQ ID NO: 7141514 - DNA, 22 bp, Homo sapiens
gaggacagtgtgatctgccagc

SEQ ID NO: 7141515 - DNA, 22 bp, Homo sapiens
gaggacagtgtgatctgccagc

SEQ ID NO: 7141516 - DNA, 22 bp, Homo sapiens
gaggacagtgtgatctgccagc

SEQ ID NO: 7141517 - DNA, 22 bp, Homo sapiens
gaggacagtgtgatctgccagc

SEQ ID NO: 7141518 - DNA, 22 bp, Homo sapiens
gaggacagtgtgatctgccagc

SEQ ID NO: 7141519 - DNA, 22 bp, Homo sapiens
gaggacagtgtgatctgccagc

SEQ ID NO: 7141520 - DNA, 17 bp, Homo sapiens
gaggacagggaagtagg

SEQ ID NO: 7141521 - DNA, 22 bp, Homo sapiens
gaggacagtgtgatctgccagc

SEQ ID NO: 7141522 - DNA, 22 bp, Homo sapiens
gaggacagtgtgatctgccagc

SEQ ID NO: 7141523 - DNA, 17 bp, Homo sapiens
gaggacagggaagtagg

SEQ ID NO: 7141524 - DNA, 17 bp, Homo sapiens
gaggacagggaagtagg

SEQ ID NO: 7141525 - DNA, 17 bp, Homo sapiens
gaggacagggaagtagg

SEQ ID NO: 7141526 - DNA, 17 bp, Homo sapiens
gaggacagggaagtagg

SEQ ID NO: 7141527 - DNA, 17 bp, Homo sapiens
gaggacagggaagtagg

SEQ ID NO: 7141528 - DNA, 22 bp, Homo sapiens
gaggacagtgtgatctgccagc

SEQ ID NO: 7141529 - DNA, 22 bp, Homo sapiens
gaggacatagtccagatggcaa

SEQ ID NO: 7141530 - DNA, 22 bp, Homo sapiens
gaggacatagtggactagggtt

SEQ ID NO: 7141531 - DNA, 22 bp, Homo sapiens
gaggacctttagtagaagtgca

SEQ ID NO: 7141532 - DNA, 22 bp, Homo sapiens
gaggacctttagtagaagtgca

SEQ ID NO: 7141533 - DNA, 22 bp, Homo sapiens
gaggacctggaatccaagagtc

SEQ ID NO: 7141534 - DNA, 22 bp, Homo sapiens
gaggaccactgcttagtaagat

SEQ ID NO: 7141535 - DNA, 22 bp, Homo sapiens
gaggacgggcttcatggggcct

SEQ ID NO: 7141536 - DNA, 22 bp, Homo sapiens
gagctggtcgaaatgggctgac

SEQ ID NO: 7141537 - DNA, 22 bp, Homo sapiens
gagctggtgctgtgcctgttct

SEQ ID NO: 7141538 - DNA, 22 bp, Homo sapiens
gagctggtgatcagctggagga

SEQ ID NO: 7141539 - DNA, 22 bp, Homo sapiens
gagctggtgtgtgcccaagcac

SEQ ID NO: 7141540 - DNA, 22 bp, Homo sapiens
gagctggtaaaggatcttgtct

SEQ ID NO: 7141541 - DNA, 22 bp, Homo sapiens
gagctgggtctccaccttggca

SEQ ID NO: 7141542 - DNA, 22 bp, Homo sapiens
gagctgggtctccaccttggca

SEQ ID NO: 7141543 - DNA, 22 bp, Homo sapiens
gagctgggtatatggctttatg

SEQ ID NO: 7141544 - DNA, 22 bp, Homo sapiens
gagctgggtgtttatttgccaa

SEQ ID NO: 7141545 - DNA, 22 bp, Homo sapiens
gagctgggtgtttatttgccaa

SEQ ID NO: 7141546 - DNA, 22 bp, Homo sapiens
gagctcccaggccccagcaagg

SEQ ID NO: 7141547 - DNA, 22 bp, Homo sapiens
gagctcccaggccccagcaagg

SEQ ID NO: 7141548 - DNA, 22 bp, Homo sapiens
gagctcccaggccccagcaagg

SEQ ID NO: 7141549 - DNA, 22 bp, Homo sapiens
gagctcctatggtcggtggctc

SEQ ID NO: 7141550 - DNA, 22 bp, Homo sapiens
gagctcctcccagggtagcact

SEQ ID NO: 7141551 - DNA, 22 bp, Homo sapiens
gagctcctgaaacgttcctgcc

SEQ ID NO: 7141552 - DNA, 22 bp, Homo sapiens
gagctcctgaaacgttcctgcc

SEQ ID NO: 7141553 - DNA, 22 bp, Homo sapiens
gagctcctgctgcatcctgcct

SEQ ID NO: 7141554 - DNA, 22 bp, Homo sapiens
gagctcctgctgcatcctgcct

SEQ ID NO: 7141555 - DNA, 22 bp, Homo sapiens
gagctgggattcatctatgtct

SEQ ID NO: 7141556 - DNA, 22 bp, Homo sapiens
gagctgggatttgaacctggga

SEQ ID NO: 7141557 - DNA, 22 bp, Homo sapiens
gagctctaaccagggacaatta

SEQ ID NO: 7141558 - DNA, 22 bp, Homo sapiens
gagctgggatttgaacctggga

SEQ ID NO: 7141559 - DNA, 22 bp, Homo sapiens
gagctgggcacacgccacttga

SEQ ID NO: 7141560 - DNA, 22 bp, Homo sapiens
gagctgggcctcagaacacagt

SEQ ID NO: 7141561 - DNA, 22 bp, Homo sapiens
gagctgggcctcagaacacagt

SEQ ID NO: 7141562 - DNA, 22 bp, Homo sapiens
gagctgggtatatggctttatg

SEQ ID NO: 7141563 - DNA, 20 bp, Homo sapiens
gagctgtgctctcaggagcc

SEQ ID NO: 7141564 - DNA, 22 bp, Homo sapiens
gagctgtgccaatctgtctggg

SEQ ID NO: 7141565 - DNA, 22 bp, Homo sapiens
gagctgtgcttataccaattca

SEQ ID NO: 7141566 - DNA, 22 bp, Homo sapiens
gagctgtggaaggcagggacca

SEQ ID NO: 7141567 - DNA, 17 bp, Homo sapiens
gaggacagggaagtagg

SEQ ID NO: 7141568 - DNA, 17 bp, Homo sapiens
gaggacagggaagtagg

SEQ ID NO: 7141569 - DNA, 22 bp, Homo sapiens
gaggacaggagactcactgttt

SEQ ID NO: 7141570 - DNA, 22 bp, Homo sapiens
gaggacaggagactcactgttt

SEQ ID NO: 7141571 - DNA, 17 bp, Homo sapiens
gaggacagggaagtagg

SEQ ID NO: 7141572 - DNA, 17 bp, Homo sapiens
gaggacagggaagtagg

SEQ ID NO: 7141573 - DNA, 17 bp, Homo sapiens
gaggacagggaagtagg

SEQ ID NO: 7141574 - DNA, 22 bp, Homo sapiens
gaggacaggagactcactgttt

SEQ ID NO: 7141575 - DNA, 22 bp, Homo sapiens
gaggacaggagactcactgttt

SEQ ID NO: 7141576 - DNA, 22 bp, Homo sapiens
gagctgtgtgcctggatggtct

SEQ ID NO: 7141577 - DNA, 22 bp, Homo sapiens
gagctgtccgcccctgggccga

SEQ ID NO: 7141578 - DNA, 22 bp, Homo sapiens
gagctggtgtgtgcccgagcac

SEQ ID NO: 7141579 - DNA, 22 bp, Homo sapiens
gagctggttttaggctatgtct

SEQ ID NO: 7141580 - DNA, 22 bp, Homo sapiens
gagctgtctggggactctgggt

SEQ ID NO: 7141581 - DNA, 22 bp, Homo sapiens
gagctgtgaaaagtgcctgggg

SEQ ID NO: 7141582 - DNA, 22 bp, Homo sapiens
gagctgtgaaaagtgcctgggg

SEQ ID NO: 7141583 - DNA, 22 bp, Homo sapiens
gagctgtgattggtgtctcact

SEQ ID NO: 7141584 - DNA, 22 bp, Homo sapiens
gagctgtgattggtgtctcact

SEQ ID NO: 7141585 - DNA, 22 bp, Homo sapiens
gagctcagtgtagtcatggctt

SEQ ID NO: 7141586 - DNA, 22 bp, Homo sapiens
gagctcatccccatggtccgtc

SEQ ID NO: 7141587 - DNA, 22 bp, Homo sapiens
gagctcatccccatggtccgtc

SEQ ID NO: 7141588 - DNA, 22 bp, Homo sapiens
gagctcatccccatggtccgtc

SEQ ID NO: 7141589 - DNA, 22 bp, Homo sapiens
gagctcaggtggtcaaaacaat

SEQ ID NO: 7141590 - DNA, 22 bp, Homo sapiens
gagctcagtgtagtcatggctt

SEQ ID NO: 7141591 - DNA, 22 bp, Homo sapiens
gagctcaggtggtcaaaacaat

SEQ ID NO: 7141592 - DNA, 23 bp, Homo sapiens
gagctcaggtagggctcgcccgc

SEQ ID NO: 7141593 - DNA, 22 bp, Homo sapiens
gagctcagggcattgagcaaga

SEQ ID NO: 7141594 - DNA, 22 bp, Homo sapiens
gagctcagggcattgagcaaga

SEQ ID NO: 7141595 - DNA, 23 bp, Homo sapiens
gagctcaggtagggctcgcccgc

SEQ ID NO: 7141596 - DNA, 23 bp, Homo sapiens
gagctcaggtagggctcgcccgc

SEQ ID NO: 7141597 - DNA, 23 bp, Homo sapiens
gagctcaggtagggctcgcccgc

SEQ ID NO: 7141598 - DNA, 22 bp, Homo sapiens
gagctcaggtggtcaaaacaat

SEQ ID NO: 7141599 - DNA, 22 bp, Homo sapiens
gagctcattcattcattgcctg

SEQ ID NO: 7141600 - DNA, 22 bp, Homo sapiens
gagctccacttagcaaggccac

SEQ ID NO: 7141601 - DNA, 22 bp, Homo sapiens
gagctcagattctggtgtcaga

SEQ ID NO: 7141602 - DNA, 22 bp, Homo sapiens
gagctcagaggcgtctttgtcc

SEQ ID NO: 7141603 - DNA, 22 bp, Homo sapiens
gagctcagcaaaggtctgtgtg

SEQ ID NO: 7141604 - DNA, 22 bp, Homo sapiens
gagctcagcaaaggtctgtgtg

SEQ ID NO: 7141605 - DNA, 22 bp, Homo sapiens
gagctcagcaaaggtctgtgtg

SEQ ID NO: 7141606 - DNA, 22 bp, Homo sapiens
gagctcagcactaaaatcatgt

SEQ ID NO: 7141607 - DNA, 22 bp, Homo sapiens
gagctcagcccaaagagcagtg

SEQ ID NO: 7141608 - DNA, 22 bp, Homo sapiens
gagctcagcccaaagagcagtg

SEQ ID NO: 7141609 - DNA, 22 bp, Homo sapiens
gagctcagcactaaaatcatgt

SEQ ID NO: 7141610 - DNA, 22 bp, Homo sapiens
gagctcagcccaaagagcagtg

SEQ ID NO: 7141611 - DNA, 18 bp, Homo sapiens
gagctcagcgtgtttcta

SEQ ID NO: 7141612 - DNA, 22 bp, Homo sapiens
gagctcaggagcatcagaagaa

SEQ ID NO: 7141613 - DNA, 22 bp, Homo sapiens
gagctcaggagcatcagaagaa

SEQ ID NO: 7141614 - DNA, 22 bp, Homo sapiens
gagctcagcccaaagagcagtg

SEQ ID NO: 7141615 - DNA, 22 bp, Homo sapiens
gagctcagcccaaagagcagtg

SEQ ID NO: 7141616 - DNA, 22 bp, Homo sapiens
gagctcagcctgaggcctggct

SEQ ID NO: 7141617 - DNA, 22 bp, Homo sapiens
gagctcagcctgaggcctggct

SEQ ID NO: 7141618 - DNA, 22 bp, Homo sapiens
gagctcagcccaaagagcagtg

SEQ ID NO: 7141619 - DNA, 22 bp, Homo sapiens
gagctcagcccaaagagcagtg

SEQ ID NO: 7141620 - DNA, 22 bp, Homo sapiens
gagcaggcattctagtggctga

SEQ ID NO: 7141621 - DNA, 22 bp, Homo sapiens
gagcaggcattctagtggctga

SEQ ID NO: 7141622 - DNA, 22 bp, Homo sapiens
gagcaggcattctagtggctga

SEQ ID NO: 7141623 - DNA, 19 bp, Homo sapiens
gagcaggccacacatgtgt

SEQ ID NO: 7141624 - DNA, 22 bp, Homo sapiens
gagcaggcaactctgcagtgcc

SEQ ID NO: 7141625 - DNA, 22 bp, Homo sapiens
gagcaggcaactctgcagtgcc

SEQ ID NO: 7141626 - DNA, 22 bp, Homo sapiens
gagcaggcattctagtggctga

SEQ ID NO: 7141627 - DNA, 22 bp, Homo sapiens
gagcaggcattctagtggctga

SEQ ID NO: 7141628 - DNA, 22 bp, Homo sapiens
gagcaggcattctagtggctga

SEQ ID NO: 7141629 - DNA, 22 bp, Homo sapiens
gagcaggatgggagctggggcc

SEQ ID NO: 7141630 - DNA, 22 bp, Homo sapiens
gagcaggatgggagctggggcc

SEQ ID NO: 7141631 - DNA, 22 bp, Homo sapiens
gagcaggatgggagctggggcc

SEQ ID NO: 7141632 - DNA, 22 bp, Homo sapiens
gagcaggacgtgggaatgggaa

SEQ ID NO: 7141633 - DNA, 22 bp, Homo sapiens
gagcaggacgtgggaatgggaa

SEQ ID NO: 7141634 - DNA, 22 bp, Homo sapiens
gagcaggcaaagatgaaaggag

SEQ ID NO: 7141635 - DNA, 22 bp, Homo sapiens
gagcaggcaaagatgaaaggag

SEQ ID NO: 7141636 - DNA, 22 bp, Homo sapiens
gagcaggcaactctgcagtgcc

SEQ ID NO: 7141637 - DNA, 22 bp, Homo sapiens
gagcaggcaactctgcagtgcc

SEQ ID NO: 7141638 - DNA, 22 bp, Homo sapiens
gagcaggcaactctgcagtgcc

SEQ ID NO: 7141639 - DNA, 22 bp, Homo sapiens
gagctcagaggcgtctttgtcc

SEQ ID NO: 7141640 - DNA, 22 bp, Homo sapiens
gagctcagaggattctggggag

SEQ ID NO: 7141641 - DNA, 22 bp, Homo sapiens
gagctcagaggattctggggag

SEQ ID NO: 7141642 - DNA, 22 bp, Homo sapiens
gagctcagagcctatagttggt

SEQ ID NO: 7141643 - DNA, 22 bp, Homo sapiens
gagcaggctctgcctgtgtgtc

SEQ ID NO: 7141644 - DNA, 22 bp, Homo sapiens
gagcaggctctgcctgtgtgtc

SEQ ID NO: 7141645 - DNA, 22 bp, Homo sapiens
gagcaggccagcaatggaaggg

SEQ ID NO: 7141646 - DNA, 22 bp, Homo sapiens
gagcaggccagcaatggaaggg

SEQ ID NO: 7141647 - DNA, 22 bp, Homo sapiens
gagcaggccagcaatggaaggg

SEQ ID NO: 7141648 - DNA, 22 bp, Homo sapiens
gagcaggcctggggtgaggcct

SEQ ID NO: 7141649 - DNA, 22 bp, Homo sapiens
gagcaggcctggggtgaggcct

SEQ ID NO: 7141650 - DNA, 22 bp, Homo sapiens
gagcaggcctggggtgaggcct

SEQ ID NO: 7141651 - DNA, 22 bp, Homo sapiens
gagcaggcctggggtgaggcct

SEQ ID NO: 7141652 - DNA, 22 bp, Homo sapiens
gagcaggcctggggtgaggcct

SEQ ID NO: 7141653 - DNA, 22 bp, Homo sapiens
gagcaggcctggggtgaggcct

SEQ ID NO: 7141654 - DNA, 22 bp, Homo sapiens
gaaagaatcaactatgtctctg

SEQ ID NO: 7141655 - DNA, 22 bp, Homo sapiens
gaaagaatcaactatgtctctg

SEQ ID NO: 7141656 - DNA, 22 bp, Homo sapiens
gaaagaatgagcatcatgactt

SEQ ID NO: 7141657 - DNA, 22 bp, Homo sapiens
gaaagaatgctatagtgacttc

SEQ ID NO: 7141658 - DNA, 22 bp, Homo sapiens
gaaagaatgctatagtgacttc

SEQ ID NO: 7141659 - DNA, 22 bp, Homo sapiens
gaaagaatgctgggagccatct

SEQ ID NO: 7141660 - DNA, 22 bp, Homo sapiens
gaaagaatgctgggagccatct

SEQ ID NO: 7141661 - DNA, 22 bp, Homo sapiens
gaaagaatgctgggagccatct

SEQ ID NO: 7141662 - DNA, 22 bp, Homo sapiens
gaaacttcttgtctcacagttc

SEQ ID NO: 7141663 - DNA, 22 bp, Homo sapiens
gaaactgggaagtcccagatca

SEQ ID NO: 7141664 - DNA, 22 bp, Homo sapiens
gaaacttgataattgaaacaga

SEQ ID NO: 7141665 - DNA, 22 bp, Homo sapiens
gaaacttgataattgaaacaga

SEQ ID NO: 7141666 - DNA, 22 bp, Homo sapiens
gaaacttgataattgaaacaga

SEQ ID NO: 7141667 - DNA, 22 bp, Homo sapiens
gaaacttgcctgaagtcaacca

SEQ ID NO: 7141668 - DNA, 22 bp, Homo sapiens
gaaactttggctaaaagccaga

SEQ ID NO: 7141669 - DNA, 22 bp, Homo sapiens
gaaacctttgccgatggggtcc

SEQ ID NO: 7141670 - DNA, 21 bp, Homo sapiens
gaaaccaggttatcaatcaca

SEQ ID NO: 7141671 - DNA, 21 bp, Homo sapiens
gaaaccaggttatcaatcaca

SEQ ID NO: 7141672 - DNA, 22 bp, Homo sapiens
gaaaccatgcaagctgctagag

SEQ ID NO: 7141673 - DNA, 22 bp, Homo sapiens
gaaacccaaactaagacagtag

SEQ ID NO: 7141674 - DNA, 22 bp, Homo sapiens
gaaaccctgagaggtggtctgg

SEQ ID NO: 7141675 - DNA, 22 bp, Homo sapiens
gaaactggatgcagggatgcag

SEQ ID NO: 7141676 - DNA, 22 bp, Homo sapiens
gaaactggatgcagggatgcag

SEQ ID NO: 7141677 - DNA, 22 bp, Homo sapiens
gaaactctcgcatcctgggaac

SEQ ID NO: 7141678 - DNA, 22 bp, Homo sapiens
gaaactctcgcatcctgggaac

SEQ ID NO: 7141679 - DNA, 22 bp, Homo sapiens
gaaacagctttaagtgatactg

SEQ ID NO: 7141680 - DNA, 22 bp, Homo sapiens
gaaaccagcatttaaaccagga

SEQ ID NO: 7141681 - DNA, 22 bp, Homo sapiens
gaaacagctagaaagccattgg

SEQ ID NO: 7141682 - DNA, 22 bp, Homo sapiens
gaaacagcccctgtgtgaagca

SEQ ID NO: 7141683 - DNA, 22 bp, Homo sapiens
gaaacagcacgtttggagagat

SEQ ID NO: 7141684 - DNA, 22 bp, Homo sapiens
gaaaacactttgatctgaaagt

SEQ ID NO: 7141685 - DNA, 22 bp, Homo sapiens
gaaaacactttgatctgaaagt

SEQ ID NO: 7141686 - DNA, 22 bp, Homo sapiens
gaaaaatgctccaaatctgtgg

SEQ ID NO: 7141687 - DNA, 22 bp, Homo sapiens
gaaaaatgctccaaatctgtgg

SEQ ID NO: 7141688 - DNA, 22 bp, Homo sapiens
gaaaaatgctccaaatctgtgg

SEQ ID NO: 7141689 - DNA, 22 bp, Homo sapiens
gaaaaatgagctgatgtcaggg

SEQ ID NO: 7141690 - DNA, 22 bp, Homo sapiens
gaaaaatgagctgatgtcaggg

SEQ ID NO: 7141691 - DNA, 22 bp, Homo sapiens
gaaaaatgagctgatgtcaggg

SEQ ID NO: 7141692 - DNA, 22 bp, Homo sapiens
gaaaaatgagctgatgtcaggg

SEQ ID NO: 7141693 - DNA, 22 bp, Homo sapiens
gaaaaatgagctgatgtcaggg

SEQ ID NO: 7141694 - DNA, 22 bp, Homo sapiens
gaaaaatgagctgatgtcaggg

SEQ ID NO: 7141695 - DNA, 22 bp, Homo sapiens
gaaaaagtgaccttggtagcta

SEQ ID NO: 7141696 - DNA, 22 bp, Homo sapiens
cttttttcctaaggcaacatga

SEQ ID NO: 7141697 - DNA, 22 bp, Homo sapiens
cttttttcctaaggcaacatga

SEQ ID NO: 7141698 - DNA, 22 bp, Homo sapiens
gaaaaaggataaatacagtgtt

SEQ ID NO: 7141699 - DNA, 22 bp, Homo sapiens
gaaaaaggataaatacagtgtt

SEQ ID NO: 7141700 - DNA, 22 bp, Homo sapiens
ctttttgttgtataagcccttt

SEQ ID NO: 7141701 - DNA, 22 bp, Homo sapiens
ctttttgttgtataagcccttt

SEQ ID NO: 7141702 - DNA, 22 bp, Homo sapiens
ctttttgttgtataagcccttt

SEQ ID NO: 7141703 - DNA, 22 bp, Homo sapiens
ctttttgtctctgtcctgatga

SEQ ID NO: 7141704 - DNA, 22 bp, Homo sapiens
ctttttgtgtatgctacagttg

SEQ ID NO: 7141705 - DNA, 22 bp, Homo sapiens
ctttttgtgtatgctacagttg

SEQ ID NO: 7141706 - DNA, 22 bp, Homo sapiens
ctttttgtgtatgctacagttg

SEQ ID NO: 7141707 - DNA, 22 bp, Homo sapiens
cttttttaaggtagctcctcct

SEQ ID NO: 7141708 - DNA, 22 bp, Homo sapiens
cttttttaaggtagctcctcct

SEQ ID NO: 7141709 - DNA, 22 bp, Homo sapiens
ctttttgttgtccacactagga

SEQ ID NO: 7141710 - DNA, 22 bp, Homo sapiens
cttttttcctaaggcaacatga

SEQ ID NO: 7141711 - DNA, 22 bp, Homo sapiens
ctttggaatattttattgagaa

SEQ ID NO: 7141712 - DNA, 22 bp, Homo sapiens
ctttggaagtaaagtcagcagg

SEQ ID NO: 7141713 - DNA, 22 bp, Homo sapiens
ctttggaagtaaagtcagcagg

SEQ ID NO: 7141714 - DNA, 22 bp, Homo sapiens
ctttggaaggtcgtccgtgtgg

SEQ ID NO: 7141715 - DNA, 22 bp, Homo sapiens
ctttggcaagggttttaattgt

SEQ ID NO: 7141716 - DNA, 22 bp, Homo sapiens
ctttggcaatgaaacacaagaa

SEQ ID NO: 7141717 - DNA, 22 bp, Homo sapiens
ctttggcaatgaaacacaagaa

SEQ ID NO: 7141718 - DNA, 22 bp, Homo sapiens
ctttggcaacacatgtgggaca

SEQ ID NO: 7141719 - DNA, 21 bp, Homo sapiens
ctttggcaagggagaagtcac

SEQ ID NO: 7141720 - DNA, 22 bp, Homo sapiens
ctttggcaacacatgtgggaca

SEQ ID NO: 7141721 - DNA, 22 bp, Homo sapiens
ctttggaatgcacagaggtgta

SEQ ID NO: 7141722 - DNA, 22 bp, Homo sapiens
ctttggagaaaagttcttgggc

SEQ ID NO: 7141723 - DNA, 22 bp, Homo sapiens
ctttggagaagaatgcatcctt

SEQ ID NO: 7141724 - DNA, 22 bp, Homo sapiens
ctttggagaagaatgcatcctt

SEQ ID NO: 7141725 - DNA, 22 bp, Homo sapiens
ctttggagggcctttcctagcc

SEQ ID NO: 7141726 - DNA, 22 bp, Homo sapiens
ctttggaggtcatagccaagag

SEQ ID NO: 7141727 - DNA, 22 bp, Homo sapiens
cttttgttaggagaaaacatca

SEQ ID NO: 7141728 - DNA, 22 bp, Homo sapiens
ctttggcagacattaggggtga

SEQ ID NO: 7141729 - DNA, 22 bp, Homo sapiens
cttttgttaggagaaaacatca

SEQ ID NO: 7141730 - DNA, 22 bp, Homo sapiens
cttttgttctacagctggggaa

SEQ ID NO: 7141731 - DNA, 22 bp, Homo sapiens
cttttgttctacagctggggaa

SEQ ID NO: 7141732 - DNA, 22 bp, Homo sapiens
ctttttcccaggtggagagagg

SEQ ID NO: 7141733 - DNA, 22 bp, Homo sapiens
ctttggcacagtgtttactagc

SEQ ID NO: 7141734 - DNA, 22 bp, Homo sapiens
ctttggcactgcgcagccattt

SEQ ID NO: 7141735 - DNA, 22 bp, Homo sapiens
ctttggcactgcgcagccattt

SEQ ID NO: 7141736 - DNA, 23 bp, Homo sapiens
ctttggcactttacaataaactc

SEQ ID NO: 7141737 - DNA, 23 bp, Homo sapiens
ctttggcactttacaataaactc

SEQ ID NO: 7141738 - DNA, 22 bp, Homo sapiens
ctttggcaatgtcattttcaat

SEQ ID NO: 7141739 - DNA, 22 bp, Homo sapiens
ctttggcacagtctcatttgat

SEQ ID NO: 7141740 - DNA, 22 bp, Homo sapiens
ctttggcacagtctcatttgat

SEQ ID NO: 7141741 - DNA, 22 bp, Homo sapiens
ctttggcaatgaaacacaagaa

SEQ ID NO: 7141742 - DNA, 20 bp, Homo sapiens
ctttggcaatgagaacaggg

SEQ ID NO: 7141743 - DNA, 22 bp, Homo sapiens
ctttttctaatcataattgtct

SEQ ID NO: 7141744 - DNA, 22 bp, Homo sapiens
ctttttctaatcataattgtct

SEQ ID NO: 7141745 - DNA, 22 bp, Homo sapiens
ctttttcctcgtagagcctaat

SEQ ID NO: 7141746 - DNA, 20 bp, Homo sapiens
ctttttctccagctctgagc

SEQ ID NO: 7141747 - DNA, 20 bp, Homo sapiens
ctttttctccagctctgagc

SEQ ID NO: 7141748 - DNA, 20 bp, Homo sapiens
ctttttctccagctctgagc

SEQ ID NO: 7141749 - DNA, 22 bp, Homo sapiens
ctttttctgatgttccatgatt

SEQ ID NO: 7141750 - DNA, 22 bp, Homo sapiens
ctttttctgatgttccatgatt

SEQ ID NO: 7141751 - DNA, 16 bp, Homo sapiens
ctttttctcccctctt

SEQ ID NO: 7141752 - DNA, 22 bp, Homo sapiens
ctttttctgatgttccatgatt

SEQ ID NO: 7141753 - DNA, 22 bp, Homo sapiens
ctttttctgatgttccatgatt

SEQ ID NO: 7141754 - DNA, 22 bp, Homo sapiens
ctttttctgatgttccatgatt

SEQ ID NO: 7141755 - DNA, 22 bp, Homo sapiens
ctttttgcaagagtttctcatc

SEQ ID NO: 7141756 - DNA, 22 bp, Homo sapiens
ctttttgtctctgtcctgatga

SEQ ID NO: 7141757 - DNA, 22 bp, Homo sapiens
ctttttgtctctgtcctgatga

SEQ ID NO: 7141758 - DNA, 22 bp, Homo sapiens
ctttttcttctaggtgtgcctg

SEQ ID NO: 7141759 - DNA, 22 bp, Homo sapiens
gaaagactcttgatgtctttgg

SEQ ID NO: 7141760 - DNA, 22 bp, Homo sapiens
gaaagactgtaggattttgaat

SEQ ID NO: 7141761 - DNA, 22 bp, Homo sapiens
gaaagacatagttgcaagatgg

SEQ ID NO: 7141762 - DNA, 22 bp, Homo sapiens
gaaagaatgctgggagccatct

SEQ ID NO: 7141763 - DNA, 22 bp, Homo sapiens
gaaagacatagttgcaagatgg

SEQ ID NO: 7141764 - DNA, 22 bp, Homo sapiens
gaaagacatagttgcaagatgg

SEQ ID NO: 7141765 - DNA, 22 bp, Homo sapiens
gaaatacaggaatgccacacag

SEQ ID NO: 7141766 - DNA, 22 bp, Homo sapiens
gaaatacaggaatgccacacag

SEQ ID NO: 7141767 - DNA, 22 bp, Homo sapiens
gaaatacaggaatgccacacag

SEQ ID NO: 7141768 - DNA, 22 bp, Homo sapiens
gaaatattacagtggaggggat

SEQ ID NO: 7141769 - DNA, 22 bp, Homo sapiens
gaaatattacagtggaggggat

SEQ ID NO: 7141770 - DNA, 22 bp, Homo sapiens
gaaatatacattgcaggaagag

SEQ ID NO: 7141771 - DNA, 22 bp, Homo sapiens
gaaatatacattgcaggaagag

SEQ ID NO: 7141772 - DNA, 22 bp, Homo sapiens
gaaatatacattgcaggaagag

SEQ ID NO: 7141773 - DNA, 22 bp, Homo sapiens
gaaatattcttgtcttgttttc

SEQ ID NO: 7141774 - DNA, 22 bp, Homo sapiens
gaaatattgggactcagagctt

SEQ ID NO: 7141775 - DNA, 22 bp, Homo sapiens
gaaatattgggactcagagctt

SEQ ID NO: 7141776 - DNA, 22 bp, Homo sapiens
gaaatattcttgtcttgttttc

SEQ ID NO: 7141777 - DNA, 22 bp, Homo sapiens
gaaatattcttgtcttgttttc

SEQ ID NO: 7141778 - DNA, 22 bp, Homo sapiens
gaaatattcttgtcttgttttc

SEQ ID NO: 7141779 - DNA, 22 bp, Homo sapiens
gaaatattcttgtcttgttttc

SEQ ID NO: 7141780 - DNA, 22 bp, Homo sapiens
gaaatgtctttgacaagagagg

SEQ ID NO: 7141781 - DNA, 22 bp, Homo sapiens
gaaatgtgcagaatgtgttaga

SEQ ID NO: 7141782 - DNA, 22 bp, Homo sapiens
gaaatgtctttgacaagagagg

SEQ ID NO: 7141783 - DNA, 22 bp, Homo sapiens
gaaatgtatttgacagtccttg

SEQ ID NO: 7141784 - DNA, 22 bp, Homo sapiens
gaaatgtatttgacagtccttg

SEQ ID NO: 7141785 - DNA, 22 bp, Homo sapiens
gaaatgtcatagtcttcaagcc

SEQ ID NO: 7141786 - DNA, 22 bp, Homo sapiens
gaaatgtatgtcttcccccatt

SEQ ID NO: 7141787 - DNA, 20 bp, Homo sapiens
gaaatgtatctcttgattct

SEQ ID NO: 7141788 - DNA, 22 bp, Homo sapiens
gaaatgtatgtcttcccccatt

SEQ ID NO: 7141789 - DNA, 22 bp, Homo sapiens
gaaatgtatttgacagtccttg

SEQ ID NO: 7141790 - DNA, 20 bp, Homo sapiens
gaaatgtatctcttgattct

SEQ ID NO: 7141791 - DNA, 20 bp, Homo sapiens
gaaatgtatctcttgattct

SEQ ID NO: 7141792 - DNA, 22 bp, Homo sapiens
gaaatgtataagctggtctttt

SEQ ID NO: 7141793 - DNA, 22 bp, Homo sapiens
gaaatgtaggcataattatttt

SEQ ID NO: 7141794 - DNA, 22 bp, Homo sapiens
gaaatattgggactcagagctt

SEQ ID NO: 7141795 - DNA, 22 bp, Homo sapiens
gaaatattgtactggagatgtt

SEQ ID NO: 7141796 - DNA, 22 bp, Homo sapiens
gaaatattgtactggagatgtt

SEQ ID NO: 7141797 - DNA, 22 bp, Homo sapiens
gaaatgtaggcataattatttt

SEQ ID NO: 7141798 - DNA, 22 bp, Homo sapiens
gaaatgtagagtatctgaggat

SEQ ID NO: 7141799 - DNA, 22 bp, Homo sapiens
gaaatgtaggcataattatttt

SEQ ID NO: 7141800 - DNA, 22 bp, Homo sapiens
gaaatgtagaattgcttaactg

SEQ ID NO: 7141801 - DNA, 22 bp, Homo sapiens
gaaatgtagaattgcttaactg

SEQ ID NO: 7141802 - DNA, 22 bp, Homo sapiens
gaaatatttctcttgagcccct

SEQ ID NO: 7141803 - DNA, 19 bp, Homo sapiens
gaagaagcttgagaagtag

SEQ ID NO: 7141804 - DNA, 22 bp, Homo sapiens
gaagaagcaggagtgtgtagca

SEQ ID NO: 7141805 - DNA, 19 bp, Homo sapiens
gaagaagcttgagaagtag

SEQ ID NO: 7141806 - DNA, 22 bp, Homo sapiens
gaagaagggagtgacaaatgca

SEQ ID NO: 7141807 - DNA, 22 bp, Homo sapiens
gaagaagcaggagtgtgtagca

SEQ ID NO: 7141808 - DNA, 22 bp, Homo sapiens
gaagaagagataatggggagca

SEQ ID NO: 7141809 - DNA, 22 bp, Homo sapiens
gaagaagacatggaacaatagt

SEQ ID NO: 7141810 - DNA, 22 bp, Homo sapiens
gaagaagacatggaacaatagt

SEQ ID NO: 7141811 - DNA, 22 bp, Homo sapiens
gaagaactttagggcagaattt

SEQ ID NO: 7141812 - DNA, 22 bp, Homo sapiens
gaagaacttataggaatgtcat

SEQ ID NO: 7141813 - DNA, 22 bp, Homo sapiens
gaagaactttagggcagaattt

SEQ ID NO: 7141814 - DNA, 22 bp, Homo sapiens
gaagaacttaacataataagga

SEQ ID NO: 7141815 - DNA, 22 bp, Homo sapiens
gaagaactgtgacagaagcagt

SEQ ID NO: 7141816 - DNA, 22 bp, Homo sapiens
gaagaactgtgacagaagcagt

SEQ ID NO: 7141817 - DNA, 22 bp, Homo sapiens
gaagaactgtgacagaagcagt

SEQ ID NO: 7141818 - DNA, 22 bp, Homo sapiens
gaagaactgacaaactagatca

SEQ ID NO: 7141819 - DNA, 22 bp, Homo sapiens
gaagaactgtgacagaagcagt

SEQ ID NO: 7141820 - DNA, 22 bp, Homo sapiens
gaagaactgtgacagaagcagt

SEQ ID NO: 7141821 - DNA, 22 bp, Homo sapiens
gaagaactgaaagttgatgcac

SEQ ID NO: 7141822 - DNA, 22 bp, Homo sapiens
gaagaactgacaaactagatca

SEQ ID NO: 7141823 - DNA, 22 bp, Homo sapiens
gaagaactaactgaccatgaat

SEQ ID NO: 7141824 - DNA, 22 bp, Homo sapiens
gaagaactgaaagttgatgcac

SEQ ID NO: 7141825 - DNA, 22 bp, Homo sapiens
gaagaaattgaattcatgagct

SEQ ID NO: 7141826 - DNA, 22 bp, Homo sapiens
gaagaaattgaattcatgagct

SEQ ID NO: 7141827 - DNA, 22 bp, Homo sapiens
gaagaacaagcagtgctttcct

SEQ ID NO: 7141828 - DNA, 22 bp, Homo sapiens
gaagaacaagcagtgctttcct

SEQ ID NO: 7141829 - DNA, 22 bp, Homo sapiens
gaagaacaagcagtgctttcct

SEQ ID NO: 7141830 - DNA, 22 bp, Homo sapiens
gaagaacacctgctgcccagtg

SEQ ID NO: 7141831 - DNA, 22 bp, Homo sapiens
gaaattgtcagtgatatgatac

SEQ ID NO: 7141832 - DNA, 22 bp, Homo sapiens
gaacttataattattaagattg

SEQ ID NO: 7141833 - DNA, 22 bp, Homo sapiens
gaacttcttcaacataatggac

SEQ ID NO: 7141834 - DNA, 22 bp, Homo sapiens
gaacttcttcaacataatggac

SEQ ID NO: 7141835 - DNA, 22 bp, Homo sapiens
gaacttcttctttaagagactc

SEQ ID NO: 7141836 - DNA, 20 bp, Homo sapiens
gaacttgggcaagtggctta

SEQ ID NO: 7141837 - DNA, 20 bp, Homo sapiens
gaacttgggcaagtggctta

SEQ ID NO: 7141838 - DNA, 22 bp, Homo sapiens
gaacttgtgcactgctggtgat

SEQ ID NO: 7141839 - DNA, 22 bp, Homo sapiens
gaactttaaaacaaagtacagt

SEQ ID NO: 7141840 - DNA, 22 bp, Homo sapiens
gaaattcactgtatttcttggg

SEQ ID NO: 7141841 - DNA, 22 bp, Homo sapiens
gaaattcaggacaaagactctt

SEQ ID NO: 7141842 - DNA, 22 bp, Homo sapiens
gaaattcaggacaaagactctt

SEQ ID NO: 7141843 - DNA, 22 bp, Homo sapiens
gaaattctgtgtcccagagtgc

SEQ ID NO: 7141844 - DNA, 22 bp, Homo sapiens
gaaattgaaaccgatctgtgtt

SEQ ID NO: 7141845 - DNA, 22 bp, Homo sapiens
gaaattgaaagaccaactgcat

SEQ ID NO: 7141846 - DNA, 22 bp, Homo sapiens
gaaattgaataccctgcatgaa

SEQ ID NO: 7141847 - DNA, 22 bp, Homo sapiens
gaaattgccagatctagtagat

SEQ ID NO: 7141848 - DNA, 22 bp, Homo sapiens
gaaattgccagatctagtagat

SEQ ID NO: 7141849 - DNA, 22 bp, Homo sapiens
gaaattgtcagcttctttcagt

SEQ ID NO: 7141850 - DNA, 22 bp, Homo sapiens
gaaattattgctagagactgca

SEQ ID NO: 7141851 - DNA, 22 bp, Homo sapiens
gaaattaagcaggggtctgtgg

SEQ ID NO: 7141852 - DNA, 22 bp, Homo sapiens
gaaattcaaaatgtcagtatag

SEQ ID NO: 7141853 - DNA, 22 bp, Homo sapiens
gaaattcaaataagatatgtag

SEQ ID NO: 7141854 - DNA, 22 bp, Homo sapiens
gaaattcaaataagatatgtag

SEQ ID NO: 7141855 - DNA, 22 bp, Homo sapiens
gaaattcaaataagatatgtag

SEQ ID NO: 7141856 - DNA, 22 bp, Homo sapiens
gaaattcaccttttacgtggcc

SEQ ID NO: 7141857 - DNA, 22 bp, Homo sapiens
gaaattcactgtatttcttggg

SEQ ID NO: 7141858 - DNA, 22 bp, Homo sapiens
gaaattcactgtatttcttggg

SEQ ID NO: 7141859 - DNA, 22 bp, Homo sapiens
gaaattaaccacctttggcttt

SEQ ID NO: 7141860 - DNA, 22 bp, Homo sapiens
gaaatgttttacaaggcatact

SEQ ID NO: 7141861 - DNA, 22 bp, Homo sapiens
gaaatgtttgggaggagtcaac

SEQ ID NO: 7141862 - DNA, 22 bp, Homo sapiens
gaaatgtttccttttgtatgct

SEQ ID NO: 7141863 - DNA, 23 bp, Homo sapiens
gaaatgtttcttgattaatccta

SEQ ID NO: 7141864 - DNA, 23 bp, Homo sapiens
gaaatgtttcttgattaatccta

SEQ ID NO: 7141865 - DNA, 22 bp, Homo sapiens
gaaattaaccacctttggcttt

SEQ ID NO: 7141866 - DNA, 22 bp, Homo sapiens
gaaattaaccacctttggcttt

SEQ ID NO: 7141867 - DNA, 22 bp, Homo sapiens
gaaattaaccacctttggcttt

SEQ ID NO: 7141868 - DNA, 22 bp, Homo sapiens
gaaattaagcaggggtctgtgg

SEQ ID NO: 7141869 - DNA, 22 bp, Homo sapiens
gaaattaagcaggggtctgtgg

SEQ ID NO: 7141870 - DNA, 22 bp, Homo sapiens
gaaatgttggacacttgaaatt

SEQ ID NO: 7141871 - DNA, 22 bp, Homo sapiens
gaaatgttggacacttgaaatt

SEQ ID NO: 7141872 - DNA, 22 bp, Homo sapiens
gaaatgttgtcctgtctcttga

SEQ ID NO: 7141873 - DNA, 22 bp, Homo sapiens
gaaatgttgtcctgtctcttga

SEQ ID NO: 7141874 - DNA, 22 bp, Homo sapiens
gaaatgttgtcctgtctcttga

SEQ ID NO: 7141875 - DNA, 22 bp, Homo sapiens
gaaatgttgtcctgtctcttga

SEQ ID NO: 7141876 - DNA, 22 bp, Homo sapiens
gaaatgttgtctctgcagcaat

SEQ ID NO: 7141877 - DNA, 22 bp, Homo sapiens
gaaatgtttccttttgtatgct

SEQ ID NO: 7141878 - DNA, 22 bp, Homo sapiens
gaaatgttatgagatatgtact

SEQ ID NO: 7141879 - DNA, 22 bp, Homo sapiens
gaaatgttatgagatatgtact

SEQ ID NO: 7141880 - DNA, 22 bp, Homo sapiens
gaaatgttcctgatccctgatt

SEQ ID NO: 7141881 - DNA, 22 bp, Homo sapiens
cttcaaatacaagtagattatg

SEQ ID NO: 7141882 - DNA, 22 bp, Homo sapiens
cttcaaatacaagtagattatg

SEQ ID NO: 7141883 - DNA, 22 bp, Homo sapiens
cttcaaatccccctgagtttga

SEQ ID NO: 7141884 - DNA, 23 bp, Homo sapiens
ctgttaaattccttaagagcagg

SEQ ID NO: 7141885 - DNA, 22 bp, Homo sapiens
ctgttaaatgagaaagcagact

SEQ ID NO: 7141886 - DNA, 20 bp, Homo sapiens
ctgttaaaaggtatgaattc

SEQ ID NO: 7141887 - DNA, 22 bp, Homo sapiens
ctgttaaaaagaccaatggatt

SEQ ID NO: 7141888 - DNA, 20 bp, Homo sapiens
ctgttaaaaggtatgaattc

SEQ ID NO: 7141889 - DNA, 22 bp, Homo sapiens
ctgttaaatagactgcagtgca

SEQ ID NO: 7141890 - DNA, 22 bp, Homo sapiens
ctgttaaagatagttaagcttc

SEQ ID NO: 7141891 - DNA, 22 bp, Homo sapiens
ctgttaaaatgtggtcttaaaa

SEQ ID NO: 7141892 - DNA, 22 bp, Homo sapiens
ctgttaaaatgtggtcttaaaa

SEQ ID NO: 7141893 - DNA, 16 bp, Homo sapiens
cttcacagaggagagt

SEQ ID NO: 7141894 - DNA, 22 bp, Homo sapiens
cttcacagatgctgagagggct

SEQ ID NO: 7141895 - DNA, 22 bp, Homo sapiens
cttcacagatgctgagagggct

SEQ ID NO: 7141896 - DNA, 22 bp, Homo sapiens
cttcaaatgtgattttaataac

SEQ ID NO: 7141897 - DNA, 22 bp, Homo sapiens
cttcacagatgctgagagggct

SEQ ID NO: 7141898 - DNA, 22 bp, Homo sapiens
cttcacagcatgagctttggag

SEQ ID NO: 7141899 - DNA, 22 bp, Homo sapiens
cttcacagccaacatgggcaca

SEQ ID NO: 7141900 - DNA, 22 bp, Homo sapiens
cttcacagccaacatgggcaca

SEQ ID NO: 7141901 - DNA, 23 bp, Homo sapiens
cttcacaggttcaggggattaag

SEQ ID NO: 7141902 - DNA, 22 bp, Homo sapiens
cttcacagtaaatccagaagaa

SEQ ID NO: 7141903 - DNA, 22 bp, Homo sapiens
cttcacagtcaccctgctgtgt

SEQ ID NO: 7141904 - DNA, 22 bp, Homo sapiens
cttcacagtcaccctgctgtgt

SEQ ID NO: 7141905 - DNA, 22 bp, Homo sapiens
cttcacagtcaccctgctgtgt

SEQ ID NO: 7141906 - DNA, 22 bp, Homo sapiens
cttcactgagtagtctagactc

SEQ ID NO: 7141907 - DNA, 22 bp, Homo sapiens
cttcactgagtagtctagactc

SEQ ID NO: 7141908 - DNA, 22 bp, Homo sapiens
cttcactgagtagtctagactc

SEQ ID NO: 7141909 - DNA, 22 bp, Homo sapiens
cttcacctgtacgctggagcta

SEQ ID NO: 7141910 - DNA, 22 bp, Homo sapiens
cttcactggaatctgtaatagt

SEQ ID NO: 7141911 - DNA, 22 bp, Homo sapiens
cttcactgcagtcatggctctg

SEQ ID NO: 7141912 - DNA, 22 bp, Homo sapiens
cttcacattgggcttgatatga

SEQ ID NO: 7141913 - DNA, 22 bp, Homo sapiens
cttccaggtaggcctaaggcag

SEQ ID NO: 7141914 - DNA, 22 bp, Homo sapiens
cttccaggtaggcctaaggcag

SEQ ID NO: 7141915 - DNA, 22 bp, Homo sapiens
cttccagggtccaggaagagcc

SEQ ID NO: 7141916 - DNA, 22 bp, Homo sapiens
cttccagggtccaggaagagcc

SEQ ID NO: 7141917 - DNA, 22 bp, Homo sapiens
cttcagaaataacaacaattac

SEQ ID NO: 7141918 - DNA, 22 bp, Homo sapiens
cttcacttcacagatgccaaga

SEQ ID NO: 7141919 - DNA, 22 bp, Homo sapiens
cttcacttcacagatgccaaga

SEQ ID NO: 7141920 - DNA, 22 bp, Homo sapiens
cttcacttgctcatcatgctat

SEQ ID NO: 7141921 - DNA, 22 bp, Homo sapiens
cttcacttcacagatgccaaga

SEQ ID NO: 7141922 - DNA, 22 bp, Homo sapiens
cttcactgtgcttcaagcagct

SEQ ID NO: 7141923 - DNA, 22 bp, Homo sapiens
cttcactggatctttgatttca

SEQ ID NO: 7141924 - DNA, 22 bp, Homo sapiens
cttcactgggctcctgagaggg

SEQ ID NO: 7141925 - DNA, 22 bp, Homo sapiens
cttcactgtttggttcacagca

SEQ ID NO: 7141926 - DNA, 22 bp, Homo sapiens
cttcactgtttggttcacagca

SEQ ID NO: 7141927 - DNA, 22 bp, Homo sapiens
cttcttcaagaggaccatccag

SEQ ID NO: 7141928 - DNA, 19 bp, Homo sapiens
cttctgtgatacatcagtc

SEQ ID NO: 7141929 - DNA, 22 bp, Homo sapiens
cttctgtgaatgaagtgtggga

SEQ ID NO: 7141930 - DNA, 22 bp, Homo sapiens
cttctgtgacgtatgtgaggac

SEQ ID NO: 7141931 - DNA, 22 bp, Homo sapiens
cttccctttctggtgacttctc

SEQ ID NO: 7141932 - DNA, 22 bp, Homo sapiens
cttctgtagccagtaacatata

SEQ ID NO: 7141933 - DNA, 22 bp, Homo sapiens
cttccctttagcatatagtagt

SEQ ID NO: 7141934 - DNA, 22 bp, Homo sapiens
cttcccttggtgaacagagcat

SEQ ID NO: 7141935 - DNA, 22 bp, Homo sapiens
cttcccttctgtgcagggcaga

SEQ ID NO: 7141936 - DNA, 22 bp, Homo sapiens
cttcccttggtgaacagagcat

SEQ ID NO: 7141937 - DNA, 22 bp, Homo sapiens
cttcccttctgcagatctttgg

SEQ ID NO: 7141938 - DNA, 22 bp, Homo sapiens
cttcccttctgtgcagggcaga

SEQ ID NO: 7141939 - DNA, 22 bp, Homo sapiens
cttcttcagttgcatgtattgg

SEQ ID NO: 7141940 - DNA, 22 bp, Homo sapiens
cttcttcataggcagtcctgtt

SEQ ID NO: 7141941 - DNA, 22 bp, Homo sapiens
cttcttcatctgtaaaacttgg

SEQ ID NO: 7141942 - DNA, 22 bp, Homo sapiens
cttcttcatgtattgatagtct

SEQ ID NO: 7141943 - DNA, 20 bp, Homo sapiens
cttcttcagcctatgcttca

SEQ ID NO: 7141944 - DNA, 20 bp, Homo sapiens
cttcttcagcctatgcttca

SEQ ID NO: 7141945 - DNA, 20 bp, Homo sapiens
cttcttcagcctatgcttca

SEQ ID NO: 7141946 - DNA, 22 bp, Homo sapiens
cttcttcagcacaatattgatg

SEQ ID NO: 7141947 - DNA, 22 bp, Homo sapiens
cttcttcagaggccagcctctg

SEQ ID NO: 7141948 - DNA, 22 bp, Homo sapiens
cttcttcaatagcaagcgcata

SEQ ID NO: 7141949 - DNA, 22 bp, Homo sapiens
cttccccaggacctctgctaaa

SEQ ID NO: 7141950 - DNA, 22 bp, Homo sapiens
cttccccaaccccgactgtgtg

SEQ ID NO: 7141951 - DNA, 22 bp, Homo sapiens
cttcccagttctgcttgagggg

SEQ ID NO: 7141952 - DNA, 22 bp, Homo sapiens
cttcccaggtgctcttagcatg

SEQ ID NO: 7141953 - DNA, 22 bp, Homo sapiens
cttcccaggtgctcttagcatg

SEQ ID NO: 7141954 - DNA, 22 bp, Homo sapiens
cttcccagttctgcttgagggg

SEQ ID NO: 7141955 - DNA, 22 bp, Homo sapiens
cttcccagttctgcttgagggg

SEQ ID NO: 7141956 - DNA, 22 bp, Homo sapiens
cttcccagaacaatgtaggctt

SEQ ID NO: 7141957 - DNA, 22 bp, Homo sapiens
cttcccagaccttagagtgcag

SEQ ID NO: 7141958 - DNA, 22 bp, Homo sapiens
cttcccagaccttagagtgcag

SEQ ID NO: 7141959 - DNA, 22 bp, Homo sapiens
cttcccagaccttagagtgcag

SEQ ID NO: 7141960 - DNA, 22 bp, Homo sapiens
cttcccagaccttagagtgcag

SEQ ID NO: 7141961 - DNA, 22 bp, Homo sapiens
cttcccagacggggtggcagcc

SEQ ID NO: 7141962 - DNA, 22 bp, Homo sapiens
cttcccagacggggtggcagcc

SEQ ID NO: 7141963 - DNA, 22 bp, Homo sapiens
cttcccagacggggtggcagcc

SEQ ID NO: 7141964 - DNA, 22 bp, Homo sapiens
cttcccagcacctcagtctggc

SEQ ID NO: 7141965 - DNA, 22 bp, Homo sapiens
cttcccagcacctcagtctggc

SEQ ID NO: 7141966 - DNA, 22 bp, Homo sapiens
cttcccttcctggggcaattta

SEQ ID NO: 7141967 - DNA, 22 bp, Homo sapiens
cttcccttcccctcacggagac

SEQ ID NO: 7141968 - DNA, 22 bp, Homo sapiens
cttcccttcccctcacggagac

SEQ ID NO: 7141969 - DNA, 22 bp, Homo sapiens
cttcccttcccctcacggagac

SEQ ID NO: 7141970 - DNA, 22 bp, Homo sapiens
cttccctggtgttagcccaatg

SEQ ID NO: 7141971 - DNA, 22 bp, Homo sapiens
cttccctgataagagcctcaga

SEQ ID NO: 7141972 - DNA, 22 bp, Homo sapiens
cttccctgataagagcctcaga

SEQ ID NO: 7141973 - DNA, 22 bp, Homo sapiens
cttccctgataagagcctcaga

SEQ ID NO: 7141974 - DNA, 19 bp, Homo sapiens
cttcccctgttacctcact

SEQ ID NO: 7141975 - DNA, 22 bp, Homo sapiens
cttccccgccggttcgctgagt

SEQ ID NO: 7141976 - DNA, 22 bp, Homo sapiens
cttccctcctggattccagact

SEQ ID NO: 7141977 - DNA, 22 bp, Homo sapiens
cttccctcctggattccagact

SEQ ID NO: 7141978 - DNA, 22 bp, Homo sapiens
cttccctcctggattccagact

SEQ ID NO: 7141979 - DNA, 22 bp, Homo sapiens
cttccctctgctccttggtcca

SEQ ID NO: 7141980 - DNA, 18 bp, Homo sapiens
cttccctcttcctttgtc

SEQ ID NO: 7141981 - DNA, 22 bp, Homo sapiens
cttccctgagctttctcaggct

SEQ ID NO: 7141982 - DNA, 22 bp, Homo sapiens
ctttctcaatgccggaaggcac

SEQ ID NO: 7141983 - DNA, 22 bp, Homo sapiens
ctttctcagtgttaattacttt

SEQ ID NO: 7141984 - DNA, 22 bp, Homo sapiens
ctttctcagtgttaattacttt

SEQ ID NO: 7141985 - DNA, 22 bp, Homo sapiens
ctttctagagtatggagtctgt

SEQ ID NO: 7141986 - DNA, 22 bp, Homo sapiens
ctttctcagtgttaattacttt

SEQ ID NO: 7141987 - DNA, 22 bp, Homo sapiens
ctttctccagagctgcttattt

SEQ ID NO: 7141988 - DNA, 22 bp, Homo sapiens
ctttctccagagctgcttattt

SEQ ID NO: 7141989 - DNA, 22 bp, Homo sapiens
ctttctccctgtcccaaactgg

SEQ ID NO: 7141990 - DNA, 22 bp, Homo sapiens
ctttctctgtgtttcacatgct

SEQ ID NO: 7141991 - DNA, 22 bp, Homo sapiens
ctttctctgtgtggtaaagggc

SEQ ID NO: 7141992 - DNA, 22 bp, Homo sapiens
ctttggaacaagaagaaatggc

SEQ ID NO: 7141993 - DNA, 21 bp, Homo sapiens
ctttgcatctatatgttctca

SEQ ID NO: 7141994 - DNA, 22 bp, Homo sapiens
ctttcctagttggtcccagcac

SEQ ID NO: 7141995 - DNA, 22 bp, Homo sapiens
ctttcctccactccctaggctt

SEQ ID NO: 7141996 - DNA, 22 bp, Homo sapiens
ctttcctagttggtcccagcac

SEQ ID NO: 7141997 - DNA, 22 bp, Homo sapiens
ctttccaccaactcacttccct

SEQ ID NO: 7141998 - DNA, 22 bp, Homo sapiens
ctttccagacctccttgtagct

SEQ ID NO: 7141999 - DNA, 22 bp, Homo sapiens
ctttccaagaatgcagatacct

SEQ ID NO: 7142000 - DNA, 22 bp, Homo sapiens
ctttccaatgcatttccaatgt

SEQ ID NO: 7142001 - DNA, 22 bp, Homo sapiens
ctttccaatgtcactatgaatc

SEQ ID NO: 7142002 - DNA, 22 bp, Homo sapiens
ctttccaatgtcactatgaatc

SEQ ID NO: 7142003 - DNA, 22 bp, Homo sapiens
cttggaggatgtgcggctgccc

SEQ ID NO: 7142004 - DNA, 22 bp, Homo sapiens
cttggaggaggtggtgcttgat

SEQ ID NO: 7142005 - DNA, 22 bp, Homo sapiens
cttggaggaaaggcagggagac

SEQ ID NO: 7142006 - DNA, 22 bp, Homo sapiens
cttggaggaaggggctcttctg

SEQ ID NO: 7142007 - DNA, 22 bp, Homo sapiens
cttggaggaaggggctcttctg

SEQ ID NO: 7142008 - DNA, 22 bp, Homo sapiens
cttggaggaaaggcagggagac

SEQ ID NO: 7142009 - DNA, 22 bp, Homo sapiens
cttggagcccagcaggcctgga

SEQ ID NO: 7142010 - DNA, 22 bp, Homo sapiens
cttggagctcccgcactgatta

SEQ ID NO: 7142011 - DNA, 22 bp, Homo sapiens
cttggagattcattgcctgaaa

SEQ ID NO: 7142012 - DNA, 22 bp, Homo sapiens
cttggagattcattgcctgaaa

SEQ ID NO: 7142013 - DNA, 22 bp, Homo sapiens
cttggagattcattgcctgaaa

SEQ ID NO: 7142014 - DNA, 22 bp, Homo sapiens
ctttcctggctggcagttgtgg

SEQ ID NO: 7142015 - DNA, 22 bp, Homo sapiens
ctttcctggctggcagttgtgg

SEQ ID NO: 7142016 - DNA, 22 bp, Homo sapiens
ctttcctgccttattcattcat

SEQ ID NO: 7142017 - DNA, 22 bp, Homo sapiens
ctttcctgagaaaggagaagga

SEQ ID NO: 7142018 - DNA, 22 bp, Homo sapiens
ctttcctgaaatctcttctgca

SEQ ID NO: 7142019 - DNA, 22 bp, Homo sapiens
ctttcctgaaatctcttctgca

SEQ ID NO: 7142020 - DNA, 22 bp, Homo sapiens
ctttcctctggcactgtctggt

SEQ ID NO: 7142021 - DNA, 22 bp, Homo sapiens
ctttcctggctggcagttgtgg

SEQ ID NO: 7142022 - DNA, 22 bp, Homo sapiens
ctttccttaataagcaggtata

SEQ ID NO: 7142023 - DNA, 22 bp, Homo sapiens
cttgctgtcttgcatttagagc

SEQ ID NO: 7142024 - DNA, 22 bp, Homo sapiens
cttgctggtgtcgtgccttcac

SEQ ID NO: 7142025 - DNA, 22 bp, Homo sapiens
cttgctggtggtgttttctatg

SEQ ID NO: 7142026 - DNA, 22 bp, Homo sapiens
cttgctggtattttctctctca

SEQ ID NO: 7142027 - DNA, 19 bp, Homo sapiens
cttgctgggtggtttctgc

SEQ ID NO: 7142028 - DNA, 22 bp, Homo sapiens
cttgcctgctggagcagggctc

SEQ ID NO: 7142029 - DNA, 22 bp, Homo sapiens
cttgcctgctggagcagggctc

SEQ ID NO: 7142030 - DNA, 22 bp, Homo sapiens
cttgctggggtaagtctgtgct

SEQ ID NO: 7142031 - DNA, 22 bp, Homo sapiens
cttgcctgaggaacagagggta

SEQ ID NO: 7142032 - DNA, 22 bp, Homo sapiens
cttgcctccctcagctcacagc

SEQ ID NO: 7142033 - DNA, 22 bp, Homo sapiens
cttgcctccctcagctcacagc

SEQ ID NO: 7142034 - DNA, 22 bp, Homo sapiens
cttgcctccctcagctcacagc

SEQ ID NO: 7142035 - DNA, 22 bp, Homo sapiens
cttgcctccctcagctcacagc

SEQ ID NO: 7142036 - DNA, 19 bp, Homo sapiens
cttcttcttggcagccaag

SEQ ID NO: 7142037 - DNA, 22 bp, Homo sapiens
cttcttcttcccccttcagggg

SEQ ID NO: 7142038 - DNA, 22 bp, Homo sapiens
cttcttctctacatcctttgat

SEQ ID NO: 7142039 - DNA, 22 bp, Homo sapiens
cttcttcccagcttccctcacc

SEQ ID NO: 7142040 - DNA, 22 bp, Homo sapiens
cttcttccagttataagagctt

SEQ ID NO: 7142041 - DNA, 22 bp, Homo sapiens
cttcttcatgtattgatagtct

SEQ ID NO: 7142042 - DNA, 22 bp, Homo sapiens
cttcttccaagcttatgctcaa

SEQ ID NO: 7142043 - DNA, 22 bp, Homo sapiens
cttgctttcagtctcggcctca

SEQ ID NO: 7142044 - DNA, 22 bp, Homo sapiens
cttgcttgaggtatggaatggg

SEQ ID NO: 7142045 - DNA, 22 bp, Homo sapiens
cttgcttggagaagagatcagt

SEQ ID NO: 7142046 - DNA, 22 bp, Homo sapiens
cttgcttgttttgaagaaagat

SEQ ID NO: 7142047 - DNA, 22 bp, Homo sapiens
cttgctgtgtggtgttctcaga

SEQ ID NO: 7142048 - DNA, 22 bp, Homo sapiens
cttgctgtgtggtgttctcaga

SEQ ID NO: 7142049 - DNA, 22 bp, Homo sapiens
cttgctgttgtgggagactggg

SEQ ID NO: 7142050 - DNA, 22 bp, Homo sapiens
cttgctgttttctaccctcaag

SEQ ID NO: 7142051 - DNA, 22 bp, Homo sapiens
cttgcttcattagtgtcttagt

SEQ ID NO: 7142052 - DNA, 22 bp, Homo sapiens
cttggaaaggaatcttttacca

SEQ ID NO: 7142053 - DNA, 22 bp, Homo sapiens
cttggaaaggttttacaaagcg

SEQ ID NO: 7142054 - DNA, 22 bp, Homo sapiens
cttggaaagaatatatgatgct

SEQ ID NO: 7142055 - DNA, 22 bp, Homo sapiens
cttggaaaggaatcttttacca

SEQ ID NO: 7142056 - DNA, 22 bp, Homo sapiens
cttggaaaggttttacaaagcg

SEQ ID NO: 7142057 - DNA, 22 bp, Homo sapiens
cttggaaagttatcattttcct

SEQ ID NO: 7142058 - DNA, 22 bp, Homo sapiens
cttggaaagttatcattttcct

SEQ ID NO: 7142059 - DNA, 22 bp, Homo sapiens
cttggaaagttatcattttcct

SEQ ID NO: 7142060 - DNA, 22 bp, Homo sapiens
cttggaacaaattaaacaatac

SEQ ID NO: 7142061 - DNA, 22 bp, Homo sapiens
cttgctttccaaatgactcact

SEQ ID NO: 7142062 - DNA, 22 bp, Homo sapiens
cttgctttgtccagaaattcag

SEQ ID NO: 7142063 - DNA, 22 bp, Homo sapiens
cttggaaactttccctgggcac

SEQ ID NO: 7142064 - DNA, 21 bp, Homo sapiens
cttggaacgggtagaactcac

SEQ ID NO: 7142065 - DNA, 22 bp, Homo sapiens
cttggaacttagtaatatgaca

SEQ ID NO: 7142066 - DNA, 22 bp, Homo sapiens
cttggaaggacgggctgtatct

SEQ ID NO: 7142067 - DNA, 22 bp, Homo sapiens
cttggacccactcccagaattg

SEQ ID NO: 7142068 - DNA, 22 bp, Homo sapiens
cttggactggacccgaggaatg

SEQ ID NO: 7142069 - DNA, 22 bp, Homo sapiens
cttggacttccaggaagtattt

SEQ ID NO: 7142070 - DNA, 22 bp, Homo sapiens
cttggactttagtctctctcca

SEQ ID NO: 7142071 - DNA, 22 bp, Homo sapiens
cttggagaaaggaaagggcttg

SEQ ID NO: 7142072 - DNA, 22 bp, Homo sapiens
cttggactttccagcttctaaa

SEQ ID NO: 7142073 - DNA, 22 bp, Homo sapiens
cttggagaaaggaaagggcttg

SEQ ID NO: 7142074 - DNA, 18 bp, Homo sapiens
cttggagaactaatgata

SEQ ID NO: 7142075 - DNA, 19 bp, Homo sapiens
cttggagaaggctatgacc

SEQ ID NO: 7142076 - DNA, 22 bp, Homo sapiens
cttggagaatcctggttattca

SEQ ID NO: 7142077 - DNA, 22 bp, Homo sapiens
cttggagaatgacagtggatta

SEQ ID NO: 7142078 - DNA, 22 bp, Homo sapiens
cttggagaatgacagtggatta

SEQ ID NO: 7142079 - DNA, 22 bp, Homo sapiens
cttggagacaggacaggcagaa

SEQ ID NO: 7142080 - DNA, 22 bp, Homo sapiens
cttggagacaggacaggcagaa

SEQ ID NO: 7142081 - DNA, 22 bp, Homo sapiens
cttggagacattgatcttttgc

SEQ ID NO: 7142082 - DNA, 22 bp, Homo sapiens
cttggagaccagtgacattgct

SEQ ID NO: 7142083 - DNA, 22 bp, Homo sapiens
cttggagaccagtgacattgct

SEQ ID NO: 7142084 - DNA, 22 bp, Homo sapiens
cttggagagagcctcagctgtt

SEQ ID NO: 7142085 - DNA, 22 bp, Homo sapiens
cttggagagagcctcagctgtt

SEQ ID NO: 7142086 - DNA, 22 bp, Homo sapiens
cttggagagagcctcagctgtt

SEQ ID NO: 7142087 - DNA, 22 bp, Homo sapiens
cttggagagggagaaaaataac

SEQ ID NO: 7142088 - DNA, 22 bp, Homo sapiens
cttggagagtggttatccctgt

SEQ ID NO: 7142089 - DNA, 22 bp, Homo sapiens
cttggagagtggttatccctgt

SEQ ID NO: 7142090 - DNA, 22 bp, Homo sapiens
cttggagatacagaggacattt

SEQ ID NO: 7142091 - DNA, 22 bp, Homo sapiens
cttggagatacaagtggtacct

SEQ ID NO: 7142092 - DNA, 22 bp, Homo sapiens
ctgtgggagcagcaccaaggac

SEQ ID NO: 7142093 - DNA, 22 bp, Homo sapiens
ctgtgggagggaaggcgcggcc

SEQ ID NO: 7142094 - DNA, 22 bp, Homo sapiens
ctgtgggagggtgagagaacca

SEQ ID NO: 7142095 - DNA, 22 bp, Homo sapiens
ctgtgggatcccatgactttcc

SEQ ID NO: 7142096 - DNA, 22 bp, Homo sapiens
ctgtgggatgggacctcagctg

SEQ ID NO: 7142097 - DNA, 22 bp, Homo sapiens
ctgtggctttctctgcctcctt

SEQ ID NO: 7142098 - DNA, 22 bp, Homo sapiens
ctgtgggagcactggggaccga

SEQ ID NO: 7142099 - DNA, 17 bp, Homo sapiens
ctgtggccacctggatg

SEQ ID NO: 7142100 - DNA, 23 bp, Homo sapiens
ctgtggccacccctagctggagg

SEQ ID NO: 7142101 - DNA, 23 bp, Homo sapiens
ctgtggccacccctagctggagg

SEQ ID NO: 7142102 - DNA, 23 bp, Homo sapiens
ctgtggccacccctagctggagg

SEQ ID NO: 7142103 - DNA, 22 bp, Homo sapiens
ctgtgggatgggacctcagctg

SEQ ID NO: 7142104 - DNA, 22 bp, Homo sapiens
ctgtgggatgggacctcagctg

SEQ ID NO: 7142105 - DNA, 22 bp, Homo sapiens
ctgtgggattcatgacattaat

SEQ ID NO: 7142106 - DNA, 22 bp, Homo sapiens
ctgtgggattcatgacattaat

SEQ ID NO: 7142107 - DNA, 22 bp, Homo sapiens
ctgtgggcagctcctcctgtca

SEQ ID NO: 7142108 - DNA, 22 bp, Homo sapiens
ctgtgggcagctcctcctgtca

SEQ ID NO: 7142109 - DNA, 22 bp, Homo sapiens
ctgtgggcatttgagtgtgggt

SEQ ID NO: 7142110 - DNA, 22 bp, Homo sapiens
ctgtgggcatttgagtgtgggt

SEQ ID NO: 7142111 - DNA, 22 bp, Homo sapiens
ctgtgggcctagtctggcctag

SEQ ID NO: 7142112 - DNA, 22 bp, Homo sapiens
ctgtgggcatttgagtgtgggt

SEQ ID NO: 7142113 - DNA, 22 bp, Homo sapiens
ctgtgggcatttgagtgtgggt

SEQ ID NO: 7142114 - DNA, 22 bp, Homo sapiens
ctgtgggcctagtctggcctag

SEQ ID NO: 7142115 - DNA, 22 bp, Homo sapiens
ctgtgggcgcctgtcagcctca

SEQ ID NO: 7142116 - DNA, 22 bp, Homo sapiens
ctgtgggcgcctgtcagcctca

SEQ ID NO: 7142117 - DNA, 19 bp, Homo sapiens
ctgtgggcggaggaggggc

SEQ ID NO: 7142118 - DNA, 19 bp, Homo sapiens
ctgtgggcggaggaggggc

SEQ ID NO: 7142119 - DNA, 19 bp, Homo sapiens
ctgtgggcggaggaggggc

SEQ ID NO: 7142120 - DNA, 22 bp, Homo sapiens
ctgtgggctcccagcttctctc

SEQ ID NO: 7142121 - DNA, 20 bp, Homo sapiens
ctgtggcatctgtcatggtg

SEQ ID NO: 7142122 - DNA, 20 bp, Homo sapiens
ctgtggcatctgtcatggtg

SEQ ID NO: 7142123 - DNA, 22 bp, Homo sapiens
ctgtggcaggtgtctggggcag

SEQ ID NO: 7142124 - DNA, 22 bp, Homo sapiens
ctgtggcaggtgtctggggcag

SEQ ID NO: 7142125 - DNA, 22 bp, Homo sapiens
ctgtggcaggaagggactagca

SEQ ID NO: 7142126 - DNA, 22 bp, Homo sapiens
ctgtggcattgccgaggctggc

SEQ ID NO: 7142127 - DNA, 22 bp, Homo sapiens
ctgtggcattgccgaggctggc

SEQ ID NO: 7142128 - DNA, 20 bp, Homo sapiens
ctgtggcatctgtcatggtg

SEQ ID NO: 7142129 - DNA, 20 bp, Homo sapiens
ctgtggcatcttgaaggagg

SEQ ID NO: 7142130 - DNA, 22 bp, Homo sapiens
ctgtggcattgccgaggctggc

SEQ ID NO: 7142131 - DNA, 22 bp, Homo sapiens
ctgtggcattgccgaggctggc

SEQ ID NO: 7142132 - DNA, 22 bp, Homo sapiens
ctgtggcattgccgaggctggc

SEQ ID NO: 7142133 - DNA, 22 bp, Homo sapiens
ctgtggcattgtgaggactgca

SEQ ID NO: 7142134 - DNA, 22 bp, Homo sapiens
ctgtggcattgtgaggactgca

SEQ ID NO: 7142135 - DNA, 22 bp, Homo sapiens
ctgtggcaggaagggactagca

SEQ ID NO: 7142136 - DNA, 22 bp, Homo sapiens
ctgtggcaggaagggactagca

SEQ ID NO: 7142137 - DNA, 22 bp, Homo sapiens
ctgtggcactcaagaagcctcc

SEQ ID NO: 7142138 - DNA, 23 bp, Homo sapiens
ctgtggcaagtcctgcacctgcc

SEQ ID NO: 7142139 - DNA, 22 bp, Homo sapiens
ctgtggcaagtctgcctgtcac

SEQ ID NO: 7142140 - DNA, 22 bp, Homo sapiens
ctgtggcacatgtggcaaggcc

SEQ ID NO: 7142141 - DNA, 22 bp, Homo sapiens
ctgtggcacatgtggcaaggcc

SEQ ID NO: 7142142 - DNA, 22 bp, Homo sapiens
ctgtggcacatgtggcaaggcc

SEQ ID NO: 7142143 - DNA, 22 bp, Homo sapiens
ctgtggagtttgtggcgctgac

SEQ ID NO: 7142144 - DNA, 19 bp, Homo sapiens
ctgtggactctagatcatg

SEQ ID NO: 7142145 - DNA, 22 bp, Homo sapiens
ctgtggagtttgtggcgctgac

SEQ ID NO: 7142146 - DNA, 22 bp, Homo sapiens
ctgtggatcagtttggaaactt

SEQ ID NO: 7142147 - DNA, 22 bp, Homo sapiens
ctgtggatttacttgagaagct

SEQ ID NO: 7142148 - DNA, 22 bp, Homo sapiens
ctgtggatttacttgagaagct

SEQ ID NO: 7142149 - DNA, 22 bp, Homo sapiens
ctgtgtgagtgactgcatctca

SEQ ID NO: 7142150 - DNA, 22 bp, Homo sapiens
ctgtgtgcaacttgcagttttg

SEQ ID NO: 7142151 - DNA, 22 bp, Homo sapiens
ctgtgtgtgaacacagcccagc

SEQ ID NO: 7142152 - DNA, 22 bp, Homo sapiens
ctgtggtggcacagcgggctgg

SEQ ID NO: 7142153 - DNA, 22 bp, Homo sapiens
ctgtggtggcacagcgggctgg

SEQ ID NO: 7142154 - DNA, 22 bp, Homo sapiens
ctgtgtcttctgttttgaagtt

SEQ ID NO: 7142155 - DNA, 22 bp, Homo sapiens
ctgtgtcttgagtaattcggtg

SEQ ID NO: 7142156 - DNA, 22 bp, Homo sapiens
ctgtgtcttgagtaattcggtg

SEQ ID NO: 7142157 - DNA, 22 bp, Homo sapiens
ctgtgtctttcctactttgtgg

SEQ ID NO: 7142158 - DNA, 22 bp, Homo sapiens
ctgtgtctttcctactttgtgg

SEQ ID NO: 7142159 - DNA, 22 bp, Homo sapiens
ctgtggtggcacagcgggctgg

SEQ ID NO: 7142160 - DNA, 20 bp, Homo sapiens
ctgtggtgagcaggagagta

SEQ ID NO: 7142161 - DNA, 22 bp, Homo sapiens
ctgtggtcactgttggggaatg

SEQ ID NO: 7142162 - DNA, 22 bp, Homo sapiens
ctgtggtcaggggttagacagg

SEQ ID NO: 7142163 - DNA, 22 bp, Homo sapiens
ctgtggtcatctcagagtggcc

SEQ ID NO: 7142164 - DNA, 22 bp, Homo sapiens
ctgtggtcaggggttagacagg

SEQ ID NO: 7142165 - DNA, 22 bp, Homo sapiens
ctgtggtctgtaggagtgatgg

SEQ ID NO: 7142166 - DNA, 21 bp, Homo sapiens
ctgtggtacagctgggacgga

SEQ ID NO: 7142167 - DNA, 22 bp, Homo sapiens
ctgtggtcaccaggctggggcc

SEQ ID NO: 7142168 - DNA, 22 bp, Homo sapiens
ctgtgggtggctgtgccccagg

SEQ ID NO: 7142169 - DNA, 22 bp, Homo sapiens
ctgtggggccaaattctcctct

SEQ ID NO: 7142170 - DNA, 22 bp, Homo sapiens
ctgtggggccaaattctcctct

SEQ ID NO: 7142171 - DNA, 22 bp, Homo sapiens
ctgtgggtattaaaaatgaatt

SEQ ID NO: 7142172 - DNA, 22 bp, Homo sapiens
ctgtgggtgaagacaagggaga

SEQ ID NO: 7142173 - DNA, 22 bp, Homo sapiens
ctgtgggtgaagacaagggaga

SEQ ID NO: 7142174 - DNA, 22 bp, Homo sapiens
ctgtggggaagatagaaccgac

SEQ ID NO: 7142175 - DNA, 22 bp, Homo sapiens
ctgtggggagctgatcagatca

SEQ ID NO: 7142176 - DNA, 22 bp, Homo sapiens
ctgtggggaaagggtcctgctc

SEQ ID NO: 7142177 - DNA, 22 bp, Homo sapiens
ctgtgggctcctgcagctcagg

SEQ ID NO: 7142178 - DNA, 22 bp, Homo sapiens
ctgtgggctcctgcagctcagg

SEQ ID NO: 7142179 - DNA, 22 bp, Homo sapiens
ctgtgggctgaaagtgctcccg

SEQ ID NO: 7142180 - DNA, 22 bp, Homo sapiens
ctgtgggctgaaagtgctcccg

SEQ ID NO: 7142181 - DNA, 22 bp, Homo sapiens
ctgtgtttgatgagaagccacc

SEQ ID NO: 7142182 - DNA, 22 bp, Homo sapiens
ctgtgtttgctatgcaaagaca

SEQ ID NO: 7142183 - DNA, 22 bp, Homo sapiens
ctgtgttttgagatattattaa

SEQ ID NO: 7142184 - DNA, 22 bp, Homo sapiens
ctgtgttttgattaaaaagcaa

SEQ ID NO: 7142185 - DNA, 22 bp, Homo sapiens
ctgtgttttgattaaaaagcaa

SEQ ID NO: 7142186 - DNA, 22 bp, Homo sapiens
ctgtgtttttggtctgatctat

SEQ ID NO: 7142187 - DNA, 22 bp, Homo sapiens
ctgtgtttctaagtaaaggagc

SEQ ID NO: 7142188 - DNA, 22 bp, Homo sapiens
ctgtgttcccctgctgctgagg

SEQ ID NO: 7142189 - DNA, 22 bp, Homo sapiens
ctgtgtttctcttgacccaagt

SEQ ID NO: 7142190 - DNA, 22 bp, Homo sapiens
ctgtgtgtttatatcatttcct

SEQ ID NO: 7142191 - DNA, 22 bp, Homo sapiens
ctgtgtgtttatatcatttcct

SEQ ID NO: 7142192 - DNA, 22 bp, Homo sapiens
ctgtgttcagtgctactgagtt

SEQ ID NO: 7142193 - DNA, 22 bp, Homo sapiens
ctgtgtgtgtctgcagcatact

SEQ ID NO: 7142194 - DNA, 22 bp, Homo sapiens
ctgtgtgtttatatcatttcct

SEQ ID NO: 7142195 - DNA, 22 bp, Homo sapiens
ctgtgtgtttatatcatttcct

SEQ ID NO: 7142196 - DNA, 22 bp, Homo sapiens
ctgtgtgtttatatcatttcct

SEQ ID NO: 7142197 - DNA, 22 bp, Homo sapiens
ctgtgtgtttatatcatttcct

SEQ ID NO: 7142198 - DNA, 22 bp, Homo sapiens
ctgtgtgtgtctgcagcatact

SEQ ID NO: 7142199 - DNA, 22 bp, Homo sapiens
ctgtgtgtgtctgcagcatact

SEQ ID NO: 7142200 - DNA, 22 bp, Homo sapiens
ctgtgtgtgtctgcagcatact

SEQ ID NO: 7142201 - DNA, 22 bp, Homo sapiens
ctgtgtgtgtctgcagcatact

SEQ ID NO: 7142202 - DNA, 22 bp, Homo sapiens
ctgtgtgtgctacaggcttcca

SEQ ID NO: 7142203 - DNA, 22 bp, Homo sapiens
ctgtgtgtgctacaggcttcca

SEQ ID NO: 7142204 - DNA, 22 bp, Homo sapiens
ctgtgtgtgtctgcagcatact

SEQ ID NO: 7142205 - DNA, 22 bp, Homo sapiens
ctgtgtgtgtctgcagcatact

SEQ ID NO: 7142206 - DNA, 22 bp, Homo sapiens
ctgtgtgtgctacaggcttcca

SEQ ID NO: 7142207 - DNA, 22 bp, Homo sapiens
ctgtgtgtgctacaggcttcca

SEQ ID NO: 7142208 - DNA, 22 bp, Homo sapiens
ctgtgtgtgctacaggcttcca

SEQ ID NO: 7142209 - DNA, 22 bp, Homo sapiens
ctgtgtgtgctacaggcttcca

SEQ ID NO: 7142210 - DNA, 23 bp, Homo sapiens
ctgtgtgtgccgagggtggccac

SEQ ID NO: 7142211 - DNA, 23 bp, Homo sapiens
ctgtgtgtgccgagggtggccac

SEQ ID NO: 7142212 - DNA, 23 bp, Homo sapiens
ctgtgtgtgccgagggtggccac

SEQ ID NO: 7142213 - DNA, 23 bp, Homo sapiens
ctgtgtgtgccgagggtggccac

SEQ ID NO: 7142214 - DNA, 22 bp, Homo sapiens
ctgtgtgtgagaagcaggttga

SEQ ID NO: 7142215 - DNA, 23 bp, Homo sapiens
ctgtgtgtgccgagggtggccac

SEQ ID NO: 7142216 - DNA, 23 bp, Homo sapiens
ctgtgtgtgccgagggtggccac

SEQ ID NO: 7142217 - DNA, 23 bp, Homo sapiens
ctgtgtgtgccgagggtggccac

SEQ ID NO: 7142218 - DNA, 22 bp, Homo sapiens
ctgtgtgtgagaagcaggttga

SEQ ID NO: 7142219 - DNA, 22 bp, Homo sapiens
ctgtgtgtgagaagcaggttga

SEQ ID NO: 7142220 - DNA, 22 bp, Homo sapiens
ctgtgtgtgagaagcaggttga

SEQ ID NO: 7142221 - DNA, 22 bp, Homo sapiens
ctgtgtgtgagaagcaggttga

SEQ ID NO: 7142222 - DNA, 22 bp, Homo sapiens
ctgtgtgtgaacacagcccagc

SEQ ID NO: 7142223 - DNA, 22 bp, Homo sapiens
ctgtgtgtgaacacagcccagc

SEQ ID NO: 7142224 - DNA, 22 bp, Homo sapiens
ctgtgtgtgagaagcaggttga

SEQ ID NO: 7142225 - DNA, 22 bp, Homo sapiens
ctgtgactttgaataagaggga

SEQ ID NO: 7142226 - DNA, 22 bp, Homo sapiens
ctgtgagaagaatcccacctga

SEQ ID NO: 7142227 - DNA, 22 bp, Homo sapiens
ctgtgagactgatagggaagag

SEQ ID NO: 7142228 - DNA, 22 bp, Homo sapiens
ctgtgagatgaccaactgactg

SEQ ID NO: 7142229 - DNA, 22 bp, Homo sapiens
ctgtgactgtgttggatgcaca

SEQ ID NO: 7142230 - DNA, 22 bp, Homo sapiens
ctgtgacttccggatgacatga

SEQ ID NO: 7142231 - DNA, 22 bp, Homo sapiens
ctgtgactggaatctggctctt

SEQ ID NO: 7142232 - DNA, 22 bp, Homo sapiens
ctgtgactgggtgacagtcctc

SEQ ID NO: 7142233 - DNA, 22 bp, Homo sapiens
ctgtgactgggtgacagtcctc

SEQ ID NO: 7142234 - DNA, 22 bp, Homo sapiens
ctgtgactgcagcaccaagtaa

SEQ ID NO: 7142235 - DNA, 18 bp, Homo sapiens
ctgtgactcctagatctc

SEQ ID NO: 7142236 - DNA, 22 bp, Homo sapiens
ctgtgactagacctgcaggaga

SEQ ID NO: 7142237 - DNA, 22 bp, Homo sapiens
ctgtgacctccaggaaggggtg

SEQ ID NO: 7142238 - DNA, 22 bp, Homo sapiens
ctgtgaccttagcaagggaaat

SEQ ID NO: 7142239 - DNA, 21 bp, Homo sapiens
ctgtgacctttctttcctcct

SEQ ID NO: 7142240 - DNA, 22 bp, Homo sapiens
ctgtgagggccagagtcagggc

SEQ ID NO: 7142241 - DNA, 22 bp, Homo sapiens
ctgtggaatcatcaggtcttac

SEQ ID NO: 7142242 - DNA, 22 bp, Homo sapiens
ctgtggaatcgggaaaagacag

SEQ ID NO: 7142243 - DNA, 22 bp, Homo sapiens
ctgtggaatcgggaaaagacag

SEQ ID NO: 7142244 - DNA, 20 bp, Homo sapiens
ctgtggaattttaccatgcg

SEQ ID NO: 7142245 - DNA, 22 bp, Homo sapiens
ctgtggacaaggatgttagcta

SEQ ID NO: 7142246 - DNA, 22 bp, Homo sapiens
ctgtggacaaggatgttagcta

SEQ ID NO: 7142247 - DNA, 21 bp, Homo sapiens
ctgtggacaggctggggcatg

SEQ ID NO: 7142248 - DNA, 22 bp, Homo sapiens
ctgtggacaggggcgcagaggt

SEQ ID NO: 7142249 - DNA, 22 bp, Homo sapiens
ctgtggacaggggcgcagaggt

SEQ ID NO: 7142250 - DNA, 22 bp, Homo sapiens
ctgtggacaggggcgcagaggt

SEQ ID NO: 7142251 - DNA, 22 bp, Homo sapiens
ctgtggacctgctcttagagac

SEQ ID NO: 7142252 - DNA, 22 bp, Homo sapiens
ctgtgaggcctttggccagata

SEQ ID NO: 7142253 - DNA, 22 bp, Homo sapiens
ctgtgaggcctttggccagata

SEQ ID NO: 7142254 - DNA, 22 bp, Homo sapiens
ctgtgaggccctgggtgctgga

SEQ ID NO: 7142255 - DNA, 22 bp, Homo sapiens
ctgtgaggcgggtggagtggag

SEQ ID NO: 7142256 - DNA, 22 bp, Homo sapiens
ctgtgagggcagggaccagagg

SEQ ID NO: 7142257 - DNA, 22 bp, Homo sapiens
ctgtgaggcgggtggagtggag

SEQ ID NO: 7142258 - DNA, 22 bp, Homo sapiens
ctgtgaggcgggtggagtggag

SEQ ID NO: 7142259 - DNA, 22 bp, Homo sapiens
ctgtgagggcagggaccagagg

SEQ ID NO: 7142260 - DNA, 22 bp, Homo sapiens
ctgtgaaatcaaccttgagccc

SEQ ID NO: 7142261 - DNA, 22 bp, Homo sapiens
ctgtctgtttcaaaagtggtta

SEQ ID NO: 7142262 - DNA, 22 bp, Homo sapiens
ctgtctgttcagattcattact

SEQ ID NO: 7142263 - DNA, 22 bp, Homo sapiens
ctgtctgttcagattcattact

SEQ ID NO: 7142264 - DNA, 22 bp, Homo sapiens
ctgtctgttgaccatagtttgc

SEQ ID NO: 7142265 - DNA, 21 bp, Homo sapiens
ctgtccctctttgcttccctc

SEQ ID NO: 7142266 - DNA, 22 bp, Homo sapiens
ctgtctgtgtggacacggctgc

SEQ ID NO: 7142267 - DNA, 22 bp, Homo sapiens
ctgtctgttatctcaccagtcc

SEQ ID NO: 7142268 - DNA, 19 bp, Homo sapiens
ctgtccctcccaggtatga

SEQ ID NO: 7142269 - DNA, 22 bp, Homo sapiens
ctgtccctctcacacctcacca

SEQ ID NO: 7142270 - DNA, 22 bp, Homo sapiens
ctgtccctcatcacctctgggt

SEQ ID NO: 7142271 - DNA, 21 bp, Homo sapiens
ctgtccctctttgcttccctc

SEQ ID NO: 7142272 - DNA, 22 bp, Homo sapiens
ctgtccctcagttctgggcaaa

SEQ ID NO: 7142273 - DNA, 22 bp, Homo sapiens
ctgtccctcagttctgggcaaa

SEQ ID NO: 7142274 - DNA, 22 bp, Homo sapiens
ctgtgaatgttatatctcaatg

SEQ ID NO: 7142275 - DNA, 22 bp, Homo sapiens
ctgtgaatttaaagcacacatc

SEQ ID NO: 7142276 - DNA, 22 bp, Homo sapiens
ctgtgaacaatagcagcatctt

SEQ ID NO: 7142277 - DNA, 22 bp, Homo sapiens
ctgtgaatcttgatgttatttc

SEQ ID NO: 7142278 - DNA, 22 bp, Homo sapiens
ctgtgaatgctagtaagagtgc

SEQ ID NO: 7142279 - DNA, 22 bp, Homo sapiens
ctgtgacagtttctcagacttt

SEQ ID NO: 7142280 - DNA, 20 bp, Homo sapiens
ctgtgaccagagacccagga

SEQ ID NO: 7142281 - DNA, 22 bp, Homo sapiens
ctgtgacccagttcctggcacc

SEQ ID NO: 7142282 - DNA, 22 bp, Homo sapiens
ctgtgacccagttcctggcacc

SEQ ID NO: 7142283 - DNA, 22 bp, Homo sapiens
ctgtgaatttaaagcacacatc

SEQ ID NO: 7142284 - DNA, 22 bp, Homo sapiens
ctgtgacagagcttgagtgaga

SEQ ID NO: 7142285 - DNA, 22 bp, Homo sapiens
ctgtgacagtttctcagaattt

SEQ ID NO: 7142286 - DNA, 18 bp, Homo sapiens
ctgtcccatcctcaggtt

SEQ ID NO: 7142287 - DNA, 18 bp, Homo sapiens
ctgtcccatcctcaggtt

SEQ ID NO: 7142288 - DNA, 22 bp, Homo sapiens
ctgtcccagtgatcctgagtgc

SEQ ID NO: 7142289 - DNA, 22 bp, Homo sapiens
ctgtcccagtgatcctgagtgc

SEQ ID NO: 7142290 - DNA, 18 bp, Homo sapiens
ctgtcccatcctcaggtt

SEQ ID NO: 7142291 - DNA, 21 bp, Homo sapiens
ctgtccccagtgagcaccccc

SEQ ID NO: 7142292 - DNA, 21 bp, Homo sapiens
ctgtccccagtgagcaccccc

SEQ ID NO: 7142293 - DNA, 22 bp, Homo sapiens
ctgtccccgcgagtccagagct

SEQ ID NO: 7142294 - DNA, 22 bp, Homo sapiens
ctgtcccctgtgctttcacttg

SEQ ID NO: 7142295 - DNA, 22 bp, Homo sapiens
ctgtccccgcgagtccagagct

SEQ ID NO: 7142296 - DNA, 22 bp, Homo sapiens
ctgtccctcagttctgggcaaa

SEQ ID NO: 7142297 - DNA, 19 bp, Homo sapiens
ctgtcccagactctgctct

SEQ ID NO: 7142298 - DNA, 22 bp, Homo sapiens
ctgtcccagatgttctcagcac

SEQ ID NO: 7142299 - DNA, 22 bp, Homo sapiens
ctgtcccagatgttctcagcac

SEQ ID NO: 7142300 - DNA, 22 bp, Homo sapiens
ctgtcccagatgttctcagcac

SEQ ID NO: 7142301 - DNA, 22 bp, Homo sapiens
ctgtcccagccccgtactctaa

SEQ ID NO: 7142302 - DNA, 22 bp, Homo sapiens
ctgtcccaggagctgtaagaca

SEQ ID NO: 7142303 - DNA, 22 bp, Homo sapiens
ctgtcccaggagctgtaagaca

SEQ ID NO: 7142304 - DNA, 22 bp, Homo sapiens
ctgtcccaggatcctgactcca

SEQ ID NO: 7142305 - DNA, 22 bp, Homo sapiens
ctgtcccaggatcctgactcca

SEQ ID NO: 7142306 - DNA, 22 bp, Homo sapiens
ctgtccagtgcagagaacagag

SEQ ID NO: 7142307 - DNA, 22 bp, Homo sapiens
ctgtccatggcaatgatgcaga

SEQ ID NO: 7142308 - DNA, 22 bp, Homo sapiens
ctgtcccacaagcagtgtgcac

SEQ ID NO: 7142309 - DNA, 19 bp, Homo sapiens
ctgtcccagactctgctct

SEQ ID NO: 7142310 - DNA, 22 bp, Homo sapiens
ctgtcatggtcagattgtcatc

SEQ ID NO: 7142311 - DNA, 22 bp, Homo sapiens
ctgtcatggtcagattgtcatc

SEQ ID NO: 7142312 - DNA, 22 bp, Homo sapiens
ctgtcatggtttgaatgctcgc

SEQ ID NO: 7142313 - DNA, 22 bp, Homo sapiens
ctgtcattcttacataatgtga

SEQ ID NO: 7142314 - DNA, 21 bp, Homo sapiens
ctgtcatgcaaccattctcca

SEQ ID NO: 7142315 - DNA, 22 bp, Homo sapiens
ctggttttctagtccactggct

SEQ ID NO: 7142316 - DNA, 22 bp, Homo sapiens
ctggttttgaatatgtctgctt

SEQ ID NO: 7142317 - DNA, 22 bp, Homo sapiens
ctggttttggctggcaaggttg

SEQ ID NO: 7142318 - DNA, 22 bp, Homo sapiens
ctggttttaatgttatgtttat

SEQ ID NO: 7142319 - DNA, 22 bp, Homo sapiens
ctggttttatgttatagatgga

SEQ ID NO: 7142320 - DNA, 22 bp, Homo sapiens
ctggtttagctgtaaggttccc

SEQ ID NO: 7142321 - DNA, 22 bp, Homo sapiens
ctggtttagtcataatggagaa

SEQ ID NO: 7142322 - DNA, 17 bp, Homo sapiens
ctggtttatgggcagtg

SEQ ID NO: 7142323 - DNA, 22 bp, Homo sapiens
ctggttcagtgaaaggcatggg

SEQ ID NO: 7142324 - DNA, 22 bp, Homo sapiens
ctggttcattaggtattagtgg

SEQ ID NO: 7142325 - DNA, 22 bp, Homo sapiens
ctggttctgattttgctgcatt

SEQ ID NO: 7142326 - DNA, 22 bp, Homo sapiens
ctggttggaagtgcagactctc

SEQ ID NO: 7142327 - DNA, 22 bp, Homo sapiens
ctggttggaggagaagtttgga

SEQ ID NO: 7142328 - DNA, 22 bp, Homo sapiens
ctgggggtcttgaaagggagag

SEQ ID NO: 7142329 - DNA, 22 bp, Homo sapiens
ctgggggtgagcagcagcgacg

SEQ ID NO: 7142330 - DNA, 22 bp, Homo sapiens
ctgggggtgagcagcagcgacg

SEQ ID NO: 7142331 - DNA, 22 bp, Homo sapiens
ctgggggtgagcagcagcgacg

SEQ ID NO: 7142332 - DNA, 19 bp, Homo sapiens
ctgggggtgctcacgctct

SEQ ID NO: 7142333 - DNA, 19 bp, Homo sapiens
ctgggggtgctcacgctct

SEQ ID NO: 7142334 - DNA, 22 bp, Homo sapiens
ctggggtgagcagaaacagggg

SEQ ID NO: 7142335 - DNA, 22 bp, Homo sapiens
ctggggtctcaattctagcggg

SEQ ID NO: 7142336 - DNA, 22 bp, Homo sapiens
ctggggtccttgccatgtgtca

SEQ ID NO: 7142337 - DNA, 22 bp, Homo sapiens
ctggggtctcaattctagcggg

SEQ ID NO: 7142338 - DNA, 22 bp, Homo sapiens
ctgggggtcgcgcctctgggca

SEQ ID NO: 7142339 - DNA, 22 bp, Homo sapiens
ctgggggtcgcgcctctgggca

SEQ ID NO: 7142340 - DNA, 22 bp, Homo sapiens
ctgggggtcgcgcctctgggca

SEQ ID NO: 7142341 - DNA, 22 bp, Homo sapiens
ctgggggtcgcgcctctgggca

SEQ ID NO: 7142342 - DNA, 22 bp, Homo sapiens
ctggggggctactgacagagga

SEQ ID NO: 7142343 - DNA, 22 bp, Homo sapiens
ctggggggctactgacagagga

SEQ ID NO: 7142344 - DNA, 22 bp, Homo sapiens
ctggggggctactgacagagga

SEQ ID NO: 7142345 - DNA, 22 bp, Homo sapiens
ctggggggctactgacagagga

SEQ ID NO: 7142346 - DNA, 22 bp, Homo sapiens
ctgggtggaaagtgctgagaat

SEQ ID NO: 7142347 - DNA, 22 bp, Homo sapiens
ctgggtggaaagtgctgagaat

SEQ ID NO: 7142348 - DNA, 22 bp, Homo sapiens
ctgggtggaaagtgctgagaat

SEQ ID NO: 7142349 - DNA, 22 bp, Homo sapiens
ctgggtggaaagtgctgagaat

SEQ ID NO: 7142350 - DNA, 22 bp, Homo sapiens
ctgggtgcttactttgtgctag

SEQ ID NO: 7142351 - DNA, 22 bp, Homo sapiens
ctggggtggtgcaggcctcatg

SEQ ID NO: 7142352 - DNA, 22 bp, Homo sapiens
ctggggtggtgcaggcctcatg

SEQ ID NO: 7142353 - DNA, 22 bp, Homo sapiens
ctggggtggtgcaggcctcatg

SEQ ID NO: 7142354 - DNA, 22 bp, Homo sapiens
ctggggtgtctcgtctgccatt

SEQ ID NO: 7142355 - DNA, 22 bp, Homo sapiens
ctggggtggtgcaggcctcatg

SEQ ID NO: 7142356 - DNA, 22 bp, Homo sapiens
ctggggtggtgcaggcctcatg

SEQ ID NO: 7142357 - DNA, 22 bp, Homo sapiens
ctggggtggaggagctcccctg

SEQ ID NO: 7142358 - DNA, 22 bp, Homo sapiens
ctggggtggatgggtccaagtt

SEQ ID NO: 7142359 - DNA, 22 bp, Homo sapiens
ctggggtggatgggtccaagtt

SEQ ID NO: 7142360 - DNA, 22 bp, Homo sapiens
ctggggtggaggagctcccctg

SEQ ID NO: 7142361 - DNA, 22 bp, Homo sapiens
ctggggtggaggagctcccctg

SEQ ID NO: 7142362 - DNA, 22 bp, Homo sapiens
ctggggtggagattggcaatct

SEQ ID NO: 7142363 - DNA, 22 bp, Homo sapiens
ctggggtggaggagctcccctg

SEQ ID NO: 7142364 - DNA, 22 bp, Homo sapiens
ctggggtggagattggcaatct

SEQ ID NO: 7142365 - DNA, 18 bp, Homo sapiens
ctgggctcgagagatcct

SEQ ID NO: 7142366 - DNA, 18 bp, Homo sapiens
ctgggctcgagagatcct

SEQ ID NO: 7142367 - DNA, 18 bp, Homo sapiens
ctgggctcgagagatcct

SEQ ID NO: 7142368 - DNA, 22 bp, Homo sapiens
ctgggctcctaaccatccaggt

SEQ ID NO: 7142369 - DNA, 22 bp, Homo sapiens
ctgggctcctaaccatccaggt

SEQ ID NO: 7142370 - DNA, 22 bp, Homo sapiens
ctgggctctaagggagcaccgt

SEQ ID NO: 7142371 - DNA, 22 bp, Homo sapiens
ctgggctctaagggagcaccgt

SEQ ID NO: 7142372 - DNA, 20 bp, Homo sapiens
ctgggctcggtggccctggc

SEQ ID NO: 7142373 - DNA, 18 bp, Homo sapiens
ctgggctcgagagatcct

SEQ ID NO: 7142374 - DNA, 20 bp, Homo sapiens
ctgggctcggtggccctggc

SEQ ID NO: 7142375 - DNA, 20 bp, Homo sapiens
ctgggctcggtggccctggc

SEQ ID NO: 7142376 - DNA, 20 bp, Homo sapiens
ctgggctcggtggccctggc

SEQ ID NO: 7142377 - DNA, 18 bp, Homo sapiens
ctgggctcgagagatcct

SEQ ID NO: 7142378 - DNA, 22 bp, Homo sapiens
ctgggggcagcaagaagccatg

SEQ ID NO: 7142379 - DNA, 22 bp, Homo sapiens
ctggggggagctgcgtccagca

SEQ ID NO: 7142380 - DNA, 22 bp, Homo sapiens
ctgggggccttacggaactcca

SEQ ID NO: 7142381 - DNA, 22 bp, Homo sapiens
ctggggggagctgcgtccagca

SEQ ID NO: 7142382 - DNA, 22 bp, Homo sapiens
ctggggggagctgcgtccagca

SEQ ID NO: 7142383 - DNA, 22 bp, Homo sapiens
ctggggctggtgaggcaggctc

SEQ ID NO: 7142384 - DNA, 22 bp, Homo sapiens
ctggggctgtaggaggacttat

SEQ ID NO: 7142385 - DNA, 22 bp, Homo sapiens
ctggggctgtaggaggacttat

SEQ ID NO: 7142386 - DNA, 22 bp, Homo sapiens
ctgggctctagaaaggaaagaa

SEQ ID NO: 7142387 - DNA, 22 bp, Homo sapiens
ctggtgtggactccgcgcggag

SEQ ID NO: 7142388 - DNA, 22 bp, Homo sapiens
ctggtgtggcggcgccctgtag

SEQ ID NO: 7142389 - DNA, 22 bp, Homo sapiens
ctggtgttggagcaaatgcagg

SEQ ID NO: 7142390 - DNA, 22 bp, Homo sapiens
ctggtgttggagcaaatgcagg

SEQ ID NO: 7142391 - DNA, 22 bp, Homo sapiens
ctggtgttgtccgggtgagagt

SEQ ID NO: 7142392 - DNA, 22 bp, Homo sapiens
ctggtgttgtccgggtgagagt

SEQ ID NO: 7142393 - DNA, 22 bp, Homo sapiens
ctggtgttgtccgggtgagagt

SEQ ID NO: 7142394 - DNA, 22 bp, Homo sapiens
ctggtgtttatctgactgccta

SEQ ID NO: 7142395 - DNA, 22 bp, Homo sapiens
ctggtgtttattacaggtgctc

SEQ ID NO: 7142396 - DNA, 22 bp, Homo sapiens
ctggtgtttattacaggtgctc

SEQ ID NO: 7142397 - DNA, 22 bp, Homo sapiens
ctggtgtttatctgactgccta

SEQ ID NO: 7142398 - DNA, 22 bp, Homo sapiens
ctggttatcctgcctattttgt

SEQ ID NO: 7142399 - DNA, 22 bp, Homo sapiens
ctggttatggctgtggctatgg

SEQ ID NO: 7142400 - DNA, 22 bp, Homo sapiens
ctggtggttcaggagaatggct

SEQ ID NO: 7142401 - DNA, 22 bp, Homo sapiens
ctggtgtctactacatggttga

SEQ ID NO: 7142402 - DNA, 22 bp, Homo sapiens
ctggtgtctgattctcccctga

SEQ ID NO: 7142403 - DNA, 22 bp, Homo sapiens
ctggtgtctgattctcccctga

SEQ ID NO: 7142404 - DNA, 22 bp, Homo sapiens
ctggtgtctgctccctcacagc

SEQ ID NO: 7142405 - DNA, 22 bp, Homo sapiens
ctggtgtctgctccctcacagc

SEQ ID NO: 7142406 - DNA, 22 bp, Homo sapiens
ctggtgtgattgagcccaggtg

SEQ ID NO: 7142407 - DNA, 22 bp, Homo sapiens
ctggtgtgattgagcccaggtg

SEQ ID NO: 7142408 - DNA, 22 bp, Homo sapiens
ctggtgtggactccgcgcggag

SEQ ID NO: 7142409 - DNA, 22 bp, Homo sapiens
ctggtaggggtgactgttatcg

SEQ ID NO: 7142410 - DNA, 22 bp, Homo sapiens
ctggtagtgtctgccgaggtcc

SEQ ID NO: 7142411 - DNA, 22 bp, Homo sapiens
ctggtagtttgcaaaatggtgt

SEQ ID NO: 7142412 - DNA, 22 bp, Homo sapiens
ctggtagtttgcaaaatggtgt

SEQ ID NO: 7142413 - DNA, 22 bp, Homo sapiens
ctggtatagtataaattaatgt

SEQ ID NO: 7142414 - DNA, 22 bp, Homo sapiens
ctggtattgagttgttgcttcc

SEQ ID NO: 7142415 - DNA, 22 bp, Homo sapiens
ctggtattgagttgttgcttcc

SEQ ID NO: 7142416 - DNA, 22 bp, Homo sapiens
ctggtcaaaaattatgcttact

SEQ ID NO: 7142417 - DNA, 22 bp, Homo sapiens
ctggtcaagagctagcagagct

SEQ ID NO: 7142418 - DNA, 22 bp, Homo sapiens
ctggtcaataatcatgtagtac

SEQ ID NO: 7142419 - DNA, 22 bp, Homo sapiens
ctggtcaaggagagtctctgca

SEQ ID NO: 7142420 - DNA, 22 bp, Homo sapiens
ctggtcaccaggtagcattgta

SEQ ID NO: 7142421 - DNA, 22 bp, Homo sapiens
ctggtgccctgtgtggcaggag

SEQ ID NO: 7142422 - DNA, 22 bp, Homo sapiens
ctggtgccctgtgtggcaggag

SEQ ID NO: 7142423 - DNA, 22 bp, Homo sapiens
ctggtgcctcctccctgtgctt

SEQ ID NO: 7142424 - DNA, 22 bp, Homo sapiens
ctggtgcctcctccctgtgctt

SEQ ID NO: 7142425 - DNA, 22 bp, Homo sapiens
ctggtgcctcctctcccaggtc

SEQ ID NO: 7142426 - DNA, 22 bp, Homo sapiens
ctggtggggagtcctggtctcc

SEQ ID NO: 7142427 - DNA, 22 bp, Homo sapiens
ctggtggggagtcctggtctcc

SEQ ID NO: 7142428 - DNA, 22 bp, Homo sapiens
ctggtggggagtcctggtctcc

SEQ ID NO: 7142429 - DNA, 22 bp, Homo sapiens
ctggtgggtagagggcatcagg

SEQ ID NO: 7142430 - DNA, 22 bp, Homo sapiens
ctggtgggtagagggcatcagg

SEQ ID NO: 7142431 - DNA, 22 bp, Homo sapiens
ctggtgggtagagggcatcagg

SEQ ID NO: 7142432 - DNA, 22 bp, Homo sapiens
ctggtacaaaatgctgatatca

SEQ ID NO: 7142433 - DNA, 22 bp, Homo sapiens
ctgggttttattacagtgagct

SEQ ID NO: 7142434 - DNA, 22 bp, Homo sapiens
ctggtacagggaaataaaggaa

SEQ ID NO: 7142435 - DNA, 22 bp, Homo sapiens
ctggtacagtgttacaaaatgg

SEQ ID NO: 7142436 - DNA, 22 bp, Homo sapiens
ctggtacatagtaagaacacaa

SEQ ID NO: 7142437 - DNA, 22 bp, Homo sapiens
ctggtacatttgatgataatag

SEQ ID NO: 7142438 - DNA, 22 bp, Homo sapiens
ctggtacatttgatgataatag

SEQ ID NO: 7142439 - DNA, 22 bp, Homo sapiens
ctggtagatgccctgctctgta

SEQ ID NO: 7142440 - DNA, 22 bp, Homo sapiens
ctgggtttagggtctccccttg

SEQ ID NO: 7142441 - DNA, 22 bp, Homo sapiens
ctgggttgatctcagccctaag

SEQ ID NO: 7142442 - DNA, 22 bp, Homo sapiens
ctgggttacaagaagcaaaaac

SEQ ID NO: 7142443 - DNA, 22 bp, Homo sapiens
ctgggtgttcacccgaggcgct

SEQ ID NO: 7142444 - DNA, 22 bp, Homo sapiens
ctgggtggaaagtgctgagaat

SEQ ID NO: 7142445 - DNA, 22 bp, Homo sapiens
ctgggtggctgtccagccagcc

SEQ ID NO: 7142446 - DNA, 22 bp, Homo sapiens
ctgggtggaaagtgctgagaat

SEQ ID NO: 7142447 - DNA, 22 bp, Homo sapiens
ctgggtggaaagtgctgagaat

SEQ ID NO: 7142448 - DNA, 22 bp, Homo sapiens
ctgggtggttctaactgttgat

SEQ ID NO: 7142449 - DNA, 22 bp, Homo sapiens
ctgggtggttctaactgttgat

SEQ ID NO: 7142450 - DNA, 22 bp, Homo sapiens
ctgggtggttttgatgtgaatt

SEQ ID NO: 7142451 - DNA, 22 bp, Homo sapiens
ctgggtggttttgatgtgaatt

SEQ ID NO: 7142452 - DNA, 22 bp, Homo sapiens
ctgggtggttttgatgtgaatt

SEQ ID NO: 7142453 - DNA, 22 bp, Homo sapiens
ctgggtggttttgatgtgaatt

SEQ ID NO: 7142454 - DNA, 22 bp, Homo sapiens
ctgggcctccagctctgccagc

SEQ ID NO: 7142455 - DNA, 22 bp, Homo sapiens
ctgggcctccagctctgccagc

SEQ ID NO: 7142456 - DNA, 22 bp, Homo sapiens
ctgggcctccacgggccatcac

SEQ ID NO: 7142457 - DNA, 22 bp, Homo sapiens
ctgggcctcatgcacagagatg

SEQ ID NO: 7142458 - DNA, 22 bp, Homo sapiens
ctgggcctcatgcacagagatg

SEQ ID NO: 7142459 - DNA, 22 bp, Homo sapiens
ctgggcctccacgggccatcac

SEQ ID NO: 7142460 - DNA, 22 bp, Homo sapiens
ctgggctcaaatcctggccctg

SEQ ID NO: 7142461 - DNA, 22 bp, Homo sapiens
ctgggctcaaatcctggccctg

SEQ ID NO: 7142462 - DNA, 22 bp, Homo sapiens
ctgggctcaagaagtcttccct

SEQ ID NO: 7142463 - DNA, 22 bp, Homo sapiens
ctgggctcaaatcctggccctg

SEQ ID NO: 7142464 - DNA, 22 bp, Homo sapiens
ctgggctcaagaagtcttccct

SEQ ID NO: 7142465 - DNA, 22 bp, Homo sapiens
ctgggctcaagaagtcttccct

SEQ ID NO: 7142466 - DNA, 22 bp, Homo sapiens
ctgggctcagtggctcatggct

SEQ ID NO: 7142467 - DNA, 22 bp, Homo sapiens
ctgggctcagtggctcatggct

SEQ ID NO: 7142468 - DNA, 22 bp, Homo sapiens
ctgggctcagtgtctcactcct

SEQ ID NO: 7142469 - DNA, 22 bp, Homo sapiens
ctgggctcagtgtctcactcct

SEQ ID NO: 7142470 - DNA, 22 bp, Homo sapiens
ctgggctcagtgtctcactcct

SEQ ID NO: 7142471 - DNA, 21 bp, Homo sapiens
ctgggctcatggtgttacaga

SEQ ID NO: 7142472 - DNA, 22 bp, Homo sapiens
ctgggctccactacttgctaac

SEQ ID NO: 7142473 - DNA, 22 bp, Homo sapiens
ctgggctccactcccacagtgt

SEQ ID NO: 7142474 - DNA, 22 bp, Homo sapiens
ctgggctccactcccacagtgt

SEQ ID NO: 7142475 - DNA, 22 bp, Homo sapiens
ctgggctccactcccacagtgt

SEQ ID NO: 7142476 - DNA, 22 bp, Homo sapiens
ctgggctccctcatgtgtctgc

SEQ ID NO: 7142477 - DNA, 22 bp, Homo sapiens
ctgggctccctcatgtgtctgc

SEQ ID NO: 7142478 - DNA, 22 bp, Homo sapiens
ctgggcctagcaacagaggagt

SEQ ID NO: 7142479 - DNA, 22 bp, Homo sapiens
ctgggcctagcaacagaggagt

SEQ ID NO: 7142480 - DNA, 22 bp, Homo sapiens
ctgggcctagcaacagaggagt

SEQ ID NO: 7142481 - DNA, 22 bp, Homo sapiens
ctgggcctagaggaagctgaca

SEQ ID NO: 7142482 - DNA, 23 bp, Homo sapiens
ctgggcctatggtctgaatccaa

SEQ ID NO: 7142483 - DNA, 23 bp, Homo sapiens
ctgggcctatggtctgaatccaa

SEQ ID NO: 7142484 - DNA, 22 bp, Homo sapiens
ctgggcctaggatggaagggcc

SEQ ID NO: 7142485 - DNA, 22 bp, Homo sapiens
ctgggcctagcaacagaggagt

SEQ ID NO: 7142486 - DNA, 22 bp, Homo sapiens
ctgggcctagaggaagctgaca

SEQ ID NO: 7142487 - DNA, 22 bp, Homo sapiens
ctgggcctaacccacagcgttt

SEQ ID NO: 7142488 - DNA, 22 bp, Homo sapiens
ctgggcctaacccacagcgttt

SEQ ID NO: 7142489 - DNA, 22 bp, Homo sapiens
ctgggcccaggcggctctcgga

SEQ ID NO: 7142490 - DNA, 22 bp, Homo sapiens
ctgggccctatggaagaaaggg

SEQ ID NO: 7142491 - DNA, 22 bp, Homo sapiens
ctgggccctatggaagaaaggg

SEQ ID NO: 7142492 - DNA, 22 bp, Homo sapiens
ctgggccctatggaagaaaggg

SEQ ID NO: 7142493 - DNA, 22 bp, Homo sapiens
ctgggccctgaagacagtcagg

SEQ ID NO: 7142494 - DNA, 22 bp, Homo sapiens
ctgggccctgaagacagtcagg

SEQ ID NO: 7142495 - DNA, 22 bp, Homo sapiens
ctgggcctcaatctcagagttt

SEQ ID NO: 7142496 - DNA, 22 bp, Homo sapiens
ctgggcctcaatctcagagttt

SEQ ID NO: 7142497 - DNA, 22 bp, Homo sapiens
ctgggcctcaccctagaccaat

SEQ ID NO: 7142498 - DNA, 22 bp, Homo sapiens
ctgggcctcaccctagaccaat

SEQ ID NO: 7142499 - DNA, 22 bp, Homo sapiens
ctgggcctcaatctcagagttt

SEQ ID NO: 7142500 - DNA, 22 bp, Homo sapiens
ctgggcctcaccctagaccaat

SEQ ID NO: 7142501 - DNA, 22 bp, Homo sapiens
ctgggcctcatccccagagttt

SEQ ID NO: 7142502 - DNA, 22 bp, Homo sapiens
ctgggcctcatccccagagttt

SEQ ID NO: 7142503 - DNA, 22 bp, Homo sapiens
ctgggcctcatcctcagagttt

SEQ ID NO: 7142504 - DNA, 22 bp, Homo sapiens
ctgggcctcatccccagagttt

SEQ ID NO: 7142505 - DNA, 22 bp, Homo sapiens
ctgggcctcatcctcagagttt

SEQ ID NO: 7142506 - DNA, 22 bp, Homo sapiens
ctgggcctcatcctcagagttt

SEQ ID NO: 7142507 - DNA, 22 bp, Homo sapiens
ctgggcctcatgcacagagatg

SEQ ID NO: 7142508 - DNA, 22 bp, Homo sapiens
ctgggccagatccagcctcaca

SEQ ID NO: 7142509 - DNA, 22 bp, Homo sapiens
ctgggatgtgaggagcgcctct

SEQ ID NO: 7142510 - DNA, 22 bp, Homo sapiens
ctgggccagcaactgcaatgga

SEQ ID NO: 7142511 - DNA, 19 bp, Homo sapiens
ctgggatgtctcctcccag

SEQ ID NO: 7142512 - DNA, 22 bp, Homo sapiens
ctgggatggctccgctgctgct

SEQ ID NO: 7142513 - DNA, 22 bp, Homo sapiens
ctgggatggctttcctgcatta

SEQ ID NO: 7142514 - DNA, 22 bp, Homo sapiens
ctgggatggctttcctgcatta

SEQ ID NO: 7142515 - DNA, 22 bp, Homo sapiens
ctgggatggctttcctgcatta

SEQ ID NO: 7142516 - DNA, 22 bp, Homo sapiens
ctgggatgggaactgagaatca

SEQ ID NO: 7142517 - DNA, 22 bp, Homo sapiens
ctgggatgggaactgagaatca

SEQ ID NO: 7142518 - DNA, 22 bp, Homo sapiens
ctgggatgggaactgagaatca

SEQ ID NO: 7142519 - DNA, 22 bp, Homo sapiens
ctgggatgtctatagaacactt

SEQ ID NO: 7142520 - DNA, 22 bp, Homo sapiens
ctgggcccacgagggctctggg

SEQ ID NO: 7142521 - DNA, 22 bp, Homo sapiens
ctgggcccaggcggctctcgga

SEQ ID NO: 7142522 - DNA, 22 bp, Homo sapiens
ctgggcccaggcggctctcgga

SEQ ID NO: 7142523 - DNA, 22 bp, Homo sapiens
ctgggcccaggcggctctcgga

SEQ ID NO: 7142524 - DNA, 22 bp, Homo sapiens
ctgggcccacgagggctctggg

SEQ ID NO: 7142525 - DNA, 22 bp, Homo sapiens
ctgggcccacgagggctctggg

SEQ ID NO: 7142526 - DNA, 22 bp, Homo sapiens
ctgggcccacgagggctctggg

SEQ ID NO: 7142527 - DNA, 22 bp, Homo sapiens
ctgggcccacgagggctctggg

SEQ ID NO: 7142528 - DNA, 22 bp, Homo sapiens
ctgggccaggaccagggttgaa

SEQ ID NO: 7142529 - DNA, 22 bp, Homo sapiens
ctgggatccacgggctcccaag

SEQ ID NO: 7142530 - DNA, 22 bp, Homo sapiens
ctgggataggaaggtttccagc

SEQ ID NO: 7142531 - DNA, 22 bp, Homo sapiens
ctgggataggaaggtttccagc

SEQ ID NO: 7142532 - DNA, 22 bp, Homo sapiens
ctgggagtttgttagtaatgca

SEQ ID NO: 7142533 - DNA, 22 bp, Homo sapiens
ctgggatgctccggcctggatg

SEQ ID NO: 7142534 - DNA, 22 bp, Homo sapiens
ctgggatgctccggcctggatg

SEQ ID NO: 7142535 - DNA, 22 bp, Homo sapiens
ctgggatgcggaggttgcggtg

SEQ ID NO: 7142536 - DNA, 22 bp, Homo sapiens
ctgggatgctccggcctggatg

SEQ ID NO: 7142537 - DNA, 22 bp, Homo sapiens
ctgggatgctccggcctggatg

SEQ ID NO: 7142538 - DNA, 22 bp, Homo sapiens
ctgggatgctccggcctggatg

SEQ ID NO: 7142539 - DNA, 22 bp, Homo sapiens
ctgggatgctccggcctggatg

SEQ ID NO: 7142540 - DNA, 22 bp, Homo sapiens
ctgggatggctccgctgctgct

SEQ ID NO: 7142541 - DNA, 19 bp, Homo sapiens
ctgggagttcactgctgcc

SEQ ID NO: 7142542 - DNA, 19 bp, Homo sapiens
ctgggagttcactgctgcc

SEQ ID NO: 7142543 - DNA, 22 bp, Homo sapiens
ctgggagttgacgaggcttgta

SEQ ID NO: 7142544 - DNA, 22 bp, Homo sapiens
ctgggagtgtccctctggtaat

SEQ ID NO: 7142545 - DNA, 22 bp, Homo sapiens
ctgggagtgtccctctggtaat

SEQ ID NO: 7142546 - DNA, 22 bp, Homo sapiens
ctgggagtgttctaggtcacat

SEQ ID NO: 7142547 - DNA, 22 bp, Homo sapiens
ctgggagtgaaaggagggctgc

SEQ ID NO: 7142548 - DNA, 22 bp, Homo sapiens
ctgggagtggtgacagctctcg

SEQ ID NO: 7142549 - DNA, 22 bp, Homo sapiens
ctgggagtctggaattttggta

SEQ ID NO: 7142550 - DNA, 22 bp, Homo sapiens
ctgggagtctggcctctggtcc

SEQ ID NO: 7142551 - DNA, 22 bp, Homo sapiens
ctgggagtcaccaggagcaagg

SEQ ID NO: 7142552 - DNA, 22 bp, Homo sapiens
ctgggagtccctggaatagctc

SEQ ID NO: 7142553 - DNA, 22 bp, Homo sapiens
ctgggaggcggaggttgcagtg

SEQ ID NO: 7142554 - DNA, 22 bp, Homo sapiens
ctggagctctccagagccccgt

SEQ ID NO: 7142555 - DNA, 22 bp, Homo sapiens
ctgggaggcggaggttgcagtg

SEQ ID NO: 7142556 - DNA, 22 bp, Homo sapiens
ctgggaggcggaggttgcagtg

SEQ ID NO: 7142557 - DNA, 22 bp, Homo sapiens
ctgggaggcggaggttgcagtg

SEQ ID NO: 7142558 - DNA, 22 bp, Homo sapiens
ctgggaggcggaggttgcagtg

SEQ ID NO: 7142559 - DNA, 22 bp, Homo sapiens
ctggagctccagggtctcctct

SEQ ID NO: 7142560 - DNA, 22 bp, Homo sapiens
ctggagccttcaccaggggaaa

SEQ ID NO: 7142561 - DNA, 22 bp, Homo sapiens
ctggagccttcaccaggggaaa

SEQ ID NO: 7142562 - DNA, 22 bp, Homo sapiens
ctggagccttcaccaggggaaa

SEQ ID NO: 7142563 - DNA, 22 bp, Homo sapiens
ctggagccttcaccaggggaaa

SEQ ID NO: 7142564 - DNA, 22 bp, Homo sapiens
tttattccaaagcttgcacttt

SEQ ID NO: 7142565 - DNA, 22 bp, Homo sapiens
tttattcattgtttcgtcgcag

SEQ ID NO: 7142566 - DNA, 22 bp, Homo sapiens
tttattcatcatctgttcatat

SEQ ID NO: 7142567 - DNA, 22 bp, Homo sapiens
tttattcattgtttcgtcgcag

SEQ ID NO: 7142568 - DNA, 22 bp, Homo sapiens
tttattccagtgtttctcaaat

SEQ ID NO: 7142569 - DNA, 22 bp, Homo sapiens
tttcacatagaaagtgatttac

SEQ ID NO: 7142570 - DNA, 22 bp, Homo sapiens
tttcacatataggggaagctac

SEQ ID NO: 7142571 - DNA, 20 bp, Homo sapiens
tttattcagcctaccctctt

SEQ ID NO: 7142572 - DNA, 22 bp, Homo sapiens
tttattcagcagcagcagtggt

SEQ ID NO: 7142573 - DNA, 22 bp, Homo sapiens
tttattcatcatctgttcatat

SEQ ID NO: 7142574 - DNA, 22 bp, Homo sapiens
tttattcatcatctgttcatat

SEQ ID NO: 7142575 - DNA, 22 bp, Homo sapiens
tttattcatcatctgttcatat

SEQ ID NO: 7142576 - DNA, 22 bp, Homo sapiens
tttattcatcatctgttcatat

SEQ ID NO: 7142577 - DNA, 22 bp, Homo sapiens
tttcagaaggggagaaaggtca

SEQ ID NO: 7142578 - DNA, 22 bp, Homo sapiens
tttcagaagtcaactaggtaaa

SEQ ID NO: 7142579 - DNA, 22 bp, Homo sapiens
tttcagaaccgctaaaataaat

SEQ ID NO: 7142580 - DNA, 22 bp, Homo sapiens
tttcagaaccgctaaaataaat

SEQ ID NO: 7142581 - DNA, 22 bp, Homo sapiens
tttcagaaccgctaaaataaat

SEQ ID NO: 7142582 - DNA, 22 bp, Homo sapiens
tttcagaaattatattagatgc

SEQ ID NO: 7142583 - DNA, 22 bp, Homo sapiens
tttcagaaattatattagatgc

SEQ ID NO: 7142584 - DNA, 22 bp, Homo sapiens
tttcagaaattgttattattct

SEQ ID NO: 7142585 - DNA, 22 bp, Homo sapiens
tttcagaaattgttattattct

SEQ ID NO: 7142586 - DNA, 22 bp, Homo sapiens
tttcagaaccaagagagacatc

SEQ ID NO: 7142587 - DNA, 22 bp, Homo sapiens
tttcagaaccaagagagacatc

SEQ ID NO: 7142588 - DNA, 22 bp, Homo sapiens
tttcagaaccaagagagacatc

SEQ ID NO: 7142589 - DNA, 23 bp, Homo sapiens
tttcagaagtggtcctaggaagc

SEQ ID NO: 7142590 - DNA, 22 bp, Homo sapiens
tttcagaagtcaactaggtaaa

SEQ ID NO: 7142591 - DNA, 22 bp, Homo sapiens
tttcagaagtcacagttgactg

SEQ ID NO: 7142592 - DNA, 22 bp, Homo sapiens
tttcagaatagcaaagcaagct

SEQ ID NO: 7142593 - DNA, 22 bp, Homo sapiens
tttcagaatagcaaagcaagct

SEQ ID NO: 7142594 - DNA, 22 bp, Homo sapiens
tttcagaatagcaaagcaagct

SEQ ID NO: 7142595 - DNA, 22 bp, Homo sapiens
tttcagaatatcgattcagtga

SEQ ID NO: 7142596 - DNA, 22 bp, Homo sapiens
ctcctgtggtcaagggtgggac

SEQ ID NO: 7142597 - DNA, 22 bp, Homo sapiens
tttcagaatatcgattcagtga

SEQ ID NO: 7142598 - DNA, 22 bp, Homo sapiens
ctccttccaacaagagaaagag

SEQ ID NO: 7142599 - DNA, 22 bp, Homo sapiens
ctccttcccttcaagtgttcct

SEQ ID NO: 7142600 - DNA, 22 bp, Homo sapiens
ctccttcctgcagatctgagat

SEQ ID NO: 7142601 - DNA, 22 bp, Homo sapiens
ctccttccctaccatcaatgtt

SEQ ID NO: 7142602 - DNA, 19 bp, Homo sapiens
ctccttccctggtttctgt

SEQ ID NO: 7142603 - DNA, 22 bp, Homo sapiens
ctccttccaacaagagaaagag

SEQ ID NO: 7142604 - DNA, 22 bp, Homo sapiens
ctccttcccatgagtgtgggca

SEQ ID NO: 7142605 - DNA, 22 bp, Homo sapiens
ctccttcccatgagtgtgggca

SEQ ID NO: 7142606 - DNA, 22 bp, Homo sapiens
ctccttcccctactcagcatcc

SEQ ID NO: 7142607 - DNA, 22 bp, Homo sapiens
ctccttcccctactcagcatcc

SEQ ID NO: 7142608 - DNA, 22 bp, Homo sapiens
ctccttcctgccccagtgataa

SEQ ID NO: 7142609 - DNA, 22 bp, Homo sapiens
ctccttcctggttagcacctta

SEQ ID NO: 7142610 - DNA, 22 bp, Homo sapiens
tttcagtttatgtcttgaatta

SEQ ID NO: 7142611 - DNA, 22 bp, Homo sapiens
ctccttcctggttagcacctta

SEQ ID NO: 7142612 - DNA, 22 bp, Homo sapiens
tttattcactcattcagccagt

SEQ ID NO: 7142613 - DNA, 19 bp, Homo sapiens
tttattcacctttaccttg

SEQ ID NO: 7142614 - DNA, 19 bp, Homo sapiens
tttattcacctttaccttg

SEQ ID NO: 7142615 - DNA, 22 bp, Homo sapiens
tttattcactcattcagccagt

SEQ ID NO: 7142616 - DNA, 22 bp, Homo sapiens
tttatgtaagtggaatgatgcc

SEQ ID NO: 7142617 - DNA, 22 bp, Homo sapiens
tttatgtaagtggaatgatgcc

SEQ ID NO: 7142618 - DNA, 22 bp, Homo sapiens
tttattcacttcagtgccaaag

SEQ ID NO: 7142619 - DNA, 22 bp, Homo sapiens
tttattcacttcagtgccaaag

SEQ ID NO: 7142620 - DNA, 22 bp, Homo sapiens
tttattcagcagcagcagtggt

SEQ ID NO: 7142621 - DNA, 22 bp, Homo sapiens
tttattcagcagcagcagtggt

SEQ ID NO: 7142622 - DNA, 22 bp, Homo sapiens
tttattcactggggtctgcccg

SEQ ID NO: 7142623 - DNA, 22 bp, Homo sapiens
tttattcactggggtctgcccg

SEQ ID NO: 7142624 - DNA, 22 bp, Homo sapiens
tttattcactcattcagccagt

SEQ ID NO: 7142625 - DNA, 22 bp, Homo sapiens
tttattcactggggtctgcccg

SEQ ID NO: 7142626 - DNA, 22 bp, Homo sapiens
tttatgcagcctcagtatcaga

SEQ ID NO: 7142627 - DNA, 21 bp, Homo sapiens
tttatgcatgcctctctgtca

SEQ ID NO: 7142628 - DNA, 21 bp, Homo sapiens
tttatgcatgcctctctgtca

SEQ ID NO: 7142629 - DNA, 22 bp, Homo sapiens
tttatgcctccagatcttgctt

SEQ ID NO: 7142630 - DNA, 22 bp, Homo sapiens
tttatgcagcgtttcaccaccc

SEQ ID NO: 7142631 - DNA, 23 bp, Homo sapiens
tttatgcagcatgtagaacatgg

SEQ ID NO: 7142632 - DNA, 23 bp, Homo sapiens
tttatgcagcatgtagaacatgg

SEQ ID NO: 7142633 - DNA, 21 bp, Homo sapiens
tttatgcagataatgctattt

SEQ ID NO: 7142634 - DNA, 22 bp, Homo sapiens
tttatgcagcactttacatttg

SEQ ID NO: 7142635 - DNA, 22 bp, Homo sapiens
tttatgcacacttagacatggc

SEQ ID NO: 7142636 - DNA, 22 bp, Homo sapiens
tttatgcacacttagacatggc

SEQ ID NO: 7142637 - DNA, 21 bp, Homo sapiens
tttatgcagataatgctattt

SEQ ID NO: 7142638 - DNA, 22 bp, Homo sapiens
tttatgattattttaaagcagc

SEQ ID NO: 7142639 - DNA, 22 bp, Homo sapiens
tttatgattattttaaagcagc

SEQ ID NO: 7142640 - DNA, 22 bp, Homo sapiens
tttatgattattttaaagcagc

SEQ ID NO: 7142641 - DNA, 22 bp, Homo sapiens
ctccaggagggcttcctgtgat

SEQ ID NO: 7142642 - DNA, 22 bp, Homo sapiens
ctccaggagggggatggctgta

SEQ ID NO: 7142643 - DNA, 22 bp, Homo sapiens
ctccaggaggttgctgcttcct

SEQ ID NO: 7142644 - DNA, 22 bp, Homo sapiens
ctccaggagtggcctggacacc

SEQ ID NO: 7142645 - DNA, 22 bp, Homo sapiens
ctccaggatgttagacgtccag

SEQ ID NO: 7142646 - DNA, 22 bp, Homo sapiens
ctccaggatgttagacgtccag

SEQ ID NO: 7142647 - DNA, 16 bp, Homo sapiens
ctccaggcaagaatgg

SEQ ID NO: 7142648 - DNA, 22 bp, Homo sapiens
ctccaggagtggcctggacacc

SEQ ID NO: 7142649 - DNA, 19 bp, Homo sapiens
ctccaggatggctgggcga

SEQ ID NO: 7142650 - DNA, 19 bp, Homo sapiens
ctccaggatggctgggcga

SEQ ID NO: 7142651 - DNA, 19 bp, Homo sapiens
ctccaggatggctgggcga

SEQ ID NO: 7142652 - DNA, 22 bp, Homo sapiens
ctccaggccaagattaagtaat

SEQ ID NO: 7142653 - DNA, 22 bp, Homo sapiens
ctccaggccaagattaagtaat

SEQ ID NO: 7142654 - DNA, 22 bp, Homo sapiens
ctccaggccagggaagtggaca

SEQ ID NO: 7142655 - DNA, 22 bp, Homo sapiens
ctccaggccagggaagtggaca

SEQ ID NO: 7142656 - DNA, 22 bp, Homo sapiens
ctccaggccagggaagtggaca

SEQ ID NO: 7142657 - DNA, 22 bp, Homo sapiens
ctccaggccatggctgcggagg

SEQ ID NO: 7142658 - DNA, 22 bp, Homo sapiens
ctccaggccatggctgcggagg

SEQ ID NO: 7142659 - DNA, 22 bp, Homo sapiens
ctccaggccatggctgcggagg

SEQ ID NO: 7142660 - DNA, 22 bp, Homo sapiens
ctccaggcccacggccgcggcc

SEQ ID NO: 7142661 - DNA, 22 bp, Homo sapiens
ctccaggcccacggccgcggcc

SEQ ID NO: 7142662 - DNA, 22 bp, Homo sapiens
ctccaggcccacgtcgaggagg

SEQ ID NO: 7142663 - DNA, 22 bp, Homo sapiens
ctccaggcccacgtcgaggagg

SEQ ID NO: 7142664 - DNA, 22 bp, Homo sapiens
tttatgattaatccaattctgt

SEQ ID NO: 7142665 - DNA, 22 bp, Homo sapiens
tttatgattattttaaagcagc

SEQ ID NO: 7142666 - DNA, 22 bp, Homo sapiens
ctccaggcccctggccttctgc

SEQ ID NO: 7142667 - DNA, 22 bp, Homo sapiens
ctccaggcccctggccttctgc

SEQ ID NO: 7142668 - DNA, 22 bp, Homo sapiens
ctccaggcccctggccttctgc

SEQ ID NO: 7142669 - DNA, 22 bp, Homo sapiens
ctccaggcccctggccttctgc

SEQ ID NO: 7142670 - DNA, 22 bp, Homo sapiens
ctctgaaactcctgcaccttct

SEQ ID NO: 7142671 - DNA, 18 bp, Homo sapiens
ctctctttccactctttg

SEQ ID NO: 7142672 - DNA, 18 bp, Homo sapiens
ctctctttccactctttg

SEQ ID NO: 7142673 - DNA, 22 bp, Homo sapiens
ctctctttctgaatgaggacta

SEQ ID NO: 7142674 - DNA, 22 bp, Homo sapiens
ctctctttctgaatgaggacta

SEQ ID NO: 7142675 - DNA, 22 bp, Homo sapiens
ctctgaaagagtttagtattat

SEQ ID NO: 7142676 - DNA, 22 bp, Homo sapiens
ctctgaaagagtttagtattat

SEQ ID NO: 7142677 - DNA, 22 bp, Homo sapiens
ctctgaaagttagagaaaatag

SEQ ID NO: 7142678 - DNA, 22 bp, Homo sapiens
ctctgaaagttagagaaaatag

SEQ ID NO: 7142679 - DNA, 22 bp, Homo sapiens
ctctctgttatgctttcatgaa

SEQ ID NO: 7142680 - DNA, 22 bp, Homo sapiens
ctctctgtggtggctgtcccat

SEQ ID NO: 7142681 - DNA, 18 bp, Homo sapiens
ctctctggtctggatccc

SEQ ID NO: 7142682 - DNA, 22 bp, Homo sapiens
ctctctggtttcagcgaagggg

SEQ ID NO: 7142683 - DNA, 22 bp, Homo sapiens
ctctctggtttcagcgaagggg

SEQ ID NO: 7142684 - DNA, 22 bp, Homo sapiens
ctctctgtcttggcatttggtc

SEQ ID NO: 7142685 - DNA, 22 bp, Homo sapiens
ctctctgtatgtgtatatttat

SEQ ID NO: 7142686 - DNA, 22 bp, Homo sapiens
ctctctgtatgtgtatatttat

SEQ ID NO: 7142687 - DNA, 22 bp, Homo sapiens
ctctctggtttcagcgaagggg

SEQ ID NO: 7142688 - DNA, 22 bp, Homo sapiens
ctctctgttatgctttcatgaa

SEQ ID NO: 7142689 - DNA, 22 bp, Homo sapiens
ctctctgttcattgagtcaaaa

SEQ ID NO: 7142690 - DNA, 18 bp, Homo sapiens
ctctctttccactctttg

SEQ ID NO: 7142691 - DNA, 22 bp, Homo sapiens
ctctctttcattggtcgccttg

SEQ ID NO: 7142692 - DNA, 18 bp, Homo sapiens
ctctctttccactctttg

SEQ ID NO: 7142693 - DNA, 22 bp, Homo sapiens
tttctcaacctcaacactattt

SEQ ID NO: 7142694 - DNA, 22 bp, Homo sapiens
tttctcaacctcaacactattt

SEQ ID NO: 7142695 - DNA, 22 bp, Homo sapiens
tttctcaacagagtatgccctt

SEQ ID NO: 7142696 - DNA, 22 bp, Homo sapiens
tttctcaacagagtatgccctt

SEQ ID NO: 7142697 - DNA, 22 bp, Homo sapiens
tttctcaaatactgttccagga

SEQ ID NO: 7142698 - DNA, 22 bp, Homo sapiens
tttctcaaattgcatgagtagc

SEQ ID NO: 7142699 - DNA, 22 bp, Homo sapiens
tttctcaaattgcatgagtagc

SEQ ID NO: 7142700 - DNA, 22 bp, Homo sapiens
tttctcaacagagtatgccctt

SEQ ID NO: 7142701 - DNA, 22 bp, Homo sapiens
tttctcaaatactgttccagga

SEQ ID NO: 7142702 - DNA, 22 bp, Homo sapiens
tttctcaaatactgttccagga

SEQ ID NO: 7142703 - DNA, 23 bp, Homo sapiens
tttctcaaagagtggcagcttca

SEQ ID NO: 7142704 - DNA, 22 bp, Homo sapiens
tttctcaaaagacagaagtgaa

SEQ ID NO: 7142705 - DNA, 22 bp, Homo sapiens
tttctcaaaattcagtggtatc

SEQ ID NO: 7142706 - DNA, 22 bp, Homo sapiens
tttctacatgtcaatccaaacc

SEQ ID NO: 7142707 - DNA, 22 bp, Homo sapiens
tttctacatgtcaatccaaacc

SEQ ID NO: 7142708 - DNA, 22 bp, Homo sapiens
tttctacagtactgatttcata

SEQ ID NO: 7142709 - DNA, 17 bp, Homo sapiens
tttctacagttggcagc

SEQ ID NO: 7142710 - DNA, 17 bp, Homo sapiens
tttctacagttggcagc

SEQ ID NO: 7142711 - DNA, 22 bp, Homo sapiens
tttctacatgtcaatccaaacc

SEQ ID NO: 7142712 - DNA, 22 bp, Homo sapiens
tttctacatgtcaatccaaacc

SEQ ID NO: 7142713 - DNA, 22 bp, Homo sapiens
tttctattttaaaggcatatgg

SEQ ID NO: 7142714 - DNA, 22 bp, Homo sapiens
tttctacatgtcagtaactgat

SEQ ID NO: 7142715 - DNA, 22 bp, Homo sapiens
tttctacatgtcagtaactgat

SEQ ID NO: 7142716 - DNA, 22 bp, Homo sapiens
tttctacatgtcagtaactgat

SEQ ID NO: 7142717 - DNA, 22 bp, Homo sapiens
tttctcaagtactgcacatgaa

SEQ ID NO: 7142718 - DNA, 22 bp, Homo sapiens
tttctcaaggtgtcatgtattt

SEQ ID NO: 7142719 - DNA, 22 bp, Homo sapiens
tttctcaaggtgtcatgtattt

SEQ ID NO: 7142720 - DNA, 22 bp, Homo sapiens
tttctcaaggtgtcatgtattt

SEQ ID NO: 7142721 - DNA, 22 bp, Homo sapiens
tttctcaaggtgtcatgtattt

SEQ ID NO: 7142722 - DNA, 22 bp, Homo sapiens
tttctcaagctgtttgccaatt

SEQ ID NO: 7142723 - DNA, 22 bp, Homo sapiens
tttctcaagctgtttgccaatt

SEQ ID NO: 7142724 - DNA, 18 bp, Homo sapiens
tttctcaaggctgacatt

SEQ ID NO: 7142725 - DNA, 18 bp, Homo sapiens
tttctcaaggctgacatt

SEQ ID NO: 7142726 - DNA, 22 bp, Homo sapiens
tttctcaactgtattatgcaga

SEQ ID NO: 7142727 - DNA, 22 bp, Homo sapiens
tttctcaactgtattatgcaga

SEQ ID NO: 7142728 - DNA, 19 bp, Homo sapiens
ctctctggcggtgtctgcg

SEQ ID NO: 7142729 - DNA, 22 bp, Homo sapiens
tttctcaagttcagatatttga

SEQ ID NO: 7142730 - DNA, 21 bp, Homo sapiens
tttctcaccatggtatggaaa

SEQ ID NO: 7142731 - DNA, 22 bp, Homo sapiens
tttctcaagttcagatatttga

SEQ ID NO: 7142732 - DNA, 22 bp, Homo sapiens
tttctcaagttcagatatttga

SEQ ID NO: 7142733 - DNA, 22 bp, Homo sapiens
tttctcaagttcagatatttga

SEQ ID NO: 7142734 - DNA, 19 bp, Homo sapiens
ctctctggcggtgtctgcg

SEQ ID NO: 7142735 - DNA, 22 bp, Homo sapiens
ctctctggcttggcacggagat

SEQ ID NO: 7142736 - DNA, 22 bp, Homo sapiens
ctctctggcttggcacggagat

SEQ ID NO: 7142737 - DNA, 22 bp, Homo sapiens
ctctctggtcccagattccaga

SEQ ID NO: 7142738 - DNA, 18 bp, Homo sapiens
ctctctggtctggatccc

SEQ ID NO: 7142739 - DNA, 22 bp, Homo sapiens
tttctacagctggtgcaacttt

SEQ ID NO: 7142740 - DNA, 22 bp, Homo sapiens
tttctacagctggtgcaacttt

SEQ ID NO: 7142741 - DNA, 22 bp, Homo sapiens
tttctacagaagatacactgct

SEQ ID NO: 7142742 - DNA, 22 bp, Homo sapiens
tttctacagaagatacactgct

SEQ ID NO: 7142743 - DNA, 22 bp, Homo sapiens
tttctacagctggtgcaacttt

SEQ ID NO: 7142744 - DNA, 22 bp, Homo sapiens
tttctacaggttgatgggtttg

SEQ ID NO: 7142745 - DNA, 22 bp, Homo sapiens
tttctacaggttgatgggtttg

SEQ ID NO: 7142746 - DNA, 22 bp, Homo sapiens
tttctacagtactgatttcata

SEQ ID NO: 7142747 - DNA, 22 bp, Homo sapiens
tttctacagtactgatttcata

SEQ ID NO: 7142748 - DNA, 22 bp, Homo sapiens
tttctacaggttgatgggtttg

SEQ ID NO: 7142749 - DNA, 22 bp, Homo sapiens
tttctacacttcgtggtgtttt

SEQ ID NO: 7142750 - DNA, 22 bp, Homo sapiens
tttctacacttcgtggtgtttt

SEQ ID NO: 7142751 - DNA, 22 bp, Homo sapiens
tttctacaatttttggcatgag

SEQ ID NO: 7142752 - DNA, 22 bp, Homo sapiens
tttctacaatttttggcatgag

SEQ ID NO: 7142753 - DNA, 22 bp, Homo sapiens
tttctacaacacttctgaatct

SEQ ID NO: 7142754 - DNA, 22 bp, Homo sapiens
tttctacaatttttggcatgag

SEQ ID NO: 7142755 - DNA, 22 bp, Homo sapiens
tttctacacttcgtggtgtttt

SEQ ID NO: 7142756 - DNA, 22 bp, Homo sapiens
tttctacagaagatacactgct

SEQ ID NO: 7142757 - DNA, 22 bp, Homo sapiens
tttctacagaagatacactgct

SEQ ID NO: 7142758 - DNA, 22 bp, Homo sapiens
tttctacaacacttctgaatct

SEQ ID NO: 7142759 - DNA, 22 bp, Homo sapiens
tttcctttctcaagagccggca

SEQ ID NO: 7142760 - DNA, 22 bp, Homo sapiens
tttctacaacacttctgaatct

SEQ ID NO: 7142761 - DNA, 22 bp, Homo sapiens
tttccaatttggtagtcatcgg

SEQ ID NO: 7142762 - DNA, 22 bp, Homo sapiens
tttccacaatgtttttgcagga

SEQ ID NO: 7142763 - DNA, 22 bp, Homo sapiens
tttccaatttttaagtggatga

SEQ ID NO: 7142764 - DNA, 22 bp, Homo sapiens
tttccacaatttgagcagcaga

SEQ ID NO: 7142765 - DNA, 22 bp, Homo sapiens
tttccacaatttgagcagcaga

SEQ ID NO: 7142766 - DNA, 22 bp, Homo sapiens
tttccacacaggctctactact

SEQ ID NO: 7142767 - DNA, 22 bp, Homo sapiens
tttccacacaggctctactact

SEQ ID NO: 7142768 - DNA, 22 bp, Homo sapiens
tttccacactcactgcactcat

SEQ ID NO: 7142769 - DNA, 22 bp, Homo sapiens
tttccacactcactgcactcat

SEQ ID NO: 7142770 - DNA, 22 bp, Homo sapiens
tttccacactgcagccagcaaa

SEQ ID NO: 7142771 - DNA, 22 bp, Homo sapiens
tttccacactgcagccagcaaa

SEQ ID NO: 7142772 - DNA, 22 bp, Homo sapiens
tttccacactgcagccagcaaa

SEQ ID NO: 7142773 - DNA, 22 bp, Homo sapiens
tttccacagctgtataaaataa

SEQ ID NO: 7142774 - DNA, 22 bp, Homo sapiens
tttccacagctgtataaaataa

SEQ ID NO: 7142775 - DNA, 22 bp, Homo sapiens
tttccacatcaccatgaggtga

SEQ ID NO: 7142776 - DNA, 22 bp, Homo sapiens
tttccactcctattgcatctca

SEQ ID NO: 7142777 - DNA, 22 bp, Homo sapiens
tttccactcctattgcatctca

SEQ ID NO: 7142778 - DNA, 22 bp, Homo sapiens
tttccactcctattgcatctca

SEQ ID NO: 7142779 - DNA, 22 bp, Homo sapiens
tttccactctggccaccatctt

SEQ ID NO: 7142780 - DNA, 22 bp, Homo sapiens
tttccactgggcacggggccag

SEQ ID NO: 7142781 - DNA, 22 bp, Homo sapiens
tttcctttctagaagcctaaat

SEQ ID NO: 7142782 - DNA, 22 bp, Homo sapiens
tttcctttctagaagcctaaat

SEQ ID NO: 7142783 - DNA, 22 bp, Homo sapiens
tttcattagtatgacagcacgc

SEQ ID NO: 7142784 - DNA, 22 bp, Homo sapiens
tttcattataaaaagttggctt

SEQ ID NO: 7142785 - DNA, 18 bp, Homo sapiens
tttcattataaagcaggc

SEQ ID NO: 7142786 - DNA, 18 bp, Homo sapiens
tttcattataaagcaggc

SEQ ID NO: 7142787 - DNA, 22 bp, Homo sapiens
tttcattatacagcttcataaa

SEQ ID NO: 7142788 - DNA, 22 bp, Homo sapiens
tttcattatacagcttcataaa

SEQ ID NO: 7142789 - DNA, 22 bp, Homo sapiens
tttcattatacagcttcataaa

SEQ ID NO: 7142790 - DNA, 22 bp, Homo sapiens
tttccaagctgtcttggcccac

SEQ ID NO: 7142791 - DNA, 22 bp, Homo sapiens
tttccaactgtaccccagtgtt

SEQ ID NO: 7142792 - DNA, 18 bp, Homo sapiens
tttccaagaagagagctc

SEQ ID NO: 7142793 - DNA, 22 bp, Homo sapiens
tttccaataaagtgtcattgtt

SEQ ID NO: 7142794 - DNA, 22 bp, Homo sapiens
tttccaataaggtcaccttcct

SEQ ID NO: 7142795 - DNA, 22 bp, Homo sapiens
tttccaaggatgtgtctctcta

SEQ ID NO: 7142796 - DNA, 22 bp, Homo sapiens
tttcattacgtgtttgacttgt

SEQ ID NO: 7142797 - DNA, 22 bp, Homo sapiens
tttcattacgtgtttgacttgt

SEQ ID NO: 7142798 - DNA, 22 bp, Homo sapiens
tttcattaaagtcaaatctggt

SEQ ID NO: 7142799 - DNA, 22 bp, Homo sapiens
tttcattaaagtcaaatctggt

SEQ ID NO: 7142800 - DNA, 22 bp, Homo sapiens
tttcattaaagtcaaatctggt

SEQ ID NO: 7142801 - DNA, 22 bp, Homo sapiens
tttcatgttacatttaaaatgt

SEQ ID NO: 7142802 - DNA, 22 bp, Homo sapiens
tttcatgttattaatagtgctg

SEQ ID NO: 7142803 - DNA, 22 bp, Homo sapiens
tttcatgttggatactgtttca

SEQ ID NO: 7142804 - DNA, 22 bp, Homo sapiens
tttcatgttggatactgtttca

SEQ ID NO: 7142805 - DNA, 22 bp, Homo sapiens
tttcatgttggatactgtttca

SEQ ID NO: 7142806 - DNA, 22 bp, Homo sapiens
tttcatgtttatggaaaatgag

SEQ ID NO: 7142807 - DNA, 19 bp, Homo sapiens
tttgacgttgaatatcact

SEQ ID NO: 7142808 - DNA, 22 bp, Homo sapiens
tttgactcaagcctttctttag

SEQ ID NO: 7142809 - DNA, 22 bp, Homo sapiens
tttgactcattgattttctctg

SEQ ID NO: 7142810 - DNA, 22 bp, Homo sapiens
tttgaccagaggtccctggaaa

SEQ ID NO: 7142811 - DNA, 21 bp, Homo sapiens
tttgaatagaaatagtgctta

SEQ ID NO: 7142812 - DNA, 22 bp, Homo sapiens
ctctgcaccttgtaggaggcaa

SEQ ID NO: 7142813 - DNA, 22 bp, Homo sapiens
ctctgcagaatttgagctgctc

SEQ ID NO: 7142814 - DNA, 22 bp, Homo sapiens
ctctgcagaatttgagctgctc

SEQ ID NO: 7142815 - DNA, 22 bp, Homo sapiens
ctctgcagaatttgagctgctc

SEQ ID NO: 7142816 - DNA, 22 bp, Homo sapiens
ctctgcagaggcccaaggctga

SEQ ID NO: 7142817 - DNA, 22 bp, Homo sapiens
ctctgatttccttattctgtca

SEQ ID NO: 7142818 - DNA, 22 bp, Homo sapiens
ctctgagtttcatttccctcct

SEQ ID NO: 7142819 - DNA, 22 bp, Homo sapiens
ctctgatgtctgggggctggat

SEQ ID NO: 7142820 - DNA, 22 bp, Homo sapiens
ctctgatgtgaccacgtagaca

SEQ ID NO: 7142821 - DNA, 22 bp, Homo sapiens
ctctgaggtttcctcacaagct

SEQ ID NO: 7142822 - DNA, 22 bp, Homo sapiens
ctctgcaaggccctccagtagc

SEQ ID NO: 7142823 - DNA, 22 bp, Homo sapiens
ctctgcaagtccagcccctggc

SEQ ID NO: 7142824 - DNA, 22 bp, Homo sapiens
ctctgcaatctgagcacttgta

SEQ ID NO: 7142825 - DNA, 22 bp, Homo sapiens
ctctgcacccccggctcctcgt

SEQ ID NO: 7142826 - DNA, 22 bp, Homo sapiens
tttgaaagcaccatttgagtag

SEQ ID NO: 7142827 - DNA, 19 bp, Homo sapiens
tttgaaagagttttattgg

SEQ ID NO: 7142828 - DNA, 19 bp, Homo sapiens
tttgaaagagttttattgg

SEQ ID NO: 7142829 - DNA, 22 bp, Homo sapiens
ctctgaggtttcctcacaagct

SEQ ID NO: 7142830 - DNA, 22 bp, Homo sapiens
ctctgaaattggccctcagcag

SEQ ID NO: 7142831 - DNA, 22 bp, Homo sapiens
ctctgaagatggtaccagcttt

SEQ ID NO: 7142832 - DNA, 22 bp, Homo sapiens
ctctgaatactttaagaattgt

SEQ ID NO: 7142833 - DNA, 21 bp, Homo sapiens
ctctgaatcctgcttctcagt

SEQ ID NO: 7142834 - DNA, 22 bp, Homo sapiens
ctctgacaccatctcatgacag

SEQ ID NO: 7142835 - DNA, 22 bp, Homo sapiens
tttcttgattagctgtggctca

SEQ ID NO: 7142836 - DNA, 22 bp, Homo sapiens
tttcttgccagagaaaaagagt

SEQ ID NO: 7142837 - DNA, 22 bp, Homo sapiens
tttcttggagctcttagggtcg

SEQ ID NO: 7142838 - DNA, 22 bp, Homo sapiens
tttcttggagctcttagggtcg

SEQ ID NO: 7142839 - DNA, 22 bp, Homo sapiens
tttcttggatgtgaaactaggg

SEQ ID NO: 7142840 - DNA, 22 bp, Homo sapiens
tttcttggatgtgaaactaggg

SEQ ID NO: 7142841 - DNA, 22 bp, Homo sapiens
tttcttggggctcctgcgccat

SEQ ID NO: 7142842 - DNA, 22 bp, Homo sapiens
tttcttgggttccagttcccag

SEQ ID NO: 7142843 - DNA, 22 bp, Homo sapiens
tttcttgtaaaagctgtgggaa

SEQ ID NO: 7142844 - DNA, 22 bp, Homo sapiens
tttcttgtaagatgtttattaa

SEQ ID NO: 7142845 - DNA, 22 bp, Homo sapiens
tttcttgtaaaagctgtgggaa

SEQ ID NO: 7142846 - DNA, 22 bp, Homo sapiens
tttgaaagacagaatatttttg

SEQ ID NO: 7142847 - DNA, 22 bp, Homo sapiens
tttgaaagacagaatatttttg

SEQ ID NO: 7142848 - DNA, 22 bp, Homo sapiens
tttgaaagaatttatgtacttt

SEQ ID NO: 7142849 - DNA, 22 bp, Homo sapiens
tttgaaagaaaccagtgagtga

SEQ ID NO: 7142850 - DNA, 22 bp, Homo sapiens
tttgaaactctgaacatgtttc

SEQ ID NO: 7142851 - DNA, 22 bp, Homo sapiens
tttgaaaatttaagtgctacac

SEQ ID NO: 7142852 - DNA, 22 bp, Homo sapiens
tttgaaacctagttatatgact

SEQ ID NO: 7142853 - DNA, 22 bp, Homo sapiens
ctctggagtgcagcctggtggc

SEQ ID NO: 7142854 - DNA, 22 bp, Homo sapiens
ctctggagtgggtggccgggag

SEQ ID NO: 7142855 - DNA, 22 bp, Homo sapiens
ctctggagtgggtggccgggag

SEQ ID NO: 7142856 - DNA, 22 bp, Homo sapiens
ctctggcaattgctgctgactc

SEQ ID NO: 7142857 - DNA, 22 bp, Homo sapiens
ctctggcacactccttccaggt

SEQ ID NO: 7142858 - DNA, 22 bp, Homo sapiens
tttgcaaagaaattattgctgt

SEQ ID NO: 7142859 - DNA, 22 bp, Homo sapiens
ctctggcagagctgtagacttc

SEQ ID NO: 7142860 - DNA, 22 bp, Homo sapiens
ctctggccagagcctgcgggaa

SEQ ID NO: 7142861 - DNA, 22 bp, Homo sapiens
ctctggccagagcctgcgggaa

SEQ ID NO: 7142862 - DNA, 22 bp, Homo sapiens
ctctggccagagcctgcgggaa

SEQ ID NO: 7142863 - DNA, 22 bp, Homo sapiens
ctctggccccagtggccccttg

SEQ ID NO: 7142864 - DNA, 22 bp, Homo sapiens
ctctggccccagtggccccttg

SEQ ID NO: 7142865 - DNA, 22 bp, Homo sapiens
ctctggccccagtggccccttg

SEQ ID NO: 7142866 - DNA, 22 bp, Homo sapiens
ctctggccgcagctcagctctg

SEQ ID NO: 7142867 - DNA, 19 bp, Homo sapiens
ctctggcctctggatgctg

SEQ ID NO: 7142868 - DNA, 19 bp, Homo sapiens
ctctggcctctggatgctg

SEQ ID NO: 7142869 - DNA, 22 bp, Homo sapiens
ctctggcctgcagatccatgct

SEQ ID NO: 7142870 - DNA, 22 bp, Homo sapiens
ctctggcctgcttcctcaggta

SEQ ID NO: 7142871 - DNA, 22 bp, Homo sapiens
ctctggcctgcttcctcaggta

SEQ ID NO: 7142872 - DNA, 22 bp, Homo sapiens
ctctggcctgcttcctcaggta

SEQ ID NO: 7142873 - DNA, 22 bp, Homo sapiens
ctctggcctgcttcctcaggta

SEQ ID NO: 7142874 - DNA, 22 bp, Homo sapiens
ctctggcctgcttcctcaggta

SEQ ID NO: 7142875 - DNA, 22 bp, Homo sapiens
ctctggcctggggcctgctccc

SEQ ID NO: 7142876 - DNA, 22 bp, Homo sapiens
ctctggcctggggcctgctccc

SEQ ID NO: 7142877 - DNA, 22 bp, Homo sapiens
ctctggcggccatgctcgtggt

SEQ ID NO: 7142878 - DNA, 22 bp, Homo sapiens
tttgagaagatgtaatgttaag

SEQ ID NO: 7142879 - DNA, 22 bp, Homo sapiens
tttgagaagcatctggtccact

SEQ ID NO: 7142880 - DNA, 22 bp, Homo sapiens
tttgagaagatgtaatgttaag

SEQ ID NO: 7142881 - DNA, 22 bp, Homo sapiens
tttgagaagatgtaatgttaag

SEQ ID NO: 7142882 - DNA, 22 bp, Homo sapiens
tttgagaagataggggaatact

SEQ ID NO: 7142883 - DNA, 22 bp, Homo sapiens
tttgagaactttggtattttcc

SEQ ID NO: 7142884 - DNA, 22 bp, Homo sapiens
tttgagaagagtttgaggtatt

SEQ ID NO: 7142885 - DNA, 22 bp, Homo sapiens
tttgagaagagtttgaggtatt

SEQ ID NO: 7142886 - DNA, 22 bp, Homo sapiens
tttgcaaacacttaagaagaga

SEQ ID NO: 7142887 - DNA, 22 bp, Homo sapiens
tttgagaaacagacgaaagaca

SEQ ID NO: 7142888 - DNA, 22 bp, Homo sapiens
tttgagaaacagacgaaagaca

SEQ ID NO: 7142889 - DNA, 22 bp, Homo sapiens
tttgagaaactgattattatgg

SEQ ID NO: 7142890 - DNA, 22 bp, Homo sapiens
tttgagaaaaagtgatgatgat

SEQ ID NO: 7142891 - DNA, 22 bp, Homo sapiens
tttgagaaaaccagaaagatct

SEQ ID NO: 7142892 - DNA, 22 bp, Homo sapiens
tttgagaaaaccagaaagatct

SEQ ID NO: 7142893 - DNA, 22 bp, Homo sapiens
tttgagaaaggggatttaattc

SEQ ID NO: 7142894 - DNA, 22 bp, Homo sapiens
tttgagaaaggggatttaattc

SEQ ID NO: 7142895 - DNA, 22 bp, Homo sapiens
tttgagaaaggggatttaattc

SEQ ID NO: 7142896 - DNA, 22 bp, Homo sapiens
tttgagaaatgggctctgtgct

SEQ ID NO: 7142897 - DNA, 22 bp, Homo sapiens
tttgagaaccctgtattttaag

SEQ ID NO: 7142898 - DNA, 22 bp, Homo sapiens
tttgactcctgccttctcctgt

SEQ ID NO: 7142899 - DNA, 22 bp, Homo sapiens
tttgactcctgtgtttctggaa

SEQ ID NO: 7142900 - DNA, 22 bp, Homo sapiens
tttgactcttgtctcttgttag

SEQ ID NO: 7142901 - DNA, 22 bp, Homo sapiens
tttgacttctatctagtaagaa

SEQ ID NO: 7142902 - DNA, 22 bp, Homo sapiens
tttgacttctatctagtaagaa

SEQ ID NO: 7142903 - DNA, 22 bp, Homo sapiens
tttgactttgggctctaactca

SEQ ID NO: 7142904 - DNA, 20 bp, Homo sapiens
ctctgggctgcaccctcgcc

SEQ ID NO: 7142905 - DNA, 20 bp, Homo sapiens
ctctgggctgcaccctcgcc

SEQ ID NO: 7142906 - DNA, 22 bp, Homo sapiens
ctctgggctgaatggctgaacc

SEQ ID NO: 7142907 - DNA, 19 bp, Homo sapiens
ctctgggctgcatcttggt

SEQ ID NO: 7142908 - DNA, 22 bp, Homo sapiens
ctctgggtcccacgtcattgct

SEQ ID NO: 7142909 - DNA, 22 bp, Homo sapiens
tttggaattggaaagtgctgtg

SEQ ID NO: 7142910 - DNA, 22 bp, Homo sapiens
tttggaattcagatggcttagg

SEQ ID NO: 7142911 - DNA, 22 bp, Homo sapiens
tttggaattccatttctgcatt

SEQ ID NO: 7142912 - DNA, 22 bp, Homo sapiens
tttggaattctgcagctcatgt

SEQ ID NO: 7142913 - DNA, 22 bp, Homo sapiens
tttggaatgtatttgaccaaag

SEQ ID NO: 7142914 - DNA, 22 bp, Homo sapiens
tttggaatgttaggtgtctcat

SEQ ID NO: 7142915 - DNA, 22 bp, Homo sapiens
tttggaattacttactcaagcc

SEQ ID NO: 7142916 - DNA, 22 bp, Homo sapiens
tttggaattatgcttaaagttt

SEQ ID NO: 7142917 - DNA, 22 bp, Homo sapiens
tttggaattcagatggcttagg

SEQ ID NO: 7142918 - DNA, 22 bp, Homo sapiens
tttggaatggtaccttcagttg

SEQ ID NO: 7142919 - DNA, 22 bp, Homo sapiens
tttggaatggtaccttcagttg

SEQ ID NO: 7142920 - DNA, 22 bp, Homo sapiens
tttggaatggtgctgtacagat

SEQ ID NO: 7142921 - DNA, 22 bp, Homo sapiens
tttggaatgtagtttaatcatc

SEQ ID NO: 7142922 - DNA, 22 bp, Homo sapiens
tttggaatgtagtttaatcatc

SEQ ID NO: 7142923 - DNA, 22 bp, Homo sapiens
tttggaatattgagaaagtgaa

SEQ ID NO: 7142924 - DNA, 22 bp, Homo sapiens
tttggaatcatagatatattca

SEQ ID NO: 7142925 - DNA, 22 bp, Homo sapiens
tttggaatcctcagtatgatca

SEQ ID NO: 7142926 - DNA, 22 bp, Homo sapiens
tttggaatagcatagaagctca

SEQ ID NO: 7142927 - DNA, 22 bp, Homo sapiens
tttggaatattaaaatgtctca

SEQ ID NO: 7142928 - DNA, 22 bp, Homo sapiens
tttggaatattaaaatgtctca

SEQ ID NO: 7142929 - DNA, 22 bp, Homo sapiens
tttggaatctgagggcttagtt

SEQ ID NO: 7142930 - DNA, 22 bp, Homo sapiens
tttggaatgaaacagcagagcc

SEQ ID NO: 7142931 - DNA, 22 bp, Homo sapiens
tttggaatgacagatatcaata

SEQ ID NO: 7142932 - DNA, 22 bp, Homo sapiens
tttggaatgacagatatcaata

SEQ ID NO: 7142933 - DNA, 22 bp, Homo sapiens
tttggaatgcccatggactggt

SEQ ID NO: 7142934 - DNA, 22 bp, Homo sapiens
tttggaatgcccatggactggt

SEQ ID NO: 7142935 - DNA, 22 bp, Homo sapiens
tttggaatggaatagagattgc

SEQ ID NO: 7142936 - DNA, 22 bp, Homo sapiens
ctctggctcccgcagcccccat

SEQ ID NO: 7142937 - DNA, 22 bp, Homo sapiens
ctctggctccatttccctatgt

SEQ ID NO: 7142938 - DNA, 22 bp, Homo sapiens
ctctggctatctgtttctatgt

SEQ ID NO: 7142939 - DNA, 22 bp, Homo sapiens
ctctggctatggcacggcgctc

SEQ ID NO: 7142940 - DNA, 22 bp, Homo sapiens
tttggaataatcagatcctagt

SEQ ID NO: 7142941 - DNA, 20 bp, Homo sapiens
ctctggctccgcgtgaccgc

SEQ ID NO: 7142942 - DNA, 22 bp, Homo sapiens
tttggaagtaaatgagtgtttt

SEQ ID NO: 7142943 - DNA, 22 bp, Homo sapiens
ctctgggtggtctcactgagtg

SEQ ID NO: 7142944 - DNA, 22 bp, Homo sapiens
ctctgggtggtctcactgagtg

SEQ ID NO: 7142945 - DNA, 22 bp, Homo sapiens
ctctgggtgtcttaggagctca

SEQ ID NO: 7142946 - DNA, 22 bp, Homo sapiens
ctctgggtgcagcgctgaccgg

SEQ ID NO: 7142947 - DNA, 22 bp, Homo sapiens
ctctgggtgcagcgctgaccgg

SEQ ID NO: 7142948 - DNA, 17 bp, Homo sapiens
ctctgggtgcctgtgtg

SEQ ID NO: 7142949 - DNA, 22 bp, Homo sapiens
ctctgggtggtctcactgagtg

SEQ ID NO: 7142950 - DNA, 23 bp, Homo sapiens
ctctgggtccgatgtcctgacag

SEQ ID NO: 7142951 - DNA, 20 bp, Homo sapiens
ctctgggtcgagacagactt

SEQ ID NO: 7142952 - DNA, 22 bp, Homo sapiens
ctctgggtctataatgcagctg

SEQ ID NO: 7142953 - DNA, 22 bp, Homo sapiens
ctctgggtctataatgcagctg

SEQ ID NO: 7142954 - DNA, 22 bp, Homo sapiens
ctctgggtgagacagacctggt

SEQ ID NO: 7142955 - DNA, 22 bp, Homo sapiens
tttgttcataatggcaaagaga

SEQ ID NO: 7142956 - DNA, 21 bp, Homo sapiens
tttgttcatagctcactcttt

SEQ ID NO: 7142957 - DNA, 22 bp, Homo sapiens
tttgttcatgcctatattctca

SEQ ID NO: 7142958 - DNA, 22 bp, Homo sapiens
ctctgggtgtgacagcacctgg

SEQ ID NO: 7142959 - DNA, 22 bp, Homo sapiens
ctctgggtgtgacagcacctgg

SEQ ID NO: 7142960 - DNA, 22 bp, Homo sapiens
ctctgggtgttaatgtcagtgt

SEQ ID NO: 7142961 - DNA, 22 bp, Homo sapiens
tttgttcagctctcattgatta

SEQ ID NO: 7142962 - DNA, 22 bp, Homo sapiens
tttgttcagctctcattgatta

SEQ ID NO: 7142963 - DNA, 21 bp, Homo sapiens
tttgttcaggcaagttacagt

SEQ ID NO: 7142964 - DNA, 21 bp, Homo sapiens
tttgttcaggcaagttacagt

SEQ ID NO: 7142965 - DNA, 21 bp, Homo sapiens
tttgttcaggggcaaagttaa

SEQ ID NO: 7142966 - DNA, 22 bp, Homo sapiens
ctctgtgcttatgctccatggg

SEQ ID NO: 7142967 - DNA, 22 bp, Homo sapiens
ctctgtgcttatgctccatggg

SEQ ID NO: 7142968 - DNA, 22 bp, Homo sapiens
ctctgtgcgggccatggtcagg

SEQ ID NO: 7142969 - DNA, 22 bp, Homo sapiens
ctctgtgctcccatgctagtaa

SEQ ID NO: 7142970 - DNA, 22 bp, Homo sapiens
ctctgtgcctcagttttcttct

SEQ ID NO: 7142971 - DNA, 22 bp, Homo sapiens
ctctgtgattttgtgagccaga

SEQ ID NO: 7142972 - DNA, 22 bp, Homo sapiens
ctctgtgattttgtgagccaga

SEQ ID NO: 7142973 - DNA, 22 bp, Homo sapiens
ctctgtgccctactgctcagct

SEQ ID NO: 7142974 - DNA, 22 bp, Homo sapiens
tttgttctaacttctgcagaca

SEQ ID NO: 7142975 - DNA, 22 bp, Homo sapiens
tttgttctattttagagatgaa

SEQ ID NO: 7142976 - DNA, 22 bp, Homo sapiens
ctctggttgagtgagaaccaag

SEQ ID NO: 7142977 - DNA, 22 bp, Homo sapiens
ctctggttgcagctgaagttcc

SEQ ID NO: 7142978 - DNA, 22 bp, Homo sapiens
ctctggtttatttcttggaaag

SEQ ID NO: 7142979 - DNA, 22 bp, Homo sapiens
ctctggtttcgcaggaaataga

SEQ ID NO: 7142980 - DNA, 22 bp, Homo sapiens
ctctgtgggggagaggcagctg

SEQ ID NO: 7142981 - DNA, 22 bp, Homo sapiens
ctctgtggtaaaatagcagtat

SEQ ID NO: 7142982 - DNA, 22 bp, Homo sapiens
ctctgtggtggagtgggtcacc

SEQ ID NO: 7142983 - DNA, 22 bp, Homo sapiens
ctctgtgggccagagaggcccc

SEQ ID NO: 7142984 - DNA, 22 bp, Homo sapiens
ctctgtgggccagagaggcccc

SEQ ID NO: 7142985 - DNA, 22 bp, Homo sapiens
ctctgtgggggagaggcagctg

SEQ ID NO: 7142986 - DNA, 22 bp, Homo sapiens
ctctgtgggggagaggcagctg

SEQ ID NO: 7142987 - DNA, 22 bp, Homo sapiens
ctctgtgggggagaggcagctg

SEQ ID NO: 7142988 - DNA, 22 bp, Homo sapiens
ctctgtgggaggaggagtaggc

SEQ ID NO: 7142989 - DNA, 22 bp, Homo sapiens
ctctgtgggccagagaggcccc

SEQ ID NO: 7142990 - DNA, 22 bp, Homo sapiens
ctctgtgggccagagaggcccc

SEQ ID NO: 7142991 - DNA, 17 bp, Homo sapiens
ctctgtggaggtgttta

SEQ ID NO: 7142992 - DNA, 17 bp, Homo sapiens
ctctgtggaggtgttta

SEQ ID NO: 7142993 - DNA, 22 bp, Homo sapiens
ctctgtggcttgcctttctgtc

SEQ ID NO: 7142994 - DNA, 22 bp, Homo sapiens
ctctgtggttagactatggctg

SEQ ID NO: 7142995 - DNA, 22 bp, Homo sapiens
ctctgtgtcagctgggtgtgca

SEQ ID NO: 7142996 - DNA, 22 bp, Homo sapiens
ctctgtgtcagctgggtgtgca

SEQ ID NO: 7142997 - DNA, 22 bp, Homo sapiens
ctctgtgtctgagttatggtct

SEQ ID NO: 7142998 - DNA, 22 bp, Homo sapiens
ctctgtgtctgaagccctattt

SEQ ID NO: 7142999 - DNA, 22 bp, Homo sapiens
ctctgtgtgctggtggggtcct

SEQ ID NO: 7143000 - DNA, 22 bp, Homo sapiens
ctctgtgtgctggtggggtcct

SEQ ID NO: 7143001 - DNA, 22 bp, Homo sapiens
ctctgtgtggtatgattgtcat

SEQ ID NO: 7143002 - DNA, 22 bp, Homo sapiens
ctctgtgtggtcctctgtattg

SEQ ID NO: 7143003 - DNA, 22 bp, Homo sapiens
ctctgtgtggtcctctgtattg

SEQ ID NO: 7143004 - DNA, 22 bp, Homo sapiens
ctctgtgttcagcctagcagaa

SEQ ID NO: 7143005 - DNA, 22 bp, Homo sapiens
ctctgtgttccgggttgctgct

SEQ ID NO: 7143006 - DNA, 22 bp, Homo sapiens
ctctgtgttccgggttgctgct

SEQ ID NO: 7143007 - DNA, 22 bp, Homo sapiens
ctctgtgttccgggttgctgct

SEQ ID NO: 7143008 - DNA, 22 bp, Homo sapiens
ttttctcttccctctggacctg

SEQ ID NO: 7143009 - DNA, 21 bp, Homo sapiens
ctctgtgttgagggtgttgag

SEQ ID NO: 7143010 - DNA, 21 bp, Homo sapiens
ctctgtgttgagggtgttgag

SEQ ID NO: 7143011 - DNA, 17 bp, Homo sapiens
ttttctctcttggattc

SEQ ID NO: 7143012 - DNA, 17 bp, Homo sapiens
ttttctctcttggattc

SEQ ID NO: 7143013 - DNA, 17 bp, Homo sapiens
ttttctctcttggattc

SEQ ID NO: 7143014 - DNA, 22 bp, Homo sapiens
ttttgcttaatctagattttgc

SEQ ID NO: 7143015 - DNA, 22 bp, Homo sapiens
ttttgcttaatctagattttgc

SEQ ID NO: 7143016 - DNA, 22 bp, Homo sapiens
ttttgctgttatatgctattat

SEQ ID NO: 7143017 - DNA, 21 bp, Homo sapiens
ttttgctgttttagaatgaga

SEQ ID NO: 7143018 - DNA, 22 bp, Homo sapiens
ttttgctggggtggctagctta

SEQ ID NO: 7143019 - DNA, 22 bp, Homo sapiens
ttttgctggtttatctctatta

SEQ ID NO: 7143020 - DNA, 22 bp, Homo sapiens
ctggagagttggaagatggact

SEQ ID NO: 7143021 - DNA, 22 bp, Homo sapiens
ctggagagtaatctctgtgtta

SEQ ID NO: 7143022 - DNA, 22 bp, Homo sapiens
ctggagagggagctgttggaag

SEQ ID NO: 7143023 - DNA, 22 bp, Homo sapiens
ctggagagggagctgttggaag

SEQ ID NO: 7143024 - DNA, 22 bp, Homo sapiens
ctggagagggagctgttggaag

SEQ ID NO: 7143025 - DNA, 22 bp, Homo sapiens
ctggagagttggaagatggact

SEQ ID NO: 7143026 - DNA, 22 bp, Homo sapiens
ctggagagttggaagatggact

SEQ ID NO: 7143027 - DNA, 22 bp, Homo sapiens
ctggagagttggaagatggact

SEQ ID NO: 7143028 - DNA, 22 bp, Homo sapiens
ctggagataagcagtcccaggc

SEQ ID NO: 7143029 - DNA, 22 bp, Homo sapiens
ctggagataagtaaagaggcaa

SEQ ID NO: 7143030 - DNA, 22 bp, Homo sapiens
ctggagataagtaaagaggcaa

SEQ ID NO: 7143031 - DNA, 19 bp, Homo sapiens
ctggagatagggcctttaa

SEQ ID NO: 7143032 - DNA, 19 bp, Homo sapiens
ctggagatagggcctttaa

SEQ ID NO: 7143033 - DNA, 22 bp, Homo sapiens
ctggagattaagttctcagcca

SEQ ID NO: 7143034 - DNA, 22 bp, Homo sapiens
ctggagcaaaagtgactcctct

SEQ ID NO: 7143035 - DNA, 22 bp, Homo sapiens
ctggagcagcaggtggccaggg

SEQ ID NO: 7143036 - DNA, 22 bp, Homo sapiens
ctggagcagcaggtggccaggg

SEQ ID NO: 7143037 - DNA, 22 bp, Homo sapiens
ctggagcagcaggtggccaggg

SEQ ID NO: 7143038 - DNA, 22 bp, Homo sapiens
ctggagagggagccctggcagt

SEQ ID NO: 7143039 - DNA, 22 bp, Homo sapiens
ctggagagggagccctggcagt

SEQ ID NO: 7143040 - DNA, 22 bp, Homo sapiens
ctggagaggctgggaacaggtt

SEQ ID NO: 7143041 - DNA, 22 bp, Homo sapiens
ctggagagaccgaaagaggctg

SEQ ID NO: 7143042 - DNA, 22 bp, Homo sapiens
ctggagagagaaaaagccttaa

SEQ ID NO: 7143043 - DNA, 22 bp, Homo sapiens
ctggagagatcctcctgaaaaa

SEQ ID NO: 7143044 - DNA, 22 bp, Homo sapiens
ctggagagatcctcctgaaaaa

SEQ ID NO: 7143045 - DNA, 22 bp, Homo sapiens
ctggagaggccccaagatattt

SEQ ID NO: 7143046 - DNA, 22 bp, Homo sapiens
ctggagaggccccaagatattt

SEQ ID NO: 7143047 - DNA, 22 bp, Homo sapiens
ctggagaggccccaagatattt

SEQ ID NO: 7143048 - DNA, 22 bp, Homo sapiens
ctggagaggctgggaacaggtt

SEQ ID NO: 7143049 - DNA, 22 bp, Homo sapiens
ctggagaggctgggaacaggtt

SEQ ID NO: 7143050 - DNA, 22 bp, Homo sapiens
ctggagcagcaggtggccaggg

SEQ ID NO: 7143051 - DNA, 22 bp, Homo sapiens
ctggagcagcaggtggccaggg

SEQ ID NO: 7143052 - DNA, 22 bp, Homo sapiens
ctggagcagcaggtggccaggg

SEQ ID NO: 7143053 - DNA, 22 bp, Homo sapiens
ctggagcaggcttgtcccagct

SEQ ID NO: 7143054 - DNA, 22 bp, Homo sapiens
ctggagcaggcttgtcccagct

SEQ ID NO: 7143055 - DNA, 22 bp, Homo sapiens
ctggagcaggtttaggagtccc

SEQ ID NO: 7143056 - DNA, 22 bp, Homo sapiens
ctggagcaggcttgtcccagct

SEQ ID NO: 7143057 - DNA, 22 bp, Homo sapiens
ctggagcaggtttaggagtccc

SEQ ID NO: 7143058 - DNA, 22 bp, Homo sapiens
ctggagcaggtttaggagtccc

SEQ ID NO: 7143059 - DNA, 22 bp, Homo sapiens
ctggagcaggcttgtcccagct

SEQ ID NO: 7143060 - DNA, 22 bp, Homo sapiens
ctggagcaggtttaggagtccc

SEQ ID NO: 7143061 - DNA, 22 bp, Homo sapiens
ctggagcaggtttaggagtccc

SEQ ID NO: 7143062 - DNA, 22 bp, Homo sapiens
ctggagcaggtttaggagtccc

SEQ ID NO: 7143063 - DNA, 22 bp, Homo sapiens
ctggagccccaggctgtgcaga

SEQ ID NO: 7143064 - DNA, 22 bp, Homo sapiens
ctggagccccaggctgtgcaga

SEQ ID NO: 7143065 - DNA, 22 bp, Homo sapiens
ctggagccctgaatgggcagga

SEQ ID NO: 7143066 - DNA, 22 bp, Homo sapiens
ctggagccctgaatgggcagga

SEQ ID NO: 7143067 - DNA, 22 bp, Homo sapiens
ctggagccctgaatgggcagga

SEQ ID NO: 7143068 - DNA, 22 bp, Homo sapiens
ctggagcatccatgcccagggt

SEQ ID NO: 7143069 - DNA, 22 bp, Homo sapiens
ctggagcatccatgcccagggt

SEQ ID NO: 7143070 - DNA, 22 bp, Homo sapiens
ctggagcatccatgcccagggt

SEQ ID NO: 7143071 - DNA, 22 bp, Homo sapiens
ctggagcatccatgcccagggt

SEQ ID NO: 7143072 - DNA, 22 bp, Homo sapiens
ctggagcatccatgcccagggt

SEQ ID NO: 7143073 - DNA, 22 bp, Homo sapiens
ctggagcctgcagttttcactt

SEQ ID NO: 7143074 - DNA, 17 bp, Homo sapiens
ctggagcctccaactcc

SEQ ID NO: 7143075 - DNA, 22 bp, Homo sapiens
ctggagcctaggttgacctggg

SEQ ID NO: 7143076 - DNA, 22 bp, Homo sapiens
ctggagcctaggttgacctggg

SEQ ID NO: 7143077 - DNA, 22 bp, Homo sapiens
ctggagccggcgagccccagcc

SEQ ID NO: 7143078 - DNA, 22 bp, Homo sapiens
ctggagccggcgagccccagcc

SEQ ID NO: 7143079 - DNA, 22 bp, Homo sapiens
ctggagccggcgagccccagcc

SEQ ID NO: 7143080 - DNA, 22 bp, Homo sapiens
ctggagccggaccagggacggt

SEQ ID NO: 7143081 - DNA, 22 bp, Homo sapiens
ctggagccgcatggagcaggga

SEQ ID NO: 7143082 - DNA, 22 bp, Homo sapiens
ctggagccggaccagggacggt

SEQ ID NO: 7143083 - DNA, 22 bp, Homo sapiens
ctggagccctgaatgggcagga

SEQ ID NO: 7143084 - DNA, 22 bp, Homo sapiens
ctggagccgcatggagcaggga

SEQ ID NO: 7143085 - DNA, 22 bp, Homo sapiens
ctggagccctgaatgggcagga

SEQ ID NO: 7143086 - DNA, 22 bp, Homo sapiens
ctggagccgcatggagcaggga

SEQ ID NO: 7143087 - DNA, 22 bp, Homo sapiens
ctggaaggtgactgtcttgaat

SEQ ID NO: 7143088 - DNA, 22 bp, Homo sapiens
ctggaaggtggatggcgaggcc

SEQ ID NO: 7143089 - DNA, 22 bp, Homo sapiens
ctggaaggtaacaaggccatta

SEQ ID NO: 7143090 - DNA, 22 bp, Homo sapiens
ctggaagggtctacttagcaga

SEQ ID NO: 7143091 - DNA, 22 bp, Homo sapiens
ctggaagggtcagagtgatgag

SEQ ID NO: 7143092 - DNA, 22 bp, Homo sapiens
ctggagaaacatcaggcatagg

SEQ ID NO: 7143093 - DNA, 22 bp, Homo sapiens
ctggagaaacatcaggcatagg

SEQ ID NO: 7143094 - DNA, 22 bp, Homo sapiens
ctggagaagaggtagtatgtag

SEQ ID NO: 7143095 - DNA, 22 bp, Homo sapiens
ctggagagaccgaaagaggctg

SEQ ID NO: 7143096 - DNA, 22 bp, Homo sapiens
ctggaagggagcactgtagaga

SEQ ID NO: 7143097 - DNA, 22 bp, Homo sapiens
ctggaagggagcactgtagaga

SEQ ID NO: 7143098 - DNA, 22 bp, Homo sapiens
ctggaagggaaatctcttggca

SEQ ID NO: 7143099 - DNA, 22 bp, Homo sapiens
ctggaagggaaatctcttggca

SEQ ID NO: 7143100 - DNA, 22 bp, Homo sapiens
ctggaaggggcagtctttgggc

SEQ ID NO: 7143101 - DNA, 22 bp, Homo sapiens
ctggaagggggacagccacaca

SEQ ID NO: 7143102 - DNA, 22 bp, Homo sapiens
ctggaagggtacataggaaact

SEQ ID NO: 7143103 - DNA, 22 bp, Homo sapiens
ctggaagggtcagagtgatgag

SEQ ID NO: 7143104 - DNA, 22 bp, Homo sapiens
ctggaagggtcagagtgatgag

SEQ ID NO: 7143105 - DNA, 19 bp, Homo sapiens
ctggaaggagggactgttc

SEQ ID NO: 7143106 - DNA, 22 bp, Homo sapiens
ctggaaggagcccgggcggatc

SEQ ID NO: 7143107 - DNA, 19 bp, Homo sapiens
ctggaaggagggactgttc

SEQ ID NO: 7143108 - DNA, 22 bp, Homo sapiens
ctggaaggagaaggaggctgtg

SEQ ID NO: 7143109 - DNA, 19 bp, Homo sapiens
ctggaaggagggactgttc

SEQ ID NO: 7143110 - DNA, 22 bp, Homo sapiens
ctggaaggcagaggttgcagtg

SEQ ID NO: 7143111 - DNA, 22 bp, Homo sapiens
ctggaaggcagaggttgcagtg

SEQ ID NO: 7143112 - DNA, 22 bp, Homo sapiens
ctggaaggctctgctgcctgtc

SEQ ID NO: 7143113 - DNA, 22 bp, Homo sapiens
ctggaaagtgcttttctgagag

SEQ ID NO: 7143114 - DNA, 22 bp, Homo sapiens
ctggaaagtgtctccatcctgg

SEQ ID NO: 7143115 - DNA, 22 bp, Homo sapiens
ctggaaagtgcatgtaatgagg

SEQ ID NO: 7143116 - DNA, 22 bp, Homo sapiens
ctggaaagtgcatgtaatgagg

SEQ ID NO: 7143117 - DNA, 22 bp, Homo sapiens
ctggaaagtgcatgtaatgagg

SEQ ID NO: 7143118 - DNA, 22 bp, Homo sapiens
ctggaaagtgctgagacaattg

SEQ ID NO: 7143119 - DNA, 22 bp, Homo sapiens
ctggaaagtgcttttctgagag

SEQ ID NO: 7143120 - DNA, 22 bp, Homo sapiens
ctgctgtgagtttggaggtcta

SEQ ID NO: 7143121 - DNA, 22 bp, Homo sapiens
ctggaaagtcaggtcagaaact

SEQ ID NO: 7143122 - DNA, 22 bp, Homo sapiens
ctggaaagtcaggtcagaaact

SEQ ID NO: 7143123 - DNA, 22 bp, Homo sapiens
ctgctgtgagtggttcttgcct

SEQ ID NO: 7143124 - DNA, 22 bp, Homo sapiens
ctgctgtgagtttggaggtcta

SEQ ID NO: 7143125 - DNA, 22 bp, Homo sapiens
ctggaaagtgaggagagttcca

SEQ ID NO: 7143126 - DNA, 22 bp, Homo sapiens
ctggaaagtgaggagagttcca

SEQ ID NO: 7143127 - DNA, 22 bp, Homo sapiens
ctgctgtgagtttggaggtcta

SEQ ID NO: 7143128 - DNA, 22 bp, Homo sapiens
ctggaaagtgaggagagttcca

SEQ ID NO: 7143129 - DNA, 22 bp, Homo sapiens
ctgctgtgagcactccagcctg

SEQ ID NO: 7143130 - DNA, 22 bp, Homo sapiens
ctgctgtgacagctgccgtgtt

SEQ ID NO: 7143131 - DNA, 23 bp, Homo sapiens
ctgctgtgaaacatggttttggt

SEQ ID NO: 7143132 - DNA, 22 bp, Homo sapiens
ctgctgtctttatttcactgct

SEQ ID NO: 7143133 - DNA, 22 bp, Homo sapiens
ctgctgtctagtatcttaaaaa

SEQ ID NO: 7143134 - DNA, 22 bp, Homo sapiens
ctgctgtctttatttcactgct

SEQ ID NO: 7143135 - DNA, 22 bp, Homo sapiens
ctggaaagttcaagataaagct

SEQ ID NO: 7143136 - DNA, 22 bp, Homo sapiens
ctggaaagttcaagataaagct

SEQ ID NO: 7143137 - DNA, 22 bp, Homo sapiens
ctggaagaggacacacgaatca

SEQ ID NO: 7143138 - DNA, 22 bp, Homo sapiens
ctggaagaggacacacgaatca

SEQ ID NO: 7143139 - DNA, 22 bp, Homo sapiens
ctggaagaggacacacgaatca

SEQ ID NO: 7143140 - DNA, 22 bp, Homo sapiens
ctggaagaggggaaatgccatg

SEQ ID NO: 7143141 - DNA, 22 bp, Homo sapiens
ctggaagaggggaaatgccatg

SEQ ID NO: 7143142 - DNA, 22 bp, Homo sapiens
ctggaagaggggaaatgccatg

SEQ ID NO: 7143143 - DNA, 22 bp, Homo sapiens
ctggaagagtaatataaattag

SEQ ID NO: 7143144 - DNA, 22 bp, Homo sapiens
ctggaagagtaatataaattag

SEQ ID NO: 7143145 - DNA, 22 bp, Homo sapiens
ctggaagagtcctaaacagata

SEQ ID NO: 7143146 - DNA, 22 bp, Homo sapiens
ctggaagagtcctaaacagata

SEQ ID NO: 7143147 - DNA, 22 bp, Homo sapiens
ctggaagagtgactttgcattt

SEQ ID NO: 7143148 - DNA, 22 bp, Homo sapiens
ctggaagagtgactttgcattt

SEQ ID NO: 7143149 - DNA, 20 bp, Homo sapiens
ctggaagcctttccagagca

SEQ ID NO: 7143150 - DNA, 22 bp, Homo sapiens
ctggaagctggaacaggtgtgg

SEQ ID NO: 7143151 - DNA, 22 bp, Homo sapiens
ctggaaggagaaggaggctgtg

SEQ ID NO: 7143152 - DNA, 22 bp, Homo sapiens
ctggaaggagaaggaggctgtg

SEQ ID NO: 7143153 - DNA, 22 bp, Homo sapiens
ctggaaggagaaggaggctgtg

SEQ ID NO: 7143154 - DNA, 22 bp, Homo sapiens
ctggaaggagaaggaggctgtg

SEQ ID NO: 7143155 - DNA, 22 bp, Homo sapiens
ctgctgtccaggagtgccctgt

SEQ ID NO: 7143156 - DNA, 22 bp, Homo sapiens
ctgctgtcccagcctcctcaca

SEQ ID NO: 7143157 - DNA, 22 bp, Homo sapiens
ctgctgtcccagcctcctcaca

SEQ ID NO: 7143158 - DNA, 22 bp, Homo sapiens
ctgctgtcccagcctcctcaca

SEQ ID NO: 7143159 - DNA, 22 bp, Homo sapiens
ctgctgtcctatctctttgttc

SEQ ID NO: 7143160 - DNA, 22 bp, Homo sapiens
ctgctgtcaaaggaaatatttg

SEQ ID NO: 7143161 - DNA, 22 bp, Homo sapiens
ctgctgtcatagccatccctcc

SEQ ID NO: 7143162 - DNA, 22 bp, Homo sapiens
ctgctgtccaacctgcactcgc

SEQ ID NO: 7143163 - DNA, 22 bp, Homo sapiens
ctgctgtccaggagtgccctgt

SEQ ID NO: 7143164 - DNA, 22 bp, Homo sapiens
ctgctgtcaaaaatcactccat

SEQ ID NO: 7143165 - DNA, 22 bp, Homo sapiens
ctgctgtcaaaaatcactccat

SEQ ID NO: 7143166 - DNA, 22 bp, Homo sapiens
ctgctggtctctttggattgcg

SEQ ID NO: 7143167 - DNA, 22 bp, Homo sapiens
ctgctggtgggaatttacaaga

SEQ ID NO: 7143168 - DNA, 22 bp, Homo sapiens
ctgctggttagtcttagtggga

SEQ ID NO: 7143169 - DNA, 22 bp, Homo sapiens
ctgctgggtctatgcaagtgga

SEQ ID NO: 7143170 - DNA, 22 bp, Homo sapiens
ctgctgggtctatgcaagtgga

SEQ ID NO: 7143171 - DNA, 22 bp, Homo sapiens
ctgctgggcagaggctgcatga

SEQ ID NO: 7143172 - DNA, 22 bp, Homo sapiens
ctgctgggtccccctgctgatt

SEQ ID NO: 7143173 - DNA, 22 bp, Homo sapiens
ctgctgggtccccctgctgatt

SEQ ID NO: 7143174 - DNA, 22 bp, Homo sapiens
ctgctgggtccccctgctgatt

SEQ ID NO: 7143175 - DNA, 22 bp, Homo sapiens
ctgctgggtctatgcaagtgga

SEQ ID NO: 7143176 - DNA, 22 bp, Homo sapiens
ctgctgggtctatgcaagtgga

SEQ ID NO: 7143177 - DNA, 19 bp, Homo sapiens
ctgctgggtgctgagggag

SEQ ID NO: 7143178 - DNA, 19 bp, Homo sapiens
ctgctgggtgctgagggag

SEQ ID NO: 7143179 - DNA, 19 bp, Homo sapiens
ctgctgggtgctgagggag

SEQ ID NO: 7143180 - DNA, 19 bp, Homo sapiens
ctgctgggtgctgagggag

SEQ ID NO: 7143181 - DNA, 19 bp, Homo sapiens
ctgctgggtgctgagggag

SEQ ID NO: 7143182 - DNA, 19 bp, Homo sapiens
ctgctgggtgctgagggag

SEQ ID NO: 7143183 - DNA, 19 bp, Homo sapiens
ctgctgggtgctgagggag

SEQ ID NO: 7143184 - DNA, 22 bp, Homo sapiens
ctgctgggtttgcctttcacca

SEQ ID NO: 7143185 - DNA, 22 bp, Homo sapiens
ctgctgggtttgcctttcacca

SEQ ID NO: 7143186 - DNA, 22 bp, Homo sapiens
ctgctggtaccagtggccgtca

SEQ ID NO: 7143187 - DNA, 22 bp, Homo sapiens
ctgctgactcattttcaacact

SEQ ID NO: 7143188 - DNA, 22 bp, Homo sapiens
ctgctgaagttgttggtctttt

SEQ ID NO: 7143189 - DNA, 22 bp, Homo sapiens
ctgctgaatgtctctttggttt

SEQ ID NO: 7143190 - DNA, 22 bp, Homo sapiens
ctgctgaaaacaataatgatga

SEQ ID NO: 7143191 - DNA, 22 bp, Homo sapiens
ctgctgagaaaagactgaggga

SEQ ID NO: 7143192 - DNA, 22 bp, Homo sapiens
ctgctgagaaaagactgaggga

SEQ ID NO: 7143193 - DNA, 22 bp, Homo sapiens
ctgctgagaaaagactgaggga

SEQ ID NO: 7143194 - DNA, 22 bp, Homo sapiens
ctgctgagaaatgcatccagtt

SEQ ID NO: 7143195 - DNA, 22 bp, Homo sapiens
ctgctgagaaccagggagaatt

SEQ ID NO: 7143196 - DNA, 22 bp, Homo sapiens
ctgctgagaaccagggagaatt

SEQ ID NO: 7143197 - DNA, 22 bp, Homo sapiens
ctgctgagaacccagattacta

SEQ ID NO: 7143198 - DNA, 22 bp, Homo sapiens
ctgctgagaacccagattacta

SEQ ID NO: 7143199 - DNA, 22 bp, Homo sapiens
ctgctgagactggctttgtgtc

SEQ ID NO: 7143200 - DNA, 22 bp, Homo sapiens
ctgctgagactggctttgtgtc

SEQ ID NO: 7143201 - DNA, 22 bp, Homo sapiens
ctgctgagagatgccaatctca

SEQ ID NO: 7143202 - DNA, 22 bp, Homo sapiens
ctgctgagagatgccaatctca

SEQ ID NO: 7143203 - DNA, 22 bp, Homo sapiens
ctgctgagagccacgtggcaca

SEQ ID NO: 7143204 - DNA, 20 bp, Homo sapiens
ctgctgagagcctggcttgc

SEQ ID NO: 7143205 - DNA, 20 bp, Homo sapiens
ctgctgagagcctggcttgc

SEQ ID NO: 7143206 - DNA, 20 bp, Homo sapiens
ctgctgagagcctggcttgc

SEQ ID NO: 7143207 - DNA, 22 bp, Homo sapiens
ctgctgagagccacgtggcaca

SEQ ID NO: 7143208 - DNA, 22 bp, Homo sapiens
ctgctgagagccacgtggcaca

SEQ ID NO: 7143209 - DNA, 22 bp, Homo sapiens
ctgctgagagccccagctgaga

SEQ ID NO: 7143210 - DNA, 22 bp, Homo sapiens
ctgctgagagccccagctgaga

SEQ ID NO: 7143211 - DNA, 22 bp, Homo sapiens
ctgctgagagctgaaggctgta

SEQ ID NO: 7143212 - DNA, 22 bp, Homo sapiens
ctgctgagagctgaaggctgta

SEQ ID NO: 7143213 - DNA, 22 bp, Homo sapiens
ctgctgagagctgaaggctgta

SEQ ID NO: 7143214 - DNA, 22 bp, Homo sapiens
ctgctgagatgccaggagctct

SEQ ID NO: 7143215 - DNA, 22 bp, Homo sapiens
ctgctgagatgccaggagctct

SEQ ID NO: 7143216 - DNA, 22 bp, Homo sapiens
ctgctgggatagaagtatctca

SEQ ID NO: 7143217 - DNA, 22 bp, Homo sapiens
ctgctgggcagaggctgcatga

SEQ ID NO: 7143218 - DNA, 22 bp, Homo sapiens
ctgctgggaaggtctgctcagt

SEQ ID NO: 7143219 - DNA, 22 bp, Homo sapiens
ctgctgggaaggtctgctcagt

SEQ ID NO: 7143220 - DNA, 22 bp, Homo sapiens
ctgctgagcatcagggctgccc

SEQ ID NO: 7143221 - DNA, 22 bp, Homo sapiens
ctgctgagcatcagggctgccc

SEQ ID NO: 7143222 - DNA, 22 bp, Homo sapiens
ctgctgagcatcagggctgccc

SEQ ID NO: 7143223 - DNA, 22 bp, Homo sapiens
ctgctgggaaggtctgctcagt

SEQ ID NO: 7143224 - DNA, 22 bp, Homo sapiens
ctgcctggggaatgtgaggatt

SEQ ID NO: 7143225 - DNA, 22 bp, Homo sapiens
ctgcctggggaatgtgaggatt

SEQ ID NO: 7143226 - DNA, 22 bp, Homo sapiens
ctgcccctgctcatggctgtcc

SEQ ID NO: 7143227 - DNA, 22 bp, Homo sapiens
ctgcctggggaatgtgaggatt

SEQ ID NO: 7143228 - DNA, 22 bp, Homo sapiens
ctgcctggggaatgtgaggatt

SEQ ID NO: 7143229 - DNA, 22 bp, Homo sapiens
ctgcctggggaatgtgaggatt

SEQ ID NO: 7143230 - DNA, 22 bp, Homo sapiens
ctgcctggggcatcagtcaagg

SEQ ID NO: 7143231 - DNA, 22 bp, Homo sapiens
ctgcctgtggacaccctggagg

SEQ ID NO: 7143232 - DNA, 22 bp, Homo sapiens
ctgcctgtggacaccctggagg

SEQ ID NO: 7143233 - DNA, 22 bp, Homo sapiens
ctgcctgtgggtacaagtggaa

SEQ ID NO: 7143234 - DNA, 22 bp, Homo sapiens
ctgcctgtgggtacaagtggaa

SEQ ID NO: 7143235 - DNA, 22 bp, Homo sapiens
ctgcctgtgggtacaagtggaa

SEQ ID NO: 7143236 - DNA, 22 bp, Homo sapiens
ctgcctgtggtctgtgatctaa

SEQ ID NO: 7143237 - DNA, 22 bp, Homo sapiens
ctgcctgtggtctgtgatctaa

SEQ ID NO: 7143238 - DNA, 22 bp, Homo sapiens
ctgcctgtgtctattccttttt

SEQ ID NO: 7143239 - DNA, 22 bp, Homo sapiens
ctgcctgtgtgtgcctgcagaa

SEQ ID NO: 7143240 - DNA, 22 bp, Homo sapiens
ctgcctgtgtgtgcctgcagaa

SEQ ID NO: 7143241 - DNA, 22 bp, Homo sapiens
ctgcctgttagtctagcagtta

SEQ ID NO: 7143242 - DNA, 19 bp, Homo sapiens
ctgcctgttatggagagaa

SEQ ID NO: 7143243 - DNA, 22 bp, Homo sapiens
ctgccttctttcaagggtaagc

SEQ ID NO: 7143244 - DNA, 22 bp, Homo sapiens
ctgccttgaaaatgaagcttta

SEQ ID NO: 7143245 - DNA, 22 bp, Homo sapiens
ctgccttgaaaatgaagcttta

SEQ ID NO: 7143246 - DNA, 21 bp, Homo sapiens
ctgccttgaatggtactggga

SEQ ID NO: 7143247 - DNA, 21 bp, Homo sapiens
ctgccttgaatggtactggga

SEQ ID NO: 7143248 - DNA, 22 bp, Homo sapiens
ctgccttgaggaggttgtggga

SEQ ID NO: 7143249 - DNA, 22 bp, Homo sapiens
ctgccttgcaccggctctctgg

SEQ ID NO: 7143250 - DNA, 22 bp, Homo sapiens
ctgccttccaaccccagactcc

SEQ ID NO: 7143251 - DNA, 22 bp, Homo sapiens
ctgcctgttttctgatagattt

SEQ ID NO: 7143252 - DNA, 22 bp, Homo sapiens
ctgcctgttttctgatagattt

SEQ ID NO: 7143253 - DNA, 22 bp, Homo sapiens
ctgcctgttcctgatcattcta

SEQ ID NO: 7143254 - DNA, 22 bp, Homo sapiens
ctgcctgttcctgatcattcta

SEQ ID NO: 7143255 - DNA, 18 bp, Homo sapiens
ctgcctgttgctgagagg

SEQ ID NO: 7143256 - DNA, 18 bp, Homo sapiens
ctgcctgttgctgagagg

SEQ ID NO: 7143257 - DNA, 18 bp, Homo sapiens
ctgcctgttgctgagagg

SEQ ID NO: 7143258 - DNA, 22 bp, Homo sapiens
ctgcctgtttcctcttgctccc

SEQ ID NO: 7143259 - DNA, 22 bp, Homo sapiens
ctgcctgtttcctcttgctccc

SEQ ID NO: 7143260 - DNA, 22 bp, Homo sapiens
ctgcctttgcccttgacactgt

SEQ ID NO: 7143261 - DNA, 22 bp, Homo sapiens
ctgcctttgcccttgacactgt

SEQ ID NO: 7143262 - DNA, 22 bp, Homo sapiens
ctgcctttgaaagttctgttga

SEQ ID NO: 7143263 - DNA, 22 bp, Homo sapiens
ctgcctttgaaagttctgttga

SEQ ID NO: 7143264 - DNA, 22 bp, Homo sapiens
ctgccttggaaaatgtggtaat

SEQ ID NO: 7143265 - DNA, 22 bp, Homo sapiens
ctgccttggaaaatgtggtaat

SEQ ID NO: 7143266 - DNA, 22 bp, Homo sapiens
ctgccttggaaaatgtggtaat

SEQ ID NO: 7143267 - DNA, 22 bp, Homo sapiens
ctgccttggccctagttcatgg

SEQ ID NO: 7143268 - DNA, 22 bp, Homo sapiens
ctgccttggccctagttcatgg

SEQ ID NO: 7143269 - DNA, 22 bp, Homo sapiens
ctgccttggtttctagcagggc

SEQ ID NO: 7143270 - DNA, 22 bp, Homo sapiens
ctgcgatgaccctctcttgctg

SEQ ID NO: 7143271 - DNA, 22 bp, Homo sapiens
ctgccttttcatctgagctgga

SEQ ID NO: 7143272 - DNA, 22 bp, Homo sapiens
ctgcgatggctgtatgtgctca

SEQ ID NO: 7143273 - DNA, 22 bp, Homo sapiens
ctgcgcaggggtggcgccagaa

SEQ ID NO: 7143274 - DNA, 22 bp, Homo sapiens
ctgcctttggggagttagaggg

SEQ ID NO: 7143275 - DNA, 22 bp, Homo sapiens
ctgcctttggaagtccagagct

SEQ ID NO: 7143276 - DNA, 22 bp, Homo sapiens
ctgcctttggaagtccagagct

SEQ ID NO: 7143277 - DNA, 22 bp, Homo sapiens
ctgccttttaaagccagtgtta

SEQ ID NO: 7143278 - DNA, 22 bp, Homo sapiens
ctgcctttgtgatcagttcttt

SEQ ID NO: 7143279 - DNA, 22 bp, Homo sapiens
ctgctctgtttcttagctgggt

SEQ ID NO: 7143280 - DNA, 22 bp, Homo sapiens
ctgctctgttcccccatcatct

SEQ ID NO: 7143281 - DNA, 22 bp, Homo sapiens
ctgctcttcacactacacccgt

SEQ ID NO: 7143282 - DNA, 22 bp, Homo sapiens
ctgctctgagaggctcttccta

SEQ ID NO: 7143283 - DNA, 21 bp, Homo sapiens
ctgctctgacagtgaggccag

SEQ ID NO: 7143284 - DNA, 21 bp, Homo sapiens
ctgctctgacagtgaggccag

SEQ ID NO: 7143285 - DNA, 22 bp, Homo sapiens
ctgctctgtggtccatgagaca

SEQ ID NO: 7143286 - DNA, 22 bp, Homo sapiens
ctgctctgtggtccatgagaca

SEQ ID NO: 7143287 - DNA, 22 bp, Homo sapiens
ctgaggggaaaagtcaggatga

SEQ ID NO: 7143288 - DNA, 23 bp, Homo sapiens
ctgaggggaaaagggcttcaggc

SEQ ID NO: 7143289 - DNA, 18 bp, Homo sapiens
ctgaggctggcaggagcc

SEQ ID NO: 7143290 - DNA, 23 bp, Homo sapiens
ctgaggggaaaagggcttcaggc

SEQ ID NO: 7143291 - DNA, 22 bp, Homo sapiens
ctgaggctggagtgcagtggtg

SEQ ID NO: 7143292 - DNA, 18 bp, Homo sapiens
ctgaggctggcaggagcc

SEQ ID NO: 7143293 - DNA, 18 bp, Homo sapiens
ctgaggctggcaggagcc

SEQ ID NO: 7143294 - DNA, 18 bp, Homo sapiens
ctgaggctggcaggagcc

SEQ ID NO: 7143295 - DNA, 22 bp, Homo sapiens
ctgaggtctattttgaaactgc

SEQ ID NO: 7143296 - DNA, 22 bp, Homo sapiens
ctgaggtccttgactgcttgcc

SEQ ID NO: 7143297 - DNA, 22 bp, Homo sapiens
ctgaggtcaggagttcaagctg

SEQ ID NO: 7143298 - DNA, 22 bp, Homo sapiens
ctgaggtcaggagttcaagctg

SEQ ID NO: 7143299 - DNA, 17 bp, Homo sapiens
ctgaggggagtgctgtg

SEQ ID NO: 7143300 - DNA, 22 bp, Homo sapiens
ctgaggctggagtgcagtggtg

SEQ ID NO: 7143301 - DNA, 22 bp, Homo sapiens
ctgaggctgcccagggccaggt

SEQ ID NO: 7143302 - DNA, 22 bp, Homo sapiens
ctgaggctgaagagggcctacg

SEQ ID NO: 7143303 - DNA, 22 bp, Homo sapiens
ctgaggctctgagaaagccaaa

SEQ ID NO: 7143304 - DNA, 22 bp, Homo sapiens
ctgaggctccctcgggtctgct

SEQ ID NO: 7143305 - DNA, 22 bp, Homo sapiens
ctgaggctccctcgggtctgct

SEQ ID NO: 7143306 - DNA, 23 bp, Homo sapiens
ctgaggcctgctgcgttcaggtt

SEQ ID NO: 7143307 - DNA, 22 bp, Homo sapiens
ctgaggcctggccccaccacag

SEQ ID NO: 7143308 - DNA, 22 bp, Homo sapiens
ctgaggccgttggtgggcctta

SEQ ID NO: 7143309 - DNA, 22 bp, Homo sapiens
ctgaggccgttggtgggcctta

SEQ ID NO: 7143310 - DNA, 22 bp, Homo sapiens
ctgaggccgtctgggtctgcag

SEQ ID NO: 7143311 - DNA, 22 bp, Homo sapiens
ctgagccaaccacagcaggagc

SEQ ID NO: 7143312 - DNA, 22 bp, Homo sapiens
ctgagccaaaaagcagagcttg

SEQ ID NO: 7143313 - DNA, 22 bp, Homo sapiens
ctgagcatttgtgcagcttctc

SEQ ID NO: 7143314 - DNA, 22 bp, Homo sapiens
ctgagcatttgccggagcgtca

SEQ ID NO: 7143315 - DNA, 22 bp, Homo sapiens
ctgagcatttgcctttttaaca

SEQ ID NO: 7143316 - DNA, 22 bp, Homo sapiens
ctgagcatttgcctttttaaca

SEQ ID NO: 7143317 - DNA, 22 bp, Homo sapiens
ctgagcatttgccggagcgtca

SEQ ID NO: 7143318 - DNA, 22 bp, Homo sapiens
ctgagcatttgtgcagcttctc

SEQ ID NO: 7143319 - DNA, 22 bp, Homo sapiens
ctgagccaaaaagcagagcttg

SEQ ID NO: 7143320 - DNA, 22 bp, Homo sapiens
ctgagccaaaaagcagagcttg

SEQ ID NO: 7143321 - DNA, 22 bp, Homo sapiens
ctgagcatcatggcagaatctt

SEQ ID NO: 7143322 - DNA, 22 bp, Homo sapiens
ctgagcatccagcaggtactgc

SEQ ID NO: 7143323 - DNA, 17 bp, Homo sapiens
ctgagcatccgtgctct

SEQ ID NO: 7143324 - DNA, 17 bp, Homo sapiens
ctgagcatccgtgctct

SEQ ID NO: 7143325 - DNA, 22 bp, Homo sapiens
ctgagcatgctacatgcagcac

SEQ ID NO: 7143326 - DNA, 22 bp, Homo sapiens
ctgagcatgctcctcttttcca

SEQ ID NO: 7143327 - DNA, 22 bp, Homo sapiens
ctgagcatggccggtccatggt

SEQ ID NO: 7143328 - DNA, 22 bp, Homo sapiens
ctgagcatggccggtccatggt

SEQ ID NO: 7143329 - DNA, 22 bp, Homo sapiens
ctgagcattatcttggattttg

SEQ ID NO: 7143330 - DNA, 22 bp, Homo sapiens
ctgaggctcagcgtgaggaaag

SEQ ID NO: 7143331 - DNA, 22 bp, Homo sapiens
ctgaggctcagcgtgaggaaag

SEQ ID NO: 7143332 - DNA, 22 bp, Homo sapiens
ctgaggctcaagggcaggtggg

SEQ ID NO: 7143333 - DNA, 22 bp, Homo sapiens
ctgaggctcaagggcaggtggg

SEQ ID NO: 7143334 - DNA, 22 bp, Homo sapiens
ctgaggctcaagggcaggtggg

SEQ ID NO: 7143335 - DNA, 22 bp, Homo sapiens
ctgaggctagtataaagagcat

SEQ ID NO: 7143336 - DNA, 22 bp, Homo sapiens
ctgaggcctgggggcgtggacg

SEQ ID NO: 7143337 - DNA, 22 bp, Homo sapiens
ctgaggcctggtgaggtggtga

SEQ ID NO: 7143338 - DNA, 22 bp, Homo sapiens
ctgaggcctggccccaccacag

SEQ ID NO: 7143339 - DNA, 22 bp, Homo sapiens
ctgaggcctggccccaccacag

SEQ ID NO: 7143340 - DNA, 22 bp, Homo sapiens
ctgaggcctggccccaccacag

SEQ ID NO: 7143341 - DNA, 22 bp, Homo sapiens
ctgaggcctgggggcgtggacg

SEQ ID NO: 7143342 - DNA, 22 bp, Homo sapiens
ctgaggcctgggggcgtggacg

SEQ ID NO: 7143343 - DNA, 22 bp, Homo sapiens
ctgaggctaacctcgagagaca

SEQ ID NO: 7143344 - DNA, 22 bp, Homo sapiens
ctgaggcctgtgttggggcagt

SEQ ID NO: 7143345 - DNA, 22 bp, Homo sapiens
ctgaggctaacctcgagagaca

SEQ ID NO: 7143346 - DNA, 22 bp, Homo sapiens
ctgaggcctgtgttggggcagt

SEQ ID NO: 7143347 - DNA, 22 bp, Homo sapiens
ctgaggcctgtgttggggcagt

SEQ ID NO: 7143348 - DNA, 22 bp, Homo sapiens
ctgaggcctggtgaggtggtga

SEQ ID NO: 7143349 - DNA, 22 bp, Homo sapiens
ctgagcagtctagccaggtgtt

SEQ ID NO: 7143350 - DNA, 22 bp, Homo sapiens
ctgagcagtctgactcaagcta

SEQ ID NO: 7143351 - DNA, 22 bp, Homo sapiens
ctgagcagtgctttgcagtggg

SEQ ID NO: 7143352 - DNA, 22 bp, Homo sapiens
ctgagcagtgctttgcagtggg

SEQ ID NO: 7143353 - DNA, 22 bp, Homo sapiens
ctgagcagtgctttgcagtggg

SEQ ID NO: 7143354 - DNA, 22 bp, Homo sapiens
ctgagcagtggttcttgagcgc

SEQ ID NO: 7143355 - DNA, 22 bp, Homo sapiens
ctgagcagtggttcttgagcgc

SEQ ID NO: 7143356 - DNA, 22 bp, Homo sapiens
ctgagcagtttcttagggctca

SEQ ID NO: 7143357 - DNA, 19 bp, Homo sapiens
ctgagcaggcaggtaggat

SEQ ID NO: 7143358 - DNA, 19 bp, Homo sapiens
ctgagcaggcaggtaggat

SEQ ID NO: 7143359 - DNA, 19 bp, Homo sapiens
ctgagcaggcaggtaggat

SEQ ID NO: 7143360 - DNA, 19 bp, Homo sapiens
ctgagcaggcaggtaggat

SEQ ID NO: 7143361 - DNA, 19 bp, Homo sapiens
ctgagcaggcaggtaggat

SEQ ID NO: 7143362 - DNA, 22 bp, Homo sapiens
ctgagcaggcggtggagcggct

SEQ ID NO: 7143363 - DNA, 22 bp, Homo sapiens
ctgagcaggcggtggagcggct

SEQ ID NO: 7143364 - DNA, 22 bp, Homo sapiens
ctgagcaggcggtggagcggct

SEQ ID NO: 7143365 - DNA, 22 bp, Homo sapiens
ctgagcaggcggtggagcggct

SEQ ID NO: 7143366 - DNA, 22 bp, Homo sapiens
ctgagcagtctagccaggtgtt

SEQ ID NO: 7143367 - DNA, 22 bp, Homo sapiens
ctgagcagtctagccaggtgtt

SEQ ID NO: 7143368 - DNA, 19 bp, Homo sapiens
ctgagcagcggcagcactt

SEQ ID NO: 7143369 - DNA, 22 bp, Homo sapiens
ctgagcagaccatggcagaggt

SEQ ID NO: 7143370 - DNA, 19 bp, Homo sapiens
ctgagcagagggaggaact

SEQ ID NO: 7143371 - DNA, 19 bp, Homo sapiens
ctgagcagagggaggaact

SEQ ID NO: 7143372 - DNA, 22 bp, Homo sapiens
ctgagcactgggcacatagctg

SEQ ID NO: 7143373 - DNA, 22 bp, Homo sapiens
ctgagcactgggcacatagctg

SEQ ID NO: 7143374 - DNA, 17 bp, Homo sapiens
ctgagcactttatcctg

SEQ ID NO: 7143375 - DNA, 22 bp, Homo sapiens
ctgagcagaagggtgcacgtgc

SEQ ID NO: 7143376 - DNA, 22 bp, Homo sapiens
ctgagcagaccatggcagaggt

SEQ ID NO: 7143377 - DNA, 22 bp, Homo sapiens
ctgagcagaccatggcagaggt

SEQ ID NO: 7143378 - DNA, 22 bp, Homo sapiens
ctgagcagaccatggcagaggt

SEQ ID NO: 7143379 - DNA, 22 bp, Homo sapiens
ctgagcagaccatggcagaggt

SEQ ID NO: 7143380 - DNA, 22 bp, Homo sapiens
ctgagcaggatattcacagcag

SEQ ID NO: 7143381 - DNA, 22 bp, Homo sapiens
ctgagcaggacagtgggagacc

SEQ ID NO: 7143382 - DNA, 22 bp, Homo sapiens
ctgagcaggacagtgggagacc

SEQ ID NO: 7143383 - DNA, 22 bp, Homo sapiens
ctgagcaggacagtgggagacc

SEQ ID NO: 7143384 - DNA, 22 bp, Homo sapiens
ctgagcaggacagtgggagacc

SEQ ID NO: 7143385 - DNA, 22 bp, Homo sapiens
ctgagcagctccctgagtggtc

SEQ ID NO: 7143386 - DNA, 22 bp, Homo sapiens
ctgagcagctccctgagtggtc

SEQ ID NO: 7143387 - DNA, 22 bp, Homo sapiens
ctgagcagctccctgagtggtc

SEQ ID NO: 7143388 - DNA, 22 bp, Homo sapiens
ctgagcagcgtggggagctggc

SEQ ID NO: 7143389 - DNA, 22 bp, Homo sapiens
ctgagcagcgtggggagctggc

SEQ ID NO: 7143390 - DNA, 22 bp, Homo sapiens
ctgagcagcgtggggagctggc

SEQ ID NO: 7143391 - DNA, 22 bp, Homo sapiens
ctgagcagcgtggggagctggc

SEQ ID NO: 7143392 - DNA, 19 bp, Homo sapiens
ctgagcagcggcagcactt

SEQ ID NO: 7143393 - DNA, 22 bp, Homo sapiens
ctgagcagcgtggggagctggc

SEQ ID NO: 7143394 - DNA, 22 bp, Homo sapiens
ctgagcagcgtggggagctggc

SEQ ID NO: 7143395 - DNA, 22 bp, Homo sapiens
ctcttctgtacctcggcctcca

SEQ ID NO: 7143396 - DNA, 22 bp, Homo sapiens
ctcttctgtacctcggcctcca

SEQ ID NO: 7143397 - DNA, 22 bp, Homo sapiens
ctcttctctgcagcctttgaag

SEQ ID NO: 7143398 - DNA, 22 bp, Homo sapiens
ctgagcactgggcacatagctg

SEQ ID NO: 7143399 - DNA, 22 bp, Homo sapiens
ctgagcacgtagttagggtcca

SEQ ID NO: 7143400 - DNA, 22 bp, Homo sapiens
ctcttcttatggccgtggctga

SEQ ID NO: 7143401 - DNA, 22 bp, Homo sapiens
ctcttcctagtgtgcagcgtgg

SEQ ID NO: 7143402 - DNA, 22 bp, Homo sapiens
ctcttcctctcatgcggtcata

SEQ ID NO: 7143403 - DNA, 22 bp, Homo sapiens
ctcttccttaagactataaaga

SEQ ID NO: 7143404 - DNA, 22 bp, Homo sapiens
ctcttcctttcccttgagggtg

SEQ ID NO: 7143405 - DNA, 22 bp, Homo sapiens
ctcttcctttcccttgagggtg

SEQ ID NO: 7143406 - DNA, 22 bp, Homo sapiens
ctcttctctgcagcctttgaag

SEQ ID NO: 7143407 - DNA, 22 bp, Homo sapiens
ttttgcttgagtgcacaaaatg

SEQ ID NO: 7143408 - DNA, 22 bp, Homo sapiens
ttttgctttaagatggagagga

SEQ ID NO: 7143409 - DNA, 22 bp, Homo sapiens
ttttgctttaagatggagagga

SEQ ID NO: 7143410 - DNA, 22 bp, Homo sapiens
ttttgctttaagatggagagga

SEQ ID NO: 7143411 - DNA, 22 bp, Homo sapiens
ttttgctttaagatggagagga

SEQ ID NO: 7143412 - DNA, 22 bp, Homo sapiens
ttttgcttttgtaacacagtgt

SEQ ID NO: 7143413 - DNA, 22 bp, Homo sapiens
ttttgcttttgtaacacagtgt

SEQ ID NO: 7143414 - DNA, 22 bp, Homo sapiens
ctcttcccagctccacgagagg

SEQ ID NO: 7143415 - DNA, 22 bp, Homo sapiens
ctcttcccagctccacgagagg

SEQ ID NO: 7143416 - DNA, 22 bp, Homo sapiens
ctcttcctacagtctgctatgc

SEQ ID NO: 7143417 - DNA, 22 bp, Homo sapiens
ttttggaacacagacattagaa

SEQ ID NO: 7143418 - DNA, 22 bp, Homo sapiens
ctgcccctgccaggcagctgtc

SEQ ID NO: 7143419 - DNA, 22 bp, Homo sapiens
ctgccccatggtccctggtggg

SEQ ID NO: 7143420 - DNA, 22 bp, Homo sapiens
ctgccccatggtccctggtggg

SEQ ID NO: 7143421 - DNA, 22 bp, Homo sapiens
ctgccccatggtccctggtggg

SEQ ID NO: 7143422 - DNA, 22 bp, Homo sapiens
ctgcccccaggctgcatggctg

SEQ ID NO: 7143423 - DNA, 22 bp, Homo sapiens
ctgccccagtgccaggcaggtg

SEQ ID NO: 7143424 - DNA, 22 bp, Homo sapiens
ctgccccagtgccaggcaggtg

SEQ ID NO: 7143425 - DNA, 22 bp, Homo sapiens
ctgccccatggtccctggtggg

SEQ ID NO: 7143426 - DNA, 22 bp, Homo sapiens
ctgccccatggtccctggtggg

SEQ ID NO: 7143427 - DNA, 22 bp, Homo sapiens
ctgccccatggtccctggtggg

SEQ ID NO: 7143428 - DNA, 22 bp, Homo sapiens
ctgccccaggcctccttttctt

SEQ ID NO: 7143429 - DNA, 22 bp, Homo sapiens
ctgccccaggcctccttttctt

SEQ ID NO: 7143430 - DNA, 22 bp, Homo sapiens
ctgccccaggcctcgggaggag

SEQ ID NO: 7143431 - DNA, 22 bp, Homo sapiens
ctgccccaggcctcgggaggag

SEQ ID NO: 7143432 - DNA, 22 bp, Homo sapiens
ctgccccagtgccaggcaggtg

SEQ ID NO: 7143433 - DNA, 22 bp, Homo sapiens
ctgccccagtgccaggcaggtg

SEQ ID NO: 7143434 - DNA, 22 bp, Homo sapiens
ctgccccaccccaacctgaggt

SEQ ID NO: 7143435 - DNA, 22 bp, Homo sapiens
ctgccccaccccaacctgaggt

SEQ ID NO: 7143436 - DNA, 22 bp, Homo sapiens
ctgccccagcctggggccttct

SEQ ID NO: 7143437 - DNA, 22 bp, Homo sapiens
ctgccccagcctggggccttct

SEQ ID NO: 7143438 - DNA, 22 bp, Homo sapiens
ctgccccaggacctcttctgga

SEQ ID NO: 7143439 - DNA, 22 bp, Homo sapiens
ctgcccagtttgggagcctttc

SEQ ID NO: 7143440 - DNA, 22 bp, Homo sapiens
ctgcccagtttgggagcctttc

SEQ ID NO: 7143441 - DNA, 22 bp, Homo sapiens
ctgcccataaactttccacctg

SEQ ID NO: 7143442 - DNA, 22 bp, Homo sapiens
ctgcccatctgcagacatgcgt

SEQ ID NO: 7143443 - DNA, 21 bp, Homo sapiens
ctgcccatttgtgatgtcccc

SEQ ID NO: 7143444 - DNA, 23 bp, Homo sapiens
ctgccccaattataaaagaagat

SEQ ID NO: 7143445 - DNA, 22 bp, Homo sapiens
ctgccccacaggcttggtaggg

SEQ ID NO: 7143446 - DNA, 22 bp, Homo sapiens
ctgccccacaggcttggtaggg

SEQ ID NO: 7143447 - DNA, 22 bp, Homo sapiens
ctgccccacaggcttggtaggg

SEQ ID NO: 7143448 - DNA, 22 bp, Homo sapiens
ctgcccaggctgaaggaacatc

SEQ ID NO: 7143449 - DNA, 22 bp, Homo sapiens
ctgcccaggggagtgctgtcgg

SEQ ID NO: 7143450 - DNA, 22 bp, Homo sapiens
ctgcccaggggagtgctgtcgg

SEQ ID NO: 7143451 - DNA, 22 bp, Homo sapiens
ctgcccaggaaggagaggatgg

SEQ ID NO: 7143452 - DNA, 22 bp, Homo sapiens
ctgcccaggaaggagaggatgg

SEQ ID NO: 7143453 - DNA, 22 bp, Homo sapiens
ctgcccaggctgaaggaacatc

SEQ ID NO: 7143454 - DNA, 22 bp, Homo sapiens
ctgcccaggctgaaggaacatc

SEQ ID NO: 7143455 - DNA, 22 bp, Homo sapiens
ctgcccaggctgaaggaacatc

SEQ ID NO: 7143456 - DNA, 22 bp, Homo sapiens
ctgcccagattttaccacctgc

SEQ ID NO: 7143457 - DNA, 22 bp, Homo sapiens
ctgcccacagttctctgccatg

SEQ ID NO: 7143458 - DNA, 22 bp, Homo sapiens
ctgcccagattttaccacctgc

SEQ ID NO: 7143459 - DNA, 22 bp, Homo sapiens
ctgcccacagttctctgccatg

SEQ ID NO: 7143460 - DNA, 22 bp, Homo sapiens
ctgcccacacctgagctgggcc

SEQ ID NO: 7143461 - DNA, 22 bp, Homo sapiens
ctgcccacactcatggggaagg

SEQ ID NO: 7143462 - DNA, 18 bp, Homo sapiens
ctgccatgtcctactgtc

SEQ ID NO: 7143463 - DNA, 22 bp, Homo sapiens
ctgccatgttacctgcacaggt

SEQ ID NO: 7143464 - DNA, 22 bp, Homo sapiens
ctgccatgttacctgcacaggt

SEQ ID NO: 7143465 - DNA, 22 bp, Homo sapiens
ctgccattaaagagcgttcaga

SEQ ID NO: 7143466 - DNA, 22 bp, Homo sapiens
ctgccattggattttcacattt

SEQ ID NO: 7143467 - DNA, 22 bp, Homo sapiens
ctgcccacacctgagctgggcc

SEQ ID NO: 7143468 - DNA, 20 bp, Homo sapiens
ctgcccagccactgagggat

SEQ ID NO: 7143469 - DNA, 20 bp, Homo sapiens
ctgcccagccactgagggat

SEQ ID NO: 7143470 - DNA, 20 bp, Homo sapiens
ctgcccagccactgagggat

SEQ ID NO: 7143471 - DNA, 20 bp, Homo sapiens
ctgcccagccactgagggat

SEQ ID NO: 7143472 - DNA, 22 bp, Homo sapiens
ctgcccaggaaccagaggggca

SEQ ID NO: 7143473 - DNA, 22 bp, Homo sapiens
ctgcccaggaaccagaggggca

SEQ ID NO: 7143474 - DNA, 20 bp, Homo sapiens
ctgcccagccactgagggat

SEQ ID NO: 7143475 - DNA, 20 bp, Homo sapiens
ctgcccagccactgagggat

SEQ ID NO: 7143476 - DNA, 20 bp, Homo sapiens
ctgcccagccactgagggat

SEQ ID NO: 7143477 - DNA, 22 bp, Homo sapiens
ctgcccagattttaccacctgc

SEQ ID NO: 7143478 - DNA, 20 bp, Homo sapiens
ctgcccagccactgagggat

SEQ ID NO: 7143479 - DNA, 22 bp, Homo sapiens
ctgcaggaggatcctgagagtg

SEQ ID NO: 7143480 - DNA, 22 bp, Homo sapiens
ctgcaggaggatcctgagagtg

SEQ ID NO: 7143481 - DNA, 22 bp, Homo sapiens
ctgcaggaggatcctgagagtg

SEQ ID NO: 7143482 - DNA, 22 bp, Homo sapiens
ctgcaggaggatcctgagagtg

SEQ ID NO: 7143483 - DNA, 22 bp, Homo sapiens
ctgcaggagtgaaagcaggcct

SEQ ID NO: 7143484 - DNA, 22 bp, Homo sapiens
ctgcaggagtgaaagcaggcct

SEQ ID NO: 7143485 - DNA, 22 bp, Homo sapiens
ctgcaggagggctggggaagcc

SEQ ID NO: 7143486 - DNA, 22 bp, Homo sapiens
ctgcaggaggatcctgagagtg

SEQ ID NO: 7143487 - DNA, 22 bp, Homo sapiens
ctgcaggagcaaagcctctgct

SEQ ID NO: 7143488 - DNA, 22 bp, Homo sapiens
ctgcaggagcaaagcctctgct

SEQ ID NO: 7143489 - DNA, 22 bp, Homo sapiens
ctgcaggagcaaagcctctgct

SEQ ID NO: 7143490 - DNA, 22 bp, Homo sapiens
ctgcaggagtgaaagcaggcct

SEQ ID NO: 7143491 - DNA, 22 bp, Homo sapiens
ctgcaggagtgaaagcaggcct

SEQ ID NO: 7143492 - DNA, 22 bp, Homo sapiens
ctgcaggagtgaaagcaggcct

SEQ ID NO: 7143493 - DNA, 22 bp, Homo sapiens
ctgcaggagtgaaagcaggcct

SEQ ID NO: 7143494 - DNA, 22 bp, Homo sapiens
ctgcaggagtgaaagcaggcct

SEQ ID NO: 7143495 - DNA, 22 bp, Homo sapiens
ctgcaggatttcatgggctgac

SEQ ID NO: 7143496 - DNA, 22 bp, Homo sapiens
ctgaggtttacaagctattgct

SEQ ID NO: 7143497 - DNA, 22 bp, Homo sapiens
ctgaggtgtttagtaggggcgg

SEQ ID NO: 7143498 - DNA, 22 bp, Homo sapiens
ctgaggtgtttagtaggggcgg

SEQ ID NO: 7143499 - DNA, 22 bp, Homo sapiens
ctgaggtggggcctgggcatca

SEQ ID NO: 7143500 - DNA, 22 bp, Homo sapiens
ctgaggtgtgaaatggtggcaa

SEQ ID NO: 7143501 - DNA, 22 bp, Homo sapiens
ctgaggtgtgaaatggtggcaa

SEQ ID NO: 7143502 - DNA, 22 bp, Homo sapiens
ctgaggtgtgaaatggtggcaa

SEQ ID NO: 7143503 - DNA, 22 bp, Homo sapiens
ctgaggtgtgaaatggtggcaa

SEQ ID NO: 7143504 - DNA, 22 bp, Homo sapiens
ctgaggtgtgagccacttcccc

SEQ ID NO: 7143505 - DNA, 22 bp, Homo sapiens
ctgaggtgtgctttcaatgggt

SEQ ID NO: 7143506 - DNA, 22 bp, Homo sapiens
ctgaggtgtggtctgggagtat

SEQ ID NO: 7143507 - DNA, 22 bp, Homo sapiens
ctgaggtgtggtctgggagtat

SEQ ID NO: 7143508 - DNA, 22 bp, Homo sapiens
ctgaggtgggagtttttctcat

SEQ ID NO: 7143509 - DNA, 22 bp, Homo sapiens
ctgaggtggggcctgggcatca

SEQ ID NO: 7143510 - DNA, 22 bp, Homo sapiens
ctgaggtggcgcctctctttaa

SEQ ID NO: 7143511 - DNA, 22 bp, Homo sapiens
ctgaggtggcctctgccgggga

SEQ ID NO: 7143512 - DNA, 22 bp, Homo sapiens
ctgaggtggaacagaggtgaag

SEQ ID NO: 7143513 - DNA, 23 bp, Homo sapiens
ctgaggtggagagtgaggtaagt

SEQ ID NO: 7143514 - DNA, 23 bp, Homo sapiens
ctgaggtggagagtgaggtaagt

SEQ ID NO: 7143515 - DNA, 23 bp, Homo sapiens
ctgaggtggagagtgaggtaagt

SEQ ID NO: 7143516 - DNA, 23 bp, Homo sapiens
ctgaggtggagagtgaggtaagt

SEQ ID NO: 7143517 - DNA, 22 bp, Homo sapiens
ctgaggtgctatggaggatacg

SEQ ID NO: 7143518 - DNA, 22 bp, Homo sapiens
ctgaggtggaacagaggtgaag

SEQ ID NO: 7143519 - DNA, 22 bp, Homo sapiens
ctgaggtggaacagaggtgaag

SEQ ID NO: 7143520 - DNA, 22 bp, Homo sapiens
ctgaggtgctatggaggatacg

SEQ ID NO: 7143521 - DNA, 22 bp, Homo sapiens
ctgaggtgctatggaggatacg

SEQ ID NO: 7143522 - DNA, 22 bp, Homo sapiens
ctgaggtgctatggaggatacg

SEQ ID NO: 7143523 - DNA, 22 bp, Homo sapiens
ctgaggtgctagggtccctgct

SEQ ID NO: 7143524 - DNA, 19 bp, Homo sapiens
ctgaggtgcagtaagaggc

SEQ ID NO: 7143525 - DNA, 22 bp, Homo sapiens
ctgaggtgatgtcaaatgggtt

SEQ ID NO: 7143526 - DNA, 19 bp, Homo sapiens
ctgaggtgaggggcatcat

SEQ ID NO: 7143527 - DNA, 19 bp, Homo sapiens
ctgaggtgaggggcatcat

SEQ ID NO: 7143528 - DNA, 22 bp, Homo sapiens
ctgaggtgagcttccctgggct

SEQ ID NO: 7143529 - DNA, 23 bp, Homo sapiens
ctgaggtctgcaattctagtagt

SEQ ID NO: 7143530 - DNA, 22 bp, Homo sapiens
ctgaggtctctttccatagtga

SEQ ID NO: 7143531 - DNA, 22 bp, Homo sapiens
ctgcagctgggccagggccacc

SEQ ID NO: 7143532 - DNA, 22 bp, Homo sapiens
ctgcagctgtgagtgctggatg

SEQ ID NO: 7143533 - DNA, 22 bp, Homo sapiens
ctgcagctgtctctactgggca

SEQ ID NO: 7143534 - DNA, 22 bp, Homo sapiens
ctgcagctgtgagtgctggatg

SEQ ID NO: 7143535 - DNA, 22 bp, Homo sapiens
ctgcagcttaaaggagttcaat

SEQ ID NO: 7143536 - DNA, 22 bp, Homo sapiens
ctgcagcctcaacctcctgagc

SEQ ID NO: 7143537 - DNA, 22 bp, Homo sapiens
ctgcagcctcaacctcctgagc

SEQ ID NO: 7143538 - DNA, 22 bp, Homo sapiens
ctgaggtttacaagctattgct

SEQ ID NO: 7143539 - DNA, 22 bp, Homo sapiens
ctgaggtttacaagctattgct

SEQ ID NO: 7143540 - DNA, 16 bp, Homo sapiens
ctgaggtttggccaca

SEQ ID NO: 7143541 - DNA, 16 bp, Homo sapiens
ctgaggtttggccaca

SEQ ID NO: 7143542 - DNA, 22 bp, Homo sapiens
ctgaggtttgtccatccttggt

SEQ ID NO: 7143543 - DNA, 22 bp, Homo sapiens
ctgaggtttgtccatccttggt

SEQ ID NO: 7143544 - DNA, 22 bp, Homo sapiens
ctgcagcctaggtgcagctggg

SEQ ID NO: 7143545 - DNA, 22 bp, Homo sapiens
ctgcagcctaggtgcagctggg

SEQ ID NO: 7143546 - DNA, 22 bp, Homo sapiens
ctgcagcctaggtgcagctggg

SEQ ID NO: 7143547 - DNA, 22 bp, Homo sapiens
ctgcaggaatctgtgctaggtg

SEQ ID NO: 7143548 - DNA, 22 bp, Homo sapiens
ctgcaggaatctgtgctaggtg

SEQ ID NO: 7143549 - DNA, 22 bp, Homo sapiens
ctgcaggaatctgtgctaggtg

SEQ ID NO: 7143550 - DNA, 22 bp, Homo sapiens
ctgcagctttcgctccatcagc

SEQ ID NO: 7143551 - DNA, 22 bp, Homo sapiens
ctgcagctttcgctccatcagc

SEQ ID NO: 7143552 - DNA, 22 bp, Homo sapiens
ctgcagcttatttgctgtgtga

SEQ ID NO: 7143553 - DNA, 22 bp, Homo sapiens
ctgcaggactgaaagatgaggt

SEQ ID NO: 7143554 - DNA, 22 bp, Homo sapiens
ctgcaggactgaaagatgaggt

SEQ ID NO: 7143555 - DNA, 22 bp, Homo sapiens
ctgcaggactgaaagatgaggt

SEQ ID NO: 7143556 - DNA, 22 bp, Homo sapiens
ctgcaggagcaaagcctctgct

SEQ ID NO: 7143557 - DNA, 22 bp, Homo sapiens
ctgcaggactgaaagatgaggt

SEQ ID NO: 7143558 - DNA, 22 bp, Homo sapiens
ctgcaggacgaccgcctcatct

SEQ ID NO: 7143559 - DNA, 22 bp, Homo sapiens
ctgcaggactgaaagatgaggt

SEQ ID NO: 7143560 - DNA, 22 bp, Homo sapiens
ctgcaggaattcaaagtgagct

SEQ ID NO: 7143561 - DNA, 22 bp, Homo sapiens
ctgcaggacagggaggagcaag

SEQ ID NO: 7143562 - DNA, 22 bp, Homo sapiens
ctgcaggacagggaggagcaag

SEQ ID NO: 7143563 - DNA, 22 bp, Homo sapiens
ctgcaggacagggaggagcaag

SEQ ID NO: 7143564 - DNA, 22 bp, Homo sapiens
ctgcaggacagggaggagcaag

SEQ ID NO: 7143565 - DNA, 22 bp, Homo sapiens
ctgcaggacagggccggaggcc

SEQ ID NO: 7143566 - DNA, 22 bp, Homo sapiens
cgtttattttgaagattccact

SEQ ID NO: 7143567 - DNA, 22 bp, Homo sapiens
cgtttattttgaagattccact

SEQ ID NO: 7143568 - DNA, 22 bp, Homo sapiens
cgttttcatgggtagaggttct

SEQ ID NO: 7143569 - DNA, 22 bp, Homo sapiens
cgttttcttcactttgcaagtt

SEQ ID NO: 7143570 - DNA, 22 bp, Homo sapiens
cgttttcttcactttgcaagtt

SEQ ID NO: 7143571 - DNA, 22 bp, Homo sapiens
ctaaaaactctacgatgcacag

SEQ ID NO: 7143572 - DNA, 22 bp, Homo sapiens
ctaaaaatccacactaggtgaa

SEQ ID NO: 7143573 - DNA, 23 bp, Homo sapiens
cgttttttcctcagatgttctgg

SEQ ID NO: 7143574 - DNA, 22 bp, Homo sapiens
cgtgtgtgtacctgcgcattta

SEQ ID NO: 7143575 - DNA, 22 bp, Homo sapiens
cgtgtgttgaaagatgtacatc

SEQ ID NO: 7143576 - DNA, 22 bp, Homo sapiens
cgtgtgtgtacctgcgcattta

SEQ ID NO: 7143577 - DNA, 22 bp, Homo sapiens
cgtgtgtgtacctgcgcattta

SEQ ID NO: 7143578 - DNA, 22 bp, Homo sapiens
cgtgtgttgaaagatgtacatc

SEQ ID NO: 7143579 - DNA, 22 bp, Homo sapiens
cgtgtttcagccagggccacct

SEQ ID NO: 7143580 - DNA, 22 bp, Homo sapiens
cgttaataggtgcaaggtaagg

SEQ ID NO: 7143581 - DNA, 22 bp, Homo sapiens
cgttaataggtgcaaggtaagg

SEQ ID NO: 7143582 - DNA, 22 bp, Homo sapiens
cgttaataggtgcaaggtaagg

SEQ ID NO: 7143583 - DNA, 22 bp, Homo sapiens
cgttaataggtgcaaggtaagg

SEQ ID NO: 7143584 - DNA, 22 bp, Homo sapiens
cgttcctctactccagctaccc

SEQ ID NO: 7143585 - DNA, 20 bp, Homo sapiens
cgtgtgtggctattttgggt

SEQ ID NO: 7143586 - DNA, 20 bp, Homo sapiens
cgtgtgtggctattttgggt

SEQ ID NO: 7143587 - DNA, 22 bp, Homo sapiens
cgtgtggtcccggcaaggcaag

SEQ ID NO: 7143588 - DNA, 22 bp, Homo sapiens
cgtgtggtcccggcaaggcaag

SEQ ID NO: 7143589 - DNA, 20 bp, Homo sapiens
cgtgtgtggctattttgggt

SEQ ID NO: 7143590 - DNA, 20 bp, Homo sapiens
cgtgtgtggctattttgggt

SEQ ID NO: 7143591 - DNA, 22 bp, Homo sapiens
cgtgtgtgtacctgcgcattta

SEQ ID NO: 7143592 - DNA, 22 bp, Homo sapiens
cgtgtgcgcacacctgtttcca

SEQ ID NO: 7143593 - DNA, 22 bp, Homo sapiens
cgtgtgcgtgcatatgcacaag

SEQ ID NO: 7143594 - DNA, 17 bp, Homo sapiens
cgtgtgcttgtgtgcac

SEQ ID NO: 7143595 - DNA, 22 bp, Homo sapiens
cgtgtctgtgtatgcaggccgt

SEQ ID NO: 7143596 - DNA, 22 bp, Homo sapiens
cgtgtctgtatgtcaatcagct

SEQ ID NO: 7143597 - DNA, 23 bp, Homo sapiens
cgtgtctgtgggcgatccggcct

SEQ ID NO: 7143598 - DNA, 22 bp, Homo sapiens
cgtgtctgggatagcagaagta

SEQ ID NO: 7143599 - DNA, 22 bp, Homo sapiens
cgtgtctgggctcccatggcag

SEQ ID NO: 7143600 - DNA, 22 bp, Homo sapiens
cgtgtctgggatagcagaagta

SEQ ID NO: 7143601 - DNA, 23 bp, Homo sapiens
cgtgtccttcagggagagtgtgg

SEQ ID NO: 7143602 - DNA, 20 bp, Homo sapiens
cgtgtccttggcgggagagc

SEQ ID NO: 7143603 - DNA, 22 bp, Homo sapiens
cgtgtccttttagcttcaggtc

SEQ ID NO: 7143604 - DNA, 22 bp, Homo sapiens
ctaaaaatccacactaggtgaa

SEQ ID NO: 7143605 - DNA, 22 bp, Homo sapiens
ctagaaatacaggcacgtgcca

SEQ ID NO: 7143606 - DNA, 22 bp, Homo sapiens
ctagaaatattttacagtcaag

SEQ ID NO: 7143607 - DNA, 22 bp, Homo sapiens
ctagagaaacgccgtgggagga

SEQ ID NO: 7143608 - DNA, 22 bp, Homo sapiens
ctagagaaaggcagtggagcaa

SEQ ID NO: 7143609 - DNA, 22 bp, Homo sapiens
ctagagaaacgccgtgggagga

SEQ ID NO: 7143610 - DNA, 22 bp, Homo sapiens
ctagagaagaggttaagcatga

SEQ ID NO: 7143611 - DNA, 22 bp, Homo sapiens
ctagagaatatgagggagtgaa

SEQ ID NO: 7143612 - DNA, 22 bp, Homo sapiens
ctagagaatcttttaagaagtg

SEQ ID NO: 7143613 - DNA, 22 bp, Homo sapiens
ctagagaatcttttaagaagtg

SEQ ID NO: 7143614 - DNA, 22 bp, Homo sapiens
ttctatgattcatttagaagtt

SEQ ID NO: 7143615 - DNA, 22 bp, Homo sapiens
ctagatcagattgctgtttcta

SEQ ID NO: 7143616 - DNA, 22 bp, Homo sapiens
ctagatcagctaactttccagt

SEQ ID NO: 7143617 - DNA, 22 bp, Homo sapiens
ctagatccattttctgtctctg

SEQ ID NO: 7143618 - DNA, 22 bp, Homo sapiens
ctagagggatgttaggatagca

SEQ ID NO: 7143619 - DNA, 22 bp, Homo sapiens
ctagaggtagaggcagtgggaa

SEQ ID NO: 7143620 - DNA, 22 bp, Homo sapiens
ctagaggtctactcttggtagt

SEQ ID NO: 7143621 - DNA, 19 bp, Homo sapiens
ctagagtaataagtacttt

SEQ ID NO: 7143622 - DNA, 22 bp, Homo sapiens
ctagaggtgagatggaatcact

SEQ ID NO: 7143623 - DNA, 22 bp, Homo sapiens
ctagaggctcagcagatgcctg

SEQ ID NO: 7143624 - DNA, 22 bp, Homo sapiens
ctagaggaacagtttcaggttt

SEQ ID NO: 7143625 - DNA, 17 bp, Homo sapiens
ctagagagaaagagcta

SEQ ID NO: 7143626 - DNA, 17 bp, Homo sapiens
ctagagagaaagagcta

SEQ ID NO: 7143627 - DNA, 17 bp, Homo sapiens
ctagagagaaagagcta

SEQ ID NO: 7143628 - DNA, 22 bp, Homo sapiens
ctagagagccgctgtggaaaat

SEQ ID NO: 7143629 - DNA, 22 bp, Homo sapiens
ctagagagccgctgtggaaaat

SEQ ID NO: 7143630 - DNA, 22 bp, Homo sapiens
ctagagaggtggtgttgggtgg

SEQ ID NO: 7143631 - DNA, 22 bp, Homo sapiens
ctagagcagattgcagagtagg

SEQ ID NO: 7143632 - DNA, 22 bp, Homo sapiens
ttctgcaggagccctagtgtat

SEQ ID NO: 7143633 - DNA, 22 bp, Homo sapiens
ttctgcagcccaacagtagttt

SEQ ID NO: 7143634 - DNA, 22 bp, Homo sapiens
ttctatttcttaatcttggctg

SEQ ID NO: 7143635 - DNA, 22 bp, Homo sapiens
ttctatttcttaatcttggctg

SEQ ID NO: 7143636 - DNA, 22 bp, Homo sapiens
ttctgaagctcccttttgtagt

SEQ ID NO: 7143637 - DNA, 22 bp, Homo sapiens
ttctatgttctaagtctcaagg

SEQ ID NO: 7143638 - DNA, 22 bp, Homo sapiens
ttctatgtggatatagaactgc

SEQ ID NO: 7143639 - DNA, 22 bp, Homo sapiens
ttctatgtgctggagaatattt

SEQ ID NO: 7143640 - DNA, 22 bp, Homo sapiens
ttctatgtggatatagaactgc

SEQ ID NO: 7143641 - DNA, 22 bp, Homo sapiens
ttctatgtggatatagaactgc

SEQ ID NO: 7143642 - DNA, 22 bp, Homo sapiens
ttctatgtagtagcagagccaa

SEQ ID NO: 7143643 - DNA, 22 bp, Homo sapiens
ttctatgtcagtgtgctctgtg

SEQ ID NO: 7143644 - DNA, 20 bp, Homo sapiens
ttctatggaccagtatattt

SEQ ID NO: 7143645 - DNA, 22 bp, Homo sapiens
ttctatgtagataaggctgctc

SEQ ID NO: 7143646 - DNA, 22 bp, Homo sapiens
ttctattgcacacaaataatta

SEQ ID NO: 7143647 - DNA, 22 bp, Homo sapiens
ttctattaatatgttaattctg

SEQ ID NO: 7143648 - DNA, 22 bp, Homo sapiens
ttctattgaatgataatctata

SEQ ID NO: 7143649 - DNA, 22 bp, Homo sapiens
ttctattgacattcactgtaac

SEQ ID NO: 7143650 - DNA, 22 bp, Homo sapiens
ttctattgtaccttttctctca

SEQ ID NO: 7143651 - DNA, 22 bp, Homo sapiens
ttctatttccagtccttcagag

SEQ ID NO: 7143652 - DNA, 22 bp, Homo sapiens
ttctattgcacacaaataatta

SEQ ID NO: 7143653 - DNA, 22 bp, Homo sapiens
ttctattgggaagtgtgagagt

SEQ ID NO: 7143654 - DNA, 22 bp, Homo sapiens
ttctattgggcagcattgcttc

SEQ ID NO: 7143655 - DNA, 22 bp, Homo sapiens
ttctgcatgtgtttcaaatact

SEQ ID NO: 7143656 - DNA, 22 bp, Homo sapiens
ttctggaaccagcctgcctggg

SEQ ID NO: 7143657 - DNA, 22 bp, Homo sapiens
ttctggaaccaacatgccagtt

SEQ ID NO: 7143658 - DNA, 22 bp, Homo sapiens
ttctggaaccagcctgcctggg

SEQ ID NO: 7143659 - DNA, 22 bp, Homo sapiens
ttctggaaccagcctgcctggg

SEQ ID NO: 7143660 - DNA, 22 bp, Homo sapiens
ttctggaactatactgttggtg

SEQ ID NO: 7143661 - DNA, 22 bp, Homo sapiens
ttctggaaccaacatgccagtt

SEQ ID NO: 7143662 - DNA, 22 bp, Homo sapiens
ttctggaacatagcaagaagtt

SEQ ID NO: 7143663 - DNA, 22 bp, Homo sapiens
ttctggaagagtaaaataagcc

SEQ ID NO: 7143664 - DNA, 22 bp, Homo sapiens
ttctggaagatacctctcctaa

SEQ ID NO: 7143665 - DNA, 22 bp, Homo sapiens
ttctggaagatacctctcctaa

SEQ ID NO: 7143666 - DNA, 22 bp, Homo sapiens
ttctggaactatactgttggtg

SEQ ID NO: 7143667 - DNA, 22 bp, Homo sapiens
ttctggaactatactgttggtg

SEQ ID NO: 7143668 - DNA, 22 bp, Homo sapiens
ttctggaagaataatgggcaaa

SEQ ID NO: 7143669 - DNA, 22 bp, Homo sapiens
ttctggaagaggtgtaagtata

SEQ ID NO: 7143670 - DNA, 22 bp, Homo sapiens
ttctggaagaggtgtaagtata

SEQ ID NO: 7143671 - DNA, 22 bp, Homo sapiens
ttctggaagccccagagtcaga

SEQ ID NO: 7143672 - DNA, 22 bp, Homo sapiens
ttctggaagccatgggaacagg

SEQ ID NO: 7143673 - DNA, 22 bp, Homo sapiens
ttctggaagccatgggaacagg

SEQ ID NO: 7143674 - DNA, 22 bp, Homo sapiens
ttctggaagccatgggaacagg

SEQ ID NO: 7143675 - DNA, 22 bp, Homo sapiens
ttctggaagcagtggggagtga

SEQ ID NO: 7143676 - DNA, 23 bp, Homo sapiens
ttctggaagatttacttgagaca

SEQ ID NO: 7143677 - DNA, 23 bp, Homo sapiens
ttctggaagatttacttgagaca

SEQ ID NO: 7143678 - DNA, 22 bp, Homo sapiens
ttctggaagcagtggggagtga

SEQ ID NO: 7143679 - DNA, 22 bp, Homo sapiens
ttctggaagctgcaggtggccg

SEQ ID NO: 7143680 - DNA, 22 bp, Homo sapiens
ttctggaagctgcaggtggccg

SEQ ID NO: 7143681 - DNA, 22 bp, Homo sapiens
ttctggaagccctaagggagaa

SEQ ID NO: 7143682 - DNA, 22 bp, Homo sapiens
ttctggaagccccagagtcaga

SEQ ID NO: 7143683 - DNA, 22 bp, Homo sapiens
ttctggaagccccagagtcaga

SEQ ID NO: 7143684 - DNA, 22 bp, Homo sapiens
ttctggaagggtggagtagctt

SEQ ID NO: 7143685 - DNA, 22 bp, Homo sapiens
ttctggaaggcagggagaaccc

SEQ ID NO: 7143686 - DNA, 22 bp, Homo sapiens
ttctggaaggcagggagaaccc

SEQ ID NO: 7143687 - DNA, 22 bp, Homo sapiens
ttctggatgctgttaagatgta

SEQ ID NO: 7143688 - DNA, 23 bp, Homo sapiens
ttctggatgttctagtctgagag

SEQ ID NO: 7143689 - DNA, 22 bp, Homo sapiens
ttctggaagctgggcagcaccc

SEQ ID NO: 7143690 - DNA, 22 bp, Homo sapiens
ttctggaagctggaaaaggcaa

SEQ ID NO: 7143691 - DNA, 22 bp, Homo sapiens
ttctggaagctggaaaaggcaa

SEQ ID NO: 7143692 - DNA, 22 bp, Homo sapiens
ttctggaagctgggcagcaccc

SEQ ID NO: 7143693 - DNA, 22 bp, Homo sapiens
ttctggaagcttttggagagaa

SEQ ID NO: 7143694 - DNA, 22 bp, Homo sapiens
ttctggaaggatgtttctatct

SEQ ID NO: 7143695 - DNA, 22 bp, Homo sapiens
ttctggaaggatgtttctatct

SEQ ID NO: 7143696 - DNA, 22 bp, Homo sapiens
ctcactcagtttttagttcatc

SEQ ID NO: 7143697 - DNA, 22 bp, Homo sapiens
ctcactcagacatccagtgcag

SEQ ID NO: 7143698 - DNA, 22 bp, Homo sapiens
ctcactcagtttttagttcatc

SEQ ID NO: 7143699 - DNA, 22 bp, Homo sapiens
ctcactcagtttttagttcatc

SEQ ID NO: 7143700 - DNA, 22 bp, Homo sapiens
ctcactgactgcaagtcaagtt

SEQ ID NO: 7143701 - DNA, 22 bp, Homo sapiens
ctcactgcaacctccgcctcct

SEQ ID NO: 7143702 - DNA, 22 bp, Homo sapiens
ctcactgcaacctccgtctccc

SEQ ID NO: 7143703 - DNA, 22 bp, Homo sapiens
ctcactgcaacctctgcctccc

SEQ ID NO: 7143704 - DNA, 22 bp, Homo sapiens
ctcacccatatctccatgactc

SEQ ID NO: 7143705 - DNA, 22 bp, Homo sapiens
ctcaccccactaccccttggtg

SEQ ID NO: 7143706 - DNA, 22 bp, Homo sapiens
ctcaccccactaccccttggtg

SEQ ID NO: 7143707 - DNA, 22 bp, Homo sapiens
ctcacccctgtaattccagcac

SEQ ID NO: 7143708 - DNA, 22 bp, Homo sapiens
ctcacccctgtaattccagcac

SEQ ID NO: 7143709 - DNA, 22 bp, Homo sapiens
ctcacctccaggagctgctggc

SEQ ID NO: 7143710 - DNA, 22 bp, Homo sapiens
ctcacctgcaatcccttccagg

SEQ ID NO: 7143711 - DNA, 22 bp, Homo sapiens
ctcactcagacatccagtgcag

SEQ ID NO: 7143712 - DNA, 22 bp, Homo sapiens
ctcacccatatctccatgactc

SEQ ID NO: 7143713 - DNA, 22 bp, Homo sapiens
ctcacccatatctccatgactc

SEQ ID NO: 7143714 - DNA, 22 bp, Homo sapiens
ctcacccatatctccatgactc

SEQ ID NO: 7143715 - DNA, 18 bp, Homo sapiens
ctcaccattctgcccaat

SEQ ID NO: 7143716 - DNA, 22 bp, Homo sapiens
ctcacaggttctgcagctcaca

SEQ ID NO: 7143717 - DNA, 22 bp, Homo sapiens
ctatagaaacaacctctctttc

SEQ ID NO: 7143718 - DNA, 22 bp, Homo sapiens
ctatatacttttcacagatgtt

SEQ ID NO: 7143719 - DNA, 22 bp, Homo sapiens
ctatagatgtcattttacatcc

SEQ ID NO: 7143720 - DNA, 22 bp, Homo sapiens
ctcacaggttctgcagctcaca

SEQ ID NO: 7143721 - DNA, 22 bp, Homo sapiens
ctatacagcagcttactagtta

SEQ ID NO: 7143722 - DNA, 22 bp, Homo sapiens
ctatacagtaaccacagtgatt

SEQ ID NO: 7143723 - DNA, 22 bp, Homo sapiens
ctatacagcagcttactagtta

SEQ ID NO: 7143724 - DNA, 22 bp, Homo sapiens
ctatacatcccaatttcagaga

SEQ ID NO: 7143725 - DNA, 22 bp, Homo sapiens
ctatactactatacagatgtaa

SEQ ID NO: 7143726 - DNA, 22 bp, Homo sapiens
ctatagaaaattgtatcacacg

SEQ ID NO: 7143727 - DNA, 22 bp, Homo sapiens
ctatagaaaattgtatcacacg

SEQ ID NO: 7143728 - DNA, 22 bp, Homo sapiens
ctatagaaaattgtatcacacg

SEQ ID NO: 7143729 - DNA, 22 bp, Homo sapiens
ctataaatctacccagcattgg

SEQ ID NO: 7143730 - DNA, 22 bp, Homo sapiens
ctataaatctacccagcattgg

SEQ ID NO: 7143731 - DNA, 22 bp, Homo sapiens
ttctggctttcttgtcaggatg

SEQ ID NO: 7143732 - DNA, 22 bp, Homo sapiens
ctataaatctacccagcattgg

SEQ ID NO: 7143733 - DNA, 22 bp, Homo sapiens
ctataaatctacccagcattgg

SEQ ID NO: 7143734 - DNA, 22 bp, Homo sapiens
ctatacactttttgaaaataga

SEQ ID NO: 7143735 - DNA, 22 bp, Homo sapiens
ctatacactttttgaaaataga

SEQ ID NO: 7143736 - DNA, 22 bp, Homo sapiens
ctatacagagcatccttaactt

SEQ ID NO: 7143737 - DNA, 22 bp, Homo sapiens
ctatacagagcatccttaactt

SEQ ID NO: 7143738 - DNA, 22 bp, Homo sapiens
ctataattatgctcaaaatgta

SEQ ID NO: 7143739 - DNA, 22 bp, Homo sapiens
ctataattatgctcaaaatgta

SEQ ID NO: 7143740 - DNA, 22 bp, Homo sapiens
ttctggcttacttcactcattt

SEQ ID NO: 7143741 - DNA, 22 bp, Homo sapiens
ttctggcttagttgttgtatat

SEQ ID NO: 7143742 - DNA, 22 bp, Homo sapiens
ttctggcttatgagctataatg

SEQ ID NO: 7143743 - DNA, 22 bp, Homo sapiens
ttctggcttcatctgacaagcc

SEQ ID NO: 7143744 - DNA, 22 bp, Homo sapiens
ttctggctttacttcccatcca

SEQ ID NO: 7143745 - DNA, 20 bp, Homo sapiens
ttctggcaaacagagttctt

SEQ ID NO: 7143746 - DNA, 22 bp, Homo sapiens
ttctggattatgtgtaagtgaa

SEQ ID NO: 7143747 - DNA, 22 bp, Homo sapiens
ttctggattctcaggatagaga

SEQ ID NO: 7143748 - DNA, 22 bp, Homo sapiens
ttctggattctcaggatagaga

SEQ ID NO: 7143749 - DNA, 22 bp, Homo sapiens
ttctggccaaggctgccagatt

SEQ ID NO: 7143750 - DNA, 22 bp, Homo sapiens
ttctggccaaggctgccagatt

SEQ ID NO: 7143751 - DNA, 22 bp, Homo sapiens
ttctggctaccctcctaatgtt

SEQ ID NO: 7143752 - DNA, 18 bp, Homo sapiens
ttctggctcactcatgct

SEQ ID NO: 7143753 - DNA, 22 bp, Homo sapiens
ttctggctccactcagccccac

SEQ ID NO: 7143754 - DNA, 22 bp, Homo sapiens
ttctggctccagatgcttctgt

SEQ ID NO: 7143755 - DNA, 23 bp, Homo sapiens
ttctggctccgagctccatcttc

SEQ ID NO: 7143756 - DNA, 22 bp, Homo sapiens
ttctggctcgattctctgaccg

SEQ ID NO: 7143757 - DNA, 22 bp, Homo sapiens
ttctggctctcccctgctgggt

SEQ ID NO: 7143758 - DNA, 22 bp, Homo sapiens
ttctggctgaaagtttatttga

SEQ ID NO: 7143759 - DNA, 22 bp, Homo sapiens
ttctggctgcagtccctgtaat

SEQ ID NO: 7143760 - DNA, 22 bp, Homo sapiens
ctcagagatatagtccctgctt

SEQ ID NO: 7143761 - DNA, 22 bp, Homo sapiens
ctcagagatatagtccctgctt

SEQ ID NO: 7143762 - DNA, 22 bp, Homo sapiens
ctcagagcaatgaacatgcaaa

SEQ ID NO: 7143763 - DNA, 22 bp, Homo sapiens
ctcagagcaatgaacatgcaaa

SEQ ID NO: 7143764 - DNA, 22 bp, Homo sapiens
ctcagagcaatgaacatgcaaa

SEQ ID NO: 7143765 - DNA, 22 bp, Homo sapiens
ctcagagagttaagtgaattac

SEQ ID NO: 7143766 - DNA, 22 bp, Homo sapiens
ctcagagaggttgaacaacttg

SEQ ID NO: 7143767 - DNA, 17 bp, Homo sapiens
ctcagagagggtaagta

SEQ ID NO: 7143768 - DNA, 17 bp, Homo sapiens
ctcagagagggtaagta

SEQ ID NO: 7143769 - DNA, 19 bp, Homo sapiens
ctcagagaggggcagtgcc

SEQ ID NO: 7143770 - DNA, 22 bp, Homo sapiens
ctcagagagggcaccagggcca

SEQ ID NO: 7143771 - DNA, 22 bp, Homo sapiens
ctcagagagggcaccagggcca

SEQ ID NO: 7143772 - DNA, 21 bp, Homo sapiens
ctcagagacaaatgccatccc

SEQ ID NO: 7143773 - DNA, 22 bp, Homo sapiens
ctcagagagacaatgtgggaca

SEQ ID NO: 7143774 - DNA, 22 bp, Homo sapiens
ctcagagctgaggccagggaca

SEQ ID NO: 7143775 - DNA, 22 bp, Homo sapiens
ctcagagcccagggtacacccg

SEQ ID NO: 7143776 - DNA, 22 bp, Homo sapiens
ctcagagccccaggagggtgtg

SEQ ID NO: 7143777 - DNA, 22 bp, Homo sapiens
ctcagaggcaagcaaggagctg

SEQ ID NO: 7143778 - DNA, 22 bp, Homo sapiens
ctcagaggcaagcaaggagctg

SEQ ID NO: 7143779 - DNA, 22 bp, Homo sapiens
ctcagagccagttagcaggtgc

SEQ ID NO: 7143780 - DNA, 22 bp, Homo sapiens
ctcagagccagttagcaggtgc

SEQ ID NO: 7143781 - DNA, 21 bp, Homo sapiens
ctcagagcagttcagagggat

SEQ ID NO: 7143782 - DNA, 17 bp, Homo sapiens
ctcagagcaggacagaa

SEQ ID NO: 7143783 - DNA, 17 bp, Homo sapiens
ctcagagcaggacagaa

SEQ ID NO: 7143784 - DNA, 22 bp, Homo sapiens
ttctttctctgtaaaaggaaaa

SEQ ID NO: 7143785 - DNA, 22 bp, Homo sapiens
ttctttctgaatacagttgagt

SEQ ID NO: 7143786 - DNA, 22 bp, Homo sapiens
ttctttctgaatacagttgagt

SEQ ID NO: 7143787 - DNA, 22 bp, Homo sapiens
ttctttctctgtaaaaggaaaa

SEQ ID NO: 7143788 - DNA, 22 bp, Homo sapiens
ttctttctctgtaaaaggaaaa

SEQ ID NO: 7143789 - DNA, 22 bp, Homo sapiens
ttctttctctgtaaaaggaaaa

SEQ ID NO: 7143790 - DNA, 22 bp, Homo sapiens
ttctttctctccacaaggcttg

SEQ ID NO: 7143791 - DNA, 22 bp, Homo sapiens
ctcactgcaagctcagcctccc

SEQ ID NO: 7143792 - DNA, 22 bp, Homo sapiens
ctcactgcaagctcagcctccc

SEQ ID NO: 7143793 - DNA, 21 bp, Homo sapiens
ttctttctgaatctgaagtat

SEQ ID NO: 7143794 - DNA, 21 bp, Homo sapiens
ttctttctgaatctgaagtat

SEQ ID NO: 7143795 - DNA, 22 bp, Homo sapiens
ttctttctgggaagagttcaga

SEQ ID NO: 7143796 - DNA, 22 bp, Homo sapiens
ttctttctgggaagagttcaga

SEQ ID NO: 7143797 - DNA, 22 bp, Homo sapiens
ttctttctgggaagagttcaga

SEQ ID NO: 7143798 - DNA, 22 bp, Homo sapiens
ttctttctggggtccttcggct

SEQ ID NO: 7143799 - DNA, 22 bp, Homo sapiens
ttctttctggggtccttcggct

SEQ ID NO: 7143800 - DNA, 22 bp, Homo sapiens
ctcagagaagatggatgaggta

SEQ ID NO: 7143801 - DNA, 21 bp, Homo sapiens
ctcagagaaatgtctgggagc

SEQ ID NO: 7143802 - DNA, 22 bp, Homo sapiens
ctcagagaacctaagcggagga

SEQ ID NO: 7143803 - DNA, 22 bp, Homo sapiens
ctcagagaacctaagcggagga

SEQ ID NO: 7143804 - DNA, 22 bp, Homo sapiens
ctcagagaacctaagcggagga

SEQ ID NO: 7143805 - DNA, 22 bp, Homo sapiens
ctcagagaaaaggagcaagggt

SEQ ID NO: 7143806 - DNA, 22 bp, Homo sapiens
ctcagaaaggtgccatttatgt

SEQ ID NO: 7143807 - DNA, 22 bp, Homo sapiens
ttctttctgtccataatgagac

SEQ ID NO: 7143808 - DNA, 22 bp, Homo sapiens
ttctttctgtccataatgagac

SEQ ID NO: 7143809 - DNA, 22 bp, Homo sapiens
ttctttctgtcatggtgtactg

SEQ ID NO: 7143810 - DNA, 22 bp, Homo sapiens
ttctttctgtcatggtgtactg

SEQ ID NO: 7143811 - DNA, 22 bp, Homo sapiens
ttctttctgtcatggtgtactg

SEQ ID NO: 7143812 - DNA, 22 bp, Homo sapiens
ctcagtgcaaccaaagtgatct

SEQ ID NO: 7143813 - DNA, 22 bp, Homo sapiens
ctcagtgaattggaggatggcc

SEQ ID NO: 7143814 - DNA, 22 bp, Homo sapiens
ctcagtgcagctaggcatgaga

SEQ ID NO: 7143815 - DNA, 22 bp, Homo sapiens
ctcagtgcagctaggcatgaga

SEQ ID NO: 7143816 - DNA, 22 bp, Homo sapiens
ttggaaaatgaggcacagagag

SEQ ID NO: 7143817 - DNA, 22 bp, Homo sapiens
ttggaaaatgaggcacagagag

SEQ ID NO: 7143818 - DNA, 22 bp, Homo sapiens
ttggaaaatgaggcacagagag

SEQ ID NO: 7143819 - DNA, 22 bp, Homo sapiens
ctcagtgcttagtgtgttttgg

SEQ ID NO: 7143820 - DNA, 22 bp, Homo sapiens
ctcagtgcttctagcttgatga

SEQ ID NO: 7143821 - DNA, 22 bp, Homo sapiens
ttggaaaagtgaaactagatgc

SEQ ID NO: 7143822 - DNA, 22 bp, Homo sapiens
ttggaaaagtgaaactagatgc

SEQ ID NO: 7143823 - DNA, 19 bp, Homo sapiens
ctcagtctggctctgcctg

SEQ ID NO: 7143824 - DNA, 22 bp, Homo sapiens
ctcagtcagggagccttgaggg

SEQ ID NO: 7143825 - DNA, 22 bp, Homo sapiens
ctcagtccacgcagcctcctga

SEQ ID NO: 7143826 - DNA, 22 bp, Homo sapiens
ctcagtccgtcccgctaggtgc

SEQ ID NO: 7143827 - DNA, 22 bp, Homo sapiens
ctcagtccttatttgcctctac

SEQ ID NO: 7143828 - DNA, 22 bp, Homo sapiens
ttggaaggagtctttggggatg

SEQ ID NO: 7143829 - DNA, 22 bp, Homo sapiens
ttggaaggatttagagatgtct

SEQ ID NO: 7143830 - DNA, 23 bp, Homo sapiens
ttggaagccagacagctgtgcag

SEQ ID NO: 7143831 - DNA, 22 bp, Homo sapiens
ttggaagccctctgcaagatcc

SEQ ID NO: 7143832 - DNA, 22 bp, Homo sapiens
ttggaagcctagttaagatgaa

SEQ ID NO: 7143833 - DNA, 22 bp, Homo sapiens
ttggaagggatattggcatatg

SEQ ID NO: 7143834 - DNA, 22 bp, Homo sapiens
ttggaaggggcagagtggctgc

SEQ ID NO: 7143835 - DNA, 22 bp, Homo sapiens
ttggagggtcttccacagccat

SEQ ID NO: 7143836 - DNA, 22 bp, Homo sapiens
ttggagggtcttccacagccat

SEQ ID NO: 7143837 - DNA, 22 bp, Homo sapiens
ttggagggtcttccacagccat

SEQ ID NO: 7143838 - DNA, 20 bp, Homo sapiens
ttggaggtgcagtgcatgca

SEQ ID NO: 7143839 - DNA, 22 bp, Homo sapiens
ttggaggggccactgcagagct

SEQ ID NO: 7143840 - DNA, 22 bp, Homo sapiens
ttggaggggccactgcagagct

SEQ ID NO: 7143841 - DNA, 22 bp, Homo sapiens
ttggaggggccactgcagagct

SEQ ID NO: 7143842 - DNA, 22 bp, Homo sapiens
ttggagggactgagcttcagtc

SEQ ID NO: 7143843 - DNA, 22 bp, Homo sapiens
ttggagggactgagcttcagtc

SEQ ID NO: 7143844 - DNA, 22 bp, Homo sapiens
ttggagggactgagcttcagtc

SEQ ID NO: 7143845 - DNA, 22 bp, Homo sapiens
ttggaggggccactgcagagct

SEQ ID NO: 7143846 - DNA, 22 bp, Homo sapiens
ttggaggggccactgcagagct

SEQ ID NO: 7143847 - DNA, 22 bp, Homo sapiens
ttggagggacagatggctaggc

SEQ ID NO: 7143848 - DNA, 22 bp, Homo sapiens
ttggagggacagatggctaggc

SEQ ID NO: 7143849 - DNA, 22 bp, Homo sapiens
ttggatccatctcaggcatagg

SEQ ID NO: 7143850 - DNA, 22 bp, Homo sapiens
ttggatcatggaatgtctgctt

SEQ ID NO: 7143851 - DNA, 22 bp, Homo sapiens
ttggatccatctcaggcatagg

SEQ ID NO: 7143852 - DNA, 22 bp, Homo sapiens
ctccactcaacaagcccagtgt

SEQ ID NO: 7143853 - DNA, 22 bp, Homo sapiens
ctccactcaacaagcccagtgt

SEQ ID NO: 7143854 - DNA, 22 bp, Homo sapiens
ctccactcaacaagcccagtgt

SEQ ID NO: 7143855 - DNA, 22 bp, Homo sapiens
ctccactcaacaagcccagtgt

SEQ ID NO: 7143856 - DNA, 22 bp, Homo sapiens
ctccactcaccagatgccagga

SEQ ID NO: 7143857 - DNA, 22 bp, Homo sapiens
ctccactcaccagatgccagga

SEQ ID NO: 7143858 - DNA, 22 bp, Homo sapiens
ctccactcaccagatgccagga

SEQ ID NO: 7143859 - DNA, 22 bp, Homo sapiens
ttggagttctgggcacagctgc

SEQ ID NO: 7143860 - DNA, 22 bp, Homo sapiens
ttggatcaaatttcatgctgtc

SEQ ID NO: 7143861 - DNA, 20 bp, Homo sapiens
ttggaggtgcagtgcatgca

SEQ ID NO: 7143862 - DNA, 22 bp, Homo sapiens
ttggaggtttgaaaatatgtgt

SEQ ID NO: 7143863 - DNA, 22 bp, Homo sapiens
ttggctctgtgtctccactcaa

SEQ ID NO: 7143864 - DNA, 22 bp, Homo sapiens
ttggctcttctcccagtggcct

SEQ ID NO: 7143865 - DNA, 22 bp, Homo sapiens
ttggctctttcctcacacagga

SEQ ID NO: 7143866 - DNA, 22 bp, Homo sapiens
ttggctctttcctcacacagga

SEQ ID NO: 7143867 - DNA, 22 bp, Homo sapiens
ttggctgagagaggaaaagggc

SEQ ID NO: 7143868 - DNA, 22 bp, Homo sapiens
ttggctgaaggttaagtgctgg

SEQ ID NO: 7143869 - DNA, 22 bp, Homo sapiens
ttggctgaaggttaagtgctgg

SEQ ID NO: 7143870 - DNA, 22 bp, Homo sapiens
ttggctgcctgtggatcgcatt

SEQ ID NO: 7143871 - DNA, 22 bp, Homo sapiens
ctccagcctcatctcctggctg

SEQ ID NO: 7143872 - DNA, 22 bp, Homo sapiens
ctccaggactgaggacagagct

SEQ ID NO: 7143873 - DNA, 22 bp, Homo sapiens
ctccaggactgaggacagagct

SEQ ID NO: 7143874 - DNA, 22 bp, Homo sapiens
ctccaggactcaggcccctggg

SEQ ID NO: 7143875 - DNA, 22 bp, Homo sapiens
ctccaggacccagtggctccag

SEQ ID NO: 7143876 - DNA, 22 bp, Homo sapiens
ctccaggacccagtggctccag

SEQ ID NO: 7143877 - DNA, 22 bp, Homo sapiens
ctccaggacccagtggctccag

SEQ ID NO: 7143878 - DNA, 22 bp, Homo sapiens
ctccaggacagattcagggcca

SEQ ID NO: 7143879 - DNA, 22 bp, Homo sapiens
ctccaggacagattcagggcca

SEQ ID NO: 7143880 - DNA, 22 bp, Homo sapiens
ctccaggacagattcagggcca

SEQ ID NO: 7143881 - DNA, 22 bp, Homo sapiens
ctccaggacagattcagggcca

SEQ ID NO: 7143882 - DNA, 22 bp, Homo sapiens
ctccaggacatgactttcttgc

SEQ ID NO: 7143883 - DNA, 22 bp, Homo sapiens
ctccaggaccagggctcctgga

SEQ ID NO: 7143884 - DNA, 22 bp, Homo sapiens
ctccaggaccagggctcctgga

SEQ ID NO: 7143885 - DNA, 20 bp, Homo sapiens
ttggctctgatcagtggagc

SEQ ID NO: 7143886 - DNA, 22 bp, Homo sapiens
ttggctctggcaaggggcaccg

SEQ ID NO: 7143887 - DNA, 17 bp, Homo sapiens
ttggctctattgcctct

SEQ ID NO: 7143888 - DNA, 22 bp, Homo sapiens
ttggctctgaaacccaagctct

SEQ ID NO: 7143889 - DNA, 21 bp, Homo sapiens
ttggctctgaaacttgcacct

SEQ ID NO: 7143890 - DNA, 22 bp, Homo sapiens
ctccagagtcacactgcctggg

SEQ ID NO: 7143891 - DNA, 22 bp, Homo sapiens
ctccagagtcacactgcctggg

SEQ ID NO: 7143892 - DNA, 22 bp, Homo sapiens
ctccagagtcacactgcctggg

SEQ ID NO: 7143893 - DNA, 22 bp, Homo sapiens
ctccagagtcatcgagcattcc

SEQ ID NO: 7143894 - DNA, 18 bp, Homo sapiens
ctccagagctgtgagaca

SEQ ID NO: 7143895 - DNA, 22 bp, Homo sapiens
ctccagaggatgcaggtgaggg

SEQ ID NO: 7143896 - DNA, 22 bp, Homo sapiens
ctccagaggatgcaggtgaggg

SEQ ID NO: 7143897 - DNA, 22 bp, Homo sapiens
ctccagaggccctatcccacta

SEQ ID NO: 7143898 - DNA, 22 bp, Homo sapiens
ctccagaggcgacttgcatcac

SEQ ID NO: 7143899 - DNA, 22 bp, Homo sapiens
ctccagagggtcagactctgag

SEQ ID NO: 7143900 - DNA, 22 bp, Homo sapiens
ctccagagggtcagactctgag

SEQ ID NO: 7143901 - DNA, 22 bp, Homo sapiens
ctccagaggttctcatctggga

SEQ ID NO: 7143902 - DNA, 22 bp, Homo sapiens
ctcaggactttcaaatagaaat

SEQ ID NO: 7143903 - DNA, 22 bp, Homo sapiens
ctcaggagacagtgtccacatg

SEQ ID NO: 7143904 - DNA, 22 bp, Homo sapiens
ctcaggagatgacagaaggtat

SEQ ID NO: 7143905 - DNA, 22 bp, Homo sapiens
ctcaggagatgacagaaggtat

SEQ ID NO: 7143906 - DNA, 22 bp, Homo sapiens
ctcaggagagtcttatatctcc

SEQ ID NO: 7143907 - DNA, 22 bp, Homo sapiens
ctcaggagatgacagaaggtat

SEQ ID NO: 7143908 - DNA, 22 bp, Homo sapiens
ctcaggacccggtccaggtggg

SEQ ID NO: 7143909 - DNA, 22 bp, Homo sapiens
ctcaggacttggttagtgtttt

SEQ ID NO: 7143910 - DNA, 22 bp, Homo sapiens
ctcaggaaccgcggcagcagcc

SEQ ID NO: 7143911 - DNA, 22 bp, Homo sapiens
ctcaggaaggaagcagggagcc

SEQ ID NO: 7143912 - DNA, 22 bp, Homo sapiens
ctcaggaaggaagcagggagcc

SEQ ID NO: 7143913 - DNA, 22 bp, Homo sapiens
ctcaggaaggaagcagggagcc

SEQ ID NO: 7143914 - DNA, 22 bp, Homo sapiens
ctcaggaaggaagcagggagcc

SEQ ID NO: 7143915 - DNA, 22 bp, Homo sapiens
ctcaggaaccgcggcagcagcc

SEQ ID NO: 7143916 - DNA, 22 bp, Homo sapiens
ctcaggaaccgcggcagcagcc

SEQ ID NO: 7143917 - DNA, 22 bp, Homo sapiens
ctcaggaaaggccatgcaaggg

SEQ ID NO: 7143918 - DNA, 22 bp, Homo sapiens
ctcaggaaaggccatgcaaggg

SEQ ID NO: 7143919 - DNA, 22 bp, Homo sapiens
ctcaggaaaatattgaagaagt

SEQ ID NO: 7143920 - DNA, 22 bp, Homo sapiens
ctcaggaaaatattgaagaagt

SEQ ID NO: 7143921 - DNA, 22 bp, Homo sapiens
ctcaggaaaggccatgcaaggg

SEQ ID NO: 7143922 - DNA, 22 bp, Homo sapiens
ctcagccccaatttgccctctt

SEQ ID NO: 7143923 - DNA, 19 bp, Homo sapiens
ctcagctgtagctcatgtg

SEQ ID NO: 7143924 - DNA, 19 bp, Homo sapiens
ctcagctgtagctcatgtg

SEQ ID NO: 7143925 - DNA, 22 bp, Homo sapiens
ctcaggaggtggtagaggccct

SEQ ID NO: 7143926 - DNA, 22 bp, Homo sapiens
ctcaggaggtggtagaggccct

SEQ ID NO: 7143927 - DNA, 22 bp, Homo sapiens
ctcaggaggtttcctgtctagg

SEQ ID NO: 7143928 - DNA, 22 bp, Homo sapiens
ctcaggaggtttcctgtctagg

SEQ ID NO: 7143929 - DNA, 22 bp, Homo sapiens
ctcaggaggtttcctgtctagg

SEQ ID NO: 7143930 - DNA, 22 bp, Homo sapiens
ctcaggagtagttcagcagctg

SEQ ID NO: 7143931 - DNA, 22 bp, Homo sapiens
ctcaggagtagttcagcagctg

SEQ ID NO: 7143932 - DNA, 22 bp, Homo sapiens
ctcaggagatgacagaaggtat

SEQ ID NO: 7143933 - DNA, 22 bp, Homo sapiens
ctcaggagcttcctcagcccat

SEQ ID NO: 7143934 - DNA, 22 bp, Homo sapiens
ctcaggaggaggaagttcattg

SEQ ID NO: 7143935 - DNA, 22 bp, Homo sapiens
ctcaggaggatgactgccttgg

SEQ ID NO: 7143936 - DNA, 22 bp, Homo sapiens
ctcaggaggatgactgccttgg

SEQ ID NO: 7143937 - DNA, 22 bp, Homo sapiens
ctcaggaggatgactgccttgg

SEQ ID NO: 7143938 - DNA, 22 bp, Homo sapiens
ctcaggaggatgactgccttgg

SEQ ID NO: 7143939 - DNA, 22 bp, Homo sapiens
ctcaggaggccattctcaaggt

SEQ ID NO: 7143940 - DNA, 22 bp, Homo sapiens
ctcaggagtagttcagcagctg

SEQ ID NO: 7143941 - DNA, 22 bp, Homo sapiens
ttgcagaacttaaagacagagt

SEQ ID NO: 7143942 - DNA, 22 bp, Homo sapiens
ttgcagaaaacagttttcttgt

SEQ ID NO: 7143943 - DNA, 22 bp, Homo sapiens
ttgcagttgctttctatattga

SEQ ID NO: 7143944 - DNA, 19 bp, Homo sapiens
ttgcagttgggtggggagt

SEQ ID NO: 7143945 - DNA, 22 bp, Homo sapiens
ttgcagttgtctttcctaattt

SEQ ID NO: 7143946 - DNA, 22 bp, Homo sapiens
ttgcagttgtctttcctaattt

SEQ ID NO: 7143947 - DNA, 22 bp, Homo sapiens
ttgcagttgttgccttccctga

SEQ ID NO: 7143948 - DNA, 22 bp, Homo sapiens
ttgcagttgttgccttccctga

SEQ ID NO: 7143949 - DNA, 22 bp, Homo sapiens
ttgcagttgtttagaatatgtg

SEQ ID NO: 7143950 - DNA, 22 bp, Homo sapiens
ttgcagtttatgttcctgcagt

SEQ ID NO: 7143951 - DNA, 22 bp, Homo sapiens
ttgcataaatgcttaaaatttg

SEQ ID NO: 7143952 - DNA, 22 bp, Homo sapiens
ttgcataaagattttattgcat

SEQ ID NO: 7143953 - DNA, 22 bp, Homo sapiens
ttgcataaaagagtatatctta

SEQ ID NO: 7143954 - DNA, 22 bp, Homo sapiens
ttgcagttttctgcctcatttc

SEQ ID NO: 7143955 - DNA, 22 bp, Homo sapiens
ttgcagttttgacagaccaaat

SEQ ID NO: 7143956 - DNA, 22 bp, Homo sapiens
ttgcagttttctgcctcatttc

SEQ ID NO: 7143957 - DNA, 22 bp, Homo sapiens
ttgcagtttgtggcaactttga

SEQ ID NO: 7143958 - DNA, 22 bp, Homo sapiens
ttgcagtttctggatgccttct

SEQ ID NO: 7143959 - DNA, 22 bp, Homo sapiens
ttgcagtttgcttttaatggga

SEQ ID NO: 7143960 - DNA, 22 bp, Homo sapiens
ttgccctgtggggcctccagcc

SEQ ID NO: 7143961 - DNA, 22 bp, Homo sapiens
ttgccctgaagaacgtcccaga

SEQ ID NO: 7143962 - DNA, 21 bp, Homo sapiens
ttgcccctgagtttttctgag

SEQ ID NO: 7143963 - DNA, 22 bp, Homo sapiens
ttgcatatgaagctgacttaaa

SEQ ID NO: 7143964 - DNA, 22 bp, Homo sapiens
ttgcatatcctccaacacatgg

SEQ ID NO: 7143965 - DNA, 22 bp, Homo sapiens
ttgcatatatttctaaggaggt

SEQ ID NO: 7143966 - DNA, 22 bp, Homo sapiens
ttgcatatatttctaaggaggt

SEQ ID NO: 7143967 - DNA, 22 bp, Homo sapiens
ttgcatagtgctgaggttcggg

SEQ ID NO: 7143968 - DNA, 22 bp, Homo sapiens
ttgcatcaaatatgtaccacag

SEQ ID NO: 7143969 - DNA, 22 bp, Homo sapiens
ttgcatcaattccttgtcctga

SEQ ID NO: 7143970 - DNA, 22 bp, Homo sapiens
ttgcatcacagtatctctgtaa

SEQ ID NO: 7143971 - DNA, 22 bp, Homo sapiens
ttgcatcacagtatctctgtaa

SEQ ID NO: 7143972 - DNA, 22 bp, Homo sapiens
ttgcatcagaaaatatgggaag

SEQ ID NO: 7143973 - DNA, 22 bp, Homo sapiens
ttgcatcagaaaatatgggaag

SEQ ID NO: 7143974 - DNA, 22 bp, Homo sapiens
ttgcatcagaattacttggagg

SEQ ID NO: 7143975 - DNA, 22 bp, Homo sapiens
ttgcatcagaattacttggagg

SEQ ID NO: 7143976 - DNA, 22 bp, Homo sapiens
ttgcatcagcaggcataattgg

SEQ ID NO: 7143977 - DNA, 22 bp, Homo sapiens
ttgcccagagtccacagcgtac

SEQ ID NO: 7143978 - DNA, 22 bp, Homo sapiens
ttgcccagagtccacagcgtac

SEQ ID NO: 7143979 - DNA, 22 bp, Homo sapiens
ttgcatcaggtagacaactata

SEQ ID NO: 7143980 - DNA, 22 bp, Homo sapiens
ttgcatcatttcctggccgtgt

SEQ ID NO: 7143981 - DNA, 22 bp, Homo sapiens
ttgcatccgggctacttccaca

SEQ ID NO: 7143982 - DNA, 22 bp, Homo sapiens
ttgcatgaaggttcaggtgtat

SEQ ID NO: 7143983 - DNA, 22 bp, Homo sapiens
ttgcatgaggccaaggggtgga

SEQ ID NO: 7143984 - DNA, 22 bp, Homo sapiens
ttgcatgcaaggcctccgtggc

SEQ ID NO: 7143985 - DNA, 22 bp, Homo sapiens
ttgcatgcatgtttctcattct

SEQ ID NO: 7143986 - DNA, 23 bp, Homo sapiens
ttgcatggagcctgggattcctc

SEQ ID NO: 7143987 - DNA, 22 bp, Homo sapiens
ctcagggatggtgaagcaccca

SEQ ID NO: 7143988 - DNA, 22 bp, Homo sapiens
ctcagggcagtatggctgagag

SEQ ID NO: 7143989 - DNA, 22 bp, Homo sapiens
ctcagggcagtatggctgagag

SEQ ID NO: 7143990 - DNA, 22 bp, Homo sapiens
ctcagggaagctatggtgaggg

SEQ ID NO: 7143991 - DNA, 22 bp, Homo sapiens
ctcagggcagtatggctgagag

SEQ ID NO: 7143992 - DNA, 18 bp, Homo sapiens
ctcagggcatcagtctgg

SEQ ID NO: 7143993 - DNA, 22 bp, Homo sapiens
ctcagggccaaggatgctgttg

SEQ ID NO: 7143994 - DNA, 22 bp, Homo sapiens
ctcagggcggcgggcagcccag

SEQ ID NO: 7143995 - DNA, 22 bp, Homo sapiens
ctcagggctctgcatgcacacg

SEQ ID NO: 7143996 - DNA, 22 bp, Homo sapiens
ctcagggctggaaagccaggaa

SEQ ID NO: 7143997 - DNA, 22 bp, Homo sapiens
ctcaggtacagatttgtggatt

SEQ ID NO: 7143998 - DNA, 22 bp, Homo sapiens
ctcaggtagagtctgcatgggg

SEQ ID NO: 7143999 - DNA, 20 bp, Homo sapiens
ctcagtaaaagcacagggtc

SEQ ID NO: 7144000 - DNA, 22 bp, Homo sapiens
ctcagtaaggatgcttcagcgg

SEQ ID NO: 7144001 - DNA, 22 bp, Homo sapiens
ctcagtaaggatgcttcagcgg

SEQ ID NO: 7144002 - DNA, 22 bp, Homo sapiens
ctcagtactttatgtatatgat

SEQ ID NO: 7144003 - DNA, 20 bp, Homo sapiens
ctcagtaaaagcacagggtc

SEQ ID NO: 7144004 - DNA, 22 bp, Homo sapiens
ctcagtagaaaatacatggact

SEQ ID NO: 7144005 - DNA, 22 bp, Homo sapiens
ctcagtcagtttttgtgagaga

SEQ ID NO: 7144006 - DNA, 18 bp, Homo sapiens
ctcagggtgaccaatgca

SEQ ID NO: 7144007 - DNA, 18 bp, Homo sapiens
ctcagggtgaccaatgca

SEQ ID NO: 7144008 - DNA, 21 bp, Homo sapiens
ctcaggggattttgagattag

SEQ ID NO: 7144009 - DNA, 21 bp, Homo sapiens
ctcaggggattttgagattag

SEQ ID NO: 7144010 - DNA, 22 bp, Homo sapiens
ctcagggctggaaagccaggaa

SEQ ID NO: 7144011 - DNA, 22 bp, Homo sapiens
ctcagggcttgagtgtccagga

SEQ ID NO: 7144012 - DNA, 21 bp, Homo sapiens
ctcagggcttggtgtcctcat

SEQ ID NO: 7144013 - DNA, 22 bp, Homo sapiens
ctcaggggacctggctccgagt

SEQ ID NO: 7144014 - DNA, 23 bp, Homo sapiens
ttattgcaaggtaaaattgctga

SEQ ID NO: 7144015 - DNA, 22 bp, Homo sapiens
ttattgcaactcctaaatagag

SEQ ID NO: 7144016 - DNA, 23 bp, Homo sapiens
ttattgcaaggtaaaattgctga

SEQ ID NO: 7144017 - DNA, 22 bp, Homo sapiens
ttattgcaccttcctcactaac

SEQ ID NO: 7144018 - DNA, 22 bp, Homo sapiens
ttattgcactattgattttcta

SEQ ID NO: 7144019 - DNA, 17 bp, Homo sapiens
ttattgcagtgctgaag

SEQ ID NO: 7144020 - DNA, 22 bp, Homo sapiens
ttattgccatcctggaacctag

SEQ ID NO: 7144021 - DNA, 20 bp, Homo sapiens
ttatttcagttgctagattg

SEQ ID NO: 7144022 - DNA, 22 bp, Homo sapiens
ttatttcatataatgttatcaa

SEQ ID NO: 7144023 - DNA, 20 bp, Homo sapiens
ttatttcagttgctagattg

SEQ ID NO: 7144024 - DNA, 20 bp, Homo sapiens
ttatttcagttgctagattg

SEQ ID NO: 7144025 - DNA, 22 bp, Homo sapiens
ttatttcaaaagagcttggggt

SEQ ID NO: 7144026 - DNA, 21 bp, Homo sapiens
ttatttcacatggacttccag

SEQ ID NO: 7144027 - DNA, 20 bp, Homo sapiens
ttatttcagttgctagattg

SEQ ID NO: 7144028 - DNA, 22 bp, Homo sapiens
ttatttattgtgtacctactgt

SEQ ID NO: 7144029 - DNA, 22 bp, Homo sapiens
ttatttattgtgtacctactgt

SEQ ID NO: 7144030 - DNA, 22 bp, Homo sapiens
ttatttattgtgtacctactgt

SEQ ID NO: 7144031 - DNA, 22 bp, Homo sapiens
ttatttattgtgtacctactgt

SEQ ID NO: 7144032 - DNA, 22 bp, Homo sapiens
ttatttattgtgtacctactgt

SEQ ID NO: 7144033 - DNA, 22 bp, Homo sapiens
ttatttatgttaacagtcgaga

SEQ ID NO: 7144034 - DNA, 22 bp, Homo sapiens
ttatttatgttaacagtcgaga

SEQ ID NO: 7144035 - DNA, 22 bp, Homo sapiens
ttatttattcattctgtctgtc

SEQ ID NO: 7144036 - DNA, 22 bp, Homo sapiens
ttatttattcattctgtctgtc

SEQ ID NO: 7144037 - DNA, 22 bp, Homo sapiens
cgctgggcaggtccacttgtta

SEQ ID NO: 7144038 - DNA, 22 bp, Homo sapiens
cgctggcattagggcagtggcc

SEQ ID NO: 7144039 - DNA, 22 bp, Homo sapiens
cgctggcagggctgatctgaag

SEQ ID NO: 7144040 - DNA, 22 bp, Homo sapiens
cgctgccttcatcccacgccta

SEQ ID NO: 7144041 - DNA, 22 bp, Homo sapiens
cgctgccttcatcccacgccta

SEQ ID NO: 7144042 - DNA, 21 bp, Homo sapiens
cgctgccttgggagtggacct

SEQ ID NO: 7144043 - DNA, 22 bp, Homo sapiens
cgctgcgaggcgcccttgttgc

SEQ ID NO: 7144044 - DNA, 22 bp, Homo sapiens
cgctgccttcatcccacgccta

SEQ ID NO: 7144045 - DNA, 22 bp, Homo sapiens
cgctgcctccaggtgcagcagg

SEQ ID NO: 7144046 - DNA, 22 bp, Homo sapiens
cgctgccaggatcccctgccgg

SEQ ID NO: 7144047 - DNA, 22 bp, Homo sapiens
cgctgccaggtcaccaggggta

SEQ ID NO: 7144048 - DNA, 22 bp, Homo sapiens
cgctgcagctggctgcagggaa

SEQ ID NO: 7144049 - DNA, 22 bp, Homo sapiens
cgctgataaacgtcacgttccc

SEQ ID NO: 7144050 - DNA, 19 bp, Homo sapiens
cgctctgggtttcgtgtca

SEQ ID NO: 7144051 - DNA, 22 bp, Homo sapiens
cgctctggcaggcacaggaggg

SEQ ID NO: 7144052 - DNA, 22 bp, Homo sapiens
cgctctggcaggcacaggaggg

SEQ ID NO: 7144053 - DNA, 22 bp, Homo sapiens
cgctctggcaggcacaggaggg

SEQ ID NO: 7144054 - DNA, 22 bp, Homo sapiens
cgctctggagaatagtagcttt

SEQ ID NO: 7144055 - DNA, 22 bp, Homo sapiens
cgctctggagaatagtagcttt

SEQ ID NO: 7144056 - DNA, 22 bp, Homo sapiens
cgctcctgaccagctgtgtccc

SEQ ID NO: 7144057 - DNA, 22 bp, Homo sapiens
cgcctctctttttctcccagac

SEQ ID NO: 7144058 - DNA, 22 bp, Homo sapiens
cgcctctctttttctcccagac

SEQ ID NO: 7144059 - DNA, 20 bp, Homo sapiens
cgctcctgttcccggtccca

SEQ ID NO: 7144060 - DNA, 20 bp, Homo sapiens
cgctcctgttcccggtccca

SEQ ID NO: 7144061 - DNA, 22 bp, Homo sapiens
cgctccttgagcgtgtcggcct

SEQ ID NO: 7144062 - DNA, 22 bp, Homo sapiens
ttatttcatataatgttatcaa

SEQ ID NO: 7144063 - DNA, 22 bp, Homo sapiens
ttatttcatataatgttatcaa

SEQ ID NO: 7144064 - DNA, 22 bp, Homo sapiens
ttatttcatgtaaaatttatgt

SEQ ID NO: 7144065 - DNA, 22 bp, Homo sapiens
cgccgtaaatgcaagcctgtag

SEQ ID NO: 7144066 - DNA, 22 bp, Homo sapiens
cgcctcagccgtggtcatcttc

SEQ ID NO: 7144067 - DNA, 16 bp, Homo sapiens
cgcctccctccctcgc

SEQ ID NO: 7144068 - DNA, 22 bp, Homo sapiens
ttattcaggaaggtgttactta

SEQ ID NO: 7144069 - DNA, 22 bp, Homo sapiens
ttattcagctctctagaggcac

SEQ ID NO: 7144070 - DNA, 22 bp, Homo sapiens
cgagagtggacagggcgcagct

SEQ ID NO: 7144071 - DNA, 22 bp, Homo sapiens
cgagagttagctaggagtcaca

SEQ ID NO: 7144072 - DNA, 22 bp, Homo sapiens
cgagagttagctaggagtcaca

SEQ ID NO: 7144073 - DNA, 22 bp, Homo sapiens
cgagatccttcagagcgcggac

SEQ ID NO: 7144074 - DNA, 22 bp, Homo sapiens
cgagatggtatttttaacgcag

SEQ ID NO: 7144075 - DNA, 22 bp, Homo sapiens
cgagcaccacttcactcttcct

SEQ ID NO: 7144076 - DNA, 22 bp, Homo sapiens
cgagcaccgcatctgctgcaga

SEQ ID NO: 7144077 - DNA, 23 bp, Homo sapiens
ttattgagggtgtagattggtgt

SEQ ID NO: 7144078 - DNA, 22 bp, Homo sapiens
ttattgagtatctgcttggtgt

SEQ ID NO: 7144079 - DNA, 22 bp, Homo sapiens
ttattgagttgtaagagctctt

SEQ ID NO: 7144080 - DNA, 22 bp, Homo sapiens
ttattgagtttacagctttaga

SEQ ID NO: 7144081 - DNA, 22 bp, Homo sapiens
ttattgagtttacagctttaga

SEQ ID NO: 7144082 - DNA, 22 bp, Homo sapiens
ttattgagtttacagctttaga

SEQ ID NO: 7144083 - DNA, 22 bp, Homo sapiens
ttattgcaaaggaagagcttga

SEQ ID NO: 7144084 - DNA, 22 bp, Homo sapiens
ttattgcaaccttttctggtgt

SEQ ID NO: 7144085 - DNA, 22 bp, Homo sapiens
ttattgcaaccttttctggtgt

SEQ ID NO: 7144086 - DNA, 22 bp, Homo sapiens
cgagagatgggttggcaggggc

SEQ ID NO: 7144087 - DNA, 22 bp, Homo sapiens
cgagagatgggttggcaggggc

SEQ ID NO: 7144088 - DNA, 22 bp, Homo sapiens
cgagaaggtcttcccacagagc

SEQ ID NO: 7144089 - DNA, 22 bp, Homo sapiens
cgagagatgggttggcaggggc

SEQ ID NO: 7144090 - DNA, 22 bp, Homo sapiens
cgagaggctggacagggctggg

SEQ ID NO: 7144091 - DNA, 22 bp, Homo sapiens
cgaagacagaccatctgagtag

SEQ ID NO: 7144092 - DNA, 22 bp, Homo sapiens
cctttttctgagttgtagcttc

SEQ ID NO: 7144093 - DNA, 22 bp, Homo sapiens
cgaaaatagatctgtttcccag

SEQ ID NO: 7144094 - DNA, 22 bp, Homo sapiens
cgaaacatctatgatcattaat

SEQ ID NO: 7144095 - DNA, 22 bp, Homo sapiens
cgaaataccacaaactctgttg

SEQ ID NO: 7144096 - DNA, 22 bp, Homo sapiens
cgaacacacttgggagttctga

SEQ ID NO: 7144097 - DNA, 22 bp, Homo sapiens
ccttttgctctcccatccagaa

SEQ ID NO: 7144098 - DNA, 22 bp, Homo sapiens
ccttttgctctcccatccagaa

SEQ ID NO: 7144099 - DNA, 22 bp, Homo sapiens
ccttttgctctcccatccagaa

SEQ ID NO: 7144100 - DNA, 22 bp, Homo sapiens
ccttttgtacacttactatata

SEQ ID NO: 7144101 - DNA, 16 bp, Homo sapiens
cctttttctcttgctg

SEQ ID NO: 7144102 - DNA, 22 bp, Homo sapiens
cctttttctgagttgtagcttc

SEQ ID NO: 7144103 - DNA, 22 bp, Homo sapiens
ccttttgtcctgcttggtttcg

SEQ ID NO: 7144104 - DNA, 22 bp, Homo sapiens
ccttttgttggggtgtattcaa

SEQ ID NO: 7144105 - DNA, 22 bp, Homo sapiens
cctttttcagcttctagaggct

SEQ ID NO: 7144106 - DNA, 22 bp, Homo sapiens
ccttttgagacttccactgtgt

SEQ ID NO: 7144107 - DNA, 22 bp, Homo sapiens
ccttttcttgccactgactcgg

SEQ ID NO: 7144108 - DNA, 22 bp, Homo sapiens
ccttttcttgccactgactcgg

SEQ ID NO: 7144109 - DNA, 22 bp, Homo sapiens
ccttttctgtgtgggtaattta

SEQ ID NO: 7144110 - DNA, 22 bp, Homo sapiens
ccttttctggccaccaagcgct

SEQ ID NO: 7144111 - DNA, 22 bp, Homo sapiens
ccttttctggccaccaagcgct

SEQ ID NO: 7144112 - DNA, 22 bp, Homo sapiens
ttatccactttagtttcagtat

SEQ ID NO: 7144113 - DNA, 22 bp, Homo sapiens
cctttgggttcaatctcggtct

SEQ ID NO: 7144114 - DNA, 22 bp, Homo sapiens
cctttggtaacattccaacctt

SEQ ID NO: 7144115 - DNA, 22 bp, Homo sapiens
cctttggtaattctgtgtagag

SEQ ID NO: 7144116 - DNA, 22 bp, Homo sapiens
cctttggtaattctgtgtagag

SEQ ID NO: 7144117 - DNA, 22 bp, Homo sapiens
ccttttctaatcttaagaatgt

SEQ ID NO: 7144118 - DNA, 22 bp, Homo sapiens
ccttttctatgtaccagcagtg

SEQ ID NO: 7144119 - DNA, 22 bp, Homo sapiens
ccttttctatccttctaggttc

SEQ ID NO: 7144120 - DNA, 22 bp, Homo sapiens
ccttttctaggatgctttatag

SEQ ID NO: 7144121 - DNA, 22 bp, Homo sapiens
ccttttctacaagcaaatgtgc

SEQ ID NO: 7144122 - DNA, 22 bp, Homo sapiens
cgggcaaggcgagactaggccc

SEQ ID NO: 7144123 - DNA, 22 bp, Homo sapiens
cgggcaaggcgagactaggccc

SEQ ID NO: 7144124 - DNA, 22 bp, Homo sapiens
cgggaggaaaggcgaggctctg

SEQ ID NO: 7144125 - DNA, 22 bp, Homo sapiens
cggcaggtgtgctcactctgcc

SEQ ID NO: 7144126 - DNA, 22 bp, Homo sapiens
cgggctggctgcagctgctgga

SEQ ID NO: 7144127 - DNA, 22 bp, Homo sapiens
cgggctggctgcagctgctgga

SEQ ID NO: 7144128 - DNA, 22 bp, Homo sapiens
cgggctggctgcagctgctgga

SEQ ID NO: 7144129 - DNA, 22 bp, Homo sapiens
cgggctggctgcagctgctgga

SEQ ID NO: 7144130 - DNA, 22 bp, Homo sapiens
cgggctggctgcagctgctgga

SEQ ID NO: 7144131 - DNA, 22 bp, Homo sapiens
cggggaggcttcggattaaagc

SEQ ID NO: 7144132 - DNA, 22 bp, Homo sapiens
cggggacacactggcagctcct

SEQ ID NO: 7144133 - DNA, 22 bp, Homo sapiens
cggggacacactggcagctcct

SEQ ID NO: 7144134 - DNA, 22 bp, Homo sapiens
cggggaagcggttctggcggta

SEQ ID NO: 7144135 - DNA, 22 bp, Homo sapiens
cggggaagcggttctggcggta

SEQ ID NO: 7144136 - DNA, 22 bp, Homo sapiens
cggggaggcttcggattaaagc

SEQ ID NO: 7144137 - DNA, 22 bp, Homo sapiens
cggggaggcttcggattaaagc

SEQ ID NO: 7144138 - DNA, 22 bp, Homo sapiens
cggggagggcagaggctccctc

SEQ ID NO: 7144139 - DNA, 22 bp, Homo sapiens
cggggaggcttcggattaaagc

SEQ ID NO: 7144140 - DNA, 22 bp, Homo sapiens
cggggaggcttcggattaaagc

SEQ ID NO: 7144141 - DNA, 22 bp, Homo sapiens
cggggaggcttcggattaaagc

SEQ ID NO: 7144142 - DNA, 22 bp, Homo sapiens
cggggagggcagaggctccctc

SEQ ID NO: 7144143 - DNA, 22 bp, Homo sapiens
cggggagggcagaggctccctc

SEQ ID NO: 7144144 - DNA, 22 bp, Homo sapiens
cggggagggcagaggctccctc

SEQ ID NO: 7144145 - DNA, 22 bp, Homo sapiens
cggggagggcagaggctccctc

SEQ ID NO: 7144146 - DNA, 22 bp, Homo sapiens
cggggagggcagaggctccctc

SEQ ID NO: 7144147 - DNA, 22 bp, Homo sapiens
cggggcagagggtcttctccag

SEQ ID NO: 7144148 - DNA, 22 bp, Homo sapiens
cggggcagagggtcttctccag

SEQ ID NO: 7144149 - DNA, 22 bp, Homo sapiens
cggggcagagggtcttctccag

SEQ ID NO: 7144150 - DNA, 22 bp, Homo sapiens
cggggcagagggtcttctccag

SEQ ID NO: 7144151 - DNA, 22 bp, Homo sapiens
cggggcaggagtccctgtagag

SEQ ID NO: 7144152 - DNA, 22 bp, Homo sapiens
cggggcagaaagttgtcttttg

SEQ ID NO: 7144153 - DNA, 22 bp, Homo sapiens
cggggcagaaagttgtcttttg

SEQ ID NO: 7144154 - DNA, 22 bp, Homo sapiens
cggggcagagggtcttctccag

SEQ ID NO: 7144155 - DNA, 22 bp, Homo sapiens
cggggcagagggtcttctccag

SEQ ID NO: 7144156 - DNA, 23 bp, Homo sapiens
cggggccagggtcaggaccggtc

SEQ ID NO: 7144157 - DNA, 22 bp, Homo sapiens
cggggccctggggctgaaggtc

SEQ ID NO: 7144158 - DNA, 22 bp, Homo sapiens
cggggccctggggctgaaggtc

SEQ ID NO: 7144159 - DNA, 22 bp, Homo sapiens
cggggcaggagtccctgtagag

SEQ ID NO: 7144160 - DNA, 23 bp, Homo sapiens
cggggccagggtcaggaccggtc

SEQ ID NO: 7144161 - DNA, 23 bp, Homo sapiens
cggggccagggtcaggaccggtc

SEQ ID NO: 7144162 - DNA, 22 bp, Homo sapiens
cggggcaggagtccctgtagag

SEQ ID NO: 7144163 - DNA, 22 bp, Homo sapiens
cggggcaggagtccctgtagag

SEQ ID NO: 7144164 - DNA, 22 bp, Homo sapiens
cggggcaggagtccctgtagag

SEQ ID NO: 7144165 - DNA, 22 bp, Homo sapiens
cggggcaggagtccctgtagag

SEQ ID NO: 7144166 - DNA, 22 bp, Homo sapiens
cggggcaggagtccctgtagag

SEQ ID NO: 7144167 - DNA, 22 bp, Homo sapiens
cggggcaggagtccctgtagag

SEQ ID NO: 7144168 - DNA, 22 bp, Homo sapiens
cggggccctggggctgaaggtc

SEQ ID NO: 7144169 - DNA, 22 bp, Homo sapiens
cggggccctggggctgaaggtc

SEQ ID NO: 7144170 - DNA, 22 bp, Homo sapiens
cggggccctggggctgaaggtc

SEQ ID NO: 7144171 - DNA, 22 bp, Homo sapiens
cgtgagcaaaatggacactccc

SEQ ID NO: 7144172 - DNA, 22 bp, Homo sapiens
cgtgagcaaaatggacactccc

SEQ ID NO: 7144173 - DNA, 22 bp, Homo sapiens
cggggctggcacaggtgaccac

SEQ ID NO: 7144174 - DNA, 21 bp, Homo sapiens
cgtgactgggtccgtctggct

SEQ ID NO: 7144175 - DNA, 21 bp, Homo sapiens
cgtgactgggtccgtctggct

SEQ ID NO: 7144176 - DNA, 22 bp, Homo sapiens
cggggctgctcgtcctcctgtg

SEQ ID NO: 7144177 - DNA, 22 bp, Homo sapiens
cggggctggcacaggtgaccac

SEQ ID NO: 7144178 - DNA, 22 bp, Homo sapiens
cggggctggcacaggtgaccac

SEQ ID NO: 7144179 - DNA, 22 bp, Homo sapiens
cggggctggcacaggtgaccac

SEQ ID NO: 7144180 - DNA, 22 bp, Homo sapiens
cgtgggagtggtgggtgctcag

SEQ ID NO: 7144181 - DNA, 22 bp, Homo sapiens
cgtgggagtggtgggtgctcag

SEQ ID NO: 7144182 - DNA, 22 bp, Homo sapiens
cgtgggagtggtgggtgctcag

SEQ ID NO: 7144183 - DNA, 22 bp, Homo sapiens
cgtgggaggaaaaatgggcttc

SEQ ID NO: 7144184 - DNA, 22 bp, Homo sapiens
cgtgggaggaaaaatgggcttc

SEQ ID NO: 7144185 - DNA, 22 bp, Homo sapiens
cgtgggaggaaaaatgggcttc

SEQ ID NO: 7144186 - DNA, 22 bp, Homo sapiens
cgtggggacccacgtgcagcac

SEQ ID NO: 7144187 - DNA, 22 bp, Homo sapiens
cgtggggacccacgtgcagcac

SEQ ID NO: 7144188 - DNA, 22 bp, Homo sapiens
cgtggggcgggtggacacttgc

SEQ ID NO: 7144189 - DNA, 22 bp, Homo sapiens
cgtggtctcccacagaaagaag

SEQ ID NO: 7144190 - DNA, 22 bp, Homo sapiens
cggggccctggggctgaaggtc

SEQ ID NO: 7144191 - DNA, 22 bp, Homo sapiens
cggggcctaccgctgcgtggcc

SEQ ID NO: 7144192 - DNA, 22 bp, Homo sapiens
cggggcctaccgctgcgtggcc

SEQ ID NO: 7144193 - DNA, 22 bp, Homo sapiens
cggggcctagtctacctcggca

SEQ ID NO: 7144194 - DNA, 22 bp, Homo sapiens
cggggctgacagcaggtgtgct

SEQ ID NO: 7144195 - DNA, 22 bp, Homo sapiens
cggggctgacagcaggtgtgct

SEQ ID NO: 7144196 - DNA, 22 bp, Homo sapiens
cggggcctgtgccagcctgtgg

SEQ ID NO: 7144197 - DNA, 22 bp, Homo sapiens
cggggcgagcagacggcggcaa

SEQ ID NO: 7144198 - DNA, 22 bp, Homo sapiens
cggggctgctcgtcctcctgtg

SEQ ID NO: 7144199 - DNA, 22 bp, Homo sapiens
cggggctgaggcaacgcggaga

SEQ ID NO: 7144200 - DNA, 22 bp, Homo sapiens
cggggctgaggcaacgcggaga

SEQ ID NO: 7144201 - DNA, 22 bp, Homo sapiens
cggggctgcgctcttcctgccg

SEQ ID NO: 7144202 - DNA, 22 bp, Homo sapiens
cggggctgaggcaacgcggaga

SEQ ID NO: 7144203 - DNA, 22 bp, Homo sapiens
cggggctgaggcaacgcggaga

SEQ ID NO: 7144204 - DNA, 22 bp, Homo sapiens
cggggctgacagcaggtgtgct

SEQ ID NO: 7144205 - DNA, 22 bp, Homo sapiens
cggggctgacagcaggtgtgct

SEQ ID NO: 7144206 - DNA, 22 bp, Homo sapiens
cggggctgacagcaggtgtgct

SEQ ID NO: 7144207 - DNA, 22 bp, Homo sapiens
cggggctgacagcaggtgtgct

SEQ ID NO: 7144208 - DNA, 22 bp, Homo sapiens
cggggctgacagcaggtgtgct

SEQ ID NO: 7144209 - DNA, 22 bp, Homo sapiens
cggggctgacagcaggtgtgct

SEQ ID NO: 7144210 - DNA, 22 bp, Homo sapiens
ttcaaatacattctttgccact

SEQ ID NO: 7144211 - DNA, 22 bp, Homo sapiens
ttcaaatcactttggagcttaa

SEQ ID NO: 7144212 - DNA, 21 bp, Homo sapiens
ttcaaagtttgcctaaagatt

SEQ ID NO: 7144213 - DNA, 21 bp, Homo sapiens
ttcaaagtttgcctaaagatt

SEQ ID NO: 7144214 - DNA, 21 bp, Homo sapiens
ttcaaagtttgcctaaagatt

SEQ ID NO: 7144215 - DNA, 22 bp, Homo sapiens
ttcaaatcagaccgaaggcaac

SEQ ID NO: 7144216 - DNA, 22 bp, Homo sapiens
ttcaaatccctgctccactatt

SEQ ID NO: 7144217 - DNA, 22 bp, Homo sapiens
ttcaaatcctagccctgtggcc

SEQ ID NO: 7144218 - DNA, 22 bp, Homo sapiens
ttcaaatgatggcagtcctggc

SEQ ID NO: 7144219 - DNA, 22 bp, Homo sapiens
ttcaaagtgcatgttcctcaga

SEQ ID NO: 7144220 - DNA, 20 bp, Homo sapiens
ttcaaagtgtatgatatgca

SEQ ID NO: 7144221 - DNA, 22 bp, Homo sapiens
ttcaaagtgtgacctgacaagc

SEQ ID NO: 7144222 - DNA, 22 bp, Homo sapiens
ttcaaagtgtgacctgacaagc

SEQ ID NO: 7144223 - DNA, 22 bp, Homo sapiens
ttcaaagtgtgacctgacaagc

SEQ ID NO: 7144224 - DNA, 22 bp, Homo sapiens
ttcaaagtgtgacctgacaagc

SEQ ID NO: 7144225 - DNA, 22 bp, Homo sapiens
ttcaaagttgcatgacagctta

SEQ ID NO: 7144226 - DNA, 22 bp, Homo sapiens
ttcaaatggttagactgttagc

SEQ ID NO: 7144227 - DNA, 22 bp, Homo sapiens
ttcaaattaccacatttgctta

SEQ ID NO: 7144228 - DNA, 22 bp, Homo sapiens
cggagaggtgggggcagcatct

SEQ ID NO: 7144229 - DNA, 22 bp, Homo sapiens
cggaggttgaggctgcagtgag

SEQ ID NO: 7144230 - DNA, 22 bp, Homo sapiens
cggagtggagaaggtcacagaa

SEQ ID NO: 7144231 - DNA, 22 bp, Homo sapiens
cggagtcttgctatgttgccca

SEQ ID NO: 7144232 - DNA, 22 bp, Homo sapiens
cggagtcttgctatgttgccca

SEQ ID NO: 7144233 - DNA, 22 bp, Homo sapiens
cggagtcttgctatgttgccca

SEQ ID NO: 7144234 - DNA, 22 bp, Homo sapiens
cggcagagcggcgagcccctcc

SEQ ID NO: 7144235 - DNA, 22 bp, Homo sapiens
cggcagagcttcctgctcagcg

SEQ ID NO: 7144236 - DNA, 22 bp, Homo sapiens
cggcagagcggcgagcccctcc

SEQ ID NO: 7144237 - DNA, 22 bp, Homo sapiens
cggcagagccctgagtcagcct

SEQ ID NO: 7144238 - DNA, 22 bp, Homo sapiens
cggcagagccctgagtcagcct

SEQ ID NO: 7144239 - DNA, 22 bp, Homo sapiens
cggcagagccctgagtcagcct

SEQ ID NO: 7144240 - DNA, 22 bp, Homo sapiens
cggcagagccctgagtcagcct

SEQ ID NO: 7144241 - DNA, 22 bp, Homo sapiens
cggcagagacggcgctttgaac

SEQ ID NO: 7144242 - DNA, 22 bp, Homo sapiens
cggcagagacggcgctttgaac

SEQ ID NO: 7144243 - DNA, 22 bp, Homo sapiens
cggcacagtggctcacgcctgt

SEQ ID NO: 7144244 - DNA, 22 bp, Homo sapiens
cggcacagggtaaacgttaccc

SEQ ID NO: 7144245 - DNA, 22 bp, Homo sapiens
cggcacaggccccatcctgact

SEQ ID NO: 7144246 - DNA, 22 bp, Homo sapiens
cggatcctcagtcgtgcgggag

SEQ ID NO: 7144247 - DNA, 22 bp, Homo sapiens
cggatgtctttgagggagagtc

SEQ ID NO: 7144248 - DNA, 22 bp, Homo sapiens
cggcacagccgggcaaggctgg

SEQ ID NO: 7144249 - DNA, 22 bp, Homo sapiens
cggcacagccgggcaaggctgg

SEQ ID NO: 7144250 - DNA, 22 bp, Homo sapiens
cggagttgtaagggatgtggct

SEQ ID NO: 7144251 - DNA, 22 bp, Homo sapiens
cggagtggggactggggtaatc

SEQ ID NO: 7144252 - DNA, 22 bp, Homo sapiens
cggcagagtgtgtgcgtgcatg

SEQ ID NO: 7144253 - DNA, 22 bp, Homo sapiens
cggcagagtgtgtgcgtgcatg

SEQ ID NO: 7144254 - DNA, 22 bp, Homo sapiens
cggcagagtgtgtgcgtgcatg

SEQ ID NO: 7144255 - DNA, 22 bp, Homo sapiens
cggcagcaaaggaagccaggtc

SEQ ID NO: 7144256 - DNA, 22 bp, Homo sapiens
cggcagcaaaggaagccaggtc

SEQ ID NO: 7144257 - DNA, 18 bp, Homo sapiens
cggcagagtgcttctagc

SEQ ID NO: 7144258 - DNA, 22 bp, Homo sapiens
cggcagagcttcctgctcagcg

SEQ ID NO: 7144259 - DNA, 18 bp, Homo sapiens
cggcagagtgcttctagc

SEQ ID NO: 7144260 - DNA, 22 bp, Homo sapiens
cggcagagcttcctgctcagcg

SEQ ID NO: 7144261 - DNA, 22 bp, Homo sapiens
cggcagagcttcctgctcagcg

SEQ ID NO: 7144262 - DNA, 22 bp, Homo sapiens
cggcaggacctcatttccttct

SEQ ID NO: 7144263 - DNA, 22 bp, Homo sapiens
cggcagctcgagggccacccgt

SEQ ID NO: 7144264 - DNA, 22 bp, Homo sapiens
cggcagggttggttttctctga

SEQ ID NO: 7144265 - DNA, 22 bp, Homo sapiens
cggcagggttggttttctctga

SEQ ID NO: 7144266 - DNA, 22 bp, Homo sapiens
cggcagggttggttttctctga

SEQ ID NO: 7144267 - DNA, 22 bp, Homo sapiens
cggcagggttggttttctctga

SEQ ID NO: 7144268 - DNA, 22 bp, Homo sapiens
cggcagggctccatgcatttct

SEQ ID NO: 7144269 - DNA, 22 bp, Homo sapiens
cggcagggctccatgcatttct

SEQ ID NO: 7144270 - DNA, 22 bp, Homo sapiens
cggcagggctccatgcatttct

SEQ ID NO: 7144271 - DNA, 22 bp, Homo sapiens
cggcagggctccatgcatttct

SEQ ID NO: 7144272 - DNA, 22 bp, Homo sapiens
ttagcaagataacagtaatttt

SEQ ID NO: 7144273 - DNA, 22 bp, Homo sapiens
ttagcaaatatcttgaaacagg

SEQ ID NO: 7144274 - DNA, 22 bp, Homo sapiens
ttagcaaatatcttgaaacagg

SEQ ID NO: 7144275 - DNA, 22 bp, Homo sapiens
ttagcaaatttccaggtgatgc

SEQ ID NO: 7144276 - DNA, 22 bp, Homo sapiens
ttagcaaatttccaggtgatgc

SEQ ID NO: 7144277 - DNA, 22 bp, Homo sapiens
ttagcaaatttccaggtgatgc

SEQ ID NO: 7144278 - DNA, 22 bp, Homo sapiens
ttagcaagaaagattgcagcac

SEQ ID NO: 7144279 - DNA, 22 bp, Homo sapiens
ccttgaaagtatatgctcaatt

SEQ ID NO: 7144280 - DNA, 22 bp, Homo sapiens
ttagcacaggcaactccacata

SEQ ID NO: 7144281 - DNA, 22 bp, Homo sapiens
ttagcaccctgatactagaatg

SEQ ID NO: 7144282 - DNA, 22 bp, Homo sapiens
ttagcaccttgaacagaccctg

SEQ ID NO: 7144283 - DNA, 22 bp, Homo sapiens
ccttcagcgtcccctttacccg

SEQ ID NO: 7144284 - DNA, 18 bp, Homo sapiens
ccttcagctctgccagta

SEQ ID NO: 7144285 - DNA, 22 bp, Homo sapiens
ccttcagcctttgtttatcaga

SEQ ID NO: 7144286 - DNA, 18 bp, Homo sapiens
ccttcagctctggttttc

SEQ ID NO: 7144287 - DNA, 22 bp, Homo sapiens
ttagacatagaatattgtctag

SEQ ID NO: 7144288 - DNA, 22 bp, Homo sapiens
ttagcaaactctgttagattct

SEQ ID NO: 7144289 - DNA, 22 bp, Homo sapiens
ttagacagtaaggcttcagttg

SEQ ID NO: 7144290 - DNA, 22 bp, Homo sapiens
ttagacatagaatattgtctag

SEQ ID NO: 7144291 - DNA, 22 bp, Homo sapiens
ttagacatagaatattgtctag

SEQ ID NO: 7144292 - DNA, 22 bp, Homo sapiens
ttagcaaactctgttagattct

SEQ ID NO: 7144293 - DNA, 22 bp, Homo sapiens
ttagacagagctccttgagggc

SEQ ID NO: 7144294 - DNA, 22 bp, Homo sapiens
ttagacagagctccttgagggc

SEQ ID NO: 7144295 - DNA, 22 bp, Homo sapiens
ttagacaggatgtatgaaagct

SEQ ID NO: 7144296 - DNA, 22 bp, Homo sapiens
ttagacaggatgtatgaaagct

SEQ ID NO: 7144297 - DNA, 21 bp, Homo sapiens
ttagcaaagcaaacacatgct

SEQ ID NO: 7144298 - DNA, 21 bp, Homo sapiens
ttagcaaagcaaacacatgct

SEQ ID NO: 7144299 - DNA, 21 bp, Homo sapiens
ttagcaaagcaaacacatgct

SEQ ID NO: 7144300 - DNA, 22 bp, Homo sapiens
ttagcaaagaagatgtgagttt

SEQ ID NO: 7144301 - DNA, 22 bp, Homo sapiens
ttagcaaagaagatgtgagttt

SEQ ID NO: 7144302 - DNA, 21 bp, Homo sapiens
ttagcaaagcaaacacatgct

SEQ ID NO: 7144303 - DNA, 21 bp, Homo sapiens
ttagcaaagcaaacacatgct

SEQ ID NO: 7144304 - DNA, 22 bp, Homo sapiens
ttagcaaatatcttgaaacagg

SEQ ID NO: 7144305 - DNA, 22 bp, Homo sapiens
ttagcaaatatcttgaaacagg

SEQ ID NO: 7144306 - DNA, 22 bp, Homo sapiens
ttagcaaagtttgccatctagt

SEQ ID NO: 7144307 - DNA, 22 bp, Homo sapiens
ttagcaaaggcccctacaccca

SEQ ID NO: 7144308 - DNA, 22 bp, Homo sapiens
ttagcaaagtttgccatctagt

SEQ ID NO: 7144309 - DNA, 22 bp, Homo sapiens
ccttcagcctcaagatccttca

SEQ ID NO: 7144310 - DNA, 22 bp, Homo sapiens
ccttcagccttcatccttcctt

SEQ ID NO: 7144311 - DNA, 22 bp, Homo sapiens
ccttcagcctagaacttgagag

SEQ ID NO: 7144312 - DNA, 22 bp, Homo sapiens
ccttcagaggtgtagattgcgt

SEQ ID NO: 7144313 - DNA, 22 bp, Homo sapiens
ccttcagccagttttctttgtt

SEQ ID NO: 7144314 - DNA, 23 bp, Homo sapiens
ccttcagaagaagtaacaggggc

SEQ ID NO: 7144315 - DNA, 23 bp, Homo sapiens
ccttcagaagaagtaacaggggc

SEQ ID NO: 7144316 - DNA, 22 bp, Homo sapiens
ccttcagacctagacaggaatc

SEQ ID NO: 7144317 - DNA, 22 bp, Homo sapiens
ccttcagacctagacaggaatc

SEQ ID NO: 7144318 - DNA, 22 bp, Homo sapiens
ccttcacacaggtagaagcaga

SEQ ID NO: 7144319 - DNA, 22 bp, Homo sapiens
ccttcacactttcacttggata

SEQ ID NO: 7144320 - DNA, 20 bp, Homo sapiens
ccttcagaacttacatagta

SEQ ID NO: 7144321 - DNA, 23 bp, Homo sapiens
ccttcagaagaagtaacaggggc

SEQ ID NO: 7144322 - DNA, 22 bp, Homo sapiens
ccttcaaatttagaacaagtga

SEQ ID NO: 7144323 - DNA, 22 bp, Homo sapiens
ttacatagttaaatagtacagc

SEQ ID NO: 7144324 - DNA, 22 bp, Homo sapiens
ttacataggtatgtttgctttg

SEQ ID NO: 7144325 - DNA, 22 bp, Homo sapiens
ttacatagttaaatagtacagc

SEQ ID NO: 7144326 - DNA, 22 bp, Homo sapiens
ccttcaaactttcattaaccag

SEQ ID NO: 7144327 - DNA, 22 bp, Homo sapiens
ttacatacttactagatctatg

SEQ ID NO: 7144328 - DNA, 22 bp, Homo sapiens
ttacatacttactagatctatg

SEQ ID NO: 7144329 - DNA, 22 bp, Homo sapiens
ttacatagattcatttagttaa

SEQ ID NO: 7144330 - DNA, 22 bp, Homo sapiens
ttacagtttctagtaatacttg

SEQ ID NO: 7144331 - DNA, 22 bp, Homo sapiens
ttacataaaagttcacgtaggc

SEQ ID NO: 7144332 - DNA, 22 bp, Homo sapiens
ttacataaaagttcacgtaggc

SEQ ID NO: 7144333 - DNA, 22 bp, Homo sapiens
ttacataaaagttcacgtaggc

SEQ ID NO: 7144334 - DNA, 22 bp, Homo sapiens
ttacataacggtatgaaaaatg

SEQ ID NO: 7144335 - DNA, 22 bp, Homo sapiens
ttacataactttaaaatgccgt

SEQ ID NO: 7144336 - DNA, 22 bp, Homo sapiens
ccttgagccagggagctggcag

SEQ ID NO: 7144337 - DNA, 22 bp, Homo sapiens
ccttgagccagggagctggcag

SEQ ID NO: 7144338 - DNA, 21 bp, Homo sapiens
ccttgaggcccaggccaggcc

SEQ ID NO: 7144339 - DNA, 20 bp, Homo sapiens
ccttgatcttggacttccag

SEQ ID NO: 7144340 - DNA, 22 bp, Homo sapiens
ccttgcagacatcagtagtggc

SEQ ID NO: 7144341 - DNA, 22 bp, Homo sapiens
ccttgaatctctgctctagaac

SEQ ID NO: 7144342 - DNA, 22 bp, Homo sapiens
ccttgagacacagccaaagatg

SEQ ID NO: 7144343 - DNA, 22 bp, Homo sapiens
ccttgcatatattatatctttg

SEQ ID NO: 7144344 - DNA, 22 bp, Homo sapiens
ccttgcatctcatttcattctt

SEQ ID NO: 7144345 - DNA, 22 bp, Homo sapiens
ccttgcagttgttactgtagcc

SEQ ID NO: 7144346 - DNA, 22 bp, Homo sapiens
ccttgcatgtgctaacgacaag

SEQ ID NO: 7144347 - DNA, 22 bp, Homo sapiens
ccttgcatttaaaggcgtaggg

SEQ ID NO: 7144348 - DNA, 22 bp, Homo sapiens
ccttgccccatctgggaatccc

SEQ ID NO: 7144349 - DNA, 22 bp, Homo sapiens
ccttgcagggaaactggaccca

SEQ ID NO: 7144350 - DNA, 22 bp, Homo sapiens
ccttgcaggggaacaggcagtg

SEQ ID NO: 7144351 - DNA, 22 bp, Homo sapiens
ccttgcagacatcagtagtggc

SEQ ID NO: 7144352 - DNA, 22 bp, Homo sapiens
ccttgcagagcataggagccct

SEQ ID NO: 7144353 - DNA, 22 bp, Homo sapiens
ccttgcagcatatagagtccct

SEQ ID NO: 7144354 - DNA, 22 bp, Homo sapiens
ccttgcctcattgtgcttctcc

SEQ ID NO: 7144355 - DNA, 22 bp, Homo sapiens
ttagggaaacaaacattttctt

SEQ ID NO: 7144356 - DNA, 22 bp, Homo sapiens
ccttgcccgctgcctctgagtt

SEQ ID NO: 7144357 - DNA, 22 bp, Homo sapiens
ccttgcccgctgcctctgagtt

SEQ ID NO: 7144358 - DNA, 22 bp, Homo sapiens
ccttgcccgctgcctctgagtt

SEQ ID NO: 7144359 - DNA, 22 bp, Homo sapiens
ccttgccctgagcaggggtcag

SEQ ID NO: 7144360 - DNA, 22 bp, Homo sapiens
ttagggaaagcagcattccctt

SEQ ID NO: 7144361 - DNA, 22 bp, Homo sapiens
ttagggaaataaaattatcagt

SEQ ID NO: 7144362 - DNA, 22 bp, Homo sapiens
ttagttttcccatctttatggt

SEQ ID NO: 7144363 - DNA, 22 bp, Homo sapiens
ttataaagattgttatgtatct

SEQ ID NO: 7144364 - DNA, 22 bp, Homo sapiens
ttataaaggtttgtgcatattt

SEQ ID NO: 7144365 - DNA, 22 bp, Homo sapiens
ttataaagattgttatgtatct

SEQ ID NO: 7144366 - DNA, 22 bp, Homo sapiens
ttagttttctcatctatctcac

SEQ ID NO: 7144367 - DNA, 22 bp, Homo sapiens
ttagttttctcatctatctcac

SEQ ID NO: 7144368 - DNA, 22 bp, Homo sapiens
ttataaacttgccaagaaggag

SEQ ID NO: 7144369 - DNA, 22 bp, Homo sapiens
ttagttttcccatctttatggt

SEQ ID NO: 7144370 - DNA, 22 bp, Homo sapiens
ttagttttcccatctttatggt

SEQ ID NO: 7144371 - DNA, 22 bp, Homo sapiens
ttatccaaactggtgaatcatt

SEQ ID NO: 7144372 - DNA, 22 bp, Homo sapiens
ttatcattgtcgcagtctaatt

SEQ ID NO: 7144373 - DNA, 22 bp, Homo sapiens
ttatcatgggacctgaatttta

SEQ ID NO: 7144374 - DNA, 22 bp, Homo sapiens
ttatcattgtcgcagtctaatt

SEQ ID NO: 7144375 - DNA, 22 bp, Homo sapiens
ttatcatagtgcagttttctga

SEQ ID NO: 7144376 - DNA, 22 bp, Homo sapiens
ttatcatctcctgctgtggtta

SEQ ID NO: 7144377 - DNA, 23 bp, Homo sapiens
ttatcaggacatgctgtctcagg

SEQ ID NO: 7144378 - DNA, 22 bp, Homo sapiens
ttatcagtcggcttaggttatg

SEQ ID NO: 7144379 - DNA, 22 bp, Homo sapiens
ttatcataagtaattgaaataa

SEQ ID NO: 7144380 - DNA, 22 bp, Homo sapiens
ttatcataagtaattgaaataa

SEQ ID NO: 7144381 - DNA, 22 bp, Homo sapiens
ttatatttctggtagccttcag

SEQ ID NO: 7144382 - DNA, 22 bp, Homo sapiens
ttatatttctggtagccttcag

SEQ ID NO: 7144383 - DNA, 22 bp, Homo sapiens
ttatatttctggtagccttcag

SEQ ID NO: 7144384 - DNA, 22 bp, Homo sapiens
ttatatttctggtagccttcag

SEQ ID NO: 7144385 - DNA, 22 bp, Homo sapiens
ttatatttctggtagccttcag

SEQ ID NO: 7144386 - DNA, 23 bp, Homo sapiens
ttataaatattttcaggtgtgtt

SEQ ID NO: 7144387 - DNA, 22 bp, Homo sapiens
ttataacaacagtttactttaa

SEQ ID NO: 7144388 - DNA, 23 bp, Homo sapiens
ttataaatattttcaggtgtgtt

SEQ ID NO: 7144389 - DNA, 23 bp, Homo sapiens
ttataaatattttcaggtgtgtt

SEQ ID NO: 7144390 - DNA, 22 bp, Homo sapiens
ttataacaacagtttactttaa

SEQ ID NO: 7144391 - DNA, 22 bp, Homo sapiens
ttataacactgccttgtcacca

SEQ ID NO: 7144392 - DNA, 22 bp, Homo sapiens
ttataacatcaatcagagttaa

SEQ ID NO: 7144393 - DNA, 22 bp, Homo sapiens
ttataacatcaatcagagttaa

SEQ ID NO: 7144394 - DNA, 22 bp, Homo sapiens
ttatattagttagacttgctgt

SEQ ID NO: 7144395 - DNA, 22 bp, Homo sapiens
ttataacattataaagtggaga

SEQ ID NO: 7144396 - DNA, 22 bp, Homo sapiens
ttaaattagtcaagcttctctg

SEQ ID NO: 7144397 - DNA, 22 bp, Homo sapiens
ttaaattattgagggattgtca

SEQ ID NO: 7144398 - DNA, 22 bp, Homo sapiens
ttaaattattgagggattgtca

SEQ ID NO: 7144399 - DNA, 22 bp, Homo sapiens
ttaaatagtaggtctattttgg

SEQ ID NO: 7144400 - DNA, 22 bp, Homo sapiens
ttaaatagtaggtctattttgg

SEQ ID NO: 7144401 - DNA, 22 bp, Homo sapiens
ttaaatagtaggtctattttgg

SEQ ID NO: 7144402 - DNA, 22 bp, Homo sapiens
ttaaatagtaggtctattttgg

SEQ ID NO: 7144403 - DNA, 22 bp, Homo sapiens
ttaaatagtaggtctattttgg

SEQ ID NO: 7144404 - DNA, 22 bp, Homo sapiens
tgtcagctcccagtcagagaga

SEQ ID NO: 7144405 - DNA, 22 bp, Homo sapiens
tgtcagcatttaaggagtaagg

SEQ ID NO: 7144406 - DNA, 22 bp, Homo sapiens
tgtcagcagctggtttgctgtt

SEQ ID NO: 7144407 - DNA, 22 bp, Homo sapiens
tgtcagcaggacattaaaagct

SEQ ID NO: 7144408 - DNA, 22 bp, Homo sapiens
tgtcagcagtatctctatctca

SEQ ID NO: 7144409 - DNA, 22 bp, Homo sapiens
tgtcagcagtatctctatctca

SEQ ID NO: 7144410 - DNA, 22 bp, Homo sapiens
tgtcagcagaaatctggtctgc

SEQ ID NO: 7144411 - DNA, 22 bp, Homo sapiens
tgtcagcacatctgtaatcaca

SEQ ID NO: 7144412 - DNA, 22 bp, Homo sapiens
tgtcagcacatctgtaatcaca

SEQ ID NO: 7144413 - DNA, 20 bp, Homo sapiens
tgtcagcaattaggagaaaa

SEQ ID NO: 7144414 - DNA, 22 bp, Homo sapiens
tgtcagcaattctggcttactc

SEQ ID NO: 7144415 - DNA, 21 bp, Homo sapiens
tgtcagcaacaatactttctc

SEQ ID NO: 7144416 - DNA, 22 bp, Homo sapiens
tgtcagcaagacatcagagtga

SEQ ID NO: 7144417 - DNA, 21 bp, Homo sapiens
tgtcagagcttgtaggacatt

SEQ ID NO: 7144418 - DNA, 22 bp, Homo sapiens
tgtcaatagttttgagttctct

SEQ ID NO: 7144419 - DNA, 22 bp, Homo sapiens
tgtcaataactggagtcattat

SEQ ID NO: 7144420 - DNA, 22 bp, Homo sapiens
tgtcaatatgtaataactgaat

SEQ ID NO: 7144421 - DNA, 22 bp, Homo sapiens
ttaaattgtcatttgagcaatg

SEQ ID NO: 7144422 - DNA, 22 bp, Homo sapiens
ttaaattgtcatttgagcaatg

SEQ ID NO: 7144423 - DNA, 22 bp, Homo sapiens
ttaaattgtcatttgagcaatg

SEQ ID NO: 7144424 - DNA, 22 bp, Homo sapiens
ttaaattccagcctcataatag

SEQ ID NO: 7144425 - DNA, 22 bp, Homo sapiens
ttaaattatttctagtgaggtg

SEQ ID NO: 7144426 - DNA, 22 bp, Homo sapiens
ttaaattatttctagtgaggtg

SEQ ID NO: 7144427 - DNA, 22 bp, Homo sapiens
ttaaattattgagggattgtca

SEQ ID NO: 7144428 - DNA, 22 bp, Homo sapiens
ttaaattatttctagtgaggtg

SEQ ID NO: 7144429 - DNA, 22 bp, Homo sapiens
ttaaattatttctagtgaggtg

SEQ ID NO: 7144430 - DNA, 22 bp, Homo sapiens
ttaaattcattccaacttttga

SEQ ID NO: 7144431 - DNA, 22 bp, Homo sapiens
ttaaattcattccaacttttga

SEQ ID NO: 7144432 - DNA, 22 bp, Homo sapiens
ttaaattccagcctcataatag

SEQ ID NO: 7144433 - DNA, 22 bp, Homo sapiens
ttaaattccagcctcataatag

SEQ ID NO: 7144434 - DNA, 22 bp, Homo sapiens
ttaaattccagcctcataatag

SEQ ID NO: 7144435 - DNA, 22 bp, Homo sapiens
ttaagaggtggtcgtgtctgtg

SEQ ID NO: 7144436 - DNA, 22 bp, Homo sapiens
ttaagaggtgaggcctttaaga

SEQ ID NO: 7144437 - DNA, 22 bp, Homo sapiens
ttaagagggtgatgctagcatt

SEQ ID NO: 7144438 - DNA, 22 bp, Homo sapiens
ttaagaggagatcatactggag

SEQ ID NO: 7144439 - DNA, 22 bp, Homo sapiens
ttaagaggagatcatactggag

SEQ ID NO: 7144440 - DNA, 21 bp, Homo sapiens
ttaagagcttagcagtaggcc

SEQ ID NO: 7144441 - DNA, 22 bp, Homo sapiens
ttaagagccaacttatccatct

SEQ ID NO: 7144442 - DNA, 18 bp, Homo sapiens
ttaagagctgaaagggga

SEQ ID NO: 7144443 - DNA, 22 bp, Homo sapiens
ttaaattttagaaacagactct

SEQ ID NO: 7144444 - DNA, 22 bp, Homo sapiens
ttaagatagaacccagtagtct

SEQ ID NO: 7144445 - DNA, 22 bp, Homo sapiens
ttaagatagaacccagtagtct

SEQ ID NO: 7144446 - DNA, 22 bp, Homo sapiens
ttaagatgatgtttcttgttgt

SEQ ID NO: 7144447 - DNA, 22 bp, Homo sapiens
ttaagattttcttcagtattat

SEQ ID NO: 7144448 - DNA, 22 bp, Homo sapiens
ccttaaaagaactatctcttct

SEQ ID NO: 7144449 - DNA, 23 bp, Homo sapiens
ccttaaatatctaccctgtggca

SEQ ID NO: 7144450 - DNA, 22 bp, Homo sapiens
ccttaaattctccatttgaaag

SEQ ID NO: 7144451 - DNA, 22 bp, Homo sapiens
ccttaaattctccatttgaaag

SEQ ID NO: 7144452 - DNA, 22 bp, Homo sapiens
ccttacacctaaaatgagagtt

SEQ ID NO: 7144453 - DNA, 22 bp, Homo sapiens
cctgttttattctgttgtatct

SEQ ID NO: 7144454 - DNA, 22 bp, Homo sapiens
cctgtttgttacctcgtttgag

SEQ ID NO: 7144455 - DNA, 18 bp, Homo sapiens
cctgtgtgtgttgcaggc

SEQ ID NO: 7144456 - DNA, 18 bp, Homo sapiens
cctgtgtgtgttgcaggc

SEQ ID NO: 7144457 - DNA, 22 bp, Homo sapiens
ttaagcacctatgttgtgccag

SEQ ID NO: 7144458 - DNA, 22 bp, Homo sapiens
ttacaaagagtgccagagtgtg

SEQ ID NO: 7144459 - DNA, 22 bp, Homo sapiens
ccttatcacaatggagtgtcac

SEQ ID NO: 7144460 - DNA, 22 bp, Homo sapiens
ccttagtgtgcctgaggcagat

SEQ ID NO: 7144461 - DNA, 22 bp, Homo sapiens
ttacaaagagtgttcttttcca

SEQ ID NO: 7144462 - DNA, 22 bp, Homo sapiens
ccttagtgtgaggggatacccc

SEQ ID NO: 7144463 - DNA, 22 bp, Homo sapiens
ccttagtgaaacagaggcaatt

SEQ ID NO: 7144464 - DNA, 22 bp, Homo sapiens
ccttagcatggctgtgctgtgt

SEQ ID NO: 7144465 - DNA, 22 bp, Homo sapiens
ccttagcattagaagctgtggg

SEQ ID NO: 7144466 - DNA, 22 bp, Homo sapiens
ccttacctgattgctggcatcc

SEQ ID NO: 7144467 - DNA, 22 bp, Homo sapiens
ccttagaaggctgaataattct

SEQ ID NO: 7144468 - DNA, 22 bp, Homo sapiens
ccttagcaaattggcatcttct

SEQ ID NO: 7144469 - DNA, 22 bp, Homo sapiens
ccttagcaacacttagcaactg

SEQ ID NO: 7144470 - DNA, 22 bp, Homo sapiens
ccttagcaactgtcatagagca

SEQ ID NO: 7144471 - DNA, 22 bp, Homo sapiens
ccttagcagggagtctgtccag

SEQ ID NO: 7144472 - DNA, 22 bp, Homo sapiens
ccttagcagggccgggcctggg

SEQ ID NO: 7144473 - DNA, 22 bp, Homo sapiens
ttacaaagattatattcagtta

SEQ ID NO: 7144474 - DNA, 22 bp, Homo sapiens
ttacaaagattatattcagtta

SEQ ID NO: 7144475 - DNA, 22 bp, Homo sapiens
ttacaaagattatattcagtta

SEQ ID NO: 7144476 - DNA, 22 bp, Homo sapiens
ttacaaagattatattcagtta

SEQ ID NO: 7144477 - DNA, 22 bp, Homo sapiens
ttacaaagcaggtcagctgaaa

SEQ ID NO: 7144478 - DNA, 21 bp, Homo sapiens
ttacaaagcaagtgctgtgtc

SEQ ID NO: 7144479 - DNA, 22 bp, Homo sapiens
ttacaaagcaggtcagctgaaa

SEQ ID NO: 7144480 - DNA, 22 bp, Homo sapiens
ttacaaagcaggtcagctgaaa

SEQ ID NO: 7144481 - DNA, 22 bp, Homo sapiens
ttacaaagcgctttacctctga

SEQ ID NO: 7144482 - DNA, 22 bp, Homo sapiens
ttacaaagcgctttacctctga

SEQ ID NO: 7144483 - DNA, 22 bp, Homo sapiens
ttacaaagcgttgagacaagta

SEQ ID NO: 7144484 - DNA, 22 bp, Homo sapiens
ttacagaagtattgagagatcc

SEQ ID NO: 7144485 - DNA, 22 bp, Homo sapiens
ttacagaagtgaaggcctttaa

SEQ ID NO: 7144486 - DNA, 22 bp, Homo sapiens
ttacaaagcgttgagacaagta

SEQ ID NO: 7144487 - DNA, 22 bp, Homo sapiens
ttacaaagcgttgagacaagta

SEQ ID NO: 7144488 - DNA, 22 bp, Homo sapiens
ttacagttgtagaaagtggttg

SEQ ID NO: 7144489 - DNA, 22 bp, Homo sapiens
ttacagtttacataagaattgt

SEQ ID NO: 7144490 - DNA, 22 bp, Homo sapiens
ttacagtttaccaagaatattg

SEQ ID NO: 7144491 - DNA, 22 bp, Homo sapiens
ttacagtttatccaggaagagc

SEQ ID NO: 7144492 - DNA, 22 bp, Homo sapiens
ttacagaagtttcagcgtttta

SEQ ID NO: 7144493 - DNA, 22 bp, Homo sapiens
ttacagaagtttcagcgtttta

SEQ ID NO: 7144494 - DNA, 21 bp, Homo sapiens
ttacagaatccatgggaagtc

SEQ ID NO: 7144495 - DNA, 21 bp, Homo sapiens
ttacagaatccatgggaagtc

SEQ ID NO: 7144496 - DNA, 21 bp, Homo sapiens
ttacagaatccatgggaagtc

SEQ ID NO: 7144497 - DNA, 22 bp, Homo sapiens
ttacagtgtgcaatcccagaat

SEQ ID NO: 7144498 - DNA, 22 bp, Homo sapiens
ttacagtgttacttgatgtcca

SEQ ID NO: 7144499 - DNA, 22 bp, Homo sapiens
ttacagttactggtactgttaa

SEQ ID NO: 7144500 - DNA, 22 bp, Homo sapiens
ttacagttgctacaaaggataa

SEQ ID NO: 7144501 - DNA, 21 bp, Homo sapiens
tcccactctaaatggactgaa

SEQ ID NO: 7144502 - DNA, 21 bp, Homo sapiens
tcccactctaaatggactgaa

SEQ ID NO: 7144503 - DNA, 20 bp, Homo sapiens
tcccactcttgtgttttcag

SEQ ID NO: 7144504 - DNA, 22 bp, Homo sapiens
tcccactgagcatatgcagatg

SEQ ID NO: 7144505 - DNA, 22 bp, Homo sapiens
tcccactgagcatatgcagatg

SEQ ID NO: 7144506 - DNA, 22 bp, Homo sapiens
tcccactgagcccctgctggtg

SEQ ID NO: 7144507 - DNA, 22 bp, Homo sapiens
cattcatttatgaaatatctat

SEQ ID NO: 7144508 - DNA, 22 bp, Homo sapiens
cattcatttatgaaatatctat

SEQ ID NO: 7144509 - DNA, 22 bp, Homo sapiens
cattcatttatgaaatatctat

SEQ ID NO: 7144510 - DNA, 22 bp, Homo sapiens
cattcatttatgaaatatctat

SEQ ID NO: 7144511 - DNA, 22 bp, Homo sapiens
tcccagagcctctgccactctg

SEQ ID NO: 7144512 - DNA, 22 bp, Homo sapiens
tcccagagcccaagttggagag

SEQ ID NO: 7144513 - DNA, 22 bp, Homo sapiens
tcccagagcccaagttggagag

SEQ ID NO: 7144514 - DNA, 22 bp, Homo sapiens
tcccagagcccaagttggagag

SEQ ID NO: 7144515 - DNA, 22 bp, Homo sapiens
cattcattcacattttgtctat

SEQ ID NO: 7144516 - DNA, 22 bp, Homo sapiens
cattcattcagcaactgttatt

SEQ ID NO: 7144517 - DNA, 22 bp, Homo sapiens
cattcattcagcaactgttatt

SEQ ID NO: 7144518 - DNA, 22 bp, Homo sapiens
cattcatttactttcaacagct

SEQ ID NO: 7144519 - DNA, 22 bp, Homo sapiens
cattcatttactttcaacagct

SEQ ID NO: 7144520 - DNA, 22 bp, Homo sapiens
cattcatttactttcaacagct

SEQ ID NO: 7144521 - DNA, 22 bp, Homo sapiens
cattcatttactttcaacagct

SEQ ID NO: 7144522 - DNA, 22 bp, Homo sapiens
cattcatttatgaaatatctat

SEQ ID NO: 7144523 - DNA, 22 bp, Homo sapiens
tcccagaggaaatggcagctga

SEQ ID NO: 7144524 - DNA, 22 bp, Homo sapiens
tcccagaggactgttggtgcta

SEQ ID NO: 7144525 - DNA, 22 bp, Homo sapiens
tcccagagctgataagccttta

SEQ ID NO: 7144526 - DNA, 22 bp, Homo sapiens
tcccagaggaaatggcagctga

SEQ ID NO: 7144527 - DNA, 22 bp, Homo sapiens
tcccagaggaaatggcagctga

SEQ ID NO: 7144528 - DNA, 22 bp, Homo sapiens
tcccagaggaaatggcagctga

SEQ ID NO: 7144529 - DNA, 22 bp, Homo sapiens
tcccagaggaaatggcagctga

SEQ ID NO: 7144530 - DNA, 22 bp, Homo sapiens
tcccagagctctggaggttgga

SEQ ID NO: 7144531 - DNA, 22 bp, Homo sapiens
tcccagagctgataagccttta

SEQ ID NO: 7144532 - DNA, 22 bp, Homo sapiens
tcccagagctctggaggttgga

SEQ ID NO: 7144533 - DNA, 22 bp, Homo sapiens
tcccagagctctggaggttgga

SEQ ID NO: 7144534 - DNA, 22 bp, Homo sapiens
tcccagagctctggaggttgga

SEQ ID NO: 7144535 - DNA, 22 bp, Homo sapiens
tcccagagctctgacaccagct

SEQ ID NO: 7144536 - DNA, 22 bp, Homo sapiens
tcccagccacagtttccacctg

SEQ ID NO: 7144537 - DNA, 22 bp, Homo sapiens
tcccagccacagtttccacctg

SEQ ID NO: 7144538 - DNA, 22 bp, Homo sapiens
tcccagccacagtttccacctg

SEQ ID NO: 7144539 - DNA, 22 bp, Homo sapiens
tcccagccacagtttccacctg

SEQ ID NO: 7144540 - DNA, 22 bp, Homo sapiens
tcccagccacagtttccacctg

SEQ ID NO: 7144541 - DNA, 22 bp, Homo sapiens
tcccagccacagtttccacctg

SEQ ID NO: 7144542 - DNA, 22 bp, Homo sapiens
tcccagccaggctctaccactt

SEQ ID NO: 7144543 - DNA, 22 bp, Homo sapiens
tcccagccaggctctaccactt

SEQ ID NO: 7144544 - DNA, 22 bp, Homo sapiens
tcccagccaggctctaccactt

SEQ ID NO: 7144545 - DNA, 22 bp, Homo sapiens
tcccagccaggctctaccactt

SEQ ID NO: 7144546 - DNA, 22 bp, Homo sapiens
tcccagccaggctctaccactt

SEQ ID NO: 7144547 - DNA, 22 bp, Homo sapiens
tcccagccattcctttaggtgt

SEQ ID NO: 7144548 - DNA, 22 bp, Homo sapiens
tcccagcccagacttctccagt

SEQ ID NO: 7144549 - DNA, 22 bp, Homo sapiens
tcccagcccagacttctccagt

SEQ ID NO: 7144550 - DNA, 22 bp, Homo sapiens
tcccagcccagacttctccagt

SEQ ID NO: 7144551 - DNA, 22 bp, Homo sapiens
tcccagcccagatttgtgtgac

SEQ ID NO: 7144552 - DNA, 22 bp, Homo sapiens
tcccagcccaggtatgatgata

SEQ ID NO: 7144553 - DNA, 22 bp, Homo sapiens
tcccagcccaggtatgatgata

SEQ ID NO: 7144554 - DNA, 23 bp, Homo sapiens
tcccaggaatctgcatttttaac

SEQ ID NO: 7144555 - DNA, 23 bp, Homo sapiens
tcccaggaatctgcatttttaac

SEQ ID NO: 7144556 - DNA, 22 bp, Homo sapiens
tcccaggaatgtctgaaagtga

SEQ ID NO: 7144557 - DNA, 22 bp, Homo sapiens
tcccaggaatgtctgaaagtga

SEQ ID NO: 7144558 - DNA, 22 bp, Homo sapiens
tcccaggaattgaagccagtgt

SEQ ID NO: 7144559 - DNA, 22 bp, Homo sapiens
tcccaggaattgaagccagtgt

SEQ ID NO: 7144560 - DNA, 22 bp, Homo sapiens
tcccaggacaggccacatggaa

SEQ ID NO: 7144561 - DNA, 22 bp, Homo sapiens
tcccaggacaggccacatggaa

SEQ ID NO: 7144562 - DNA, 22 bp, Homo sapiens
tcccaggacatgggctctgctc

SEQ ID NO: 7144563 - DNA, 22 bp, Homo sapiens
tcccaggacatgggctctgctc

SEQ ID NO: 7144564 - DNA, 22 bp, Homo sapiens
tcccaggacccaggcattcaca

SEQ ID NO: 7144565 - DNA, 22 bp, Homo sapiens
tcccaggacttccagttggagg

SEQ ID NO: 7144566 - DNA, 22 bp, Homo sapiens
tcccaggacttccagttggagg

SEQ ID NO: 7144567 - DNA, 22 bp, Homo sapiens
tcccaggacttccagttggagg

SEQ ID NO: 7144568 - DNA, 22 bp, Homo sapiens
cattcaaatgtgccactgtcct

SEQ ID NO: 7144569 - DNA, 22 bp, Homo sapiens
cattcaagagtggacataatgc

SEQ ID NO: 7144570 - DNA, 22 bp, Homo sapiens
cattcacaaaaccacatgccat

SEQ ID NO: 7144571 - DNA, 22 bp, Homo sapiens
cattcacaaaaccacatgccat

SEQ ID NO: 7144572 - DNA, 22 bp, Homo sapiens
cattcacaaaaccacatgccat

SEQ ID NO: 7144573 - DNA, 22 bp, Homo sapiens
cattcacagagggggaagcatc

SEQ ID NO: 7144574 - DNA, 22 bp, Homo sapiens
cattcacagagggggaagcatc

SEQ ID NO: 7144575 - DNA, 22 bp, Homo sapiens
cattcacagagggggaagcatc

SEQ ID NO: 7144576 - DNA, 22 bp, Homo sapiens
cattcacaatggattgcttcaa

SEQ ID NO: 7144577 - DNA, 22 bp, Homo sapiens
cattcacaaagctgattgatgg

SEQ ID NO: 7144578 - DNA, 22 bp, Homo sapiens
cattcacatcttgttccatcac

SEQ ID NO: 7144579 - DNA, 22 bp, Homo sapiens
cattcacatcttgttccatcac

SEQ ID NO: 7144580 - DNA, 22 bp, Homo sapiens
cattcactcagcgatgccagta

SEQ ID NO: 7144581 - DNA, 22 bp, Homo sapiens
cattcactcagcgatgccagta

SEQ ID NO: 7144582 - DNA, 22 bp, Homo sapiens
cattcagagctttcttatcata

SEQ ID NO: 7144583 - DNA, 17 bp, Homo sapiens
cattcagagtaattaca

SEQ ID NO: 7144584 - DNA, 22 bp, Homo sapiens
cattcaggtacactcagtgcta

SEQ ID NO: 7144585 - DNA, 22 bp, Homo sapiens
cattcagtggagtattattcag

SEQ ID NO: 7144586 - DNA, 22 bp, Homo sapiens
cattcataagactttgctcttg

SEQ ID NO: 7144587 - DNA, 22 bp, Homo sapiens
cattcataggaggagatgatta

SEQ ID NO: 7144588 - DNA, 22 bp, Homo sapiens
cattcattcacattttgtctat

SEQ ID NO: 7144589 - DNA, 22 bp, Homo sapiens
cattcattagaatagatatgta

SEQ ID NO: 7144590 - DNA, 22 bp, Homo sapiens
cattcattagaatagatatgta

SEQ ID NO: 7144591 - DNA, 22 bp, Homo sapiens
cattcattagaatagatatgta

SEQ ID NO: 7144592 - DNA, 22 bp, Homo sapiens
cattcaaaggcatgtcctattt

SEQ ID NO: 7144593 - DNA, 22 bp, Homo sapiens
cattatccaacagcactttcca

SEQ ID NO: 7144594 - DNA, 22 bp, Homo sapiens
cattatctcagttgaacttatg

SEQ ID NO: 7144595 - DNA, 22 bp, Homo sapiens
cattatattacagcactgttaa

SEQ ID NO: 7144596 - DNA, 22 bp, Homo sapiens
cattatattttactgcatggga

SEQ ID NO: 7144597 - DNA, 22 bp, Homo sapiens
cattatattttactgcatggga

SEQ ID NO: 7144598 - DNA, 22 bp, Homo sapiens
catgtttctgagaaaagtagga

SEQ ID NO: 7144599 - DNA, 22 bp, Homo sapiens
catgtttgtacaaaggtacaca

SEQ ID NO: 7144600 - DNA, 22 bp, Homo sapiens
catgttttctaggctttcacaa

SEQ ID NO: 7144601 - DNA, 22 bp, Homo sapiens
catgttttctaggctttcacaa

SEQ ID NO: 7144602 - DNA, 22 bp, Homo sapiens
catgttgggaatcagctgagag

SEQ ID NO: 7144603 - DNA, 22 bp, Homo sapiens
catgttgggaatcagctgagag

SEQ ID NO: 7144604 - DNA, 22 bp, Homo sapiens
catgttgggcatgcatatgtgt

SEQ ID NO: 7144605 - DNA, 22 bp, Homo sapiens
catgttggtgtgctgcacccat

SEQ ID NO: 7144606 - DNA, 22 bp, Homo sapiens
catgttggtgtgctgcacccgt

SEQ ID NO: 7144607 - DNA, 22 bp, Homo sapiens
catgttgtatcattctgttcct

SEQ ID NO: 7144608 - DNA, 22 bp, Homo sapiens
catgtttaattgcgatgtttga

SEQ ID NO: 7144609 - DNA, 22 bp, Homo sapiens
catgtttaattgcgatgtttga

SEQ ID NO: 7144610 - DNA, 22 bp, Homo sapiens
catgttatttatccattaaaca

SEQ ID NO: 7144611 - DNA, 22 bp, Homo sapiens
catgttaatgaatttttgcagt

SEQ ID NO: 7144612 - DNA, 19 bp, Homo sapiens
catgttatgctgtagtatc

SEQ ID NO: 7144613 - DNA, 22 bp, Homo sapiens
catgttaagtgtttgataacca

SEQ ID NO: 7144614 - DNA, 22 bp, Homo sapiens
catgttaatatgcattgagtac

SEQ ID NO: 7144615 - DNA, 22 bp, Homo sapiens
catgttaagtgtttgataacca

SEQ ID NO: 7144616 - DNA, 22 bp, Homo sapiens
catgttaagtgtttgataacca

SEQ ID NO: 7144617 - DNA, 22 bp, Homo sapiens
catgttaactaagattaactat

SEQ ID NO: 7144618 - DNA, 22 bp, Homo sapiens
catgttaactaagattaactat

SEQ ID NO: 7144619 - DNA, 22 bp, Homo sapiens
catgttaactaagattaactat

SEQ ID NO: 7144620 - DNA, 22 bp, Homo sapiens
catgttggctgaggctgtattt

SEQ ID NO: 7144621 - DNA, 22 bp, Homo sapiens
catgttggcttgtcacaatgaa

SEQ ID NO: 7144622 - DNA, 22 bp, Homo sapiens
catgttctcttaatgttaacta

SEQ ID NO: 7144623 - DNA, 22 bp, Homo sapiens
catgttggcaaggatacagcag

SEQ ID NO: 7144624 - DNA, 22 bp, Homo sapiens
catgttctaacaatgagaaacc

SEQ ID NO: 7144625 - DNA, 22 bp, Homo sapiens
catgttctaatattgtgacata

SEQ ID NO: 7144626 - DNA, 22 bp, Homo sapiens
tccccagaggtgaggcagcttt

SEQ ID NO: 7144627 - DNA, 22 bp, Homo sapiens
tccccagaggtgaggcagcttt

SEQ ID NO: 7144628 - DNA, 22 bp, Homo sapiens
tccccagaggtgaggcagcttt

SEQ ID NO: 7144629 - DNA, 22 bp, Homo sapiens
tccccagatggccagctacatg

SEQ ID NO: 7144630 - DNA, 22 bp, Homo sapiens
tccccagattcatgtctgctgt

SEQ ID NO: 7144631 - DNA, 19 bp, Homo sapiens
tccccagcacctctgagtc

SEQ ID NO: 7144632 - DNA, 19 bp, Homo sapiens
tccccagcacctctgagtc

SEQ ID NO: 7144633 - DNA, 19 bp, Homo sapiens
tccccagcacctctgagtc

SEQ ID NO: 7144634 - DNA, 19 bp, Homo sapiens
tccccagcacctctgagtc

SEQ ID NO: 7144635 - DNA, 19 bp, Homo sapiens
tccccagcacctctgagtc

SEQ ID NO: 7144636 - DNA, 19 bp, Homo sapiens
tccccagcacctctgagtc

SEQ ID NO: 7144637 - DNA, 22 bp, Homo sapiens
tccccagaggtgaggcagcttt

SEQ ID NO: 7144638 - DNA, 22 bp, Homo sapiens
tccccactgggcctcctctttc

SEQ ID NO: 7144639 - DNA, 22 bp, Homo sapiens
tccccagacagcgggaggcctg

SEQ ID NO: 7144640 - DNA, 22 bp, Homo sapiens
tccccagacagcgggaggcctg

SEQ ID NO: 7144641 - DNA, 22 bp, Homo sapiens
tccccactcctgggcagatgcg

SEQ ID NO: 7144642 - DNA, 22 bp, Homo sapiens
tccccactcctgggcagatgcg

SEQ ID NO: 7144643 - DNA, 22 bp, Homo sapiens
tccccactctctcctggagctt

SEQ ID NO: 7144644 - DNA, 22 bp, Homo sapiens
tccccactctctcctggagctt

SEQ ID NO: 7144645 - DNA, 22 bp, Homo sapiens
tccccactctctcctggagctt

SEQ ID NO: 7144646 - DNA, 22 bp, Homo sapiens
tccccactctctcctggagctt

SEQ ID NO: 7144647 - DNA, 22 bp, Homo sapiens
tccccactctgggccaccacaa

SEQ ID NO: 7144648 - DNA, 22 bp, Homo sapiens
tccccactctgggccaccacaa

SEQ ID NO: 7144649 - DNA, 22 bp, Homo sapiens
tccccactctgggccaccacaa

SEQ ID NO: 7144650 - DNA, 22 bp, Homo sapiens
tccccactctgggccaccacaa

SEQ ID NO: 7144651 - DNA, 22 bp, Homo sapiens
tccccactctgggccaccacaa

SEQ ID NO: 7144652 - DNA, 22 bp, Homo sapiens
tccccactgggcctcctctttc

SEQ ID NO: 7144653 - DNA, 22 bp, Homo sapiens
tccccactgggcctcctctttc

SEQ ID NO: 7144654 - DNA, 22 bp, Homo sapiens
tccccactgggcctcctctttc

SEQ ID NO: 7144655 - DNA, 22 bp, Homo sapiens
tccccagcattgagggtctctc

SEQ ID NO: 7144656 - DNA, 22 bp, Homo sapiens
tccccagcattgagggtctctc

SEQ ID NO: 7144657 - DNA, 22 bp, Homo sapiens
tccccagccgtgaaggagagga

SEQ ID NO: 7144658 - DNA, 22 bp, Homo sapiens
tccccagctctgtgcttccact

SEQ ID NO: 7144659 - DNA, 22 bp, Homo sapiens
tccccagctctgtgcttccact

SEQ ID NO: 7144660 - DNA, 22 bp, Homo sapiens
tccccagctctgtgcttccact

SEQ ID NO: 7144661 - DNA, 22 bp, Homo sapiens
tccccagctctgtgcttccact

SEQ ID NO: 7144662 - DNA, 22 bp, Homo sapiens
tccccagcttgctacttctgct

SEQ ID NO: 7144663 - DNA, 22 bp, Homo sapiens
tccccagcttgctacttctgct

SEQ ID NO: 7144664 - DNA, 22 bp, Homo sapiens
tccccaggaaattctgattctt

SEQ ID NO: 7144665 - DNA, 22 bp, Homo sapiens
tcccgtaggttgctgtagtcgg

SEQ ID NO: 7144666 - DNA, 22 bp, Homo sapiens
tcccgttgatgacggtgcatcc

SEQ ID NO: 7144667 - DNA, 22 bp, Homo sapiens
tccctagaatatctgctgcagc

SEQ ID NO: 7144668 - DNA, 22 bp, Homo sapiens
tccctaggaccccaccttccgc

SEQ ID NO: 7144669 - DNA, 22 bp, Homo sapiens
tccctaggagaattgccgcagc

SEQ ID NO: 7144670 - DNA, 22 bp, Homo sapiens
tccctaggagaattgccgcagc

SEQ ID NO: 7144671 - DNA, 20 bp, Homo sapiens
tccctaggcaggagggcact

SEQ ID NO: 7144672 - DNA, 22 bp, Homo sapiens
cattgcacgggcgtctgtctgt

SEQ ID NO: 7144673 - DNA, 22 bp, Homo sapiens
tcccagggtcctcttctggaat

SEQ ID NO: 7144674 - DNA, 22 bp, Homo sapiens
tcccagggtcctcttctggaat

SEQ ID NO: 7144675 - DNA, 22 bp, Homo sapiens
tccccactcctgggcagatgcg

SEQ ID NO: 7144676 - DNA, 22 bp, Homo sapiens
tccccactcaccactggccaaa

SEQ ID NO: 7144677 - DNA, 22 bp, Homo sapiens
cattgcaccacattgcatccct

SEQ ID NO: 7144678 - DNA, 22 bp, Homo sapiens
cattgacatcaggcttggccaa

SEQ ID NO: 7144679 - DNA, 22 bp, Homo sapiens
cattgaatccttccttcagaag

SEQ ID NO: 7144680 - DNA, 22 bp, Homo sapiens
cattgagaatctgggctacagc

SEQ ID NO: 7144681 - DNA, 22 bp, Homo sapiens
cattgagagaatcacatagaag

SEQ ID NO: 7144682 - DNA, 22 bp, Homo sapiens
cattgagagaatcacatagaag

SEQ ID NO: 7144683 - DNA, 22 bp, Homo sapiens
cattgagaggctgcctgcctga

SEQ ID NO: 7144684 - DNA, 22 bp, Homo sapiens
cattgattatggaaagcagtgg

SEQ ID NO: 7144685 - DNA, 22 bp, Homo sapiens
cattgattatggaaagcagtgg

SEQ ID NO: 7144686 - DNA, 22 bp, Homo sapiens
cattgcaacttcaaactcctgg

SEQ ID NO: 7144687 - DNA, 22 bp, Homo sapiens
cattgcaacttcaaactcctgg

SEQ ID NO: 7144688 - DNA, 22 bp, Homo sapiens
tcccaggatctgagggcagaga

SEQ ID NO: 7144689 - DNA, 22 bp, Homo sapiens
tcccaggatctgagggcagaga

SEQ ID NO: 7144690 - DNA, 22 bp, Homo sapiens
tcccaggagcaccttttgagcc

SEQ ID NO: 7144691 - DNA, 16 bp, Homo sapiens
tcccaggaggcggaac

SEQ ID NO: 7144692 - DNA, 22 bp, Homo sapiens
tcccaggaggtgcttcctagga

SEQ ID NO: 7144693 - DNA, 22 bp, Homo sapiens
tcccaggaggtgcttcctagga

SEQ ID NO: 7144694 - DNA, 22 bp, Homo sapiens
tcccaggaggtgcttcctagga

SEQ ID NO: 7144695 - DNA, 22 bp, Homo sapiens
cattgaaagagataaagccttt

SEQ ID NO: 7144696 - DNA, 22 bp, Homo sapiens
cattgaaacctaacataggctg

SEQ ID NO: 7144697 - DNA, 22 bp, Homo sapiens
cattgaaatatggaaactgatg

SEQ ID NO: 7144698 - DNA, 18 bp, Homo sapiens
cattgacagtatatcttt

SEQ ID NO: 7144699 - DNA, 22 bp, Homo sapiens
cattgaatccttccttcagaag

SEQ ID NO: 7144700 - DNA, 18 bp, Homo sapiens
cattgacagtatatcttt

SEQ ID NO: 7144701 - DNA, 22 bp, Homo sapiens
cattgacagttctttaagttgc

SEQ ID NO: 7144702 - DNA, 22 bp, Homo sapiens
tccctcacctagtctttgactc

SEQ ID NO: 7144703 - DNA, 22 bp, Homo sapiens
tccctataattgcacatccatt

SEQ ID NO: 7144704 - DNA, 22 bp, Homo sapiens
tccctagtcgcatctgtggaga

SEQ ID NO: 7144705 - DNA, 22 bp, Homo sapiens
tccctaggtcctagtcacagta

SEQ ID NO: 7144706 - DNA, 22 bp, Homo sapiens
tccctaggtcctagtcacagta

SEQ ID NO: 7144707 - DNA, 22 bp, Homo sapiens
tcctagaagatggatcagagaa

SEQ ID NO: 7144708 - DNA, 22 bp, Homo sapiens
tcctagaagatggatcagagaa

SEQ ID NO: 7144709 - DNA, 18 bp, Homo sapiens
tcctcagcctcacctagc

SEQ ID NO: 7144710 - DNA, 18 bp, Homo sapiens
tcctcagcctcacctagc

SEQ ID NO: 7144711 - DNA, 18 bp, Homo sapiens
tcctcagcctcacctagc

SEQ ID NO: 7144712 - DNA, 22 bp, Homo sapiens
tccctcagaaattctctctgaa

SEQ ID NO: 7144713 - DNA, 22 bp, Homo sapiens
tccctcagaaattctctctgaa

SEQ ID NO: 7144714 - DNA, 22 bp, Homo sapiens
tccctcagaaattctctctgaa

SEQ ID NO: 7144715 - DNA, 22 bp, Homo sapiens
tccctcagaaattctctctgaa

SEQ ID NO: 7144716 - DNA, 22 bp, Homo sapiens
tcctcaggagagctcctatgcc

SEQ ID NO: 7144717 - DNA, 22 bp, Homo sapiens
tcctcaggagagctcctatgcc

SEQ ID NO: 7144718 - DNA, 22 bp, Homo sapiens
tcctcaggatctaggagtgctt

SEQ ID NO: 7144719 - DNA, 22 bp, Homo sapiens
tcctcaggatctaggagtgctt

SEQ ID NO: 7144720 - DNA, 22 bp, Homo sapiens
tcctcaggatctaggagtgctt

SEQ ID NO: 7144721 - DNA, 22 bp, Homo sapiens
tcctcaggatctaggagtgctt

SEQ ID NO: 7144722 - DNA, 22 bp, Homo sapiens
tcctcaggatgtggagtagaat

SEQ ID NO: 7144723 - DNA, 22 bp, Homo sapiens
tcctcaggatgtggagtagaat

SEQ ID NO: 7144724 - DNA, 22 bp, Homo sapiens
tcctcaggatgtggagtagaat

SEQ ID NO: 7144725 - DNA, 22 bp, Homo sapiens
tcctcaggatgtggagtagaat

SEQ ID NO: 7144726 - DNA, 22 bp, Homo sapiens
tcctcaggatgtggggtagaat

SEQ ID NO: 7144727 - DNA, 22 bp, Homo sapiens
tcctcaggatgtggggtagaat

SEQ ID NO: 7144728 - DNA, 22 bp, Homo sapiens
tcctcaggatgtggggtagaat

SEQ ID NO: 7144729 - DNA, 22 bp, Homo sapiens
tcctcaggcggtgaggaggggc

SEQ ID NO: 7144730 - DNA, 22 bp, Homo sapiens
tcctcaggcggtgaggaggggc

SEQ ID NO: 7144731 - DNA, 22 bp, Homo sapiens
tcctcaggcggtgaggaggggc

SEQ ID NO: 7144732 - DNA, 22 bp, Homo sapiens
tcctcaggctgcctggaagact

SEQ ID NO: 7144733 - DNA, 22 bp, Homo sapiens
tcctcaggctgcctggaagact

SEQ ID NO: 7144734 - DNA, 21 bp, Homo sapiens
tcctctccatgatctgtttgt

SEQ ID NO: 7144735 - DNA, 21 bp, Homo sapiens
tcctctccatgatctgtttgt

SEQ ID NO: 7144736 - DNA, 22 bp, Homo sapiens
tcctctccatgtctcacgccac

SEQ ID NO: 7144737 - DNA, 21 bp, Homo sapiens
tcctctccatgatctgtttgt

SEQ ID NO: 7144738 - DNA, 21 bp, Homo sapiens
tcctctccatgatctgtttgt

SEQ ID NO: 7144739 - DNA, 21 bp, Homo sapiens
tcctctccatgatctgtttgt

SEQ ID NO: 7144740 - DNA, 22 bp, Homo sapiens
tcctctccatattttctgattt

SEQ ID NO: 7144741 - DNA, 22 bp, Homo sapiens
tcctctccatattttctgattt

SEQ ID NO: 7144742 - DNA, 22 bp, Homo sapiens
tcctctccatattttctgattt

SEQ ID NO: 7144743 - DNA, 22 bp, Homo sapiens
tcctctccaggtgagccgaaat

SEQ ID NO: 7144744 - DNA, 22 bp, Homo sapiens
tcctctccatattttctgattt

SEQ ID NO: 7144745 - DNA, 22 bp, Homo sapiens
tcctcccctcagggcaacggat

SEQ ID NO: 7144746 - DNA, 22 bp, Homo sapiens
tcctcccctcagggcaacggat

SEQ ID NO: 7144747 - DNA, 22 bp, Homo sapiens
catttgtatgttcctccttagg

SEQ ID NO: 7144748 - DNA, 22 bp, Homo sapiens
catttgtatcatatgtatctta

SEQ ID NO: 7144749 - DNA, 22 bp, Homo sapiens
catttgtagttaaaaatgtctc

SEQ ID NO: 7144750 - DNA, 22 bp, Homo sapiens
catttgtatagtgcttagacca

SEQ ID NO: 7144751 - DNA, 22 bp, Homo sapiens
catttgtagtatctgtttatat

SEQ ID NO: 7144752 - DNA, 22 bp, Homo sapiens
catttgtacatgttgtcttctt

SEQ ID NO: 7144753 - DNA, 22 bp, Homo sapiens
catttgtactgttcaatgtcat

SEQ ID NO: 7144754 - DNA, 22 bp, Homo sapiens
catttgtacagaacagctttat

SEQ ID NO: 7144755 - DNA, 22 bp, Homo sapiens
catttgtactgttcaatgtcat

SEQ ID NO: 7144756 - DNA, 22 bp, Homo sapiens
catttgtagagtaggaaagagt

SEQ ID NO: 7144757 - DNA, 22 bp, Homo sapiens
catttgtaatactgacttgcag

SEQ ID NO: 7144758 - DNA, 22 bp, Homo sapiens
catttgtaagcatggcgttgga

SEQ ID NO: 7144759 - DNA, 22 bp, Homo sapiens
catttgtacagaacagctttat

SEQ ID NO: 7144760 - DNA, 22 bp, Homo sapiens
tcctcagggaagatgagcctca

SEQ ID NO: 7144761 - DNA, 22 bp, Homo sapiens
tcctcagggaagatgagcctca

SEQ ID NO: 7144762 - DNA, 22 bp, Homo sapiens
tcctcagggaagatgagcctca

SEQ ID NO: 7144763 - DNA, 22 bp, Homo sapiens
tcctcaggctgcctggaagact

SEQ ID NO: 7144764 - DNA, 22 bp, Homo sapiens
tcctcaggctgcctggaagact

SEQ ID NO: 7144765 - DNA, 22 bp, Homo sapiens
tcctcagggaagatgagcctca

SEQ ID NO: 7144766 - DNA, 22 bp, Homo sapiens
catttggaccaaaatagccaac

SEQ ID NO: 7144767 - DNA, 22 bp, Homo sapiens
catttggaccaaaatagccaac

SEQ ID NO: 7144768 - DNA, 22 bp, Homo sapiens
catttggattttgaagagagta

SEQ ID NO: 7144769 - DNA, 22 bp, Homo sapiens
catgtgtggttacctacttgac

SEQ ID NO: 7144770 - DNA, 22 bp, Homo sapiens
catgtgtgtccatgtgactaag

SEQ ID NO: 7144771 - DNA, 22 bp, Homo sapiens
catgtgtccacccttgaacaca

SEQ ID NO: 7144772 - DNA, 22 bp, Homo sapiens
catgtgtgtctccaccagctgc

SEQ ID NO: 7144773 - DNA, 22 bp, Homo sapiens
catgtgtgtgagggaaacatgt

SEQ ID NO: 7144774 - DNA, 22 bp, Homo sapiens
catgtgtgtggacgagcgtggc

SEQ ID NO: 7144775 - DNA, 22 bp, Homo sapiens
catgttaaaatatacattctga

SEQ ID NO: 7144776 - DNA, 22 bp, Homo sapiens
catgttaaaatatacattctga

SEQ ID NO: 7144777 - DNA, 18 bp, Homo sapiens
catgtgttctacatcagt

SEQ ID NO: 7144778 - DNA, 18 bp, Homo sapiens
catgtgttctacatcagt

SEQ ID NO: 7144779 - DNA, 22 bp, Homo sapiens
catgtgttgtctcatttaatcc

SEQ ID NO: 7144780 - DNA, 22 bp, Homo sapiens
tccaggctcccctgcgtgctcc

SEQ ID NO: 7144781 - DNA, 19 bp, Homo sapiens
tccaggctccattggcaga

SEQ ID NO: 7144782 - DNA, 22 bp, Homo sapiens
tccaggctcccctgcgtgctcc

SEQ ID NO: 7144783 - DNA, 19 bp, Homo sapiens
tccaggctccattggcaga

SEQ ID NO: 7144784 - DNA, 19 bp, Homo sapiens
tccaggctccattggcaga

SEQ ID NO: 7144785 - DNA, 22 bp, Homo sapiens
tccaggctcagtcaagcacttc

SEQ ID NO: 7144786 - DNA, 18 bp, Homo sapiens
tccaggctccaggctaac

SEQ ID NO: 7144787 - DNA, 18 bp, Homo sapiens
tccaggctccaggctaac

SEQ ID NO: 7144788 - DNA, 18 bp, Homo sapiens
tccaggctccaggctaac

SEQ ID NO: 7144789 - DNA, 22 bp, Homo sapiens
tccaggctcccctgcgtgctcc

SEQ ID NO: 7144790 - DNA, 22 bp, Homo sapiens
tccaggctcccctgcgtgctcc

SEQ ID NO: 7144791 - DNA, 22 bp, Homo sapiens
tccaggctccctcaggatgcac

SEQ ID NO: 7144792 - DNA, 22 bp, Homo sapiens
tccaggctccctcaggatgcac

SEQ ID NO: 7144793 - DNA, 22 bp, Homo sapiens
tccaggctccctcaggatgcac

SEQ ID NO: 7144794 - DNA, 22 bp, Homo sapiens
tccaggctccctcaggatgcac

SEQ ID NO: 7144795 - DNA, 21 bp, Homo sapiens
catgtgtcattggagagcaat

SEQ ID NO: 7144796 - DNA, 22 bp, Homo sapiens
tccaggcccatggagcagagct

SEQ ID NO: 7144797 - DNA, 22 bp, Homo sapiens
tccaggcccatggagcagagct

SEQ ID NO: 7144798 - DNA, 22 bp, Homo sapiens
tccaggcccatggagcagagct

SEQ ID NO: 7144799 - DNA, 22 bp, Homo sapiens
tccaggccccactgaagcccct

SEQ ID NO: 7144800 - DNA, 22 bp, Homo sapiens
tccaggccccactgaagcccct

SEQ ID NO: 7144801 - DNA, 22 bp, Homo sapiens
tccaggccccactgaagcccct

SEQ ID NO: 7144802 - DNA, 20 bp, Homo sapiens
tccaggcagctcagagtgtc

SEQ ID NO: 7144803 - DNA, 22 bp, Homo sapiens
tccaggcccatagacacttctc

SEQ ID NO: 7144804 - DNA, 22 bp, Homo sapiens
tccaggcccatagacacttctc

SEQ ID NO: 7144805 - DNA, 22 bp, Homo sapiens
tccaggcccatggagcagagct

SEQ ID NO: 7144806 - DNA, 22 bp, Homo sapiens
tccaggcccatggagcagagct

SEQ ID NO: 7144807 - DNA, 22 bp, Homo sapiens
tccaggcccatggagcagagct

SEQ ID NO: 7144808 - DNA, 22 bp, Homo sapiens
tccaggcccatggagcagagct

SEQ ID NO: 7144809 - DNA, 20 bp, Homo sapiens
tccagctgggaacagctgat

SEQ ID NO: 7144810 - DNA, 22 bp, Homo sapiens
tccaggcagcccttcctgactc

SEQ ID NO: 7144811 - DNA, 20 bp, Homo sapiens
tccaggcagctcagagtgtc

SEQ ID NO: 7144812 - DNA, 20 bp, Homo sapiens
tccaggcagctcagagtgtc

SEQ ID NO: 7144813 - DNA, 22 bp, Homo sapiens
tccagctggcctaacttcaggg

SEQ ID NO: 7144814 - DNA, 22 bp, Homo sapiens
tccagctggcctaacttcaggg

SEQ ID NO: 7144815 - DNA, 22 bp, Homo sapiens
tccaggcccgagatgggctgga

SEQ ID NO: 7144816 - DNA, 22 bp, Homo sapiens
tccaggcccctgcctgggcctg

SEQ ID NO: 7144817 - DNA, 22 bp, Homo sapiens
tccaggcccctgcctgggcctg

SEQ ID NO: 7144818 - DNA, 22 bp, Homo sapiens
tccaggcccctgcctgggcctg

SEQ ID NO: 7144819 - DNA, 22 bp, Homo sapiens
tccaggcccctgcctgggcctg

SEQ ID NO: 7144820 - DNA, 22 bp, Homo sapiens
tccaggcccgagatgggctgga

SEQ ID NO: 7144821 - DNA, 22 bp, Homo sapiens
tccaggcccgagatgggctgga

SEQ ID NO: 7144822 - DNA, 22 bp, Homo sapiens
tccaggcccgagatgggctgga

SEQ ID NO: 7144823 - DNA, 22 bp, Homo sapiens
tccaggcccgagatgggctgga

SEQ ID NO: 7144824 - DNA, 22 bp, Homo sapiens
tccaggccccactgaagcccct

SEQ ID NO: 7144825 - DNA, 22 bp, Homo sapiens
tccaggccccagaccgtactgc

SEQ ID NO: 7144826 - DNA, 22 bp, Homo sapiens
tccaggccccagaccgtactgc

SEQ ID NO: 7144827 - DNA, 22 bp, Homo sapiens
tccaggccccagaccgtactgc

SEQ ID NO: 7144828 - DNA, 22 bp, Homo sapiens
tccaggccccagcaccttggga

SEQ ID NO: 7144829 - DNA, 22 bp, Homo sapiens
tccaggccccagcaccttggga

SEQ ID NO: 7144830 - DNA, 22 bp, Homo sapiens
tccaggccccagcaccttggga

SEQ ID NO: 7144831 - DNA, 22 bp, Homo sapiens
tccaggccccagcaccttggga

SEQ ID NO: 7144832 - DNA, 22 bp, Homo sapiens
tccaggccccagcaccttggga

SEQ ID NO: 7144833 - DNA, 22 bp, Homo sapiens
tccaggccccccacgctaatgg

SEQ ID NO: 7144834 - DNA, 22 bp, Homo sapiens
tccaggccccccacgctaatgg

SEQ ID NO: 7144835 - DNA, 22 bp, Homo sapiens
tccaggccccccacgctaatgg

SEQ ID NO: 7144836 - DNA, 22 bp, Homo sapiens
tccaggccccccacgctaatgg

SEQ ID NO: 7144837 - DNA, 22 bp, Homo sapiens
tccaggcccctgcctgggcctg

SEQ ID NO: 7144838 - DNA, 22 bp, Homo sapiens
tccagccctgtggcttccaccc

SEQ ID NO: 7144839 - DNA, 22 bp, Homo sapiens
tccagccctgtgtctgggagag

SEQ ID NO: 7144840 - DNA, 22 bp, Homo sapiens
tccagccctgtgtctgggagag

SEQ ID NO: 7144841 - DNA, 22 bp, Homo sapiens
tccagccctgtgtctgggagag

SEQ ID NO: 7144842 - DNA, 22 bp, Homo sapiens
tccagccctgtgtctgggagag

SEQ ID NO: 7144843 - DNA, 22 bp, Homo sapiens
tccagccgccggccctgcaggt

SEQ ID NO: 7144844 - DNA, 22 bp, Homo sapiens
tccagccgtcacagccacattc

SEQ ID NO: 7144845 - DNA, 22 bp, Homo sapiens
tccagcctaatgttcttcccac

SEQ ID NO: 7144846 - DNA, 22 bp, Homo sapiens
tccagagagccacggacagggg

SEQ ID NO: 7144847 - DNA, 22 bp, Homo sapiens
tccagactggggccatgtctgc

SEQ ID NO: 7144848 - DNA, 19 bp, Homo sapiens
tccagactgtccaggctat

SEQ ID NO: 7144849 - DNA, 22 bp, Homo sapiens
tccagactgttcacattggcat

SEQ ID NO: 7144850 - DNA, 22 bp, Homo sapiens
tccagagaaatctagtcttaca

SEQ ID NO: 7144851 - DNA, 22 bp, Homo sapiens
tccagagaacgatgaaagctgg

SEQ ID NO: 7144852 - DNA, 22 bp, Homo sapiens
tccagagacttgcatgtgcttg

SEQ ID NO: 7144853 - DNA, 22 bp, Homo sapiens
tccagagagaaaaacaagcttt

SEQ ID NO: 7144854 - DNA, 22 bp, Homo sapiens
tccagcctaggggaacagctgc

SEQ ID NO: 7144855 - DNA, 22 bp, Homo sapiens
tccagcctaggggaacagctgc

SEQ ID NO: 7144856 - DNA, 22 bp, Homo sapiens
tccagcctaggggaacagctgc

SEQ ID NO: 7144857 - DNA, 22 bp, Homo sapiens
tccagcctcatttctcctgctt

SEQ ID NO: 7144858 - DNA, 22 bp, Homo sapiens
tccagcctcatttctcctgctt

SEQ ID NO: 7144859 - DNA, 22 bp, Homo sapiens
tccagcctcatttctcctgctt

SEQ ID NO: 7144860 - DNA, 22 bp, Homo sapiens
tccagcctcatttctcctgctt

SEQ ID NO: 7144861 - DNA, 22 bp, Homo sapiens
tccagcctcctatttaccctaa

SEQ ID NO: 7144862 - DNA, 22 bp, Homo sapiens
tccagcctcctatttaccctaa

SEQ ID NO: 7144863 - DNA, 17 bp, Homo sapiens
tccagcctcctctgctg

SEQ ID NO: 7144864 - DNA, 17 bp, Homo sapiens
tccagcctcctctgctg

SEQ ID NO: 7144865 - DNA, 17 bp, Homo sapiens
tccagcctcctctgctg

SEQ ID NO: 7144866 - DNA, 17 bp, Homo sapiens
tccagcctcctctgctg

SEQ ID NO: 7144867 - DNA, 23 bp, Homo sapiens
tccagcctcttgctctcacatgc

SEQ ID NO: 7144868 - DNA, 22 bp, Homo sapiens
tccagctcttcagttctgcaaa

SEQ ID NO: 7144869 - DNA, 22 bp, Homo sapiens
tccagctcttgttgcccactgc

SEQ ID NO: 7144870 - DNA, 22 bp, Homo sapiens
tccagctcttgttgcccactgc

SEQ ID NO: 7144871 - DNA, 22 bp, Homo sapiens
tccagctcttcagttctgcaaa

SEQ ID NO: 7144872 - DNA, 22 bp, Homo sapiens
tccagctcttgttgcccactgc

SEQ ID NO: 7144873 - DNA, 22 bp, Homo sapiens
tccagctgacatctcctgaggg

SEQ ID NO: 7144874 - DNA, 20 bp, Homo sapiens
tccagctgacattctctttc

SEQ ID NO: 7144875 - DNA, 22 bp, Homo sapiens
tccagctgaggtggcctctgtg

SEQ ID NO: 7144876 - DNA, 22 bp, Homo sapiens
tccagctgcaaggggcacagct

SEQ ID NO: 7144877 - DNA, 22 bp, Homo sapiens
tccagctgcaaggggcacagct

SEQ ID NO: 7144878 - DNA, 22 bp, Homo sapiens
tccagctgctagctagatgcaa

SEQ ID NO: 7144879 - DNA, 22 bp, Homo sapiens
tccagctgctagctagatgcaa

SEQ ID NO: 7144880 - DNA, 22 bp, Homo sapiens
tccagctgctgacccagtagcc

SEQ ID NO: 7144881 - DNA, 22 bp, Homo sapiens
tcatgagtggattaatatggct

SEQ ID NO: 7144882 - DNA, 22 bp, Homo sapiens
tcatgagtctgcaaattatgga

SEQ ID NO: 7144883 - DNA, 18 bp, Homo sapiens
tcatgagaatagcagggg

SEQ ID NO: 7144884 - DNA, 18 bp, Homo sapiens
tcatgaggaaggagaaga

SEQ ID NO: 7144885 - DNA, 18 bp, Homo sapiens
tcatgaggtagaggctgg

SEQ ID NO: 7144886 - DNA, 22 bp, Homo sapiens
tcatgagtttaaggtttaggct

SEQ ID NO: 7144887 - DNA, 22 bp, Homo sapiens
tcatgattcttctaccacagca

SEQ ID NO: 7144888 - DNA, 22 bp, Homo sapiens
tcatgatttttctttacagttg

SEQ ID NO: 7144889 - DNA, 22 bp, Homo sapiens
tcatgatttttctttacagttg

SEQ ID NO: 7144890 - DNA, 22 bp, Homo sapiens
tcatgcaaaagacttgaacttt

SEQ ID NO: 7144891 - DNA, 22 bp, Homo sapiens
tcatgcaaactctagtccttta

SEQ ID NO: 7144892 - DNA, 22 bp, Homo sapiens
tcatgcaaagccaattccagct

SEQ ID NO: 7144893 - DNA, 22 bp, Homo sapiens
tcatgcaaagccaattccagct

SEQ ID NO: 7144894 - DNA, 22 bp, Homo sapiens
tcatgcaaatactgttccagaa

SEQ ID NO: 7144895 - DNA, 22 bp, Homo sapiens
tcatgcaaatactgttccagaa

SEQ ID NO: 7144896 - DNA, 22 bp, Homo sapiens
tcatgcaagaataataggaagg

SEQ ID NO: 7144897 - DNA, 22 bp, Homo sapiens
tcatgcaagaataataggaagg

SEQ ID NO: 7144898 - DNA, 22 bp, Homo sapiens
tcatgcaaggctgaaacatggt

SEQ ID NO: 7144899 - DNA, 22 bp, Homo sapiens
tcatgcaaggctgaaacatggt

SEQ ID NO: 7144900 - DNA, 22 bp, Homo sapiens
cataacagtggcttcagcaagt

SEQ ID NO: 7144901 - DNA, 22 bp, Homo sapiens
cataaattgtacccattccaac

SEQ ID NO: 7144902 - DNA, 22 bp, Homo sapiens
cataacacattcatcagcagag

SEQ ID NO: 7144903 - DNA, 22 bp, Homo sapiens
cataacacctgatggcaatgat

SEQ ID NO: 7144904 - DNA, 22 bp, Homo sapiens
tcatcagtttagaaaaaatatg

SEQ ID NO: 7144905 - DNA, 22 bp, Homo sapiens
tcatcataatatggaatcttgt

SEQ ID NO: 7144906 - DNA, 22 bp, Homo sapiens
tcatgaacaaatgatttactaa

SEQ ID NO: 7144907 - DNA, 22 bp, Homo sapiens
tcatgaacatctcaaataacca

SEQ ID NO: 7144908 - DNA, 22 bp, Homo sapiens
tcatgaacatggaatatctttt

SEQ ID NO: 7144909 - DNA, 21 bp, Homo sapiens
tcatgaacattcactgactgc

SEQ ID NO: 7144910 - DNA, 22 bp, Homo sapiens
tcatgaacttcctagccagact

SEQ ID NO: 7144911 - DNA, 22 bp, Homo sapiens
tcatgaacttcctagccagact

SEQ ID NO: 7144912 - DNA, 22 bp, Homo sapiens
tcatgaagtccaaactaaagca

SEQ ID NO: 7144913 - DNA, 22 bp, Homo sapiens
tcatgacaactatattattcca

SEQ ID NO: 7144914 - DNA, 22 bp, Homo sapiens
tcatgacaggtgagtttttagg

SEQ ID NO: 7144915 - DNA, 22 bp, Homo sapiens
tcatgacaggtgagtttttagg

SEQ ID NO: 7144916 - DNA, 22 bp, Homo sapiens
tcatgacatctgtttatctcaa

SEQ ID NO: 7144917 - DNA, 22 bp, Homo sapiens
tcatgacatgtgaattgaatat

SEQ ID NO: 7144918 - DNA, 22 bp, Homo sapiens
catcttttcagaagccattctg

SEQ ID NO: 7144919 - DNA, 22 bp, Homo sapiens
catcttttcagaagccattctg

SEQ ID NO: 7144920 - DNA, 22 bp, Homo sapiens
catcttttggcctattctgagg

SEQ ID NO: 7144921 - DNA, 22 bp, Homo sapiens
catctttgtttcatctgtccag

SEQ ID NO: 7144922 - DNA, 22 bp, Homo sapiens
catctttgtaacttccacataa

SEQ ID NO: 7144923 - DNA, 20 bp, Homo sapiens
catctttggcaggactcctt

SEQ ID NO: 7144924 - DNA, 22 bp, Homo sapiens
catctttgggctgcatggaagg

SEQ ID NO: 7144925 - DNA, 19 bp, Homo sapiens
catctttggtcacctagtc

SEQ ID NO: 7144926 - DNA, 19 bp, Homo sapiens
tcatgcaatcagtgaactg

SEQ ID NO: 7144927 - DNA, 22 bp, Homo sapiens
tcatgcaatctcttgttcagga

SEQ ID NO: 7144928 - DNA, 22 bp, Homo sapiens
tcatgcactatagtgtttgaca

SEQ ID NO: 7144929 - DNA, 19 bp, Homo sapiens
tcatgcactttgatgtaac

SEQ ID NO: 7144930 - DNA, 22 bp, Homo sapiens
catctttggagaaacttccgtt

SEQ ID NO: 7144931 - DNA, 18 bp, Homo sapiens
tcattcattaaacttggc

SEQ ID NO: 7144932 - DNA, 22 bp, Homo sapiens
tcattcattctttctgaatata

SEQ ID NO: 7144933 - DNA, 22 bp, Homo sapiens
tcattcatttgctcactccaca

SEQ ID NO: 7144934 - DNA, 22 bp, Homo sapiens
tcattcatttgctcactccaca

SEQ ID NO: 7144935 - DNA, 22 bp, Homo sapiens
tcatgtgacaggcactgttctg

SEQ ID NO: 7144936 - DNA, 22 bp, Homo sapiens
tcatgtgacaggcactgttctg

SEQ ID NO: 7144937 - DNA, 23 bp, Homo sapiens
tcatgtggaaaaggatctggtct

SEQ ID NO: 7144938 - DNA, 22 bp, Homo sapiens
catgaaaaatttactgttaaca

SEQ ID NO: 7144939 - DNA, 22 bp, Homo sapiens
catcttttggcctattctgagg

SEQ ID NO: 7144940 - DNA, 22 bp, Homo sapiens
catcttttggtaggagccgggc

SEQ ID NO: 7144941 - DNA, 22 bp, Homo sapiens
catgaaaaatttactgttaaca

SEQ ID NO: 7144942 - DNA, 22 bp, Homo sapiens
catgaaaaatttactgttaaca

SEQ ID NO: 7144943 - DNA, 21 bp, Homo sapiens
tcatttattgagaaatgactg

SEQ ID NO: 7144944 - DNA, 21 bp, Homo sapiens
tcatttattgagaaatgactg

SEQ ID NO: 7144945 - DNA, 21 bp, Homo sapiens
tcatttattgagaaatgactg

SEQ ID NO: 7144946 - DNA, 22 bp, Homo sapiens
tcatttatgcaggaatggcata

SEQ ID NO: 7144947 - DNA, 22 bp, Homo sapiens
tcatttatgtctttgccatcca

SEQ ID NO: 7144948 - DNA, 22 bp, Homo sapiens
tcatttatgtctttgccatcca

SEQ ID NO: 7144949 - DNA, 21 bp, Homo sapiens
tcatttattgagaaatgactg

SEQ ID NO: 7144950 - DNA, 21 bp, Homo sapiens
tcatttattgagaaatgactg

SEQ ID NO: 7144951 - DNA, 22 bp, Homo sapiens
tcatttatgcaggaatggcata

SEQ ID NO: 7144952 - DNA, 22 bp, Homo sapiens
tcatttatgcaggaatggcata

SEQ ID NO: 7144953 - DNA, 22 bp, Homo sapiens
tcatttatgcaggaatggcata

SEQ ID NO: 7144954 - DNA, 22 bp, Homo sapiens
tcatttatgcaggaatggcata

SEQ ID NO: 7144955 - DNA, 22 bp, Homo sapiens
tcatttatcgctgccttttaaa

SEQ ID NO: 7144956 - DNA, 22 bp, Homo sapiens
tcatttatcgctgccttttaaa

SEQ ID NO: 7144957 - DNA, 22 bp, Homo sapiens
tcattccttaacattcatttgc

SEQ ID NO: 7144958 - DNA, 22 bp, Homo sapiens
tcattcctccagcgggagtcca

SEQ ID NO: 7144959 - DNA, 22 bp, Homo sapiens
tcattcctcaggaagggattta

SEQ ID NO: 7144960 - DNA, 22 bp, Homo sapiens
tcattccatttccagctctgaa

SEQ ID NO: 7144961 - DNA, 22 bp, Homo sapiens
tcattccttatccgtatctttt

SEQ ID NO: 7144962 - DNA, 22 bp, Homo sapiens
tcattcctttacagttgatcct

SEQ ID NO: 7144963 - DNA, 21 bp, Homo sapiens
tcattcgatttcctctatctc

SEQ ID NO: 7144964 - DNA, 20 bp, Homo sapiens
tcattcgccccagtttaaga

SEQ ID NO: 7144965 - DNA, 22 bp, Homo sapiens
tcattctcagactcttggcctc

SEQ ID NO: 7144966 - DNA, 22 bp, Homo sapiens
tcattctcctctggaaaaggca

SEQ ID NO: 7144967 - DNA, 22 bp, Homo sapiens
tcattctctgggatgcagtttg

SEQ ID NO: 7144968 - DNA, 22 bp, Homo sapiens
tcattctgcatcactcttgctc

SEQ ID NO: 7144969 - DNA, 22 bp, Homo sapiens
tcattctggatgactttctaga

SEQ ID NO: 7144970 - DNA, 22 bp, Homo sapiens
tcattctggatgactttctaga

SEQ ID NO: 7144971 - DNA, 22 bp, Homo sapiens
tcattcttgatcactagttagt

SEQ ID NO: 7144972 - DNA, 22 bp, Homo sapiens
tcattcttgatcactagttagt

SEQ ID NO: 7144973 - DNA, 22 bp, Homo sapiens
tcattcttgatcactagttagt

SEQ ID NO: 7144974 - DNA, 22 bp, Homo sapiens
tcattcttgcgtatgccatggt

SEQ ID NO: 7144975 - DNA, 22 bp, Homo sapiens
tcattctttaccaagttgtcac

SEQ ID NO: 7144976 - DNA, 22 bp, Homo sapiens
tcattgaaaactcagcatctac

SEQ ID NO: 7144977 - DNA, 22 bp, Homo sapiens
tcattgaaagtgcctcctcgga

SEQ ID NO: 7144978 - DNA, 19 bp, Homo sapiens
tcattgaacataattactt

SEQ ID NO: 7144979 - DNA, 22 bp, Homo sapiens
tccacatgacttctaataactg

SEQ ID NO: 7144980 - DNA, 22 bp, Homo sapiens
tccacatgacttctaataactg

SEQ ID NO: 7144981 - DNA, 20 bp, Homo sapiens
tccacatcttttgagatgtg

SEQ ID NO: 7144982 - DNA, 20 bp, Homo sapiens
tccacatcttttgagatgtg

SEQ ID NO: 7144983 - DNA, 22 bp, Homo sapiens
tccacattatgtttctcctttc

SEQ ID NO: 7144984 - DNA, 22 bp, Homo sapiens
tccagacattttatagcagtct

SEQ ID NO: 7144985 - DNA, 22 bp, Homo sapiens
tccagaccaaggaaggctgggc

SEQ ID NO: 7144986 - DNA, 22 bp, Homo sapiens
tccagaccatggatggctgcaa

SEQ ID NO: 7144987 - DNA, 22 bp, Homo sapiens
tccacatagtcattaatttctg

SEQ ID NO: 7144988 - DNA, 22 bp, Homo sapiens
tccacatcaagggcagagaggt

SEQ ID NO: 7144989 - DNA, 22 bp, Homo sapiens
tccacagttttgccactagctg

SEQ ID NO: 7144990 - DNA, 22 bp, Homo sapiens
tccacagtggttgaactagtaa

SEQ ID NO: 7144991 - DNA, 22 bp, Homo sapiens
tccacagtggttgaactagttt

SEQ ID NO: 7144992 - DNA, 22 bp, Homo sapiens
tcatttatttgactttggagtg

SEQ ID NO: 7144993 - DNA, 17 bp, Homo sapiens
tccaagccagcttgcct

SEQ ID NO: 7144994 - DNA, 22 bp, Homo sapiens
tcatttatttataccattgcct

SEQ ID NO: 7144995 - DNA, 22 bp, Homo sapiens
tcatttatttgactttggagtg

SEQ ID NO: 7144996 - DNA, 17 bp, Homo sapiens
tccaagccagcttgcct

SEQ ID NO: 7144997 - DNA, 20 bp, Homo sapiens
tccaagccctccttccattc

SEQ ID NO: 7144998 - DNA, 21 bp, Homo sapiens
tccaagccttcaacacattca

SEQ ID NO: 7144999 - DNA, 22 bp, Homo sapiens
tccacagtctatttttagtcta

SEQ ID NO: 7145000 - DNA, 22 bp, Homo sapiens
tccacaggtcagggagataggc

SEQ ID NO: 7145001 - DNA, 22 bp, Homo sapiens
tccacaggtccggcatgaacag

SEQ ID NO: 7145002 - DNA, 22 bp, Homo sapiens
tccacaggtcctctttgcaaag

SEQ ID NO: 7145003 - DNA, 22 bp, Homo sapiens
tccacaggtatgaggccccacc

SEQ ID NO: 7145004 - DNA, 22 bp, Homo sapiens
tccacaggtatttctccttgct

SEQ ID NO: 7145005 - DNA, 22 bp, Homo sapiens
ccagagaggcaaaactccttcc

SEQ ID NO: 7145006 - DNA, 22 bp, Homo sapiens
ccagagaggcaaaactccttcc

SEQ ID NO: 7145007 - DNA, 22 bp, Homo sapiens
ccagagaggccaaggtcgtggt

SEQ ID NO: 7145008 - DNA, 22 bp, Homo sapiens
ccagagaggccaaggtcgtggt

SEQ ID NO: 7145009 - DNA, 22 bp, Homo sapiens
tctcccacagtctcccatggct

SEQ ID NO: 7145010 - DNA, 22 bp, Homo sapiens
ccagagaggccttggcaagaca

SEQ ID NO: 7145011 - DNA, 22 bp, Homo sapiens
ccagagaggccttggcaagaca

SEQ ID NO: 7145012 - DNA, 22 bp, Homo sapiens
tctccctcattcctgcttccat

SEQ ID NO: 7145013 - DNA, 22 bp, Homo sapiens
tctccctcattcctgcttccat

SEQ ID NO: 7145014 - DNA, 22 bp, Homo sapiens
tctccctctgtaagatcagggg

SEQ ID NO: 7145015 - DNA, 22 bp, Homo sapiens
tctccctctcagatttattcac

SEQ ID NO: 7145016 - DNA, 22 bp, Homo sapiens
tctccctctttgtctgctttgg

SEQ ID NO: 7145017 - DNA, 22 bp, Homo sapiens
tctccctctttgtctgctttgg

SEQ ID NO: 7145018 - DNA, 22 bp, Homo sapiens
tctccctctgtaagatcagggg

SEQ ID NO: 7145019 - DNA, 22 bp, Homo sapiens
tctccctctgtaagatcagggg

SEQ ID NO: 7145020 - DNA, 22 bp, Homo sapiens
tctcccttggtcacagattcct

SEQ ID NO: 7145021 - DNA, 22 bp, Homo sapiens
tctccgggtgcatgtgtgtgcc

SEQ ID NO: 7145022 - DNA, 22 bp, Homo sapiens
tctccgggtggcggcgaaggga

SEQ ID NO: 7145023 - DNA, 22 bp, Homo sapiens
tctcctggccgggctgtcccct

SEQ ID NO: 7145024 - DNA, 22 bp, Homo sapiens
tctccctggagccctgaagcat

SEQ ID NO: 7145025 - DNA, 22 bp, Homo sapiens
tctccctgtggaggacccctta

SEQ ID NO: 7145026 - DNA, 22 bp, Homo sapiens
tctccctgtggaggacccctta

SEQ ID NO: 7145027 - DNA, 20 bp, Homo sapiens
tctccctgcccatctcagat

SEQ ID NO: 7145028 - DNA, 20 bp, Homo sapiens
tctccctgcccatctcagat

SEQ ID NO: 7145029 - DNA, 22 bp, Homo sapiens
tctccctggagccctgaagcat

SEQ ID NO: 7145030 - DNA, 22 bp, Homo sapiens
tctccctggagccctgaagcat

SEQ ID NO: 7145031 - DNA, 22 bp, Homo sapiens
tctccctctttgtctgctttgg

SEQ ID NO: 7145032 - DNA, 22 bp, Homo sapiens
tctccctctttgtctgctttgg

SEQ ID NO: 7145033 - DNA, 23 bp, Homo sapiens
tctccctgaggttgttagcatta

SEQ ID NO: 7145034 - DNA, 21 bp, Homo sapiens
ccagagagagggaagtgggtt

SEQ ID NO: 7145035 - DNA, 21 bp, Homo sapiens
ccagagagagggaagtgggtt

SEQ ID NO: 7145036 - DNA, 22 bp, Homo sapiens
tctccaggaagccctccctgac

SEQ ID NO: 7145037 - DNA, 22 bp, Homo sapiens
tctccaggaaccatcatggtaa

SEQ ID NO: 7145038 - DNA, 22 bp, Homo sapiens
tctccaggaagccctccctgac

SEQ ID NO: 7145039 - DNA, 22 bp, Homo sapiens
tctccaggaagccctccctgac

SEQ ID NO: 7145040 - DNA, 22 bp, Homo sapiens
tctccaggaagccctccctgac

SEQ ID NO: 7145041 - DNA, 22 bp, Homo sapiens
tctccaggaaagacactggact

SEQ ID NO: 7145042 - DNA, 22 bp, Homo sapiens
tctccaggaaagacactggact

SEQ ID NO: 7145043 - DNA, 22 bp, Homo sapiens
tctccaggaaagacactggact

SEQ ID NO: 7145044 - DNA, 22 bp, Homo sapiens
tctccaggaaagacactggact

SEQ ID NO: 7145045 - DNA, 22 bp, Homo sapiens
tctccaggaaccatcatggtaa

SEQ ID NO: 7145046 - DNA, 22 bp, Homo sapiens
tctccaggaaccatcatggtaa

SEQ ID NO: 7145047 - DNA, 20 bp, Homo sapiens
tctccagatgcagatgacat

SEQ ID NO: 7145048 - DNA, 22 bp, Homo sapiens
tctccagaggtcccttgtctct

SEQ ID NO: 7145049 - DNA, 22 bp, Homo sapiens
tctccagaggtcccttgtctct

SEQ ID NO: 7145050 - DNA, 22 bp, Homo sapiens
tctccactattttctagctctt

SEQ ID NO: 7145051 - DNA, 22 bp, Homo sapiens
tctccactctgagtgcctttca

SEQ ID NO: 7145052 - DNA, 18 bp, Homo sapiens
tctccacttctgtgagaa

SEQ ID NO: 7145053 - DNA, 22 bp, Homo sapiens
tctccagaaatggggctgggga

SEQ ID NO: 7145054 - DNA, 21 bp, Homo sapiens
ccagagagagggaagtgggtt

SEQ ID NO: 7145055 - DNA, 21 bp, Homo sapiens
ccagagagagggaagtgggtt

SEQ ID NO: 7145056 - DNA, 21 bp, Homo sapiens
ccagagagagggaagtgggtt

SEQ ID NO: 7145057 - DNA, 22 bp, Homo sapiens
ccagagagctacaaggcataaa

SEQ ID NO: 7145058 - DNA, 22 bp, Homo sapiens
ccagagagattgcttctaaaga

SEQ ID NO: 7145059 - DNA, 22 bp, Homo sapiens
ccagagagattgcttctaaaga

SEQ ID NO: 7145060 - DNA, 22 bp, Homo sapiens
ccagagagagtactgggctctg

SEQ ID NO: 7145061 - DNA, 22 bp, Homo sapiens
ccagagagagtactgggctctg

SEQ ID NO: 7145062 - DNA, 22 bp, Homo sapiens
ccagagagctacaaggcataaa

SEQ ID NO: 7145063 - DNA, 22 bp, Homo sapiens
ccagagagctacaaggcataaa

SEQ ID NO: 7145064 - DNA, 22 bp, Homo sapiens
ccagagagctacaaggcataaa

SEQ ID NO: 7145065 - DNA, 22 bp, Homo sapiens
ccagagagctacaaggcataaa

SEQ ID NO: 7145066 - DNA, 22 bp, Homo sapiens
ccagagagctacaaggcataaa

SEQ ID NO: 7145067 - DNA, 19 bp, Homo sapiens
ccagagagctaggtacaga

SEQ ID NO: 7145068 - DNA, 19 bp, Homo sapiens
ccagagagctaggtacaga

SEQ ID NO: 7145069 - DNA, 19 bp, Homo sapiens
ccagagagctaggtacaga

SEQ ID NO: 7145070 - DNA, 19 bp, Homo sapiens
ccagagagctaggtacaga

SEQ ID NO: 7145071 - DNA, 19 bp, Homo sapiens
ccagagagctaggtacaga

SEQ ID NO: 7145072 - DNA, 22 bp, Homo sapiens
ccacctcctaggcctggagaag

SEQ ID NO: 7145073 - DNA, 22 bp, Homo sapiens
ccacctcctaggcctggagaag

SEQ ID NO: 7145074 - DNA, 22 bp, Homo sapiens
ccacctccacctattgccagcc

SEQ ID NO: 7145075 - DNA, 22 bp, Homo sapiens
ccacctccacctattgccagcc

SEQ ID NO: 7145076 - DNA, 22 bp, Homo sapiens
ccacctccacctattgccagcc

SEQ ID NO: 7145077 - DNA, 22 bp, Homo sapiens
ccacctccacctattgccagcc

SEQ ID NO: 7145078 - DNA, 22 bp, Homo sapiens
ccacctcctaggcctggagaag

SEQ ID NO: 7145079 - DNA, 22 bp, Homo sapiens
ccacctcctcggccatgtgacg

SEQ ID NO: 7145080 - DNA, 22 bp, Homo sapiens
ccacctcctcggccatgtgacg

SEQ ID NO: 7145081 - DNA, 22 bp, Homo sapiens
ccacctcctcggccatgtgacg

SEQ ID NO: 7145082 - DNA, 22 bp, Homo sapiens
ccacctctcagggtttcctaat

SEQ ID NO: 7145083 - DNA, 22 bp, Homo sapiens
ccacctctcagggtttcctaat

SEQ ID NO: 7145084 - DNA, 22 bp, Homo sapiens
tctatattccagatacagatta

SEQ ID NO: 7145085 - DNA, 22 bp, Homo sapiens
tctatattccagatacagatta

SEQ ID NO: 7145086 - DNA, 22 bp, Homo sapiens
tctcaaatgtaaagcatgattt

SEQ ID NO: 7145087 - DNA, 22 bp, Homo sapiens
tctcaaattcccttttcctcct

SEQ ID NO: 7145088 - DNA, 18 bp, Homo sapiens
tctatatggacatagaga

SEQ ID NO: 7145089 - DNA, 22 bp, Homo sapiens
tctcaacaccacttgctgaaga

SEQ ID NO: 7145090 - DNA, 22 bp, Homo sapiens
tctcaacagtgaaatgtgtttg

SEQ ID NO: 7145091 - DNA, 22 bp, Homo sapiens
tctcaacagtgaaatgtgtttg

SEQ ID NO: 7145092 - DNA, 22 bp, Homo sapiens
tctcaaatttgttagataaaat

SEQ ID NO: 7145093 - DNA, 22 bp, Homo sapiens
tctcaaatttgttagataaaat

SEQ ID NO: 7145094 - DNA, 22 bp, Homo sapiens
tctcaaatttatacagagttca

SEQ ID NO: 7145095 - DNA, 22 bp, Homo sapiens
tctcaaattcccttttcctcct

SEQ ID NO: 7145096 - DNA, 22 bp, Homo sapiens
tctcaaattcccttttcctcct

SEQ ID NO: 7145097 - DNA, 22 bp, Homo sapiens
tctcaaatttatacagagttca

SEQ ID NO: 7145098 - DNA, 22 bp, Homo sapiens
tctcaaatttgctggaccagta

SEQ ID NO: 7145099 - DNA, 22 bp, Homo sapiens
tctcaagagggaggcaatcatg

SEQ ID NO: 7145100 - DNA, 22 bp, Homo sapiens
tctcaagactggttttcacagc

SEQ ID NO: 7145101 - DNA, 22 bp, Homo sapiens
tctcaagactggttttcacagc

SEQ ID NO: 7145102 - DNA, 22 bp, Homo sapiens
tctcaagaccccatttatttta

SEQ ID NO: 7145103 - DNA, 21 bp, Homo sapiens
tctcaacttttctctttgggc

SEQ ID NO: 7145104 - DNA, 22 bp, Homo sapiens
tctcaagctagtgtttatagta

SEQ ID NO: 7145105 - DNA, 22 bp, Homo sapiens
tctcaagcttgttggtatgttt

SEQ ID NO: 7145106 - DNA, 23 bp, Homo sapiens
tctcaagcttcactgtgtgttgt

SEQ ID NO: 7145107 - DNA, 22 bp, Homo sapiens
tctccacactttctctcccagg

SEQ ID NO: 7145108 - DNA, 22 bp, Homo sapiens
tctccacaccagaaggagctga

SEQ ID NO: 7145109 - DNA, 22 bp, Homo sapiens
tctccacactttctctcccagg

SEQ ID NO: 7145110 - DNA, 22 bp, Homo sapiens
tctccacaccagaaggagctga

SEQ ID NO: 7145111 - DNA, 22 bp, Homo sapiens
tctccacactttctctcccagg

SEQ ID NO: 7145112 - DNA, 22 bp, Homo sapiens
tctccacaccagaaggagctga

SEQ ID NO: 7145113 - DNA, 22 bp, Homo sapiens
tctccacagaaggttccaggcc

SEQ ID NO: 7145114 - DNA, 22 bp, Homo sapiens
tctccacagaaggttccaggcc

SEQ ID NO: 7145115 - DNA, 22 bp, Homo sapiens
tctccacagtcccacctcgctt

SEQ ID NO: 7145116 - DNA, 22 bp, Homo sapiens
tctccacagtcccacctcgctt

SEQ ID NO: 7145117 - DNA, 22 bp, Homo sapiens
tctccacattctattggctata

SEQ ID NO: 7145118 - DNA, 22 bp, Homo sapiens
tctccacattctattggctata

SEQ ID NO: 7145119 - DNA, 20 bp, Homo sapiens
tctccaccacagagagcaga

SEQ ID NO: 7145120 - DNA, 22 bp, Homo sapiens
tctccactattttctagctctt

SEQ ID NO: 7145121 - DNA, 22 bp, Homo sapiens
ccacttttttctccatctctga

SEQ ID NO: 7145122 - DNA, 22 bp, Homo sapiens
ccagaaaaatcctcccttgtcc

SEQ ID NO: 7145123 - DNA, 22 bp, Homo sapiens
ccagaaaaatcctcccttgtcc

SEQ ID NO: 7145124 - DNA, 22 bp, Homo sapiens
ccagaaaaatcctcccttgtcc

SEQ ID NO: 7145125 - DNA, 22 bp, Homo sapiens
tctccacaagctttctcctttt

SEQ ID NO: 7145126 - DNA, 22 bp, Homo sapiens
tctccacaagtgttgagagtac

SEQ ID NO: 7145127 - DNA, 22 bp, Homo sapiens
tctccacaccagaaggagctga

SEQ ID NO: 7145128 - DNA, 22 bp, Homo sapiens
ccactttttcagtgtgcatgca

SEQ ID NO: 7145129 - DNA, 22 bp, Homo sapiens
ccactttttagagaacaaaact

SEQ ID NO: 7145130 - DNA, 22 bp, Homo sapiens
ccactttttcagtgtgcatgca

SEQ ID NO: 7145131 - DNA, 22 bp, Homo sapiens
ccacttttttctccatctctga

SEQ ID NO: 7145132 - DNA, 22 bp, Homo sapiens
ccacttttttctccatctctga

SEQ ID NO: 7145133 - DNA, 22 bp, Homo sapiens
ccactttttagagaacaaaact

SEQ ID NO: 7145134 - DNA, 22 bp, Homo sapiens
ccacttttgggaacagtgagta

SEQ ID NO: 7145135 - DNA, 22 bp, Homo sapiens
ccacttttgggaacagtgagta

SEQ ID NO: 7145136 - DNA, 22 bp, Homo sapiens
ccacttttgggaacagtgagta

SEQ ID NO: 7145137 - DNA, 22 bp, Homo sapiens
ccacttttctacccactgtgac

SEQ ID NO: 7145138 - DNA, 22 bp, Homo sapiens
ccacttttgggaacagtgagta

SEQ ID NO: 7145139 - DNA, 19 bp, Homo sapiens
ccactttgcttctctgggt

SEQ ID NO: 7145140 - DNA, 22 bp, Homo sapiens
ccactttggcaccttctgccta

SEQ ID NO: 7145141 - DNA, 22 bp, Homo sapiens
ccactttgtaatgtgttatgtt

SEQ ID NO: 7145142 - DNA, 22 bp, Homo sapiens
ccacttttcactaagatgaatt

SEQ ID NO: 7145143 - DNA, 22 bp, Homo sapiens
ccacttttcactaagatgaatt

SEQ ID NO: 7145144 - DNA, 22 bp, Homo sapiens
ccacttttcactaagatgaatt

SEQ ID NO: 7145145 - DNA, 22 bp, Homo sapiens
ccacttttctacccactgtgac

SEQ ID NO: 7145146 - DNA, 22 bp, Homo sapiens
ccacttttctacccactgtgac

SEQ ID NO: 7145147 - DNA, 22 bp, Homo sapiens
ccacttgaaacttagtggcata

SEQ ID NO: 7145148 - DNA, 22 bp, Homo sapiens
ccacttgaaatatctttgttct

SEQ ID NO: 7145149 - DNA, 22 bp, Homo sapiens
ccacttgaatcaaattcttagg

SEQ ID NO: 7145150 - DNA, 22 bp, Homo sapiens
ccacttgaattttagtggtttt

SEQ ID NO: 7145151 - DNA, 22 bp, Homo sapiens
ccacttgacaataaactgagct

SEQ ID NO: 7145152 - DNA, 22 bp, Homo sapiens
ccacttgacattttcattaaga

SEQ ID NO: 7145153 - DNA, 22 bp, Homo sapiens
ccacttgcaaaagagaaagtta

SEQ ID NO: 7145154 - DNA, 22 bp, Homo sapiens
ccacttgtgaaataatcaaata

SEQ ID NO: 7145155 - DNA, 22 bp, Homo sapiens
ccactttgaaccactgaggtgg

SEQ ID NO: 7145156 - DNA, 22 bp, Homo sapiens
ccactttgagaagctgatgaaa

SEQ ID NO: 7145157 - DNA, 22 bp, Homo sapiens
ccactttgcaagatattcagag

SEQ ID NO: 7145158 - DNA, 19 bp, Homo sapiens
ccactttgcagatagtgag

SEQ ID NO: 7145159 - DNA, 18 bp, Homo sapiens
ccactttgcagcctggcc

SEQ ID NO: 7145160 - DNA, 22 bp, Homo sapiens
tcctgactccaggtcctgtgtg

SEQ ID NO: 7145161 - DNA, 20 bp, Homo sapiens
tcctgaatttcctttctgct

SEQ ID NO: 7145162 - DNA, 22 bp, Homo sapiens
ccacatctcggtcccctctttg

SEQ ID NO: 7145163 - DNA, 22 bp, Homo sapiens
ccacatctcttgatgtacctac

SEQ ID NO: 7145164 - DNA, 22 bp, Homo sapiens
ccacatctgcagtcccttctgt

SEQ ID NO: 7145165 - DNA, 22 bp, Homo sapiens
ccacatctgcagtcccttctgt

SEQ ID NO: 7145166 - DNA, 22 bp, Homo sapiens
ccacatctggtggccagtgcta

SEQ ID NO: 7145167 - DNA, 22 bp, Homo sapiens
ccacatctgttcttagttctga

SEQ ID NO: 7145168 - DNA, 22 bp, Homo sapiens
ccacatcttttttcctgaacag

SEQ ID NO: 7145169 - DNA, 22 bp, Homo sapiens
ccacatgaaattgcttatattt

SEQ ID NO: 7145170 - DNA, 22 bp, Homo sapiens
ccacatgatgaggaagctgaac

SEQ ID NO: 7145171 - DNA, 22 bp, Homo sapiens
ccacatgctcaccaagtccctg

SEQ ID NO: 7145172 - DNA, 22 bp, Homo sapiens
ccacatgctcaccaagtccctg

SEQ ID NO: 7145173 - DNA, 22 bp, Homo sapiens
ccacatgctctctctccaggtt

SEQ ID NO: 7145174 - DNA, 22 bp, Homo sapiens
ccacatgctctctctccaggtt

SEQ ID NO: 7145175 - DNA, 22 bp, Homo sapiens
ccacatgctctctctccaggtt

SEQ ID NO: 7145176 - DNA, 22 bp, Homo sapiens
ccacatgtgcactgctgtatgg

SEQ ID NO: 7145177 - DNA, 22 bp, Homo sapiens
ccacatgtgcactgctgtatgg

SEQ ID NO: 7145178 - DNA, 22 bp, Homo sapiens
ccacatggatagatagggacat

SEQ ID NO: 7145179 - DNA, 19 bp, Homo sapiens
ccacatggctggatgacag

SEQ ID NO: 7145180 - DNA, 22 bp, Homo sapiens
ccacatggtcctcatttactct

SEQ ID NO: 7145181 - DNA, 22 bp, Homo sapiens
ccacatgctcttgttacagtgt

SEQ ID NO: 7145182 - DNA, 22 bp, Homo sapiens
ccacatgctcttgttacagtgt

SEQ ID NO: 7145183 - DNA, 22 bp, Homo sapiens
ccacattgactgtctgtagatt

SEQ ID NO: 7145184 - DNA, 22 bp, Homo sapiens
ccacattgactgtctgtagatt

SEQ ID NO: 7145185 - DNA, 22 bp, Homo sapiens
ccacattggcctcagaggttag

SEQ ID NO: 7145186 - DNA, 22 bp, Homo sapiens
ccacattggcctcagaggttag

SEQ ID NO: 7145187 - DNA, 22 bp, Homo sapiens
ccacatttactgatgtatgtat

SEQ ID NO: 7145188 - DNA, 22 bp, Homo sapiens
ccacatttactggatgctcagg

SEQ ID NO: 7145189 - DNA, 22 bp, Homo sapiens
ccacatttggagaagatacttt

SEQ ID NO: 7145190 - DNA, 22 bp, Homo sapiens
tcctgaagtcacaggctctgag

SEQ ID NO: 7145191 - DNA, 22 bp, Homo sapiens
tcctgaataaattagctgtcac

SEQ ID NO: 7145192 - DNA, 22 bp, Homo sapiens
tcctgaatccaggagagtaggg

SEQ ID NO: 7145193 - DNA, 22 bp, Homo sapiens
tcctgaatgagttgatcacaat

SEQ ID NO: 7145194 - DNA, 22 bp, Homo sapiens
tcctgaattcctctttgcatcc

SEQ ID NO: 7145195 - DNA, 22 bp, Homo sapiens
tcctgaattgttgagaagcagc

SEQ ID NO: 7145196 - DNA, 22 bp, Homo sapiens
tcctgaatttcccagcatgaac

SEQ ID NO: 7145197 - DNA, 22 bp, Homo sapiens
tcctgaagtatgggtatggagt

SEQ ID NO: 7145198 - DNA, 22 bp, Homo sapiens
tcctgaagtatgggtatggagt

SEQ ID NO: 7145199 - DNA, 22 bp, Homo sapiens
tcctctgccaaagggagttgcc

SEQ ID NO: 7145200 - DNA, 21 bp, Homo sapiens
tcctctgatcctggatccgca

SEQ ID NO: 7145201 - DNA, 22 bp, Homo sapiens
tcctctgatttgattacctagt

SEQ ID NO: 7145202 - DNA, 21 bp, Homo sapiens
tcctctgcagtgaggtggcct

SEQ ID NO: 7145203 - DNA, 22 bp, Homo sapiens
tcctctgagctcaaaatccagc

SEQ ID NO: 7145204 - DNA, 22 bp, Homo sapiens
tcctctgagtaaagaagattgc

SEQ ID NO: 7145205 - DNA, 18 bp, Homo sapiens
tcctctctttccccaggg

SEQ ID NO: 7145206 - DNA, 18 bp, Homo sapiens
tcctctctttccccaggg

SEQ ID NO: 7145207 - DNA, 18 bp, Homo sapiens
tcctctctttccccaggg

SEQ ID NO: 7145208 - DNA, 22 bp, Homo sapiens
tcctctccatgtctcacgccac

SEQ ID NO: 7145209 - DNA, 22 bp, Homo sapiens
tcctctccatgtctcacgccac

SEQ ID NO: 7145210 - DNA, 22 bp, Homo sapiens
tcctctccatgtctcacgccac

SEQ ID NO: 7145211 - DNA, 22 bp, Homo sapiens
tcctctccatgtctcacgccac

SEQ ID NO: 7145212 - DNA, 22 bp, Homo sapiens
tcctctctgcactggccctgcc

SEQ ID NO: 7145213 - DNA, 22 bp, Homo sapiens
tcctctctgcactggccctgcc

SEQ ID NO: 7145214 - DNA, 21 bp, Homo sapiens
tcctctccatgatctgtttgt

SEQ ID NO: 7145215 - DNA, 18 bp, Homo sapiens
tcctctctttccccaggg

SEQ ID NO: 7145216 - DNA, 18 bp, Homo sapiens
tcctctctttccccaggg

SEQ ID NO: 7145217 - DNA, 18 bp, Homo sapiens
tcctctctttccccaggg

SEQ ID NO: 7145218 - DNA, 18 bp, Homo sapiens
tcctctctttccccaggg

SEQ ID NO: 7145219 - DNA, 18 bp, Homo sapiens
tcctctctttccccaggg

SEQ ID NO: 7145220 - DNA, 22 bp, Homo sapiens
tcctctgaaatgtgtgttcggc

SEQ ID NO: 7145221 - DNA, 22 bp, Homo sapiens
tcctctgaagaaaaggagcagg

SEQ ID NO: 7145222 - DNA, 22 bp, Homo sapiens
tcctctgaagaaaaggagcagg

SEQ ID NO: 7145223 - DNA, 22 bp, Homo sapiens
tcctctgaaggttccgagggag

SEQ ID NO: 7145224 - DNA, 22 bp, Homo sapiens
tcctctgaattcgctctgtgat

SEQ ID NO: 7145225 - DNA, 22 bp, Homo sapiens
tcctctgactcacagcctgggg

SEQ ID NO: 7145226 - DNA, 22 bp, Homo sapiens
tcctctgaaggttccgagggag

SEQ ID NO: 7145227 - DNA, 22 bp, Homo sapiens
ccacccttgggttcggaggccg

SEQ ID NO: 7145228 - DNA, 22 bp, Homo sapiens
ccacccttgggttcggaggccg

SEQ ID NO: 7145229 - DNA, 22 bp, Homo sapiens
ccaccgccatggcgttgtacag

SEQ ID NO: 7145230 - DNA, 22 bp, Homo sapiens
ccacccttgggttcggaggccg

SEQ ID NO: 7145231 - DNA, 22 bp, Homo sapiens
ccacccttccattcttcctctt

SEQ ID NO: 7145232 - DNA, 22 bp, Homo sapiens
ccaccctgtgcaggcgtgggta

SEQ ID NO: 7145233 - DNA, 22 bp, Homo sapiens
ccaccctgtgtttttgccattg

SEQ ID NO: 7145234 - DNA, 23 bp, Homo sapiens
tcggtgggcgtggaggccgaggc

SEQ ID NO: 7145235 - DNA, 22 bp, Homo sapiens
ccaccctggacaggcctctgag

SEQ ID NO: 7145236 - DNA, 22 bp, Homo sapiens
ccaccctggactcgaggcccga

SEQ ID NO: 7145237 - DNA, 22 bp, Homo sapiens
ccaccctgggttctgatgtgga

SEQ ID NO: 7145238 - DNA, 20 bp, Homo sapiens
ccaccctgtccggggcggag

SEQ ID NO: 7145239 - DNA, 22 bp, Homo sapiens
ccaccctgtgcaggcgtgggta

SEQ ID NO: 7145240 - DNA, 22 bp, Homo sapiens
tcgcttgaacccaggaagtgga

SEQ ID NO: 7145241 - DNA, 22 bp, Homo sapiens
tcggaaggggccgcgctcggac

SEQ ID NO: 7145242 - DNA, 22 bp, Homo sapiens
tcggaatgatacataatagtta

SEQ ID NO: 7145243 - DNA, 22 bp, Homo sapiens
tcggagagttggaagtagcaga

SEQ ID NO: 7145244 - DNA, 22 bp, Homo sapiens
tcggagcgtcactggctggagg

SEQ ID NO: 7145245 - DNA, 22 bp, Homo sapiens
tcggagctgtagatgaaaccct

SEQ ID NO: 7145246 - DNA, 22 bp, Homo sapiens
tcggagctgtagatgaaaccct

SEQ ID NO: 7145247 - DNA, 22 bp, Homo sapiens
tcggaggatatcacagagcttt

SEQ ID NO: 7145248 - DNA, 23 bp, Homo sapiens
tcggtgggcgtggaggccgaggc

SEQ ID NO: 7145249 - DNA, 22 bp, Homo sapiens
tcggggtctttgacacgctctg

SEQ ID NO: 7145250 - DNA, 22 bp, Homo sapiens
tcgggctgctcgctgcggaact

SEQ ID NO: 7145251 - DNA, 22 bp, Homo sapiens
tcggggtctttgacacgctctg

SEQ ID NO: 7145252 - DNA, 22 bp, Homo sapiens
tcggagctgtagatgaaaccct

SEQ ID NO: 7145253 - DNA, 22 bp, Homo sapiens
tcggccacggggtttcctccaa

SEQ ID NO: 7145254 - DNA, 22 bp, Homo sapiens
tcgggccataggctaggtccct

SEQ ID NO: 7145255 - DNA, 22 bp, Homo sapiens
tcgggctcgctctcctagcgga

SEQ ID NO: 7145256 - DNA, 22 bp, Homo sapiens
tcgggctcctgcacttggagac

SEQ ID NO: 7145257 - DNA, 22 bp, Homo sapiens
ccaccagcagtgtgcaaggatt

SEQ ID NO: 7145258 - DNA, 22 bp, Homo sapiens
ccaccagctgcatatgcacgta

SEQ ID NO: 7145259 - DNA, 22 bp, Homo sapiens
ccaccagctgcatatgcacgta

SEQ ID NO: 7145260 - DNA, 22 bp, Homo sapiens
ccaccagcttcagcagccgcgg

SEQ ID NO: 7145261 - DNA, 22 bp, Homo sapiens
ccaccagctgcatatgcacgta

SEQ ID NO: 7145262 - DNA, 22 bp, Homo sapiens
ccaccagcttcagcagccgcgg

SEQ ID NO: 7145263 - DNA, 22 bp, Homo sapiens
ccaccagaccaccaagagcaac

SEQ ID NO: 7145264 - DNA, 22 bp, Homo sapiens
ccaccagagcttcgtggcttaa

SEQ ID NO: 7145265 - DNA, 22 bp, Homo sapiens
ccaccagagcttcgtggcttaa

SEQ ID NO: 7145266 - DNA, 22 bp, Homo sapiens
ccaccagagggcagactgtgat

SEQ ID NO: 7145267 - DNA, 22 bp, Homo sapiens
ccaccagcagtgtgcaaggatt

SEQ ID NO: 7145268 - DNA, 22 bp, Homo sapiens
ccaccagcagtgtgcaaggatt

SEQ ID NO: 7145269 - DNA, 22 bp, Homo sapiens
ccaccagcagtgtgcaaggatt

SEQ ID NO: 7145270 - DNA, 22 bp, Homo sapiens
ccaccagcagtgtgcaaggatt

SEQ ID NO: 7145271 - DNA, 22 bp, Homo sapiens
ccaccacttctggcttctggtg

SEQ ID NO: 7145272 - DNA, 22 bp, Homo sapiens
ccaccactgaggcacaggagcc

SEQ ID NO: 7145273 - DNA, 22 bp, Homo sapiens
ccaccacatttgcctagacttt

SEQ ID NO: 7145274 - DNA, 22 bp, Homo sapiens
ccaccactgaggcacaggagcc

SEQ ID NO: 7145275 - DNA, 22 bp, Homo sapiens
ccaccagaagctgggagaagct

SEQ ID NO: 7145276 - DNA, 22 bp, Homo sapiens
ccaccaagtcccactataattt

SEQ ID NO: 7145277 - DNA, 22 bp, Homo sapiens
ccaccacatttgcctagacttt

SEQ ID NO: 7145278 - DNA, 22 bp, Homo sapiens
ccaccacatttgcctagacttt

SEQ ID NO: 7145279 - DNA, 18 bp, Homo sapiens
tcctttcaccccttctct

SEQ ID NO: 7145280 - DNA, 22 bp, Homo sapiens
tcctttccagcctcacctcagc

SEQ ID NO: 7145281 - DNA, 22 bp, Homo sapiens
ccaccaggacagccctgagggg

SEQ ID NO: 7145282 - DNA, 22 bp, Homo sapiens
ccaccaggacagccctgagggg

SEQ ID NO: 7145283 - DNA, 22 bp, Homo sapiens
ccaccagctttgccaccctgct

SEQ ID NO: 7145284 - DNA, 22 bp, Homo sapiens
ccaccagctttgccaccctgct

SEQ ID NO: 7145285 - DNA, 22 bp, Homo sapiens
ccaccagctttgccaccctgct

SEQ ID NO: 7145286 - DNA, 22 bp, Homo sapiens
ccaccagcttcagcagccgcgg

SEQ ID NO: 7145287 - DNA, 22 bp, Homo sapiens
ccaccagctttggcggtgacag

SEQ ID NO: 7145288 - DNA, 22 bp, Homo sapiens
ccaccagctttggcggtgacag

SEQ ID NO: 7145289 - DNA, 22 bp, Homo sapiens
ccaccagctttggcggtgacag

SEQ ID NO: 7145290 - DNA, 22 bp, Homo sapiens
ccaccagctttgccaccctgct

SEQ ID NO: 7145291 - DNA, 22 bp, Homo sapiens
tcgcggggaagtggtgggctaa

SEQ ID NO: 7145292 - DNA, 22 bp, Homo sapiens
tcctttccatgcttctagaggc

SEQ ID NO: 7145293 - DNA, 22 bp, Homo sapiens
tcgcccaggctggagtgcagtg

SEQ ID NO: 7145294 - DNA, 22 bp, Homo sapiens
tcgccccgaggcagccctatgc

SEQ ID NO: 7145295 - DNA, 22 bp, Homo sapiens
tcgctgaggctgcacggctgcc

SEQ ID NO: 7145296 - DNA, 22 bp, Homo sapiens
tcgctgaggctgcacggctgcc

SEQ ID NO: 7145297 - DNA, 22 bp, Homo sapiens
tctcctggctcaccaggctgga

SEQ ID NO: 7145298 - DNA, 22 bp, Homo sapiens
tctcctggctcaccaggctgga

SEQ ID NO: 7145299 - DNA, 22 bp, Homo sapiens
tctcctggctcaccaggctgga

SEQ ID NO: 7145300 - DNA, 22 bp, Homo sapiens
tctcctggctcaccaggctgga

SEQ ID NO: 7145301 - DNA, 22 bp, Homo sapiens
tctcctggccgggctgtcccct

SEQ ID NO: 7145302 - DNA, 22 bp, Homo sapiens
tctcctggcctttaggttaagg

SEQ ID NO: 7145303 - DNA, 22 bp, Homo sapiens
tctcctggccgggctgtcccct

SEQ ID NO: 7145304 - DNA, 22 bp, Homo sapiens
tctcctggccgggctgtcccct

SEQ ID NO: 7145305 - DNA, 23 bp, Homo sapiens
tctcctggctgcactgtggccac

SEQ ID NO: 7145306 - DNA, 23 bp, Homo sapiens
tctcctggctgcactgtggccac

SEQ ID NO: 7145307 - DNA, 23 bp, Homo sapiens
tctcctggctgcactgtggccac

SEQ ID NO: 7145308 - DNA, 22 bp, Homo sapiens
tctcctggctctaaaaggctgt

SEQ ID NO: 7145309 - DNA, 22 bp, Homo sapiens
tctcctggctctaaaaggctgt

SEQ ID NO: 7145310 - DNA, 17 bp, Homo sapiens
tctcctggctctatcag

SEQ ID NO: 7145311 - DNA, 17 bp, Homo sapiens
tctcctggctctatcag

SEQ ID NO: 7145312 - DNA, 23 bp, Homo sapiens
tctctgagttgtactttcccttg

SEQ ID NO: 7145313 - DNA, 22 bp, Homo sapiens
tctctgagttgtaaaaaatagt

SEQ ID NO: 7145314 - DNA, 23 bp, Homo sapiens
tctctgagttgtactttcccttg

SEQ ID NO: 7145315 - DNA, 22 bp, Homo sapiens
tctctgagttctcctccagccc

SEQ ID NO: 7145316 - DNA, 22 bp, Homo sapiens
tctctcttgtcaccccatctgc

SEQ ID NO: 7145317 - DNA, 22 bp, Homo sapiens
tctctcttgtcaccccatctgc

SEQ ID NO: 7145318 - DNA, 23 bp, Homo sapiens
tctcctggctgcactgtggccac

SEQ ID NO: 7145319 - DNA, 22 bp, Homo sapiens
tctctcttgtcaccccatctgc

SEQ ID NO: 7145320 - DNA, 22 bp, Homo sapiens
tctctgagttctcctccagccc

SEQ ID NO: 7145321 - DNA, 22 bp, Homo sapiens
tctctgcatccccagggctctc

SEQ ID NO: 7145322 - DNA, 22 bp, Homo sapiens
tctctgcatgacccaaggctga

SEQ ID NO: 7145323 - DNA, 22 bp, Homo sapiens
tctctgatgacctatgatgttg

SEQ ID NO: 7145324 - DNA, 22 bp, Homo sapiens
tctctgatgctgccagggaaaa

SEQ ID NO: 7145325 - DNA, 22 bp, Homo sapiens
tctctgatgtatatcagagaac

SEQ ID NO: 7145326 - DNA, 22 bp, Homo sapiens
tctctgcaagatgagaaatatt

SEQ ID NO: 7145327 - DNA, 22 bp, Homo sapiens
tctctgcccaagtttctcaagt

SEQ ID NO: 7145328 - DNA, 22 bp, Homo sapiens
tctctgcccaagtttctcaagt

SEQ ID NO: 7145329 - DNA, 22 bp, Homo sapiens
tctctgcccaagtttctcaagt

SEQ ID NO: 7145330 - DNA, 22 bp, Homo sapiens
tctctgcccatcctcagtccac

SEQ ID NO: 7145331 - DNA, 22 bp, Homo sapiens
tctctgcccatcctcagtccac

SEQ ID NO: 7145332 - DNA, 22 bp, Homo sapiens
tctctgcccatcctcagtccac

SEQ ID NO: 7145333 - DNA, 22 bp, Homo sapiens
tctctgcccatcctcagtccac

SEQ ID NO: 7145334 - DNA, 22 bp, Homo sapiens
tctctgccacagcttctgcctt

SEQ ID NO: 7145335 - DNA, 22 bp, Homo sapiens
tctctgccacagcttctgcctt

SEQ ID NO: 7145336 - DNA, 22 bp, Homo sapiens
tctctgcccatgagcaatctgc

SEQ ID NO: 7145337 - DNA, 22 bp, Homo sapiens
tctctgggaaatggagaatttt

SEQ ID NO: 7145338 - DNA, 22 bp, Homo sapiens
tctctgggaatgggcctgggta

SEQ ID NO: 7145339 - DNA, 22 bp, Homo sapiens
tctctgggaatgggcctgggta

SEQ ID NO: 7145340 - DNA, 22 bp, Homo sapiens
tctctgcccatcctcagtccac

SEQ ID NO: 7145341 - DNA, 22 bp, Homo sapiens
tctctgggaatgggcctgggta

SEQ ID NO: 7145342 - DNA, 22 bp, Homo sapiens
tctctgggaattcacaagccct

SEQ ID NO: 7145343 - DNA, 22 bp, Homo sapiens
tctctgggacactgggtcagtt

SEQ ID NO: 7145344 - DNA, 22 bp, Homo sapiens
tctctgggacactgggtcagtt

SEQ ID NO: 7145345 - DNA, 22 bp, Homo sapiens
tctctgggaattttttggacat

SEQ ID NO: 7145346 - DNA, 22 bp, Homo sapiens
tctctgggaattttttggacat

SEQ ID NO: 7145347 - DNA, 22 bp, Homo sapiens
tctctgggacactgggtcagtt

SEQ ID NO: 7145348 - DNA, 22 bp, Homo sapiens
tctctgggacactgggtcagtt

SEQ ID NO: 7145349 - DNA, 22 bp, Homo sapiens
tctctgggacactgggtcagtt

SEQ ID NO: 7145350 - DNA, 22 bp, Homo sapiens
tctctgggagcaattgtttgct

SEQ ID NO: 7145351 - DNA, 22 bp, Homo sapiens
tctctgggagcaattgtttgct

SEQ ID NO: 7145352 - DNA, 22 bp, Homo sapiens
tctctgggagccaggatgacac

SEQ ID NO: 7145353 - DNA, 21 bp, Homo sapiens
tctctgggaggacttgtgaga

SEQ ID NO: 7145354 - DNA, 21 bp, Homo sapiens
tctctgggaggacttgtgaga

SEQ ID NO: 7145355 - DNA, 22 bp, Homo sapiens
tctctgggagccaggatgacac

SEQ ID NO: 7145356 - DNA, 22 bp, Homo sapiens
tctctgggagttgagcagcagc

SEQ ID NO: 7145357 - DNA, 22 bp, Homo sapiens
tctctgggagttgagcagcagc

SEQ ID NO: 7145358 - DNA, 22 bp, Homo sapiens
tctctgggagttgagcagcagc

SEQ ID NO: 7145359 - DNA, 22 bp, Homo sapiens
tctctgggagttgagcagcagc

SEQ ID NO: 7145360 - DNA, 22 bp, Homo sapiens
tctctgggagttgagcagcagc

SEQ ID NO: 7145361 - DNA, 22 bp, Homo sapiens
ccagcagggcagtgccctggac

SEQ ID NO: 7145362 - DNA, 22 bp, Homo sapiens
ccagcagggaaaaacccaccaa

SEQ ID NO: 7145363 - DNA, 22 bp, Homo sapiens
ccagcagggaaaaacccaccaa

SEQ ID NO: 7145364 - DNA, 22 bp, Homo sapiens
ccagcagggcagtgccctggac

SEQ ID NO: 7145365 - DNA, 22 bp, Homo sapiens
ccagcagggcagtgccctggac

SEQ ID NO: 7145366 - DNA, 22 bp, Homo sapiens
ccagcagggaaaaacccaccaa

SEQ ID NO: 7145367 - DNA, 22 bp, Homo sapiens
ccagcagggcagtgccctggac

SEQ ID NO: 7145368 - DNA, 22 bp, Homo sapiens
ccagcagggcagtgccctggac

SEQ ID NO: 7145369 - DNA, 22 bp, Homo sapiens
ccagcagggcagtgccctggac

SEQ ID NO: 7145370 - DNA, 22 bp, Homo sapiens
ccagcagggcagtgccctggac

SEQ ID NO: 7145371 - DNA, 22 bp, Homo sapiens
ccagcagctttattggctctcc

SEQ ID NO: 7145372 - DNA, 22 bp, Homo sapiens
ccagcagctttattggctctcc

SEQ ID NO: 7145373 - DNA, 22 bp, Homo sapiens
ccagcagctttattggctctcc

SEQ ID NO: 7145374 - DNA, 22 bp, Homo sapiens
ccagcagctttattggctctcc

SEQ ID NO: 7145375 - DNA, 22 bp, Homo sapiens
ccagcagctttattggctctcc

SEQ ID NO: 7145376 - DNA, 19 bp, Homo sapiens
ccagcagctttgattctct

SEQ ID NO: 7145377 - DNA, 22 bp, Homo sapiens
ccagcagggaaaaacccaccaa

SEQ ID NO: 7145378 - DNA, 22 bp, Homo sapiens
ccagcagctttattggctctcc

SEQ ID NO: 7145379 - DNA, 22 bp, Homo sapiens
ccagcagctttattggctctcc

SEQ ID NO: 7145380 - DNA, 22 bp, Homo sapiens
ccagcagctttattggctctcc

SEQ ID NO: 7145381 - DNA, 22 bp, Homo sapiens
ccagcagctttattggctctcc

SEQ ID NO: 7145382 - DNA, 21 bp, Homo sapiens
ccagcagctcaaggatctctt

SEQ ID NO: 7145383 - DNA, 21 bp, Homo sapiens
ccagcagctcaaggatctctt

SEQ ID NO: 7145384 - DNA, 22 bp, Homo sapiens
ccagcagctcagctactggtca

SEQ ID NO: 7145385 - DNA, 22 bp, Homo sapiens
ccagcagctcagctactggtca

SEQ ID NO: 7145386 - DNA, 22 bp, Homo sapiens
ccagcagctcagctactggtca

SEQ ID NO: 7145387 - DNA, 22 bp, Homo sapiens
ccagcagctccctcagggtccg

SEQ ID NO: 7145388 - DNA, 22 bp, Homo sapiens
ccagcagctccctcagggtccg

SEQ ID NO: 7145389 - DNA, 22 bp, Homo sapiens
ccagcagctccctcagggtccg

SEQ ID NO: 7145390 - DNA, 22 bp, Homo sapiens
ccagcagctgacaccagtccca

SEQ ID NO: 7145391 - DNA, 22 bp, Homo sapiens
ccagcagctgacaccagtccca

SEQ ID NO: 7145392 - DNA, 22 bp, Homo sapiens
ccagcagctgacaccagtccca

SEQ ID NO: 7145393 - DNA, 22 bp, Homo sapiens
ccagcagctgacaccagtccca

SEQ ID NO: 7145394 - DNA, 22 bp, Homo sapiens
ccagcagctgacaccagtccca

SEQ ID NO: 7145395 - DNA, 22 bp, Homo sapiens
ccagcagctgcaaagcctgggt

SEQ ID NO: 7145396 - DNA, 22 bp, Homo sapiens
ccagcagctgcaaagcctgggt

SEQ ID NO: 7145397 - DNA, 22 bp, Homo sapiens
ccagcagctgcaaagcctgggt

SEQ ID NO: 7145398 - DNA, 22 bp, Homo sapiens
ccagcagctgcaaagcctgggt

SEQ ID NO: 7145399 - DNA, 22 bp, Homo sapiens
ccagcagctgcaaagcctgggt

SEQ ID NO: 7145400 - DNA, 22 bp, Homo sapiens
ccagcagctgcaaagcctgggt

SEQ ID NO: 7145401 - DNA, 22 bp, Homo sapiens
ccagcagctgctatgtggtttt

SEQ ID NO: 7145402 - DNA, 22 bp, Homo sapiens
ccagcagctgctatgtggtttt

SEQ ID NO: 7145403 - DNA, 22 bp, Homo sapiens
ccagcagagtctaggaaggagg

SEQ ID NO: 7145404 - DNA, 22 bp, Homo sapiens
ccagcagagtatcaatgtattt

SEQ ID NO: 7145405 - DNA, 22 bp, Homo sapiens
ccagcagagggtcttggccatt

SEQ ID NO: 7145406 - DNA, 22 bp, Homo sapiens
ccagcagagggtcttggccatt

SEQ ID NO: 7145407 - DNA, 22 bp, Homo sapiens
tctctgggataaactgggccag

SEQ ID NO: 7145408 - DNA, 22 bp, Homo sapiens
tctctgggataaactgggccag

SEQ ID NO: 7145409 - DNA, 22 bp, Homo sapiens
ccagcactgctctcagactgag

SEQ ID NO: 7145410 - DNA, 22 bp, Homo sapiens
ccagcactgctctcagactgag

SEQ ID NO: 7145411 - DNA, 22 bp, Homo sapiens
ccagcactgctctcagactgag

SEQ ID NO: 7145412 - DNA, 22 bp, Homo sapiens
ccagcagagtctaggaaggagg

SEQ ID NO: 7145413 - DNA, 22 bp, Homo sapiens
ccagcagagtggggtttagagt

SEQ ID NO: 7145414 - DNA, 22 bp, Homo sapiens
ccagcagcagcgtccaaggaga

SEQ ID NO: 7145415 - DNA, 22 bp, Homo sapiens
ccagcagcagcgtccaaggaga

SEQ ID NO: 7145416 - DNA, 22 bp, Homo sapiens
ccagcagcaggccaggccctcc

SEQ ID NO: 7145417 - DNA, 22 bp, Homo sapiens
ccagcagcaggccaggccctcc

SEQ ID NO: 7145418 - DNA, 22 bp, Homo sapiens
ccagcagcaggccaggccctcc

SEQ ID NO: 7145419 - DNA, 22 bp, Homo sapiens
ccagcagcaggccaggccctcc

SEQ ID NO: 7145420 - DNA, 22 bp, Homo sapiens
ccagcagcaggccaggccctcc

SEQ ID NO: 7145421 - DNA, 22 bp, Homo sapiens
ccagcagcatcctgcagcactt

SEQ ID NO: 7145422 - DNA, 22 bp, Homo sapiens
ccagcagcatcctgcagcactt

SEQ ID NO: 7145423 - DNA, 22 bp, Homo sapiens
ccagcagcatcctgcagcactt

SEQ ID NO: 7145424 - DNA, 22 bp, Homo sapiens
ccagcagccaccttctcgaaat

SEQ ID NO: 7145425 - DNA, 22 bp, Homo sapiens
ccagcagccaccttctcgaaat

SEQ ID NO: 7145426 - DNA, 22 bp, Homo sapiens
ccagcagccagagaaggacctc

SEQ ID NO: 7145427 - DNA, 22 bp, Homo sapiens
ccagcagccagagaaggacctc

SEQ ID NO: 7145428 - DNA, 22 bp, Homo sapiens
ccagcagccagagaaggacctc

SEQ ID NO: 7145429 - DNA, 22 bp, Homo sapiens
ccagcagcccacaggcgtccct

SEQ ID NO: 7145430 - DNA, 22 bp, Homo sapiens
ccagcagcccacaggcgtccct

SEQ ID NO: 7145431 - DNA, 22 bp, Homo sapiens
ccagcagcccacaggcgtccct

SEQ ID NO: 7145432 - DNA, 22 bp, Homo sapiens
ccagcagccctcttccaagact

SEQ ID NO: 7145433 - DNA, 22 bp, Homo sapiens
ccagcagcgatagggtgagtgc

SEQ ID NO: 7145434 - DNA, 22 bp, Homo sapiens
ccagcagcgatagggtgagtgc

SEQ ID NO: 7145435 - DNA, 22 bp, Homo sapiens
ccagcagcgatagggtgagtgc

SEQ ID NO: 7145436 - DNA, 22 bp, Homo sapiens
ccagcagcgatagggtgagtgc

SEQ ID NO: 7145437 - DNA, 22 bp, Homo sapiens
tctgcagaattcgaggaagaaa

SEQ ID NO: 7145438 - DNA, 22 bp, Homo sapiens
tctgcagaattcgaggaagaaa

SEQ ID NO: 7145439 - DNA, 22 bp, Homo sapiens
tctgcagaagtggctgggccac

SEQ ID NO: 7145440 - DNA, 19 bp, Homo sapiens
tctgcagaaggcatacatg

SEQ ID NO: 7145441 - DNA, 22 bp, Homo sapiens
tctgcagaaggaatcagctgag

SEQ ID NO: 7145442 - DNA, 22 bp, Homo sapiens
tctgcagaagctcactaaatcc

SEQ ID NO: 7145443 - DNA, 22 bp, Homo sapiens
tctgcagaaggaatcagctgag

SEQ ID NO: 7145444 - DNA, 22 bp, Homo sapiens
tctgatatcgcactaaactctg

SEQ ID NO: 7145445 - DNA, 22 bp, Homo sapiens
tctgagagtctctgaggcagat

SEQ ID NO: 7145446 - DNA, 22 bp, Homo sapiens
tctgagagtacgggctgcgcgc

SEQ ID NO: 7145447 - DNA, 22 bp, Homo sapiens
tctgagagtacgggctgcgcgc

SEQ ID NO: 7145448 - DNA, 22 bp, Homo sapiens
tctgagagtagagctgcctctt

SEQ ID NO: 7145449 - DNA, 22 bp, Homo sapiens
tctgagagtccatctccaagcc

SEQ ID NO: 7145450 - DNA, 22 bp, Homo sapiens
tctgagagtctctgaggcagat

SEQ ID NO: 7145451 - DNA, 22 bp, Homo sapiens
ccagcccttgagatggaaggga

SEQ ID NO: 7145452 - DNA, 21 bp, Homo sapiens
tctgagagcaactgcccttta

SEQ ID NO: 7145453 - DNA, 21 bp, Homo sapiens
tctgagagcaactgcccttta

SEQ ID NO: 7145454 - DNA, 22 bp, Homo sapiens
tctgagagcaaggcattagcag

SEQ ID NO: 7145455 - DNA, 22 bp, Homo sapiens
tctgagagcaggaggagctgct

SEQ ID NO: 7145456 - DNA, 22 bp, Homo sapiens
tctgagagcaggaggagctgct

SEQ ID NO: 7145457 - DNA, 22 bp, Homo sapiens
tctgagagcaggaggagctgct

SEQ ID NO: 7145458 - DNA, 22 bp, Homo sapiens
tctgagagcaggaggagctgct

SEQ ID NO: 7145459 - DNA, 22 bp, Homo sapiens
tctgagagcatcactggggtac

SEQ ID NO: 7145460 - DNA, 22 bp, Homo sapiens
tctgagagccactgaacagcaa

SEQ ID NO: 7145461 - DNA, 22 bp, Homo sapiens
tctgagagccactgaacagcaa

SEQ ID NO: 7145462 - DNA, 22 bp, Homo sapiens
tctgagagcctctagcctaagt

SEQ ID NO: 7145463 - DNA, 22 bp, Homo sapiens
tctgagagctctggggcccctt

SEQ ID NO: 7145464 - DNA, 22 bp, Homo sapiens
tctgagagctctggggcccctt

SEQ ID NO: 7145465 - DNA, 22 bp, Homo sapiens
tctgagagctctggggcccctt

SEQ ID NO: 7145466 - DNA, 22 bp, Homo sapiens
tctgagagctgccatctcattt

SEQ ID NO: 7145467 - DNA, 22 bp, Homo sapiens
tctgagagctgccatctcattt

SEQ ID NO: 7145468 - DNA, 22 bp, Homo sapiens
tctgagagctgtagaagcctat

SEQ ID NO: 7145469 - DNA, 22 bp, Homo sapiens
tctgagagctgtagaagcctat

SEQ ID NO: 7145470 - DNA, 22 bp, Homo sapiens
tctgagaggattcctgtcccga

SEQ ID NO: 7145471 - DNA, 22 bp, Homo sapiens
tctgagaggcagaccttcctaa

SEQ ID NO: 7145472 - DNA, 22 bp, Homo sapiens
tctgagaggcatctgcacttct

SEQ ID NO: 7145473 - DNA, 22 bp, Homo sapiens
tctgagaggcatctgcacttct

SEQ ID NO: 7145474 - DNA, 22 bp, Homo sapiens
tctgagaggtgaattcagcaaa

SEQ ID NO: 7145475 - DNA, 22 bp, Homo sapiens
tctgagaggtgaattcagcaaa

SEQ ID NO: 7145476 - DNA, 22 bp, Homo sapiens
tctgagaggttaagcaatttga

SEQ ID NO: 7145477 - DNA, 22 bp, Homo sapiens
ccagccctgtcaccaactggag

SEQ ID NO: 7145478 - DNA, 22 bp, Homo sapiens
ccagccctgtaaggatgaggca

SEQ ID NO: 7145479 - DNA, 22 bp, Homo sapiens
ccagccctgtaaggatgaggca

SEQ ID NO: 7145480 - DNA, 22 bp, Homo sapiens
ccagccctgtaaggatgaggca

SEQ ID NO: 7145481 - DNA, 22 bp, Homo sapiens
ccagccctgtcaccaactggag

SEQ ID NO: 7145482 - DNA, 22 bp, Homo sapiens
ccagccctgtcaccaactggag

SEQ ID NO: 7145483 - DNA, 19 bp, Homo sapiens
ccagccctgtcacttcttg

SEQ ID NO: 7145484 - DNA, 19 bp, Homo sapiens
ccagccctgtcacttcttg

SEQ ID NO: 7145485 - DNA, 22 bp, Homo sapiens
ccagccctgtttatgtgtcact

SEQ ID NO: 7145486 - DNA, 22 bp, Homo sapiens
ccagccctgtttatgtgtcact

SEQ ID NO: 7145487 - DNA, 19 bp, Homo sapiens
ccagccctgtcacttcttg

SEQ ID NO: 7145488 - DNA, 22 bp, Homo sapiens
ccagccctgtttatgtgtcact

SEQ ID NO: 7145489 - DNA, 22 bp, Homo sapiens
ccagcccttagataaacctggc

SEQ ID NO: 7145490 - DNA, 22 bp, Homo sapiens
ccagcccttcccaactggccag

SEQ ID NO: 7145491 - DNA, 22 bp, Homo sapiens
ccagcatgctcagtctaaattg

SEQ ID NO: 7145492 - DNA, 22 bp, Homo sapiens
ccagcatggcacctgagatgag

SEQ ID NO: 7145493 - DNA, 22 bp, Homo sapiens
ccagcatggcacctgagatgag

SEQ ID NO: 7145494 - DNA, 20 bp, Homo sapiens
ccagcatgtacacatgtgga

SEQ ID NO: 7145495 - DNA, 20 bp, Homo sapiens
ccagcatgtacacatgtgga

SEQ ID NO: 7145496 - DNA, 22 bp, Homo sapiens
ccagcatttgcatggtgttaaa

SEQ ID NO: 7145497 - DNA, 22 bp, Homo sapiens
ccagccacagcttccagctcct

SEQ ID NO: 7145498 - DNA, 22 bp, Homo sapiens
ccagccacagcttccagctcct

SEQ ID NO: 7145499 - DNA, 22 bp, Homo sapiens
ccagccacagcttccagctcct

SEQ ID NO: 7145500 - DNA, 22 bp, Homo sapiens
ccagccacagcttccagctcct

SEQ ID NO: 7145501 - DNA, 22 bp, Homo sapiens
ccagccacagcttccagctcct

SEQ ID NO: 7145502 - DNA, 22 bp, Homo sapiens
ccagccacagcttccagctcct

SEQ ID NO: 7145503 - DNA, 22 bp, Homo sapiens
ccagccacgaagctcccttcat

SEQ ID NO: 7145504 - DNA, 22 bp, Homo sapiens
ccagccaccgcttgtttgcact

SEQ ID NO: 7145505 - DNA, 22 bp, Homo sapiens
ccagccctcactgaggcctctc

SEQ ID NO: 7145506 - DNA, 22 bp, Homo sapiens
ccagccctgcctctcagggccc

SEQ ID NO: 7145507 - DNA, 22 bp, Homo sapiens
ccagccctgcctctcagggccc

SEQ ID NO: 7145508 - DNA, 22 bp, Homo sapiens
ccagccctcactgaggcctctc

SEQ ID NO: 7145509 - DNA, 22 bp, Homo sapiens
ccagccctgcctctcagggccc

SEQ ID NO: 7145510 - DNA, 22 bp, Homo sapiens
tctgaatatgtttatcatctct

SEQ ID NO: 7145511 - DNA, 22 bp, Homo sapiens
tctgaatatgtttatcatctct

SEQ ID NO: 7145512 - DNA, 22 bp, Homo sapiens
tctgaatatgtttatcatctct

SEQ ID NO: 7145513 - DNA, 22 bp, Homo sapiens
tctgaatatgtttatcatctct

SEQ ID NO: 7145514 - DNA, 22 bp, Homo sapiens
tctgaatagagagaggtccttt

SEQ ID NO: 7145515 - DNA, 22 bp, Homo sapiens
tctgaatagtatattgaaagca

SEQ ID NO: 7145516 - DNA, 22 bp, Homo sapiens
tctgaatagttctattttaaag

SEQ ID NO: 7145517 - DNA, 22 bp, Homo sapiens
tctgaatagttctattttaaag

SEQ ID NO: 7145518 - DNA, 22 bp, Homo sapiens
tctgaataatgtccttgtatca

SEQ ID NO: 7145519 - DNA, 22 bp, Homo sapiens
tctgaataatgtccttgtatca

SEQ ID NO: 7145520 - DNA, 22 bp, Homo sapiens
tctgaatagagagaggtccttt

SEQ ID NO: 7145521 - DNA, 19 bp, Homo sapiens
tctgaagtccagggcatac

SEQ ID NO: 7145522 - DNA, 22 bp, Homo sapiens
tctgaaggtttgattggagcta

SEQ ID NO: 7145523 - DNA, 18 bp, Homo sapiens
tctgaatattatgcagtg

SEQ ID NO: 7145524 - DNA, 18 bp, Homo sapiens
tctgaatattatgcagtg

SEQ ID NO: 7145525 - DNA, 18 bp, Homo sapiens
tctgaatattatgcagtg

SEQ ID NO: 7145526 - DNA, 22 bp, Homo sapiens
tctgaatgcacttagttaccaa

SEQ ID NO: 7145527 - DNA, 19 bp, Homo sapiens
tctgaatgggatgagttgg

SEQ ID NO: 7145528 - DNA, 22 bp, Homo sapiens
tctgaatgtatcgaattgaggc

SEQ ID NO: 7145529 - DNA, 22 bp, Homo sapiens
tctgaatgtatcgaattgaggc

SEQ ID NO: 7145530 - DNA, 22 bp, Homo sapiens
tctgaatgttaggaaactttct

SEQ ID NO: 7145531 - DNA, 22 bp, Homo sapiens
tctgaatgttaggaaactttct

SEQ ID NO: 7145532 - DNA, 22 bp, Homo sapiens
tctgaattctgacaatttgaat

SEQ ID NO: 7145533 - DNA, 22 bp, Homo sapiens
ccagcatcctcagctcacttct

SEQ ID NO: 7145534 - DNA, 22 bp, Homo sapiens
ccagcatcgacttcctgcctga

SEQ ID NO: 7145535 - DNA, 22 bp, Homo sapiens
ccagcatctaacgctcctggga

SEQ ID NO: 7145536 - DNA, 22 bp, Homo sapiens
ccagcatctatgtgctgttgat

SEQ ID NO: 7145537 - DNA, 22 bp, Homo sapiens
ccagcatctatgtgctgttgat

SEQ ID NO: 7145538 - DNA, 22 bp, Homo sapiens
ccagcatgagacgatgatgaag

SEQ ID NO: 7145539 - DNA, 18 bp, Homo sapiens
ccagcatgccagaggctg

SEQ ID NO: 7145540 - DNA, 18 bp, Homo sapiens
ccagcatgccagaggctg

SEQ ID NO: 7145541 - DNA, 22 bp, Homo sapiens
ccagcaggtgtagggctcatgg

SEQ ID NO: 7145542 - DNA, 19 bp, Homo sapiens
ccagcaggttcatttcagg

SEQ ID NO: 7145543 - DNA, 19 bp, Homo sapiens
ccagcaggttcatttcagg

SEQ ID NO: 7145544 - DNA, 22 bp, Homo sapiens
tctctgtgtgccttcatctgcc

SEQ ID NO: 7145545 - DNA, 22 bp, Homo sapiens
ccagcaggtgtagggctcatgg

SEQ ID NO: 7145546 - DNA, 22 bp, Homo sapiens
ccagcagggttggtttcttctg

SEQ ID NO: 7145547 - DNA, 22 bp, Homo sapiens
ccagcaggggaatatttttagg

SEQ ID NO: 7145548 - DNA, 22 bp, Homo sapiens
ccagcaggtgtagggctcatgg

SEQ ID NO: 7145549 - DNA, 22 bp, Homo sapiens
ccagcaggtgtagggctcatgg

SEQ ID NO: 7145550 - DNA, 22 bp, Homo sapiens
ccagcaggtgtagggctcatgg

SEQ ID NO: 7145551 - DNA, 22 bp, Homo sapiens
tctctgtgtgttggctgtatat

SEQ ID NO: 7145552 - DNA, 22 bp, Homo sapiens
tctctgtgtgtgtgacagcatt

SEQ ID NO: 7145553 - DNA, 22 bp, Homo sapiens
tctctgtgttccctgttttctc

SEQ ID NO: 7145554 - DNA, 22 bp, Homo sapiens
tctcttaaaggtcttcagctga

SEQ ID NO: 7145555 - DNA, 22 bp, Homo sapiens
tctctgttcatggcactatgtc

SEQ ID NO: 7145556 - DNA, 22 bp, Homo sapiens
tctctgttcatggcactatgtc

SEQ ID NO: 7145557 - DNA, 22 bp, Homo sapiens
tcagctttggtcacattgagtt

SEQ ID NO: 7145558 - DNA, 22 bp, Homo sapiens
tcagctttggtcacattgagtt

SEQ ID NO: 7145559 - DNA, 22 bp, Homo sapiens
tcagcttttaaaaacaagaagt

SEQ ID NO: 7145560 - DNA, 22 bp, Homo sapiens
tcagctttgcaagttagaaaat

SEQ ID NO: 7145561 - DNA, 22 bp, Homo sapiens
tcagctttgccaccagctgtaa

SEQ ID NO: 7145562 - DNA, 22 bp, Homo sapiens
tcagctttgatctcaggcaatc

SEQ ID NO: 7145563 - DNA, 22 bp, Homo sapiens
tcagctttgatctcaggcaatc

SEQ ID NO: 7145564 - DNA, 22 bp, Homo sapiens
tcagctttgcaagttagaaaat

SEQ ID NO: 7145565 - DNA, 22 bp, Homo sapiens
tcagctgcataagtcaccttgc

SEQ ID NO: 7145566 - DNA, 22 bp, Homo sapiens
tcagctgccccagtggccccag

SEQ ID NO: 7145567 - DNA, 22 bp, Homo sapiens
tcagctgccccagtggccccag

SEQ ID NO: 7145568 - DNA, 22 bp, Homo sapiens
cagtttatatataagcacattg

SEQ ID NO: 7145569 - DNA, 22 bp, Homo sapiens
tcagctttgatctcaggcaatc

SEQ ID NO: 7145570 - DNA, 22 bp, Homo sapiens
cagtttagcaaatttgtatcaa

SEQ ID NO: 7145571 - DNA, 22 bp, Homo sapiens
cagtttaagtagaactgagaat

SEQ ID NO: 7145572 - DNA, 20 bp, Homo sapiens
cagtttacaacataaattgt

SEQ ID NO: 7145573 - DNA, 22 bp, Homo sapiens
cagtttatagctctagcagctt

SEQ ID NO: 7145574 - DNA, 22 bp, Homo sapiens
cagtttatatataagcacattg

SEQ ID NO: 7145575 - DNA, 22 bp, Homo sapiens
cagtttatagttgttatgtgtg

SEQ ID NO: 7145576 - DNA, 22 bp, Homo sapiens
cagtttatatataagcacattg

SEQ ID NO: 7145577 - DNA, 22 bp, Homo sapiens
cagtttatagttgttatgtgtg

SEQ ID NO: 7145578 - DNA, 22 bp, Homo sapiens
cagtttatatataagcacattg

SEQ ID NO: 7145579 - DNA, 22 bp, Homo sapiens
cagtttatatataagcacattg

SEQ ID NO: 7145580 - DNA, 22 bp, Homo sapiens
tcagcttttgtcagaaattgta

SEQ ID NO: 7145581 - DNA, 22 bp, Homo sapiens
tcagctttttacatgtgaaata

SEQ ID NO: 7145582 - DNA, 22 bp, Homo sapiens
tcaggaaactacagttgaacta

SEQ ID NO: 7145583 - DNA, 21 bp, Homo sapiens
tcaggaaacacctcttaagga

SEQ ID NO: 7145584 - DNA, 22 bp, Homo sapiens
tcaggaaaatactgcttatcca

SEQ ID NO: 7145585 - DNA, 21 bp, Homo sapiens
tcaggaaacacctcttaagga

SEQ ID NO: 7145586 - DNA, 22 bp, Homo sapiens
tcaggaaagagtaatgtataca

SEQ ID NO: 7145587 - DNA, 22 bp, Homo sapiens
tcaggaaagagtaatgtataca

SEQ ID NO: 7145588 - DNA, 22 bp, Homo sapiens
cataaaatggcttgttctttaa

SEQ ID NO: 7145589 - DNA, 22 bp, Homo sapiens
tcaggaaagaagatgctcagtg

SEQ ID NO: 7145590 - DNA, 22 bp, Homo sapiens
tcaggaaactgtcaagtgggat

SEQ ID NO: 7145591 - DNA, 22 bp, Homo sapiens
cataaaatggcttgttctttaa

SEQ ID NO: 7145592 - DNA, 22 bp, Homo sapiens
cataaactctctgtaccaatat

SEQ ID NO: 7145593 - DNA, 22 bp, Homo sapiens
cataaactctctgtaccaatat

SEQ ID NO: 7145594 - DNA, 22 bp, Homo sapiens
cataaactcttgagattcttgt

SEQ ID NO: 7145595 - DNA, 22 bp, Homo sapiens
cataaagtaggcaagcattcca

SEQ ID NO: 7145596 - DNA, 22 bp, Homo sapiens
cataaagtaggcaagcattcca

SEQ ID NO: 7145597 - DNA, 22 bp, Homo sapiens
cataaagtatagatctgtgggt

SEQ ID NO: 7145598 - DNA, 22 bp, Homo sapiens
cataaagtcatgatctgagtat

SEQ ID NO: 7145599 - DNA, 22 bp, Homo sapiens
cataaagtcatgatctgagtat

SEQ ID NO: 7145600 - DNA, 22 bp, Homo sapiens
cataaagtctcataattcactt

SEQ ID NO: 7145601 - DNA, 22 bp, Homo sapiens
cataaagtctcataattcactt

SEQ ID NO: 7145602 - DNA, 22 bp, Homo sapiens
cataaagtgctgggtttaggaa

SEQ ID NO: 7145603 - DNA, 22 bp, Homo sapiens
cataaagtagcagagcatgact

SEQ ID NO: 7145604 - DNA, 22 bp, Homo sapiens
cataaagtaacatggaccttaa

SEQ ID NO: 7145605 - DNA, 22 bp, Homo sapiens
cataaagtagcagagcatgact

SEQ ID NO: 7145606 - DNA, 22 bp, Homo sapiens
cataaagtagcagagcatgact

SEQ ID NO: 7145607 - DNA, 22 bp, Homo sapiens
cataaagtagcagagcatgact

SEQ ID NO: 7145608 - DNA, 22 bp, Homo sapiens
cataaagtagcagagcatgact

SEQ ID NO: 7145609 - DNA, 22 bp, Homo sapiens
cataaagtaaagatgtcttcca

SEQ ID NO: 7145610 - DNA, 22 bp, Homo sapiens
cataaagtaaagatgtcttcca

SEQ ID NO: 7145611 - DNA, 19 bp, Homo sapiens
cataaatgtacaagataca

SEQ ID NO: 7145612 - DNA, 22 bp, Homo sapiens
cataaagttttataggctcaaa

SEQ ID NO: 7145613 - DNA, 22 bp, Homo sapiens
cataaagtgtataagtgaagaa

SEQ ID NO: 7145614 - DNA, 22 bp, Homo sapiens
cataaagttaagctgtaagtat

SEQ ID NO: 7145615 - DNA, 22 bp, Homo sapiens
cataaagttaagctgtaagtat

SEQ ID NO: 7145616 - DNA, 19 bp, Homo sapiens
cataaatgtacaagataca

SEQ ID NO: 7145617 - DNA, 19 bp, Homo sapiens
cataaatgtacaagataca

SEQ ID NO: 7145618 - DNA, 19 bp, Homo sapiens
cataaatgtacaagataca

SEQ ID NO: 7145619 - DNA, 19 bp, Homo sapiens
cataaatgtacaagataca

SEQ ID NO: 7145620 - DNA, 19 bp, Homo sapiens
cataaatgtacaagataca

SEQ ID NO: 7145621 - DNA, 22 bp, Homo sapiens
cataaattcagttctgcctctt

SEQ ID NO: 7145622 - DNA, 22 bp, Homo sapiens
tcagcagacctgttatttggat

SEQ ID NO: 7145623 - DNA, 22 bp, Homo sapiens
tcagcagaatgtggcatgtcac

SEQ ID NO: 7145624 - DNA, 22 bp, Homo sapiens
tcagcagactaggcagattact

SEQ ID NO: 7145625 - DNA, 22 bp, Homo sapiens
tcagcagagctcaggctccagc

SEQ ID NO: 7145626 - DNA, 22 bp, Homo sapiens
tcagcagaggcagactctcctt

SEQ ID NO: 7145627 - DNA, 22 bp, Homo sapiens
tcagcagaggggaaggcatctg

SEQ ID NO: 7145628 - DNA, 22 bp, Homo sapiens
tcagcagaggggaaggcatctg

SEQ ID NO: 7145629 - DNA, 22 bp, Homo sapiens
tcagcagagtggaacattgtca

SEQ ID NO: 7145630 - DNA, 22 bp, Homo sapiens
tcagcagagtttcatcttggga

SEQ ID NO: 7145631 - DNA, 22 bp, Homo sapiens
tcagcagagtttcatcttggga

SEQ ID NO: 7145632 - DNA, 22 bp, Homo sapiens
tcagcagagtttcatcttggga

SEQ ID NO: 7145633 - DNA, 22 bp, Homo sapiens
tcagcagatgggttgtgttggc

SEQ ID NO: 7145634 - DNA, 22 bp, Homo sapiens
tcagcagatgtggtgaaaagtc

SEQ ID NO: 7145635 - DNA, 19 bp, Homo sapiens
tcagcagattttgcaaaca

SEQ ID NO: 7145636 - DNA, 19 bp, Homo sapiens
tcagcagcactgtgatttc

SEQ ID NO: 7145637 - DNA, 23 bp, Homo sapiens
tcagcagcagaagtgctgggatg

SEQ ID NO: 7145638 - DNA, 22 bp, Homo sapiens
tcagcagcagctcagcatgttt

SEQ ID NO: 7145639 - DNA, 22 bp, Homo sapiens
tcagcagcagctcagcatgttt

SEQ ID NO: 7145640 - DNA, 21 bp, Homo sapiens
tcagcagcatctgcctagagt

SEQ ID NO: 7145641 - DNA, 21 bp, Homo sapiens
tcagcagcatctgcctagagt

SEQ ID NO: 7145642 - DNA, 21 bp, Homo sapiens
tcagcagcatctgcctagagt

SEQ ID NO: 7145643 - DNA, 22 bp, Homo sapiens
tcagcagccgcagctgactcag

SEQ ID NO: 7145644 - DNA, 19 bp, Homo sapiens
cagtttaactaattttatc

SEQ ID NO: 7145645 - DNA, 22 bp, Homo sapiens
cagttaaacgggccatgtgagt

SEQ ID NO: 7145646 - DNA, 22 bp, Homo sapiens
cagttaaagctgcatgtgtcag

SEQ ID NO: 7145647 - DNA, 22 bp, Homo sapiens
cagttaaaggcccaatatctgg

SEQ ID NO: 7145648 - DNA, 22 bp, Homo sapiens
cagttaaaggcccaatatctgg

SEQ ID NO: 7145649 - DNA, 22 bp, Homo sapiens
cagttaaaggcccaatatctgg

SEQ ID NO: 7145650 - DNA, 22 bp, Homo sapiens
cagttaaaggcccaatatctgg

SEQ ID NO: 7145651 - DNA, 22 bp, Homo sapiens
cagttaaagtgcttatcacaga

SEQ ID NO: 7145652 - DNA, 22 bp, Homo sapiens
cagttaaagtgcttatcacaga

SEQ ID NO: 7145653 - DNA, 22 bp, Homo sapiens
cagttaaatgatgtgccctaga

SEQ ID NO: 7145654 - DNA, 22 bp, Homo sapiens
cagttaaattctccagttacca

SEQ ID NO: 7145655 - DNA, 22 bp, Homo sapiens
cagttaaattctccagttacca

SEQ ID NO: 7145656 - DNA, 22 bp, Homo sapiens
cagttaaattctccagttacca

SEQ ID NO: 7145657 - DNA, 22 bp, Homo sapiens
cagttaaattctccagttacca

SEQ ID NO: 7145658 - DNA, 22 bp, Homo sapiens
cagttaaatttggctgttttct

SEQ ID NO: 7145659 - DNA, 22 bp, Homo sapiens
cagttaatcttgccattatatc

SEQ ID NO: 7145660 - DNA, 22 bp, Homo sapiens
cagttaacttcatatgatcatt

SEQ ID NO: 7145661 - DNA, 22 bp, Homo sapiens
cagttaatgtcctatacaatag

SEQ ID NO: 7145662 - DNA, 22 bp, Homo sapiens
cagttaatgtcctatacaatag

SEQ ID NO: 7145663 - DNA, 22 bp, Homo sapiens
cagttacatgctcatgtcatca

SEQ ID NO: 7145664 - DNA, 22 bp, Homo sapiens
cagttacattaataatgcacat

SEQ ID NO: 7145665 - DNA, 22 bp, Homo sapiens
cagttacattaataatgcacat

SEQ ID NO: 7145666 - DNA, 22 bp, Homo sapiens
cagttaccagatcgcaggaggt

SEQ ID NO: 7145667 - DNA, 22 bp, Homo sapiens
tcagatgccaactgaacaacag

SEQ ID NO: 7145668 - DNA, 22 bp, Homo sapiens
tcagatgccctttgttttagac

SEQ ID NO: 7145669 - DNA, 21 bp, Homo sapiens
tcagcagaatatgaactgcac

SEQ ID NO: 7145670 - DNA, 21 bp, Homo sapiens
cagttacacaagtgttaccag

SEQ ID NO: 7145671 - DNA, 21 bp, Homo sapiens
cagttacacaagtgttaccag

SEQ ID NO: 7145672 - DNA, 22 bp, Homo sapiens
cagttacacaccattgtgaaca

SEQ ID NO: 7145673 - DNA, 22 bp, Homo sapiens
cagttacacaccattgtgaaca

SEQ ID NO: 7145674 - DNA, 18 bp, Homo sapiens
cagttacaccttcattca

SEQ ID NO: 7145675 - DNA, 22 bp, Homo sapiens
cagttaatgtgggccaagttct

SEQ ID NO: 7145676 - DNA, 18 bp, Homo sapiens
cagttacaccttcattca

SEQ ID NO: 7145677 - DNA, 22 bp, Homo sapiens
cagttacagagccagttagaga

SEQ ID NO: 7145678 - DNA, 22 bp, Homo sapiens
cagttacagagccagttagaga

SEQ ID NO: 7145679 - DNA, 19 bp, Homo sapiens
cagttacagcagctaagac

SEQ ID NO: 7145680 - DNA, 19 bp, Homo sapiens
cagttacagcagctaagac

SEQ ID NO: 7145681 - DNA, 21 bp, Homo sapiens
cagttacagccaggacaaggc

SEQ ID NO: 7145682 - DNA, 21 bp, Homo sapiens
cagttacagccaggacaaggc

SEQ ID NO: 7145683 - DNA, 22 bp, Homo sapiens
cagttacagctgcaccagagcc

SEQ ID NO: 7145684 - DNA, 22 bp, Homo sapiens
cagttacagctgcaccagagcc

SEQ ID NO: 7145685 - DNA, 19 bp, Homo sapiens
cagttacaggcactgtggg

SEQ ID NO: 7145686 - DNA, 19 bp, Homo sapiens
cagttacaggcactgtggg

SEQ ID NO: 7145687 - DNA, 22 bp, Homo sapiens
cagttacataaatgataaaatg

SEQ ID NO: 7145688 - DNA, 22 bp, Homo sapiens
cagttacataaatgataaaatg

SEQ ID NO: 7145689 - DNA, 22 bp, Homo sapiens
cagttacataaatgataaaatg

SEQ ID NO: 7145690 - DNA, 22 bp, Homo sapiens
cagttacatatttagtaggtta

SEQ ID NO: 7145691 - DNA, 22 bp, Homo sapiens
cagttacatatttagtaggtta

SEQ ID NO: 7145692 - DNA, 22 bp, Homo sapiens
cagttacatgctcatgtcatca

SEQ ID NO: 7145693 - DNA, 22 bp, Homo sapiens
tcagagaaaatggaaactttta

SEQ ID NO: 7145694 - DNA, 22 bp, Homo sapiens
tcagagaaaggccaaaatatca

SEQ ID NO: 7145695 - DNA, 22 bp, Homo sapiens
tcagactgtgtcataagtaggt

SEQ ID NO: 7145696 - DNA, 22 bp, Homo sapiens
tcagactgtttgcaccataggc

SEQ ID NO: 7145697 - DNA, 22 bp, Homo sapiens
tcagactgtttgcaccataggc

SEQ ID NO: 7145698 - DNA, 22 bp, Homo sapiens
tcagactggggctccctgagga

SEQ ID NO: 7145699 - DNA, 22 bp, Homo sapiens
tcagactggtgaccctgaatct

SEQ ID NO: 7145700 - DNA, 22 bp, Homo sapiens
tcagactgatcatctatcagat

SEQ ID NO: 7145701 - DNA, 22 bp, Homo sapiens
tcagactgactagtcaatgaaa

SEQ ID NO: 7145702 - DNA, 22 bp, Homo sapiens
tcagactgaccgaagcatctgg

SEQ ID NO: 7145703 - DNA, 22 bp, Homo sapiens
tcagactgaccgaagcatctgg

SEQ ID NO: 7145704 - DNA, 22 bp, Homo sapiens
tcagactgctgtccctgcctgg

SEQ ID NO: 7145705 - DNA, 22 bp, Homo sapiens
tcagactggattttcacgtttt

SEQ ID NO: 7145706 - DNA, 22 bp, Homo sapiens
tcagactgaaagatacacctct

SEQ ID NO: 7145707 - DNA, 19 bp, Homo sapiens
tcagactgaaagtttagat

SEQ ID NO: 7145708 - DNA, 19 bp, Homo sapiens
tcagactgaaagtttagat

SEQ ID NO: 7145709 - DNA, 22 bp, Homo sapiens
cagtgtctccagatgctccaat

SEQ ID NO: 7145710 - DNA, 21 bp, Homo sapiens
tcagagaacccggcaggcaag

SEQ ID NO: 7145711 - DNA, 22 bp, Homo sapiens
cagtgtctcagtttcacttgaa

SEQ ID NO: 7145712 - DNA, 22 bp, Homo sapiens
tcagagaaataattgctgagtt

SEQ ID NO: 7145713 - DNA, 22 bp, Homo sapiens
tcagagaaataattgctgagtt

SEQ ID NO: 7145714 - DNA, 22 bp, Homo sapiens
tcagagaaataattgctgagtt

SEQ ID NO: 7145715 - DNA, 22 bp, Homo sapiens
tcagagaaataattgctgagtt

SEQ ID NO: 7145716 - DNA, 22 bp, Homo sapiens
tcagagaaatgaagtagggatt

SEQ ID NO: 7145717 - DNA, 22 bp, Homo sapiens
tcagagaaatgacaatatatag

SEQ ID NO: 7145718 - DNA, 22 bp, Homo sapiens
tcagagaaatgctgagctcatg

SEQ ID NO: 7145719 - DNA, 22 bp, Homo sapiens
cagtgtgaggaattagtgtcca

SEQ ID NO: 7145720 - DNA, 22 bp, Homo sapiens
cagtgtttccgtcagtatgtga

SEQ ID NO: 7145721 - DNA, 23 bp, Homo sapiens
cagtgtgacgaggtgaggcaggc

SEQ ID NO: 7145722 - DNA, 22 bp, Homo sapiens
cagtgtctttcagactcagaaa

SEQ ID NO: 7145723 - DNA, 22 bp, Homo sapiens
cagtgtctttcagactcagaaa

SEQ ID NO: 7145724 - DNA, 22 bp, Homo sapiens
cagtgtctccagatgctccaat

SEQ ID NO: 7145725 - DNA, 22 bp, Homo sapiens
cagtgtctcccccaggttctgt

SEQ ID NO: 7145726 - DNA, 22 bp, Homo sapiens
cagtgtctgaaataacaccgga

SEQ ID NO: 7145727 - DNA, 22 bp, Homo sapiens
cagtgtctgcctttctgtttgg

SEQ ID NO: 7145728 - DNA, 22 bp, Homo sapiens
cagtgtctgcctttctgtttgg

SEQ ID NO: 7145729 - DNA, 22 bp, Homo sapiens
cagtgtctgggacagaaagtca

SEQ ID NO: 7145730 - DNA, 22 bp, Homo sapiens
cagtgtctgggacagaaagtca

SEQ ID NO: 7145731 - DNA, 22 bp, Homo sapiens
cagtgtctggttggctctacgt

SEQ ID NO: 7145732 - DNA, 22 bp, Homo sapiens
cagtgtcttatttgtagctcag

SEQ ID NO: 7145733 - DNA, 18 bp, Homo sapiens
cagtgtcttggtaaaata

SEQ ID NO: 7145734 - DNA, 18 bp, Homo sapiens
cagtgtcttggtaaaata

SEQ ID NO: 7145735 - DNA, 22 bp, Homo sapiens
cagtgttttgttacttgggcac

SEQ ID NO: 7145736 - DNA, 22 bp, Homo sapiens
cagttaaaagaagtctatctta

SEQ ID NO: 7145737 - DNA, 22 bp, Homo sapiens
cagtgtttgtatagaatatgca

SEQ ID NO: 7145738 - DNA, 22 bp, Homo sapiens
cagttaaaaggtatgctaccaa

SEQ ID NO: 7145739 - DNA, 22 bp, Homo sapiens
cagttaaaatgtgctataagaa

SEQ ID NO: 7145740 - DNA, 22 bp, Homo sapiens
cagttaaacagattgagtgtta

SEQ ID NO: 7145741 - DNA, 22 bp, Homo sapiens
cagttaaacgatgatggggtca

SEQ ID NO: 7145742 - DNA, 22 bp, Homo sapiens
cagttaaacgggccatgtgagt

SEQ ID NO: 7145743 - DNA, 22 bp, Homo sapiens
cagtgggtaaataagtgggtaa

SEQ ID NO: 7145744 - DNA, 22 bp, Homo sapiens
cagtgggtaaataagtgggtaa

SEQ ID NO: 7145745 - DNA, 22 bp, Homo sapiens
cagtgggggtgaggccgaggta

SEQ ID NO: 7145746 - DNA, 22 bp, Homo sapiens
cagtgggggtgaggccgaggta

SEQ ID NO: 7145747 - DNA, 22 bp, Homo sapiens
cagtgggtaggaaaggctcttc

SEQ ID NO: 7145748 - DNA, 22 bp, Homo sapiens
cagtgggtaggaaaggctcttc

SEQ ID NO: 7145749 - DNA, 22 bp, Homo sapiens
cagtgggggggccatgctgcag

SEQ ID NO: 7145750 - DNA, 22 bp, Homo sapiens
cagtggggggactgaggcctga

SEQ ID NO: 7145751 - DNA, 23 bp, Homo sapiens
cagtgggcttctaactgctcctg

SEQ ID NO: 7145752 - DNA, 23 bp, Homo sapiens
cagtgggcttctaactgctcctg

SEQ ID NO: 7145753 - DNA, 22 bp, Homo sapiens
cagtggggaggccaggatagaa

SEQ ID NO: 7145754 - DNA, 22 bp, Homo sapiens
cagtggggaggccaggatagaa

SEQ ID NO: 7145755 - DNA, 22 bp, Homo sapiens
cagtggggaggccaggatagaa

SEQ ID NO: 7145756 - DNA, 22 bp, Homo sapiens
cagtgggaatgaagtggaggcc

SEQ ID NO: 7145757 - DNA, 22 bp, Homo sapiens
cagtgggaatgaagtggaggcc

SEQ ID NO: 7145758 - DNA, 22 bp, Homo sapiens
cagtgggaatgaagtggaggcc

SEQ ID NO: 7145759 - DNA, 22 bp, Homo sapiens
cagtgggacatgggcactgggc

SEQ ID NO: 7145760 - DNA, 22 bp, Homo sapiens
cagtgggacatgggcactgggc

SEQ ID NO: 7145761 - DNA, 22 bp, Homo sapiens
cagtgggacatgggcactgggc

SEQ ID NO: 7145762 - DNA, 22 bp, Homo sapiens
cagtgggaagggcagaggcttt

SEQ ID NO: 7145763 - DNA, 22 bp, Homo sapiens
cagtgggaaagtgaagagcatt

SEQ ID NO: 7145764 - DNA, 22 bp, Homo sapiens
cagtgggaagaatgcagcctcc

SEQ ID NO: 7145765 - DNA, 22 bp, Homo sapiens
cagtgggaagaatgcagcctcc

SEQ ID NO: 7145766 - DNA, 22 bp, Homo sapiens
cagtgggattgggattggaacc

SEQ ID NO: 7145767 - DNA, 21 bp, Homo sapiens
cagtgggctgctgcgctccag

SEQ ID NO: 7145768 - DNA, 22 bp, Homo sapiens
cagtgggctgtgatggattcac

SEQ ID NO: 7145769 - DNA, 22 bp, Homo sapiens
cagtgggacatgggcactgggc

SEQ ID NO: 7145770 - DNA, 22 bp, Homo sapiens
cagtgggagcaaatacactcat

SEQ ID NO: 7145771 - DNA, 22 bp, Homo sapiens
cagtgggatatgggggcagcat

SEQ ID NO: 7145772 - DNA, 22 bp, Homo sapiens
cagtgggatatgggggcagcat

SEQ ID NO: 7145773 - DNA, 22 bp, Homo sapiens
cagtggctgtttctggaaggca

SEQ ID NO: 7145774 - DNA, 22 bp, Homo sapiens
cagtggcttacaatgaactaga

SEQ ID NO: 7145775 - DNA, 22 bp, Homo sapiens
cagtggctgtttctggaaggca

SEQ ID NO: 7145776 - DNA, 22 bp, Homo sapiens
cagtggcttctcatgtcattca

SEQ ID NO: 7145777 - DNA, 22 bp, Homo sapiens
cagtggcttctcatgtcattca

SEQ ID NO: 7145778 - DNA, 20 bp, Homo sapiens
cagtggcttctgtggaatat

SEQ ID NO: 7145779 - DNA, 20 bp, Homo sapiens
cagtggcttctgtggaatat

SEQ ID NO: 7145780 - DNA, 22 bp, Homo sapiens
cagtggcttcttcctagagcca

SEQ ID NO: 7145781 - DNA, 22 bp, Homo sapiens
cagtggcttcttcctagagcca

SEQ ID NO: 7145782 - DNA, 22 bp, Homo sapiens
cagtggctgtgaccagggacct

SEQ ID NO: 7145783 - DNA, 22 bp, Homo sapiens
cagtggctgtgaccagggacct

SEQ ID NO: 7145784 - DNA, 22 bp, Homo sapiens
cagtggctgtgaccagggacct

SEQ ID NO: 7145785 - DNA, 22 bp, Homo sapiens
cagtggctggttagggacagga

SEQ ID NO: 7145786 - DNA, 22 bp, Homo sapiens
cagtggctggttagggacagga

SEQ ID NO: 7145787 - DNA, 21 bp, Homo sapiens
cagtggcagttcttgcctctg

SEQ ID NO: 7145788 - DNA, 22 bp, Homo sapiens
cagtggcatacttggctgatat

SEQ ID NO: 7145789 - DNA, 22 bp, Homo sapiens
cagtggctgagagtggacactg

SEQ ID NO: 7145790 - DNA, 22 bp, Homo sapiens
cagtgcccaagatgtgccatgc

SEQ ID NO: 7145791 - DNA, 22 bp, Homo sapiens
cagtggcaggggaagcaggtgt

SEQ ID NO: 7145792 - DNA, 22 bp, Homo sapiens
cagtgccaggagacaagatcag

SEQ ID NO: 7145793 - DNA, 22 bp, Homo sapiens
cagtgccatattgaaagacatt

SEQ ID NO: 7145794 - DNA, 22 bp, Homo sapiens
cagtgccatgatgcagagcaat

SEQ ID NO: 7145795 - DNA, 22 bp, Homo sapiens
cagtgccacttaatgaggctgc

SEQ ID NO: 7145796 - DNA, 18 bp, Homo sapiens
tcacagacttactgggcc

SEQ ID NO: 7145797 - DNA, 22 bp, Homo sapiens
tcacagacttgtctccagggat

SEQ ID NO: 7145798 - DNA, 22 bp, Homo sapiens
tcacagagaaaagctatcacaa

SEQ ID NO: 7145799 - DNA, 22 bp, Homo sapiens
tcacagacttgtctccagggat

SEQ ID NO: 7145800 - DNA, 22 bp, Homo sapiens
tcacagactgtgttgctactca

SEQ ID NO: 7145801 - DNA, 18 bp, Homo sapiens
tcacagacttactgggcc

SEQ ID NO: 7145802 - DNA, 22 bp, Homo sapiens
tcacagactcttgattgtctaa

SEQ ID NO: 7145803 - DNA, 22 bp, Homo sapiens
tcacagactggtcagtcaactt

SEQ ID NO: 7145804 - DNA, 21 bp, Homo sapiens
tcacagactggtcagtgaggc

SEQ ID NO: 7145805 - DNA, 21 bp, Homo sapiens
tcacagactggtcagtgaggc

SEQ ID NO: 7145806 - DNA, 22 bp, Homo sapiens
tcacagagaaaagctatcacaa

SEQ ID NO: 7145807 - DNA, 22 bp, Homo sapiens
tcacagagaaatgtggcacaaa

SEQ ID NO: 7145808 - DNA, 22 bp, Homo sapiens
tcacagagaaatgtggcacaaa

SEQ ID NO: 7145809 - DNA, 22 bp, Homo sapiens
tcacagagaaatgtggcacaaa

SEQ ID NO: 7145810 - DNA, 22 bp, Homo sapiens
tcacagagaactataatccatc

SEQ ID NO: 7145811 - DNA, 22 bp, Homo sapiens
tcacagagaaatgtggcacaaa

SEQ ID NO: 7145812 - DNA, 22 bp, Homo sapiens
tcacagagaactataatccatc

SEQ ID NO: 7145813 - DNA, 22 bp, Homo sapiens
tcacagctgttttgtccattaa

SEQ ID NO: 7145814 - DNA, 22 bp, Homo sapiens
tcacagctttcagattgttccc

SEQ ID NO: 7145815 - DNA, 22 bp, Homo sapiens
tcacagctttgagcagagacca

SEQ ID NO: 7145816 - DNA, 22 bp, Homo sapiens
tcacaggaaccatcagagaaat

SEQ ID NO: 7145817 - DNA, 22 bp, Homo sapiens
tcacaggaaccatcagagaaat

SEQ ID NO: 7145818 - DNA, 22 bp, Homo sapiens
tcacaggaagaggtgtctatct

SEQ ID NO: 7145819 - DNA, 22 bp, Homo sapiens
tcacaggaagggtaaatattta

SEQ ID NO: 7145820 - DNA, 22 bp, Homo sapiens
tcacaggaccctgagggtggcg

SEQ ID NO: 7145821 - DNA, 22 bp, Homo sapiens
tcacaggaccctgagggtggcg

SEQ ID NO: 7145822 - DNA, 22 bp, Homo sapiens
tcacaggaccctgagggtggcg

SEQ ID NO: 7145823 - DNA, 22 bp, Homo sapiens
tcacaggaccctgagggtggcg

SEQ ID NO: 7145824 - DNA, 22 bp, Homo sapiens
tcacaggagaatgtacttacca

SEQ ID NO: 7145825 - DNA, 22 bp, Homo sapiens
tcacaggagagctgatgctggt

SEQ ID NO: 7145826 - DNA, 22 bp, Homo sapiens
tcacaggagattatgtgtgcta

SEQ ID NO: 7145827 - DNA, 22 bp, Homo sapiens
tcacaggagattatgtgtgcta

SEQ ID NO: 7145828 - DNA, 22 bp, Homo sapiens
tcacaggagcccaggggagctg

SEQ ID NO: 7145829 - DNA, 22 bp, Homo sapiens
tcacaggaggaacctggcctgg

SEQ ID NO: 7145830 - DNA, 22 bp, Homo sapiens
tcacaggaggaacctggcctgg

SEQ ID NO: 7145831 - DNA, 22 bp, Homo sapiens
tcacagttatagtctgtagaat

SEQ ID NO: 7145832 - DNA, 22 bp, Homo sapiens
tcacagttcaaaccccatatct

SEQ ID NO: 7145833 - DNA, 22 bp, Homo sapiens
tcacagttatgggccttggtca

SEQ ID NO: 7145834 - DNA, 22 bp, Homo sapiens
tcacagttcaactagttcagat

SEQ ID NO: 7145835 - DNA, 21 bp, Homo sapiens
tcacagttcaagatgaacccc

SEQ ID NO: 7145836 - DNA, 22 bp, Homo sapiens
tcacagttcatctgataaacta

SEQ ID NO: 7145837 - DNA, 22 bp, Homo sapiens
tcacagttctagaggtaagcag

SEQ ID NO: 7145838 - DNA, 22 bp, Homo sapiens
tcacagttctagaggtaagcag

SEQ ID NO: 7145839 - DNA, 22 bp, Homo sapiens
tcacagttgagcaggttgtgca

SEQ ID NO: 7145840 - DNA, 22 bp, Homo sapiens
tcacagttgattgaaacacagc

SEQ ID NO: 7145841 - DNA, 21 bp, Homo sapiens
tcacagttggccaggcattta

SEQ ID NO: 7145842 - DNA, 17 bp, Homo sapiens
tcacagttggtctcagt

SEQ ID NO: 7145843 - DNA, 17 bp, Homo sapiens
tcacagttggtctcagt

SEQ ID NO: 7145844 - DNA, 22 bp, Homo sapiens
tcacagtttccataggtcagca

SEQ ID NO: 7145845 - DNA, 22 bp, Homo sapiens
cagtgcatgaaacaatatgcag

SEQ ID NO: 7145846 - DNA, 22 bp, Homo sapiens
cagtgcatgaaacaatatgcag

SEQ ID NO: 7145847 - DNA, 22 bp, Homo sapiens
cagtgcatgaaacaatatgcag

SEQ ID NO: 7145848 - DNA, 22 bp, Homo sapiens
cagtgcatgcacacacatggta

SEQ ID NO: 7145849 - DNA, 22 bp, Homo sapiens
cagtgcatgtctgtgtggggat

SEQ ID NO: 7145850 - DNA, 22 bp, Homo sapiens
cagtgcatgtggcactctccag

SEQ ID NO: 7145851 - DNA, 20 bp, Homo sapiens
cagtgcattgcttctgattt

SEQ ID NO: 7145852 - DNA, 22 bp, Homo sapiens
cagtgccaagccacagatcact

SEQ ID NO: 7145853 - DNA, 23 bp, Homo sapiens
tcacagttacttttgcatcaacc

SEQ ID NO: 7145854 - DNA, 22 bp, Homo sapiens
tcacagttactccttcagatga

SEQ ID NO: 7145855 - DNA, 22 bp, Homo sapiens
tcacagttaattgttggaatgt

SEQ ID NO: 7145856 - DNA, 22 bp, Homo sapiens
tcacagttaattgttggaatgt

SEQ ID NO: 7145857 - DNA, 22 bp, Homo sapiens
tcacagtgtggcaactcacaga

SEQ ID NO: 7145858 - DNA, 22 bp, Homo sapiens
tcacagtgttggaatcagagct

SEQ ID NO: 7145859 - DNA, 20 bp, Homo sapiens
tcacaggagggaaggcaggt

SEQ ID NO: 7145860 - DNA, 20 bp, Homo sapiens
tcacaggagggaaggcaggt

SEQ ID NO: 7145861 - DNA, 20 bp, Homo sapiens
tcacaggagggaaggcaggt

SEQ ID NO: 7145862 - DNA, 22 bp, Homo sapiens
tcacaggagggagagacaccca

SEQ ID NO: 7145863 - DNA, 22 bp, Homo sapiens
tcacaggagggagagacaccca

SEQ ID NO: 7145864 - DNA, 22 bp, Homo sapiens
tcacaggagggagagacaccca

SEQ ID NO: 7145865 - DNA, 22 bp, Homo sapiens
tcacaggagtcaaggaatagta

SEQ ID NO: 7145866 - DNA, 22 bp, Homo sapiens
tcacaggagtcaaggaatagta

SEQ ID NO: 7145867 - DNA, 21 bp, Homo sapiens
tcacaactttgaatttcaata

SEQ ID NO: 7145868 - DNA, 22 bp, Homo sapiens
tcacaagacaagacaaattgca

SEQ ID NO: 7145869 - DNA, 22 bp, Homo sapiens
tcacaagacagaaaacatttag

SEQ ID NO: 7145870 - DNA, 22 bp, Homo sapiens
tcacaacaggaaggaccagctg

SEQ ID NO: 7145871 - DNA, 22 bp, Homo sapiens
tcacaacgcctctgcaaatcct

SEQ ID NO: 7145872 - DNA, 20 bp, Homo sapiens
tcacaactccatcatttccc

SEQ ID NO: 7145873 - DNA, 22 bp, Homo sapiens
tcacaactctttccatttaata

SEQ ID NO: 7145874 - DNA, 22 bp, Homo sapiens
tcacaactctttccatttaata

SEQ ID NO: 7145875 - DNA, 22 bp, Homo sapiens
tcacaactgggtgtcttcatca

SEQ ID NO: 7145876 - DNA, 21 bp, Homo sapiens
tcacaactttgaatttcaata

SEQ ID NO: 7145877 - DNA, 22 bp, Homo sapiens
tcacaaatcattttatctgtgt

SEQ ID NO: 7145878 - DNA, 22 bp, Homo sapiens
tcacaaatcgaagccttataat

SEQ ID NO: 7145879 - DNA, 22 bp, Homo sapiens
tcacaaatgtctcctgtcctgt

SEQ ID NO: 7145880 - DNA, 22 bp, Homo sapiens
tcacaaatgtttgcatgtgtct

SEQ ID NO: 7145881 - DNA, 22 bp, Homo sapiens
tcaatgatagacaagatctaag

SEQ ID NO: 7145882 - DNA, 22 bp, Homo sapiens
tcacaaatattttaacagtagg

SEQ ID NO: 7145883 - DNA, 22 bp, Homo sapiens
tcacaaatattttaacagtagg

SEQ ID NO: 7145884 - DNA, 22 bp, Homo sapiens
tcacaaatcattttatctgtgt

SEQ ID NO: 7145885 - DNA, 22 bp, Homo sapiens
tcacaaatcattttatctgtgt

SEQ ID NO: 7145886 - DNA, 22 bp, Homo sapiens
tatttgaaagtgtacaaaaact

SEQ ID NO: 7145887 - DNA, 22 bp, Homo sapiens
tatttgaaagtgtacaaaaact

SEQ ID NO: 7145888 - DNA, 22 bp, Homo sapiens
tatttgaaagtgtacaaaaact

SEQ ID NO: 7145889 - DNA, 22 bp, Homo sapiens
tatttgaaagtgtacaaaaact

SEQ ID NO: 7145890 - DNA, 22 bp, Homo sapiens
tcacagacctggtgggaggtgg

SEQ ID NO: 7145891 - DNA, 22 bp, Homo sapiens
tcacagacctggtgggaggtgg

SEQ ID NO: 7145892 - DNA, 22 bp, Homo sapiens
tcacactttatttatttcatgc

SEQ ID NO: 7145893 - DNA, 22 bp, Homo sapiens
tcacagacctggtgggaggtgg

SEQ ID NO: 7145894 - DNA, 22 bp, Homo sapiens
tcacactttatttatttcatgc

SEQ ID NO: 7145895 - DNA, 22 bp, Homo sapiens
tcacagacgcatcctcaggtag

SEQ ID NO: 7145896 - DNA, 22 bp, Homo sapiens
tcacagacgcctcccctcgcct

SEQ ID NO: 7145897 - DNA, 22 bp, Homo sapiens
tcacagactcaagggcatagga

SEQ ID NO: 7145898 - DNA, 22 bp, Homo sapiens
tcacagactcaagggcatagga

SEQ ID NO: 7145899 - DNA, 22 bp, Homo sapiens
tcacagactcttgattgtctaa

SEQ ID NO: 7145900 - DNA, 22 bp, Homo sapiens
cagtgagcacggccagagggga

SEQ ID NO: 7145901 - DNA, 22 bp, Homo sapiens
cagtgagataccacagagcaaa

SEQ ID NO: 7145902 - DNA, 22 bp, Homo sapiens
cagtgagagtatttgtgctaag

SEQ ID NO: 7145903 - DNA, 22 bp, Homo sapiens
cagtgaggaagctgtctggacc

SEQ ID NO: 7145904 - DNA, 22 bp, Homo sapiens
cagtgaggaagctgtctggacc

SEQ ID NO: 7145905 - DNA, 22 bp, Homo sapiens
cagtgagctcctgtctgtccct

SEQ ID NO: 7145906 - DNA, 22 bp, Homo sapiens
cagtgaggaagctgtctggacc

SEQ ID NO: 7145907 - DNA, 22 bp, Homo sapiens
tcacacttagagcgaattgttt

SEQ ID NO: 7145908 - DNA, 22 bp, Homo sapiens
cagtgaggaagctgtctggacc

SEQ ID NO: 7145909 - DNA, 22 bp, Homo sapiens
cagtgaagtttaaagtgtagat

SEQ ID NO: 7145910 - DNA, 22 bp, Homo sapiens
cagtgaatttagatgttggtgg

SEQ ID NO: 7145911 - DNA, 22 bp, Homo sapiens
tcacaagacagaaaacatttag

SEQ ID NO: 7145912 - DNA, 22 bp, Homo sapiens
tcacaagactgagcttgcttga

SEQ ID NO: 7145913 - DNA, 22 bp, Homo sapiens
tcacaagacagaaaacatttag

SEQ ID NO: 7145914 - DNA, 22 bp, Homo sapiens
tcacaagagctggactgtcttt

SEQ ID NO: 7145915 - DNA, 22 bp, Homo sapiens
tcacaagagctggactgtcttt

SEQ ID NO: 7145916 - DNA, 22 bp, Homo sapiens
cagtgagaccttctaaggtggt

SEQ ID NO: 7145917 - DNA, 22 bp, Homo sapiens
cagtgagaccttctaaggtggt

SEQ ID NO: 7145918 - DNA, 22 bp, Homo sapiens
cagtgagaccttctaaggtggt

SEQ ID NO: 7145919 - DNA, 22 bp, Homo sapiens
cagtgagagtatttgtgctaag

SEQ ID NO: 7145920 - DNA, 22 bp, Homo sapiens
cagtgagaattcagtaggtact

SEQ ID NO: 7145921 - DNA, 22 bp, Homo sapiens
cagtgagaaaactaagacatta

SEQ ID NO: 7145922 - DNA, 22 bp, Homo sapiens
cagtgagaattcagtaggtact

SEQ ID NO: 7145923 - DNA, 22 bp, Homo sapiens
cagtgagaattcagtaggtact

SEQ ID NO: 7145924 - DNA, 22 bp, Homo sapiens
cagtgagaattcagtaggtact

SEQ ID NO: 7145925 - DNA, 22 bp, Homo sapiens
cagtgacacccagtctggccca

SEQ ID NO: 7145926 - DNA, 22 bp, Homo sapiens
cagtgacacccagtctggccca

SEQ ID NO: 7145927 - DNA, 22 bp, Homo sapiens
cagtgacgtaaactgcatgtgc

SEQ ID NO: 7145928 - DNA, 22 bp, Homo sapiens
cagtagggaatgtgggaggctg

SEQ ID NO: 7145929 - DNA, 22 bp, Homo sapiens
cagtagggaatgtgggaggctg

SEQ ID NO: 7145930 - DNA, 22 bp, Homo sapiens
cagtaggcaggttgtcttctta

SEQ ID NO: 7145931 - DNA, 22 bp, Homo sapiens
cagtaggaaggatgcagaaaaa

SEQ ID NO: 7145932 - DNA, 22 bp, Homo sapiens
cagtagtctttttcctcctaga

SEQ ID NO: 7145933 - DNA, 22 bp, Homo sapiens
cagtagtagttaaactgtgtat

SEQ ID NO: 7145934 - DNA, 22 bp, Homo sapiens
cagtaggggttctttaagttgt

SEQ ID NO: 7145935 - DNA, 22 bp, Homo sapiens
cagtaggtgctcaacaagtaca

SEQ ID NO: 7145936 - DNA, 22 bp, Homo sapiens
cagtagtgaaaagcagcccagc

SEQ ID NO: 7145937 - DNA, 22 bp, Homo sapiens
cagtagtgaaaagcagcccagc

SEQ ID NO: 7145938 - DNA, 21 bp, Homo sapiens
cagtagtgaggtatttgccaa

SEQ ID NO: 7145939 - DNA, 21 bp, Homo sapiens
cagtagtgcgtcgcagaggac

SEQ ID NO: 7145940 - DNA, 22 bp, Homo sapiens
cagtagtggaagggagagaaaa

SEQ ID NO: 7145941 - DNA, 22 bp, Homo sapiens
cagtagtggaagggagagaaaa

SEQ ID NO: 7145942 - DNA, 22 bp, Homo sapiens
cagtagtggggagcccagtgtc

SEQ ID NO: 7145943 - DNA, 22 bp, Homo sapiens
cagtagtggtctatcactggag

SEQ ID NO: 7145944 - DNA, 22 bp, Homo sapiens
cagtagtgttgctgagtgtcag

SEQ ID NO: 7145945 - DNA, 22 bp, Homo sapiens
cagtagtgttgctgagtgtcag

SEQ ID NO: 7145946 - DNA, 18 bp, Homo sapiens
cagtataaccagcaactc

SEQ ID NO: 7145947 - DNA, 22 bp, Homo sapiens
cagtatatgctctttcatcaaa

SEQ ID NO: 7145948 - DNA, 22 bp, Homo sapiens
cagtatatgctctttcatcaaa

SEQ ID NO: 7145949 - DNA, 22 bp, Homo sapiens
tatttccacaccttttgaatct

SEQ ID NO: 7145950 - DNA, 22 bp, Homo sapiens
tatttccacaccttttgaatct

SEQ ID NO: 7145951 - DNA, 22 bp, Homo sapiens
tatttccaccctcagtaaggaa

SEQ ID NO: 7145952 - DNA, 22 bp, Homo sapiens
tatttccaaaagcctattatga

SEQ ID NO: 7145953 - DNA, 22 bp, Homo sapiens
tatttccaaaagcctattatga

SEQ ID NO: 7145954 - DNA, 22 bp, Homo sapiens
tatttccaagctgaatccaatg

SEQ ID NO: 7145955 - DNA, 22 bp, Homo sapiens
tatttccacctattattttctg

SEQ ID NO: 7145956 - DNA, 22 bp, Homo sapiens
tatttccacctattattttctg

SEQ ID NO: 7145957 - DNA, 22 bp, Homo sapiens
tatttccacctattattttctg

SEQ ID NO: 7145958 - DNA, 22 bp, Homo sapiens
tatttccacttaggtgcctgtt

SEQ ID NO: 7145959 - DNA, 22 bp, Homo sapiens
tatttccagaggagtatagaag

SEQ ID NO: 7145960 - DNA, 22 bp, Homo sapiens
tatttccagaggagtatagaag

SEQ ID NO: 7145961 - DNA, 22 bp, Homo sapiens
tatttccagaggagtatagaag

SEQ ID NO: 7145962 - DNA, 22 bp, Homo sapiens
cagtagcatgcttatcttttga

SEQ ID NO: 7145963 - DNA, 22 bp, Homo sapiens
cagtagcatgtaataaagacag

SEQ ID NO: 7145964 - DNA, 22 bp, Homo sapiens
cagtagcatgtaataaagacag

SEQ ID NO: 7145965 - DNA, 22 bp, Homo sapiens
cagtagcatgtaataaagacag

SEQ ID NO: 7145966 - DNA, 22 bp, Homo sapiens
cagtcccactagtgccaatacc

SEQ ID NO: 7145967 - DNA, 22 bp, Homo sapiens
cagtcccaccaggatcgctctt

SEQ ID NO: 7145968 - DNA, 22 bp, Homo sapiens
cagtcccacaagatctccacaa

SEQ ID NO: 7145969 - DNA, 22 bp, Homo sapiens
cagtcccacaagatctccacaa

SEQ ID NO: 7145970 - DNA, 22 bp, Homo sapiens
cagtcccaccaggatcgctctt

SEQ ID NO: 7145971 - DNA, 20 bp, Homo sapiens
cagtcccaatccagggccag

SEQ ID NO: 7145972 - DNA, 20 bp, Homo sapiens
cagtcccaatccagggccag

SEQ ID NO: 7145973 - DNA, 22 bp, Homo sapiens
cagtcccaaggaggaagcagtc

SEQ ID NO: 7145974 - DNA, 20 bp, Homo sapiens
cagtcccaatccagggccag

SEQ ID NO: 7145975 - DNA, 19 bp, Homo sapiens
cagtcccaaattcttgtca

SEQ ID NO: 7145976 - DNA, 19 bp, Homo sapiens
cagtcccaaattcttgtca

SEQ ID NO: 7145977 - DNA, 19 bp, Homo sapiens
cagtcccaaattcttgtca

SEQ ID NO: 7145978 - DNA, 22 bp, Homo sapiens
cagtcccaaggaggaagcagtc

SEQ ID NO: 7145979 - DNA, 22 bp, Homo sapiens
cagtcccaaggaggaagcagtc

SEQ ID NO: 7145980 - DNA, 22 bp, Homo sapiens
cagtccagagcccaccagagga

SEQ ID NO: 7145981 - DNA, 18 bp, Homo sapiens
cagtcccaaaccttagga

SEQ ID NO: 7145982 - DNA, 22 bp, Homo sapiens
cagtccagagcccaccagagga

SEQ ID NO: 7145983 - DNA, 20 bp, Homo sapiens
cagtccactggagttcctac

SEQ ID NO: 7145984 - DNA, 22 bp, Homo sapiens
cagtcccagaagagcctgggag

SEQ ID NO: 7145985 - DNA, 22 bp, Homo sapiens
cagtcccagacatagtaaggga

SEQ ID NO: 7145986 - DNA, 22 bp, Homo sapiens
cagtcccagaagagcctgggag

SEQ ID NO: 7145987 - DNA, 22 bp, Homo sapiens
cagtcccactagtgccaatacc

SEQ ID NO: 7145988 - DNA, 22 bp, Homo sapiens
cagtcccagaagagcctgggag

SEQ ID NO: 7145989 - DNA, 22 bp, Homo sapiens
tatttcttgttccctccaagtt

SEQ ID NO: 7145990 - DNA, 22 bp, Homo sapiens
tatttcttgttccctccaagtt

SEQ ID NO: 7145991 - DNA, 22 bp, Homo sapiens
cagtcccagacatagtaaggga

SEQ ID NO: 7145992 - DNA, 22 bp, Homo sapiens
cagtcccagacccagaaggtgg

SEQ ID NO: 7145993 - DNA, 22 bp, Homo sapiens
cagtcccagacccagaaggtgg

SEQ ID NO: 7145994 - DNA, 22 bp, Homo sapiens
tatttctttcaggtatgtgttg

SEQ ID NO: 7145995 - DNA, 22 bp, Homo sapiens
tatttctttcaggtatgtgttg

SEQ ID NO: 7145996 - DNA, 22 bp, Homo sapiens
tatttctttcaggtatgtgttg

SEQ ID NO: 7145997 - DNA, 22 bp, Homo sapiens
tatttcttttcgtgacttattg

SEQ ID NO: 7145998 - DNA, 22 bp, Homo sapiens
tatttcttttcgtgacttattg

SEQ ID NO: 7145999 - DNA, 22 bp, Homo sapiens
tatttcttttcgtgacttattg

SEQ ID NO: 7146000 - DNA, 22 bp, Homo sapiens
caggtgttggaagggcagtggg

SEQ ID NO: 7146001 - DNA, 22 bp, Homo sapiens
caggtgttgatgtttattgagt

SEQ ID NO: 7146002 - DNA, 22 bp, Homo sapiens
caggtgttgcagttgaagactg

SEQ ID NO: 7146003 - DNA, 22 bp, Homo sapiens
caggtgttgcagttgaagactg

SEQ ID NO: 7146004 - DNA, 22 bp, Homo sapiens
caggtgttgcctaaattgacaa

SEQ ID NO: 7146005 - DNA, 22 bp, Homo sapiens
caggtgttcaagctggaggcca

SEQ ID NO: 7146006 - DNA, 22 bp, Homo sapiens
caggtgttctaagccgggcagt

SEQ ID NO: 7146007 - DNA, 22 bp, Homo sapiens
caggtgttctggaaatcagcag

SEQ ID NO: 7146008 - DNA, 17 bp, Homo sapiens
caggtgttctgtttttc

SEQ ID NO: 7146009 - DNA, 22 bp, Homo sapiens
caggtgttgatactaatcgtgg

SEQ ID NO: 7146010 - DNA, 22 bp, Homo sapiens
caggtgttggaagggcagtggg

SEQ ID NO: 7146011 - DNA, 22 bp, Homo sapiens
caggtgttgggagaagagataa

SEQ ID NO: 7146012 - DNA, 22 bp, Homo sapiens
caggtgttgtctaaagcttcag

SEQ ID NO: 7146013 - DNA, 22 bp, Homo sapiens
caggtgtttaggtttcatggat

SEQ ID NO: 7146014 - DNA, 22 bp, Homo sapiens
caggtgtttcaaatgtgaaact

SEQ ID NO: 7146015 - DNA, 22 bp, Homo sapiens
caggtgtttcaatcccaagtca

SEQ ID NO: 7146016 - DNA, 22 bp, Homo sapiens
caggttccagttgcagggactt

SEQ ID NO: 7146017 - DNA, 22 bp, Homo sapiens
caggttagttaatctttgtttc

SEQ ID NO: 7146018 - DNA, 22 bp, Homo sapiens
caggttcattctttcttgtatt

SEQ ID NO: 7146019 - DNA, 22 bp, Homo sapiens
caggttcccaggtccagggctt

SEQ ID NO: 7146020 - DNA, 22 bp, Homo sapiens
caggttcagcaggaggcatccc

SEQ ID NO: 7146021 - DNA, 22 bp, Homo sapiens
caggttacaatgaaaccattaa

SEQ ID NO: 7146022 - DNA, 22 bp, Homo sapiens
caggttagcaacatggttagag

SEQ ID NO: 7146023 - DNA, 22 bp, Homo sapiens
caggttagtaaggtctacataa

SEQ ID NO: 7146024 - DNA, 22 bp, Homo sapiens
caggttagtatttttagttcat

SEQ ID NO: 7146025 - DNA, 15 bp, Homo sapiens
caggttagtttccag

SEQ ID NO: 7146026 - DNA, 22 bp, Homo sapiens
caggtgtttcctgaagttgatg

SEQ ID NO: 7146027 - DNA, 22 bp, Homo sapiens
caggtgtttgtcaattccatcc

SEQ ID NO: 7146028 - DNA, 23 bp, Homo sapiens
caggtgttttacatatggtagtt

SEQ ID NO: 7146029 - DNA, 23 bp, Homo sapiens
caggtgttttacatatggtagtt

SEQ ID NO: 7146030 - DNA, 22 bp, Homo sapiens
caggtgttttttattctgaaag

SEQ ID NO: 7146031 - DNA, 22 bp, Homo sapiens
caggtgttaattgttggagcaa

SEQ ID NO: 7146032 - DNA, 22 bp, Homo sapiens
caggtgttaatcacttttaagc

SEQ ID NO: 7146033 - DNA, 22 bp, Homo sapiens
caggtgttatacatgaaattta

SEQ ID NO: 7146034 - DNA, 22 bp, Homo sapiens
caggtgttcaagctggaggcca

SEQ ID NO: 7146035 - DNA, 22 bp, Homo sapiens
caggtggtcaggcagatgggct

SEQ ID NO: 7146036 - DNA, 22 bp, Homo sapiens
caggtggtgcctccaggctggt

SEQ ID NO: 7146037 - DNA, 22 bp, Homo sapiens
caggtggtgcctccaggctggt

SEQ ID NO: 7146038 - DNA, 22 bp, Homo sapiens
caggtggtgcctccaggctggt

SEQ ID NO: 7146039 - DNA, 22 bp, Homo sapiens
caggtgtgccgggagcagtttg

SEQ ID NO: 7146040 - DNA, 22 bp, Homo sapiens
caggtggtcaggcagatgggct

SEQ ID NO: 7146041 - DNA, 22 bp, Homo sapiens
caggtggtcaggcagatgggct

SEQ ID NO: 7146042 - DNA, 22 bp, Homo sapiens
cagggtggggaaatagcgccct

SEQ ID NO: 7146043 - DNA, 22 bp, Homo sapiens
cagggtggggaaatagcgccct

SEQ ID NO: 7146044 - DNA, 22 bp, Homo sapiens
cagggtggggaaatagcgccct

SEQ ID NO: 7146045 - DNA, 22 bp, Homo sapiens
cagggtggggaaatagcgccct

SEQ ID NO: 7146046 - DNA, 22 bp, Homo sapiens
cagggtgggcacccagcctcca

SEQ ID NO: 7146047 - DNA, 22 bp, Homo sapiens
cagggtgggcacccagcctcca

SEQ ID NO: 7146048 - DNA, 22 bp, Homo sapiens
cagggtgggcacccagcctcca

SEQ ID NO: 7146049 - DNA, 22 bp, Homo sapiens
cagggtgggcacccagcctcca

SEQ ID NO: 7146050 - DNA, 22 bp, Homo sapiens
cagggtgggcacccagcctcca

SEQ ID NO: 7146051 - DNA, 22 bp, Homo sapiens
cagggtggccctgtggtctcat

SEQ ID NO: 7146052 - DNA, 22 bp, Homo sapiens
cagggtggccctgtggtctcat

SEQ ID NO: 7146053 - DNA, 22 bp, Homo sapiens
cagggtggccctgtggtctcat

SEQ ID NO: 7146054 - DNA, 22 bp, Homo sapiens
cagggtggccctgtggtctcat

SEQ ID NO: 7146055 - DNA, 22 bp, Homo sapiens
cagggtggccctgtggtctcat

SEQ ID NO: 7146056 - DNA, 22 bp, Homo sapiens
caggttgggctgcgaggaggag

SEQ ID NO: 7146057 - DNA, 22 bp, Homo sapiens
caggttggggacttaggatgac

SEQ ID NO: 7146058 - DNA, 22 bp, Homo sapiens
caggttggggacttaggatgac

SEQ ID NO: 7146059 - DNA, 22 bp, Homo sapiens
caggttgaaagtggaggagcta

SEQ ID NO: 7146060 - DNA, 22 bp, Homo sapiens
caggtttctagttctaagaata

SEQ ID NO: 7146061 - DNA, 22 bp, Homo sapiens
caggttctgaggatggtgcctg

SEQ ID NO: 7146062 - DNA, 22 bp, Homo sapiens
caggttctgggtcctgggtcct

SEQ ID NO: 7146063 - DNA, 22 bp, Homo sapiens
caggttcttaacttgttcttcc

SEQ ID NO: 7146064 - DNA, 22 bp, Homo sapiens
tatttccaaaaaggccatattc

SEQ ID NO: 7146065 - DNA, 22 bp, Homo sapiens
tatttcattctttatcaggagc

SEQ ID NO: 7146066 - DNA, 22 bp, Homo sapiens
tatttcattctttatcaggagc

SEQ ID NO: 7146067 - DNA, 22 bp, Homo sapiens
tatttcattctttatcaggagc

SEQ ID NO: 7146068 - DNA, 22 bp, Homo sapiens
tatttcatgtgcaccataattc

SEQ ID NO: 7146069 - DNA, 22 bp, Homo sapiens
tatttcatgtgcaccataattc

SEQ ID NO: 7146070 - DNA, 22 bp, Homo sapiens
tatttcatgtgcaccataattc

SEQ ID NO: 7146071 - DNA, 22 bp, Homo sapiens
tatttcatgtgcaccataattc

SEQ ID NO: 7146072 - DNA, 22 bp, Homo sapiens
tatttcatctggaacaaggtaa

SEQ ID NO: 7146073 - DNA, 22 bp, Homo sapiens
tatttcatctggaacaaggtaa

SEQ ID NO: 7146074 - DNA, 22 bp, Homo sapiens
tatttcagtcacttcttctctg

SEQ ID NO: 7146075 - DNA, 22 bp, Homo sapiens
tatttataacagtgagaacggg

SEQ ID NO: 7146076 - DNA, 22 bp, Homo sapiens
tatttataacagtgagaacggg

SEQ ID NO: 7146077 - DNA, 22 bp, Homo sapiens
tatttcaggtatggtgtgaaat

SEQ ID NO: 7146078 - DNA, 21 bp, Homo sapiens
tatttagttttacaaatgtgg

SEQ ID NO: 7146079 - DNA, 22 bp, Homo sapiens
cagtaaaaatgttgtcaaggca

SEQ ID NO: 7146080 - DNA, 22 bp, Homo sapiens
tatttataacagtgagaacggg

SEQ ID NO: 7146081 - DNA, 22 bp, Homo sapiens
tatttataacagtgagaacggg

SEQ ID NO: 7146082 - DNA, 22 bp, Homo sapiens
caggggacattaaagctccata

SEQ ID NO: 7146083 - DNA, 22 bp, Homo sapiens
caggggagtgagtccctctctg

SEQ ID NO: 7146084 - DNA, 22 bp, Homo sapiens
caggggagtgagtccctctctg

SEQ ID NO: 7146085 - DNA, 22 bp, Homo sapiens
caggggagttttatgcaacaga

SEQ ID NO: 7146086 - DNA, 22 bp, Homo sapiens
caggggagttttatgcaacaga

SEQ ID NO: 7146087 - DNA, 22 bp, Homo sapiens
caggggagttttatgcaacaga

SEQ ID NO: 7146088 - DNA, 22 bp, Homo sapiens
caggggagttttatgcaacaga

SEQ ID NO: 7146089 - DNA, 22 bp, Homo sapiens
caggggagttttatgcaacaga

SEQ ID NO: 7146090 - DNA, 22 bp, Homo sapiens
caggggagttttatgcaacaga

SEQ ID NO: 7146091 - DNA, 22 bp, Homo sapiens
caggggcaagaatgctgtcagc

SEQ ID NO: 7146092 - DNA, 22 bp, Homo sapiens
caggggcaagaatgctgtcagc

SEQ ID NO: 7146093 - DNA, 22 bp, Homo sapiens
tagtctggacttcttagtgtca

SEQ ID NO: 7146094 - DNA, 22 bp, Homo sapiens
tagtcttaagtaattcatggaa

SEQ ID NO: 7146095 - DNA, 22 bp, Homo sapiens
tagtcttcctggaagaagtgtt

SEQ ID NO: 7146096 - DNA, 22 bp, Homo sapiens
tagtgaaacctgacagatcatg

SEQ ID NO: 7146097 - DNA, 22 bp, Homo sapiens
tagtgaaacctgacagatcatg

SEQ ID NO: 7146098 - DNA, 22 bp, Homo sapiens
tatattgtctctgccttgtctg

SEQ ID NO: 7146099 - DNA, 22 bp, Homo sapiens
tatattgtctctgccttgtctg

SEQ ID NO: 7146100 - DNA, 22 bp, Homo sapiens
tatatttaaatccaggttgaaa

SEQ ID NO: 7146101 - DNA, 22 bp, Homo sapiens
tatatttaaatccaggttgaaa

SEQ ID NO: 7146102 - DNA, 22 bp, Homo sapiens
tatatttaaatccaggttgaaa

SEQ ID NO: 7146103 - DNA, 22 bp, Homo sapiens
tatatttaaatccaggttgaaa

SEQ ID NO: 7146104 - DNA, 22 bp, Homo sapiens
tatcaggagttgacagttgcta

SEQ ID NO: 7146105 - DNA, 22 bp, Homo sapiens
tagtgataatgtttatgctttt

SEQ ID NO: 7146106 - DNA, 22 bp, Homo sapiens
tagtgaaagtattaaacagctg

SEQ ID NO: 7146107 - DNA, 22 bp, Homo sapiens
tagtgaaagtcaaagacagcta

SEQ ID NO: 7146108 - DNA, 22 bp, Homo sapiens
tagtgaaagtcaaagacagcta

SEQ ID NO: 7146109 - DNA, 22 bp, Homo sapiens
tagtgaaatgagaatgtatgac

SEQ ID NO: 7146110 - DNA, 22 bp, Homo sapiens
tagtgaaatgataacagagcag

SEQ ID NO: 7146111 - DNA, 22 bp, Homo sapiens
tagtgaaatttatgcacagcta

SEQ ID NO: 7146112 - DNA, 22 bp, Homo sapiens
tagtgaatgttggctattaata

SEQ ID NO: 7146113 - DNA, 22 bp, Homo sapiens
tagtgaattcctaataggaaga

SEQ ID NO: 7146114 - DNA, 22 bp, Homo sapiens
tatcatttaacagaatcattgc

SEQ ID NO: 7146115 - DNA, 22 bp, Homo sapiens
tatcatttaacagaatcattgc

SEQ ID NO: 7146116 - DNA, 22 bp, Homo sapiens
cagggtggcactcagcgcatct

SEQ ID NO: 7146117 - DNA, 22 bp, Homo sapiens
tatcatttaacagaatcattgc

SEQ ID NO: 7146118 - DNA, 22 bp, Homo sapiens
tatcatttaacagaatcattgc

SEQ ID NO: 7146119 - DNA, 22 bp, Homo sapiens
tatcattgtgttatttcttcca

SEQ ID NO: 7146120 - DNA, 22 bp, Homo sapiens
tatcattgctgatgtgctgaga

SEQ ID NO: 7146121 - DNA, 22 bp, Homo sapiens
tatcattgtgttatttcttcca

SEQ ID NO: 7146122 - DNA, 22 bp, Homo sapiens
tatcatttaacagaatcattgc

SEQ ID NO: 7146123 - DNA, 22 bp, Homo sapiens
tatcattgtgtttgccagtcac

SEQ ID NO: 7146124 - DNA, 22 bp, Homo sapiens
tatcatgtgcgcttattgattt

SEQ ID NO: 7146125 - DNA, 22 bp, Homo sapiens
cagggtggcactcagcgcatct

SEQ ID NO: 7146126 - DNA, 22 bp, Homo sapiens
cagggtggcactcagcgcatct

SEQ ID NO: 7146127 - DNA, 22 bp, Homo sapiens
cagggtggcaggcaccatggcc

SEQ ID NO: 7146128 - DNA, 22 bp, Homo sapiens
cagggtggcaggcaccatggcc

SEQ ID NO: 7146129 - DNA, 22 bp, Homo sapiens
cagggtggcaggcaccatggcc

SEQ ID NO: 7146130 - DNA, 22 bp, Homo sapiens
cagggtggcaggcaccatggcc

SEQ ID NO: 7146131 - DNA, 22 bp, Homo sapiens
cagggtggcaggcaccatggcc

SEQ ID NO: 7146132 - DNA, 22 bp, Homo sapiens
cagggtggcaggcaccatggcc

SEQ ID NO: 7146133 - DNA, 22 bp, Homo sapiens
cagggtggcaggcaccatggcc

SEQ ID NO: 7146134 - DNA, 22 bp, Homo sapiens
cagggtggcaggcaccatggcc

SEQ ID NO: 7146135 - DNA, 22 bp, Homo sapiens
cagggtggcaggcaccatggcc

SEQ ID NO: 7146136 - DNA, 22 bp, Homo sapiens
cagggtggccaggtagataata

SEQ ID NO: 7146137 - DNA, 22 bp, Homo sapiens
cagggtggccaggtagataata

SEQ ID NO: 7146138 - DNA, 22 bp, Homo sapiens
cagggtggccctgtggtctcat

SEQ ID NO: 7146139 - DNA, 22 bp, Homo sapiens
tatcatctgcaaagcacatcta

SEQ ID NO: 7146140 - DNA, 22 bp, Homo sapiens
tatcatgctaagattgattctt

SEQ ID NO: 7146141 - DNA, 22 bp, Homo sapiens
tatcatgcttaccattttcaaa

SEQ ID NO: 7146142 - DNA, 22 bp, Homo sapiens
tatcatgcttaccattttcaaa

SEQ ID NO: 7146143 - DNA, 22 bp, Homo sapiens
tatcataagttaattaaacagt

SEQ ID NO: 7146144 - DNA, 22 bp, Homo sapiens
tatcataagttaattaaacagt

SEQ ID NO: 7146145 - DNA, 22 bp, Homo sapiens
tatcataagttaattaaacagt

SEQ ID NO: 7146146 - DNA, 22 bp, Homo sapiens
tatcataggtgtcataatagca

SEQ ID NO: 7146147 - DNA, 22 bp, Homo sapiens
tatcatcactgtaatccgttga

SEQ ID NO: 7146148 - DNA, 22 bp, Homo sapiens
tatcagtgtggtttctggactg

SEQ ID NO: 7146149 - DNA, 22 bp, Homo sapiens
tatcagtggtcacaagatacat

SEQ ID NO: 7146150 - DNA, 23 bp, Homo sapiens
tatcagtgtgatgaggctgctgc

SEQ ID NO: 7146151 - DNA, 22 bp, Homo sapiens
tatcagtagaacaatggacatt

SEQ ID NO: 7146152 - DNA, 22 bp, Homo sapiens
tatcagtagaacaatggacatt

SEQ ID NO: 7146153 - DNA, 22 bp, Homo sapiens
tatcagtagaacaatggacatt

SEQ ID NO: 7146154 - DNA, 22 bp, Homo sapiens
tatcagtagataaacggattgc

SEQ ID NO: 7146155 - DNA, 20 bp, Homo sapiens
tatcagtaggatattctgcc

SEQ ID NO: 7146156 - DNA, 22 bp, Homo sapiens
tatcagtatggattcatggatt

SEQ ID NO: 7146157 - DNA, 22 bp, Homo sapiens
tatcagtatggattcatggatt

SEQ ID NO: 7146158 - DNA, 22 bp, Homo sapiens
tatcagtatggattcatggatt

SEQ ID NO: 7146159 - DNA, 22 bp, Homo sapiens
caggggaagatgccaagggaga

SEQ ID NO: 7146160 - DNA, 22 bp, Homo sapiens
caggggaaggagccttgaaact

SEQ ID NO: 7146161 - DNA, 22 bp, Homo sapiens
caggggaagatgccaagggaga

SEQ ID NO: 7146162 - DNA, 22 bp, Homo sapiens
caggggaaggagccttgaaact

SEQ ID NO: 7146163 - DNA, 22 bp, Homo sapiens
caggggacagtatggtggatga

SEQ ID NO: 7146164 - DNA, 22 bp, Homo sapiens
caggggacattaaagctccata

SEQ ID NO: 7146165 - DNA, 22 bp, Homo sapiens
caggggacattaaagctccata

SEQ ID NO: 7146166 - DNA, 22 bp, Homo sapiens
cagggctttgtgtgcctgggga

SEQ ID NO: 7146167 - DNA, 22 bp, Homo sapiens
cagggctttgaacaggcatcaa

SEQ ID NO: 7146168 - DNA, 22 bp, Homo sapiens
cagggctttgaacaggcatcaa

SEQ ID NO: 7146169 - DNA, 22 bp, Homo sapiens
cagggctttgtaatatgagcac

SEQ ID NO: 7146170 - DNA, 22 bp, Homo sapiens
cagggctttcctgagaagtgat

SEQ ID NO: 7146171 - DNA, 22 bp, Homo sapiens
cagggctttcccttgtagaaat

SEQ ID NO: 7146172 - DNA, 22 bp, Homo sapiens
cagggcttggttggaaccaccc

SEQ ID NO: 7146173 - DNA, 18 bp, Homo sapiens
cagggctgtggggtcact

SEQ ID NO: 7146174 - DNA, 22 bp, Homo sapiens
tagggtggttagaaggagtatg

SEQ ID NO: 7146175 - DNA, 22 bp, Homo sapiens
tagggtggttagaaggagtatg

SEQ ID NO: 7146176 - DNA, 22 bp, Homo sapiens
tagggtggttagaaggagtatg

SEQ ID NO: 7146177 - DNA, 22 bp, Homo sapiens
tagggtggttagaaggagtatg

SEQ ID NO: 7146178 - DNA, 23 bp, Homo sapiens
tagggtgttaagtcagtgattga

SEQ ID NO: 7146179 - DNA, 23 bp, Homo sapiens
tagggtgttaagtcagtgattga

SEQ ID NO: 7146180 - DNA, 22 bp, Homo sapiens
taggtacacagtaagtgctcaa

SEQ ID NO: 7146181 - DNA, 22 bp, Homo sapiens
tagggtggagactggaagcagg

SEQ ID NO: 7146182 - DNA, 22 bp, Homo sapiens
tagggtggagactggaagcagg

SEQ ID NO: 7146183 - DNA, 22 bp, Homo sapiens
tagggtggagactggaagcagg

SEQ ID NO: 7146184 - DNA, 22 bp, Homo sapiens
tagggtgggcagttcttgggga

SEQ ID NO: 7146185 - DNA, 22 bp, Homo sapiens
tagggtgggcagttcttgggga

SEQ ID NO: 7146186 - DNA, 22 bp, Homo sapiens
taggtacagtttctggtgtctt

SEQ ID NO: 7146187 - DNA, 22 bp, Homo sapiens
taggtacatggaattggacatt

SEQ ID NO: 7146188 - DNA, 22 bp, Homo sapiens
taggtactggacataatataag

SEQ ID NO: 7146189 - DNA, 22 bp, Homo sapiens
taggtacttttcaagtaataat

SEQ ID NO: 7146190 - DNA, 22 bp, Homo sapiens
taggtagctttggcgtttcttg

SEQ ID NO: 7146191 - DNA, 22 bp, Homo sapiens
taggtaggtaaacaggactaat

SEQ ID NO: 7146192 - DNA, 22 bp, Homo sapiens
tagggcaggtgaagaaaagcta

SEQ ID NO: 7146193 - DNA, 22 bp, Homo sapiens
tagggcaggtgaagaaaagcta

SEQ ID NO: 7146194 - DNA, 22 bp, Homo sapiens
tagggcagttataacattagtg

SEQ ID NO: 7146195 - DNA, 22 bp, Homo sapiens
tagggcagttataacattagtg

SEQ ID NO: 7146196 - DNA, 22 bp, Homo sapiens
tagggcaggggaggaatctgaa

SEQ ID NO: 7146197 - DNA, 22 bp, Homo sapiens
tagggcaggggaggaatctgaa

SEQ ID NO: 7146198 - DNA, 21 bp, Homo sapiens
tagggcaggcattggaagaga

SEQ ID NO: 7146199 - DNA, 22 bp, Homo sapiens
tagggcaggggaggaatctgaa

SEQ ID NO: 7146200 - DNA, 21 bp, Homo sapiens
tagggcaggcattggaagaga

SEQ ID NO: 7146201 - DNA, 21 bp, Homo sapiens
tagggcaggcattggaagaga

SEQ ID NO: 7146202 - DNA, 21 bp, Homo sapiens
tagggcaggcattggaagaga

SEQ ID NO: 7146203 - DNA, 21 bp, Homo sapiens
tagggcaggcattggaagaga

SEQ ID NO: 7146204 - DNA, 22 bp, Homo sapiens
tagggacaaagagctgaggcct

SEQ ID NO: 7146205 - DNA, 22 bp, Homo sapiens
cagggctccatgcagggactcc

SEQ ID NO: 7146206 - DNA, 22 bp, Homo sapiens
cagggctccatgcagggactcc

SEQ ID NO: 7146207 - DNA, 22 bp, Homo sapiens
tagggaaggagaccaagccaca

SEQ ID NO: 7146208 - DNA, 18 bp, Homo sapiens
tagggctctagggagtga

SEQ ID NO: 7146209 - DNA, 22 bp, Homo sapiens
tagggctcgggcacaggacagg

SEQ ID NO: 7146210 - DNA, 22 bp, Homo sapiens
tagggctccactcccagagatt

SEQ ID NO: 7146211 - DNA, 22 bp, Homo sapiens
tagggctccactcccagagatt

SEQ ID NO: 7146212 - DNA, 22 bp, Homo sapiens
tagggctcagagaagtggggcc

SEQ ID NO: 7146213 - DNA, 22 bp, Homo sapiens
tagggcagttataacattagtg

SEQ ID NO: 7146214 - DNA, 22 bp, Homo sapiens
tagggcagtttcatgttatctt

SEQ ID NO: 7146215 - DNA, 21 bp, Homo sapiens
tagggcatattcagtggtctg

SEQ ID NO: 7146216 - DNA, 22 bp, Homo sapiens
tagggcatttgtgggtgttgtt

SEQ ID NO: 7146217 - DNA, 22 bp, Homo sapiens
taggaacaaagagcctcacatt

SEQ ID NO: 7146218 - DNA, 22 bp, Homo sapiens
taggaacaaagagcctcacatt

SEQ ID NO: 7146219 - DNA, 22 bp, Homo sapiens
taggaaatttgaaatatgtggg

SEQ ID NO: 7146220 - DNA, 22 bp, Homo sapiens
taggaaattttactggtctggg

SEQ ID NO: 7146221 - DNA, 22 bp, Homo sapiens
taggaaattggaaactcttcac

SEQ ID NO: 7146222 - DNA, 22 bp, Homo sapiens
taggaacaactgcaggtacaag

SEQ ID NO: 7146223 - DNA, 22 bp, Homo sapiens
taggaacaactgcaggtacaag

SEQ ID NO: 7146224 - DNA, 22 bp, Homo sapiens
taggaacaagtttccttgctgt

SEQ ID NO: 7146225 - DNA, 22 bp, Homo sapiens
taggaacacacatgtgtagctg

SEQ ID NO: 7146226 - DNA, 22 bp, Homo sapiens
taggaacacagggacttgatga

SEQ ID NO: 7146227 - DNA, 22 bp, Homo sapiens
taggaacagtcctagaaatctg

SEQ ID NO: 7146228 - DNA, 18 bp, Homo sapiens
taggaacattgattggag

SEQ ID NO: 7146229 - DNA, 22 bp, Homo sapiens
taggacatggacatcttcggtg

SEQ ID NO: 7146230 - DNA, 21 bp, Homo sapiens
tagctttaatattcccacatt

SEQ ID NO: 7146231 - DNA, 22 bp, Homo sapiens
taggaaatggctcagttactgc

SEQ ID NO: 7146232 - DNA, 22 bp, Homo sapiens
tagctttaataagctgctgaat

SEQ ID NO: 7146233 - DNA, 22 bp, Homo sapiens
tagctttaagatgagatgtgga

SEQ ID NO: 7146234 - DNA, 22 bp, Homo sapiens
cagggcaggaatttgacattgc

SEQ ID NO: 7146235 - DNA, 22 bp, Homo sapiens
cagggcaggacagatacattac

SEQ ID NO: 7146236 - DNA, 22 bp, Homo sapiens
cagggcaggaatttgacattgc

SEQ ID NO: 7146237 - DNA, 22 bp, Homo sapiens
cagggcaggaatttgacattgc

SEQ ID NO: 7146238 - DNA, 22 bp, Homo sapiens
taggaaattgccaatatatgac

SEQ ID NO: 7146239 - DNA, 22 bp, Homo sapiens
taggaaattgccaatatatgac

SEQ ID NO: 7146240 - DNA, 22 bp, Homo sapiens
cagggcaggaatttgacattgc

SEQ ID NO: 7146241 - DNA, 22 bp, Homo sapiens
cagggcaggaatttgacattgc

SEQ ID NO: 7146242 - DNA, 22 bp, Homo sapiens
cagggcagcttcctttgttagg

SEQ ID NO: 7146243 - DNA, 22 bp, Homo sapiens
cagggcagcttcctttgttagg

SEQ ID NO: 7146244 - DNA, 22 bp, Homo sapiens
cagggcagccaggccccgtggg

SEQ ID NO: 7146245 - DNA, 22 bp, Homo sapiens
cagggcagccaggccccgtggg

SEQ ID NO: 7146246 - DNA, 22 bp, Homo sapiens
cagggcagagccaggatttcaa

SEQ ID NO: 7146247 - DNA, 22 bp, Homo sapiens
cagggcagagggaaactccttt

SEQ ID NO: 7146248 - DNA, 22 bp, Homo sapiens
cagggcagagggaaactccttt

SEQ ID NO: 7146249 - DNA, 22 bp, Homo sapiens
cagggcagagggaaactccttt

SEQ ID NO: 7146250 - DNA, 22 bp, Homo sapiens
cagggcagagggaaactccttt

SEQ ID NO: 7146251 - DNA, 22 bp, Homo sapiens
cagggcagccaggccccgtggg

SEQ ID NO: 7146252 - DNA, 22 bp, Homo sapiens
cagggcagccaggccccgtggg

SEQ ID NO: 7146253 - DNA, 22 bp, Homo sapiens
cagggcagccaggccccgtggg

SEQ ID NO: 7146254 - DNA, 22 bp, Homo sapiens
tagctatttggaaaattccaat

SEQ ID NO: 7146255 - DNA, 22 bp, Homo sapiens
tagctattttgcttggaaatac

SEQ ID NO: 7146256 - DNA, 22 bp, Homo sapiens
tagctatttggaaaattccaat

SEQ ID NO: 7146257 - DNA, 22 bp, Homo sapiens
tagctattgttggtagttaccc

SEQ ID NO: 7146258 - DNA, 22 bp, Homo sapiens
tagctactgatgcaagagtttg

SEQ ID NO: 7146259 - DNA, 22 bp, Homo sapiens
tagctagaaagtttcagctgtg

SEQ ID NO: 7146260 - DNA, 22 bp, Homo sapiens
tagctcagcaggtgggacaggt

SEQ ID NO: 7146261 - DNA, 22 bp, Homo sapiens
tagctcatctaggctaccacag

SEQ ID NO: 7146262 - DNA, 22 bp, Homo sapiens
tagctcatgtaatccgaacata

SEQ ID NO: 7146263 - DNA, 22 bp, Homo sapiens
tagctcctacaagtacagcaaa

SEQ ID NO: 7146264 - DNA, 22 bp, Homo sapiens
tagctcctccccatccaggttc

SEQ ID NO: 7146265 - DNA, 22 bp, Homo sapiens
tagctcctggctgcagggcctc

SEQ ID NO: 7146266 - DNA, 22 bp, Homo sapiens
tagctcctggctgcagggcctc

SEQ ID NO: 7146267 - DNA, 22 bp, Homo sapiens
cagggcctggagctgggcctgc

SEQ ID NO: 7146268 - DNA, 22 bp, Homo sapiens
cagggcctgcttccttcttgtt

SEQ ID NO: 7146269 - DNA, 22 bp, Homo sapiens
cagggcctggagctgggcctgc

SEQ ID NO: 7146270 - DNA, 22 bp, Homo sapiens
cagggcctggagctgggcctgc

SEQ ID NO: 7146271 - DNA, 22 bp, Homo sapiens
cagggcctggagctgggcctgc

SEQ ID NO: 7146272 - DNA, 22 bp, Homo sapiens
cagggcctgcctggttcctgga

SEQ ID NO: 7146273 - DNA, 22 bp, Homo sapiens
cagggcctgcttccttcttgtt

SEQ ID NO: 7146274 - DNA, 22 bp, Homo sapiens
cagggcctgcttccttcttgtt

SEQ ID NO: 7146275 - DNA, 22 bp, Homo sapiens
taggagctgagacatctttaaa

SEQ ID NO: 7146276 - DNA, 21 bp, Homo sapiens
taggagctgatggggaagtag

SEQ ID NO: 7146277 - DNA, 18 bp, Homo sapiens
taggaggatactgagatg

SEQ ID NO: 7146278 - DNA, 22 bp, Homo sapiens
cagggcctcattgtcagtcctg

SEQ ID NO: 7146279 - DNA, 22 bp, Homo sapiens
cagggcctccccggcagtcttt

SEQ ID NO: 7146280 - DNA, 22 bp, Homo sapiens
cagggcctccccggcagtcttt

SEQ ID NO: 7146281 - DNA, 17 bp, Homo sapiens
taggagactggctgtcc

SEQ ID NO: 7146282 - DNA, 17 bp, Homo sapiens
taggagactggctgtcc

SEQ ID NO: 7146283 - DNA, 22 bp, Homo sapiens
taggagaagagtcagggcctaa

SEQ ID NO: 7146284 - DNA, 22 bp, Homo sapiens
taggagaagagtcagggcctaa

SEQ ID NO: 7146285 - DNA, 22 bp, Homo sapiens
taggagagctgaactattgtct

SEQ ID NO: 7146286 - DNA, 22 bp, Homo sapiens
taggagaggtgaatggcacact

SEQ ID NO: 7146287 - DNA, 22 bp, Homo sapiens
taggagaggtgaatggcacact

SEQ ID NO: 7146288 - DNA, 22 bp, Homo sapiens
taggactttgagaattgttatt

SEQ ID NO: 7146289 - DNA, 22 bp, Homo sapiens
taggacttagtctaatttttct

SEQ ID NO: 7146290 - DNA, 19 bp, Homo sapiens
taggaccctggtggccccc

SEQ ID NO: 7146291 - DNA, 19 bp, Homo sapiens
taggaccctggtggccccc

SEQ ID NO: 7146292 - DNA, 22 bp, Homo sapiens
cagggccttcgtaagtgtccgg

SEQ ID NO: 7146293 - DNA, 22 bp, Homo sapiens
cagggccttcgtaagtgtccgg

SEQ ID NO: 7146294 - DNA, 22 bp, Homo sapiens
cagggccttcgtaagtgtccgg

SEQ ID NO: 7146295 - DNA, 22 bp, Homo sapiens
cagggccttcgtaagtgtccgg

SEQ ID NO: 7146296 - DNA, 22 bp, Homo sapiens
cagggcctgtacaagtcccacc

SEQ ID NO: 7146297 - DNA, 22 bp, Homo sapiens
cagggcctgtacaagtcccacc

SEQ ID NO: 7146298 - DNA, 22 bp, Homo sapiens
cagggcctgtacaagtcccacc

SEQ ID NO: 7146299 - DNA, 22 bp, Homo sapiens
cagggcctgtcacgacgctcat

SEQ ID NO: 7146300 - DNA, 22 bp, Homo sapiens
cagggcctgtcacgacgctcat

SEQ ID NO: 7146301 - DNA, 22 bp, Homo sapiens
cagggcctgtcacgacgctcat

SEQ ID NO: 7146302 - DNA, 22 bp, Homo sapiens
cagggccttgttcaggagtgaa

SEQ ID NO: 7146303 - DNA, 22 bp, Homo sapiens
cagggccttgttcaggagtgaa

SEQ ID NO: 7146304 - DNA, 22 bp, Homo sapiens
cagggccttgttcaggagtgaa

SEQ ID NO: 7146305 - DNA, 22 bp, Homo sapiens
cagggccttgttcaggagtgaa

SEQ ID NO: 7146306 - DNA, 22 bp, Homo sapiens
cagggccttgttcaggagtgaa

SEQ ID NO: 7146307 - DNA, 22 bp, Homo sapiens
cagggccttttagcatcttctc

SEQ ID NO: 7146308 - DNA, 22 bp, Homo sapiens
cagggccttttagcatcttctc

SEQ ID NO: 7146309 - DNA, 22 bp, Homo sapiens
cagggcggggtctgccggccct

SEQ ID NO: 7146310 - DNA, 22 bp, Homo sapiens
cagggctcactcggctggcgtc

SEQ ID NO: 7146311 - DNA, 22 bp, Homo sapiens
cagggctcactcggctggcgtc

SEQ ID NO: 7146312 - DNA, 22 bp, Homo sapiens
cagggctcactcggctggcgtc

SEQ ID NO: 7146313 - DNA, 22 bp, Homo sapiens
cagggctcagaagacagacctc

SEQ ID NO: 7146314 - DNA, 22 bp, Homo sapiens
cagggctcaggaaatcagacgt

SEQ ID NO: 7146315 - DNA, 22 bp, Homo sapiens
cagggctcaccactgggatcct

SEQ ID NO: 7146316 - DNA, 22 bp, Homo sapiens
cagggctcagggactgcagaaa

SEQ ID NO: 7146317 - DNA, 22 bp, Homo sapiens
cagggctcaggctctgggattc

SEQ ID NO: 7146318 - DNA, 22 bp, Homo sapiens
cagggctcagggactgcagaaa

SEQ ID NO: 7146319 - DNA, 22 bp, Homo sapiens
cagggctcagggactgcagaaa

SEQ ID NO: 7146320 - DNA, 22 bp, Homo sapiens
cagggctcaggctctgggattc

SEQ ID NO: 7146321 - DNA, 22 bp, Homo sapiens
cagggctcaggctctgggattc

SEQ ID NO: 7146322 - DNA, 22 bp, Homo sapiens
cagggctcaggctctgggattc

SEQ ID NO: 7146323 - DNA, 22 bp, Homo sapiens
cagggctcaggctctgggattc

SEQ ID NO: 7146324 - DNA, 22 bp, Homo sapiens
tactcacattctgtttcttgct

SEQ ID NO: 7146325 - DNA, 22 bp, Homo sapiens
tactatttttgcaacgtataca

SEQ ID NO: 7146326 - DNA, 22 bp, Homo sapiens
tactatttttgcaacgtataca

SEQ ID NO: 7146327 - DNA, 22 bp, Homo sapiens
tactatttttgcaacgtataca

SEQ ID NO: 7146328 - DNA, 22 bp, Homo sapiens
tactattttgacatgaaattga

SEQ ID NO: 7146329 - DNA, 22 bp, Homo sapiens
tactattttgacatgaaattga

SEQ ID NO: 7146330 - DNA, 22 bp, Homo sapiens
tactcaaaaagttatgaatcat

SEQ ID NO: 7146331 - DNA, 22 bp, Homo sapiens
tactgtctgcttcttatagctt

SEQ ID NO: 7146332 - DNA, 22 bp, Homo sapiens
tactgtctggagttgccaaagg

SEQ ID NO: 7146333 - DNA, 22 bp, Homo sapiens
tactgtctctgccctggccagg

SEQ ID NO: 7146334 - DNA, 22 bp, Homo sapiens
tactgtcattagcattaacttt

SEQ ID NO: 7146335 - DNA, 22 bp, Homo sapiens
tactgtctaataagattgatgg

SEQ ID NO: 7146336 - DNA, 22 bp, Homo sapiens
tactgtctatacacttgattac

SEQ ID NO: 7146337 - DNA, 22 bp, Homo sapiens
tactgtatgatttcatgtatat

SEQ ID NO: 7146338 - DNA, 22 bp, Homo sapiens
tactgtatgaattatgttattt

SEQ ID NO: 7146339 - DNA, 23 bp, Homo sapiens
tactgtatattactgtgttatac

SEQ ID NO: 7146340 - DNA, 22 bp, Homo sapiens
tactgtatgaattatgttattt

SEQ ID NO: 7146341 - DNA, 22 bp, Homo sapiens
tactgtatgaattatgttattt

SEQ ID NO: 7146342 - DNA, 21 bp, Homo sapiens
tactgtagccttgcactgtag

SEQ ID NO: 7146343 - DNA, 22 bp, Homo sapiens
tactgtatactactgctgttct

SEQ ID NO: 7146344 - DNA, 21 bp, Homo sapiens
tactgtatagatgtgttcttg

SEQ ID NO: 7146345 - DNA, 21 bp, Homo sapiens
tactgtatagatgtgttcttg

SEQ ID NO: 7146346 - DNA, 22 bp, Homo sapiens
gtgagggcagcttggtcagtgt

SEQ ID NO: 7146347 - DNA, 17 bp, Homo sapiens
gtgagggcagaggatgg

SEQ ID NO: 7146348 - DNA, 17 bp, Homo sapiens
gtgagggcagaggatgg

SEQ ID NO: 7146349 - DNA, 22 bp, Homo sapiens
gtgaggggagtaaagccatgtt

SEQ ID NO: 7146350 - DNA, 22 bp, Homo sapiens
gtgaggggagtaaagccatgtt

SEQ ID NO: 7146351 - DNA, 22 bp, Homo sapiens
gtgaggggccaagagtagggca

SEQ ID NO: 7146352 - DNA, 22 bp, Homo sapiens
gtgaggggccaagagtagggca

SEQ ID NO: 7146353 - DNA, 22 bp, Homo sapiens
gtgaggggccaagagtagggca

SEQ ID NO: 7146354 - DNA, 22 bp, Homo sapiens
gtgaggggagtaaagccatgtt

SEQ ID NO: 7146355 - DNA, 20 bp, Homo sapiens
cagccctgtgacctggccct

SEQ ID NO: 7146356 - DNA, 20 bp, Homo sapiens
cagccctgtgacctggccct

SEQ ID NO: 7146357 - DNA, 20 bp, Homo sapiens
cagccctgtgacctggccct

SEQ ID NO: 7146358 - DNA, 22 bp, Homo sapiens
cagccctgtgcggagggccctg

SEQ ID NO: 7146359 - DNA, 22 bp, Homo sapiens
cagccctgtgcggagggccctg

SEQ ID NO: 7146360 - DNA, 22 bp, Homo sapiens
gtgagggcagaacccccaggcc

SEQ ID NO: 7146361 - DNA, 22 bp, Homo sapiens
gtgaggggtggctgagcagttt

SEQ ID NO: 7146362 - DNA, 22 bp, Homo sapiens
gtgaggtaaactgtagttcaga

SEQ ID NO: 7146363 - DNA, 22 bp, Homo sapiens
tactatgtgaaaatactatagt

SEQ ID NO: 7146364 - DNA, 22 bp, Homo sapiens
tactatgttcttcctaaatagt

SEQ ID NO: 7146365 - DNA, 22 bp, Homo sapiens
tactattgaatcattgtcaatc

SEQ ID NO: 7146366 - DNA, 22 bp, Homo sapiens
tactatttggaattttaaattg

SEQ ID NO: 7146367 - DNA, 22 bp, Homo sapiens
tactatttggaattttaaattg

SEQ ID NO: 7146368 - DNA, 22 bp, Homo sapiens
tactatttggaattttaaattg

SEQ ID NO: 7146369 - DNA, 22 bp, Homo sapiens
gtgaggggtggctgagcagttt

SEQ ID NO: 7146370 - DNA, 22 bp, Homo sapiens
gtgaggggtggctgagcagttt

SEQ ID NO: 7146371 - DNA, 22 bp, Homo sapiens
gtgaggggtggctgagcagttt

SEQ ID NO: 7146372 - DNA, 22 bp, Homo sapiens
gtgaggggccaagagtagggca

SEQ ID NO: 7146373 - DNA, 22 bp, Homo sapiens
gtgaggggccaagagtagggca

SEQ ID NO: 7146374 - DNA, 22 bp, Homo sapiens
gtgaggggccaagagtagggca

SEQ ID NO: 7146375 - DNA, 22 bp, Homo sapiens
gtgaggggtctggacgcacagt

SEQ ID NO: 7146376 - DNA, 22 bp, Homo sapiens
caggctggagtgcagtggcgcc

SEQ ID NO: 7146377 - DNA, 22 bp, Homo sapiens
caggctggagtgcagtggcgcc

SEQ ID NO: 7146378 - DNA, 22 bp, Homo sapiens
caggctggagtgcagtggcgcc

SEQ ID NO: 7146379 - DNA, 22 bp, Homo sapiens
caggctggagtgcaatggtgct

SEQ ID NO: 7146380 - DNA, 22 bp, Homo sapiens
caggctggagtgcagtggcgcc

SEQ ID NO: 7146381 - DNA, 22 bp, Homo sapiens
caggctggagtgcagtggcgcc

SEQ ID NO: 7146382 - DNA, 22 bp, Homo sapiens
caggctggagtgcaatggtgct

SEQ ID NO: 7146383 - DNA, 22 bp, Homo sapiens
caggctggagtgcaatggtgct

SEQ ID NO: 7146384 - DNA, 22 bp, Homo sapiens
caggctggagtgcaatggcaca

SEQ ID NO: 7146385 - DNA, 22 bp, Homo sapiens
caggctggagtgcaatggtgct

SEQ ID NO: 7146386 - DNA, 22 bp, Homo sapiens
caggctggagtgcaatggcaca

SEQ ID NO: 7146387 - DNA, 22 bp, Homo sapiens
caggctggagtgcaatggcaca

SEQ ID NO: 7146388 - DNA, 22 bp, Homo sapiens
caggctggagtgcaatgacgcc

SEQ ID NO: 7146389 - DNA, 22 bp, Homo sapiens
caggctggagtgcaatggcaca

SEQ ID NO: 7146390 - DNA, 22 bp, Homo sapiens
caggctggagtgcaatggcaca

SEQ ID NO: 7146391 - DNA, 22 bp, Homo sapiens
caggctggagtgcaatgacgcc

SEQ ID NO: 7146392 - DNA, 22 bp, Homo sapiens
tactgtgcaaaaatgaatattg

SEQ ID NO: 7146393 - DNA, 22 bp, Homo sapiens
tactgtgcaaaaatgaatattg

SEQ ID NO: 7146394 - DNA, 22 bp, Homo sapiens
tactgtgcagctgtgctttggg

SEQ ID NO: 7146395 - DNA, 22 bp, Homo sapiens
caggctgcctggaagaggactg

SEQ ID NO: 7146396 - DNA, 22 bp, Homo sapiens
tactgtcttttcctaaatgggt

SEQ ID NO: 7146397 - DNA, 22 bp, Homo sapiens
tactgtctggcaattaagaatc

SEQ ID NO: 7146398 - DNA, 23 bp, Homo sapiens
tactgtcttctattaagtaagga

SEQ ID NO: 7146399 - DNA, 22 bp, Homo sapiens
tactgtctttaggggtagaaat

SEQ ID NO: 7146400 - DNA, 22 bp, Homo sapiens
caggctggagtgagtgtagtgg

SEQ ID NO: 7146401 - DNA, 22 bp, Homo sapiens
caggctggagtgagtgtagtgg

SEQ ID NO: 7146402 - DNA, 22 bp, Homo sapiens
caggctggagtgagtgtagtgg

SEQ ID NO: 7146403 - DNA, 22 bp, Homo sapiens
caggctggagtgagtgtagtgg

SEQ ID NO: 7146404 - DNA, 22 bp, Homo sapiens
caggctggagtgagtgtagtgg

SEQ ID NO: 7146405 - DNA, 22 bp, Homo sapiens
caggctgcctggaagaggactg

SEQ ID NO: 7146406 - DNA, 22 bp, Homo sapiens
caggctgcctggaagaggactg

SEQ ID NO: 7146407 - DNA, 22 bp, Homo sapiens
caggctgcctggaagaggactg

SEQ ID NO: 7146408 - DNA, 22 bp, Homo sapiens
caggctggagtgcagtggggcg

SEQ ID NO: 7146409 - DNA, 22 bp, Homo sapiens
caggctggagtgcagtggggcg

SEQ ID NO: 7146410 - DNA, 22 bp, Homo sapiens
caggctggagtgcagtggggcg

SEQ ID NO: 7146411 - DNA, 22 bp, Homo sapiens
caggctggagtgcagtggcgct

SEQ ID NO: 7146412 - DNA, 22 bp, Homo sapiens
caggctggagtgcagtggcgct

SEQ ID NO: 7146413 - DNA, 22 bp, Homo sapiens
caggctggagtgcagtggggcg

SEQ ID NO: 7146414 - DNA, 22 bp, Homo sapiens
caggctggagtgcagtggggcg

SEQ ID NO: 7146415 - DNA, 22 bp, Homo sapiens
caggctggagtgcagtggggcg

SEQ ID NO: 7146416 - DNA, 22 bp, Homo sapiens
caggctggagtgcagtggggcg

SEQ ID NO: 7146417 - DNA, 22 bp, Homo sapiens
caggctggagtgcagtggggcg

SEQ ID NO: 7146418 - DNA, 22 bp, Homo sapiens
caggctggagtgcagtggcgct

SEQ ID NO: 7146419 - DNA, 22 bp, Homo sapiens
caggctggagtgcagtggcgct

SEQ ID NO: 7146420 - DNA, 22 bp, Homo sapiens
caggctggagtgcagtggcgct

SEQ ID NO: 7146421 - DNA, 22 bp, Homo sapiens
caggctggagtgcagtggcgct

SEQ ID NO: 7146422 - DNA, 22 bp, Homo sapiens
caggctggagtgcagtggcgct

SEQ ID NO: 7146423 - DNA, 22 bp, Homo sapiens
caggctggagtgcagtggcgcc

SEQ ID NO: 7146424 - DNA, 22 bp, Homo sapiens
caggctggagtgcagtggcgcc

SEQ ID NO: 7146425 - DNA, 22 bp, Homo sapiens
tagaacataagtcattcatttg

SEQ ID NO: 7146426 - DNA, 22 bp, Homo sapiens
tagaacataagtcattcatttg

SEQ ID NO: 7146427 - DNA, 22 bp, Homo sapiens
tagaacataagtcattcatttg

SEQ ID NO: 7146428 - DNA, 22 bp, Homo sapiens
caggctggagtgcagtggtgcc

SEQ ID NO: 7146429 - DNA, 22 bp, Homo sapiens
caggctggagtgcagtggtgcc

SEQ ID NO: 7146430 - DNA, 22 bp, Homo sapiens
caggctggagtgcagtggtgcc

SEQ ID NO: 7146431 - DNA, 22 bp, Homo sapiens
caggctggagtgcagtggtgcc

SEQ ID NO: 7146432 - DNA, 22 bp, Homo sapiens
caggctggagtgcagtggggcg

SEQ ID NO: 7146433 - DNA, 22 bp, Homo sapiens
tagaacatcaggttgaatttgg

SEQ ID NO: 7146434 - DNA, 22 bp, Homo sapiens
tagaataatctgaggaaatgct

SEQ ID NO: 7146435 - DNA, 22 bp, Homo sapiens
tagaataatctgaggaaatgct

SEQ ID NO: 7146436 - DNA, 22 bp, Homo sapiens
tagaatatacactacagcttaa

SEQ ID NO: 7146437 - DNA, 22 bp, Homo sapiens
tagaatatacactacagcttaa

SEQ ID NO: 7146438 - DNA, 22 bp, Homo sapiens
tagaatagtggctggcatattt

SEQ ID NO: 7146439 - DNA, 22 bp, Homo sapiens
tagaatagtgttttcattatgg

SEQ ID NO: 7146440 - DNA, 19 bp, Homo sapiens
tagaatagttacacagatt

SEQ ID NO: 7146441 - DNA, 22 bp, Homo sapiens
tagaatatgattaattttctta

SEQ ID NO: 7146442 - DNA, 22 bp, Homo sapiens
tagaatatgattaattttctta

SEQ ID NO: 7146443 - DNA, 22 bp, Homo sapiens
tagaatatgattaattttctta

SEQ ID NO: 7146444 - DNA, 22 bp, Homo sapiens
tagaatatacactacagcttaa

SEQ ID NO: 7146445 - DNA, 18 bp, Homo sapiens
tagaatataggtcattct

SEQ ID NO: 7146446 - DNA, 18 bp, Homo sapiens
tagaatataggtcattct

SEQ ID NO: 7146447 - DNA, 22 bp, Homo sapiens
tagacattttctcaacatctct

SEQ ID NO: 7146448 - DNA, 22 bp, Homo sapiens
caggctgtccaggctcctttgg

SEQ ID NO: 7146449 - DNA, 22 bp, Homo sapiens
tagacattttctcaacatctct

SEQ ID NO: 7146450 - DNA, 22 bp, Homo sapiens
caggctggtcccagagcattgc

SEQ ID NO: 7146451 - DNA, 22 bp, Homo sapiens
caggctggtcccagagcattgc

SEQ ID NO: 7146452 - DNA, 22 bp, Homo sapiens
caggctggtcccagagcattgc

SEQ ID NO: 7146453 - DNA, 22 bp, Homo sapiens
caggctgggctggtgttagagt

SEQ ID NO: 7146454 - DNA, 22 bp, Homo sapiens
caggctgggctggtgttagagt

SEQ ID NO: 7146455 - DNA, 22 bp, Homo sapiens
caggctgggctccggagataaa

SEQ ID NO: 7146456 - DNA, 22 bp, Homo sapiens
caggctgggctccggagataaa

SEQ ID NO: 7146457 - DNA, 22 bp, Homo sapiens
caggctgggcagcctccccggc

SEQ ID NO: 7146458 - DNA, 22 bp, Homo sapiens
caggctgggctccggagataaa

SEQ ID NO: 7146459 - DNA, 22 bp, Homo sapiens
caggctgggctccggagataaa

SEQ ID NO: 7146460 - DNA, 22 bp, Homo sapiens
caggctgggcagcctccccggc

SEQ ID NO: 7146461 - DNA, 21 bp, Homo sapiens
tagaatcactaataagatgta

SEQ ID NO: 7146462 - DNA, 21 bp, Homo sapiens
tagaatcactaataagatgta

SEQ ID NO: 7146463 - DNA, 22 bp, Homo sapiens
tagaatatgtggtaggatctgg

SEQ ID NO: 7146464 - DNA, 22 bp, Homo sapiens
tagaatatgattaattttctta

SEQ ID NO: 7146465 - DNA, 22 bp, Homo sapiens
tagaatatgtggtaggatctgg

SEQ ID NO: 7146466 - DNA, 22 bp, Homo sapiens
tagaatatgtggtgtatacttt

SEQ ID NO: 7146467 - DNA, 22 bp, Homo sapiens
tagataaattagaaagtttact

SEQ ID NO: 7146468 - DNA, 22 bp, Homo sapiens
tagataaaagggcaaagggcat

SEQ ID NO: 7146469 - DNA, 22 bp, Homo sapiens
tagataaattagaaagtttact

SEQ ID NO: 7146470 - DNA, 22 bp, Homo sapiens
tagataaattagaaagtttact

SEQ ID NO: 7146471 - DNA, 22 bp, Homo sapiens
tagataaaagggcaaagggcat

SEQ ID NO: 7146472 - DNA, 22 bp, Homo sapiens
tagataaaagggcaaagggcat

SEQ ID NO: 7146473 - DNA, 22 bp, Homo sapiens
tagataaaagggcaaagggcat

SEQ ID NO: 7146474 - DNA, 22 bp, Homo sapiens
tagagtgtcataacagtgccca

SEQ ID NO: 7146475 - DNA, 22 bp, Homo sapiens
tagagtgtccaacacataggag

SEQ ID NO: 7146476 - DNA, 22 bp, Homo sapiens
tagagtgtcataacagtgccca

SEQ ID NO: 7146477 - DNA, 21 bp, Homo sapiens
tagagtgtctgtgtgggaatt

SEQ ID NO: 7146478 - DNA, 22 bp, Homo sapiens
tagagtgttttgttaggcagca

SEQ ID NO: 7146479 - DNA, 18 bp, Homo sapiens
tagagttactacatgatt

SEQ ID NO: 7146480 - DNA, 22 bp, Homo sapiens
tagagttatccttcacaggtat

SEQ ID NO: 7146481 - DNA, 22 bp, Homo sapiens
tagagttatccttcacaggtat

SEQ ID NO: 7146482 - DNA, 22 bp, Homo sapiens
tagagtgtaatacaaactaaac

SEQ ID NO: 7146483 - DNA, 22 bp, Homo sapiens
tagagtgtcataacagtgccca

SEQ ID NO: 7146484 - DNA, 22 bp, Homo sapiens
tagagtgtcataacagtgccca

SEQ ID NO: 7146485 - DNA, 19 bp, Homo sapiens
tagaggagaagggaagtgg

SEQ ID NO: 7146486 - DNA, 19 bp, Homo sapiens
tagaggagaagggaagtgg

SEQ ID NO: 7146487 - DNA, 19 bp, Homo sapiens
tagaggagaagggaagtgg

SEQ ID NO: 7146488 - DNA, 22 bp, Homo sapiens
tagaggaactgcctttcttctg

SEQ ID NO: 7146489 - DNA, 22 bp, Homo sapiens
tagaggagaacacaaattatag

SEQ ID NO: 7146490 - DNA, 22 bp, Homo sapiens
tagaggagaacacaaattatag

SEQ ID NO: 7146491 - DNA, 22 bp, Homo sapiens
tagagctggaaaactgcaggta

SEQ ID NO: 7146492 - DNA, 22 bp, Homo sapiens
tagagctgtatcaaagagcctt

SEQ ID NO: 7146493 - DNA, 23 bp, Homo sapiens
tagagcttcagcgaatgtgctca

SEQ ID NO: 7146494 - DNA, 22 bp, Homo sapiens
tagagcttggactgcattttcg

SEQ ID NO: 7146495 - DNA, 22 bp, Homo sapiens
tagagcttggggatttagtagt

SEQ ID NO: 7146496 - DNA, 22 bp, Homo sapiens
tagaggaaatttccaaggtgag

SEQ ID NO: 7146497 - DNA, 22 bp, Homo sapiens
cagggcagaacatatagatagt

SEQ ID NO: 7146498 - DNA, 22 bp, Homo sapiens
cagggcagaacatatagatagt

SEQ ID NO: 7146499 - DNA, 22 bp, Homo sapiens
cagggcagaacatatagatagt

SEQ ID NO: 7146500 - DNA, 22 bp, Homo sapiens
cagggcagaaggcactctactc

SEQ ID NO: 7146501 - DNA, 22 bp, Homo sapiens
cagggcagaaggcactctactc

SEQ ID NO: 7146502 - DNA, 22 bp, Homo sapiens
cagggcagaaggcactctactc

SEQ ID NO: 7146503 - DNA, 20 bp, Homo sapiens
cagggcacactgcagcctcg

SEQ ID NO: 7146504 - DNA, 22 bp, Homo sapiens
cagggcacagttatggaggtgg

SEQ ID NO: 7146505 - DNA, 22 bp, Homo sapiens
cagggcacggagaagtcacccc

SEQ ID NO: 7146506 - DNA, 22 bp, Homo sapiens
tagataatttggcatcatattg

SEQ ID NO: 7146507 - DNA, 22 bp, Homo sapiens
tagataatttggcatcatattg

SEQ ID NO: 7146508 - DNA, 22 bp, Homo sapiens
tagatacacacacagtcatgtg

SEQ ID NO: 7146509 - DNA, 22 bp, Homo sapiens
tagataatttggcatcatattg

SEQ ID NO: 7146510 - DNA, 22 bp, Homo sapiens
tagataatttggcatcatattg

SEQ ID NO: 7146511 - DNA, 22 bp, Homo sapiens
tagataatttggcatcatattg

SEQ ID NO: 7146512 - DNA, 22 bp, Homo sapiens
tagataaattagaaagtttact

SEQ ID NO: 7146513 - DNA, 22 bp, Homo sapiens
tagataacagcactggcctcgc

SEQ ID NO: 7146514 - DNA, 22 bp, Homo sapiens
tagataacttgcacctacagga

SEQ ID NO: 7146515 - DNA, 22 bp, Homo sapiens
tagataagaatggcatcttctc

SEQ ID NO: 7146516 - DNA, 22 bp, Homo sapiens
cagggatggcgctggctgcccg

SEQ ID NO: 7146517 - DNA, 22 bp, Homo sapiens
cagggatggcgctggctgcccg

SEQ ID NO: 7146518 - DNA, 22 bp, Homo sapiens
tagatacacacacagtcatgtg

SEQ ID NO: 7146519 - DNA, 22 bp, Homo sapiens
cagggcaaagagagcacatgct

SEQ ID NO: 7146520 - DNA, 22 bp, Homo sapiens
cagggcaaagagagcacatgct

SEQ ID NO: 7146521 - DNA, 22 bp, Homo sapiens
cagggcaaagtcttctagaacc

SEQ ID NO: 7146522 - DNA, 22 bp, Homo sapiens
cagggcaaggcagagcgtcccc

SEQ ID NO: 7146523 - DNA, 22 bp, Homo sapiens
cagggcaagtttgagattattt

SEQ ID NO: 7146524 - DNA, 21 bp, Homo sapiens
cagggcacacagaggatggta

SEQ ID NO: 7146525 - DNA, 22 bp, Homo sapiens
tagcaagtagatactcatttag

SEQ ID NO: 7146526 - DNA, 22 bp, Homo sapiens
tagcaagtatgatactccatga

SEQ ID NO: 7146527 - DNA, 22 bp, Homo sapiens
tagcaagtggcaccacatttct

SEQ ID NO: 7146528 - DNA, 22 bp, Homo sapiens
tagcaagtgttggtgaagatgt

SEQ ID NO: 7146529 - DNA, 21 bp, Homo sapiens
tagcaatacgtggaccatggg

SEQ ID NO: 7146530 - DNA, 22 bp, Homo sapiens
cagggcagagccaggatttcaa

SEQ ID NO: 7146531 - DNA, 22 bp, Homo sapiens
tagcaagatccttccctggcgt

SEQ ID NO: 7146532 - DNA, 22 bp, Homo sapiens
tagcaagatcgtgtctctaaaa

SEQ ID NO: 7146533 - DNA, 22 bp, Homo sapiens
tagcaagatgatgaattattca

SEQ ID NO: 7146534 - DNA, 22 bp, Homo sapiens
tagcattatctgtcttatcatt

SEQ ID NO: 7146535 - DNA, 22 bp, Homo sapiens
tagcattatttcctctttttgt

SEQ ID NO: 7146536 - DNA, 22 bp, Homo sapiens
tagcattccatcactcagcacc

SEQ ID NO: 7146537 - DNA, 22 bp, Homo sapiens
tagcattccatcactcagcacc

SEQ ID NO: 7146538 - DNA, 22 bp, Homo sapiens
tagcgatcaggattaaagtcca

SEQ ID NO: 7146539 - DNA, 22 bp, Homo sapiens
tagctacaaggaagaatggaaa

SEQ ID NO: 7146540 - DNA, 20 bp, Homo sapiens
tagcaatgagtgttccattt

SEQ ID NO: 7146541 - DNA, 22 bp, Homo sapiens
tagcaatgctctatgatgaaaa

SEQ ID NO: 7146542 - DNA, 22 bp, Homo sapiens
tagcaatgcttcattatttaaa

SEQ ID NO: 7146543 - DNA, 22 bp, Homo sapiens
tagcaatgcttcattatttaaa

SEQ ID NO: 7146544 - DNA, 22 bp, Homo sapiens
tagcaatgtaagatgttaacac

SEQ ID NO: 7146545 - DNA, 22 bp, Homo sapiens
tagcaatgtgtgtgtataaatt

SEQ ID NO: 7146546 - DNA, 22 bp, Homo sapiens
tagcattagtcagatatgtttt

SEQ ID NO: 7146547 - DNA, 22 bp, Homo sapiens
tagcattatctgtcttatcatt

SEQ ID NO: 7146548 - DNA, 22 bp, Homo sapiens
cctgaggggctgcaggccagct

SEQ ID NO: 7146549 - DNA, 22 bp, Homo sapiens
cctgaggggctgcaggccagct

SEQ ID NO: 7146550 - DNA, 22 bp, Homo sapiens
cctgagggtcaaggagccctag

SEQ ID NO: 7146551 - DNA, 22 bp, Homo sapiens
cctgagggctcagcccccagcc

SEQ ID NO: 7146552 - DNA, 22 bp, Homo sapiens
cctgagggctcagcccccagcc

SEQ ID NO: 7146553 - DNA, 22 bp, Homo sapiens
cctgagggcgccgagctcccag

SEQ ID NO: 7146554 - DNA, 22 bp, Homo sapiens
cctgagggcgccgagctcccag

SEQ ID NO: 7146555 - DNA, 22 bp, Homo sapiens
cctgaggcttaatctgtcccaa

SEQ ID NO: 7146556 - DNA, 22 bp, Homo sapiens
cctgaggcttaatctgtcccaa

SEQ ID NO: 7146557 - DNA, 22 bp, Homo sapiens
cctgagggaacatgcacccaat

SEQ ID NO: 7146558 - DNA, 22 bp, Homo sapiens
cctgagggaacatgcacccaat

SEQ ID NO: 7146559 - DNA, 22 bp, Homo sapiens
cctgagggaaggatgctaccca

SEQ ID NO: 7146560 - DNA, 22 bp, Homo sapiens
cctgagggagggtataggctgt

SEQ ID NO: 7146561 - DNA, 22 bp, Homo sapiens
cctgagggagggtataggctgt

SEQ ID NO: 7146562 - DNA, 22 bp, Homo sapiens
cctgagggagggtataggctgt

SEQ ID NO: 7146563 - DNA, 22 bp, Homo sapiens
cctgagcttgatccttctgtct

SEQ ID NO: 7146564 - DNA, 22 bp, Homo sapiens
cctgaggccctggctgtgctga

SEQ ID NO: 7146565 - DNA, 22 bp, Homo sapiens
cctgaggctccacctccagaga

SEQ ID NO: 7146566 - DNA, 22 bp, Homo sapiens
cctgaggctcgcgcgcccctgg

SEQ ID NO: 7146567 - DNA, 22 bp, Homo sapiens
cctgaggcttaatctgtcccaa

SEQ ID NO: 7146568 - DNA, 22 bp, Homo sapiens
cctgaggctctcctgaataatg

SEQ ID NO: 7146569 - DNA, 22 bp, Homo sapiens
cctgaggctggcccttccatcc

SEQ ID NO: 7146570 - DNA, 22 bp, Homo sapiens
cctgaccctccttagagtccag

SEQ ID NO: 7146571 - DNA, 19 bp, Homo sapiens
cctgaccacacaggccttg

SEQ ID NO: 7146572 - DNA, 22 bp, Homo sapiens
cctgaccacccttggacaaggt

SEQ ID NO: 7146573 - DNA, 22 bp, Homo sapiens
cctgaccagagtgagggcttag

SEQ ID NO: 7146574 - DNA, 22 bp, Homo sapiens
cctgaccatttgccacatgggt

SEQ ID NO: 7146575 - DNA, 22 bp, Homo sapiens
cctgacaggagaagcgcagcat

SEQ ID NO: 7146576 - DNA, 22 bp, Homo sapiens
cctgacaggagaagcgcagcat

SEQ ID NO: 7146577 - DNA, 22 bp, Homo sapiens
cctgacaggcggaggctgcagt

SEQ ID NO: 7146578 - DNA, 22 bp, Homo sapiens
cctgacagtggtagccttggca

SEQ ID NO: 7146579 - DNA, 19 bp, Homo sapiens
cctgaccacacaggccttg

SEQ ID NO: 7146580 - DNA, 22 bp, Homo sapiens
cctgactctggccaggccagct

SEQ ID NO: 7146581 - DNA, 22 bp, Homo sapiens
cctgactctggccaggccagct

SEQ ID NO: 7146582 - DNA, 22 bp, Homo sapiens
cctgacgaaaggcgtgctggag

SEQ ID NO: 7146583 - DNA, 22 bp, Homo sapiens
cctgaccttagtttccttgtga

SEQ ID NO: 7146584 - DNA, 22 bp, Homo sapiens
cctgaccttcaagtctgttctt

SEQ ID NO: 7146585 - DNA, 22 bp, Homo sapiens
cctgactcctgggcaaaaccaa

SEQ ID NO: 7146586 - DNA, 22 bp, Homo sapiens
cctgacctccaagtggctctgg

SEQ ID NO: 7146587 - DNA, 22 bp, Homo sapiens
cctgaccttagtttccttgtga

SEQ ID NO: 7146588 - DNA, 22 bp, Homo sapiens
cctgagacatgaaccaggctcc

SEQ ID NO: 7146589 - DNA, 22 bp, Homo sapiens
cctgagaatgtttaacagagaa

SEQ ID NO: 7146590 - DNA, 22 bp, Homo sapiens
cctgagaatgtttaacagagaa

SEQ ID NO: 7146591 - DNA, 22 bp, Homo sapiens
cctgagaatttgtggttcagga

SEQ ID NO: 7146592 - DNA, 22 bp, Homo sapiens
tggggtacttgtatcaaagcac

SEQ ID NO: 7146593 - DNA, 22 bp, Homo sapiens
tgggggtgtgccagggacctcc

SEQ ID NO: 7146594 - DNA, 22 bp, Homo sapiens
tggggtacttgtatcaaagcac

SEQ ID NO: 7146595 - DNA, 22 bp, Homo sapiens
tggggtacttgtatcaaagcac

SEQ ID NO: 7146596 - DNA, 22 bp, Homo sapiens
tggggtaggagtcagcgagaga

SEQ ID NO: 7146597 - DNA, 22 bp, Homo sapiens
tgggggtgtgccagggacctcc

SEQ ID NO: 7146598 - DNA, 22 bp, Homo sapiens
tgggggtgtgccagggacctcc

SEQ ID NO: 7146599 - DNA, 22 bp, Homo sapiens
tgggggtgtcctggtgcacaca

SEQ ID NO: 7146600 - DNA, 22 bp, Homo sapiens
tgggggtgtcctggtgcacaca

SEQ ID NO: 7146601 - DNA, 22 bp, Homo sapiens
tgggggtgtcctggtgcacaca

SEQ ID NO: 7146602 - DNA, 22 bp, Homo sapiens
tgggggtgtgccagggacctcc

SEQ ID NO: 7146603 - DNA, 22 bp, Homo sapiens
tggggtcccactcagctcccct

SEQ ID NO: 7146604 - DNA, 22 bp, Homo sapiens
tggggtccagtgcctggcaagg

SEQ ID NO: 7146605 - DNA, 22 bp, Homo sapiens
tggggtcccaactctgattgat

SEQ ID NO: 7146606 - DNA, 22 bp, Homo sapiens
tggggtcccactcagctcccct

SEQ ID NO: 7146607 - DNA, 19 bp, Homo sapiens
tggggtcaagagaggcttc

SEQ ID NO: 7146608 - DNA, 22 bp, Homo sapiens
tggggtccagtgccaccccaag

SEQ ID NO: 7146609 - DNA, 22 bp, Homo sapiens
tggggtccagtgccaccccaag

SEQ ID NO: 7146610 - DNA, 22 bp, Homo sapiens
tggggtaggagtcagcgagaga

SEQ ID NO: 7146611 - DNA, 22 bp, Homo sapiens
tggggtagggaaaagaagtcga

SEQ ID NO: 7146612 - DNA, 22 bp, Homo sapiens
tggggtaggtatgaaaactagg

SEQ ID NO: 7146613 - DNA, 19 bp, Homo sapiens
tggggtcaagagaggcttc

SEQ ID NO: 7146614 - DNA, 21 bp, Homo sapiens
tgggggagaattggttgcttt

SEQ ID NO: 7146615 - DNA, 22 bp, Homo sapiens
tgggggagagaggcattctttc

SEQ ID NO: 7146616 - DNA, 22 bp, Homo sapiens
tgggggagagaggcattctttc

SEQ ID NO: 7146617 - DNA, 22 bp, Homo sapiens
tgggggagagaggcattctttc

SEQ ID NO: 7146618 - DNA, 22 bp, Homo sapiens
tgggggtggttcttgcctccag

SEQ ID NO: 7146619 - DNA, 22 bp, Homo sapiens
tgggggtggttcttgcctccag

SEQ ID NO: 7146620 - DNA, 22 bp, Homo sapiens
tgggggtggttcttgcctccag

SEQ ID NO: 7146621 - DNA, 22 bp, Homo sapiens
tgggggtgtcctggtgcacaca

SEQ ID NO: 7146622 - DNA, 22 bp, Homo sapiens
cctgaggtcagccattcttgcc

SEQ ID NO: 7146623 - DNA, 22 bp, Homo sapiens
cctgaggtcacaacttgcttat

SEQ ID NO: 7146624 - DNA, 21 bp, Homo sapiens
cctgagggtggttgtgaagat

SEQ ID NO: 7146625 - DNA, 22 bp, Homo sapiens
cctgccaggagctggtgctgca

SEQ ID NO: 7146626 - DNA, 22 bp, Homo sapiens
cctgccaggccagtgagcttcc

SEQ ID NO: 7146627 - DNA, 22 bp, Homo sapiens
cctgccaggagctggtgctgca

SEQ ID NO: 7146628 - DNA, 22 bp, Homo sapiens
cctgccaggagctggtgctgca

SEQ ID NO: 7146629 - DNA, 22 bp, Homo sapiens
cctgccaggagctggtgctgca

SEQ ID NO: 7146630 - DNA, 22 bp, Homo sapiens
cctgcagaagagtccagctcat

SEQ ID NO: 7146631 - DNA, 22 bp, Homo sapiens
cctgcagacacttgtccagcaa

SEQ ID NO: 7146632 - DNA, 22 bp, Homo sapiens
cctgcaccaggcccagcatggt

SEQ ID NO: 7146633 - DNA, 22 bp, Homo sapiens
cctgcacccaggccgcacctct

SEQ ID NO: 7146634 - DNA, 22 bp, Homo sapiens
cctgcacccaggccgcacctct

SEQ ID NO: 7146635 - DNA, 22 bp, Homo sapiens
cctgcacctaacacaacgctct

SEQ ID NO: 7146636 - DNA, 22 bp, Homo sapiens
cctgcacctgagcagcctgact

SEQ ID NO: 7146637 - DNA, 22 bp, Homo sapiens
cctgcacctgagcagcctgact

SEQ ID NO: 7146638 - DNA, 22 bp, Homo sapiens
cctgcactacctggggctgctg

SEQ ID NO: 7146639 - DNA, 22 bp, Homo sapiens
cctgcacttctcacagctgctg

SEQ ID NO: 7146640 - DNA, 22 bp, Homo sapiens
cctgcacttctcacagctgctg

SEQ ID NO: 7146641 - DNA, 22 bp, Homo sapiens
cctgcagaaagggtccccagga

SEQ ID NO: 7146642 - DNA, 22 bp, Homo sapiens
cctgcagaaagggtccccagga

SEQ ID NO: 7146643 - DNA, 22 bp, Homo sapiens
cctgcagaaagggtccccagga

SEQ ID NO: 7146644 - DNA, 22 bp, Homo sapiens
cctgcagaagagtccagctcat

SEQ ID NO: 7146645 - DNA, 22 bp, Homo sapiens
cctgatggtatattgttgggag

SEQ ID NO: 7146646 - DNA, 22 bp, Homo sapiens
cctgatggctgtctgggcctga

SEQ ID NO: 7146647 - DNA, 20 bp, Homo sapiens
tggggtcctggaggggatcc

SEQ ID NO: 7146648 - DNA, 22 bp, Homo sapiens
tggggtcgagggttctctggca

SEQ ID NO: 7146649 - DNA, 22 bp, Homo sapiens
cctgcaagacctgagacacacc

SEQ ID NO: 7146650 - DNA, 22 bp, Homo sapiens
cctgcacagaccaaagaggaca

SEQ ID NO: 7146651 - DNA, 22 bp, Homo sapiens
cctgcacagccggacccctgct

SEQ ID NO: 7146652 - DNA, 22 bp, Homo sapiens
cctgcacagccttggctgacac

SEQ ID NO: 7146653 - DNA, 22 bp, Homo sapiens
cctgcacaggccaggcatctga

SEQ ID NO: 7146654 - DNA, 22 bp, Homo sapiens
cctgcacatgtgtgcgcctgta

SEQ ID NO: 7146655 - DNA, 22 bp, Homo sapiens
cctgcaccacaaggcttcagag

SEQ ID NO: 7146656 - DNA, 22 bp, Homo sapiens
cctgcaccacactcactgctca

SEQ ID NO: 7146657 - DNA, 22 bp, Homo sapiens
tggctctctacaggtcaagacc

SEQ ID NO: 7146658 - DNA, 22 bp, Homo sapiens
tggctctcccaatacctttctg

SEQ ID NO: 7146659 - DNA, 22 bp, Homo sapiens
tggctctctacaggtcaagacc

SEQ ID NO: 7146660 - DNA, 22 bp, Homo sapiens
tggctctccagagcctatggta

SEQ ID NO: 7146661 - DNA, 22 bp, Homo sapiens
tggctctcagctcccagcagcc

SEQ ID NO: 7146662 - DNA, 22 bp, Homo sapiens
cctccctgctcctcaactggca

SEQ ID NO: 7146663 - DNA, 22 bp, Homo sapiens
cctccctgcgctcctgcggcgg

SEQ ID NO: 7146664 - DNA, 22 bp, Homo sapiens
cctccctgcgctcctgcggcgg

SEQ ID NO: 7146665 - DNA, 22 bp, Homo sapiens
cctccctgcgctcctgcggcgg

SEQ ID NO: 7146666 - DNA, 22 bp, Homo sapiens
cctccctctttcagtcccacag

SEQ ID NO: 7146667 - DNA, 21 bp, Homo sapiens
tggctctgaaagagtgctgca

SEQ ID NO: 7146668 - DNA, 22 bp, Homo sapiens
tggctctgaccaggtagaggag

SEQ ID NO: 7146669 - DNA, 21 bp, Homo sapiens
tggctctgaaagagtgctgca

SEQ ID NO: 7146670 - DNA, 21 bp, Homo sapiens
tggctctgaaagagtgctgca

SEQ ID NO: 7146671 - DNA, 21 bp, Homo sapiens
tggctctgaaagagtgctgca

SEQ ID NO: 7146672 - DNA, 22 bp, Homo sapiens
tggctctcttgtaaggtagtag

SEQ ID NO: 7146673 - DNA, 21 bp, Homo sapiens
tggctctgaaagagtgctgca

SEQ ID NO: 7146674 - DNA, 21 bp, Homo sapiens
tgggagagcgttgctgtcctc

SEQ ID NO: 7146675 - DNA, 21 bp, Homo sapiens
tgggagagcgttgctgtcctc

SEQ ID NO: 7146676 - DNA, 21 bp, Homo sapiens
tgggagagcgttgctgtcctc

SEQ ID NO: 7146677 - DNA, 21 bp, Homo sapiens
tgggagagcgttgctgtcctc

SEQ ID NO: 7146678 - DNA, 22 bp, Homo sapiens
tgggagcaggaagcaggaagta

SEQ ID NO: 7146679 - DNA, 22 bp, Homo sapiens
tgggagcaggaagcaggaagta

SEQ ID NO: 7146680 - DNA, 22 bp, Homo sapiens
tgggagcaggaagcaggaagta

SEQ ID NO: 7146681 - DNA, 22 bp, Homo sapiens
tgggagcaggtgtgctagggaa

SEQ ID NO: 7146682 - DNA, 22 bp, Homo sapiens
tgggagcaggtgtgctagggaa

SEQ ID NO: 7146683 - DNA, 22 bp, Homo sapiens
tgggagcaggtgtgctagggaa

SEQ ID NO: 7146684 - DNA, 22 bp, Homo sapiens
tgggagcaggtgtgctagggaa

SEQ ID NO: 7146685 - DNA, 22 bp, Homo sapiens
tgggagcaggtgtgctagggaa

SEQ ID NO: 7146686 - DNA, 22 bp, Homo sapiens
tgggagcaggtgtgctagggaa

SEQ ID NO: 7146687 - DNA, 22 bp, Homo sapiens
tgggagcagttcaggtgtggct

SEQ ID NO: 7146688 - DNA, 22 bp, Homo sapiens
tgggagcagttcaggtgtggct

SEQ ID NO: 7146689 - DNA, 22 bp, Homo sapiens
tgggagcagttcaggtgtggct

SEQ ID NO: 7146690 - DNA, 22 bp, Homo sapiens
tgggagcagttgcatctccagt

SEQ ID NO: 7146691 - DNA, 22 bp, Homo sapiens
tgggagcagttgtgaagctcag

SEQ ID NO: 7146692 - DNA, 22 bp, Homo sapiens
tgggagcagttgtgaagctcag

SEQ ID NO: 7146693 - DNA, 22 bp, Homo sapiens
tgggagcagttgtgaagctcag

SEQ ID NO: 7146694 - DNA, 22 bp, Homo sapiens
tgggagccattttagaggctgc

SEQ ID NO: 7146695 - DNA, 22 bp, Homo sapiens
tgggagccattttagaggctgc

SEQ ID NO: 7146696 - DNA, 22 bp, Homo sapiens
tgggagcccaagggagctgccg

SEQ ID NO: 7146697 - DNA, 22 bp, Homo sapiens
tgggagcccaagggagctgccg

SEQ ID NO: 7146698 - DNA, 22 bp, Homo sapiens
tgggagcctggcaggccagagg

SEQ ID NO: 7146699 - DNA, 22 bp, Homo sapiens
tgggagctaattactccggttg

SEQ ID NO: 7146700 - DNA, 23 bp, Homo sapiens
tgggagctcaagggaggctgccc

SEQ ID NO: 7146701 - DNA, 22 bp, Homo sapiens
cctctggcatagcaagtggcct

SEQ ID NO: 7146702 - DNA, 22 bp, Homo sapiens
cctctggccacatgggacatag

SEQ ID NO: 7146703 - DNA, 22 bp, Homo sapiens
cctctggcagccagccagttgt

SEQ ID NO: 7146704 - DNA, 22 bp, Homo sapiens
cctctggcaagtgatttatcat

SEQ ID NO: 7146705 - DNA, 22 bp, Homo sapiens
cctctggcagccagccagttgt

SEQ ID NO: 7146706 - DNA, 22 bp, Homo sapiens
cctctggcaacttcacagccca

SEQ ID NO: 7146707 - DNA, 22 bp, Homo sapiens
cctctggcaacttcacagccca

SEQ ID NO: 7146708 - DNA, 22 bp, Homo sapiens
cctctggatctttctccacact

SEQ ID NO: 7146709 - DNA, 22 bp, Homo sapiens
cctctggcaacttcacagccca

SEQ ID NO: 7146710 - DNA, 22 bp, Homo sapiens
cctctggcaacttcacagccca

SEQ ID NO: 7146711 - DNA, 22 bp, Homo sapiens
cctctggcaacttcacagccca

SEQ ID NO: 7146712 - DNA, 22 bp, Homo sapiens
tgggagctcctggagggcagga

SEQ ID NO: 7146713 - DNA, 22 bp, Homo sapiens
tgggagctcctggagggcagga

SEQ ID NO: 7146714 - DNA, 22 bp, Homo sapiens
tgggagctcagaaagggaggtc

SEQ ID NO: 7146715 - DNA, 22 bp, Homo sapiens
tgggagctcagaaagggaggtc

SEQ ID NO: 7146716 - DNA, 23 bp, Homo sapiens
tgggagctcaagggaggctgccc

SEQ ID NO: 7146717 - DNA, 22 bp, Homo sapiens
tgggagctcacaggcctggctc

SEQ ID NO: 7146718 - DNA, 22 bp, Homo sapiens
tgggagctcacaggcctggctc

SEQ ID NO: 7146719 - DNA, 22 bp, Homo sapiens
cctgaaaatcaaggtagtttgg

SEQ ID NO: 7146720 - DNA, 22 bp, Homo sapiens
cctgaagcacaaaagcacagct

SEQ ID NO: 7146721 - DNA, 22 bp, Homo sapiens
cctgaagcacccggagctggca

SEQ ID NO: 7146722 - DNA, 22 bp, Homo sapiens
cctctttgttcaggctgctggc

SEQ ID NO: 7146723 - DNA, 23 bp, Homo sapiens
cctgaagggtcagggtcctcagc

SEQ ID NO: 7146724 - DNA, 22 bp, Homo sapiens
cctgaataatttgtgaaaagat

SEQ ID NO: 7146725 - DNA, 22 bp, Homo sapiens
cctgaatactggtgctgaaagt

SEQ ID NO: 7146726 - DNA, 22 bp, Homo sapiens
cctgaataggctctgctcaaaa

SEQ ID NO: 7146727 - DNA, 22 bp, Homo sapiens
cctgaatgcctgacatttcact

SEQ ID NO: 7146728 - DNA, 22 bp, Homo sapiens
cctcttgacagcctctgtttcc

SEQ ID NO: 7146729 - DNA, 22 bp, Homo sapiens
cctcttctgagtgagactccct

SEQ ID NO: 7146730 - DNA, 22 bp, Homo sapiens
cctcttgagtgtctgttttcca

SEQ ID NO: 7146731 - DNA, 22 bp, Homo sapiens
cctcttgattggttggaagcgg

SEQ ID NO: 7146732 - DNA, 22 bp, Homo sapiens
cctcttgatttggctgtgaagt

SEQ ID NO: 7146733 - DNA, 22 bp, Homo sapiens
cctctttgactctcaggtcttt

SEQ ID NO: 7146734 - DNA, 21 bp, Homo sapiens
tgggccagatctgagtttcta

SEQ ID NO: 7146735 - DNA, 22 bp, Homo sapiens
tgggccagcaattgctgctcag

SEQ ID NO: 7146736 - DNA, 21 bp, Homo sapiens
tgggccagatctgagtttcta

SEQ ID NO: 7146737 - DNA, 22 bp, Homo sapiens
tgggccagcaattgctgctcag

SEQ ID NO: 7146738 - DNA, 22 bp, Homo sapiens
tgggccagaggcatggagctat

SEQ ID NO: 7146739 - DNA, 22 bp, Homo sapiens
tgggccagaggcatggagctat

SEQ ID NO: 7146740 - DNA, 22 bp, Homo sapiens
tgggccagaggcatggagctat

SEQ ID NO: 7146741 - DNA, 22 bp, Homo sapiens
tgggccagatccatggcaataa

SEQ ID NO: 7146742 - DNA, 22 bp, Homo sapiens
tgggccagatccatggcaataa

SEQ ID NO: 7146743 - DNA, 22 bp, Homo sapiens
tgggccagaggcatggagctat

SEQ ID NO: 7146744 - DNA, 22 bp, Homo sapiens
tgggccagatccatggcaataa

SEQ ID NO: 7146745 - DNA, 22 bp, Homo sapiens
tgggccagaagtatgcatgttt

SEQ ID NO: 7146746 - DNA, 22 bp, Homo sapiens
tgggccacttgaaagtggatgt

SEQ ID NO: 7146747 - DNA, 22 bp, Homo sapiens
tgggccacttgaaagtggatgt

SEQ ID NO: 7146748 - DNA, 22 bp, Homo sapiens
tgggccagaagtatgcatgttt

SEQ ID NO: 7146749 - DNA, 22 bp, Homo sapiens
tgggccagaagtatgcatgttt

SEQ ID NO: 7146750 - DNA, 22 bp, Homo sapiens
tgggccagaagtatgcatgttt

SEQ ID NO: 7146751 - DNA, 22 bp, Homo sapiens
tgggccagagagtaagaaaggt

SEQ ID NO: 7146752 - DNA, 22 bp, Homo sapiens
tgggccagagagtaagaaaggt

SEQ ID NO: 7146753 - DNA, 22 bp, Homo sapiens
tgggccagagagtaagaaaggt

SEQ ID NO: 7146754 - DNA, 22 bp, Homo sapiens
tgggccagaggcatggagctat

SEQ ID NO: 7146755 - DNA, 22 bp, Homo sapiens
tgggccagaggcatggagctat

SEQ ID NO: 7146756 - DNA, 22 bp, Homo sapiens
tgggccagaggcatggagctat

SEQ ID NO: 7146757 - DNA, 22 bp, Homo sapiens
cctctggccatcccccattaag

SEQ ID NO: 7146758 - DNA, 22 bp, Homo sapiens
cctctggccatcccccattaag

SEQ ID NO: 7146759 - DNA, 22 bp, Homo sapiens
cctctggcctaggccgggagag

SEQ ID NO: 7146760 - DNA, 22 bp, Homo sapiens
cctctggcctaggccgggagag

SEQ ID NO: 7146761 - DNA, 22 bp, Homo sapiens
cctctggccagagaaaggccag

SEQ ID NO: 7146762 - DNA, 22 bp, Homo sapiens
cctctggccacatgggacatag

SEQ ID NO: 7146763 - DNA, 22 bp, Homo sapiens
tgggcagggagctggaaccaca

SEQ ID NO: 7146764 - DNA, 22 bp, Homo sapiens
tgggcagggagctggaaccaca

SEQ ID NO: 7146765 - DNA, 22 bp, Homo sapiens
tgggcagggagctggaaccaca

SEQ ID NO: 7146766 - DNA, 22 bp, Homo sapiens
tgggcagggagctggaaccaca

SEQ ID NO: 7146767 - DNA, 22 bp, Homo sapiens
tgggcagggagctggaaccaca

SEQ ID NO: 7146768 - DNA, 22 bp, Homo sapiens
tgggcagggagctggaaccaca

SEQ ID NO: 7146769 - DNA, 22 bp, Homo sapiens
tgggccacgtgacccttaccct

SEQ ID NO: 7146770 - DNA, 22 bp, Homo sapiens
tgggccacgtgacccttaccct

SEQ ID NO: 7146771 - DNA, 22 bp, Homo sapiens
tgggcagggagctggaaccaca

SEQ ID NO: 7146772 - DNA, 22 bp, Homo sapiens
tgggccactaccttctctggat

SEQ ID NO: 7146773 - DNA, 22 bp, Homo sapiens
tgggccactcttccctgggtct

SEQ ID NO: 7146774 - DNA, 22 bp, Homo sapiens
tgggccactgagggtggtcatt

SEQ ID NO: 7146775 - DNA, 23 bp, Homo sapiens
tgggccactatagaaatctctca

SEQ ID NO: 7146776 - DNA, 22 bp, Homo sapiens
tgggccactcttccctgggtct

SEQ ID NO: 7146777 - DNA, 22 bp, Homo sapiens
tgggccactgctccaagtagct

SEQ ID NO: 7146778 - DNA, 22 bp, Homo sapiens
tgggccactgctgcggaaggcg

SEQ ID NO: 7146779 - DNA, 22 bp, Homo sapiens
tgggccacttgaaagtggatgt

SEQ ID NO: 7146780 - DNA, 22 bp, Homo sapiens
cctggaggctctgggagggcag

SEQ ID NO: 7146781 - DNA, 22 bp, Homo sapiens
cctggaggctctgggagggcag

SEQ ID NO: 7146782 - DNA, 22 bp, Homo sapiens
cctggaggcggaggttgcagtg

SEQ ID NO: 7146783 - DNA, 22 bp, Homo sapiens
cctggaggctctgggagggcag

SEQ ID NO: 7146784 - DNA, 22 bp, Homo sapiens
cctggaggctctgggagggcag

SEQ ID NO: 7146785 - DNA, 22 bp, Homo sapiens
cctggaggcggaggttgcagtg

SEQ ID NO: 7146786 - DNA, 22 bp, Homo sapiens
cctggaggcggaggttgcagtg

SEQ ID NO: 7146787 - DNA, 22 bp, Homo sapiens
cctggaggagcgctgaccagct

SEQ ID NO: 7146788 - DNA, 22 bp, Homo sapiens
cctggaggcagaaataggactt

SEQ ID NO: 7146789 - DNA, 22 bp, Homo sapiens
cctggaggcagaaataggactt

SEQ ID NO: 7146790 - DNA, 22 bp, Homo sapiens
cctggaggcagaaataggactt

SEQ ID NO: 7146791 - DNA, 22 bp, Homo sapiens
cctggaggcggaggttgcagtg

SEQ ID NO: 7146792 - DNA, 22 bp, Homo sapiens
cctggaggcggaggttgcagtg

SEQ ID NO: 7146793 - DNA, 22 bp, Homo sapiens
cctggagggaccctggccctgt

SEQ ID NO: 7146794 - DNA, 22 bp, Homo sapiens
cctggagggaccctggccctgt

SEQ ID NO: 7146795 - DNA, 22 bp, Homo sapiens
cctggagggaccctggccctgt

SEQ ID NO: 7146796 - DNA, 22 bp, Homo sapiens
cctggagggaccctggccctgt

SEQ ID NO: 7146797 - DNA, 22 bp, Homo sapiens
cctggagggaccctggccctgt

SEQ ID NO: 7146798 - DNA, 22 bp, Homo sapiens
cctggaggctctgggagggcag

SEQ ID NO: 7146799 - DNA, 22 bp, Homo sapiens
cctggaggctctgggagggcag

SEQ ID NO: 7146800 - DNA, 22 bp, Homo sapiens
cctggagggaccctggccctgt

SEQ ID NO: 7146801 - DNA, 22 bp, Homo sapiens
cctggagggaccctggccctgt

SEQ ID NO: 7146802 - DNA, 22 bp, Homo sapiens
cctggagggcagcccattctgg

SEQ ID NO: 7146803 - DNA, 22 bp, Homo sapiens
cctggagggcagcccattctgg

SEQ ID NO: 7146804 - DNA, 22 bp, Homo sapiens
cctggagggcagcccattctgg

SEQ ID NO: 7146805 - DNA, 22 bp, Homo sapiens
cctggagggcgccgcacagtcc

SEQ ID NO: 7146806 - DNA, 22 bp, Homo sapiens
cctggagggcgccgcacagtcc

SEQ ID NO: 7146807 - DNA, 22 bp, Homo sapiens
cctggagggcgccgcacagtcc

SEQ ID NO: 7146808 - DNA, 22 bp, Homo sapiens
cctggagggcgccgcacagtcc

SEQ ID NO: 7146809 - DNA, 22 bp, Homo sapiens
cctggagggcgccgcacagtcc

SEQ ID NO: 7146810 - DNA, 22 bp, Homo sapiens
cctggagcttggtcacgctgcg

SEQ ID NO: 7146811 - DNA, 22 bp, Homo sapiens
cctggagcttttccagttgaca

SEQ ID NO: 7146812 - DNA, 22 bp, Homo sapiens
cctggagcttttccagttgaca

SEQ ID NO: 7146813 - DNA, 22 bp, Homo sapiens
cctggagcttggtcacgctgcg

SEQ ID NO: 7146814 - DNA, 22 bp, Homo sapiens
cctggagcttggtcacgctgcg

SEQ ID NO: 7146815 - DNA, 22 bp, Homo sapiens
cctggagcttggtcacgctgcg

SEQ ID NO: 7146816 - DNA, 18 bp, Homo sapiens
cctggagctccacagcaa

SEQ ID NO: 7146817 - DNA, 18 bp, Homo sapiens
cctggagctccacagcaa

SEQ ID NO: 7146818 - DNA, 18 bp, Homo sapiens
cctggagctccacagcaa

SEQ ID NO: 7146819 - DNA, 22 bp, Homo sapiens
cctggagcttttccatcctgga

SEQ ID NO: 7146820 - DNA, 22 bp, Homo sapiens
cctggagcttttccatcctgga

SEQ ID NO: 7146821 - DNA, 22 bp, Homo sapiens
cctggagcttttccatcctgga

SEQ ID NO: 7146822 - DNA, 22 bp, Homo sapiens
cctggaggagcgctgaccagct

SEQ ID NO: 7146823 - DNA, 22 bp, Homo sapiens
cctggaggagcgctgaccagct

SEQ ID NO: 7146824 - DNA, 22 bp, Homo sapiens
cctggaggagcgctgaccagct

SEQ ID NO: 7146825 - DNA, 22 bp, Homo sapiens
tgtcaataacatttacttctat

SEQ ID NO: 7146826 - DNA, 22 bp, Homo sapiens
tgtcaagttgttaagttctggg

SEQ ID NO: 7146827 - DNA, 22 bp, Homo sapiens
tgtcaagtctagttgctggctt

SEQ ID NO: 7146828 - DNA, 22 bp, Homo sapiens
tgtcaagtgattagccataatg

SEQ ID NO: 7146829 - DNA, 23 bp, Homo sapiens
tgtcaagtatagcaggccctccc

SEQ ID NO: 7146830 - DNA, 22 bp, Homo sapiens
tgtcaagatgacagatagatga

SEQ ID NO: 7146831 - DNA, 22 bp, Homo sapiens
tgtcaagagctgttgaggctga

SEQ ID NO: 7146832 - DNA, 22 bp, Homo sapiens
tgtcaacatttatcaagttatt

SEQ ID NO: 7146833 - DNA, 22 bp, Homo sapiens
tgtcaacagatctcaaagctgg

SEQ ID NO: 7146834 - DNA, 22 bp, Homo sapiens
tgtcaacagatctcaaagctgg

SEQ ID NO: 7146835 - DNA, 22 bp, Homo sapiens
tgtcaacacacctatctcaatt

SEQ ID NO: 7146836 - DNA, 22 bp, Homo sapiens
tgtcaaatttttattgcagtat

SEQ ID NO: 7146837 - DNA, 22 bp, Homo sapiens
tgtcaaatagtagaaagatggc

SEQ ID NO: 7146838 - DNA, 19 bp, Homo sapiens
cctggaggtgaaggttctc

SEQ ID NO: 7146839 - DNA, 22 bp, Homo sapiens
tgtattcagtgatttcacaata

SEQ ID NO: 7146840 - DNA, 22 bp, Homo sapiens
tgtattcagtgcctagcatatg

SEQ ID NO: 7146841 - DNA, 22 bp, Homo sapiens
tgtattcatgtgagcctaggaa

SEQ ID NO: 7146842 - DNA, 22 bp, Homo sapiens
tgtattccaaaatgctgaggat

SEQ ID NO: 7146843 - DNA, 22 bp, Homo sapiens
tgtattctaaatacatcttacc

SEQ ID NO: 7146844 - DNA, 22 bp, Homo sapiens
cctggagggcgccgcacagtcc

SEQ ID NO: 7146845 - DNA, 22 bp, Homo sapiens
cctggagggcgccgcacagtcc

SEQ ID NO: 7146846 - DNA, 22 bp, Homo sapiens
cctggaggggaccaggaccagg

SEQ ID NO: 7146847 - DNA, 22 bp, Homo sapiens
cctggaggggaccaggaccagg

SEQ ID NO: 7146848 - DNA, 22 bp, Homo sapiens
cctggaggggaccaggaccagg

SEQ ID NO: 7146849 - DNA, 22 bp, Homo sapiens
cctggaggggaccaggaccagg

SEQ ID NO: 7146850 - DNA, 22 bp, Homo sapiens
cctggaggggaccaggaccagg

SEQ ID NO: 7146851 - DNA, 16 bp, Homo sapiens
cctggaggtcacttca

SEQ ID NO: 7146852 - DNA, 16 bp, Homo sapiens
cctggaggtcacttca

SEQ ID NO: 7146853 - DNA, 18 bp, Homo sapiens
cctggaggtcttcggggt

SEQ ID NO: 7146854 - DNA, 18 bp, Homo sapiens
cctggaggtcttcggggt

SEQ ID NO: 7146855 - DNA, 16 bp, Homo sapiens
cctggaggtcacttca

SEQ ID NO: 7146856 - DNA, 18 bp, Homo sapiens
cctggaggtcttcggggt

SEQ ID NO: 7146857 - DNA, 18 bp, Homo sapiens
cctggaggtcttcggggt

SEQ ID NO: 7146858 - DNA, 18 bp, Homo sapiens
cctggaggtcttcggggt

SEQ ID NO: 7146859 - DNA, 18 bp, Homo sapiens
cctggaggtcttcggggt

SEQ ID NO: 7146860 - DNA, 18 bp, Homo sapiens
cctggaggtcttcggggt

SEQ ID NO: 7146861 - DNA, 19 bp, Homo sapiens
cctggaggtgaaggttctc

SEQ ID NO: 7146862 - DNA, 19 bp, Homo sapiens
cctggaggtgaaggttctc

SEQ ID NO: 7146863 - DNA, 22 bp, Homo sapiens
cctgcttcagggatgatggcac

SEQ ID NO: 7146864 - DNA, 22 bp, Homo sapiens
cctgcttcagggatgatggcac
